United States Patent 9,782,462 (MODIFIED POLYNUCLEOTIDES FOR THE PRODUCTION OF PROTEINS ASSOCIATED WITH HUMAN DISEASE) - sequence listing, part 59

SEQ ID NO: 113171 - DNA, 2826 bp, Artificial Sequence
  Description of Artificial Sequence: Synthetic coding sequence
atgatccggaactctctctgtcagccatcccgctgtcttgacgggtatttgtttttcaataggaaaatgttcggcgctcgcacccacggttttcacatcctgatggccatgctcatcggtatccactgtgaagaggacgtgaacgaatgcagcagcaatccctgtcagaatggaggcacatgcgaaaacctcccggggaattacacatgccactgtcctttcgacaatcttagtcgaaccttttacgggggcagggattgctcagatatactcctgggctgcacccaccaacaatgcctaaataatgggacgtgcatcccccactttcaagatggccagcacgggtttagctgcctctgccctagcggttacactggcagtctgtgcgagatcgcaactactctcagttttgaaggggatgggttcctctgggtcaagtcaggaagcgttaccaccaagggaagcgtttgtaacatcgcgctgcggttccaaacagtgcagccgatggccctcttgctttttcgctccaacagagacgtttttgtgaagctggagctactctccggatatatccatctgtctattcaggttaataaccagagtaaggttcttctgtttatttcacacaacactagcgacggagagtggcactttgttgaggttatctttgcagaagctgtcactctgactttgatagatgatagctgcaaggaaaaatgtatcgctaaggctccaacccccttagaatctgaccagagcatctgcgcctttcagaactctttcctcggaggattgcctgttggcatgacctctaatggggtggcactgctgaacttttacaatatgccaagcacaccgtctttcgtgggatgcctgcaggacatcaagattgactggaatcatatcactttggaaaatatctcctctggctccagtcttaacgttaaagctgggtgtgtccggaaggactggtgcgagtcacagccctgtcagtcacggggacgctgcatcaacctgtggttaagctatcagtgcgattgccatagaccttacgaaggccccaattgcctgagggaatatgttgcaggacgattcggacaggacgacagcaccgggtacgtaatttttactttggacgaaagctacggcgacacaatctcactgagcatgttcgtgaggacactccagccaagtggcctcttactggccttagaaaattctacatatcagtacattagagtttggctagaacggggacggcttgcaatgttgacaccgaattcaccaaagcttgttgtcaagtttgtgctgaacgatgggaacgtgcatctgatttccctcaagatcaagccctataagatcgaactgtaccagagcagtcagaacctgggattcatctccgcatccacctggaaaatagaaaaaggtgacgtcatctacatcggcggtctgcccgataagcaggaaaccgaattgaacgggggcttcttcaagggctgtatccaggatgtgaggctgaacaatcagaacctggagttttttcccaacccaaccaataacgcttctcttaatccggtgctcgtgaatgtcacacagggctgcgccggagataacagctgcaaatcaaatccctgccacaacggcggggtctgtcatagtcgctgggacgatttttcctgttcctgtcctgccctgacaagcggaaaagcttgtgaggaggtccagtggtgcggattctcgccgtgtccgcatggcgctcaatgccagccggtcttgcaggggtttgagtgcatcgctaatgccgtgtttaacgggcagtctggacagattctatttcgctccaatggaaacattacgcgtgaactcacaaacatcacttttggtttccgcactagagatgcaaatgtcatcatcctgcacgccgaaaaggagcccgagttcttgaacattagcatccaggacagtagattgttctttcagttgcaaagtgggaatagtttctacatgttgtcgctgacctccctgcagtcggtaaatgatggcacttggcacgaggtgacactgtccatgactgaccccttgtctcaaacgagtaggtggcaaatggaggtggataacgagactccattcgtgacaagtaccatcgcgaccggctctctgaacttcctgaaagacaataccgacatctatgttggggacagggcaatcgacaacatcaagggtttacagggatgcctgagcacaattgagataggcggcatctatctatcgtactttgaaaatgtgcatggcttcattaataagcctcaggaagagcagttcttaaagatctctaccaactccgtggtaactgggtgcttgcagctaaacgtgtgcaatagcaacccatgccttcacggagggaactgcgaagatatttacagttcgtaccactgtagttgccctcttgggtggtccggaaagcactgcgaactgaacatcgacgagtgcttctccaatccctgtatccacgggaactgctcagatagggtggctgcatatcactgcacatgcgagccgggctacaccggcgtgaactgcgaggtcgatatcgataactgccagtctcatcagtgcgccaacggcgctacatgcatctcccataccaatgggtacagctgcctgtgcttcggtaacttcaccggaaaattctgtaggcagagtcgtctccctagtacagtgtgtggcaatgagaagacaaacctgacttgttacaacggcgggaattgcaccgagttccagactgagttgaagtgcatgtgtcggcctgggttcacaggtgagtag

SEQ ID NO: 113172 - DNA, 129 bp, Artificial Sequence
  Description of Artificial Sequence: Synthetic coding sequence
gagaaagatatcgatgaatgcgcaagtgacccctgcgtgaacggaggtctttgtcaagacctcctcaataaatttcagtgtctgtgcgatgtcgcctttgctggggaacgttgtgaagtagactattag

SEQ ID NO: 113173 - DNA, 4149 bp, Artificial Sequence
  Description of Artificial Sequence: Synthetic coding sequence
atgaaagatccctgcttttccaacccttgtcagggctctgctacctgtgtgaataccccgggagaacggagcttcctgtgtaaatgtccacctggctacagcggcacaatttgcgaaacaacaattggcagttgtggaaaaaattcgtgccagcatggaggaatttgccaccaggaccccatttaccccgtctgcatctgccctgccggctatgctggtcggttctgcgaaatcgaccacgatgagtgcgccagtagcccatgtcaaaacggagctgtgtgtcaggacggcatcgatggatattcatgcttttgcgtgccaggttatcagggccgccactgcgacctggaggttgacgagtgtgcaagtgatccctgtaaaaatgaagctacatgtcttaacgagatcggtcggtacacatgtatatgcccgcacaactacagtggggtgaattgtgagctggaaatcgatgagtgttggagtcagccttgcctgaacggagctacctgccaagatgctctgggagcatacttttgtgattgtgcaccaggcttcctgggagatcattgtgagctgaacacagacgagtgcgcctcccagccgtgcctgcatggcgggttgtgcgtcgatggggagaaccggtactcttgcaactgcacagggtccgggtttacaggaacccactgcgagactctgatgcccctttgttggtcgaagccctgtcataacaatgcgacatgtgaggactcagtcgataattatacatgtcattgctggcctggatataccggagcccagtgcgagatcgacctcaatgagtgtaatagtaatccctgccaaagcaacggcgagtgtgtggaactctcatcggaaaagcaatatggaaggatcactggcctcccatccagcttctcctaccacgaagctagcgggtacgtatgtatttgccagccagggtttaccgggattcattgtgaggaagacgtgaatgagtgcagcagcaatccttgtcagaatgggggtacatgcgagaatcttcccgggaattatacatgccactgcccttttgacaacctgtcccggaccttttacggaggtcgggactgttctgacattctgttggggtgcactcatcaacaatgtttgaacaacggaacatgcattccgcacttccaggacgggcagcacggtttctcctgtttgtgtccttctgggtacactggcagcctgtgcgaaatcgccacaactctcagcttcgagggagacggttttctatgggtcaaaagcggaagcgtgaccaccaagggctctgtgtgcaacatcgctctcagattccaaaccgtgcaacctatggcactgctcctgttccggagtaatcgagatgtgttcgtgaaactcgaattactgagcggctatattcatctgagcatccaggttaacaatcaatcaaaggtgttacttttcattagccacaacacatcggatggagagtggcatttcgtggaggtgatctttgcagaggcggtgacccttacgctcatagacgattcctgcaaggagaagtgcattgccaaagctcctacaccattggagtccgaccagagtatctgcgcctttcagaatagctttctgggtgggctgcccgtggggatgacctcgaacggcgtagctctattgaacttttataacatgccttcaactccttcttttgtgggatgcctccaagacattaaaattgactggaaccacattacactcgagaacatcagttccggctcatctctcaatgttaaagcaggatgtgtccggaaagactggtgcgaatcacagccgtgccagagccgcggaagatgcataaacctgtggctgtcatatcagtgcgactgccaccgtccatatgagggtccgaactgcttgagggagtacgtggccggcaggttcggtcaggatgattccacaggctatgtcatttttaccctcgacgagagttatggggataccataagtctgtccatgttcgttcggaccctgcagccgtctgggcttttattggctctcgaaaacagcacataccagtacattagggtgtggctggaacgagggcgactcgcaatgctaacacccaacagccccaaactcgtggtaaagttcgtgcttaatgacgggaatgtgcacctgatctcattgaagataaaaccctacaaaattgaactgtatcagtcttcccagaatttgggcttcatcagtgcctctacttggaaaatagagaaaggagacgtgatttacattggtggcctccccgataagcaggaaacagaacttaacggaggcttcttcaagggatgtatacaagacgttaggttaaacaatcaaaatctagagtttttccctaatccaaccaataacgcaagtctcaatccggtgctagttaatgttacccaagggtgcgccggcgataatagttgtaagcgccagaccaacgttggccgcgcccttactgaactcggaagccgcggtccgaaataccaggtctcactgttccggttttgtgtaggaagctgggcaaccggcaacaccttcttcctctctagcataaagcctggatccaatccttgccataatggcggagtgtgccattcaagatgggacgatttctcctgcagctgtccagctcttacttccgggaaggcatgcgaggaggtccaatggtgtggcttttcaccttgcccgcatggggcccagtgtcagcctgtccttcagggttttgagtgcatcgcaaacgccgtctttaatggccagtccgggcagatcctgttcaggagcaacggtaacataactcgggaactcacgaacatcactttcggcttcagaaccagagacgcaaacgttattattctgcacgctgagaaggagccagaatttttaaacattagtatccaggatagtcgacttttcttccaactgcagtctggcaattcattctacatgttatctttgacctccctgcagtctgtcaatgacggcacttggcatgaggtgaccctgagcatgaccgacccgttatcacagacttctaggtggcaaatggaagtcgataatgagacaccatttgtgaccagcaccatagcaaccgggagtcttaacttccttaaggataatacagacatctacgtgggggaccgagccattgataatatcaagggtcttcagggatgcctcagtacaatcgagataggaggtatctacctctcttatttcgagaacgtgcacggtttcataaataagccacaagaggagcaatttctgaaaattagcaccaattctgttgtcaccggctgtctgcagcttaacgtttgcaattctaacccttgtttacacggaggtaattgcgaggatatttattctagctaccactgctcttgtcccctcggatggagtggaaagcactgtgaactgaatatcgacgaatgttttagcaatccatgcatccacgggaactgtagcgatcgcgtggcggcctatcactgcacatgtgagcccgggtatactggggtgaattgcgaggtggacattgataattgtcaatcccaccaatgtgcgaatggggcgacctgcatttcgcatactaatggctattcatgcttgtgcttcgggaacttcaccggaaaattctgccggcaatccagactaccttctactgtttgcgggaatgaaaaaacaaacctgacttgctacaatggaggaaattgtaccgaattccaaactgaactcaagtgcatgtgccggccgggattcaccggcgagtggtgtgaaaaagatatcgacgagtgcgcttcagacccttgtgtaaacgggggactgtgtcaggaccttttgaataagttccagtgcttgtgtgacgtggcttttgccggggagcgatgtgaggtagatctcgctgatgatctgattagcgacatatttactaccattgggagcgtgactgtcgcactcctacttatactcttgctcgcaatcgtagccagtgtggtgacttctaataagcgggcgacgcagggtacctatagcccttcccgccaggagaaggaagggtctagggtcgagatgtggaatctcatgccgcctcctgccatggagcggctcatctag

SEQ ID NO: 113174 - DNA, 2613 bp, Artificial Sequence
  Description of Artificial Sequence: Synthetic coding sequence
atggctctgaagaatatcaactatttactcattttttacctgtcgttttctctgctgatttatattaagaatagtttttgtaataagaacaacaccaggtgcttgtcaaattcttgccagaacaactctacctgtaaggattttagtaaagacaacgactgtagttgttccgatactgcaaacaatctagacaaagattgtgacaatatgaaggatccatgctttagcaacccttgtcagggatcagctacttgcgttaacacgcccggagaacgcagtttcctttgcaagtgtccccccggatattctggaaccatttgtgaaacaacgattggcagctgtggtaagaacagctgtcagcacggcggcatatgtcaccaggatcccatatacccagtgtgtatttgtccagctggatacgccggcagattttgtgagatcgatcacgacgagtgtgcatcaagcccatgtcagaatggagccgtctgtcaggacggcattgatggctatagctgtttttgcgtcccaggctatcagggcaggcactgcgatttggaggttgatgagtgtgcatccgatccatgcaagaatgaagctacatgtctcaatgaaatcggccgttacacctgtatctgcccacataattactctggggtgaactgtgagcttgagattgacgagtgctggtctcaaccctgcctgaatggagcaacatgccaggacgcactcggagcatacttttgcgactgcgctcctggattccttggggaccactgtgagttgaatactgatgaatgcgccagccagccctgtcttcacggggggctgtgcgtggacggagagaatcggtactcttgtaactgtacgggaagtggttttaccgggacccattgcgaaaccttgatgccactgtgctggtctaaaccttgccataataacgccacatgcgaggacagcgtggataattatacttgccactgttggcccgggtatacgggcgcccagtgtgagatagaccttaatgagtgcaattctaatccctgccagagcaacggggagtgtgtggagttgtcatccgagaagcagtacggcaggattacaggcctaccaagctctttctcttatcacgaggcaagtggttacgtctgcatttgtcaacccggctttacaggtattcactgcgaggaggatgtgaatgagtgttcaagcaacccctgccagaacggggggacttgcgaaaatctgcccggtaactatacatgccactgtccgttcgacaacctctcccgcaccttctacggcggaagggactgcagtgacatcctgcttgggtgcacacaccagcagtgcctgaataacggaacatgcattccccatttccaagatggacaacatggattcagctgtctgtgcccatccggatacacagggtccctatgtgaaatagccacaacactgagtttcgagggagatggattcctctgggttaaatcgggaagcgttactacgaagggatcagtctgcaatatagccctgcgttttcaaacagtccagcctatggccctgctgctgtttcggtccaaccgtgacgtgtttgtcaagttagaactcttgtcgggctacatccatctgagtattcaggtgaataaccagtccaaagtgctactctttatcagccataatacaagcgacggggagtggcacttcgttgaagtcatctttgcggaggctgttacccttacactcattgatgattcgtgtaaggaaaagtgtatcgccaaagctcctaccccgctggagtccgaccagagcatctgcgcgttccagaatagctttctaggtgggctacctgtggggatgacgtcaaatggtgtggctttgttgaatttctacaacatgccttctactccaagcttcgtgggatgcctgcaggacataaagattgattggaaccatattacgcttgaaaatatctcttctggctccagtctaaacgtgaaggccggatgcgtgcgtaaagattggtgcgagtcccagccttgtcaatcccgtgggagatgcattaatttgtggttatcctaccaatgtgattgccacagaccctatgagggccccaactgcctgagggggaaattttgtcggcagtctagattgccttcaaccgtgtgcggtaacgagaaaacgaatttgacctgttataacggcggcaactgcaccgagttccagactgaactcaaatgcatgtgccggccaggctttactggggaatggtgtgagaaagatatcgacgaatgtgctagtgacccttgtgtgaatggtggtctctgtcaggacctcctgaataaatttcagtgtctctgcgatgtagcttttgctggtgaaagatgcgaggttgatttggccgatgacctgatatcagacatcttcacgaccattggctccgtgaccgtcgccttactgctaattctcttgttggctatcgtcgccagcgtggtgactagcaacaagcgcgccacccaaggtacctattcaccttcgaggcaggagaaagagggtagcagggttgagatgtggaatctcatgccgccccccgccatggagcgtttgatctag

SEQ ID NO: 113175 - DNA, 882 bp, Artificial Sequence
  Description of Artificial Sequence: Synthetic coding sequence
atgccattatgctggtctaaaccctgtcacaataatgcaacatgcgaagacagtgttgataactatacttgccactgttggcccgggtatacaggagctcagtgtgagatagacctaaatgaatgcaattctaatccgtgccagtcaaatggcgagtgcgtcgaactgtcttcagaaaaacaatatggaagaattacgggcctgccaagcagcttctcttaccacgaggcaagtggttacgtgtgtatctgtcagccgggcttcacgggcatacattgtgaggaagatgtgaatgagtgctctagcaacccttgccagaatggcggcacatgcgagaacctgccagggaattatacgtgccactgtccattcgacaacttaagcaggacgttctatggggggcgagactgtagcgacattctgctgggctgtacccatcaacagtgcctcaacaacgggacctgcattccccatttccaagacgggcagcacggttttagttgtctttgtccttctggctatacgggtagtctctgtgaaattgctacaacactgagcttcgagggggacgggttcctgtgggtcaagagcgggtccgtcaccaccaaaggctccgtatgcaacatagctctgcgcttccagaccgtgcagccaatggccctcctgttatttcgttccaatcgcgacgttttcgtgaagcttgagctcctgagcggctacatccatttatctatccaagttaacaaccaatcaaaggtgctcttgtttatctcacacaacacctctgacggtgagtggcattttgttgaggcagtttctaaaacactgaagctgatcggtattacgttaccgtggcgcacatctagactggcccaccactag

SEQ ID NO: 113176 - DNA, 2664 bp, Artificial Sequence
  Description of Artificial Sequence: Synthetic coding sequence
atggctctgcttcttttccgctcgaaccgcgacgtgtttgtgaagctcgaactgctttctggctatattcatctgtcaatccaggttaataatcaatctaaagtgcttctcttcattagtcacaataccagtgacggagagtggcattttgtagaagtgatcttcgcagaggcagtgaccttgaccctcattgatgactcctgtaaagagaaatgcattgcaaaagcaccaacaccattggagagcgaccagtccatctgcgcttttcaaaactcctttctgggtgggctacctgtgggcatgacctcgaacggcgtggccctactgaatttctacaatatgccctctacacctagtttcgtaggctgtctgcaggacatcaagatcgattggaaccacataaccctcgaaaatatcagctccggatcatcattgaatgttaaagctggttgcgtacggaaagactggtgtgagtcacaaccatgtcaaagccgtggtagatgtatcaatctgtggctgtcctaccagtgcgattgccatagaccttatgaggggcctaattgcctgagggagtacgttgccggtcgcttcggacaggatgattcaacaggatatgttatctttacactggacgaatcctacggcgataccatttcactctccatgtttgttcggaccctgcagccaagtgggctgctcctagctcttgaaaattccacttaccagtatatcagggtgtggcttgagcgaggacggctcgctatgctcacccctaacagtcctaagctggtcgtgaaattcgtactcaatgatgggaacgtacacttgattagtctgaagatcaagccctataagattgagttgtaccagtctagccagaatctaggcttcattagtgcgagtacatggaaaatcgaaaaaggggatgtgatctacattggggggctacccgataaacaggagaccgaattgaatggcggcttttttaagggctgcattcaggatgtgcgcctcaataaccagaacttagagtttttcccaaaccctacaaacaatgcttccttgaaccctgtactggtgaatgttacgcagggttgcgccggcgacaattcatgtaaaagcaatccatgccacaacgggggagtttgccactctagatgggacgactttagctgctcctgccccgcactgacctccgggaaggcttgcgaggaggtgcagtggtgcggtttcagcccctgccctcatggagctcagtgccagccagttttacagggctttgagtgcatcgcaaatgcagtttttaatggccagtccggtcagatcctgttcaggtctaacggaaacataacccgcgagttgaccaacattacattcggttttcgtacccgagacgccaacgttattattctgcatgctgagaaagaacccgagttcctgaatattagcatccaggacagcagacttttttttcagcttcagtcaggcaacagcttttatatgctctccttaacatcactccagtccgtcaacgatggtacttggcacgaagttactttatccatgacagatcctctgtcccagacttcccgctggcagatggaagtggataatgagaccccctttgtgacatccacaattgcaacaggcagcctgaactttctgaaagataacaccgatatctacgtcggcgacagagccattgataacatcaaggggttgcaggggtgcctgtccactatagagatagggggcatctacttgtcatacttcgagaatgtgcatggtttcatcaataaaccacaggaggaacagttcctgaaaatatccactaattcagtcgtgaccggctgcctgcagctgaacgtgtgcaatagcaacccttgtctgcacggcggtaactgcgaggatatctattcgtcctaccattgttcatgccccctggggtggagcggcaagcactgcgagctgaatattgacgagtgtttctccaatccctgcattcatggcaattgttctgatagggtggccgcttatcactgcacctgcgagcctggctacaccggggtcaattgtgaagtggacatcgataattgtcaatctcatcaatgcgctaacggtgccacatgtattagccatacaaacggctattcctgtctctgctttggtaattttaccgggaaattctgtagacaatccagactgccgagcaccgtgtgcggtaatgagaagaccaacctcacctgctataacggtggcaattgcactgaatttcagaccgaactgaaatgtatgtgccgaccaggattcacgggggaatggtgcgagaaggatattgatgagtgcgcctccgacccgtgcgttaacgggggcttgtgtcaggacttgctgaacaagttccagtgcttatgcgacgtagccttcgccggtgaacgatgcgaggtggacctcgctgatgacctgattagcgacatctttacgactatcggtagcgtgaccgtcgcactgctgttgatcctgctgctggcgatcgtcgctagcgtggttaccagcaataaacgcgcaacacagggcacgtatagtccctccagacaggagaaggaaggttctagggtggagatgtggaacctcatgcccccgcctgccatggaacgactaatttag

SEQ ID NO: 113177 - DNA, 3885 bp, Artificial Sequence
  Description of Artificial Sequence: Synthetic coding sequence
atggcgctcaagaacataaactacttgttgattttttatctgagctttagtttgttaatttatatcaagaacagcttctgcaacaagaacaacacccgctgtctgtctaacagctgccaaaacaactcgacctgtaaagatttcagtaaagacaacgactgctcatgctccgacaccgccaataaccttgataaggattgtgacaatatgaaagacccttgctttagcaacccttgccagggctcggcgacatgcgtgaatacacctggggaacggtccttcctttgcaagtgtcctcctggatattccgggacaatctgcgaaaccacaattggctcgtgcggcaagaattcttgtcagcatggggggatctgccaccaggatcctatctaccccgtttgcatctgcccagcgggctacgccggtcggttctgcgagattgatcacgacgaatgcgctagcagcccatgccagaatggtgctgtctgccaggacgggattgatggctacagctgcttctgtgtgcctggttaccagggacgccactgtgatctcgaggtggacgaatgtgctagtgacccgtgtaagaacgaagccacgtgcctgaacgagatcgggaggtatacatgtatttgcccacataactactcaggctatactggcgcccaatgtgagatcgacctgaacgagtgtaatagcaacccttgtcagtctaacggagagtgtgtggagctgtccagcgaaaagcagtacggacgtattaccggcctgcctagctcatttagctaccatgaagcaagtggatatgtgtgcatatgccagccaggattcaccggtatccactgtgaagaagacgtcaacgagtgctcctccaacccttgccaaaacgggggcacctgcgaaaaccttcccgggaactacacctgccattgcccgttcgataatttaagcaggacattttatggggggcgagattgttcggatatcttgctcggttgtacacaccagcagtgcttgaacaacggaacgtgcatcccacattttcaggatggacagcacggtttctcatgcctctgcccatctggttataccggatccctatgtgaaattgccactaccctttcttttgagggagacgggttcctttgggttaaaagtggcagcgttaccaccaaagggtccgtgtgcaacattgcactgaggttccagaccgttcaaccaatggctctcttactctttcgcagcaaccgggacgtattcgtaaaactggagttgttgtcgggatatattcacctaagcattcaggttaataatcagtccaaagtcctccttttcatctcccacaatactagtgatggtgagtggcattttgtggaggtcattttcgctgaggctgtcaccctcacactcatcgatgacagttgtaaggaaaagtgcattgccaaagctcctactcctctcgagtcagaccagtccatatgtgcctttcagaatagctttctcggcgggctgcccgtaggtatgacgtcaaacggagtcgctttgttaaacttttacaacatgccctcaaccccctcatttgtcggttgcttgcaggatatcaagatagactggaaccacattactctcgaaaacatctcaagtggcagctctcttaacgtcaaagcaggttgcgtgcgcaaggattggtgcgagagccagccatgccagtctagaggtagatgtattaatctctggctgtcttatcagtgcgattgccaccggccttatgaaggcccaaattgtttgagggaatacgtggccggtaggtttggccaggacgattcaaccgggtacgtgatcttcacactggatgaaagctatggagataccatttcactgtccatgtttgtccgaacccttcagccatctggtcttctattagccttggagaattcaacataccagtacattagggtgtggctcgaaaggggaaggctcgctatgctaactcccaattcgccaaaactggtggttaagttcgttctaaatgacggaaatgtacacttaatcagtcttaagatcaagccctataagatcgagttgtatcagtcttctcagaatctcggcttcatcagcgccagtacctggaagatagagaagggggacgtgatatacatcggaggccttccggataagcaggagactgagctgaacggggggttttttaaaggctgcatccaggatgtccgtctaaacaatcagaatttggaattctttcctaaccctactaacaatgcttctttgaatccggttctggtcaacgtcactcagggctgtgccggcgacaacagctgtaaaagcaatccttgccacaacgggggcgtctgtcacagtcgttgggacgactttagttgttcctgtccagctctgacctccggtaaggcttgcgaagaagtgcagtggtgcggcttctcgccgtgcccacacggcgcccagtgtcaacctgtcctgcagggatttgaatgtatcgctaatgcggttttcaatgggcagtctggccagatcttatttaggtccaacggaaatatcacccgcgagctgactaatataacttttgggttccggactagagacgcaaacgtcattattcttcatgcggaaaaggaaccggaattcctgaatatctccattcaggactcaaggttgtttttccagctgcagtctggcaattctttctatatgttgtccttgacctctctgcagtccgtgaatgatgggacctggcatgaagtgacactgtctatgacagacccactgtcccagaccagccggtggcagatggaggtagacaatgagaccccgtttgtgactagcactattgcgactggttcactgaactttctgaaagataacactgacatttacgtgggagaccgagccatcgataacattaagggcttgcaggggtgcctaagcacaatagaaatcggaggaatttatctctcttatttcgagaacgtgcacgggtttataaataagccgcaggaagaacagttcctgaaaatctcaacgaattctgttgtgaccggctgcttgcagctaaacgtttgtaattccaacccctgtctgcacggaggcaattgcgaggacatatatagctcctatcattgttcttgccccctgggctggagcggcaaacactgcgagcttaacattgatgagtgcttctctaacccctgtatccatgggaattgcagcgatagagttgctgcctatcattgcacctgcgagcctggttatactggagtgaattgcgaggtggacatcgacaactgccaatctcatcagtgcgcaaatggcgcgacatgcatcagccatacaaatggatacagttgcctttgtttcggaaactttactggtaaattctgtcgccaaagtagattgccctcaacagtttgtgggaatgagaagacgaaccttacctgctacaacggggggaactgtaccgaattccagaccgagctgaagtgtatgtgccggcccggtttcactggcgagtggtgtgagaaggacattgacgagtgcgccagcgatccctgcgtcaatggtggcctgtgccaggatctgctgaataagttccagtgtttgtgcgacgtggcatttgccggtgagaggtgcgaggtcgacctggcggacgacctcatcagcgacatcttcacaactattggaagcgttactgtcgctctactgctcatcttgctgctggctatcgtggcgtcagttgtgactagcaacaagcgggcgacacaaggcacatactcaccttctaggcaggaaaaggagggcagccgcgtcgagatgtggaatctgatgccccctcccgcaatggagcgactgatctag

SEQ ID NO: 113178 - DNA, 3531 bp, Artificial Sequence
  Description of Artificial Sequence: Synthetic coding sequence
atggccctcgcacgtcccggcacacctgacccccaggccctggcgtcggtactcttgctccttctgtgggccccggctctgagcctgctcgctggaaccgtgccaagcgagccaccttccgcatgcgcaagcgacccatgtgctcctggcaccgagtgtcaagctacagagtccggaggatacacctgtgggccgatggaaccaaggggatgtgctactcagccctgccaccacggggctctgtgcgtgccacagggccctgacccgaccgggttcagatgctattgcgtccctggattccagggcccccgatgcgagctggatatcgacgaatgcgcgagcaggccctgccatcacggggctacttgccgtaatcttgcagaccgatacgagtgtcattgccccctgggttacgcaggcgtcacctgcgaaatggaagtggacgagtgcgcctctgctccatgtctgcacggaggctcatgcttggatggagtcggatcattccggtgcgtctgcgcacccggctatgggggaacaaggtgccagctggatctcgacgaatgtcaatcacagccatgcgctcacggcggaacatgccatgacctggtcaatggttttcgctgcgattgcgccggcaccgggtacgagggaactcactgtgagcgcgaggtattggagtgtgcctcggccccctgtgagcataacgctagctgccttgagggtctgggctcatttagatgcctgtgctggccagggtacagtggggagttgtgtgaggttgacgaggacgagtgtgccagcagcccatgccagcacggcggacggtgtcttcagcggtcggacccagcactctacggaggggtccaagccgccttccctggcgcattctctttcagacatgctgccggttttttatgtcactgtccccctggattcgaaggcgccgactgtggagttgaggtcgacgaatgtgcatccaggccctgtctgaatggaggacactgtcaggatttgccgaacggattccaatgccactgccctgatgggtacgcaggtccgacctgtgaggaagatgttgatgagtgtctgtctgatccctgcctgcatggtggaacctgctccgatactgtggccggttacatttgtcgctgtcctgagacctggggaggcagggactgttccgtgcagctcactgggtgccagggtcatacttgcccccttgccgcaacgtgcattcctatctttgagtccggggtgcactcttatgtgtgccattgtccacctgggacacatggcccattctgtggccaaaacaccaccttttccgtgatggccggtagccccatacaggccagcgttccagctggcggacccttaggcctggcgctgcggttcaggactacccttcccgcgggtacattagctaccagaaatgatacaaaggagagccttgaacttgccttagtggccgccacactgcaggccacgctctggtcctacagcactacagttctggtgctgcggttgccagacttagccctgaatgacggtcattggcaccaagtcgaagttgtgctccatctcgccactttagagctccgcttgtggcacgaaggatgccccgctcgcctgtgcgttgcttccggccccgtggcccttgcctccaccgcttcagccactccgctccccgccggaatcagcagcgctcagctcggggatgcaaccttcgccgggtgcctgcaggacgtgagagtggatggccacttacttttaccagaggacctgggcgaaaacgtcctcctcggctgcgaaaggcgtgagcaatgccggcctctgccatgcgtgcatggagggtcctgcgtggacttgtggacccattttcggtgcgactgcgcacgcccccaccggggacccacttgtgcagacgaaataccagcagctacgtttgggttgggtggtgccccttcttcagcctcgttccttctgcaagagttaccgggcccaaatctgacggttagtttcctgctaagaacaagagagagtgccggccttctcctacaatttgcgaacgactctgccgcaggcctgaccgtgttcttatcagaaggtagaatcagggctgaagttcctgggagtcctgcggtcgttcttcccggtcgttgggacgatggactgagacatcttgtcatgcttagctttggcccagatcagctccaagatcttggccaacacgtacacgttgggggacgcctgttggcagccgactcccagccatggggtgggccatttagaggttgcctgcaagacttacggctggatggctgtcacctgccttttttccctctccccctagacaattcctctcagccctcggagctcgggggtcgtcagagttggaacctaactgctggctgcgtgtccgaggatatgtgtagtcctgatccttgttttaatggtgggacatgcttggtcacttggaacgacttccactgtacgtgcccggctaacttcaccggcccaacttgcgcccaacagctttggtgtccgggacaaccatgccttccccctgctacctgtgaggaagtacccgacgggttcgtgtgcgtggcagaggctacatttagagaaggaccacctgctgccttctctgggcataatgcctcctccggtcgcctcctgggagggctatccctggcgtttcgaacccgtgactcggaagcttggctgctccgggccgctgccggcgccctggaaggtgtgtggctagcggtcaggaatggttccttggctggcggcgtgaggggtggccatgggctgccgggtgccgtgctgccgattcccggcccaagagttgcggacggagcttggcaccgagtgaggctggccatggaacgtcctgccgccacaacaagtcggtggctgctatggttggacggcgctgcaacccctgtggctctgcggggtctcgccagtgatctcggttttttacagggacccggtgcagtgcggattctgttggcagaaaattttactggttgtctcggcagggtcgcattaggaggactgcctctccccctggcgcgcccgaggccaggagccgctccaggcgcccgggagcatttcgcctcctggcccggaaccccagctcccatcctcggatgtaggggcgccccagtgtgtgcaccgtctccctgtctccacgacggagcctgccgcgacctcttcgacgcctttgcgtgcgcatgcggacccggatgggaaggcccccgttgtgaagcccatgtcgacccgtgtcactccgccccctgcgccagaggcaggtgccacactcatccagacgggcgctttgaatgtagatgtccaccaggtttcggcggcccaaggtgtcggtgggacggttgggcaggcggctgggctgcaaacgccccatggggctacggcggtgcggagaagtctgctcgctcagtggatgaaagcttacccttccctggccctcatgtcctgatctgcgacatgaggcgcactgtgtag

SEQ ID NO: 113179 - DNA, 2862 bp, Artificial Sequence
  Description of Artificial Sequence: Synthetic coding sequence
atggccatggaacccggtgccctctggacatttctgggacacctgtggttgttagccggcccaacctgtgaggaggacgtcgacgagtgtctgtctgacccctgcttgcacggaggcacctgcagcgacaccgtggcaggttatatatgtaggtgtcccgagacgtggggcggccgtgattgtagtgtgcagctcactggatgccagggacacacctgcccacttgctgccacttgtatccctatattcgagagcggagtgcatagctacgtttgccattgcccaccagggacacatggacccttttgcggacagaacaccacattctctgtcatggccggatcccccatccaagcttcagttccagccggaggacccttgggcctggcactgcggttcagaaccactctcccagctggcacactggcaactcgaaacgacacaaaggaatctctggagcttgccctggtggcagccaccctgcaggcgactctctggtcctactctaccacagtcctggtccttagactcccagatcttgcgctgaatgacggccattggcatcaagttgaggttgtgctgcatctagccacacttgaacttcgcctgtggcacgaaggttgtcccgctaggctttgcgtagcttctggacctgtagctctcgccagcaccgcgtccgccacaccccttcccgcggggatctcgtccgctcagctgggcgacgccaccttcgcaggctgcttgcaggacgtgcgagttgacggtcacttgctcctgcccgaagatctgggcgagaacgtgctcctggggtgcgagcgtcgcgagcagtgccgtcccctcccgtgcgtacacggtggaagttgcgtcgacctgtggacacattttagatgcgactgcgctagaccccatcgcggccccacctgcgcagacgaaatcccggctgctacctttggcttaggcggcgcaccttccagtgcatccttcctcctccaggagctgcccggaccaaaccttacagtgtcttttctcctgcgaactcgcgaatcagccgggctgcttctccaattcgctaatgattcagccgcggggctcaccgtctttctttctgagggtaggatccgcgctgaggttccaggaagccccgcagttgtgctgccaggcaggtgggacgacgggttgagacacctcgtgatgcttagctttggaccagatcagctgcaggaccttggccaacacgttcacgttggtggccggctcctcgcagccgattcccaaccatggggaggcccattcaggggctgtttgcaggatctgcgcctggacggctgccacctgcccttttttccactgcccctggataatagttcccagccttccgaattaggaggcaggcagtcctggaatttaacagcaggttgtgtgagtgaagacatgtgcagtcccgatccctgctttaacggcggaacatgtctggtgacctggaacgatttccactgcacctgtccggccaacttcactggcccaacatgtgcccagcagttgtggtgccccggccagccttgcctcccaccggccacttgtgaggaagtccctgatggcttcgtctgcgtggccgaggccaccttccgggagggaccaccagccgcatttagcggccacaatgcctctagcggacgtctgctggggggattaagcttagcgtttaggacccgggatagtgaagcatggctgctgcgtgctgccgcgggggctctggagggggtttggctcgcagtcaggaacgggtcactcgccggaggagtacgtggtggacacgggctcccaggagctgtgcttcctattccgggtccaagggttgctgacggagcctggcatagggtgagactagctatggagaggcctgccgccacaacaagccggtggttgctatggctcgatggagcggctacgcccgtggcattgcgcggcctggcatccgatctcgggtttctgcaggggccgggagctgtgcgaatattgctcgccgagaattttaccggatgcctaggccgtgtggcattaggcggcttgccccttccacttgctagaccgagaccaggagctgcacccggcgcacgggagcactttgcaagctggccgggaacacccgctccgatactcggatgcagaggcgcccccgtttgcgcacctagcccgtgtcttcacgatggagcatgtagggatctcttcgatgcgtttgcgtgcgcttgcggccccggctgggaaggtcccaggtgcgaggcacacgtagatccctgccactccgccccctgtgcaagaggtagatgccacactcacccagacggacgattcgagtgtaggtgcccacctggcttcggcgggcccagatgccgcctgccagtcccctcaaaagaatgctcgctgaacgtgacctgcttggatggcagcccctgcgagggggggagcccggccgcaaattgctcatgtctagagggccttgcgggtcaaaggtgccaagtcccaactttgccctgtgaagccaacccgtgtctgaatggaggtacctgccgcgcagcgggaggcgtctcagaatgtatctgtaatgcacgcttttctgggcaattttgcgaagtggcaaagggattgcctctcccactgccctttcctctactcgaggtcgccgtccctgcagcatgtgcttgcctcttacttttactactcggcctgctgagcgggatattagccgcccgcaaacggcgccagagcgaggggacttactccccctcccagcaggaagtggctggagctcgacttgagatggatagtgtgctgaaggtcccccccgaagaacgtctcatctag

SEQ ID NO: 113180 - DNA, 3858 bp, Artificial Sequence
  Description of Artificial Sequence: Synthetic coding sequence
atggctctggcccgtcctgggacccccgacccccaagcgctggcttccgttctccttttacttttgtgggctcccgccctctcactgctggctggcacagtgccctccgagcccccgagcgcatgcgctagtgatccctgtgcaccaggaactgagtgtcaggctacagaaagcggcggatatacgtgtggtccaatggagccaagaggttgtgcaacacagccctgtcaccatggggccttgtgtgtgccgcaaggccccgacccaaccggatttcggtgctactgcgtcccaggctttcaaggtccaagatgcgaacttgatatcgacgagtgtgcttcccgcccatgccaccacggagcaacctgccggaacttggccgatcgctatgagtgccattgtcccttgggctatgcgggagttacatgcgagatggaagttgacgagtgtgcatctgctccatgtctacatggcggctcatgcttagacggcgtgggcagctttcggtgtgtatgcgctccggggtacggggggacacggtgtcagctggacctggatgaatgtcagagccaaccttgcgcgcatggaggtacatgccacgacctggtcaatggattccgatgtgactgcgccggtactgggtacgaagggactcactgtgaacgcgaggtgttagaatgcgcaagcgctccttgtgaacacaatgctagttgcctggagggcctgggtagctttcgatgcttgtgctggccgggctactccggtgagctttgcgaagtggacgaggacgaatgcgcgtcttccccatgccagcatggcgggagatgcctgcagcgttccgaccctgccctgtacggaggtgtacaggcagcttttcccggtgccttctcttttaggcacgcagcaggattcctgtgtcactgcccccctgggttcgaaggagccgactgtggtgtcgaggtcgacgagtgcgcgtctagaccatgtctcaatggcggccattgtcaggatcttcccaacggatttcaatgccattgtcccgacggatatgccgggccaacctgtgaggaagatgttgacgagtgtctttccgatccctgcctgcacggagggacctgcagcgacacagtggccgggtacatttgcagatgtccagagacatggggaggtcgggattgctccgtccagctcaccgggtgtcaggggcatacctgtccccttgcagcaacatgcataccaatcttcgagtcaggagtccacagttacgtctgccactgccccccaggaactcatggaccattttgcggccagaatacgaccttctctgtgatggccggtagtcctattcaagcttcggtcccggccggggggccgctaggcctagccttgcggtttcgaacaactctgcccgccgggaccctggcaaccagaaacgacacaaaagaaagccttgagcttgccctcgtcgcggcaactctgcaagcgaccctctggagttatagtactaccgtactggtactccgactgccagacctggccttgaatgatggacattggcatcaggtggaggttgtgctccatctagcgactttggaacttcggttatggcacgaaggatgtccggccaggttgtgtgtggcatctggcccagttgccttggcgagcaccgctagcgctacacccctccccgccggaattagttccgcccagttaggagatgctacttttgcaggttgcctacaggacgtccgggtggatggccatctgctgctgcccgaggacctgggggagaatgtgctgctgggctgcgaaagacgcgaacaatgcaggccactgccttgcgtgcatggcggcagttgtgttgatttatggacgcacttccggtgcgactgcgcgagaccccatcgcggtccgacatgcgcagacgaaattcctgctgccaccttcgggttgggcggggcgccaagttccgcctcgtttttactgcaggagcttcccggccctaacctgaccgtgtcctttttactgcgtactcgtgagtctgcaggtctgctgctccagttcgctaacgatagcgccgccggtttgactgtctttctgtccgagggcagaatcagagccgaagttccaggtagcccagccgtagttctgcccggcagatgggacgacggcctccggcatctggtcatgctgtcatttgggcctgaccagctccaggatctggggcaacacgtccatgtgggaggccgtttacttgccgccgacagccagccctggggcggccccttccggggttgcctccaggatttaagactggatggctgccatctgcccttctttcctctgcctcttgacaattctagtcagccatctgagctgggaggccggcagtcctggaatctgaccgctgggtgtgtgtccgaggatatgtgtagccctgatccatgttttaatggcgggacttgtctcgttacctggaatgacttccactgtacctgtcccgcaaattttacaggcccaacctgcgcccaacagctctggtgtcctgggcagccgtgtctcccaccagccacgtgcgaagaagtgcctgatgggtttgtgtgcgtggcagaggccacctttcgagagggcccccctgccgctttctctggacataatgccagcagtggaagacttctgggcggactttccttggccttcagaacacgagactcagaagcctggctgcttcgcgccgccgcgggagctctggaaggggtctggctggcggttcgcaatggctctctcgccggaggagttaggggggggcacggcctgccaggagctgtgcttcctattccaggcccacgggtcgctgatggggcctggcatcgggttcgcctcgccatggaacggcctgctgcaacaaccagccgctggcttttgtggctggatggagccgccacacccgtggcactacgtggtctggcatctgacctcggctttttgcagggacccggcgctgtacggatcctactggcagaaaacttcaccggttgcctggggcgagttgcactgggagggcttcccttgccgctggcgcggcctagacccggtgcagcccccggtgcacgcgagcacttcgcttcttggccaggtacacctgcaccaattctaggctgtcgtggagctcccgtttgcgcccccagcccatgtctgcacgacggcgcatgcagagacctgttcgacgccttcgcttgtgcttgtggccccgggtgggagggccctcgctgcgaggcccatgtcgacccctgccacagtgccccttgtgcccgtggccgatgtcacacacatccagacggaaggttcgagtgccgatgcccccccgggtttggtggcccccggtgccgtttacccgtcccctccaaggaatgttccctgaatgtgacgtgtttggatggctcaccatgtgagggcgggtctcctgctgctaattgttcgtgcctcgaggggcttgctggtcagcgctgtcaggttcctaccctgccctgtgaggccaatccctgcctgaatggcggcacgtgtagagccgcaggtggtgtgtccgaatgcatctgtaatgcaagattctccgggcaattttgtgaagtggcaaagggactccctctcccactgccgttcccgctgctggaagtggccgtgccggctgcttgcgcatgtctgctgctgctactgttggggctgctatccggcatcttggcagccaggaagcggcggcaatccgagggcacctattcgccctcacaacaggaggttgcaggggctcgcctggagatggattcggttctcaaggtgccacccgaagaaaggttaatatag

SEQ ID NO: 113181 - DNA, 363 bp, Artificial Sequence
  Description of Artificial Sequence: Synthetic coding sequence
atggcaaatcccggtctcggccttctgctggccttaggactcccattcctactcgcgcgctggggcagagcatggggacagatccagacaacctccgccaacgaaaactccaccgtgttgccctctagcacctcaagctcatcagacggaaacctccggcctgaggccatcaccgccatcattgtggtgttctccctcctcgccgccttgcttctggcagttgggctggccctcctggtgcgaaaattacgagagaagaggcagacagagggcacgtaccggccttccagcgaggagcaagtaggggcacgcgttcctcccacccccaacctgaaattgccccctgaagagcgattgatctag

SEQ ID NO: 113182 - DNA, 372 bp, Artificial Sequence
  Description of Artificial Sequence: Synthetic coding sequence
atggccaatcccgggctgggcctcctgttagctttagggttgccgttcctgctcgcacggtggggcagggcatggggacaaatccagacgactagcgcaaatgaaaacagcaccgtgctgcctagctctacaagtagtagcagcgatggcaatctgagaccagaggctatcacggccatcatagtggtgttcagcctgcttgctgcactcctgctcgccgtgggcttggctctcttggtccgcaagttgcgggagaagcgtcagacagagggcacctaccgaccgtccagcgaggagcagttcagccacgccgccgaggcaagagccccccaagactccaaagaaaccgttcagggatgcctgcccatttag

SEQ ID NO: 113183 - DNA, 363 bp, Artificial Sequence
  Description of Artificial Sequence: Synthetic coding sequence
atggctaatcccggactgggcctgctgctggcgttgggacttccatttctcttggcgcggtggggccgcgcgtggggtcagatacagacaacctccgcgaacgagaattctacagtactaccgagtagcacctcttccagctcggacgggaaccttcgtccggaggccatcacagctattatcgtggtgttcagcctgctcgctgcgctcctgttagccgttggcctcgccctgctggtccgcaagctgagggagaagcggcagactgaggggacatacaggccttcttccgaggaacaggttggcgctagagtcccacccacgccaaatttgaagctgcctcccgaagaacgcctgatttag

SEQ ID NO: 113184 - DNA, 1599 bp, Artificial Sequence
  Description of Artificial Sequence: Synthetic coding sequence
atgccagcccctcccgggcgtacccacacatggtttctgttacagagtctcgaagatttggacaccagcctcagaaagttgaacagtcgactatttgtagtgagggggcaacccgctgacgtttttccccgcctgttcaaggagtggggagtcacgagactcacatttgaatatgacagcgagcccttcgggaaggagcgcgatgccgctattatgaaaatggccaaagaggccggtgtcgaagtggtgactgaaaacagccacaccctctatgacctggaccgcattattgaactgaatgggcaaaagccccctctgacatacaagcgtttccaggctattatctcccggatggaactcccaaagaaaccagtggggctggtgaccagccagcaaatggagtcatgtcgggcagaaatacaggagaatcacgatgagacgtatggcgtcccaagcttagaggagcttgggttcccgacagagggactgggcccggctgtttggcaaggcggagagacagaggctctggctcggcttgacaagcacctggagcgcaaggcttgggttgccaattatgagaggcccaggatgaatgcaaactccttacttgcaagtcctacaggcctgagcccatacctgagattcggttgtttaagctgcagacttttttactaccggttatgggatttgtataagaaggtcaagcggaattctacccctccgctgtcacttttcggccagcttctgtggagggagtttttctacaccgcagcaaccaacaatccccgttttgaccgaatggaaggtaatcccatttgcatacagattccatgggatcggaatccggaagccctcgctaaatgggctgaggggaagacagggttcccatggatcgacgcaatcatgacccagctgcgtcaggagggttggatccaccacctcgctaggcacgccgtggcctgcttcctgacaaggggagacctgtgggtaagttgggaaagtggtgtgcgcgtcttcgatgaactcctattagatgcagacttttcggtgaacgcgggctcgtggatgtggttgagctgcagcgccttcttccagcaattttttcactgctactgtcccgtgggcttcggtagacgcaccgacccaagtggcgattatatcaggagatacctccccaaacttaaagcctttccgtcccgctacatctacgaaccatggaacgccccagagtccatccagaaggctgctaagtgtatcatcggggtggactaccctcgccccattgttaaccacgcagaaacgtctcggctcaatatagagcggatgaagcagatctaccagcagttgtctagataccgcgggttgtgtttgctcgcctctgttccatcctgcgtcgaagacctgtcccaccctgtggccgagccttcgtcatcacaggccggctcaatgtcttcagccgggcctagacccttgccttctgggcccgcatctccaaagcgtaagctcgaggctgctgaggagccccctggcgaggagctgagtaaaagagccagggtggctgaactccctacacccgagttgccaagcaaggatgcctag

SEQ ID NO: 113185 - DNA, 1845 bp, Artificial Sequence
  Description of Artificial Sequence: Synthetic coding sequence
atgggcggagtacatgtggcctacagaggcggcgcaggcgttgccggtgcagtgtggaccgtgatggcggctaccgtggctacagccgccgctgttgccccggcccctgctcccgggaccgactccgcctcctcagttcattggttccgcaaaggcctccgactgcatgacaatcctgccctgctggccgccgttaggggcgccaggtgtgtcagatgtgtctatattctggacccgtggttcgccgcctcttcgtccgtgggaataaatcgttggcggtttctcctacagtctctggaagacctcgataccagtcttagaaagctaaacagccgactcttcgtcgtgagagggcagccagccgatgtctttccaagacttttcaaggagtggggggttacccggcttacttttgagtacgactctgagccattcggcaaggaaagggacgccgccataatgaagatggcaaaagaagccggagtagaagtggtcaccgaaaacagtcacaccctgtacgatctggacaggatcatcgagctcaacggacagaagccgccacttacctataaaagattccaggccataattagcagaatggaactcccaaagaagcctgttggcctggtcacctcccagcagatggagtcctgtagagcagagatccaggaaaaccacgatgaaacttacggagtccccagtctggaagaactgggcttcccgaccgaaggtctgggcccggctgtttggcagggaggcgagactgaggcgttagcccgcctcgataagcacctcgaacgcaaagcatgggtggcgaactacgaacgaccccggatgaacgcaaatagccttctggcaagtccaaccgggctgtctccttatctgagatttggctgcttaagttgccgtctcttctactacaggttgtgggatctttataagaaagtgaaacgtaacagcaccccgccattaagtctttttggccagctgttatggagagagtttttctacaccgcggccaccaacaacccccgctttgatcgaatggaaggcaaccctatttgtatccagatcccttgggacagaaatcctgaagctctagccaagtgggctgaagggaagacgggatttccatggatcgatgctatcatgactcagctgaggcaggaaggatggattcatcatctcgcccgccatgctgtggcctgttttctcacccgtggagatctttgggtctcgtgggagtcaggcgttagagtgtttgatgaactgcttctcgatgcagacttcagtgttaatgccggttcgtggatgtggttgagctgtagcgcattctttcagcaatttttccactgctactgccccgtcggctttgggcgacgcacagacccctccggagactatatcaggcgctacctcccaaaactgaaggcttttccatcacgctacatctatgagccatggaacgcccccgagtccatccagaaagccgctaagtgtatcattggcgtggactatccaaggcccatcgttaaccacgccgagacctccagactgaatattgagagaatgaagcagatctatcaacagcttagccggtatagaggtctgtgcctgctggcatcggtgccctcctgcgtcgaagacctgtcacaccctgtagcggagcccagcagtagccaggcggggtcaatgagctcggccggccccagacctctgcccagcggacctgccagcccgaaaagaaagctggaggcagcagaggagccccctggtgaggagttgagcaagagagcacgcgtcgcagaattgcccacccctgaactacccagcaaagatgcctag

SEQ ID NO: 113186 - DNA, 522 bp, Artificial Sequence
  Description of Artificial Sequence: Synthetic coding sequence
atggatgtgacaattcaacatccctggtttaagagaactttggggcctttttaccccagtagactcttcgaccagtttttcggggagggacttttcgagtatgacttgctcccattcctctctagcaccatttctccatactatcgccaaagcctttttcgcactgtcctagattctggcatctctgaggttcgatcagaccgtgataagttcgtgatctttttggacgttaagcactttagccctgaggaccttactgttaaggttcaagatgacttcgtggaaattcacgggaaacacaacgagagacaggacgatcatggctatatttccagggagttccatagaaggtacaggttgccctctaatgtggaccaatcggccctctcctgcagtctaagcgccgacggaatgctgacgttctgcgggcccaagatccaaactggcttggacgctacccatgccgagcgggcgattccggtttcacgagaagagaagcctaccagcgccccttcaagctag

SEQ ID NO: 113187 - DNA, 570 bp, Artificial Sequence
  Description of Artificial Sequence: Synthetic coding sequence
atggctctggtgagaggtggttggctttggagacaatcctctattcttcggagatggaaaagaaactggttcgccctgtggttggatggcactctcggatactaccatgacgagaccgcacaggacgaggaagatagggtgctgatccatttcaacgtgcgggacattaaaatcggcccggagtgccatgatgtgcagcccccagaagggcgtagtcgtgacggactgttgacagtgaatctgcgcgaaggtgggagactccatctctgtgccgaaacaaaagacgacgcactggcctggaaaacagccctcttagaggccaacagcacaccagtaagggtgtatagcccctaccaggattattacgaggtggtgcctcctaatgctcacgaggcaacctacgtaagatcttactacggtcccccctacgcaggaccaggagtcactcatgtgatcgttcgtgaagacccatgttactctgccggagcacccctagcaatgggaatgctcgcaggcgctgctaccggagcagcactgggatcattgatgtggagcccatgttggttttag

SEQ ID NO: 113188 - DNA, 528 bp, Artificial Sequence
  Description of Artificial Sequence: Synthetic coding sequence
atggacatcgctatccaccatccatggattcgccggcctttcttcccttttcattcccctagtagactgtttgatcagttttttggcgaacacttattagaaagcgacctttttcctacgtctaccagcctatcaccattctacctccgacctcctagcttcttgcgtgcccctagttggtttgatacggggttgagcgagatgcgactggaaaaagacagattttctgtgaatctcgacgtgaaacacttttcccctgaagagctgaaggtcaaggtgctcggcgacgtgattgaggtgcacgggaaacatgaagagcgccaggacgagcatggatttatctctcgcgagttccatcggaagtacaggattcccgcagatgtcgaccctttgaccattacatccagcctgtccagcgacggagtgctgactgtaaatggcccaagaaagcaggtgagcggaccggagcgcacaatcccaatcacacgggaggaaaagcctgcggtaaccgctgctccgaagaagtag

SEQ ID NO: 113189 - DNA, 525 bp, Artificial Sequence
  Description of Artificial Sequence: Synthetic coding sequence
atggatatcgccatacaccacccctggatccgccggccattcttcccttttcactcacccagcagactctttgaccagtttttcggggaacatctgctggagagcgatctgtttccaactagcacgtccctaagtccattttatctaagaccgccgtcattcctgcgggcaccgagttggtttgacacaggcctgtctgagatgaggctggaaaaagaccggttttctgtgaacctcgatgtcaagcatttttcccctgaagaactcaaggtcaaggtcctcggcgacgtcatcgaggtccacggcaaacacgaagagagacaagacgaacatggatttatcagcagagagttccatagaaagtatcgaattcccgcagacgtagatccactcacaattacttcttccctctctagtgatggcgtcctaactgttaacggccccagaaagcaggtatctgggcctgagagaactatccccataactagagaggagaagcctgccgtgactgccgctccgaagtag

SEQ ID NO: 113190 - DNA, 528 bp, Artificial Sequence
  Description of Artificial Sequence: Synthetic coding sequence
atggatattgctatccatcatccttggattcggaggcctttctttccgtttcatagcccctctcggctcttcgaccaattcttcggagagcacctgctggagagcgacctgttccccactagcaccagcctctctcccttctatcttcggccccctagctttctcagagctcccagttggtttgatacaggactgagtgaaatgaggctagaaaaagatcgcttcagtgtcaatctcgatgtgaagcatttcagccctgaagaactcaaggtgaaggtcctgggagacgtgattgaggtccacggtaaacatgaggagaggcaggatgagcatggctttattagccgggagtttcaccgaaaataccgtatccccgcggatgtcgatccccttactattacaagctcactgtctagcgatggagtgctgaccgtcaatggccccaggaagcaggtcagcggcccggagaggacaataccaatcacacgagaggagaaacccgccgttaccgccgcaccgaagaaatag

SEQ ID NO: 113191 - DNA, 234 bp, Artificial Sequence
  Description of Artificial Sequence: Synthetic coding sequence
atggacatcgcgattcatcatccctggattaggcgtcctttcttcccattccactctcccagtaggctgttcgaccagttctttggagagcatctgctggagtctgatctgttcccaacatctacctctctaagccccttctaccttaggccaccgtcatttctacgggcgcccagttggttcgacactggactatctgaaatgcgcctggagaaggaccgtttctcagtgtag

SEQ ID NO: 113192 - DNA, 393 bp, Artificial Sequence
  Description of Artificial Sequence: Synthetic coding sequence
atggacatcgccattcatcacccttggatcaggcgaccgttcttccccttccacagtcccagcaggctgttcgatcagttttttggcgagcacctcttagagtctgatctctttccaacgagcacgtctctgagcccattttacctgcgaccgccatcgttcctgcgcgcaccaagttggtttgacactgggctttccgaaatgagactcgaaaaggaccgattctccgttaacttggatgtgaagcatttctcccccgaggagctgaaggttaaagtgctcggcgatgtgatagaggtgcacggtaaacacgaggaaaggcaggatgaacatggctttatctcccgtgaattccatcgaaaatatagaattccagctgacgtagacccttag

SEQ ID NO: 113193 - DNA, 528 bp, Artificial Sequence
  Description of Artificial Sequence: Synthetic coding sequence
atggatattgccattcaccacccctggatccgaagacctttctttcccttccactctccttcccgcctgtttgaccagttcttcggagaacacttgctggagagtgatcttttccccacatcaacgagtctgtccccattctacctgaggcctccatcgtttctgagagctccgagctggtttgatacgggcctgtccgagatgcgactggaaaaagacaggttttccgtcaacttggacgtaaaacatttttcaccagaagagctgaaagtgaaggtgctcggcgatgtcatcgaagtccatggaaaacacgaggaacggcaggatgagcacggctttataagccgagagtttcacaggaaatacagaatccccgcagatgtcgatcctctgacaatcacctccagcctgtccagtgatggtgtcctcactgtgaacggccctagaaagcaggttagtggtcccgagcggactatcccaataaccagggaagaaaaaccagcggtgaccgctgcccctaagaaatag

SEQ ID NO: 113194 - DNA, 528 bp, Artificial Sequence
  Description of Artificial Sequence: Synthetic coding sequence
atggacatcgcaatccatcatccgtggatcaggcgaccgtttttcccctttcacagcccaagtcggttattcgaccagttctttggtgagcatctgttagaaagtgatctttttcctacttctacttccttgagccccttctatttgcggccaccgagctttcttcgtgctccatcttggtttgatactggactgtctgaaatgagactagagaaggatcgtttttccgtgaacctggatgtaaaacacttcagtcctgaggagctgaaagtgaaggttctgggggatgtgattgaggtacacggaaaacatgaagaaagacaggatgaacacggttttatcagtagagagttccatcggaagtatagaattccagccgacgtggatcctcttacaattacctcatccctttccagcgatggagtccttaccgtaaacgggccccgcaaacaggtttccgggcccgaacggactatacctattacgcgggaggagaagcccgccgtgaccgccgctcccaagaaatag

SEQ ID NO: 113195 - DNA, 210 bp, Artificial Sequence
  Description of Artificial Sequence: Synthetic coding sequence
atggacatcgccattcatcatccatggattagaaggccgttctttccatttcactcaccgtctaggctgttcgaccagtttttcggagagcatcttctggagagtgacctgttccccaccagcactagcctatccccgttttacctaaggccgccaagctttctgcgggccccttcatggttcgatacggggctttccgagatgcgatag

SEQ ID NO: 113196 - DNA, 2148 bp, Artificial Sequence
  Description of Artificial Sequence: Synthetic coding sequence
atgcaccttctgcccgccttagccggggttcttgccacactggttttggcccagccctgcgaaggaaccgaccccgcgagcccaggagccgtcgagacatcagtgctgcgagactgcatagccgaggccaaacttctggtcgatgccgcctataactggacccagaagtccatcaagcagcggttgcgctccgggtctgcgtctcccatggatttgctgtcctactttaaacagcccgtggctgccaccaggactgttgtccgagcggcagactatatgcacgtagctctgggactactcgaggagaagctgcagccccagcgcagtggaccatttaacgtgacagatgtgttaaccgaaccacagttgcggttgttgagtcaggccagcggttgcgcactgagagaccaggcagagagatgttctgacaagtatagaactattacggggcggtgcaataacaagcgacgccctctgctgggcgccagcaaccaggccctcgctcgctggctgcccgcagaatatgaagatggcctctctctcccattcggatggacaccgtcccgaaggcgtaacgggttcctgctaccattggttcgtgcggtgtctaaccagatagttagatttcctaatgaacgtttgaccagtgaccgaggtagggcactcatgtttatgcagtggggccaattcatcgaccatgacctggacttctcccctgaatcccccgctagggtagcctttacggctggcgttgactgtgagaggacgtgtgctcaactgccaccatgcttccctattaaaataccacccaatgatccaaggatcaaaaatcagcgtgactgcattccgttttttaggagcgctccaagttgcccacagaacaagaatagggtcagaaaccagattaacgcgctcacttcttttgttgacgcatccatggtgtatgggtcagaggtttctctaagcctccggctgcgcaatcggacgaattatttaggactgttggccataaatcaaaggttccaggataacgggagggctctgctaccgttcgataatctccatgatgatccttgcctattaaccaatagatcagccaggattccgtgttttcttgccggggacaccaggtccaccgaaactcccaagctagccgcgatgcacactctgtttatgagagagcacaacaggctagccaccgagttacgcagactaaacccccgctggaacggcgacaagctgtacaacgaggcccgtaagatcatgggggccatggttcaaatcataacttacagggactttctgccattggtcctaggaaaggccagggccagaagaactcttgggcattatcgtggttactgctccaatgtagatcctcgggtggcaaacgtgttcacacttgcgtttcgatttggtcacaccatgcttcagccatttatgtttagattggacagccaatacagagcatccgctccaaacagccatgtgccattgagctccgcgttttttgcatcctggaggatcgtctatgaagggggcatcgatcccatcctgagaggcctgatggccacaccagccaagctgaacaggcaagacgcaatgctcgtggacgagctccgggatcgactcttcagacaagttcgaaggatcggattagacttagccgcgctcaatatgcagcggtctagggatcatggcctgcctggatataatgcctggaggcgattttgcggactgagtcagcctcgcaatctagcccagctgtctcgcgtgctgaaaaaccaggaccttgcaagaaaatttctgaatctgtacggcacaccagacaacatagacatctggatcggggcaattgccgagcctctccttcccggcgcccgagtcggtcctctgttagcatgccttttcgagaaccaattccggcgtgctagggatggagacagattttggtggcagaaaagaggggtattcacgaaaaggcagaggaaagcgctgagccgtatatcattatctaggatcatatgtgacaatacaggtatcactacagtgtcgcgggatatcttcagagcgaacatatatccacgggggttcgtgaattgcagccgaatcccccgcttaaacctaagcgcttggcggggcacttag

SEQ ID NO: 113197 - DNA, 594 bp, Artificial Sequence
  Description of Artificial Sequence: Synthetic coding sequence
atgtcttcagctccagccccaggacccgcacccgcctctcttactctgtgggacgaggaagattttcagggtaggcgctgccgtctgctctctgactgcgcgaatgtctgtgagagaggaggattaccacgtgttcgcagtgtcaaggtggaaaatggcgtgtgggtggctttcgaatatcctgatttccaaggacagcagtttatactggaaaagggagactacccacgctggtccgcctggagcggaagctcatcgcataattccaatcagcttttgtctttcaggcccgtcctgtgcgcgaaccacaacgatagtcgggtaaccctgttcgaaggggataattttcagggctgtaagtttgacctggtcgatgattacccatctcttccttcaatgggctgggcttcaaaggacgtcggctcgctcaaggtcagttctggggcctgggtcgcctatcagtaccctggctaccggggataccagtatgttctggagcgcgatcgccacagcggggagttctgcacctatggagagctcgggacccaagcacacaccggacagttacaaagcatacgtagggttcagcattag

SEQ ID NO: 113198 - DNA, 594 bp, Artificial Sequence
  Description of Artificial Sequence: Synthetic coding sequence
atgtcatccgctccagcccccggacccgccccggcgtcgctaaccctgtgggacgaggaggacttccaggggcgcagatgtaggctgctgtcagattgtgcaaatgtttgcgagcggggtggcctccccagagtccgctccgtgaaagtggagaatggagtgtgggtcgcctttgaataccctgactttcaggggcagcagttcattctcgaaaaaggtgactacccgagatggtcggcttggtcggggagttcctcccacaatagcaatcagttactgagttttaggccagtgctgtgtgccaaccataacgacagtcgagtcaccctgttcgagggagataacttccaaggatgcaagtttgacctggtagacgattacccctccctaccttctatggggtgggcgtcaaaagatgtgggttcattgaaggtcagttctggcgcatgggtggcataccagtaccccggctatagaggttaccagtatgtgctggaacgcgacagacactcaggagagttttgtacttacggcgaactgggcacccaggcacacacagggcaactgcaaagcattaggagagttcaacactag

SEQ ID NO: 113199 - DNA, 390 bp, Artificial Sequence
  Description of Artificial Sequence: Synthetic coding sequence
atgtcctcagcaccagctcccggccccgccccggcaagtcttaccctgtgggacgaagaagattttcagggacgccgatgcaggcttctgagcgactgcgctaatgtctgtgagagaggcggtctccctcgggtgcgcagtgtcaaagtggagaatggcgtgtgggtggccttcgaataccccgacttccagggccagcagtttatcctcgagaaaggagattatccgcgatggagcgcctggagcggctctagcagtcataattcgaatcagcttcttagctttcggccggtgctgtgtgcgaatcacaacgatagcagggtgacactatttgagggagacaactttcagggatgtaagtttgatctggtggatgattacccttcctag

SEQ ID NO: 113200 - DNA, 591 bp, Artificial Sequence
  Description of Artificial Sequence: Synthetic coding sequence
atgactctacaatgcaccaaatccgccgggccttggaaaatggtagtgtgggacgaagacggattccagggccggcggcacgagttcacagccgagtgcccatcagtgctcgagcttggatttgagactgtccgtagcctcaaggtgctcagcggcgcctgggtcggatttgagcacgcggggttccaggggcaacaatacatactcgagcgtggtgagtacccatcctgggacgcgtgggggggaaataccgcctatccggcagagcggctgacaagcttcaggcctgccgcgtgtgccaatcatcgcgattctcgcctaaccatctttgagcaggaaaacttcctagggaaaaaaggcgagttatccgatgattacccttcactgcaggccatggggtgggaagggaatgaggttggaagtttccacgtgcacagcggcgcctgggtgtgttctcagttcccgggatacagagggttccagtatgttctcgagtgtgatcaccatagcggcgattacaagcattttagagagtggggatcacatgcacccactttccaagtgcagtcaattcgccgtattcaacaatag

SEQ ID NO: 113201 - DNA, 1614 bp, Artificial Sequence
  Description of Artificial Sequence: Synthetic coding sequence
atggagcgagtgaacgacgcctcatgcggcccaagtgggtgctatacctaccaggtgtcccgccattctacagaaatgctccataacttgaaccagcagcggaaaaacgggggaaggttctgtgacgtgttactgagagtcggcgacgaaagcttccccgctcacagggccgtcttggctgcctgctcagagtactttgagtccgtcttttccgcccagctgggcgacgggggggcagccgatggggggcctgctgacgtcggaggcgcgacagctgcccccggtgggggcgccggaggaagtcgcgagctcgagatgcacacaatttcaagcaaagttttcggcgatattttggactttgcctacacaagccgaatcgtcgtacggctagagagcttccccgagctaatgaccgcagcaaagttcctactgatgagaagcgtcatagaaatctgtcaggaagtcattaagcagtccaatgtgcagattctagtacctcccgctagagcagatattatgttatttcgtccgccggggaccagcgacctcggttttcctctggatatgacgaatggagccgccctggccgccaacagcaacggcatcgccggctccatgcaacctgaggaggaagcggccagagccgccggggccgcaatcgccggtcaagcttctttgcccgtccttccaggcgtcgacagactgcctatggtggccgggccactttctccccagctcctgactagccccttcccatcagttgcatcaagcgctccacccctgacgggcaaacgcggacgtggaagacctcgaaaagcaaacctgttagacagcatgtttgggagcccaggaggacttcgtgaggccgggatcctgccatgcggcctgtgcggaaaggtcttcacggatgctaatagactgcgacagcacgaagcacagcacggggtcaccagcctgcaactgggctacatagaccttccaccaccccggctcggagaaaatggtcttcctattagcgaagatcccgatggcccaaggaaacgatcacgtacgcggaagcaggtggcctgtgagatctgcggcaagatctttcgggatgtatatcatctgaatagacataagttatctcactctggcgagaaaccttactcatgccccgtctgtggactgagatttaaacgcaaagatcggatgtcatatcatgtcagaagtcatgacgggagcgtgggcaagccgtatatatgccagtcctgcggaaagggtttctcgcgccctgaccatctgaacgggcatatcaaacaagttcacacttcggagcgaccccataagtgtcaggtatgggtgggctcttcctccggtctccctcctttagaacccctcccttctgatctcccaagctgggacttcgcccaaccagccttgtggcgctcaagccatagcgtgcctgatacagctttttccttatcattgaagaaatctttccccgcgctggaaaatctgggtcccgcgcacagctctaatactctgttttgccccgcaccgccaggatatctgcgacagggttggaccactccggaaggctcccgcgcctttactcagtggcccgtgggctag

SEQ ID NO: 113202 - DNA, 618 bp, Artificial Sequence
  Description of Artificial Sequence: Synthetic coding sequence
atggcatcagatcatcagacccaagcaggaaagcctcagtccctcaatccaaagattatcatattcgaacaggagaatttccaggggcattctcatgagctcaacggaccatgtcccaacctgaaggagacaggggtggagaaggccggttctgtcctggtccaggcaggcccatgggtgggatatgaacaggccaattgcaagggtgagcagttcgtgttcgaaaagggagaatatcccagatgggacagttggacaagttctagacgtaccgacagcctctcctcgctgaggcctattaaagtggattcccaggagcacaagattatattgtatgaaaacccgaacttcaccggcaagaagatggaaatcattgacgacgacgtgccatcttttcacgcgcatgggtatcaagagaaagtttcctcagtcagagtgcagagcggaacatgggtgggataccagtaccccggctacaggggcctccaatacctgctagagaaaggtgattataaggacagtagcgactttggtgcaccgcatccgcaggtacagtccgtcaggaggatacgtgacatgcaatggcatcagcgcggagcttttcacccttctaactag

SEQ ID NO: 113203 - DNA, 1284 bp, Artificial Sequence
  Description of Artificial Sequence: Synthetic coding sequence
atgaggcaccttggtgctttcctgttcctgctgggagtgctcggtgcacttaccgaaatgtgcgaaatccctgaaatggatagccacctggtggaaaaactgggccaacacctacttccatggatggatagattgagtctggagcatctcaatcctagcatttatgtcggtcttcgattgagtagtctacaggctgggactaaggaggacctatatctccattcacttaaacttggttatcagcagtgcctgctcgggagtgcgttctcggaggatgacggagactgccagggcaagccatcaatggggcagcttgccctgtaccttctggcccttcgagctaattgcgaattcgtgcgcggacataaaggggataggctcgtttcccagctgaagtggttcctggaggacgagaagcgtgccataggacatgaccataagggccatccccacacaagttattatcagtacgggcttgggatccttgccctctgtcttcatcagaagcgagtccacgactccgttgtggacaagctgctgtatgctgttgaaccgtttcaccaaggccaccacagcgtggataccgctgccatggccggcctggcattcacatgtctgaaaagatccaattttaaccccggaaggaggcagagaattactatggccatacgaaccgtaagggaagaaattcttaaagcccagactcctgagggacatttcggtaacgtgtattcaacgcccctggccctgcagtttcttatgacttctcctatgaggggagctgaacttggcacggcttgcttgaaagctagggttgcgttgttagcgtcgctgcaggacggcgcctttcagaacgctctcatgattagccaattacttcctgtcctcaaccacaagacatatatcgatttgatctttcccgactgtctggctccaagagttatgttggaacccgcggctgagacaatcccccagacacaggaaatcatctctgtgacgctgcaggtcctcagtttgttaccaccctatagacagtctatctccgttctggcaggttcaaccgtggaagatgtgctgaagaaggcccatgagctgggtgggttcacctacgagacccaggcctcactatctggcccctatttaacaagcgttatgggtaaagctgccggggagcgcgagttttggcagctgttgagagatcctaatactccactcctccagggtatcgctgactatcgacccaaggatggagagaccatagagctgcgcttggtgtcctggtag

SEQ ID NO: 113204 - DNA, 525 bp, Artificial Sequence
  Description of Artificial Sequence: Synthetic coding sequence
atgggtaaaataaccttctatgaagatcgggacttccagggaaggtgctacaattgtatctccgactgcccaaatctgcgcgtgtacttttctagatgtaactcaatacgggttgactcaggatgttggatgctttacgagcggcctaattaccagggacaccagtacttcctgagacgtggcaagtaccccgattaccaacactggatggggctctctgactccgtccagtcatgtcgaatcatccctcacacatcttcacataaactccgactttatgagcgggatgattataggggcctgatgtcagagcttacggatgattgcgcctgtgtgccagaactctttcgattacctgagatttactcactgcacgtgctggagggctgctgggttctctacgaaatgcccaattatcgggggaggcagtacttgcttagacccggagattaccggaggtaccacgactggggcggggctgatgctaaggtagggtcactgcgccgagtcacagatctgtactag

SEQ ID NO: 113205 - DNA, 528 bp, Artificial Sequence
  Description of Artificial Sequence: Synthetic coding sequence
atgggcaagattacattttacgaggatcgggcatttcagggccggtcttatgaatgcactactgattgtcctaaccttcaaccatattttagcaggtgtaattccatcagggtggaaagtgggtgctggatgatctacgaacgccccaattaccaaggacaccagtattttctcaggcggggcgagtacccagactaccagcagtggatggggctgtccgacagtatccggtcctgctgcctgataccaccacactcgggggcataccgtatgaagatttatgacagagatgagctcagaggtcagatgtcagagctgaccgatgattgcatcagcgttcaggacaggtttcacctgaccgagattcatagcctcaacgttctggagggatcttggatcctgtatgagatgccgaattacagaggacgacaatatctgttacggcccggagaataccgacgtttcctagactggggggcacccaatgctaaggtgggctcactcaggcgcgtgatggacctctattag

SEQ ID NO: 113206 - DNA, 525 bp, Artificial Sequence
  Description of Artificial Sequence: Synthetic coding sequence
atggggaagataaccttctacgaggaccgagcctttcaggggcggtcatatgagacaaccaccgactgtccaaatctgcaaccctacttttcaagatgtaatagtatccgagtcgagagcggatgttggatgctttatgaacgacctaactaccagggacaacagtacttgttgagacggggcgagtatcccgattatcagcaatggatggggttgagtgacagcattcgctcatgttgtctgatacctcagaccgtcagtcacaggctgagactgtacgaaagggaagaccataaaggcctaatgatggagctgtcagaagattgccctagcattcaagaccggtttcacctgagtgaaatccggtccctgcatgtgctggaaggatgctgggtgttatatgaactgcctaactacagaggaagacagtaccttttgcgcccacaggaataccggcgctgccaagactggggcgccatggatgcgaaggctgggagtctgaggagggtggtggatctttactag

SEQ ID NO: 113207 - DNA, 525 bp, Artificial Sequence
  Description of Artificial Sequence: Synthetic coding sequence
atgggcaaaatcactctctacgaagacagaggctttcagggacgacattatgaatgcagctccgatcaccccaatctgcagccatacttgtcacggtgcaacagcgcgagagtggactctggttgctggatgctgtacgagcagcctaattatagtgggctccagtattttctgcgccgcggggactatgcagatcatcagcaatggatgggattgtctgactcagtgagatcatgccgcctgatcccgcactccgggagtcacagaataaggctctatgagcgagaagattatcggggacagatgattgagtttaccgaggactgtagttgccttcaggacagattccgcttcaacgagattcacagtttaaatgttcttgagggctcatgggtgctgtatgaactgtcaaactacagaggaaggcagtacctcctgatgcccggcgactaccgacggtaccaagactggggtgcgacaaacgccagggtagggtccctccgacgcgttattgatttttcctag

SEQ ID NO: 113208 - DNA, 537 bp, Artificial Sequence
  Description of Artificial Sequence: Synthetic coding sequence
atgagcaagaccggcacaaagatcactttttacgaagacaaaaattttcagggccgccggtacgattgtgactgtgactgcgctgatttccacacgtacctgtctagatgcaattccatcaaagtcgaaggtggtacatgggccgtttacgagcggccaaattttgcaggatacatgtacatcctgcctcagggggagtatccagaatatcagcgatggatgggtcttaacgacaggctttcttcctgtcgcgcggtccatcttccctccggcgggcaatataagatacagatcttcgagaagggagacttctccgggcaaatgtacgaaaccacagaggactgcccctcgattatggagcaatttcacatgagagagatccacagttgtaaagtcctggagggggtgtggatattttatgaactgcctaactatagaggacgacagtatcttttagataaaaaggaatataggaaacccattgattggggagccgcttctcctgccgttcagtcttttaggcgaatcgtggagtag

SEQ ID NO: 113209 - DNA, 537 bp, Artificial Sequence
  Description of Artificial Sequence: Synthetic coding sequence
atgagcaaaactggcactaaaatcactttctatgaagacaagaacttccagggacgacgctacgattgtgactgtgattgcgcggatttccacacatatctatcccggtgcaattccattaaagtggaaggagggacttgggccgtgtatgagaggccaaacttcgccggatatatgtacatactgccccagggagagtatccagaataccaaagatggatgggactgaacgaccgactcagctcatgccgcgccgttcacttgccatcagggggacagtacaagattcagatttttgagaagggagacttctcggggcaaatgtatgagacaactgaggattgcccaagcattatggagcagttccacatgcgtgaaatccacagttgtaaagtgttagaaggggtgtggattttttatgagctgccaaactaccgggggcgacaatatcttctcgacaagaaagagtatcgtaagcccatcgattggggcgctgccagcccagccgtccagtccttccgcagaatcgttgaatag

SEQ ID NO: 113210 - DNA, 960 bp, Artificial Sequence
  Description of Artificial Sequence: Synthetic coding sequence
atggcctcatcagccgcaggttgcgtggtgattgtgggcagcggagtcattggacgatcttgggctatgctcttcgccagcggcggcttccaagttaagctgtatgatatcgagcagcaacagattcgcaatgctcttgagaatattagaaaagagatgaaactactggagcaggcaggaagtctgaaaggaagtttgagcgttgaagaacagctttccctgatttccggctgtccgaatatccaagaggccgttgagggggcgatgcatatccaggagtgcgttcccgaggacctggagctgaagaagaaaatcttcgcccagctcgacagtatcatcgatgatcgcgtcatcttatcctcatcaacctcttgcttaatgcccagcaaactgttcgcggggctggttcacgtcaaacagtgcatcgtggctcaccccgtcaatcccccatattatatccctcttgttgagctggtgccccaccctgagactgcacctaccaccgtcgatcgcactcatgccctcatgaaaaagatagggcaatgcccaatgcgcgtccagaaagaagtagctggcttcgttctaaaccggctgcagtacgccattattagtgaggcctggcgattagtagaagaaggaatagtgagtcccagcgacctcgatctggtcatgtctgaggggttgggtatgcgttacgcctttatcggtcccctcgaaacaatgcatcttaatgccgagggtatgctgtcttactgcgaccggtactctgaggggattaaacatgttctacagacctttggaccaatacccgagtttagcagagccactgcggaaaaggtcaatcaggacatgtgcatgaaggtgcctgatgatcctgagcacctggcagcaaggcggcaatggcgggatgagtgcctgatgcgcctcgctaagctgaagtcgcaagtgcagccgcagtag

SEQ ID NO: 113211 - DNA, 2346 bp, Artificial Sequence
  Description of Artificial Sequence: Synthetic coding sequence
atggctaaaacacccagcgaccatttgctttccacccttgaggagctggttccttatgacttcgaaaaattcaagtttaagcttcagaatacgagtgtgcagaaggaacatagccgaattccccggtcccagatccagagagctagaccagtaaaaatggcaaccttgctggtaacctattacggtgaggaatatgccgttcagctaactctccaggtgctgcgagctatcaaccagcggttgttggcggaagagctgcatagggctgctatccaggaatattcaacccaggagaatggcaccgatgactcagcagccagctcttcccttggggagaataagcctcgaagtctaaaaacaccggatcatcccgagggaaatgaaggtaacgggcctaggccctacggtggcggcgcggcctccctgcgttgcagtcagcctgaagcgggtcgtgggctgagcagaaaaccactgagcaagagaagggagaaagccagtgaagggctagatgctcaggggaaaccaagaactagaagcccggccctgcctggtggaaggagtccaggcccttgccgcgccctggaaggtggacaggcagaggtcagattacgaagaaatgcatcttcagccgggagactgcaagggttggccggcggggcacctggtcagaaggaatgccggcctttcgaggtgtatcttccttcaggtaaaatgaggccaagatctctcgaggtgacgatcagcacaggcgagaaggcaccagccaaccccgagatcctcttgacattggaggagaagactgccgctaatctcgacagcgcaactgaacccagagcaaggcccactcctgacggtggcgcgagtgctgacctgaaggagggacccgggaaccccgaacactctgtgactgggagaccccccgatactgccgcttcacccagatgccacgcccaggagggagaccccgtggatggtacatgcgtgagggacagctgtagtttccccgaagcggtatccggccaccctcaagccagtggttctagatcccccggatgcccgagatgccaggactcacacgagaggaagagccccggctcactgtcaccccaacctttgccccagtgtaagaggcacctaaaacaggtgcagctcctattttgcgaagatcacgacgagcctatctgtctgatctgttctctgagtcaagaacaccaggggcaccgggtccgacctattgaggaggtcgccctagagcacaaaaaaaaaatccagaagcagctagaacacctgaaaaagctgcggaaaagtggcgaggagcaacgtagttatggagaagaaaaagcagtctcttttctcaaacagaccgaggccttgaagcagcgggtgcagcggaagctggaacaagtctactatttcttggaacagcaggagcatttctttgtcgcatcattagaagacgtgggacagatggttggacagatcagaaaggcatatgatactcgagtaagtcaggacattgctctgttggacgctctgatcggggagttagaggctaaggagtgtcagagcgagtgggagcttctgcaggacatcggcgacatcctgcaccgggctaaaaccgtgccagtgcctgagaagtggacaaccccacaggagatcaagcagaagattcagctccttcaccagaagagtgagttcgtagaaaagtccaccaagtatttcagcgaaaccctgcggagcgaaatggagatgttcaatgtgccagaactcatcggtgcacaagcacacgccgtgaacgtgattctggatgccgaaaccgcctatccaaaccttattttctcggatgatctcaaaagtgtgcggttggggaacaagtgggagcgactccctgatggtccccagagattcgattcgtgcattatcgtattgggctcgccttccttcctcagcggcaggcgctactgggaagttgaggtaggagacaaaacagcctggatcctcggagcttgtaaaacgtccatttcccgaaagggaaatatgaccctgtcacccgaaaacgggtactgggtggtgatcatgatgaaggaaaacgaatatcaggcctcttctgtgccccccactagactcttaataaaagagccccctaagagagtaggtatctttgtggactaccgggtgggctccatttccttctacaatgtgacggctcggagtcatatttataccttcgccagttgttccttttccggccctttgcagcccatcttctcacccggaacccgggacggagggaagaacaccgctccattgacaatttgcccggtcggcggccagggaccagactag

SEQ ID NO: 113212 - DNA, 945 bp, Artificial Sequence
  Description of Artificial Sequence: Synthetic coding sequence
atgagtcgggttccagcatttctgtccgcggcagaagtggaggagcatctacggagttcttccctccttatcccacccctcgagacagccctggctaatttttccagcggccccgaaggcggtgttatgcaaccggttcggacagtagttccggttaccaaacatcgtgggtatcttggcgtgatgccagcctactctgctgccgaggacgccctgaccacgaagctggtgaccttttatgaagaccggggtattacaagtgtggtccccagccatcaggccactgtgcttctgtttgagcctagtaacggaacccttctggcagtgatggatggaaacgtgataaccgccaagagaacagctgccgtatccgccatcgcaaccaagttcctgaaaccaccttctagcgaagtcctgtgcatcctgggtgcgggagtacaggcatactcccactatgaaatcttcactgagcagttctccttcaaggaggttaggatttggaaccggacaaaagaaaacgccgaaaagttcgcggacactgtgcagggtgaggtcagagtgtgcagttccgtccaggaggccgtcgcgggtgccgatgtcatcatcactgtgacgttggcgaccgaacctattttatttggcgagtgggtgaagcccggcgctcatatcaacgcagtcggagcaagccgccccgactggcgcgagcttgacgatgaattgatgaaagaggcagttctgtatgtggactcacaggaggcagccctcaaggagtctggcgatgtgttgcttagtggagccgaaatattcgccgaactgggagaagtaattaagggtgtgaagcctgctcactgtgagaaaacaacagtgtttaaatccctggggatggctgtggaagacacagtagccgcaaaacttatttatgatagttggagctcaggaaaatag

SEQ ID NO: 113213 - DNA, 819 bp, Artificial Sequence
  Description of Artificial Sequence: Synthetic coding sequence
atgcagcctgtgaggacagttgtgcccgtcactaaacaccgcggatacctcggagtgatgcctgcgtacagcgccgccgaggatgccctgactaccaagctcgtcacattctacgaagatcgtggcatcacttctgttgtgccctctcaccaagcaacggtgcttctgtttgaaccatctaacggaaccctgctggcggttatggacggaaatgttattaccgccaagcggacagcggccgtcagcgcaattgctactaaattcctcaagccacccagtagcgaagtcttgtgtatcctgggtgccggggtacaggcttatagccactacgaaatttttactgagcagttcagttttaaggaagtgcgaatctggaatcgaaccaaggaaaatgctgaaaaatttgctgatacagtccaaggagaggtgagagtttgtagctctgttcaagaagccgtggctggggcagatgtgatcatcaccgtgaccttggccacggaaccaatattgttcggcgaatgggttaagccaggagcccacattaatgcagtaggagccagtcgccccgactggagagagctggacgacgagcttatgaaagaggctgtcctttatgtcgactctcaggaggctgccctcaaggagtcaggggatgttctcctgtccggggctgagattttcgccgagctgggcgaggtgatcaaaggtgttaaacccgctcattgcgaaaaaactaccgttttcaagtctttaggcatggccgtggaagatacagtggccgctaaattgatttacgattcctggagttctggaaagtag

SEQ ID NO: 113214 - DNA, 945 bp, Artificial Sequence
  Description of Artificial Sequence: Synthetic coding sequence
atgagtcgggtgccagcgttcttgagtgcagccgaagtggaggagcaccttagaagttcgagccttctcatcccgcctctcgagacagccttggctaatttcagctctggtccagagggcggcgtgatgcagcccgttaggactgtcgtgcccgtgactaagcaccgaggctacttgggggtgatgccggcctactcagcggctgaagatgcattaaccaccaaactcgtcacgttctacgaagaccggggaattacctctgttgttccgtcacatcaagccactgttctgttatttgagccatccaatgggacgctgcttgctgttatggatgggaatgttataacagccaagagaaccgccgcagtcagtgctattgcaacaaaattcctgaaacctccttccagcgaggtcttgtgtatcctgggggcaggtgttcaggcctactcccactatgagatctttactgaacagttctcctttaaagaggtacgtatatggaaccgtacaaaggagaatgccgaaaagtttgccgacactgtgcagggcgaagtgagagtgtgctcgagcgtgcaggaagcggtggccggtgccgacgtgatcattactgtgaccctggcaactgagcctatcctcttcggcgagtgggtgaaacccggtgcacatatcaatgccgttggcgcatcacgacccgattggcgggagctggatgatgaattgatgaaggaggcagttctgtatgtagactcacaagaggctgcgctgaaagagagcggcgatgtcctgctttcaggtgcagaaattttcgccgagctgggagaggtcatcaaaggcgtgaaacctgcccactgcgagaaaacaacggtttttaaatcgcttggcatggccgttgaagataccgtggccgcaaagttaatttacgactcgtggtcaagcggcaaatag

SEQ ID NO: 113215 - DNA, 990 bp, Artificial Sequence
  Description of Artificial Sequence: Synthetic coding sequence
atggcgacagggcagaagttaatgcgggcagtgagggtattcgagttcggaggccccgaagtgctgaagctcagatccgacatagcggtcccgattcctaaagatcaccaggtcctgatcaaggttcatgcctgtggagttaatcccgttgagacatatatacgttccgggacatactctaggaagcccctgcttccctatacccccggttcggatgtcgctggagtgatagaagccgtgggggataatgcgtcggcatttaaaaaaggcgatcgggtgttcacatcatccactatatctggcggttatgctgagtatgctctcgccgccgatcacaccgtgtacaagctcccagagaagcttgacttcaagcaaggagcagccattgggattccctatttcaccgcatacagagcgcttatccattcagcctgtgtgaaggccggggagtctgtgttggttcatggcgcatctggaggtgtgggattagccgcctgccagatcgctagagcatatgggttgaaaatcctaggcacagccgggacggaggaggggcagaaaattgtgctgcaaaacggagcgcacgaggtgttcaaccatagagaggtgaactatatcgacaaaattaagaagtacgtgggcgagaaaggcatagacatcatcatcgaaatgctcgccaacgtcaatctgtcgaaagacctgtctctcctgtcacacggtggccgggtgattgtagtgggctctcggggcaccatcgagatcaatccaagggacactatggctaaggagtccagtatcattggagtgacactgttctcatccactaaagaagaattccagcagtatgcggccgctctgcaggccggcatggaaatagggtggttgaagcccgtcattggcagccagtacccactggaaaaggtcgccgaggcccacgaaaatatcattcatggttccggggccactggaaaaatgatcttgctgctgtag

SEQ ID NO: 113216 - DNA, 732 bp, Artificial Sequence
  Description of Artificial Sequence: Synthetic coding sequence
atggcaacaggccagaagctcatgcgcgccgtgcgggtcttcgagttcggtggcccagaagtgctgaagctaaggtcagatattgctgtgcctataccaaaggatcatcaggtcctgatcaaagtccatgcctgcggagtgaacccagtcgagacgtatattcgcagtggtacctactccagaaagcccctcttgccctacactcccgggtcagacgttgcaggggtcattgaagccgtcggggacaatgcttcagctttcaaaaaaggagatcgtgtcttcacatcatccacgatatcaggggggtatgcagaatatgcccttgccgctgaccacaccgtgtacaaactcccagagaagctggatttcaaacagggtgctgccattggcattccctacttcaccgcgtaccgcgctctgatccactctgcatgcgtgaaggctggagagtcagtcctcgtacatggcgcctcaggaggggtcgggctcgcagcttgccagatcgcccgtgcgtacgggttaaaaattctgggtactgccgggaccgaggaggggcaaaagattgttctgcagaacggggcacatgaggtcttcaaccaccgcgaggtgaattacattgacaagatcaaaaagtacgtgggcgaaaagggaatagacatcattatagaaatgctggctaacgtcaacttatcaaaagatctgtctttgctgagccatgggggaagagtgtag

SEQ ID NO: 113217 - DNA, 888 bp, Artificial Sequence
  Description of Artificial Sequence: Synthetic coding sequence
atggccacgggtcagaagctaatgagagccgtgcgcgtctttgagtttggcggacctgaagttctgaagttgagaagcgatattgccgtgccaattcctaaggatcaccaggtcctcatcaaggtgcatgcctgtggggtgaaccctgtagaaacctatatccgctctgggacttattcacggaagccactgcttccttacactccgggatccgacgtcgctggggtcattgaagccgtgggcgataatgcttccgcctttaagaagggtgatcgcgttttcacttcaagtactatctccggaggctacgccgagtacgcattggcagcagaccacactgtgtacaagttaccagagaagttggacttcaaacaaggagccgcaataggcatcccatacttcaccgcttaccgagctctcatccactccgcctgtgtcaaggccggggagagtgtgttagttcacggggccagcgggggcgtgggcctggctgcctgtcagattgcccgcgcatacgggttgaagatcctaggtacagccggcaccgaagaggggcagaaaatcgtcctgcagaacggtgcacacgaagttttcaaccacagggaagttaattacattgacaagatcaaagttgtcggttcgaggggcaccatcgagataaaccctagggataccatggctaaagagtccagcattatcggcgtgaccttgttcagttctactaaagaagagtttcaacagtacgctgccgctttacaggccgggatggagattggctggctcaaacctgtcatcggaagccagtacccactcgaaaaggtggcggaggctcacgagaatatcatccatggatcaggcgcaacgggcaagatgattctgcttttgtag

SEQ ID NO: 113218 - DNA, 579 bp, Artificial Sequence
  Description of Artificial Sequence: Synthetic coding sequence
atgcacctgttatctagtgcctgtgtcaaggcgggagaatccgtgctcgtgcacggtgcctctggcggagtcggtctagccgcttgccagatcgctcgcgcttatggtttgaaaatactcggcacggccggcacagaagaaggacagaagattgttttgcagaacggggcccacgaggtctttaatcatagagaagtcaattacattgataagatcaagaaatacgtgggggagaagggaatcgatataattatcgagatgctggctaatgtgaacctcagcaaggatctctctctgctcagccatgggggccgggtgatcgttgtggggtcgcgcggaacgattgaaataaatcctcgagatacaatggctaaggagtctagcatcattggcgtgactctgttcagtagcacaaaagaagaattccagcaatatgcagctgcactgcaggctggcatggagatcggatggttgaagccggtgatcggttcccagtatccattggaaaaagtggctgaggctcatgaaaacataatccatggcagtggagccaccggcaagatgatactgctcctttag

SEQ ID NO: 113219 - DNA, 990 bp, Artificial Sequence
  Description of Artificial Sequence: Synthetic coding sequence
atggcgactggacagaagctgatgcgcgcagtaagagtgtttgaattcggaggtccagaagtactgaagctccgtagtgacatcgcagtgccaatccccaaagaccatcaggttctaattaaggtgcatgcatgcggcgtcaaccctgtcgagacatacattcggagtggcacctattccagaaagcctttgctcccttacacccccgggtccgacgtagccggggtgatcgaagctgtgggagataatgcaagtgcatttaagaagggggaccgggtattcacctccagcaccatatccggtggatacgctgagtatgccctggccgccgaccacacagtgtacaaactccctgagaaactcgatttcaaacagggtgcggcgatcggcatcccgtactttactgcctaccgcgcgctaattcactcagcgtgtgtcaaggccggcgagtccgtcctagtccacggagcctcaggcggtgtaggcctcgccgcctgtcagatcgcacgcgcatatggcctgaagattcttggaactgccgggacggaggaaggacagaagatcgtgctgcagaatggggcacatgaggtgttcaatcatcgcgaagtaaattatattgataagattaagaagtacgtaggtgagaaggggatcgacattatcatcgaaatgcttgcgaatgtgaatttatcaaaagacctgtctctgctgagccatggtggacgagtcatagtggtaggtagcagaggcaccattgagatcaatcccagggacaccatggccaaagagtcgagtatcattggtgtgaccttgtttagcagtactaaagaggaattccagcagtatgctgctgccctccaggcagggatggagatcggttggctcaagccagtgatcggaagtcagtaccccttggagaaggtggcggaagctcacgaaaacataatccatggcagtggggccaccggtaagatgatactgctgctttag

SEQ ID NO: 113220 - DNA, 621 bp, Artificial Sequence
  Description of Artificial Sequence: Synthetic coding sequence
atggcaaccgggcagaagctcatgcgtgcagtgcgcgtgtttgagttcggaggccccgaagtgctgaaactcagatctgacattgcagtgcccattcctaaggatcaccaggtgctaattaaggttcacgcatgtggggtgaacccagtcgagacctatatccgcagcgggacctactctcggaaaccactgttaccctacacaccgggttccgacgtggcaggtgttattgaggctgttggcgataatgcctccgccttcaaaaagggagaccgggtcttcacaagttcaactattagtggaggatacgccgagtacgctctggcggcagatcacactgtctataagctgccagagaagctcgacttcaagcagggagctgcaattggaataccttattttactgcgtatcgtgcactgattcactccgcttgtgtgaaagctggcgagtccgttctggtgcacggagcaagcggcggagtgggactggcagcttgccagatcgcgagggcctacggactgaaaatcctgggtactgccggtactgaggaaggccagaagatcgtcttgcagaatggggcacacgaagtgttcaatcaccgggaagtgaattacatctag

SEQ ID NO: 113221 - DNA, 1050 bp, Artificial Sequence
  Description of Artificial Sequence: Synthetic coding sequence
atgaagggactgtacttccagcagtcctctaccgacgaggagattacatttgttttccaggagaaagaggacctaccagtgacagaggacaattttgtcaagctccaggtgaaagcttgcgccctgtcacagattaacaccaagttgctcgccgagatgaagatgaagaaggatctgttcccggtgggccgtgaaatcgccggtatcgtactggatgtgggctctaaagtgtcattctttcaaccagacgatgaggtggtaggcatccttcccttggacagtgaagacccaggtttatgcgaggtcgttcgggtccacgagcattacctcgttcacaagccagagaaagttacctggacagaagccgccgggtcaatcagagacggggtcagagcctatacagccttacattatctgtctcacctttcccccggaaaaagcgtcttaatcatggatggtgcgtctgcctttggcactatcgccatacagcttgctcaccatcgtggggctaaggtgatctctactgcttgttctctcgaagacaaacagtgtctggagaggtttcggcctcctatcgcccgcgtgattgatgtgtcaaacggaaaggtgcatgtggccgaaagctgtttggaagagaccgggggcttaggtgtggatatcgtgctggacgctggagtccgactctattccaaggatgacgaacccgcagtcaagctgcaactgctgcctcacaaacatgacatcataactctcttgggcgtcggagggcactgggtaactacagaggaaaacttacaactggatccacctgattcgcattgtctcttcctgaaaggagccaccctggcctttctcaatgatgaagtatggaatttaagtaacgtgcagcaaggaaaatacctgtgtattctcaaagatgtgatggaaaagctgagcaccggagtgttccggccccagctggatgaacccatcccgctgtacgaggccaaagtttccatggaggcagtgcaaaagaatcagggccgaaagaaacaggtggtgcagttctag

SEQ ID NO: 113222 - DNA, 546 bp, Artificial Sequence
  Description of Artificial Sequence: Synthetic coding sequence
atgaagggactgtattttcagcaaagctcaacagacgaggaaattacattcgtttttcaagaaaaggaagacctccctgtaacagaggacaattttgttaaattgcaggtcaaggcatgtgccctgagccagatcaacactaagttgctggccgaaatgaagatgaagaaggacctgttccctgtggggcgcgagatcgccggtattgtgttagatgtcgggagcaaggtaagttttttccagccagatgatgaagtagtcggaatcctgcccctcgatagtgaggaccctgggctctgcgaggtcgtccgagttcatgagcactatctagtccacaaaccggaaaaggtcacttggacagaggctgcgggctctatcagagatggagtgagggcttacacggctctccactacctgagtcacctgtctccgggcaaatctgtgttgattatggatggagccagcgctttcggtactatcgccatccagttagcccaccaccgtggcgctaaggtcattagcaccgcatgtagcctagaggactag

SEQ ID NO: 113223 - DNA, 60 bp, Artificial Sequence
  Description of Artificial Sequence: Synthetic coding sequence
atgaaggggctttatttccagcaatccagcactgacgaagaaataaccttcgtattttag

SEQ ID NO: 113224 - DNA, 597 bp, Artificial Sequence
  Description of Artificial Sequence: Synthetic coding sequence
atgaaaggcctttatttccagcaaagctcgaccgacgaggaaatcactttcgtttttcaagagaaggaggatttgcctgtgaccgaggacaactttgtcaagttacaggtgaaagcgtgcgcgctgtctcagattaacacaaagttgctggctgagatgaagatgaagaaggacctttttccggttggaagagaaatcgccggcattgtcctggacgtcggatccaaagtgagtttctttcaacccgatgatgaagtggtgggaatcctgccactggactctgaggaccctgggctgtgcgaagtggtgcgcgtacacgagcactacctcgttcacaagccagaaaaagttacctggacggaggctgcaggatctattcgagacggtgttagggcatacacagccttgcattatctgagccacctcagcccaggaaaaagcgtgctcattatggacggtgcgtctgctttcgggacgattgccatacagctcgcgcaccaccgcggcgcgaaagtgatctccactgcctgtagcctcgaagacaagcaatgcctggagcgctttagacctcctattgagaattctaccatcgcttag

SEQ ID NO: 113225 - DNA, 2916 bp, Artificial Sequence
  Description of Artificial Sequence: Synthetic coding sequence
atggagctgtccgatgctaacctccaaaccctgaccgaatacctaaaaaagacgctggatcctgacccggcaattcggcgccctgctgaaaaatttctggagagtgttgagggaaaccagaactatccacttttgcttctcacactactggagaaaagccaggacaatgttattaaggtttgcgccagcgtgaccttcaagaactatatcaaacggaattggcgcatcgtcgaggacgaacccaacaagatttgtgaggctgaccgtgtggcaataaaagccaatatcgtacatttgatgttgtccagccccgagcagatccagaagcaattgtctgatgcaatttcaatcattgggcgggaagatttcccgcaaaagtggcctgacctcctcacagagatggtcaataggtttcaaagcggggattttcacgttattaatggcgttctacgcacagcccatagcctctttaagagatatagacacgaatttaagtccaatgaactctggaccgaaatcaaactggtcctcgatgcgtttgccctacctctgacaaatctgttcaaggcaaccatcgaactgtgcagtacacatgccaatgacgcctctgcgctgcgcatattattctcttcactgatcctgatatcgaagttattttacagcctgaactttcaagatcttccagagttttttgaggacaacatggaaacatggatgaataactttcacaccttgctgactctggacaacaagctgttgcagaccgacgacgaagaggaagcgggtcttcttgagctcttaaaaagccagatctgtgataatgcggccctctacgctcagaaatatgacgaggaatttcagagatacctgcccaggtttgtgaccgctatttggaatctgctggtgacgactgggcaggaggtgaagtacgacctgctggtctcgaacgccattcaatttcttgcttccgtttgtgaaaggccacactacaagaatctgtttgaggaccagaacactctgacaagcatttgtgaaaaggtcatcgtgcctaacatggagtttcgcgctgcggatgaggaagcgtttgaggacaactccgaagaatacatccgccgtgacctcgaggggtccgacattgacacccgccggcgcgcagcttgtgatctggttcgcggcttgtgtaaattttttgaagggccagtgaccggtatctttagcggctacgtgaattctatgctccaagaatatgcaaaaaaccccagcgtgaattggaagcacaaggatgcagctatctacctggttacttctctcgcgtccaaagcacagacccagaagcacggtattacacaggcaaatgaactggtgaacctgaccgagttcttcgtcaatcatattctgccagacttaaaatctgcgaacgtgaacgagttcccagtcctcaaagcagacgggatcaaatacatcatgatatttagaaatcaggtgccaaaggaacatttgttggtttcaattcccctgctgattaaccacttgcaagctgaatctattgtggtccacacgtatgcagcacatgccctcgagagactttttacaatgcgaggcccaaataacgccactttgtttaccgctgcagaaatagctcctttcgtagagatcctcctgacaaatctttttaaggcactcaccttgcccggttcctccgagaatgagtatattatgaaagccataatgagatccttctccctcttgcaggaggccatcatcccttatattcccacactgatcacccaattgacccagaagttgttagctgtgagcaaaaacccatcgaagcctcactttaatcactacatgttcgaggcaatatgtctgagtataaggatcacttgcaaggccaatcccgctgcggtggttaatttcgaggaggccctatttctggtttttacagagatcctacagaacgacgtccaggagtttataccatacgtttttcaggtcatgagcctcctcttggagacgcataagaacgacatcccatcttcctatatggcactcttccctcatttactgcagcccgtactgtgggaacgaactggaaatatacccgctctggtccgcctgttgcaggctttcctggaaagaggcagtaacacaatcgcctctgccgcggcggacaagatacctggcctgctcggcgtcttccagaagttgatagccagcaaggccaatgaccatcagggtttttatcttttaaactctatcattgagcacatgccaccagagtccgtggatcaataccgaaaacagatcttcatacttctcttccaacggctccagaactctaagacaaccaaattcattaagtcattcctggtcttcattaacttgtattgcatcaagtatggcgctttagctctccaggagatattcgatggcatacaacctaagatgtttggaatggttctggaaaaaattatcatccctgaaattcagaaggtgtcaggcaacgtagagaaaaaaatttgtgcagtcggtatcaccaagctccttactgaatgcccccccatgatggacactgaatacacaaagctgtggacccctctcctccaatccctgattggcctgtttgagctcccggaggatgataccatccccgacgaggagcactttatcgatatcgaggacacgcccggctaccagactgccttttctcagttggcattcgctggcaaaaaggaacacgatccagtgggtcaaatggttaacaacccaaaaattcacctcgctcaatcattgcacaagctaagtaccgcttgtccaggacgggtgcctagcatggtatctacaagtcttaatgccgaggctctacagtacctgcagggatatcttcaggcagcttccgttaccttactttag

SEQ ID NO: 113226 - DNA, 2748 bp, Artificial Sequence
  Description of Artificial Sequence: Synthetic coding sequence
atggagctgtcagacgctaatcttcagactctgacggagtacttaaagaagactctggaccccgaccccgcaattagacgcccagcagagaaattcttggagtcagtcgaggggaaccagaattaccccctgctgttgcttacactgcttgagaaatcacaggacaacgtgataaaggtgtgtgccagtgtgacgtttaagaactatattaagaggaactggaggatcgtggaggacgaacctaataaaatctgcgaagccgatcgcgtcgcaatcaaggccaatattgtgcacttgatgcttagttctccagagcagatacagaaacagttatcagatgccatcagcattattggacgggaagacttcccacaaaagtggccggaccttctgacggaaatggtcaaccggtttcagagtggcgatttccacgtgataaacggcgtcctgcgaactgctcactcattattcaaacggtatcggcatgaattcaaaagtaatgaactctggacagaaataaaacttgtgctggacgctttcgccctcccgctcaccaatttgtttaaggccacaatcgaattatgttccacccacgctaacgatgccagcgctttgcgcatactcttcagttcactgatactgatttcaaagttattttatagcttaaactttcaggaccttcccgagtttttcgaagacaatatggagacctggatgaataacttccacactctcctgactttagataataagttgcttcagactgacctggtttctaacgcaatacagtttctggccagtgtatgcgagcgcccccactacaagaatctgtttgaagaccaaaacaccttaaccagcatatgcgagaaagtgattgtgccaaacatggagttcagggctgctgacgaggaggcattcgaggataacagcgaagaatatatccgtcgtgatcttgaggggagcgacatcgacacaaggaggcgtgccgcctgcgatttagttcggggcctctgtaagttcttcgaaggacccgtcacgggtatcttttcagggtacgtaaatagcatgttgcaggagtatgccaaaaaccctagcgtaaattggaaacacaaggacgccgcaatatacctggtaactagtctggcctccaaagcgcaaacacaaaaacacgggatcacccaagctaatgagctcgtcaacctgaccgagttcttcgtgaaccacatacttcctgatttgaaatcagcaaacgttaacgaattccccgtgctgaaagccgacgggatcaagtacattatgatcttcagaaaccaagtgccaaaagagcatcttttggtgagcatccctttgctgattaaccacctgcaggccgagagcatcgtagtgcacacctatgcagctcacgctctcgagagattgttcaccatgagaggaccgaataatgcaacactgtttacggctgccgaaattgcacccttcgtggagatattactaactaatctgtttaaggccctgaccttgccagggtcaagcgaaaatgagtatatcatgaaggcgatcatgaggagtttttcccttcttcaggaagccatcataccctatattcctactttgataacacagctgacgcagaagctgcttgctgtatccaagaacccaagcaaacctcattttaatcattacatgtttgaggcaatttgtctcagcattaggataacttgtaaggccaacccagccgccgtcgtcaattttgaggaggcgctgtttcttgttttcacggagattttgcagaatgatgtgcaggagttcattccctatgtattccaggtcatgagcctgctgttggagacccataaaaatgatatcccatcatcctacatggcactgttcccccacttattgcagcccgtattatgggaacgtacaggcaacatccccgcattagtgcgtcttctccaagccttcttggagcgcggttccaacaccatcgcgtccgccgccgcggataaaattccagggctgctgggagttttccagaaactcattgcaagcaaggcgaatgaccatcaggggttctaccttctaaacagtattatcgaacatatgcctcccgagagtgtggatcaataccggaagcagattttcatcctgctgtttcagagactacagaacagtaaaaccacgaaatttatcaagtcattcctcgtgttcattaacctctactgcatcaaatacggagcactggcactgcaggagatcttcgacggaattcagccaaagatgttcggcatggtcttagagaagataatcattcccgaaattcagaaagtgagtgggaacgttgagaagaagatatgcgctgttggtatcaccaagctcctcactgagtgcccaccaatgatggacactgagtacactaaactctggaccccattgctgcagtctctgatcggcctgttcgagctgcctgaagatgataccattcccgacgaagagcacttcatagatatcgaggacacacccggctatcagaccgcgttttcacaactggctttcgcaggaaagaaggagcacgaccccgtcgggcaaatggtcaataaccccaaaatacatcttgcgcaatctctgcacaaactgtcaacagcttgtcctggaagggtcccctcgatggtgtcgacgtcgctaaatgccgaagccttacagtacctgcaggggtacctccaggctgcctccgttactctgttatag

SEQ ID NO: 113227 - DNA, 1710 bp, Artificial Sequence
  Description of Artificial Sequence: Synthetic coding sequence
atggagacctggatgaataactttcacacactcctgacactagataacaaactgctgcagactgatgatgaggaggaggcaggcttattggagctgctgaagagccagatatgtgacaacgccgcactctacgcccaaaaatatgacgaggagttccagcggtacctgccgcggtttgtgacagcaatttggaatctgttggtgactactggacaagaagtgaaatacgatctgctggtgtccaatgccatccagttcctcgctagcgtctgcgagagacctcactacaagaacctgttcgaagaccaaaatacattgacttcaatttgtgaaaaatcaatcgtggtgcacacctatgcggctcacgctctggagcgactgtttactatgcgtgggccaaataacgcgacactcttcactgcggcagagattgcgcccttcgtagagatactgttgactaacttgtttaaggcacttacactccccgggtcttctgagaatgagtacattatgaaggctattatgagaagcttttcgctgctgcaggaggcaattatcccctatatccctaccttgatcacacagttaactcagaagcttcttgccgtctccaagaatccctctaaaccacactttaaccactatatgttcgaagccatttgtctgtctataaggatcacttgcaaagccaacccagctgccgtggtgaattttgaagaggctttattcctcgtgttcacagaaattctacagaacgatgtgcaggaatttatcccgtatgtatttcaggtgatgagcttgctgctcgagacacataagaacgacataccatcttcctacatggccctcttcccccatctgctgcagcccgttctctgggaaagaaccggcaatatacctgccttagtacgcctcttgcaggctttcctggagcgcggcagtaacacgattgcctctgcggcggcagataaaatcccgggactgctcggcgttttccagaagttgatcgctagtaaagcaaatgatcaccagggcttttatctgctgaacagtataatcgagcatatgcctcctgagagcgttgatcagtaccggaaacagatcttcatcctgttgtttcagaggctgcaaaattctaaaaccacaaagtttatcaagagcttcttagtcttcataaatctctattgtattaagtatggcgctcttgccctccaggaaatcttcgatggcatccagcccaagatgtttggcatggttctggagaagataatcatccctgaaattcagaaggttagcgggaatgtggagaaaaaaatctgtgcggtgggcattacaaagctgctcacagaatgtccccccatgatggacacagaatacacgaagctgtggactccgctgctccagtcgcttatcggcctctttgagctccctgaagacgacacaattcccgatgaggaacacttcatcgacatcgaggatacacccgggtatcagaccgcatttagccagctggcattcgcaggcaagaaggaacacgatcccgtggggcagatggtgaataaccccaagattcacttggcacagagcctgcacaaactctccaccgcctgtcccggaagggtcccctctatggtcagcacaagtctgaacgctgaagcattgcaatacctccagggctacctgcaggcagcttctgtcaccctcctctag

SEQ ID NO: 113228 - DNA, 2265 bp, Artificial Sequence
  Description of Artificial Sequence: Synthetic coding sequence
atgctctctaacttgaacttccaagacttgccagagtttttcgaggacaatatggagacttggatgaacaactttcatacactgctcactctcgacaacaagctcctacaaactgacgacgaggaggaagctggtctgcttgaactgctcaagtctcaaatctgcgataatgccgcgctgtatgcccagaaatatgatgaggagttccagcggtacctcccacgttttgtgactgctatttggaaccttctggtcaccacaggacaggaagtgaaatatgatttgctggtgtccaatgcaattcagtttctcgcaagtgtttgcgagcggccgcactataaaaatctgttcgaggatcagaacacacttacatccatctgtgagaaggtgatagtgcccaacatggagtttcgcgcagccgacgaagaggctttcgaagacaactctgaagagtacattcgccgtgatctggagggatccgacatcgacacccgccgccgcgccgcctgtgatctcgtcaggggactgtgtaagtttttcgaaggaccagtgacagggatcttcagtggttacgtgaactctatgctgcaggagtacgccaaaaaccccagtgtgaattggaagcacaaagacgctgctatttatctagtgacctccttagcaagcaaagcccagactcagaagcatgggatcacccaggccaacgaacttgtaaacctcactgaattttttgttaaccatatactcccggacctgaaaagtgctaatgtgaatgagtttcccgtgctcaaagctgatggaataaagtatattatgatatttcggaatcaggtcccaaaggagcacttgttagtttccatccctctgctcataaaccacctccaggcagagtccatcgttgtccatacgtacgcagctcacgcactggagagattattcacaatgcggggacccaataacgctaccctgttcaccgcagccgagatagcaccgtttgtggaaattctgctcacgaatttgttcaaagccctgacattgccgggcagctccgagaacgagtacatcatgaaggccatcatgagaagcttctcattactacaagaggccatcatcccttatatcccgaccctcattacccagctgacccagaaactcctggctgttagcaagaatccaagcaagcctcactttaaccattacatgttcgaggcgatatgcctgagcatcagaatcacttgcaaggcaaatcccgccgctgtggtaaattttgaagaagcactgttccttgtcttcaccgagatcttacagaatgacgtacaggagttcatcccgtatgtgtttcaggtgatgagtttgcttctcgaaacccataagaacgacatccctagcagctatatggccctgtttccccacctgctgcaaccagtactttgggagagaactggtaacattcccgcactcgttagactgctgcaggcatttctcgaacgcggcagcaatacaatcgcgagtgcggcagcagacaagatccctggactgttgggggtgtttcaaaagctcatcgctagcaaagcaaacgaccaccagggtttctatctactgaattcaatcattgagcacatgcctcccgaatcggtcgatcagtaccgcaagcagatttttattctcctgttccagcggcttcagaattcaaaaaccaccaaatttatcaagtcttttcttgtctttatcaacctctactgcatcaagtacggtgctctggctctgcaggaaatttttgatggcatccaacccaagatgtttggaatggtgctggaaaagattataattcccgagatccagaaggtgagcggaaacgtagaaaagaagatctgcgccgtgggcatcacaaagctgctcacagagtgtccccctatgatggatacagaatatactaaactctggaccccactgttacagagtctgataggcctgttcgaattgcccgaagacgataccatccctgacgaggaacactttatagacatcgaggacactcccggctatcagaccgcgttcagtcagcttgcatttgcaggcaagaaggagcatgaccccgtcgggcagatggtgaacaacccaaagatccatctggcccagtccctgcacaagctgagcacagcctgccctgggagagtgccttctatggtaagcacctctctcaatgccgaggccctacagtaccttcagggatacttgcaggccgcctcagtaaccttactgtag

SEQ ID NO: 113229 - DNA, 888 bp, Artificial Sequence
  Description of Artificial Sequence: Synthetic coding sequence
atgcaacccgaaggcgctgagaaaggtaagtcgtttaaacagaggttggtgctgaagtctagcttagccaaggagactctttcagagttcctaggaacattcatcttgatcgtgcttggctgcggatgtgtggcacaggctatcctgagtcgaggacgattcggaggggtgatcactattaacgtgggtttcagcatggctgtcgcgatggccatttatgtagccggcggcgtgagcggcggccacatcaacccagcggtgtctctagccatgtgcctgttcggaagaatgaagtggttcaaactgccattttacgtaggcgcccagtttctgggggccttcgtgggcgccgcaaccgtgtttggaatctactatgacgggctgatgagtttcgcagggggaaagctactgatcgtaggcgagaacgccactgctcatatttttgccacttaccccgctccatacctttcccttgcaaacgcgtttgccgatcaggtcgtggccactatgatcctgcttatcatagtgttcgctatcttcgactcccgaaacctgggtgcccctaggggacttgagcctatcgccataggtcttctcatcattgtcattgcctcttccctcggcctgaactccggctgcgctatgaaccccgcccgcgatctgagtcctcgcctgtttacagccctggccggatggggcttcgaggttttccgggcgggcaataacttctggtggataccagttgtgggcccgttggttggagcagtgattgggggcctcatatacgtgctggtgattgaaattcaccatccagaacccgacagcgtcttcaaaacagagcagagcgaggacaagcctgaaaaatatgagctgagcgtgataatgtag

SEQ ID NO: 113230 - DNA, 1353 bp, Artificial Sequence
  Description of Artificial Sequence: Synthetic coding sequence
atgtctgccatccaggctgcgtggccatcaggcactgaatgtatagccaaatataactttcacgggacagcagagcaggatctaccattttgcaaaggtgacgttctgaccatagtcgcagttacaaaggaccctaattggtacaaagcaaagaacaaagttggtagggaggggatcatccctgccaattatgtgcaaaaaagagaaggggtgaaggccgggacaaagcttagcctcatgccatggttccatggaaagatcaccagggaacaggcggagcggctgctgtatccaccagaaacgggactttttctggtgcgtgagtcaacaaattatcccggagactataccctgtgcgtgagttgtgatggcaaagtggaacactacaggatcatgtatcatgcgagcaaactttctatagacgaagaagtttattttgagaaccttatgcagcttgtggagcattacacatctgacgccgatggactgtgtacccggttgatcaaaccaaaggtgatggaaggcacggtcgccgcgcaggacgagttctaccgatctggatgggccctgaacatgaaggaattaaaactcttgcagactatcgggaagggcgaatttggagacgtcatgctaggtgactaccgtgggaacaaggtggctgtcaaatgtattaaaaatgacgcaaccgctcaagcattcctggcagaagctagcgtaatgacgcaactccgccactccaatttagttcagttgctgggcgtcatcgtggaggaaaaaggtggtttgtatatagttacagagtatatggccaaggggtctctggtggattacttacgttccaggggacggtcggtcctgggcggtgactgtctgctgaaattctctttagacgtgtgcgaagctatggagtatctcgaaggtaacaattttgtccatcgggacctagctgcacggaacgtgttagtctcagaagataatgtagcgaaagtgtccgattttgggctgactaaagaagctagctctactcaggatacaggcaaactgcctgtaaagtggaccgctcccgaggcgctgagagaaaaaaaattctcaacaaagtccgatgtctggtcctttggaatcctgttgtgggaaatctattccttcggaagagtgccttatcctcgtatcccactcaaggatgtggttcccagagtggagaaggggtataaaatggacgctccagatggctgtccccctgcagtctatgaagtcatgaagaattgttggcacttagacgctgctatgaggccgagctttctgcagctgcgagagcaactggagcacatcaaaactcatgagctccacttgtag

SEQ ID NO: 113231 - DNA, 1353 bp, Artificial Sequence
  Description of Artificial Sequence: Synthetic coding sequence
atgtccgccatccaggcagcttggccatcaggcaccgagtgtatcgcaaaatataattttcacggcaccgccgagcaggatctccccttttgcaagggggatgttttgaccattgtcgcggtcactaaggatccaaattggtacaaagcgaaaaacaaagtgggccgcgaaggcataattcccgctaactatgtccagaagcgggagggagtgaaagctggaactaagctgtccctaatgccgtggtttcatggcaaaatcactagagagcaagccgagcgcctcttgtaccccccggagacagggcttttcctggtgagagaatccaccaattaccccggagactacaccctgtgcgtttcttgtgacggtaaggtcgagcactaccgaatcatgtatcatgcatccaagttatctatcgatgaagaggtttacttcgagaatctgatgcagctggtggagcattacactagtgatgctgacggactgtgcactcggctgatcaagcccaaagtgatggaagggacggtcgccgcccaagacgaattctatagaagtgggtgggcgttgaacatgaaggagctcaaactcctccagaccatcgggaagggggagttcggcgatgttatgctgggggactacagggggaacaaggttgccgtcaagtgtattaagaacgacgccaccgcccaagctttcctggccgaggctagcgtcatgactcaactgagacatagtaacctggtacaactgctaggagtgatcgttgaggaaaagggaggtttgtacatagtgaccgagtacatggccaaagggtccctggtggactacttacgcagccgcgggcgcagtgtactaggcggtgactgtctgctcaaattcagtctcgacgtttgtgaggccatggaatacctcgaaggcaacaacttcgtacatagagacctggcggccagaaacgtcctcgtgagcgaagacaatgtggcaaaagtctcagacttcggattaaccaaagaggccagcagtactcaggacaccggcaaacttccagtaaaatggaccgcacctgaagcactgagggaaaagaaattcagcaccaagagcgacgtgtggtcatttggcattctactctgggaaatatattcgtttgggcgcgttccttacccacgaatcccattgaaggacgtagtgcctagagtggaaaagggttataagatggatgcgcctgacgggtgcccacccgctgtgtacgaagtaatgaagaactgctggcatttggacgcagcaatgcgacctagcttccttcaactccgcgagcaactcgagcacatcaagacccacgagctgcacctctag

SEQ ID NO: 113232 - DNA, 1200 bp, Artificial Sequence
  Description of Artificial Sequence: Synthetic coding sequence
atgagcgctattcaagccgcttggccttcaggcactgagtgcattgccaaatacaattttcatggcacagcagaacaagacttgcccttctgtaagggtgacgtgcttaccatagttgcagttaccaaggaccccaattggtataaggcaaagaataaggtgggaagagagggcatcatcccggccaactacgtgcagaaacgtgaaggtgtcaaagctggaaccaaactctccttgatgccgtggttccacggcaaactctccattgacgaagaggtttactttgagaatctgatgcagttggtcgaacattatacctctgacgcagatggactatgtacacggctgatcaaaccgaaagtcatggagggcacagtagccgctcaggatgagttctaccggtccggctgggctttgaacatgaaggagctaaagctgcttcagaccattgggaaaggcgaatttggggacgtcatgctgggcgactaccgaggcaacaaggtggccgtgaagtgcatcaaaaatgacgcaacagctcaggcgttcttagcagaggccagcgtgatgacgcaactgcgccattctaatctcgtgcagcttctcggggtgattgtcgaggaaaaaggcggactgtacatcgttactgagtatatggcaaaaggtagcctggtcgattatctgcggtcaaggggccgaagcgtgttaggcggtgattgcttgctgaaattctcgctggacgtatgtgaagccatggaatatctggagggtaacaatttcgtgcacagagatctggctgcaagaaatgtattggtttcggaagacaacgtcgcaaaagtgagcgacttcgggctcacgaaggaagccagcagcactcaagacaccggaaagctacccgtcaaatggaccgctcccgaggccttgagagagaagaaattctctactaagagtgacgtctggagcttcggcattttactctgggaaatttacagctttggcagggtaccctaccccaggatccccctgaaggacgtggtgccgagggtcgagaaagggtataaaatggatgcacccgacgggtgtcccccggccgtctacgaggtcatgaaaaactgctggcatctggacgccgccatgcgtccgtcctttctccagctacgggagcagctggagcacataaagacccacgagttgcatctgtag

SEQ ID NO: 113233 - DNA, 783 bp, Artificial Sequence
  Description of Artificial Sequence: Synthetic coding sequence
atggtagccgctccctgggcaacacaggagcaagaagagggcagaggcatccagccaggtgacagaggcgatcagaagtccgctgcatcacagaagccaaggagccgggggatcttgcattctctgttctgttgcgtctgccgcgatgatggcgaagctctgcccgcacactccggcgcccctctgcttgtcgaagagaacggggccattccaaaaacccccgtgcaatatctcctcccagaggcaaaggcgcaggatagcgacaaaatttgtgtggtcatcgatctcgatgaaaccttggttcactcttcattcaagccagtaaacaacgctgacttcattatccctgtggagatagacggcgtagtgcaccaggtgtatgtgctgaaaagaccacatgttgatgaatttctgcagcggatgggagaactgtttgagtgtgtgttgtttactgccagcctggccaagtacgccgatcctgtggccgacctccttgacaaatggggcgcgttccgtgcaagactattccgcgagagttgtgtgtttcaccgcggcaactatgttaaagacctttcccggctggggagggacctgcgtagggttttgattttggacaactctccagcgtcttacgtattccatcctgataatgcagtgcctgtagcgagctggtttgacaacatgtcggatacagaacttcatgacctcttgcccttctttgaacagctcagccgtgtcgatgacgtgtatagcgtgcttaggcaaccgaggcccggctcatag

SEQ ID NO: 113234 - DNA, 2604 bp, Artificial Sequence
  Description of Artificial Sequence: Synthetic coding sequence
atggaagtcccggcagccggacgggtgcctgctgaaggggcgcccactgccgcagtggccgaagtacgatgtccaggccccgcccctcttcgcctactggagtggcgtgtggccgccggagccgctgtgaggatcggtagcgtgctggccgtctttgaagcagctgcctctgcccaatcgtctggagcttcacagtcccgagtcgcctcaggcggttgtgtgagacctgctaggcccgaacggagactgaggagcgagcgggccggtgtcgttcgggagctctgcgctcagccagggcaggtggttgcgcctggtgctgttctggtgaggcttgaaggatgttctcaccccgtggtgatgaagggactgtgcgccgagtgtggccaggacctaactcaactccagtctaagaatggaaagcagcaggtcccgctgtcaacagcaactgttagcatggtgcatagcgttccagaactgatggtaagttccgagcaggccgaacagctaggccgtgaagatcagcagaggctacatagaaatagaaagcttgtgctgatggtcgacttagaccagaccttgatccacacaaccgaacagcactgccagcagatgtcaaacaaaggaatcttccatttccaactgggcagaggcgagccgatgttgcacactcggctgcgaccccactgtaaggatttcctggagaagatagctaaattgtacgaactgcatgtcttcacatttgggtcgcggctgtatgcacacactattgccggattcctagaccctgaaaaaaagcttttttcccatagaattctgagtcgcgacgaatgcattgatcctttcagcaagaccggcaacctccggaacctgttcccttgtggcgacagcatggtctgcatcattgacgaccgagaggatgtatggaaatttgcgcctaatctaatcactgtcaagaaatatgtgtattttcagggaacaggagacatgaacgcacctcctgggagtagggagtcccagacaaggaaaaaagtgaatcactcacgtggaacggaggtgagtgaaccatccccccccgtgcgggacccagagggcgttacccaggctccaggtgttgagccatctaatggattggagaaacctgcacgtgaacttaatggcagtgaggctgcaacaccaagggatagtccccggccaggcaaaccggatgagcgcgatatctggcctcctgctcaggcccctacatccagccaggagctggctggggcgccagaacctcaagggtcttgcgcccagggcggacgagtggctcccggtcagagacccgctcaaggggcaacaggcacagacctagacttcgacctgtcttccgattcagaaagctcatccgaatccgagggcactaagagctcttcttccgcctcagacggagaatctgaaggcaagaggggacgacagaagcctaaggcagctccagagggggccggagcacttgcccaaggctcctccctggaacccggcaggcccgccgccccaagcctccctggggaagctgaaccaggagctcacgcgccggacaaggagcccgagctcggcggacaggaggaaggcgagagggatggactttgtggtctggggaacggctgcgccgacaggaaagaagccgagaccgagtcgcagaatagcgaactgtccggtgttacagccggcgagtctctcgaccagtccatggaagaggaagaggaggaggatacggatgaagatgatcatttaatctacctagaggagattttggtacgcgtgcacactgattattatgctaaatacgatcgttacctgaacaaggagattgaggaagcccccgacattcgtaagatcgtgcccgagttaaaaagtaaggttttggcagatgtggctatcattttctcggggctgcacccgactaattttccaatagagaagacgagagaacactatcatgctacagcactgggagcaaagattctgactaggctggtgttaagtcctgatgcgccagacagagcgacccacctaatcgccgcccgcgccgggactgagaaagtgctgcaggcccaagagtgcgggcacctacacgttgttaacccagactggctctggtcatgtctggagcgctgggacaaggtagaagaacaactgtttcctctcagagacgatcacactaaggcacagagggaaaattcaccagctgcttttcctgatcgggaaggggtgcctcccaccgccctgttccatcccatgcccgtactccctaaggcccaacctgggccagaggtgagaatctacgactccaacacaggtaagcttattagaaccggggctagaggacccccagcgccctcctcttctctgcccatccgccaggaaccctcaagctttcggtggaccactagtcttgagaaggcagccacaacagcaaccgcccggaggggtggcctccgcagtaggcggaggagtcccagcccgggtagtcagggtcctgccggcagcggacgatctggacaccttcgacccgccagaggtgcgcgacaaggcgccgggggccctgaagccactagaggctcatag

SEQ ID NO: 113235 - DNA, 2886 bp, Artificial Sequence
  Description of Artificial Sequence: Synthetic coding sequence
atggaagttccggctgctggcagggtgccagcggagggggctcctacagccgcagttgccgaagtccgctgccccggccctgcaccgctgcgtctcctggagtggcgtgtggccgccggcgctgccgtacgcattgggtccgtgctggccgtattcgaagcggctgcatctgcccaatctagtggagcaagccagtcacgggtcgcttcagggggttgtgtgaggcctgcaagacccgaacgacgactgagatcagaacgcgcaggcgtggtacgggagctctgtgcgcagcccggacaggtggtggctccgggggccgtactggtgaggctcgaagggtgcagccatcctgtggtgatgaaaggtttatgcgctgaatgcggccaggacctgactcaattgcagtctaaaaacggcaagcagcaggtgcccttaagcactgccaccgtcagtatggtgcacagcgtgccagagctgatggtgagttcagagcaggcagaacagctaggcagagaagaccaacagaggctgcacaggaataggaagctcgtgctgatggtcgacctggatcagaccctaatccacactacagagcagcattgccagcagatgtcaaataaaggaatcttccacttccagctcgggaggggggaaccgatgctccataccagacttagaccgcattgtaaagacttcctggaaaaaattgctaaactgtatgagctacacgtctttacctttggaagtcgactatatgcacataccatcgccggttttttagatcctgagaagaagttattcagccaccgaattctctcaagagacgagtgtatcgatccattttcaaaaacgggcaacttaagaaatctgttcccatgcggcgattctatggtatgcattattgacgatagggaggacgtctggaaattcgcccccaacctgatcacggtaaagaagtatgtctactttcagggaactggggatatgaatgccccaccggggtctcgcgagagccagacgcgcaaaaaggtgaatcactccagagggactgaggtcagcgaacccagtccccccgttcgagaccccgaaggggtgacacaggcgcccggtgtggagccgtcaaatggcctcgaaaaaccggcgcgagaactgaatgggagtgaggccgccacaccccgtgattcccctcgtccaggcaaaccggatgagcgggacatatggccaccagcccaggctcctacttcgtctcaagagctcgcaggagccccggagcctcagggctcttgcgcccagggaggcagagtcgcacctgggcagagacctgcacaaggagccacaggtacagatctggatttcgacctgtcctcagattcagaaagcagcagcgaatcggaagggaccaagtcttccagcagcgcctctgacggcgaatccgaggggaagagagggcggcagaaacccaaggcggcgccggagggagctggggctctggctcaaggttcatctctggaaccagggagaccagcggccccctcgttgccgggcgaggcagagcccggggctcacgccccagacaaggagccagagctgggcggacaagaggaaggggagagagacggactgtgcggactgggaaatggatgcgctgatcgtaaggaggctgaaaccgagagtcaaaatagcgagctctccggtgttacagcgggggagtccctggaccaatcgatggaagaggaggaggaagaggacactgatgaggacgatcaccttatatatcttgaagagattctcgtccgtgttcacacagattactacgcaaaatatgataggtacctgaacaaggagattgaggaagctcctgacatccgcaagatcgtccctgaacttaaatcaaaagtgctcgccgacgtggctatcatcttttctgggttgcaccccacaaacttccccattgaaaagacgagggaacattaccacgccaccgcgctcggcgccaagattctgactcgactcgtccttagccctgatgccccagatcgcgcaacacatctgatcgcagcaagggccggcacagagaaggtgcttcaggcacaggagtgcggacatctgcatgtcgtgaatcctgactggttgtggtcgtgtttggaacggtgggacaaggtggaagagcagctcttcccattgcgggatgaccatacgaaggcccagagagaaaatagtcccgctgctttccctgatcgcgaaggagtcccccccacggctctgttccaccccatgccggtactgccaaaggcccaacctggaccagaagtgagaatttacgattctaatactgggaagctcatccgaactggggctaggggcccgcctgcaccgtcaagctcgctacccatacggcaggagccgtcatctttccgagctgtccccccaccccaacctcagatgtttggggaggagttaccagatgcacaggacggggagcagcctggcccttctcgtcggaaaagacagccgagtatgtcggaaacgatgcctctgtatacactgtgcaaagaggatctggaaagtatggacaaggaggtcgatgacatcctgggtgagggaagcgacgactccgattctgaaaagcggcgccccgaggaacaggaggaggagccgcagccacggaagcctggaactagacgcgaacgtaccctaggcgcacccgctagcagtgaaagatctgcggccggcggaagagggccaagggggcacaagcgcaaactcaatgaggaggacgctgctagtgaaagttctcgagaaagttctaatgaagatgagggttcttctagcgaggcggatgagatggcgaaggctctggaagccgagttgaacgatttgatgtag

SEQ ID NO: 113236 - DNA, 786 bp, Artificial Sequence
  Description of Artificial Sequence: Synthetic coding sequence
atggatagctctgccgtaattacccagattagtaaagaggaggcccgcggccccctgaggggaaagggcgatcagaaaagcgccgccagccaaaaaccccggagtcgtggtatcttgcattctctgttttgttgcgtctgccgggacgacggtgaggcactaccagcccatagcggagcccccctcctcgtggaggaaaacggtgccataccaaaacagacgcccgtgcaatatctgctgccagaggccaaggctcaggatagcgataagatctgtgtggtgatcgacctcgatgagaccctcgtccactcctccttcaaacccgtgaataacgctgacttcataattcctgtagagatcgacggcgtggtgcatcaggtctacgtattgaaacgccctcatgtcgacgaattcctccagaggatgggggagctgttcgagtgtgtgctatttaccgccagtcttgccaagtatgctgaccccgtagccgacctgcttgataagtggggcgcgttccgcgcgaggctcttccgagaatcgtgtgtcttccataggggcaattatgtgaaggatttgagcagattgggccgggatctgaggcgtgtcttaattcttgacaacagccccgcctcttacgtgttccatcccgataatgctgtccccgtagctagctggtttgataatatgtcagatactgagctacatgatctgctccctttctttgaacagttatctagggtggacgatgtgtactcagtgttgagacaacccaggcccggtagttag

SEQ ID NO: 113237 - DNA, 2928 bp, Artificial Sequence
  Description of Artificial Sequence: Synthetic coding sequence
atggaagattacgaacaggaactttgcggcgtagaggatgattttcacaaccaatttgcggccgagttggaagtacttgcggagctggagggagccagtactcctagcccgtctggtgtcccactctttaccgccggacgacccccaaggactttcgaagaagcccttgccagaggtgatgccgctagctcaccagctccagctgcgtcagtggggtctagccagggaggggcccggaagcgacaggtggatgcggatctgcagccagctggatctctgccgcatgccccaagaatcaaacgtccacgcctacaggtcgtcaaacgtctgaacttcagatccgaagagatggaagagcctcctcctccggattcttcacctacagacattactcctccgccctcacctgaggatctggccgaactgtggggccatggggtgagtgaggcggccgctgatgtaggactcacacgggcttcccccgcagctagaaacccggtgctaagacgaccacctattctggaagattatgtccacgtgacgtcgacagagggcgtcagagcctatcttgtccttagggcagacccaatggctccgggggtgcaaggttccttactgcacgtgccctggagaggaggaggtcaattggacctgctaggagtttctctcgcgtccctaaaaaagcaggtcgacggggaaaggcgggaaagactactgcaggaggctcagaagctctccgacacattgcattctctccggtccggcgaagaggaagccgcacagcctctgggagcccccgaggaggaacctacagatgggcaggatgcgtcttcacactgcctgtgggtcgacgagtttgcgccgaggcattatacggaattactcagcgacgactttacaaaccgctgcttactcaagtggcttaaattgtgggacctcgtggtgtttggacatgaaagacccagtcgcaaaccaagaccttccgtggaaccggcccgggttagcaaagaggcgactgctccaggaaaatggaagtctcatgaacaagtgctagaagaaatgctcgaggcaggccttgaccccagccagcgcccaaaacagaaggtcgccttgctgtgtggtccacccggactcggcaaaacaactctggcacacgtgatagctcgccatgctggctattcagtggtcgagatgaatgcctcggacgacaggtccccggaagtgttccgcactcggatcgaggccgcaacccagatggagtcagtgttaggagcgggtgggaagcctaattgcttagtgattgacgagattgatggcgccccggtagccgcaataaatgtgctgctgagcatactgaacaggaaagggcctcaagaggtgggaccgcagggcccagccgtgccttcaggcggcggcagaagacgaagggctgagggcgggctgctaatgaggccaatcatctgtatttgtaacgaccagtttgccccctcactgcggcaactcaagcaacaagctttcctgctgcactttcctcccactctaccctccaggttggttcagaggcttcaggaggtatccctcaggcagggcatgagggccgacccaggtgttttggcagccctatgtgaaaaaactgacaacgatatcagggcttgtattaacaccctgcagttcctatacagccgggggcagcgggaattgtctgtgcgtgatgtccaagctacccgcgtgggtcttaaagaccagcggcggggcctgttttccgtctggcaggaggtattccagctccctcgggcccagaggcgcagggtagggcaggaccccgcactgcccgcggataccctgttgctgggggacggtgatgcagggagcctaacttctgcatcccaacgcttttaccgcgtgcttcatgccgccgcctccgccggcgaacatgaaaaggtggttcagggcctgttcgataattttttgcgcctgcggctgcgcgactcctctttgggagctgtatgcgttgccctggattggctggcgtttgatgatttactggcaggcgcagcgcaccacagtcagtcctttcagctgctgagatatcccccttttttgccagtagcatttcatgtgctctttgcttcatctcacactcccagaattactttccctagtagccagcaagaggcccagaaccgtatgagccagatgcgcaacctgatccagaccttagtatcaggcatagctcctgccaccaggagtcgggcaactcctcaggccctgctcctagacgctttatgcctgctccttgatatcctcgctcctaagctgcgcccagtgtctacgcaactgtatagcacgcgcgagaagcagcagttggcatctctcgtgggtacaatgctcgcatactcccttacctatcgacaggagcggacgcccgatggccagtatatctaccggctggagcccaacgtggaagaactgtgtcggtttcctgaactccctgccagaaaaccactgacctatcagaccaagcaactgattgcaagagaaatagaggtcgagaaaatgcggcgcgcggaggctagcgcccgagtcgagaatagtccccaggtggacggttctcctcctggtctggagggtctgctagggggaatcggcgagaaaggcgtgcatagacctgcccctcggaaccacgagcagcggctagaacacatcatgcggcgtgccgcaagggaagagcagcccgaaaaggacttctttggaagagtggtcgtgagaagcacggccgtgccaagcgcaggcgatacagctcccgagcaggattctgtggagagacgaatgggaaccgccgtcggccggagtgaggtgtggtttaggtttaacgagggagtgagtaacgcagtgcgtagaagcctctatatcagggatttgctatag

SEQ ID NO: 113238 - DNA, 3555 bp, Artificial Sequence
  Description of Artificial Sequence: Synthetic coding sequence
atgcacgtgaacgcgtcagctaggaggtggggcagagggggagccgccgcactccccggcccggctgcttcgcctcgacgccccgctccccgcactggccctgttggtagaccaaccttagcgcctagtccctccagggcacatgctcatgccaagacgaacctgcttcctggccgggctgtacaggccccagatgcagtcccaggagcgggaagttcccgagcgccggcacggtggcgccccagagaccctggaagcagtgctcctgacgcttggcagagattccggcccgcgccactgagggcccagccccgtccccctccccgtccggctcctggcccaccacctccaaggaaggggggatgtggcggccagtggcgcgcgccgcaggacaggaccagaggcttacggtcccgtaatagcccccggccccctctggctcagccgcggttgaggcacgccaaccaatggcgggcccctcccggaactcctgccgccgactggcggagaccagcaagaagcgggcgtgccgtccgtgacggcgggggaggcgccggaggtagtgaacgagagcttggcttggcagacggcatggaggactacgagcaagagctctgtggagtcgaggacgactttcacaaccaattcgctgccgaactggaagttttggctgaactggaaggcgctagtaccccgtccccttccggcgtgcccctgttcaccgccggaaggcctccccgaacttttgaagaagcactggcaagaggcgacgccgcaagtagccccgcccctgcagcaagcgttggttcaagtcaaggcggcgccaggaaacggcaagttgatgctgatcttcagcccgcgggatcgttaccccacgcgcctcggatcaagcgaccacgacttcaggtggtgaagaggctcaatttcagaagcgaagagatggaggaaccgcctccccctgatagttctccgaccgatatcacaccacctccaagccctgaggatctggccgaactctggggtcatggcttttctgaggcagccgccgatgtgggcctcacccgggcctcccccgctgctcgaaaccccgtcctccgcaggcctcccattcttgaggactacgtgcatgtgaccagtaccgaaggcgtgcgtgcctatctggttctgagggcagacccaatggcgcccggcgtgcaggggtcactccttcatgtgccttggcgaggtggcggccagttagatctgctcggagtcagccttgcttctctgaagaaacaggtggatggggagaggcgggaacgactactgcaagaggcccagaagctaagtgatactttacaccggtctggggaggaagaggcagctcaacccctcggagcaccagaggaggagcccacagatggtcaggacgcttcctctcactgcctgtgggttgatgagtttgccccacgccattacacggaactcctgagtgatgactttacaaatcgctgcctgctgaagtggctgaagctgtgggacctcgtcgttttcggccatgaaagaccatcgcgaaaaccgagaccttcggtggaaccggctagagtctctaaagaggcaaccgctcctggcaagtggaagtcccatgagcaggtgctggaggagatgttagaggcaggtctcgacccgtctcagcggccaaagcagaaagtcgcactgctctgtggaccccctggactgggaaagaccacgcttgctcacgttatagcccgccatgccgggtacagcgtggtggaaatgaacgcatccgatgatagatcgcctgaggtcttccgtacgcggatcgaggcagcaacacagatggaaagcgttctaggcgccggagggaaaccaaactgcttggtcattgacgaaatagacggagcgcctgtggccgctatcaacgtgttgttgtcaatcctgaatcggaaagggccccaggaagtggggcctcagggcccggcagtgcccagtggcggcggacgtcggcgacgtgctgagggtggactgcttatgagacccatcatttgcatatgcaacgaccagtttgccccatcgctgcgtcaactgaagcagcaagcctttctcctgcactttccccccactctgccctccagactggtacagcgcttacaagaaggtatgcgtgccgaccctggggtcctcgcagcactgtgcgagaaaactgataacgacataagggcttgtattaacaccctgcagtttctctatagcagggggcagcgggagctatctgtgagagatgttcaagccactagggttgggctgaaagaccagcgccgaggattgttttcagtttggcaggaggtatttcaactgccaagggctcagaggtctagccagcacgtttccgtcctgacctgccatggcacacctggagacgctggtctcgtggtactgcaagatatgggagacgccggtctcgggctgtgggacgtgttactgctggcatggactcgtaggggcacctttcctggaagattctatcgcgtactgcacgccgccgcatcggctggtgaacatgaaaaagtggtgcagggattattcgataatttcctgcgtcttaggctgagggacagtagcctcggggccgtgtgtgtggcactagattggcttgcctttgacgatctgttggccggtgcagcccaccacagccagtcctttcagctgctccgataccccccttttctgcctgtggccttccatgtcttgttcgctagttcacacaccccacggattacgtttccaagtagccaacaggaagcccagaatcgaatgtctcagatgcgcaacctgatccagactctggtcagtgggattgcgcctgcaacccgctccagagcgacccctcaggccctattgctggacgcactctgtttactcctcgatatactcgctccaaaattgagacccgtgtcaacccagctgtactccacccgggaaaaacagcagctggccagcctagttggtaccatgctggcttattcactgacctaccgacaagagcggacacctgacggtcagtacatctacaggctggagcctaacgtcgaggaactgtgtcgcttcccagaactccccgcccggaagccactgacctatcagaccaagcagctgatcgcaagagagattgaagttgagaagatgcgtagggctgaagcaagcgcccgcgtagaaaacagtccacaggttgatggttcacccccgggcctggaggggctgctgggggggatcggagagaaaggcgtgcacagacccgcacctaggaatcacgaacagcgcctggagcatattatgagaagggccgccagagaagagcagccagaaaaggacttcttcgggcgagtggtcgtgagaagtactgcagtccctagcgcgggtgacactgccccagaacaggacagcgttgagcggaggatgggtacagcagtgggtcgttcagaggtctggttccgatttaacgagggagtgagtaacgctgtgaggaggagcctgtacatccgcgacctgctgtag

SEQ ID NO: 113239 - DNA, 3012 bp, Artificial Sequence
  Description of Artificial Sequence: Synthetic coding sequence
atggaggactacgaacaggaattgtgcggagtggaggacgattttcacaaccaattcgcagccgaactggaagttcttgctgagctcgaaggagcgtcgactccaagtccaagtggcgtgccactctttacagctggacgacccccccgaacattcgaggaggcgctcgcaaggggcgacgctgctagtagtcccgctccagccgcttctgtcggatcgagtcagggcggcgctagaaagaggcaggtggatgccgacctccagccagccggttctctaccacacgggcgcttagccgcgctcccacagggcctaagaagcggcagagaagctgaggaggcctccggatcactacacgtcagtcctcctgcgcctaggataaagcgcccccgcctccaggtggtgaagagactgaactttcggagcgaagaaatggaggagccgcccccccccgacagttctcccaccgacattaccccaccccccagccctgaggacctcgccgaattgtggggccacggcgtatcagaggctgcggcggatgtgggtctgacccgtgctagtccggctgctaggaatcctgtgctgaggcgaccacctatcctggaggattacgtgcacgtgactagcaccgagggcgtacgcgcctacctcgttctgagagccgacccaatggcaccaggggtccagggaagtctgttacacgtcccctggcgagggggcgggcaattagatttactgggcgtgtcactggcctcgctgaagaaacaggtcgacggcgagaggcgcgagcgactgttacaagaagcacagaagttgtcagatactcttcacagccttcgaagcggagaggaggaggccgctcagccattgggagcccctgaagaggaaccaaccgacggacaagatgcctctagccactgcctgtgggtcgacgaattcgctcctcggcattatacagagttactatccgatgattttaccaatcgatgccttctgaagtggctgaagctgtgggatttagtcgtctttgggcacgaacgaccttcccggaagccacgcccctctgtagagcccgcacgcgtatctaaggaagccaccgcccccggcaagtggaagtcacacgagcaggtcctggaagaaatgctcgaggccggtcttgaccccagccagaggccaaaacagaaggttgcgctgctctgcggtccaccggggctgggcaagacgaccttagcccacgtgattgcccgtcacgccggctatagcgtggtggagatgaacgcctccgatgaccgctcccctgaggtgttccgcacacgcatcgaagccgccacccagatggagtctgtgctgggcgcagggggaaagccgaactgtctggtgattgacgaaatagacggcgcacccgtggcagcaattaacgtactcctgtccattctgaatcgtaagggccctcaggaagtcggaccccaaggacctgctgtccctagtggcggtgggcggaggaggagggccgagggcggattactaatgcgtcccattatttgcatttgcaacgaccagtttgccccctcactgaggcaactgaaacagcaagcctttcttttgcatttcccccccacgctaccctcgcgcctggtgcagcgccttcaggaagtgtcactgaggcagggcatgcgcgcagaccctggagttctggctgctttgtgcgagaaaacagacaatgacatcagagcgtgtataaatacactccagttcttgtatagtcggggccaacgcgaactctccgtgcgagatgtccaggccactcgcgttgggctcaaggaccagcgcagggggctgttcagcgtgtggcaggaggtatttcagctgcctcgggcccagcgccggagggtcggccaggaccccgctttgcctgccgacaccctgctgctgggggacggagatgccgggtctctgacatcagcttctcagcgcttctatagggtactccatgccgccgctagcgctggcgagcacgagaaagtagttcaagggctgttcgataacttccttagattacggttacgggacagtagcctgggggcagtgtgtgttgccctggactggcttgcatttgatgacttgttggcaggggctgcacaccattctcagtcatttcagctgttgagatatccgccttttctgccagtggcctttcatgtgctgttcgcttcttcacacactcctcggataactttcccttcctcacagcaggaagcccaaaaccgaatgtctcaaatgagaaacttaatacaaaccctagtctcaggcatcgcccctgccactcggagccgtgccactccacaagctctgttgctggatgcactgtgcctgctgcttgatatcctcgcccccaaactgcgcccagtctctacccagctgtatagcaccagggaaaagcagcagcttgcgtcccttgtcggaaccatgttggcctacagtctcacttaccgccaggagcggactcctgacgggcaatacatttatcggctggagcccaacgtggaggagctctgcagatttcctgaactgcctgcacgtaagccgctcacataccaaactaagcagctgatcgctcgggaaatagaggtcgaaaagatgagacgtgccgaggccagtgcaagagtggaaaactccccgcaggtggacggatcccctcccggactggaaggacttctgggtggcataggagaaaagggggtgcatcgccctgcgccacgcaaccacgagcagcgcttggaacatatcatgcgcagggctgcaagggaggagcagcccgaaaaagattttttcgggcgagtcgtggtccgctccacagctgtacctagcgccggcgacacagcccccgaacaggactccgtggagcgccgcatgggcactgctgtcggcaggtccgaggtttggtttagatttaatgagggcgtcagtaacgcagttagacgtagtttgtacatccgggacctgctctag

SEQ ID NO: 113240 - DNA, 1575 bp, Artificial Sequence
  Description of Artificial Sequence: Synthetic coding sequence
atgaaggagccaaggatcttcccacgcgagaggccaactccatggaccagggcccctttacctccccgtggaagactcgatggaagccttggcccccaaggcgggcccgttcttaacaccggacatcccctaggggttaacagcgacccgtttttgatggccgccggcagtctggggggtaacttgaccccctttccccgtaaccctagccccttcccagcttctagtggtagcttggccagtaacccagcaccctttcccgccggcgctcgtgacccaagcatggcctcgttcccacgggggatgaaccccacggggaccggtgcggtaagctttccccgcccgggagggctcctgggacctgggcccggcccaggtcctacgctgaaccctaggacgggggccttgcccggccccggtcctctctctaacccccggttggggggactccccggccccggcccaatgagtaaccctagagcggggggactcctgggcgcgggccctgacccccggggaggcggccccatgggaccaggatccgggcccaatttaagagccggggtgttgttgacatctggtaatggtccgccaaatccaagacctgtgggtctaggcccaggcccaaatccaaacctgcgatctgggttccttggaacaaacccagctccgcggtcgggtgtgttccccggccccggactggggcccaatccacgcccctcagggctgggcccagggcctaatctggatgcccgggctgggggccttcttggcacaggtagcggcctcaatctacgaatggcaggcccccagggtctggatttagctcccatacttcgggccgcaggtctcctcggtgccaattccgcctctttctctcaagcctccgggaacatgggcactagcccttcttcgatggccagggtgccaggtccaatggggcccaactccggtccatcatcgcgcgggattgggcttcctggcccaaacccatctcctatgtcccgggcgccaggacccatcggtcccaactccgcccatttcagcaggcccgtggggccaatgggcgtaaacgctaacccatttcctcgaggcgctggatccagtgccttctcacaaagtagcggaacattagcttcaaatcccgctacattccagaggagtgctggactgcaaggatccaaccccaccatatttcctcgggcatctggtccacttggccccaatcctgccaactttccacgggccaccggcctgcaggggccgtcgccgacgaccttccccaggagcactggaccacttgggccgggccaggttacttttccacggccagcggctgggcacctaggaccatctcctgcaggcccagtaggcattaaccctgcgccatttaccaggcctaccggcacactgggcctgaatcccgcttcatttcctcgaatgaacggacccgccggcaaatcctttgtgcccttcccacgggttggcagtctgcccggaactaatcccgccgcgtttccacgaccaggtggtccaatggccgcgatgtaccctaacggcatgctccccccctag

SEQ ID NO: 113241 - DNA, 366 bp, Artificial Sequence
  Description of Artificial Sequence: Synthetic coding sequence
atggtgcagatcgttatctctagtgctagagccggcggtctggccgagtgggttctcatggagttacaaggcgaaattgaagcccggtattcgaccgggctggcagggaacctcttgggggatctgcactacactactgagggcatcccagtactcatcgttggtcatcacatactgtacgggaagattatccacctggagaagccctttgcagtgttggtgaaacatacacctggagatcaggattgcgatgagcttggaagagaaacaggtacacggtacctggtcacagctctaattaaagacaagatcctctttaaaacaagacccaagccaattatcacaagtgtgcctaagaaagtttag

SEQ ID NO: 113242 - DNA, 366 bp, Artificial Sequence
  Description of Artificial Sequence: Synthetic coding sequence
atggtgcagattgtgatctcaagcgctcgggctggcggtcttgcagaatgggtcctcatggagcttcagggcgaaattgaagcacggtatagcacagggctggctggcaacctcctaggagaccttcattacaccacggagggaatcccagtgctcattgttggacaccatattttatatgggaaaatcatacatctggagaaacccttcgccgtattagtgaaacatacacccggggatcaggactgcgatgaactcggccgagagacaggaactcgctatctcgtgaccgcactgataaaggataaaattctgttcaagactaggccgaaaccaataattacctctgtgccaaaaaaggtgtag

SEQ ID NO: 113243 - DNA, 1776 bp, Artificial Sequence
  Description of Artificial Sequence: Synthetic coding sequence
atgaaatacattctggttacagggggggttatctcagggataggcaaaggtattatcgccagttccgtcggtaccattttgaagagctgcggcctccacgtgacctcaataaagatcgatccttacattaatattgatgcaggcactttctccccctatgaacacggcgaggtattcgtgctcgatgacggaggggaagttgacttggacctaggtaactacgaacggttccttgatattcggctgactaaggacaacaaccttacaaccggaaaaatttaccagtacgtcatcaacaaagagcgaaaaggggactatctcggcaaaacagtccaagtggtgccccatatcactgacgctattcaggagtgggtgatgagacaagcgttaataccggtagacgaagacggcctggagccgcaggtctgcgtcatcgaactgggagggaccgtgggtgacatcgagtccatgccctttatcgaagcctttaggcaattccagttcaaagtaaagcgagagaacttctgtaatatccatgtgagcctggtgccccagccgagctctactggcgaacagaaaactaaaccaactcagaatagtgtgagagagctgagggggctgggtcttagccctgatctggttgtctgtaggtgcagtaatcccctggatacctccgtgaaagaaaagatcagcatgttttgccatgtagaaccagagcaggtcatttgcgtgcatgatgtatcatccatctatagggtgcctcttctcttggaggagcagggagtggtcgattactttctgcggcgactagacctgcccatagagcgccagccaaggaaaatgttgatgaagtggaaggagatggccgatcgctacgatcgattactcgaaacctgttctattgctttggtgggcaagtatacaaagtttagcgatagctatgcttctgtaattaaagccctggagcactccgccctggccattaatcataaactggaaattaaatatatcgacagtgccgatttagaaccaataacatcccaggaggagccggtgcgttaccacgaagcttggcagaaactgtgttctgcacacggcgtactggttcctggtggattcggagtgcgggggacagaggggaaaatccaggcaatcgcctgggcacgcaatcagaaaaagccattcttaggtgtgtgtctggggatgcaactggccgtggtagagttcagtagaaatgtgcttggctggcaagatgccaactccacagagttcgatccaacaacctctcacccagttgtagtagatatgcctgagcataacccgggccagatgggaggaaccatgcggttaggaaagagaaggaccctgtttcagacaaaaaactcagtgatgaggaaactgtacggagatgcagactatcttgaagagagacaccgccacagatttgaagtgaatcccgtctggaagaagtgcttagaagaacagggactgaaatttgtcggccaggacgtggaaggcgaacggatggaaatcgtggaactggaggatcaccccttttttgtgggcgttcagtatcaccctgaattcctgtcccggcccattaagccttcaccaccatatttcggcctccttttagctagcgttgggcgactgtcacattaccttcagaaaggttgcagactttctccgcgcgacacctatagtgaccggtctgggagcagctctccagactccgaaattacagagctaaaatttccctccataaaccacgattag

SEQ ID NO: 113244 - DNA, 1776 bp, Artificial Sequence
  Description of Artificial Sequence: Synthetic coding sequence
atgaagtacatccttgttacaggtggagtaatcagcgggattggaaaaggcatcatcgcctcctccgttgggacgattttaaaatcttgcggactgcacgtcacatccattaaaattgacccttacatcaacatcgacgcggggacattcagcccttatgagcacggggaggtcttcgttctcgacgacggcggggaggttgatctggacctggggaactacgagaggtttctggacatacgcctgaccaaggataacaacctaaccacaggcaagatctatcagtatgtgataaacaaagagcggaaaggagactacctgggaaagaccgtgcaagtggttccacatattacagatgctatccaggaatgggtgatgcgccaggctctgatacctgtggacgaggacgggttggagcctcaggtctgcgtgatcgagcttggagggacagttggagatattgagtcaatgccctttatcgaagcattcagacagtttcagttcaaggtgaagcgggagaatttttgtaatattcacgtctctttggtcccacagccatccagtaccggcgaacagaagaccaaacccacgcagaattctgtgcgggaactgcggggactgggtctgtcaccggacctggtagtatgtaggtgcagcaacccactagatacttccgtcaaagaaaaaattagtatgttctgtcacgtagaacctgaacaggtgatttgtgtacacgatgtgtcatctatctaccgcgtacctttactgcttgaagagcagggcgtcgtcgactactttttgagaagactcgatctaccgatcgaacgccaaccgagaaaaatgttgatgaagtggaaagagatggccgaccgttacgaccgactgctcgagacatgcagcatcgcactggtgggcaagtacaccaaattcagcgactcgtacgcttctgtcattaaagcattggaacactccgctttagccattaaccataagctggagattaaatacattgactcggccgacctagaacctattacatcccaggaagaacctgtcaggtatcacgaagcctggcagaagctctgttctgcacatggcgtcctcgttccaggggggtttggggtgcgagggacggaaggtaaaatccaggctatagcatgggcgcgaaatcaaaagaagccatttctcggcgtgtgcctgggcatgcaacttgctgttgtggaattttctcgtaacgtgcttggctggcaggatgccaactcaaccgaattcgacccaacgacaagccaccccgtcgtcgtcgatatgcccgaacacaatccagggcagatgggaggaacaatgcgcctcggaaaaaggcggactctgttccagactaagaacagtgtcatgagaaagttgtatggggatgctgattatttggaggaaagacaccggcaccgattcgaagtcaaccccgtttggaaaaagtgcttagaagagcagggtctgaaatttgtcggccaagatgtagaaggggaacgcatggagatcgttgaactggaagaccaccccttttttgttggagttcagtatcatccagagtttttatcacggcctatcaaaccatctccgccctactttggattgctgctggcgtccgtcggacgcctcagccattatctgcaaaaaggctgccggttatcgccaagagacacctacagtgatcgctcgggaagtagctctcccgacagtgaaatcaccgagctgaaatttccatccatcaaccacgattag

SEQ ID NO: 113245 - DNA, 1083 bp, Artificial Sequence
  Description of Artificial Sequence: Synthetic coding sequence
atgttctgccacgtggagcctgagcaggtcatctgtgtgcatgacgttagctccatttatagagttcccctgctgttagaggagcagggagtcgtggattatttcctgcgccgcttagatctgcctatcgagcgacaacctcgaaagatgctcatgaagtggaaagaaatggcagataggtatgaccggctcctggagacgtgcagtattgccctcgtgggcaagtacactaagtttagtgatagctatgcctcagtgatcaaggctttagagcatagtgccctggctatcaaccataagcttgaaattaagtatattgactcggcagacctcgagccaattactagtcaagaagagcctgtcaggtaccacgaggcgtggcaaaaactatgttctgcgcacggagtcttggtcccaggcggctttggagtgcgaggaaccgagggaaagattcaggccattgcatgggcgcggaaccagaagaaacccttcttgggcgtctgtctgggcatgcagctcgccgtggttgagttcagccgaaacgtgctgggctggcaggacgccaacagtactgagtttgaccctacaactagccatccagttgtcgttgacatgccagagcataatcccggtcaaatgggtggcaccatgaggcttggtaaacggcggacactgttccagactaaaaacagcgtgatgaggaaactatatggagacgccgattacctggaagagaggcacagacaccgcttcgaggtgaatcctgtttggaagaagtgtctcgaggagcagggcctgaaattcgttggtcaggatgtggagggagagaggatggaaatcgtagagctggaagaccatccgttcttcgttggggtgcagtatcatcctgaattcttgtccaggcccatcaagcccagtccaccgtatttcggtctgctgctggcttcggtggggaggctttcccactatctccaaaagggttgcagactgtctccacgtgatacctatagtgaccggagcggtagttcaagccctgacagcgagataaccgaacttaagttcccttctatcaaccacgactag

SEQ ID NO: 113246 - DNA, 945 bp, Artificial Sequence
  Description of Artificial Sequence: Synthetic coding sequence
atgcccaaatctaaaagcaagatgaaatatattctcgtgacaggtggcgtgatttccgggattgggaaaggaattatcgccagctcagtggggacaatccttaaaagctgtgggctccacgtcactagtattaaaattgatccatatattaatattgatgccggtactttctctccctatgagcacggtgaagtattcgtcctcgacgacggtggggaagtggacctggatcttgggaattatgagaggttcttagatatcagattgaccaaggacaacaacctcacaaccggcaagatctatcaatatgtcattaacaaggagcgaaaaggcgattacctggggaagacagtccaggtggtgccacacatcaccgacgctattcaggagtgggtcatgaggcaggccttgattcccgtagatgaggacggtctggagccgcaggtatgcgtcattgagctgggcgggacggtgggggacatagaatcaatgccttttattgaagctttccggcagttccagtttaaggttaaacgagaaaatttttgcaatattcacgtatccctagtaccacagcctagcagcacgggtgaacagaaaactaagccaacccagaactccgtgcgcgagcttcgcgggctagggctgtctcctgacctcgtggtctgccggtgctcgaatcccctggacacttcagtgaaagaaaagatatcgatgttttgccatgtggagcccgaacaggttatttgtgtccacgatgtctccagcatctacagggtgcccctactgctggaagaacagggcgttgtcgactatttcttgagaagactggacctgcctatcgagagacagccgcgcaaaatgcttatgaagtggaaagaaatggccgataggtttgcttgcaatgaggagctcggcgttctcgcgagctttacactgctttag

SEQ ID NO: 113247 - DNA, 1761 bp, Artificial Sequence
  Description of Artificial Sequence: Synthetic coding sequence
atgaagtatatcctggtgacaggaggcgtgatctccggcataggtaagggcattattgccagctccatcgggaccattctgaagtcatgtggcttgagagtaacggccattaagatcgatccatacattaacatcgatgccggaacattctccccctatgagcacggagaagtgttcgtgctgaacgatggcggggaggtggacctcgacctaggcaactatgagcggttcctcgatattaatctgtacaaagacaataatataaccactggcaagatttaccagcacgttattaacaaggagagacggggcgattacttgggaaagacagtgcaggtggtcccgcacatcaccgatgccgtgcaggagtgggtgatgaaccaggccaaggttccagtggatggcaacaaggaggaaccacagatttgtgtgatcgaactcggaggaacgattggagatatcgaaggaatgcctttcgtcgaggcattcagacagttccaattcaaagcaaagcgggagaacttctgcaatattcacgtgagcctggtgcctcagctttcagcaaccggtgagcagaagacaaagccaactcagaacagcgtacgtgctctcagaggtttaggcctaagcccagatctcattgtctgccgaagctcaacacctatcgaaatggcggttaaagagaaaatatctatgttttgccatgtgaatcccgaacaggtgatctgcatccacgacgtgagttctacctaccgggtgccagtcctgctcgaagaacaatccatcgtgaaatacttcaaggagcggctgcatctgccaatcggggatagcgcctcgaacctgctgtttaaatggagaaacatggccgatcggtatgagcgcctgcagaagatctgttcaatcgcccttgtcggcaaatataccaagctgcgcgactgttacgccagcgtgttcaaggccctggagcacagcgcacttgccatcaatcacaaactgaaccttatgtacatcgatagcatcgacctggagaaaatcacggagactgaggaccccgtcaagttccacgaagcctggcaaaagctctgcaaagccgatgggatcctggttcctggcggatttggtattcgcggcacccttggcaaactgcaggcaatatcttgggctcgcactaaaaagatcccgttcctgggcgtgtgtcttggcatgcagcttgccgttatcgaattcgcccgtaattgccttaacttgaaggacgccgactcaactgagtttcgccctaatgcccctgtgcctctggtcattgacatgccggagcataaccctggtaacctgggcggtacgatgagacttgggatccgcaggacagtttttaagaccgagaattccattctacggaaactctacggagacgtccctttcatcgaggaacgacaccggcacaggtttgaggtgaacccgaacttgattaaacagtttgagcagaacgacctgtctttcgtggggcaggacgtcgacggtgacaggatggagattatagagttagctaatcacccatactttgtgggcgtgcagttccatccggagttttccagccggccaatgaagccttcaccaccgtacctgggacttctgctggccgccacaggcaacctgaacgcttatctgcagcaggggtgtaaactaagctcttcagaccgttacagtgacgctagcgatgactccttttcagagcctaggattgcagaactcgaaatctcttag

SEQ ID NO: 113248 - DNA, 531 bp, Artificial Sequence
  Description of Artificial Sequence: Synthetic coding sequence
atgtacattgattccatcgatctggaaaagatcacagagacagaagaccccgtaaagtttcacgaggcatggcagaaactgtgcaaggccgacggcatcctagtcccaggagggtttggcattagaggcaccctgggcaagctgcaggccatctcttgggccagaaccaaaaaaattccctttttaggtgtgtgtctggggatgcagttagctgtgatcgaattcgcccgcaactgtctgaatttaaaggacgcagactcaaccgagtttagacctaatgcccccgtgcccctcgtaattgacatgcctgagcataatcccgggaatctagggggaactatgagattgggtatacgacgtacggtctttaagacagaaaattcaattctgatttctctctcacttggactggccagcgtggagcacactgagtgccctagcgcctttgacctgcgcgacagtctgtttattggtttgttttgtgagctgcctatgttgcttgaaatgaatctggactgggacctggattag

SEQ ID NO: 113249 - DNA, 1761 bp, Artificial Sequence
  Description of Artificial Sequence: Synthetic coding sequence
atgaagtacatcctcgtcacaggaggcgtgatcagcggaattggcaagggcatcattgcatcaagcattggcacaatcttaaaatcatgcggtttgcgcgtgaccgccatcaaaatagatccgtacataaacattgacgctggcacctttagtccatacgaacacggggaggtgttcgtccttaacgacggaggtgaagtggaccttgatctgggaaattacgagaggtttctggatataaatttatacaaggataataatattaccactggcaaaatataccaacacgtgatcaacaaggagcgacggggcgattacctgggcaagaccgtgcaagttgtgccccatatcaccgacgccgtgcaggaatgggtgatgaaccaggctaaagtgcccgtggacggaaacaaagaagaacctcagatctgcgttattgaactgggggggaccattggagacatcgaagggatgccgttcgtcgaagccttcaggcaattccagttcaaggccaagagggagaacttttgtaatattcatgtttctcttgtgcctcagttaagcgctacgggcgaacaaaagacgaaacccacacagaattcggttagagcactccggggactggggctgagtccggacctcatcgtttgcaggtcatccacacctatcgagatggctgtgaaggaaaaaatcagtatgttctgtcatgttaaccccgagcaggtgatttgcattcatgacgtctcaagtacctacagagtgccggtcttgttggaggagcagtctattgtcaaatacttcaaagaacgactccatctgccaatcggcgattccgccagcaatcttttgttcaagtggcgaaacatggccgatagatacgaaaggcttcagaagatttgtagcatagccctcgttgggaaatacactaaactgagggattgttacgcttcagtgttcaaagccctggagcactccgctctggccatcaatcataaacttaatctgatgtacattgactcaattgacttagaaaagattacagagaccgaagacccagtgaagtttcatgaggcatggcagaagctttgcaaggctgatggtattcttgtccctggcgggtttggcattagggggacactcggcaaactgcaggctatctcttgggcccgcactaagaaaataccttttctgggcgtgtgtctgggcatgcagctcgcagtgatagagttcgccaggaattgtctgaacctcaaagacgctgattctactgaattccggcctaacgctcctgtaccgctcgtcatcgacatgcccgaacacaacccgggtaaccttgggggcaccatgcgcctgggaatccgccggactgtttttaagacagagaatagcatcctacggaagctatatggagatgttccatttattgaagagagacaccgccacaggttcgaagtcaaccccaatctcataaaacagtttgaacagaacgacctcagctttgtggggcaggacgttgatggcgataggatggagattatcgagctcgcgaaccacccctattttgtgggggtgcagtttcatcctgaattctccagcagacctatgaaaccgtctcctccgtatctgggattacttctggcggcaactgggaatctgaatgcctatctgcaacaggggtgcaagctgtcgtctagcgatcggtattctgacgccagcgacgactccttctccgagcctaggatcgcggagttggagattagttag

SEQ ID NO: 113250 - DNA, 1761 bp, Artificial Sequence
  Description of Artificial Sequence: Synthetic coding sequence
atgaaatacatcctggtgaccggtggggttatatcaggcatcggcaagggaattatagcatcaagcatcgggactattttaaaatcatgcggccttagggtgactgctatcaagattgacccatacatcaatatagacgctggaacattttccccttatgagcacggggaagtattcgtgttgaatgatggcggggaggtagatcttgacctcggcaattacgagaggtttctagatattaatctgtacaaggacaacaatattacgacaggaaagatttatcaacatgtgatcaacaaagagcgcagaggcgactatcttggaaagacggttcaagtggtgccccacatcaccgacgcagtgcaggagtgggtgatgaatcaggcgaaagtccctgtcgacggaaacaaggaagaaccacagatttgtgttatcgaactgggcggcacaatcggggatattgaaggcatgccctttgtcgaggcctttcgccaattccaatttaaggcgaaacgagaaaacttttgcaacattcacgtctcgctggtaccacagctctctgccacgggcgagcagaaaacaaaaccaacacagaactcagtccgcgccctaaggggactcggcctttcccccgacttgatcgtgtgccgcagcagcaccccaatcgaaatggccgttaaagaaaaaatctccatgttctgtcacgttaaccctgagcaggtcatctgtatccatgacgttagttcaacttacagggttccagtgttgctcgaggagcagtccatcgtgaagtacttcaaggaacgcctacacctgcccattggggactctgcctctaatctcttgttcaagtggagaaacatggcggatcggtacgagcgccttcagaaaatctgcagcattgctctggttggtaagtatactaaactccgcgactgttatgccagtgtatttaaagccctcgaacattctgccctggcgatcaatcacaagttaaacttaatgtacatagacagtatcgacctcgaaaaaatcacggaaactgaagatccggtcaagtttcatgaggcctggcagaagctttgtaaagccgacggcattttagtacctggaggctttggcattagaggcacgcttgggaagcttcaggctatttcatgggcacgcacgaagaaaatacccttcctcggagtgtgtctgggaatgcagctcgcggtgatagaatttgctagaaactgcctgaatctcaaggacgccgattctacggaattcaggccaaacgctcctgtgccgctggtgattgacatgcccgaacacaaccccgggaaccttggggggactatgaggctcgggatccgacggacggtgttcaagacggaaaattctatcctgaggaagttgtatggagacgtcccgtttatcgaggagaggcaccgtcacaggtttgaagtgaatccgaatctcattaaacagttcgagcaaaatgacctcagcttcgtgggccaagatgtcgatggggatcgcatggagattatcgagctggccaatcatccttactttgtgggcgtgcagttccacccagaattctcttccaggccaatgaagccatcacccccttatcttggactgctgctggcggccaccggtaacctgaatgcctacttgcagcagggctgtaagctgagtagttctgacagatatagcgacgctagcgacgacagtttttcagagcctcggatcgcggagctggagatcagttag

SEQ ID NO: 113251 - DNA, 399 bp, Artificial Sequence
  Description of Artificial Sequence: Synthetic coding sequence
tagggcaaattacaagccatctcctgggctaggacaaaaaagatcccctttttgggggtgtgtttggggatgcagctggctgtcattgaatttgcccggaactgtttgaacctgaaggacgccgatagcactgagttccgccccaatgcgcctgttccactcgtgattgacatgcccgaacacaaccccggaaaccttggggggaccatgcgactgggcatccgaaggactgtatttaagaccgaaaactcgatcctcattagccttagcttggggctggcgtcagtcgaacatactgaatgcccttcggcgtttgacttgagagattccctgttcattggcctgttttgtgagctacctatgctgctggaaatgaacttggactgggatcttgactag

SEQ ID NO: 113252 - DNA, 3654 bp, Artificial Sequence
  Description of Artificial Sequence: Synthetic coding sequence
atggcagctggcagggcacaagtgccgagttccgaacaggcatggctggaagacgcgcaggtgttcatccaaaaaactctctgcccagctgttaaggagccgaacgttcagttaacccccctggtgatcgactgtgtcaagactgtttggttgagccaggggaggaaccagggctcaacactgcccctgtcttactcatttgtgagcgttcaagatctgaagacacaccagagacttccatgctgttcccatcttagctggagctctagcgcctatcaggcttgggcacaggaggcaggaccaaacggcaatcctctgccacgcgagcaattgctgctactgggcaccctcacggacctttccgccgaccttgagcaggagtgtaggaacggatctttgtatgtgcgcgataacacgggcgttctcagttgcgagttaatcgatctggacctgagttggcttggtcacctatttcttttcccaagatggagctacctgccaccggcccgctggaatagcagcggggaaggccacctggaactgtgggatgccccagtgccagtgttccctctgactatttcccctggtcccgtgacgccaatacccgtcctctaccccgagtccgcatcatgtctgcttcgactgcgcaacaaacttagaggcgtccagcggaaccttgctggcagcctcgtaaggctgtctgctttggtgaaatccaagcagaaagcttacttcattctaagcctgggtagatcccacccggccgtaacacatgtgtcaatcatcgtgcaggtgcctgcgcagctggtatggcacagggccctacgcccaggtactgcatatgtgcttacagagcttcgcgtgtctaagatccgaggtcagaggcagcacgtttggatgactagccagagcagtagattgctgctgctgaagcctgaatgtgtacaggagctcgagctggagttagaaggtcctctgctggaggcggaccccaaaccgctgcctatgccctccaattccgaagataaaaaggatcctgaatcccttgtgcgttactctagactgttatcctactctggcgctgttacaggcgtgctcaatgaacctgctgggctctacgagctagacggtcaactcggactgtgtcttgcctaccagcagttcagagggctacggagagtgatgaggccaggggtgtgtctgcaactccaagacgtgcacctgttgcaatctgtgggggggggtaccaggcgccccgtcctggctccctgtctcagaggggcagtgctcctgcagtcatttagccggcagaaacccggagctcactcaagcagacaggcatatggtgcatctctgtatgagcagctcgtgtgggagaggcagttgggtctcccattgtatttatgggcaacaaaggctttggaggaactggcctgtaagttatgccctcacgtccttaggcatcaccagtttctgcagcattctagcccaggatccccatctctgggcctccaacttctagcaccaacactcgacctgctggccccccctgggtcccctgtccgaaacgcccataacgaaattttggaggagcctcaccattgtccattgcagaagtatacacgccttcagacaccctcttcttttccaacacttgccacactaaaggaggagggacagagaaaagcttgggcgtcattcgatccaaaagcgctcctccctctgccggaagcctcctaccttccttcatgtcaactgaaccgtcggttggcttggtcatggctgtgcctgctccccagtgccttctgccctgcacaagttctcctgggagtgctagtggcaagttcccacaagggttgtttgcagcttagggaccaatccgggtccctgccctgccttctgcttgcgaaacactcccagccactctcagaccctagattaatcggatgcctcgtccgcgcagaaagattccaactgattgttgagagggacgtgagaagcagttttccctcttggaaagagctttctatgcccgggtttattcagaaacagcaagcacgtgtgtacgtccagttttttctcgccgatgccctgatcttaccagttcccaggccatgccttcatagcgccacccctagcacaccacagacagatcccacaggacctgaagggccacatttgggccagtcaaggttatttttgctatgccacaaagaagcgctgatgaaacgaaacttttgtgttccccccggggctagtccagaagtcccgaagcctgcattatctttttatgtgctgggttcttggcttggggggacacagcggaaggagggtacgggctggggcctcccagaaccacaaggaaacgatgataatgatcaaaaggtgcacctgattttctttggctcttcagtcaggtggttcgagttcttgcatcccggacaggtgtaccgcctgattgcacccgggcctgccactcccatgctgttcgaaaaggatggttccagttgcatcagcagaagaccactagagctggctggctgcgcttcatgcctgactgtccaggacaattggacactggaactcgagtcctcccaagacatccaggacgtactggacgccaacaagagcttgcctgaaagctccttgacggacttgctgagcgacaactttacagatagccttgtgagtttctccgccgagatactgtcccgcacactctgcgagccattggtcgcgtccctctggatgaaactgggcaatactggggcgatgcgccgatgcgtaaagctgactgttgcccttgaaaccgccgaatgcgagtttccaccccacctggacgtgtatatcgaggaccctcaccttccccctagtctcggcctgttacccggagctcgagtgcatttttctcagctggaaaaaagagtctcccgcagtcataatgtttactgttgcttcaggagttccacctatgtccaggtgctgtcattccctccggaaaccaccatcagtatccctcttcctcacatatatctcgcagagctcttgcagggggggcagtcacctttccaggccacagcatcctgtcacattgtgagcgtgttctccctccaattgttctgggtctgtgcctattgcactagcatttgtaggcagggcaagtgtacacggctgggctctacttgtccaacacagactgctattagtcaagccataatccgattgcttgtagaggacggaacggcagaggcagttgtgacatgccggaatcatcacgtagcagctgctttgggcttatgccccagagaatgggccagtctgctggatttcgttcaggttccaggccgggtggtcctgcagttcgccgggccgggagcacagttagagagctccgctcgagtagacgagcccatgacaatgtttctgtggactctttgtacatccccgagcgtgctgcggccaatcgtcctcagttttgagttggaaaggaagcctagtaaaatcgtaccattggagccgcccaggctacaaaggtttcaatgtggcgagttacctttcctcacacatgttaaccctaggctgcggctctcctgcctctctattcgtgagagcgagtatagctctagccttggcattctggcatccagctgctag

SEQ ID NO: 113253 - DNA, 3096 bp, Artificial Sequence
  Description of Artificial Sequence: Synthetic coding sequence
atggctgcggggcgcgcacaggttccgagtagtgaacaggcttggctggaagatgcacaggtattcatccaaaaaacgttatgtcccgctgtaaaggagcctaatgtacagctgacacccttggtaatagattgcgtgaagaccgtgtggctaagccaaggtcgcaaccaagggtcaacattgcccttatcttatagcttcgtgtctgtgcaggatttaaagacgcatcagagactgccctgttgtagccatctgtcttggtcctcctcggcctaccaggcctgggctcaagaagctggaccgaatggaaatcccttgcctagagagcaattgttactgttgggcactctgacagacttatccgctgacctggaacaggagtgtagaaacgggtccctgtacgttagagacaacaccggagtgctgagctgcgagctgattgacctggatctttcttggctcggccatctgttcctgttcccccgttggagttatctccctcctgctcgctggaacagttcaggcgaaggacatctcgagctctgggatgcgcccgttcctgtgttcccactgacaatttctcctggtccggtcaccccaattcccgtgctgtaccccgagagcgctagctgtctcttgcggctgaggagccaccctgcagtcactcacgtttcgattattgttcaagtccctgcacagcttgtttggcatagagcattgcgccctggtacagcctacgtgctgacagagctgagagttagcaaaattagaggacagcgccagcatgtatggatgacctctcagtcaagcagactgctgctgctgaagcctgaatgtgttcaagagcttgaactcgagctggaaggccctctgcttgaagctgaccccaagccactgcccatgccctcgaacagtgaggacaagaaggacccagagagtctcgtgcgctactcgcgattactgagttattcaggcgccgtgaccggggtcctgaacgagccagcgggcctgtacgagcttgatggccaattggggctgtgcctggcgtaccagcagttccgggggctcagaagagtgatgcgcccgggagtttgcctccagctgcaggatgtgcatctgctacagtctgtcggcggcgggaccagacgcccagtattggctccgtgcttgcgaggcgctgtactgctgcagagcttcagcaggcaaaagccaggagcccattcatctaggcaggcctatggcgcttccctatatgaacagctggtttgggagaggcagcttggattaccactctatttatgggctactaaggcactggaggaactggcttgtaagctgtgccctcatgttttaagacatcaccagtttctgcagcattctagtcccggatcaccctccctcggcctgcagctgctggccccaactcttgatttgctggccccccccggaagccccgtcaggaatgcccataacgaaattctcgaggagccacaccactgccccctgcagaagtacactcggcttcaaacacctagtagcttccccacactggcaactctgaaagaggaagggcagaggaaagcctgggccagctttgaccccaaagcgctcctcccattgccggaagcgtcttacctaccatcttgccagctgaatagacgcctagcctggtcatggctttgcctgctgccgtcggccttttgtcccgctcaagtcctgctcggtgtcctggtggcctcttctcacaaggggtgtcttcagctgagagatcagtccggctcacttccttgtctgcttctggccaaacacagtcagcccctcagcgatccccggcttatcggatgcctggtgcgagctgagagatttcaactgatcgtggagcgtgacgttcgttcttccttccccagttggaaagagctttcgatgccagggttcatccagaagcaacaggcgcgagtgtacgtccagttcttcctcgccgacgctttaattctccctgtgcccaggccttgcttgcactcagcaacgcctagtacgccacaaaccgacccaacaggtcctgaggggccacacctgggacagagccgactattccttctctgccacaaggaagcgttgatgaaacggaacttctgcgtgccgcccggagcatccccagaggtgccaaagccggccctaagtttctacgtgctcggcagctggctggggggcacccaacggaaggaggggaccggatggggcctgcccgagccccaaggaaacgatgataacgaccaaaaagttcacttaattttttttggaagcagtgttaggtggttcgaatttctgcatcctgggcaggtgtataggttgatcgcccccgggcctgctacgcctatgctttttgaaaaggatgggtcctcttgcatatcaagaagaccgcttgaactcgcaggttgcgcctcctgtttaacggtccaagacaactggactcttgagctcgagagctctcaagacatacaggacgtcctggatgccaacaagtcgctgccagagtcaagtctaaccgatctgctctccgataactttactgattctctggtaagcttttctgcagagattttgagtagaacactgtgcgagcccctggtggctagtctatggatgaaattgggtaataccggagctatgagaaggtgtgtcaagctcacagttgcactcgagaccgccgagtgcgaattcccgccacatcttgatgtctacatcgaggatcctcacctgccacccagcctgggcctgctccccggtgctagagtccatttctcacaactcgagaagagggtttcccgttcacacaacgtgtactgctgtttccggagctctacctatgtacaggttttgtctttccccccggagaccaccatatccatccctctacctcacatttacctggctgagctgttacaagggggacagagccctttccaagctacagcgagctgtcacatcgtaagcgtgttctcattacaacttttctgggtatgtgcatattgtacgtcaatttgccggcaggctcccggaggtggttgggattgtcggtccagaggggatctttag

SEQ ID NO: 113254 - DNA, 843 bp, Artificial Sequence
  Description of Artificial Sequence: Synthetic coding sequence
atgcaagcgaaatacagctctacaagagacatgctggatgatgatggggacaccacgatgtccctccatagtcagggttcagctaccactcggcaccctgagccacgaaggacggagcaccgcgctccttcatctacgtggcgccctgtcgccctcacgttactcacgctatgcctggtgctgctgatcgggctagccgccctggggttgttgttcttccagtactaccagctcagtaatactggccaggacactattagccagatggaggagagactgggcaacacctctcaagagttgcagagtctgcaggtccagaatattaagctggccgggtctctgcaacacgttgcagaaaagctttgtagggagttatataacaaggctggtgcccacaggtgctcaccatgtacagaacaatggaaatggcacggagacaactgctatcagttttataaagatagcaaaagctgggaagattgtaaatacttttgcctttccgagaactccacaatgctcaagatcaacaagcaagaggatttagaatttgcagcatcacagtcttatagcgagtttttttatagttactggactgggcttctcagacctgatagtgggaaggcctggctctggatggacggcacccctttcacctccgaactgtttcacatcataatagacgtcacttccccaagatctcgagattgtgtagctattctgaacggtatgatcttttccaaagattgcaaggaactcaagagatgtgtctgcgaacggcgggctggaatggtcaagcccgagagtctccacgttccccccgagaccctcggtgaaggcgactag

SEQ ID NO: 113255 - DNA, 213 bp, Artificial Sequence
  Description of Artificial Sequence: Synthetic coding sequence
atgcaggcaaagtatagctctacacgagatatgcttgacgatgacggtgacactactatgtccttgcacagtcaggggtctgctaccacccgtcatcctgaacctcgccggacagaacacagggctccatccagcacatggcgccccgtagctcttacactgctgacattatgcctagtgctgctcattggcttggccgcgctcggactctag

SEQ ID NO: 113256 - DNA, 879 bp, Artificial Sequence
  Description of Artificial Sequence: Synthetic coding sequence
atgactagaacgtacgaaaacttccagtacttggagaataaggtgaaagtccaggggttcaagaatggcccccttccactccagtctttgctgcaacgcctctgtagtggcccttgtcatctgctcttatccctgggtctgggtctcttgctacttgtgattatttgcgtggtcgggtttcagaacagtaaattccagagggatctcgttaccctcaggacagacttttccaattttacatctaataccgttgcggagatccaagctctcacctcccagggatcttccctggaggaaacgatcgccagcttgaaggctgaggtcgaaggatttaagcaagaacgtcaggccgtccatagcgaaatgctgctgagagtccaacagctagtgcaggatttaaagaagctaacatgtcaggttgctacactgaataacaacggagaggaggctagcactgagggtacctgctgccctgttaactgggtggagcatcaagattcttgctattggttctcccattctgggatgtcatgggctgaggccgagaagtattgccagctcaagaatgcacacttagtggtaataaatagtagagaggagcagaattttgtacagaagtatctgggatccgcatacacctggatggggctttctgatccagagggtgcttggaagtgggtcgacgggactgactacgcaacaggattccaaaattggaagcctggacaaccagatgactggcagggacacgggcttggcggcggggaggactgcgctcacttccacccggacggcagatggaatgatgatgtgtgtcaaagaccatatcactgggtttgtgaggccgggctgggacagacttctcaggagagtcattag

SEQ ID NO: 113257 - DNA, 951 bp, Artificial Sequence
  Description of Artificial Sequence: Synthetic coding sequence
atgacgcgcacctacgagaatttccaatacctagagaataaggtgaaggtacagggctttaagaacggccctctcccgctgcagtcgctgctgcagaggttatgttctggaccatgtcatcttttgctgtcacttgggctggggctcctgctcctcgtaatcatttgcgtggtgggatttcaaaattcgaagtttcagcgagatctggtgacactcaggacagacttttctaattttacatcgaataccgttgccgaaatacaggccctgactagtcagggtagttctctggaagagaccatcgccagcctcaaggcagaggtcgaaggctttaagcaggagcgccaggccggagtgagcgaactgcaggaacacaccacacagaaagcccacttgggacactgtccacactgtccttccgtgtgtgtgcccgtacactccgaaatgctcctgcgagttcagcagctggtgcaggacctcaagaagctgacgtgccaggttgcgacactcaacaacaacgcttccactgagggaacatgttgccccgtgaactgggtggaacatcaagacagttgttactggtttagccacagtggcatgtcgtgggctgaagcagaaaaatactgtcagttaaagaacgcacaccttgtagtcataaacagccgcgaggaacagaacttcgttcagaaatatctcgggagcgcatacacctggatgggcttgtccgatcccgagggggcatggaaatgggtcgatggcacagactatgcaactggattccaaaactggaagcctggccaaccagacgattggcagggccacgggttgggaggcggcgaggactgtgctcatttccatcccgatggtagatggaacgatgacgtctgtcagcgcccatatcactgggtgtgtgaggcaggtctgggacagacctctcaggaaagccattag

SEQ ID NO: 113258 - DNA, 879 bp, Artificial Sequence
  Description of Artificial Sequence: Synthetic coding sequence
atgaccaggacatacgagaattttcagtaccttgagaacaaagtgaaggtgcagggatttaagaatggacctctcccactgcagtcgctactccagaggttatgctccgggccatgtcacttgctgttgagcctgggcctcgggctgctgttactagtcattatttgcgtggtggggtttcaaaactcgaagttccaacgggatctcgtgaccttacggaccgacttttccaactttacaagtaatacagtggccgaaatccaggccttaacatctcagggatcctctctagaggaaaccattgcaagccttaaagccgaggttgaggggtttaaacaggagcgccaggctgtgcactctgaaatgctcctgagggttcaacagctagtacaggacctgaaaaagctgacgtgtcaagtagccactctgaacaataacggcgaggaggcgagtaccgaggggacttgttgtccagtgaactgggtggaacatcaggattcttgttactggttctcacattcagggatgtcatgggccgaggccgagaagtactgtcaactgaagaacgcacatcttgttgtgatcaatagcagggaggagcagaactttgtccaaaagtatcttggcagcgcttacacctggatgggactgtctgatccggagggtgcttggaagtgggtggatgggacagattatgccaccggatttcaaaactggaaaccagggcagccggatgattggcaagggcacgggctgggcgggggtgaagactgcgcgcattttcatcccgacggacgctggaatgatgatgtgtgccaacgcccataccactgggtgtgtgaggccggcttggggcagaccagccaggaatcacactag

SEQ ID NO: 113259 - DNA, 798 bp, Artificial Sequence
  Description of Artificial Sequence: Synthetic coding sequence
atgagcgaagaggtgacgtacgctgacctacagttccaaaattcctcagaaatggagaagattcccgaaatcgggaaattcggagagaaagccccccccgccccatcacatgtgtggagacccgcggcgctgtttctgactcttctgtgcctgctgcttctcataggtctcggcgtacttgcttcaatgttccatgtgacattaaaaatcgagatgaagaagatgaacaaactgcagaacatctccgaagagttacagcggaatatatcccttcagctgatgagtaacatgaatatcagcaacaaaataaggaacctgtccactacccttcaaacaatcgcgacgaaactgtgcagggagttatattccaaggagcaggagcacaaatgtaaaccctgtccccggcggtggatttggcacaaagatagttgctacttcttatccgacgatgtgcagacctggcaagagtctaagatggcctgcgccgctcagaatgcttctttactgaagatcaataacaagaatgccctggaattcattaagagtcaatcacgatcatacgactactggctgggcctttccccagaggaggactctacaagagggatgcgggtcgataatataatcaatagcagtgcctgggtcatacggaatgcccctgacttgaacaatatgtactgcggttatatcaaccgcctgtatgttcagtattaccactgcacatataagaagcgaatgatctgcgagaaaatggccaacccagttcagcttggatctacctactttagggaagcttag

SEQ ID NO: 113260 - DNA, 699 bp, Artificial Sequence
  Description of Artificial Sequence: Synthetic coding sequence
atgtcagaggaggtgacttatgccgatctgcagttccagaactcgtccgaaatggagaagattcctgaaatcggcaagttcggcgagaaggtgcacgttacgctgaagatcgaaatgaaaaaaatgaacaagctccagaacatctccgaagaactgcagagaaacatttccctgcagctcatgtcgaatatgaatatcagcaataagataaggaatctgtcaacaacactgcagactatcgctactaaactgtgccgagaactgtactctaaagagcaggaacataaatgcaagccgtgccctcgcaggtggatttggcacaaggattcctgctacttcctgtcagacgacgtccagacctggcaggaaagtaagatggcctgcgctgcccagaatgcttccctgctgaaaattaataataaaaacgccctggagtttatcaagtcccagagccgcagttacgattattggctgggactcagccctgaagaggactcaacacgcgggatgcgagttgacaacatcatcaactcaagcgcatgggttatccggaacgctcctgatctgaataacatgtactgcggatatattaaccgtttatacgtgcagtattaccattgcacatacaagaagcgaatgatttgcgagaaaatggccaaccccgtccaactaggctctacctacttccgggaggcatag

SEQ ID NO: 113261 - DNA, 828 bp, Artificial Sequence
  Description of Artificial Sequence: Synthetic coding sequence
atgtggatcgacttctttacctattccagcatgagcgaggaggtgacatacgcagacctccagtttcagaactcttctgagatggaaaaaatacccgaaatcggcaagttcggcgagaaagctccccccgcacctagccacgtttggcgcccggccgccctgtttttgaccttgctgtgcttattgcttcttattggactgggagtcctcgcttcaatgttccatgttacccttaagatagaaatgaaaaagatgaacaagctgcaaaacatatccgaagagctacagcgaaacatctcactgcagttgatgagcaacatgaacatatcaaataagattaggaacctatcaaccacacttcaaacaatcgctaccaagctctgtagggagctctatagcaaggaacaggagcacaaatgtaaaccttgcccgagacggtggatctggcataaagactcttgctattttctgtcagacgacgtccaaacatggcaggagagcaaaatggcatgtgcagcacagaacgcctcactgttaaaaatcaataataaaaatgcacttgagttcatcaagtcacagtcaaggtcttacgactattggctcggactgtcccctgaggaagactccaccaggggaatgagggttgacaatataatcaactcgagtgcctgggtcatccgcaacgcgcctgatctaaacaatatgtattgcggatacatcaacaggctgtatgtgcagtactaccactgcacatataagaaaaggatgatctgcgagaagatggctaacccagtgcagcttggaagcacctatttccgggaggcttag

SEQ ID NO: 113262 - DNA, 264 bp, Artificial Sequence
  Description of Artificial Sequence: Synthetic coding sequence
cataaatgtaagccttgtccgcgcagatggatttggcataaagatagctgctatttcctaagtgacgacgtccaaacgtggcaagaatcaaagatggcatgtgcagcacagaatgcatctctcttgaaaataaacaacaaaaacatcttttcggttatcaaaaagaagaccgagaagttcttctggctgggcttgagttgggacagctccggcaggagctggttttgggaggacgggagcgtaccatcacctagcctatactag

SEQ ID NO: 113263 - DNA, 498 bp, Artificial Sequence
  Description of Artificial Sequence: Synthetic coding sequence
atgtcggaagaggtcacgtacgcagatctacaattccagaactcaagcgagatggaaaaaattcctgaaatcggtaagttcggggaaaaagcccctcctgcacccagtcatgtctggcgacctgcagccctgttcctgacgcttctgtgtctcctgctgttaataggtctgggtgtgctggcctctatgtttcatgtcactctgaagatcgagatgaaaaaaatgaataagctgcaaaacatctccgaggagttacaacggaacatttcactgcaactaatgtctaatatgaacatctcaaacaaaatacgtaacctatcgacaacactgcagaccatcgcgaccaagctatgtcgtgagctgtactctaaggagcaggaacacaagtgtaagccttgccccagacggtggatttggcataaagatagctgctactttctcagcgacgacgtgcaaacatggcaggagtctaagatggcctgcgcggctcagaattag

SEQ ID NO: 113264 - DNA, 642 bp, Artificial Sequence
  Description of Artificial Sequence: Synthetic coding sequence
atgtcagaggaggtaacctatgccgatctccagttccagaatagttctgaaatggagaagatccccgagataggcaaattcggagaaaaagcccctcccgccccatctcacgtgtggcgacccgctgctctattcctgacactgctgtgcctgcttcttctgatcggcctgggagtgttagctagtatgtttcatgttaccctgaagatcgaaatgaagaagatgaataaattacaaaatatatccgaagaactccagcgcaatatatcactccagcttatgtccaacatgaatataagcaataaaatcaggaaccttagcacaacactgcaaacaatagccacgaaactttgccgggagctatactctaaggagcaggagcacaaatgtaagccgtgtccccggcgttggatatggcacaaggacagttgctactttctgtccgacgatgtgcaaacctggcaggagtccaagatggcctgtgccgcccagaacgcttctttactgaagattaacaataagaatgcattggagttcattaaaagccagtcacgatcgtacgactactggttaggcctttccccagaagaggatagtacaaggggcatgagggtggacaacattataaattcttctgcctag

SEQ ID NO: 113265 - DNA, 423 bp, Artificial Sequence
  Description of Artificial Sequence: Synthetic coding sequence
atggcggcaacgggtttttccgctcctaacgggtcttgccatggcacatcaaggactgtgaattctgatgcacctatgtctccagagctgccgaagcctcatctgcccgaccagttggtgatcgtaaacgaaacagaagccgatagcaaaccgtcaaagaacgtcgcaaggtcggcggccgtcgaaaccgcctccctgtcccctagcctggtccccgcccgtcagcccaccatttcactgctatgcgaagacaccgcagatacacttagcgtggaatctttgacccttgtaccacctgtcgatccccactcgctgagaagcctaacgggcatgcccccattgtcaactcctgccgctgcctgtactgagcctgttggcgaagaggctgcctgcgctgagcccgtagggacggcagaagactag

SEQ ID NO: 113266 - DNA, 2721 bp, Artificial Sequence
  Description of Artificial Sequence: Synthetic coding sequence
atgtttggaagatctagatcttgggtcggcggcggacacgggaagacttctcggaatattcactcccttgaccacctaaagtacttgtatcacgtgctgacaaagaacacaactgtcaccgaacagaatcgcaatttgctcgtggaaacgatccgtagtatcactgaaatcctcatttggggggaccagaatgatagcagcgtgttcgattttttcttggagaaaaatatgttcgtgtttttcctgaatatcctcaggcagaaaagcgggcggtacgtatgcgtgcagctgctccaaacgttgaacatcttatttgagaatattagccatgaaacaagcctgtactaccttctgtctaacaactacgtcaactccattatagtgcacaagtttgacttctctgatgaagagataatggcctactatatttccttcctaaaaactcttagcctcaagttgaacaatcatactgttcacttcttctacaacgagcatacgaatgatttcgccctgtacactgaggcgatcaaattcttcaaccatcccgagagcatggtacgaatcgcggtgcggactattacactgaatgtgtacaaagtcgataaccaggctatgttgcattatattagagataaaacagcagtgccctatttcagcaacctggtatggtttatcggatcccatgtgattgaactagatgattgtgtccagacagacgaggagcaccgtaaccgcggtaagctcagcgatcttgtggcagaacaccttgaccatcttcattatctcaacgacatcttgatcattaattgtgagtttctcaatgacgttctgactgaccatctgctgaacaggctattcctccccctgtacgtgtactcactggaaaatcaagacaagggcggggaaaggccgaagatcagtctgccggtcagcctttacctgctgtctcaggtttttctcattatacaccacgctcctttagtgaactctttagctgaggtgatcctgaacggtgatttgtccgaaatgtacgctaagaccgagcaggatatccaacgatcatccgctaagccctctataagatgcttcatcaaacccacagaaacgttggagcggagcttggagatgaacaagcacaagggcaaacggcgtgtgcagaaacgtcctaactataagaacgtaggggaggaggaagacgaagaaaaaggtccaacagaggacgcgcaggaagacgctgagaaagcaaaggagatcgaaatggtgataatggaacggagtaagctgtctgaactagccgcctccacctcagtgcaggaacagaatactacagatgaagaaaagtcggcggctgcaacctgctccgagtccacccagtggagtcggcctttcctggacatggtgtatcacgcacttgactctccggacgatgactatcatgctctgtttgttttgtgcttactgtacgcaatgtctcataacaagggaatggatccagaaaagctggaaagaattcagctgcctgtgccgaatgctgctgagaagactacatacaatcacccactggccgagagactgatacgtattatgaacaacgctgctcagccagatggaaaaattcggttggccacgcttgagttgtcatgcctcctgttaaagcaacaggtcctcatgagcgctggctgtatcatgaaagatgtgcatctggcctgcttagagggcgctagggaggagagtgtgcatctggtgagacacttctataagggcgaggacatctttctggatatgtttgaggacgaatatagatctatgacaatgaagcccatgaatgtcgagtacctgatgatggacgccagtattctcttacctcccacaggaacaccactgacagggatcgactttgtgaaaaggctaccatgcggtgatgtggagaagacccgccgggccatccgagtctttttcatgctgcggtctctgagtctgcagctgcgcggtgagccagaaacacagctgccgctgacgcgcgaagaggatctgatcaagacagacgatgttcttgatcttaataattctgatctgatcgcgtgtactgttatcaccaaggacggggggatggtgcagagatttctcgctgtggacatataccagatgtctctagtggagcccgacgtatcgcgcctggggtggggagtggttaagttcgcagggctcctgcaagacatgcaagttacgggtgtagaggacgattcgcgcgcattgaatattactattcataagccggccagcagccctcatagcaaaccattcccaattctgcaggccacatttattttctcagaccatattcgctgtatcatcgcaaaacaaagacttgcaaagggacgcattcaagcccgcagaatgaagatgcagcgcatcgctgcgctgctggacctccctattcagcctactacggaagtcctgggcttcggtctagggtcctcaacctctacacagcatctcccatttaggttctacgaccaggggaggagaggctcgtccgacccgaccgtgcaacgaagcgtttttgcctccgtagacaaggtgcccggagaacctgcccccagacccgcaccacagctagttcaccatggtgggaggtcaaggagctttagcctgtggtcgctgtgcgagttacctttcctttcccaaaagccccgtcgcctcgccgcgcctgcctcttag

SEQ ID NO: 113267 - DNA, 3162 bp, Artificial Sequence
  Description of Artificial Sequence: Synthetic coding sequence
atgtttggccgttcccgatcctgggtgggtggaggacacgggaagacttcacggaacatacattcacttgaccatctgaagtatctttaccacgtgttgaccaagaacacaaccgttacggagcagaaccgaaatctcttggtagagaccataagaagcatcactgagatactcatttggggtgatcaaaacgactcctccgtttttgatttttttctcgaaaaaaatatgtttgtgttctttcttaacatcctgagacagaagtcaggccgttatgtgtgcgttcagttacttcagactctcaacattctgttcgaaaatatctcccatgaaacatccctgtattatttgcttagtaataattatgtcaactcaataatcgtgcacaagttcgatttcagcgatgaagagatcatggcatattacattagcttcctcaaaaccttgtcactgaaacttaataatcataccgttcatttcttctataatgagcatacaaatgactttgctctctacactgaggctataaagttcttcaaccatcctgagagcatggtccggatcgcggttagaaccattactctgaatgtgtataaggtttccctcgacaatcaagctatgctgcattacatccgggataaaactgccgtgccctacttttccaatttggtctggtttatcggtagccacgtaatcgagttagacgattgcgtgcaaaccgacgaagaacataggaatcgaggaaagttatctgatctggtcgccgagcacctcgaccatctgcattatctcaacgacatcctgattatcaattgcgaatttctgaacgatgtactgacggaccatctgctcaaccgcctttttctccctttgtatgtgtattcactggagaatcaggataaggggggcgagagacctaagatatcccttccagtgagtctgtatctgctgagtcaggtatttttaattattcaccatgctcctttggtcaactcactggcagaggtcatattgaatggggacttgtcagaaatgtacgcaaaaacagagcaagatatacagcgttcgtccgcaaagccatctatacgctgcttcatcaagccaactgagaccttggagaggagtttagaaatgaacaaacataagggtaaacggagagtgcagaaaagaccgaattacaagaatgtgggcgaagaggaggatgaggagaagggccccacagaggatgcacaggaggatgccgagaaggccaagggaacagaagggggcagtaagggaattaaaacaagcggcgaaagtgaagagatcgagatggtgattatggaaagaagcaagctctctgagctggcggcctctaccagtgtgcaggaacagaatacaacagatgaggagaagagtgcggctgccacatgctctgagagtacacagtggtcaaggcctttccttgacatggtgtatcatgccttggattctcccgacgatgactatcatgcactctttgtactctgcctgttgtacgcaatgagtcacaataagggaatggaccccgaaaagctagaacgtatccagctccctgtcccgaatgccgcagagaagaccacctataaccatccccttgcagaaagactgataagaatcatgaataacgccgcacagcctgacggcaagattagactagccacattggagctttcatgcctgcttctgaaacagcaggttttaatgtcagccggttgcatcatgaaggacgtccacctagcgtgtcttgaaggagctcgcgaggaatccgttcacttggtgcggcatttttacaagggggaggatatatttctggatatgttcgaagatgagtatcgctctatgacaatgaaacctatgaacgtggagtaccttatgatggacgcaagcatcctcctgcctccgaccgggacaccactgacaggcattgacttcgttaaacgcctgccatgtggggacgtggagaaaactagacgggcgattagggtgttcttcatgctgagatccctgtccctccagctgcggggggagcctgaaacccagctccctctaacacgggaggaagacctgatcaagaccgacgacgtgctggatctgaataattccgacctgatcgcttgcactgtgatcacgaaggatggtgggatggttcaaaggttcctggccgtcgatatttatcagatgtctctcgtggagccagacgtttcccgcctgggatggggagttgtcaagtttgcaggcctgctgcaggatatgcaggtcaccggcgtggaggacgatagcagggccctgaacatcaccatacataagcccgctagtagcccgcattcaaagccgtttccaattttacaggccacgttcatatttagcgatcacattcgctgcataattgctaaacaacgcctggcaaaaggccggattcaggctcggcgaatgaaaatgcagcgtatcgcagccctgttggatttgcctatccagcctacgacagaggtgctcggttttggcctaggaagctcaacatctacccaacatttaccgttcaggttctatgaccaggggcggcgaggctcttctgatcccactgtccagaggagcgtgttcgcctcagtggataaggtgcctgggttcgcagtcgctcagtgcattaaccaacatagtagccctagtctgagctcccaaagccccccttccgccagcggaagtccctctggctctggatcaacctcccactgtgacagtggaggaacatccagctcttccactccgtccacagcccagtcccccgctgacgctcctatgagccctgagctgccaaagcctcacttaccggatcagttagtgatagtgaatgaaactgaagccgactcaaagccttcaaaaaatgttgccaggagcgccgctgtagaaacggcctctctgagtccatcactggttccagccagacaacctactatctcgctgttatgcgaagatactgccgacactctctccgtggagtccctgaccctggtgcccccagtggatccccatagcttacggtcccttacagggatgcctccactgtccactccagcagccgcatgtacagagccagtgggcgaggaagcggcatgcgcagagccagtaggcactgcggaagattag

SEQ ID NO: 113268 - DNA, 3162 bp, Artificial Sequence
  Description of Artificial Sequence: Synthetic coding sequence
atgtttggtcgttcaagaagctgggtcggggggggacacggaaagacatctagaaacattcactctcttgaccatcttaaatacctgtatcacgtcctgaccaaaaacacgacagtgacggaacagaacaggaatctgctggtagagaccatacggtcaataaccgagattttaatttggggcgaccagaatgatagctcagtttttgacttcttccttgaaaaaaatatgtttgtgttcttcctaaacattctgcgccaaaaaagtggccgctatgtttgcgtgcagcttctgcaaacgttgaatattctgttcgagaacatatcccacgagacgagcttatactatctgctgtccaacaactacgttaacagcatcattgtccacaagtttgatttttccgatgaggaaattatggcctactatatatcatttctaaaaaccttatccctgaagctaaacaaccacaccgtgcactttttctacaatgagcatacgaacgatttcgccctgtataccgaggcgataaaattttttaaccacccagagagcatggttagaattgcagtccgtactattacattgaacgtgtacaaggtctctgtggataaccaggctatgctgcactacatccgagacaaaacagcagtgccttacttttccaacctagtatggttcatcgggagtcacgttatcgagctcgacgattgcgtgcagacagacgaagagcatcggaatcgagggaaactttctgaccttgtggccgagcatttggaccacttgcactatctgaatgatatactcattataaactgcgaattcttgaatgacgtccttacagaccatctcttgaacaggctgtttctccccttatatgtgtattccctagaaaaccaggacaagggaggggaacggccaaagatttccttacctgtgagtctctatctgttatcccaggtctttctgattatccatcacgcgccgctggtaaatagtctggctgaagttattctgaacggcgacctctctgagatgtacgcaaagaccgaacaggatatacagcggagcagcgccaaaccgagcattcgctgcttcattaaacccaccgagacactagagaggtcgttggaaatgaacaagcataaggggaagcgtagagtccaaaagaggccgaactataagaatgtcggtgaggaggaggacgaggagaagggtccaacagaggacgcgcaagaggatgctgaaaaggccaagggaactgaaggaggttcaaaggggattaaaacatcaggtgaatccgaagagatcgaaatggtcatcatggagaggtccaagctgagcgagctagctgcctccacaagtgttcaggaacaaaacaccaccgacgaagagaagtcagcggccgctacctgttctgagtccacccagtggagcagaccatttcttgacatggtgtaccacgctctcgatagtccagatgatgactatcacgcactcttcgtcctctgtttactttacgcaatgagccacaataaagggatggaccccgaaaagcttgagcgcatccagttacccgtgcctaatgccgccgaaaagacaacctacaatcaccctttggccgaaagattgattaggattatgaacaacgcagcccaaccagacggaaaaatccgattggcgacattggaactgtcctgcctgttactgaagcaacaggtgctgatgtccgccggttgcataatgaaagacgtgcatctggcctgtctcgagggggcccgggaggagtcagtgcacctcgtgcgccatttttataaaggcgaggacatcttcctggacatgttcgaagatgaatacaggtcaatgacgatgaagccaatgaatgtcgagtatctcatgatggacgcctctatactcctccctccgaccggcacccctttgaccggtatcgatttcgtcaagagactgccatgtggggacgtggagaaaacccggcgggccattcgtgttttcttcatgctgaggtccctttcactgcaactgcgaggagagccggagactcaactccctctgaccagagaagaggatctcatcaagacagatgatgtcctcgacctcaataactccgaccttatcgcttgtaccgtgataacaaaggacggaggcatggtgcagcgcttcctggcggtcgatatctaccaaatgtctcttgtcgagccagacgtgtcaaggctgggctggggggtagtcaagttcgctggcctgctgcaggacatgcaggtgactggggtcgaggacgatagtagagccctcaatattaccatccataaacctgccagttccccacactccaagccattccctatcctgcaagccaccttcatctttagcgaccacataagatgtattatcgctaaacagagactggctaaggggagaattcaggcccgccgtatgaagatgcagcgtattgccgcattgctggatctgccgattcagcccaccaccgaggtgttaggcttcgggctgggaagcagcacatcaacccagcatctgccattcagattttacgatcaagggcgccgcggctccagcgatcctaccgtgcaacgcagtgtgtttgccagtgtggacaaggtacctggctttgctgtagcacagtgcattaatcagcactctagccccagtctgtcctcccagagccccccctccgcgagtggttctcctagcggatctggttccacctcccactgtgattcagggggtacgtccagtagctctacgcccagtaccgcccagagccctgctgacgctcctatgtcccccgaacttcctaagcctcatctacccgaccaacttgttattgtcaacgaaactgaagcggattctaaaccaagcaaaaatgttgcacgtagcgctgcagtggaaaccgcttccctttccccctccctggtgcctgcccgtcaacctacaatctcactgctatgtgaggatacagcagatacactgagcgtcgaaagcctgactctggttccacctgtggatccacacagcctgcgttcgctgacaggaatgcctcccttgtcaactcccgcagctgcttgtacagagcccgtgggagaagaggcagcctgtgccgaaccagtggggacagctgaggattag

SEQ ID NO: 113269 - DNA, 288 bp, Artificial Sequence
  Description of Artificial Sequence: Synthetic coding sequence
atgcatgatagcaataacgtggagaaagacataaccccatccgaactgcctgcgaacccggcaattcgcgccaactgccatcaggaaccctctgtatgtctgcaagccgcttgcccggaatcttggatcggcttccagcgaaaatgcttctatttttccgacgacaccaaaaactggacatcatcccagaggttctgtgactcgcaggacgccgatctggcccaagtcgagagctttcaggagctcgtgtcgtatccagggtctcggagggtttgtctcttcgagtag

SEQ ID NO: 113270 - DNA, 525 bp, Artificial Sequence
  Description of Artificial Sequence: Synthetic coding sequence
atgattaaccccgagctaagagatggacgggcagatggcttcatacaccgcatcgtgcctaagctgatccaaaattggaaaatcggcctcatgtgtttccttagcatcataatcactaccgtatgtattatcatgatcgccacctggtctaagcatgccaagcctgttgcgtgctccggcgactggctaggcgttcgcgacaaatgtttctatttttccgatgacacacgcaattggacagcctctaagatattttgttcattgcaaaaggctgagcttgctcagatagacacacaagaggatatggaatttctgaagaggtacgctggaaccgacatgcactggattggcttgagccgcaaacagggtgacagttggaagtggacgaacgggaccaccttcaacggctggtttgaaataataggcaatgggagttttgcctttctcagcgcagacggggtgcactcctcacgggggttcatcgacataaagtggatttgcagcaagcctaaatacttcctctag

SEQ ID NO: 113271 - DNA, 2406 bp, Artificial Sequence
  Description of Artificial Sequence: Synthetic coding sequence
atgcatcacaggatgaacgagatgaatctgagtcccgttggaatggaacaactgactagtagcagcgtttccaatgcccttcctgtttctgggagccatctcgggttggcggcaagtccaacacattccgccatccctgccccggggctgccagtggcgattcctaacttggggccctccttgtctagcctgcccagcgctctgtcactcatgctgccaatgggaataggtgaccggggagtgatgtgcggccttcccgagagaaattatacgctgcctccaccaccctatccccacttggagagtagctattttcgaaccatcctccccggaattctttcttatctggccgatagacctccacctcagtatatccaccctaactcaattaatgtggacggaaatactgccctcagtattacaaacaatcccagcgcactggacccttatcaatcaaatggaaatgtggggttggagccaggaattgtgtctatcgattcccgcagcgtgaatacacatggggcacagtcccttcatccatctgacggacatgaggtcgctctggacacagcgatcactatggagaatgtcagtagggttacatctcctatctcaacggatggcatggcagaagaacttaccatggacggtgtggcgggagagcactcacagatcccaaatggaagcagaagtcatgagccactgagcgtggacagtgtgtccaataatctggctgccgacgcggtgggtcacggtggggttatcccgatgcatggaaatggcctcgaactgcccgttgttatggagacagatcacattgcctctagggtcaacggtatgtccgattctgccctgtctgacagcatccacacagtggccatgtcaacaaacagtgtgagcgtggcgttgtccacatcccacaaccttgccagtctggagtctgtttctctgcatgaagtgggcctttcccttgagcctgtagctgtgtcatctatcacccaggaggtcgcaatgggcaccggccatgtggatgtcagttccgatagtctgtctttcgtgtccccttcattacaaatggaggactccaatagtaataaggaaaatatggctacacttttcacaatctggtgtactctttgtgatcgcgcttacccctccgactgtcctgagcatggccccgtgaccttcgtccccgatacacccattgaaagtcgggcacgtctgtctcttccaaaacagctggtattgcgccagtctatcgtgggcgcggaagtgggtgtctggacgggcgaaaccatcccagttcggacatgcttcggtccattaatcggccagcagtcccatagcatggaggtggccgaatggacagacaaagccgtcaatcatatctggaagatttaccataatggtgtgctcgagttttgcataatcacaacggacgagaacgagtgcaactggatgatgtttgtcagaaaggcgcgcaacagggaggaacagaatttagttgcgtacccgcacgatggcaagattttcttctgtactagccaggatataccacccgaaaatgagctgctgttctactactctcgcgattatgcccaacagatcggcgtacccgaacaccccgacgtccacctgtgtaactgcggaaaagagtgcaactcttacaccgagtttaaagcacatttaacttcccacatacacaaccacttgccgactcagggccacagcggatcacatgggccatctcattccaaagagcgcaagtggaagtgttccatgtgccctcaggcttttatctctcccagtaaattgcatgttcatttcatgggacacatggggatgaagccacataagtgtgatttctgtagtaaggcgttttcagatccttccaatctgagaacccacctgaagatccataccggacaaaaaaattatcgatgtaccctctgtgacaaatcttttacccagaaagcgcatctggagtctcatatggtaatccatactggggagaagaatctcaaatgtgactattgtgataagctgtttatgcggcggcaggacctgaaacagcacgtactgatccatacccaagagaggcagattaagtgcccgaagtgcgataaactgtttctgcgaaccaatcatttgaaaaagcacctgaactctcacgaagggaagagggactacgtctgcgagaaatgtactaaggcctacctgacaaaataccacctgacgcggcatctaaagacatgcaagggaccaacctcttcatcgtcagccccagaggaggaagaagaagacgacagcgaagaggaggatcttgccgacagtgtaggcactgaggattgtcggattaattcagctgtgtacagcgcggatgagtccctgtcggcccacaaatag

SEQ ID NO: 113272 - DNA, 465 bp, Artificial Sequence
  Description of Artificial Sequence: Synthetic coding sequence
atgcatgacagcaataatgttgaaaaggatataactccctctgagctgcctgccaacccagcaatcagagcaaattgccatcaagagcctagcgtttgcctgcaagctgcttgccccgagtcctggattggtttccagagaaaatgtttctacttcagtgacgacaccaaaaactggacctccagccagagattctgtgactcacaggacgcagacctggcgcaagtagaaagttttcaggaactgaactttctgctcaggtataagggaccgtcagaccattggataggactttcccgcgaacagggccagccgtggaaatggataaacgggactgaatggactcgccagttccccattctgggagcaggcgaatgtgcttatctgaatgacaagggagcatcttctgcgaggcattataccgaacggaaatggatttgctctaaatcagacattcatgtctag

SEQ ID NO: 113273 - DNA, 585 bp, Artificial Sequence
  Description of Artificial Sequence: Synthetic coding sequence
atgcacgactctaacaatgtcgaaaaagacataaccccctctgaattacccgctaatccaggctgccttcacagcaaagaacacagcattaaggcaactctgatctggcggctgttctttttgatcatgtttttgactatcatcgtttgcgggatggtcgctgccctgagcgccatccgggctaattgccaccaggagccatctgtgtgtctccaagctgcctgtcccgaatcttggattggctttcagagaaaatgcttttacttttctgatgatactaagaattggaccagttcacagcgcttctgcgattcacaggacgctgatctggcccaagtcgaaagcttccaggagttaaactttctcctccgatacaaaggaccctctgaccattggattggcctgtctcgcgaacagggtcaaccctggaagtggatcaacggtaccgagtggacgagacaacttgttatgaaagaagatggcgctaatctctacgttgccaaagttagtcaagttccgcggatgaatcctcgacccgtcatggtgtcctaccctggctcgcgcagagtgtgtttgtttgagtag

SEQ ID NO: 113274 - DNA, 576 bp, Artificial Sequence
  Description of Artificial Sequence: Synthetic coding sequence
atgcacgatagcaacaatgttgaaaaagatattaccccgagcgagctccccgcgaacccaggctgcctccactccaaagaacacagcataaaagccaccctgatttggagactattttttctgattatgtttctaaccataatcgtttgcggcatggtagccgcactctccgctatccgggccaactgtcatcaggagccatctgtctgcctgcaggcagcctgccccgaaagttggatcggctttcagcgaaaatgcttttacttcagtgatgacactaagaattggacgagtagtcaaagattctgcgattcccaggatgccgacctggcccaggttgaatccttccaggagttgaatttcctcctccgctacaagggcccctcagatcactggatcggcctttcccgcgagcagggtcaaccatggaaatggataaatggaaccgaatggactagacagtttcccattctgggggccggggagtgcgcctatctgaatgataaaggagcgtcatcggcgagacactacaccgaacggaaatggatttgctcaaagtccgatattcatgtctag

SEQ ID NO: 113275 - DNA, 399 bp, Artificial Sequence
  Description of Artificial Sequence: Synthetic coding sequence
atgcatgattccaacaatgttgagaaagatatcactccttccgaactgcctgcaaaccccgggtgtttgcattccaaagaacactctatcaaagcaacactgatttggcgcttgttcttcctaatcatgtttctgaccatcatcgtctgcggcatggtggcggccctgtctgcaatccgggccaattgtcaccaggagcctagcgtgtgcctgcaggctgcatgtcctgagtcttggattggttttcagagaaagtgcttctacttctctgacgacacaaaaaattggacatccagccagcgcttctgtgacagtcaagacgctgaccttgcccaggtcgagtccttccaggaactcgtaagttacccagggtctcgtagggtttgcttgttcgaatag

SEQ ID NO: 113276 - DNA, 891 bp, Artificial Sequence
  Description of Artificial Sequence: Synthetic coding sequence
atgtccgattctaaggagccaagggtgcagcaactgggactcctgggatgccttggtcatggagccctggtgctacagctgttatcattcatgctgcttgccggagttttggttgctatcttggtgcaggtctccaaggtgccaagctcactcagccaggaacagtcagagcaggacgcaatttaccaaaatttaacccagttaaaggcagcagtgggcgaactgtcagagaaaagcaagctgcaagagatctatcaagaactcacgcagctgaaggcggctgtgggggagctgccggaaaaatcaaaacttcaagaaatctatcaagagctgacaaggctgaaggcggccgtgggagaactgcccgaaaaatcaaaactgcaggaaatctaccaggaacttacaaggctgaaggcggccgttggcgaattaccagaaaaatctaagctccaggaaatctaccaggaactgaccaggctgaaggcggcagtcggggaactgcctgaaaagtccaagctgcaggagatctatcaggaactgaccgagctgaaagcagccgtgggtgagctcccggaaaagtccaaattgcaagagatctaccaggaattgactcaactcaaagctgccgtgggagaattgcctgaccagtccaagcagcagcaaatataccaggaactgacagatctgaagacggctttcgaacgcctttgcaggcattgccctaaagactggaccttcttccagggcaactgttacttcatgtcgaattcacagcgtaattggcacgactcggtgactgcctgtcaggaggtgcgcgctcagctcgttgtgatcaagaccgcagaggaacagctccccgcagtgttagaacagtggaggacgcagcagtag

SEQ ID NO: 113277 - DNA, 2379 bp, Artificial Sequence
  Description of Artificial Sequence: Synthetic coding sequence
atggctgctccatcactcttgaactggcgccgtgttagctcctttacgggccccgtccctagagctcgacacggccatcgggcggttgccatccgtgaattaatgatcatcttcggggggggcaatgagggtatcgccgatgaactccacgtgtacaacacagcaacaaaccagtggttcctgccagctgtgcggggtgacattcctcccggttgtgctgcacacggcttcgtttgtgacggcactcgcatcctcgtgttcggcggcatggtggagtacgggcgctactctaacgagctttatgagttgcaggcatcccgctggctttggaaaaaagttaagccgcaccctccaccttcaggcctacctccctgtcctcgcttgggccattcattctctctttacggcaataagtgctatctcttcgggggactggccaacgaatctgaggattctaacaataatgtaccacgatacctcaatgacttctacgagctggagctgcaacacggctcaggcgttgttggctggtccatccccgtgaccaagggcgtcgtgccttctccacgtgagagccacactgctgtgatttactgcaagaaggactctggtagtcctaaaatgtacgtgttcggaggcatgtgtggagccagacttgatgatctctggcagttggatctagagaccatgtcatggtcaaagcctgaaaccaaaggcaccgttccattgccccgcagtctacacactgcaagcgtaatcggcaataagatgtacatttttgggggttgggtcccacacaagggcgagaacaccgagactagcccacatgactgcgaatggcggtgcacaagttcctttagctacctgaatctggataccaccgaatggactacacttgtcagcgattcgcaagaagacaaaaagaattcgagacctagaccccgcgctggacactgtgccgtggcgatcgggacccgcctttatttctggagcggacgggacggctataaaaaagcactgaattcacaggtgtgttgtaaagatctctggtatctcgatacagagaaaccaccagctccatctcaagtgcagctgattaaggcgaccaccaacagcttccatgtgaaatgggatgaggtgtccaccgtggagggctacctgttgcagttgtccacagacttgccataccaggcagcgagctctgacagttcagccgcgccaaatatgcagggagtgaggatggacccacataggcaaggaagcaataacatcgtgccgaattccatcaatgacacaatcaactcgaccaaaacggagcagccagccaccaaggaaaccagcatgaagaacaaacctgactttaaagcactcaccgattcaaacgctatcctttatccaagcctggcctcaaatgccagtaatcataattctcatgttgtcgacatgttgcggaagaacgagggaccccatacctccgccaatgtcggagtgctgagcagctgcctggacgtccgtaccgtcatcccagaaacttccgtgagtagcaccgtaagctcaactcaaaccatggtgacccaacagaccattaagaccgagtcatcatcaacaaacggagcagtcgtgaaggacgagacaagtctcacgacgtttagcacgaaatctgaagtagacgagacttacgcattgcctgcaacaaaaatttcgagggtcgagacacacgccaccgctacaccattcagtaaagagacacctagtaatcccgttgctacagtgaaagcaggggaacggcagtggtgcgatgtgggcatattcaaaaacaatacagctctcgtgtctcaattttacctcctgcccaaagggaagcaaagtatctctaaagttggaaatgccgatgttcccgactacagcctgctgaaaaaacaagacctggtgcctggcacgggctatcgtttccgggtcgccgccataaatggctgcggcattggacctttttctaaaatcagcgaatttaagacatgcatcccaggctttcccggtgcaccatcagccgttaggatttccaaaaacgtcgaagggattcacctgagctgggagccccctacttctccatctggcaatatcttagaatatagtgcatacttggcaatacgaactgcgcagatccaggataacccaagccaactggtgttcatgcgcatttactgtggactgaaaacatcttgcatcgtgactgctggccagctagcgaatgcacacatcgactacacttcacggcccgcaattgtctttaggatttcggcaaaaaacgagaaaggatacgggcccgcgacccaggtcagatggctgcagggaaataacaaaaaagcaccactcaactag

SEQ ID NO: 113278 - DNA, 498 bp, Artificial Sequence
  Description of Artificial Sequence: Synthetic coding sequence
atgactagtgaaattacgtatgctgaggtccggttcaaaaatgaattcaaaagctctggcattaacaccgcatcttctgccgagaccgcgtggtcctgctgccctaagaactggaagtcctttagctctaactgctatttcatatcaactgaaagcgcaagttggcaggactcggagaaggactgtgcacggatggaggctcatttgctggtgatcaacacccaggaagagcaagacttcatctttcagaatctgcaggaggagagcgcgtacttcgttggcctgtccgaccctgaggggcagcgacactggcaatgggtggaccagacgccctataatgaaagttcaacattttggcatcctcgtgagccctctgatcctaatgagcgctgtgtggtgctgaattttagaaaatcccccaaacgatgggggtggaacgacgtaaattgcctgggtcctcagcggtctgtgtgcgaaatgatgaagatccacctctag

SEQ ID NO: 113279 - DNA, 615 bp, Artificial Sequence
  Description of Artificial Sequence: Synthetic coding sequence
atgacctctgaaatcacttatgcggaggtaaggtttaagaacgaattcaaaagctcagggattaacacggcatcttctgctgcctctaaagaaagaacagcaccccacaagtcaaacacaggtttccccaagcttctttgtgcctcgctcctcatcttcttcctgctgctggcaatttcttttttcattgcatttgtgaagacggcttggtcatgctgtcccaaaaattggaagagcttttcttctaattgttactttatatcaacagaatctgcaagctggcaggacagcgaaaaggattgtgctcgcatggaagcccacttgctcgtgatcaacacacaagaggagcaggactttatctttcagaatctgcaggaagagagcgcttattttgttggcctaagtgatcctgagggacaacggcactggcagtgggtggaccagaccccctacaatgagtcctcaactttttggcaccctcgggagccgtctgacccaaatgagcgatgtgtcgtcctcaattttagaaagtccccaaagaggtggggatggaatgacgtgaattgtctcgggccgcagcgctccgtgtgcgagatgatgaagatccatctctag

SEQ ID NO: 113280 - DNA, 597 bp, Artificial Sequence
  Description of Artificial Sequence: Synthetic coding sequence
atgacgagcgaaatcacatatgccgaggtgaggtttaagaacgaatttaagtcctcaggtattaacacggcttcatccgccgttttctttcagaagtacagccagctgctggaaaagaagacaactaaggaacttgtccatactactcttgagtgcgttaaaaagaatatgcccgtggaagagaccgcttggagctgctgccctaagaactggaagtctttcagcagcaactgctacttcatcagtactgagtccgcttcatggcaggactctgagaaagattgtgccagaatggaagcacatctgcttgtcattaatacacaggaggagcaggatttcatctttcagaatctgcaagaggagagtgcttacttcgtggggctatctgatcccgaaggccaacgccactggcagtgggtggaccagaccccctacaacgagtcgagcactttctggcaccctagagagccatctgacccgaacgagagatgtgttgtacttaactttcgtaagtcgcctaagaggtggggttggaatgatgtgaactgtctgggaccccaacgtagtgtctgtgagatgatgaagatccacctgtag

SEQ ID NO: 113281 - DNA, 549 bp, Artificial Sequence
  Description of Artificial Sequence: Synthetic coding sequence
atggtccccgaagaagaacctcaggaccgcgtgccacacaattttatgtatagtaagaccgtaaagagattgagcaagctgagagagtatcagcagtaccatccttccctgacctgcgtcatggagggtaaggatatagaagactggagttgctgtccgacaccctggacatcattccagtcctcttgttattttatctcaacgggcatgcagtcttggacaaaatcccagaagaactgtagcgtgatgggtgccgacttggtggtgattaataccagagaggagcaggactttatcatccagaatctgaagcgaaatagtagctatttcctcggcctgtctgatcccggaggaagaagacactggcagtgggtggatcagaccccatataacgaaaatgttacattctggcacagcggcgaacctaataacctcgacgaacgatgtgccatcatcaattttaggagtagcgaagaatgggggtggaacgacattcattgccatgtgccccagaagtcaatctgcaagatgaaaaagatctacatttag

SEQ ID NO: 113282 - DNA, 642 bp, Artificial Sequence
  Description of Artificial Sequence: Synthetic coding sequence
atggtgccggaggaggagcctcaggaccgggagaaaggcctatggtggttccaactgaaagtctggagtatggcagtggttagcatcctcttgctgagtgtgtgctttaccgtctcctccgtggtcccgcacaactttatgtacagcaagaccgttaagcgcctcagtaaactgcgcgaataccagcagtaccacccgagcctgacatgtgtcatggagggcaaagacattgaggattggagctgctgtccaaccccttggacctcattccagagctcttgctatttcatttcaaccgggatgcaatcatggacaaaaagccagaagaattgctctgtcatgggagcggatttggtggtaataaacactagagaagagcaagatttcattattcagaatctgaaacgcaactcttcctattttctgggccttagcgaccccggtggacgccgtcactggcaatgggtggaccagactccctataatgagaacgtaacgttttggcactctggcgaaccaaacaatctggatgaaagatgcgcgataattaattttaggagctccgaggaatgggggtggaatgacatccattgccatgtcccacagaaatccatatgcaaaatgaaaaagatctacatctag

SEQ ID NO: 113283 - DNA, 549 bp, Artificial Sequence
  Description of Artificial Sequence: Synthetic coding sequence
atggtgcctgaagaggagccacaggatcgggtgcctcataatttcatgtattctaaaaccgtcaagaggttaagcaaactgagagagtatcagcaataccaccccagtctgacatgtgtaatggaaggaaaagatattgaggactggagctgttgccccactccctggacctcctttcaatcctcctgttactttatctcgaccggcatgcagagctggaccaagagccaaaaaaactgttcggtcatgggagctgacttagtggttataaatactagggaggaacaggattttatcatccagaacctcaaacgcaacagctcctactttctgggcctctccgatccagggggccgtagacactggcagtgggtggatcaaaccccttacaacgagaatgtgaccttttggcacagtggtgagcctaacaatttggatgagagatgtgcgataatcaacttcagaagctcagaagaatggggatggaatgacatccactgtcatgtgccccagaagtcgatctgcaagatgaaaaagatctacatctag

SEQ ID NO: 113284 - DNA, 642 bp, Artificial Sequence
  Description of Artificial Sequence: Synthetic coding sequence
atggtcccagaagaagaaccccaagatcgggaaaagggtctctggtggtttcagctgaaagtttggagcatggccgtggtgtccattttgttgctctcggtctgtttcacagtaagttctgtggtacctcataatttcatgtattctaagactgtgaaaaggctctccaagttgcgggaataccagcagtatcatccttctctcacatgtgtgatggagggcaaggatatagaagattggtcatgctgccccactccctggacatcttttcaatcttcatgttatttcatttccacaggaatgcagtcgtggactaaatctcagaagaactgtagcgtcatgggggccgatctggtcgtaatcaatacccgtgaggagcaggatttcatcatccagaacttaaagagaaactcatcttatttcctgggcctctcggaccccggaggccgccgacattggcagtgggtggaccaaacgccatataatgaaaacgtgacattctggcattctggagaaccaaataatctcgacgaacgctgcgctatcattaactttcgctcaagcgaggagtggggttggaacgacatacactgccatgtccctcagaagagcatctgcaagatgaagaagatttacatctag

SEQ ID NO: 113285 - DNA, 648 bp, Artificial Sequence
  Description of Artificial Sequence: Synthetic coding sequence
atgggtcttgaaaagcctcagtccaagctggaaggagggatgcatcctcagctgattcccagtgtaatcgcggtggtttttatcttgcttctttctgtctgttttattgcgtcatgtctcgtgacacaccacaatttttcgagatgcaaacgaggcactggggtccacaaattagaacatcatgctaagctgaaatgcatcaaggaaaaatccgagctcaagtctgccgaggggtctacatggaactgttgtccaattgattggagagcctttcagtctaactgctatttccccctgaccgataacaagacgtgggcagaaagtgaacgcaactgctcagggatgggagctcacttaatgacaatttccaccgaagcggagcagaactttatcatccagtttttggataggagattgagctattttctcgggctgagggacgaaaacgcgaagggacagtggaggtgggtcgatcagactccattcaacccacggcgagtcttctggcacaagaacgagccggataattcccagggagagaactgcgtggtgctggtttacaatcaagacaaatgggcctggaacgacgttccttgtaatttcgaagcttcccgtatctgcaagattcccggcaccacactgaactag

SEQ ID NO: 113286 - DNA, 435 bp, Artificial Sequence
  Description of Artificial Sequence: Synthetic coding sequence
atgggattagaaaaacctcaatctaagctggaggggggaatgcatccccagctgatcccttctgtgatcgccgtggtcttcatcttgctcctttccgtctgctttatcgcctcttgcctcgtgacacatcacaactttagccgctgtaaaaggggaaccggtgtgcacaagctggagcaccacgccaagttaaagtgcatcaaggaaaaatcagaactcaagagcgccgaggggagcacttggaactgctgtcccatagactggagggcattccaaagcaattgttactttccacttacagacaataagacctgggcagagagcgaacggaactgctcaggtatgggagctcacttgatgaccatttctactgaggccgagcagaacttcatcattcaatttctagatcggagactctcctattttctgggttag

SEQ ID NO: 113287 - DNA, 660 bp, Artificial Sequence
  Description of Artificial Sequence: Synthetic coding sequence
atgaactcttctaagtcgtccgaaacccagtgtactgagcgagggtgcttttcctcccagatgtttctgtggacggtggctggaattcccatactgtttcttagcgcctgtttcatcactcggtgcgtggtcacttttcgcattttccaaacatgtgatgagaagaaatttcaattgcctgagaatttcaccgagctgtcttgctacaactatggctccggctccgtgaagaattgttgccctcttaactgggagtactttcaatcctcatgttattttttcagcaccgatacaattagttgggcactcagcttgaagaactgttcagcgatgggggcacatctagtggtgattaattcgcaggaagaacaagaattcctgtcatacaagaaacccaaaatgagagaatttttcattggcctctctgaccaagttgtcgaaggacagtggcagtgggtcgatgggactccactcactaaatccctcagcttttgggatgtgggcgagccgaacaatatcgcaacgctcgaagactgcgctactatgcgtgattcaagcaatccacgccagaactggaacgatgtcacttgtttcctcaactatttcaggatatgcgaaatggtcggaatcaaccctctgaacaagggcaaatccctgtag

SEQ ID NO: 113288 - DNA, 1134 bp, Artificial Sequence
  Description of Artificial Sequence: Synthetic coding sequence
atgagtgactcaaaagaacccagggtccagcagctaggactcctcgaagaggatcccaccacaagcggcatacggctgttccctcgcgacttccagttccagcagatacatggacataagtccagcacgggctgtctgggccatggcgccctagtgttacagctcttatcgtttatgcttctggcaggtgtcctagtagccattctagttcaggtgtctaaagttccgtcttctctgagccaggaacagtccgaacaggatgctatttatcagaatttgactcagctgaaggcagccgtgggagagctctccgaaaagagtaagctgcaagaaatataccaggagttaacacaacttaaggctgccgtcgtgggggagctcccagagaaaagcaagttacaagaaatttaccaggagcttactcgcctgaaagcagcagtgggtgaactgccagaaaagagtaagctgcaggaaatctaccaggagctgacacgactgaaagcagctgtgggcgagctgcctgagaagtccaaactgcaggaaatctatcaggagctgaccgagctcaaagctgctgtgggggagctgcctgagaaaagcaaattacaggagatctatcaggaactgacacagcttaaagccgccgttggcgaactgcccgaccagagcaaacagcagcagatataccaagagttgacagacctcaagactgctttcgaacgtctctgcagacattgtcctaaagattggacctttttccaggggaactgttactttatgtccaattcccagagaaattggcacgactctgttacagcatgccaagaggtgcgagcccagctcgttgtaattaaaactgccgaggagcaaaacttcttgcagcttcagacatctcggagtaaccgattctcttggatgggactgtcagaccttaaccaggaagggacatggcagtgggtcgacggcagtcctctttcaccctccttccagcggtactggaatagcggcgagccgaacaattcagggaatgaagactgcgccgaatttagcggcagcggatggaacgacaacaggtgtgacgtggataattattggatttgcaagaagcctgcggcatgtttcagagatgaatag

SEQ ID NO: 113289 - DNA, 1200 bp, Artificial Sequence
  Description of Artificial Sequence: Synthetic coding sequence
atgagtgacagtaaagaaccacgcgtccagcagttaggcttgctggaagaggatccaactacatcaggcattcgcctgtttccgcgggactttcagttccagcagattcacgggcacaaatcttcaacgggctgcctggggcatggcgcattggtgctgcagctgctctccttcatgcttctcgctggcgttttagtggccatcctggtccaggtctctaaggtaccgagcagcctgtcccaagaacagtccgaacaggatgccatctatcagaatctgacgcaactgaaagccgctgtgggggaactctccgagaagagtaagttgcaagaaatctatcaggagctgacccagctgaaggctgctgtgggcgagctgccagaaaagtctaaactgcaggaaatctaccaggaactgactcggctcaaagctgccgtcggagagctccccgagaagagcaaactgcaggagatctaccaagagttgaccagactgaaagccgccgtaggcgagctgcctgaaaaatcgaagctgcaggaaatataccaggagctcacaagactgaaggccgccgtgggggaactgcccgaaaagagcaagttacaggagatctatcaggaacttacagagttgaaggcagctgtgggagaactgcccgaaaagtcaaagttgcaggaaatttatcaggagttaacccagctgaaagccgcagtgggcgagttaccggaccagtccaagcagcagcaaatctaccaggagctgaccgacctgaaaacggcttttgaacggctttgccgacattgtccaaaggactggacattctttcaaggaaattgttactttatgagtaacagccagaggaactggcacgattctgtgactgcatgtcaggaggtccgggctcagctggtcgtaatcaagaccgccgaagaacaaaatttccttcagctccagaccagtcgatccaatcgtttctcatggatgggcctttccgacctcaaccaggagggcacgtggcagtgggtggatgggagtcccctgagcccctctttccagcggtattggaattccggcgagcccaataatagtgggaatgaggactgtgctgagtttagcgggagcgggtggaatgacaacagatgtgacgtggacaactactggatctgtaagaaacctgctgcctgctttcgggatgagtag

SEQ ID NO: 113290 - DNA, 1047 bp, Artificial Sequence
  Description of Artificial Sequence: Synthetic coding sequence
atgtcagattccaaggagcccagagtgcaacagctgggattactgggttgcctgggtcatggagcactggttctccaactcttgagctttatgctgctggccggtgttctggttgctattctcgtgcaagtgagcaaggttccaagctccctgtcccaggagcagtctgagcaagacgcaatttaccaaaacctcacccagctaaaagccgccgtcggagagctttcagaaaaaagtaaactccaggaaatctaccaggaactaacgcaactcaaagctgcagtgggggagcttccagaaaagagtaaattacaggaaatttatcaggagttaacgcgactgaaagcagcagtcggagagcttcccgagaagagcaagttgcaggaaatttaccaggagctaaccagacttaaagccgctgtcggagagctgcctgaaaaatccaagttacaggaaatctatcaggaactgacagaattgaaagccgccgtgggggagctgcctgagaagtctaaactgcaggaaatctatcaggaactgacacagctaaaagcagctgtgggagagttgcctgatcaatctaaacagcagcagatctaccaggaactcactgatctgaaaactgccttcgagaggctgtgtcggcattgtccaaaagactggacttttttccaaggaaattgttatttcatgagcaatagccagcgcaactggcacgacagcgttaccgcctgtcaagaggtgagggcccagctggtggtcatcaaaacagccgaggagcaaaacttcctacagctacagacttccaggagtaatcggtttagttggatgggcctcagcgatttaaatcaggagggcacctggcagtgggttgacggtagccctctaagcccgtcttttcagcgctattggaatagtggtgaaccaaataactcaggtaacgaggattgcgctgaatttagtggctccgggtggaatgacaacagatgtgatgtagataactactggatctgcaagaagccagctgcgtgtttccgggatgagtag

SEQ ID NO: 113291 - DNA, 975 bp, Artificial Sequence
  Description of Artificial Sequence: Synthetic coding sequence
atgtcagatagcaaggagcctagggtccagcagctgggacttctagaagaggacccaacgacatccggaattaggttgttccctcgagattttcaattccagcagatacacggccacaagtcctcaacgggttgcttgggtcacggagctcttgtgctgcagttactgagtttcatgctcctggcaggggtgctggttgctattctggttcaggtcagtaaggtaccctctagcctttcacaggagcagagcgagcaggacgccatttaccagaaccttacccagttgaaagccgctgttggggagttatcagagaagtccaagcttcaggagatttaccaggaactgactcaactgaaagcggccgtgggggagctgccggagaagtccaaactacaggagatctaccaggagctgactaggttaaaggcagctgtgggggaacttccggaaaaatctaaactgcaggaaatttatcaagaactaactcgcctgaaggcagcggtgggagagctgcccgaaaagtccaagctgcaggaaatctaccaggaactcacacggctcaaggccgcggtcggtgagttgccagagaagagcaaacttcaggaaatataccaagaattgactgagctaaaggcagcggtgggtgagcttcccgaaaaatctaaattgcaagagatctaccaggaactgacccagttgaaagcggccgtgggtgagcttcccgatcagtctaaacagcagcagatctatcaggaactgactgatctcaagaccgcgttcgagcgtctgtgcagacattgccctaaagattggacattctttcagggcaactgctattttatgtctaattcccagcgaaattggcacgactccgtcacagcttgccaggaagtcagagcccagctggtggttattaagactgccgaagaacagttacccgcagtgctcgaacagtggagaacacagcagtag

SEQ ID NO: 113292 - DNA, 771 bp, Artificial Sequence
  Description of Artificial Sequence: Synthetic coding sequence
atgagcgactccaaagaaccaagggtccaacagttaggccttttagtctccaaagtgccaagtagtttatcccaagagcagtcagagcaagacgctatttatcaaaatttgactcagctaaaggccgctgttggagagctcagtgaaaagtcgaagctgcaagagatctaccaggagcttacacagctgaaggcggctgtcggtgagctgcccgagaaatctaagctccaggagatctaccaggaactgacacgcctgaaggccgctgtcggcgagctacccgagaagagtaaactgcaggaaatataccaggagctgactcgccttaaagctgccgtgggggagttacccgaaaaatccaaactgcaagagatttatcaggagctcacacggctgaaggccgctgtcggcgaactgcccgagaagagtaagctccaggaaatctatcaggagctgaccgaactgaaggcggccgtcggcgagctgccggagaagtccaaattgcaggagatataccaagagcttacacagctgaaggccgctgtgggcgaattgccggaccagagcaagcagcagcagatttaccaggagttgaccgacctgaagacggccttcgagagactgtgtagacactgcccaaaggactggaccttcttccagggcaactgttacttcatgtctaattcacagagaaactggcatgattccgttactgcatgccaagaggtgagggcgcagctagtggttatcaaaacagccgaggaacaatag

SEQ ID NO: 113293 - DNA, 999 bp, Artificial Sequence
  Description of Artificial Sequence: Synthetic coding sequence
atgagtgattcgaaagagcctcgcgtccagcagctggggctcttagaagaggatccaaccacttctggcattcgtttatttccacgggattttcagtttcagcagattcacggccacaagtcatccaccgtgccattcctgctgggtcctgtgtccaaagttcctagcagtctgtcccaagagcagtcagagcaggacgcaatctaccagaatctgactcaattgaaggcagcagttggggaactgagtgaaaaatctaagttgcaggaaatctaccaggaactcacacaattgaaagctgctgtgggagaattacccgagaagagtaaactccaagagatctatcaggaactgacccgccttaaggcagccgttggtgagctccccgaaaaatccaaactccaggagatttatcaggaactgacgcgcctaaaggcagccgtaggggagctgccagagaaatccaaactgcaggaaatctatcaggagctcacagagctgaaagccgccgtcggagaactgccggagaaaagcaagctgcaggagatataccaggaactgacccaacttaaggccgcggtggaacggttgtgccgtcactgtcccaaggattggacttttttccagggcaactgttacttcatgagcaactcgcagcgaaactggcatgatagcgtcaccgcatgccaggaagtgcgagctcaactcgtggtgatcaaaaccgccgaggaacagaacttcctgcagctccaaaccagcagaagtaataggtttagctggatgggactcagcgatctgaatcaagaagggacttggcagtgggtggatggttctccattaagcccgagcttccaaaggtactggaactccggggagcccaacaactcaggtaacgaagattgcgccgagttttctggttccggctggaacgataatcggtgcgatgtcgacaactactggatctgcaaaaagcccgccgcttgcttccgcgacgaatag

SEQ ID NO: 113294 - DNA, 1164 bp, Artificial Sequence
  Description of Artificial Sequence: Synthetic coding sequence
atgtcggattcaaaagagcctagagtgcaacagctcggactcctggaggaagacccgacaaccaactttcagttccagcagatccatggacacaagagctcgactggatgcctggggcacggcgctctggtattgcagctcctgtccttcatgctgctcgctggcgtcctgccgcggttaagtaaggtaccgtcctcgctttcacaggaacagtccgaacaggacgccatatatcagaatctcacccagttgaaggctgctgttggagaacttagtgagaagagcaagctgcaggagatctatcaagagctgacccaattaaaggctgctgtaggcgagctgccagaaaagagcaaactgcaagaaatatatcaagagttaacccggttgaaagctgccgtgggggaacttccggagaagagtaagcttcaggaaatctaccaagagctgaccaggctcaaggcagccgttggtgaattgcctgagaaatcaaagctccaggaaatttaccaggagctcacacgcttaaaggccgcggtaggcgaactccctgagaaaagtaagctccaagagatttatcaggagctgacggaactgaaagccgctgtcggggaactccccgagaagagcaagctgcaagagatctaccaggaactcacccagttaaaggccgccgtgggcgagctgcctgaccagagcaaacagcagcagatctaccaagaactgaccgatcttaagacggccttcgaaagactgtgccgccattgtcctaaggattggacattctttcagggcaactgttactttatgagtaactcacagaggaactggcatgattccgtgacagcatgccaagaggtgcgtgcccaactcgtggttatcaagacagcagaagaacagaactttctgcagcttcagacaagtagaagcaaccgtttttcatggatggggcttagtgatctgaaccaggagggtacatggcagtgggtcgatggatctcccttgagtccctcattccaaaggtattggaactcaggggaaccaaataatagcggaaatgaggattgtgctgagttctccggcagcggatggaacgacaatcggtgcgatgttgataactattggatttgcaagaaacccgccgcctgctttcgggatgagtag

SEQ ID NO: 113295 - DNA, 567 bp, Artificial Sequence
  Description of Artificial Sequence: Synthetic coding sequence
atgaattggcatatgataatctctggcctgatcgtcgtcgtattgaaagtggtggggatgacactgttcctcctctacttcccacagatcttcaataaaagcaatgatggctttacaacgacaagaagttacggtacagtgtcacagatcttcggcagctctagcccctcgcccaatggcttcatcacgacgagaagctacggcaccgtgtgtcctaaggactgggaattttaccaggctaggtgcttcttcctcagcacctcggaaagcagctggaatgaaagtcgggacttttgtaagggcaagggaagtacccttgcaatcgtgaacactccagagaaattaaaattcctgcaagacattactgacgccgagaaatactttatcggcttgatataccacagggaggagaagcggtggcgctggattaacaattccgtatttaatggcaatgtgaccaaccagaaccaaaacttcaattgcgccaccatcggcttaactaaaaccttcgacgccgcttcctgtgatatctcctatcgccgaatatgtgaaaagaatgctaagtag

SEQ ID NO: 113296 - DNA, 630 bp, Artificial Sequence
  Description of Artificial Sequence: Synthetic coding sequence
atgatgcaagagcagcagcctcaatctacagaaaagcgcggctggttatccctgcgtctctggtctgtggcaggcataagtatcgctttgctgtccgcctgcttcatcgtttcttgtgtcgtgacataccattttacatacggagagaccggcaagagactgagcgagctccattcctaccactcttcattgacttgcttttcagaaggaacaaaagttcccgcatgggggtgctgtccggcatcgtggaaatcttttgggagtagctgctactttatttcttccgaggagaaagtatggagcaagtctgaacaaaactgtgtggagatgggggcccacctagtggtatttaatactgaagccgagcaaaacttcatcgtacagcagctgaacgaatcttttagctatttcctgggactgtcagatcctcagggcaacaataattggcagtggatcgacaagactccatacgaaaagaatgttagattctggcacctgggcgagcccaatcacagcgctgaacagtgtgcgtccatcgtcttctggaaacctacaggctggggttggaacgatgtcatctgcgagacaaggaggaattccatttgcgaaatgaataaaatctatttatag

SEQ ID NO: 113297 - DNA, 432 bp, Artificial Sequence
  Description of Artificial Sequence: Synthetic coding sequence
atggaatatcaccccgacctggagaacttggatgaagacggttatacacagcttcatttcgactctcagagcaacactcggatcgccgtggttagtgaaaagggatcgtgcgccgcttcaccaccttggcggctgattgctgtaatcttgggaatcctttgtctggtgatcctcgtcattgccgtggtcctggggactatgggagtgctcagctccccctgcccccctaactggattatctatgagaagtcttgctacttattctccatgagcctgaattcttgggatggctcaaagaggcagtgctggcagctgggctccaacctgctgaaaatcgacagcagcaacgaactaatcagcgatcagaatcactcatacccccggaagccaatctccaagctgtgcatggactcgcgtgtgagccacctgtag

SEQ ID NO: 113298 - DNA, 744 bp, Artificial Sequence
  Description of Artificial Sequence: Synthetic coding sequence
atggaatatcacccagacctggaaaatctggatgaggatggatatacacagctgcactttgattctcagtcaaacaccagaattgccgttgtgagcgaaaaaggcagctgcgcggcctcccccccctggcgcctaatcgctgtgatccttggcattctctgtttggtgattctggtcatcgcagttgtccttggaactatggccatatggagatccaatagtgggtccaacacactcgaaaacggctacttccttagcagaaataaggaaaaccacagtcaacccactcagagcagtctggaggactctgttactccaacaaaggctgtgaaaacaaccggggtgctcagcagcccctgtccgccaaattggattatctatgaaaaatcctgctacctgtttagtatgtccctaaacagctgggatggcagcaaaagacagtgttggcaacttggaagcaacctcctcaagatcgactcaagcaatgaactgggctttatcgttaaacaggtaagcagccaacctgataatagtttttggattggactttctcggccacagacagaagtgccctggctttgggaggacggatccacttttagctctaacctattccaaatcaggaccaccgcaactcaggaaaacccttcaccaaattgtgtctggatccacgtgagtgtaatttatgaccagttatgttccgtgccttcttatagtatctgcgagaagaagttttcaatgtag

SEQ ID NO: 113299 - DNA, 234 bp, Artificial Sequence
  Description of Artificial Sequence: Synthetic coding sequence
atggaatatcatcccgacctggaaaatctggatgaggatggctacactcagcttcactttgactcacagtcaaataccagaatcgccgttgtgagcgagaagggctcctgcgccgcctctccgccatggagactgattgccgttatcttaggtattttatgtcttgtgattttggtgattgctgtggtactaggcaccatggctggctttaaagcagtggagtttaaaggttag

SEQ ID NO: 113300 - DNA, 606 bp, Artificial Sequence
  Description of Artificial Sequence: Synthetic coding sequence
atggaataccatccagatctcgagaacctggacgaggacggctatacacagctgcacttcgattcccagagcaataccaggattgccgtcgtctccgaaaaaggtagttgcgcagcctcccctccgtggcgcctgatagcggttatactcgggattctttgtctagtgattttggtaattgccgtagtcctcggtactatgggcgtactctcttctccttgtccccctaactggatcatctacgaaaagagttgctatctcttctcaatgagcctgaacagttgggacggaagcaaacgacaatgctggcagttgggatctaacctccttaaaatcgattcatctaacgaactcggcttcatcgtgaaacaggtgtcatcccagccagacaattcattttggatcggcttgtcccgacctcagaccgaagtgccgtggctatgggaagatggctccacgttttctagtaatctgtttcagatcagaaccaccgctacacaagagaacccttcaccgaattgcgtatggatccacgtgtccgtgatatatgaccagctctgtagtgttccttcatattcaatctgtgaaaaaaaattttccatgtag

SEQ ID NO: 113301 - DNA, 507 bp, Artificial Sequence
  Description of Artificial Sequence: Synthetic coding sequence
atggagtaccaccctgatttggaaaatctggatgaagatggctacacacagcttcatttcgactcgcagagcaataccaggatagccgtggtcagtgaaaaaggggtcttatcgtcgccttgtcctcctaattggatcatatacgaaaagagttgttacttgttctccatgtcattgaattcctgggatggatctaaacggcagtgttggcagctcggatccaacctgctgaagatcgattcttccaacgaacttggatttatcgtcaaacaggtgtccagtcagccagataattctttctggatcggcttgagcaggccccaaacagaggtcccctggctgtgggaagacggctctacgttttcttccaacctgttccagatccggacgaccgcaactcaagaaaatccttcccccaactgcgtatggatccatgtgtcagtcatttacgatcagctgtgtagcgtcccatcgtactcgatctgtgagaagaagttttctatgtag

SEQ ID NO: 113302 - DNA, 351 bp, Artificial Sequence
  Description of Artificial Sequence: Synthetic coding sequence
atggagtatcatccagacctagagaaccttgacgaggacggatatacccagctgcactttgacagtcaaagcaatactcgcatcgcagtggtctcagagaaggggagctgtgcagcttctcctccctggaggctgattgcagtgatcctgggaattttgtgcctcgtgatcttggtgattgccgtcgttttaggcaccatgggtacgggccagtttctgaaagatctgtccttcctcaataatcggcggaagttgttcggggacccaatccaggaggccacccactggaggatggcaaccttttaccaagaaataaaaagaactacggtgaaccctcacaatcacttgtag

SEQ ID NO: 113303 - DNA, 744 bp, Artificial Sequence
  Description of Artificial Sequence: Synthetic coding sequence
atggagtaccaccccgaccttgaaaatttagatgaggatggctatacacaactgcatttcgactctcaatcaaatacccggatagccgttgtgagtgagaaaggctcatgcgccgcctccccaccgtggcgtcttattgctgttatccttggaatcttgtgtttggtcatactagttatcgcagttgtgctaggcacaatggccatctggcgatctaactctggcagcaacaccctggaaaatggctactttctgagcaggaataaggagaaccactcgcaacctacgcagagctcgctggaggacagtgtcacccccaccaaagccgttaaaacgaccggcgtattgtcaagcccttgcccccccaactggatcatttatgaaaagagctgctacttgttctccatgtctctgaattcttgggacggatcaaagcggcagtgctggcagctcggttccaacttgcttaagatcgactcatctaacgagctgggttttatcgtcaagcaggtgagcagtcaacccgacaacagcttttggatcggcctttccagaccacagaccgaagtgccttggctgtgggaagacgggagcacttttagcagtaacttgttccagatcagaacaacggcgacacaggaaaatccctcccctaattgcgtctggatccacgtatcggttatctacgaccaactgtgttccgtgccaagctacagtatttgcgagaagaagttctcaatgtag

SEQ ID NO: 113304 - DNA, 570 bp, Artificial Sequence
  Description of Artificial Sequence: Synthetic coding sequence
atggaataccatcccgacctggagaacctggatgaagatggctatacccaactgcatttcgattcccagtcaaacacgcggatcgcggttgtaagcgagaaaggctcttgtgccgctagcccaccctggcgcctgatcgctgttattctcggtattctgtgtctcgtcatactggtgatcgcggtcgtgctcggtaccatggcgatctggaggtcgaactctggcagtaacactctcgagaatggttatttcctaagtcgtaataaagagaatcatagccagcctacccaatccagcttggaggactccgttactcccacaaaggccgtgaaaacgacaggcgttcttagttctccatgtcctcccaattggatcatatatgaaaaatcttgttaccttttctcgatgtcattaaattcttgggatggttcaaagaggcagtgttggcaattaggctctaatctgctgaaaatagacagttccaatgaactcataagtgatcagaatcacagctatccacgaaagccaatttctaaattatgtatggactctcgggtgtcgcacttgtag

SEQ ID NO: 113305 - DNA, 10281 bp, Artificial Sequence
  Description of Artificial Sequence: Synthetic coding sequence
gtgcttccctcgcacacatgcggaaaccccggagagatactgaaaggtgttctacacgggactcggttcaatattggcgacaagatcaggtactcctgcctgccaggatatattctggaaggacatgcaattctgacgtgcattgtgtcaccagggaacggagcatcgtgggatttccctgcccctttctgcagggctgaaggggcctgcggagggacgctgcgaggaaccagcagtagcatttcctccccccacttcccaagtgaatatgaaaataacgccgactgtacctggaccatcctggccgagccaggcgacactatcgcattagtcttcactgacttccaattggaggagggctacgatttcctggaaataagcgggacggaagctcctagcatctggctgacaggaatgaatctgcccagccctgtcatttcttcaaagaactggcttcgactgcatttcactagcgatagcaatcaccgccgtaaaggttttaatgctcaattccaggttaagaaggccattgaactaaaatctcggggcgtgaaaatgcttccaagcaaagatgggtctcacaagaacagtgtgctgtcccagggcggggtggcactggtcagtgatatgtgtccagaccctggtattcctgaaaatgggcgaagagctgggagtgactttagtagggtcggcgctaacgtacagttttcttgtgaggataattatgtcctccaaggttccaagagcataacatgccaacgtgtaaccgagactctggctgcctggtcagaccatcgcccaatttgccgggctagaacctgcgggtctaatctccgtgggccttcgggcgtgataacaagtcccaactacccggtccagtacgaagataacgcacactgcgtctgggtgatcactacgactgatccggataaggttatcaaactggctttcgaagaattcgagcttgagcgcggctacgacactttgactgttggcgacgccggtaaggtcggggacaccaggtctgtgctctatgtactgacgggaagttccgtgcctgacctcatcgtgagtatgagtaaccaaatgtggcttcacctgcagtccgatgattccattggcagtcccggctttaaagcagtttatcaggaaatcgagaagggcggatgtggtgacccaggtatccccgcgtatggcaaacgtaccgggtcctcattccttcacggtgacaccctgaccttcgagtgtcccgcagcttttgagctggtgggagagcgggtcattacctgccagcagaataaccagtggagcggcaacaagccaagctgcgtcttctcctgcttcttcaactttacggcctcttctggcatcattctgtcacccaactatcctgaggagtacggcaacaacatgaattgcgtctggttaattataagtgaacctgggtcacgcatccaccttatatttaatgatttcgacgtcgaaccacaattcgatttcctggctgttaaagacgatggcatcagtgacattacagttctgggcactttctctgggaatgaggttccatcacaactggcctcctccggccacatcgtgcgtctggagtttcagagcgatcattccacaaccggaagaggcttcaatattacatacactacatttggccaaaacgagtgccacgaccctgggataccaattaatgggcggcggtttggcgatcgattcctgctcgggtcttccgtttcattccattgcgatgacggctttgtgaaaacccaagggagtgaatccataacctgtatcctgcaggacggaaacgtggtgtggtcctctacagttcctcgctgcgaggcaccttgtgggggccacttgaccgcatctagcggtgttattcttcctccgggctggcccggttattacaaagactccttacattgcgagtggatcatcgaggctaaacctgggcacagcatcaagatcaccttcgaccgttttcagaccgaggtgaactatgatacgttggaggttcgcgatggccccgctagttccagtcctctgatcggcgaataccacggcacccaggccccgcagttcctcatctctaccggcaactttatgtatctgctgtttacgacggacaactcacgcagctcaatcggcttcttgatccattatgaatcagttactctggaatcagactcctgcctggatccagggatcccagtgaacggacacagacacggaggtgatttcggtattcgtagcacagtgacattctcctgcgaccctgggtacacgctatcggacgacgagccactcgtatgcgagcggaaccatcaatggaaccacgctctaccatcgtgcgacgctctgtgcgggggctacatccaaggaaagtcagggaccgtgctgtcccctgggttccccgatttctaccctaatagccttaactgtacatggaccatcgaagtttcgcacggcaagggggttcagatgattttccataccttccatcttgagagctctcatgactacttgctgattacggaagacggctccttttcagagcctgtggctcgtttaacgggaagcgttctaccccacacaataaaggcggggctctttggaaatttcactgcccagcttcgcttcatctctgatttctcaatttcatacgaagggtttaacatcaccttttccgagtacgacctagagccgtgcgacgaccctggggtacctgcttttagccggcgcatcggatttcatttcggcgtaggagacagcctcacattttcgtgcttcctgggctaccgactggagggcgccactaaacttacttgtctcggaggagggcgtcgcgtatggtctgcccctctgccccggtgcgttgcggagtgcggggccagcgtgaagggaaatgagggaacccttttgtctccaaacttccctagcaattatgacaataatcatgagtgcatctataaaatcgaaactgaggcaggaaagggaatccacctgcgaacccgctctttccaactctttgaaggcgacacactgaaagtgtacgacggcaaggactctagctccaggccgttgggcacctttaccaagaacgaactcctggggttgatattgaacagcacaagcaaccatctttggctggaatttaacactaatgggagcgacactgaccagggattccagctcacttacactagcttcgatctggttaagtgcgaagaccccggaattccaaattatggttatcgtattagagacgagggacattttaccgacaccgtggtgctgtactcttgtaatcccgggtatgcaatgcacgggtctaataccctaacgtgcttgtcaggagacaggcgagtctgggacaagcccctaccttcgtgtatcgctgaatgtggcggacagatccatgcagccacgtcgggcagaatactttccccaggataccctgcgccctatgacaacaacctgcattgtacctggattatagaggcggatccaggaaagactatctctctgcacttcatcgtgttcgatacagagatggcccacgacatactgaaagtgtgggacgggcctgtcgattccgatatcctgctgaaagaatggtctggaagtgctctcccggaagacatccattcgacgttcaatagcttgaccctacagttcgactccgacttctttatcagcaagagcggcttttcaatccagttttcaacaagcatcgctgcaacctgtaatgacccaggaatgccccagaatggtacaagatacggggactcacgcgaggccggagatactgtcaccttccagtgtgaccctggataccaactgcaagggcaggctaaaatcacctgcgtccagttgaacaaccgctttttctggcaacctgatccccccacttgcattgccgcctgcggcgggaacctgaccggacctgccggggtgatcttgtctccgaactacccacagccctatccacccggaaaagagtgtgattggagggtgaaggtcaaccctgatttcgtgatagcattgatttttaaatcttttaacatggagccttcctacgatttcttgcacatttatgaaggggaggattccaactctccgttaataggatcttaccagggttcacaggccccagagcgcatcgagtcatctggaaactcactattcctggccttccgatcagatgccagcgttgggctaagtgggttcgccattgaatttaaggagaaaccccgggaggcctgctttgaccccgggaacatcatgaatggaacacgcgtcggtaccgacttcaagttaggaagcactattacgtatcagtgtgattcaggctacaagatcctcgaccccagtagtatcacctgtgtcattggcgccgatggcaagccttcatgggatcaagtcctgccttcttgcaatgctccctgtggaggtcagtacacaggttcagagggggtcgtactgtcacctaattatccacataactatactgctggccagatatgcctttactccattacagtcccgaaagaattcgtggtgtttggacagttcgcttactttcagacggccctcaacgacctggccgagttgttcgatggcacccacgcccaagccaggctgctgagttcgctgtccggatcgcattctggcgagaccttgccacttgcgacgagtaaccagatcctgctgcgattcagcgccaaaagcggcgctagtgcgagggggttccactttgtctaccaggctgtgccgagaacttctgatacccagtgttcatcagtacctgaacccagatatggcagacgtatcgggagtgaattctcggcagggtccattgtgagatttgagtgcaatccaggctatctgcttcagggatccaccgccctccactgccagtcggtacctaacgcccttgcccagtggaacgacacgatcccgtcgtgtgttgtgccttgctccgggaatttcacccagcgcagggggactattttatcccccggctatcctgagccatatggcaataacttaaactgtatttggaaaatcatcgttaccgagggcagtgggatccaggacccctccgaccagttttgtcatggggccgagcttgggctggagatccacgacggcggtgacgttaccgcgccccgcctgggtagctttagcggaactacagtgcccgccttgctgaattcaacttctaaccagctctatctgcactttcaaagcgacatatcagtggctgcggctggattccatctggagtacaaaactgtgggactagcagcctgtcaggagccagctttgcccagtaatagcatcaagatcggtgaccgatacatggttaatgatgtgctcagcttccagtgtgagcccggatatactctccagggccgcagccacatcagttgcatgccaggaaccgtcagacgctggaattaccctagccccctgtgcatcgccacatgcggaggcacattgtccactttgggaggggttatcctgagccccggattccctggaagctacccgaataacttggattgtacctggagaatctctctgcccattggttacggagcgcacatccagtttctgaacttttctaccgaggctaatcacgactttctcgaaatccaaaacggaccttaccatacaagccccatgatcggccagttctcaggaacggatctgcccgccgccctgctgagtactacccacgagacgcttatccatttttattccgaccattcgcagaatcgacaaggtttcaaactggcataccaggcatacgagctgcaaaattgtcctgatcctcctccatttcaaaacgggtatatgatcaattctgattactcagtaggtcagagtgtgtccttcgagtgctaccctggctacattctgattggtcaccctgttctgacctgtcagcacggaatcaatcgtaattggaattacccgtttccaaggtgcgacgcaccttgcggctataacgtaacttctcagaatggcacaatctacagtccaggctttccagacgaatatcctattctgaaagattgcatatggttgattactgttccaccaggacatggcgtatacataaacttcactcttttgcaaacggaagcggtcaatgactacattgctgtgtgggacggtcctgatcagaactcaccgcagttgggcgtgtttagcggtaacacagccttggagacagcctatagttctactaatcaggtcctccttaagttccacagcgacttcagcaatggaggcttcttcgtgctcaacttccacgcctttcagctgaaaaaatgtcaaccccccccagcagtgcctcaggctgagatgctgacagaagacgatgattttgagataggggatttcgtgaaataccagtgccatcctgggtacacactggttgggaccgatattctgacatgtaaactcagctcccagctgcagttcgaggggagtctaccgacttgtgaggcccagtgccccgcaaacgaggtccggaccggatcttctggcgttattttaagcccgggctaccccggcaactattttaacagccaaacatgttcttggtccattaaagtggaacccaattacaatatcaccatctttgtcgacacctttcagagtgaaaagcagtttgacgctctcgaggtatttgacggatcaagtgggcaatcacctttactcgtggtcctttcaggcaaccacacagagcagtcgaactttaccagccgctccaatcagctgtaccttcgatggtcgaccgatcacgccaccagcaagaaaggcttcaaaataagatacgccgctccctactgtagcctgacacatccccttaagaatggaggtattctgaataggacggctggagctgtgggatccaaagtgcattacttttgtaagccaggttaccgcatggtgggccactccaacgcaacctgtcgaagaaaccctctgggaatgtaccaatgggatagtctgacacccctttgccaggccgtgagctgtggaataccagagtcccctggaaacggctcatttaccggcaatgaattcacattggactcgaaggtagtttatgaatgtcacgagggctttaagttggaatcaagtcaacaagcaacggccgtgtgccaggaggatgggctgtggagcaacaaaggcaagccacccacctgtaagcccgtagcttgtccgtcaatagaagcccagcttagcgagcacgtaatctggcgtcttgttagcgggagccttaatgaatatggggcccaggtgctcctatcatgctcccccggctactacctagagggctggcgtttgctgcggtgtcaggccaacggcacctggaatataggtgatgagaggccctcatgcagggtgatctcatgcggatcgctttcttttccaccaaacggaaataaaatcggaacactgacagtctacggcgccactgctatctttacttgtaacactggatacactctggtgggttctcatgtgagagagtgtcttgcaaacggactctggagcggaagtgagaccagatgcttggctgggcactgcggttcaccagatcccattgtaaacgggcatatctctggcgacggcttctcttatagggataccgtggtttaccagtgtaatccaggcttcaggctggtgggaacgagcgtacggatatgcctacaagaccataagtggagcgggcaaactccagtatgcgttccaattacctgtggccaccctggaaacccggctcacgggtttacgaatggcagcgagttcaacctgaatgacgtcgtcaatttcacttgtaatactgggtacctgctgcagggagtatctcgcgcccagtgcaggagcaatggccagtggagcagccctctgcccacttgtcgggtggtaaattgttccgaccctggttttgtcgaaaacgccatccgtcacggccagcaaaactttccagaatcctttgagtacgggatgagcatactttatcactgtaaaaaggggttttacctgctgggcagctcggctttgacttgtatggccaatgggctgtgggatcgatctttgccaaaatgtttagccatatcctgcggtcaccccggagtcccagcgaacgccgtcttaactggagagctgtttacctatggtgctgttgtgcattactcatgcaggggttctgagagcctcattgggaatgatacacgagtgtgtcaagaggactcccactggtctggcgctttgcctcattgtaccggtaataaccccggcttttgcggcgacccgggaacccctgcccatggcagcaggctcggcgacgacttcaaaacaaagagcctcctccggttctcttgtgaaatgggacaccaactgcggggctcacctgagagaacctgcctgctgaacggcagttggtctggcttgcaacccgtatgcgaggctgtgagttgcggcaacccgggaacccccacaaacggaatgattgtgagcagcgacggaatcctgttttcatcaagtgttatctatgcctgctgggaaggttataagacatccggcctgatgacgagacattgcactgctaacggcacctggacgggtactgcacccgattgtacaattatctcatgcggcgaccccggaacgcttgccaatgggatccagttcggcacggatttcacatttaataagacggtgtcttaccaatgtaaccctggctacgtgatggaggccgtaacctctgccactatccgttgtaccaaagatggccgctggaatccatccaaaccagtttgcaaggcagtgttgtgccctcagccacctcccgtgcagaacggtaccgtggagggttccgatttcaggtggggcagctccatctcatactcatgtatggatgggtatcaactcagccactcagctatactgagctgcgaaggtaggggcgtctggaagggagaaatcccccagtgtctccccgttttttgcggcgaccctgggatccctgcggaggggcgcctcagcggcaagtctttcacgtataagtctgaagttttctttcagtgcaaatctcctttcatcctcgtgggctcttcccgcagggtttgccaggctgatggaacatggtctgggatccaacccacatgtatcgatccagcgcacaacacctgtcctgatccaggcacccctcactttggcatccagaacagctcccgtgggtacgaagttggaagtaccgtcttctttaggtgccgtaagggctatcatattcagggctccactacaaggacttgcctagctaacctgacgtggagtggtatccagacggagtgcatcccacacgcatgtcgacagcccgaaaccccagcacatgccgatgtgagagccattgatctcccgaccttcggatacaccttggtgtacacatgtcatccaggattcttcctggcaggtggatctgagcataggacctgcaaagcagacatgaagtggactggcaagtctcccgtttgtaagtccaaaggagtccgagaggtgaacgaaacagtgactaaaactcctgtgccatcggacgttttctttgtgaactcattgtggaaagggtactatgagtacctgggaaagagacaaccagcaacactgacagtggattggttcaacgcaacctcgtccaaagtgaatgccactttttcagaggccagtccagttgagctaaagctgactggcatctacaagaaggaagaagcacacttactgctcaaggcgttccagatcaagggccaagctgacatctttgtgagcaagtttgagaatgataattgggggctggacggatacgtgagttctggtctggagcgagggggctttaccttccaaggtgatatccatgggaaggacttcggaaaattcaaactggagcggcaggatccactgaacccagaccaggatagctcatctcactaccacggtacatcctcaggatcggttgctgccgccatcctggtcccctttttcgcccttatactcagtggcttcgctttctatctgtataagcatcgcactagacccaaggtccaatacaatgggtatgccgggcacgaaaactcaaacggccaggcatcattcgaaaacccaatgtatgatacaaacctgaaaccaactgaggcaaaagccgtgcgttttgacactacactgaacacggtttgtaccgtggtgtag

SEQ ID NO: 113306 - DNA, 10167 bp, Artificial Sequence
  Description of Artificial Sequence: Synthetic coding sequence
atgaccgcctggcgaaggttccaaagcctgctcctgctcctggggctcctggtcctatgtgcaagattactgacagctgcaaaagggcaaaattgcggggggcttgttcaagggccaaatggaactatagaatcccccggctttccgcacgggtatcccaactacgcaaactgtacgtggattatcatcacaggggagcgtaatcgcattcagttgtctttccatactttcgcccttgaggaagactttgatattctctctgtgtacgacggacagccgcagcagggcaatcttaaggtgcggttgagtgggtttcagctgccctccagtattgtgagcactggctcaattcttactctctggtttactaccgacttcgccgtgtctgctcagggcttcaaggctctttacgaggtcctgcctagtcacacctgcgggaacccaggcgaaatcctgaagggcgtgttacacggcactcggtttaatatcggggacaaaatccgctatagttgcctgcccgggtatattttggagggacacgcaatcctcacctgtatcgtgtccccaggaaacggcgcgtcctgggactttcccgccccattctgccgcgctgaaggtgcctgcgggggcaccctgagggggaccagctcatcaatttcctcgccacatttcccaagcgaatacgagaacaacgcggattgcacttggactatactggccgagcccggcgataccattgcgttggtattcaccgattttcaactcgaggaggggtatgatttcctcgagattagcggcacagaggccccttccatttggctgacaggtatgaatctgccatccccggtgatatcttccaagaattggcttagactccattttacctcggactccaaccatcggcgcaaaggcttcaatgcacagtttcaagtaaagaaggccatcgaattaaagagccggggtgtgaagatgcttccaagcaaagacggatctcacaaaaactcagtccttagtcagggtggggtcgctctggtttctgacatgtgtccggaccccggcattccggagaacggccgaagggccggatcggatttttccagagtgggggctaacgtgcagttcagttgcgaggataattatgttttacaggggagcaaatcaattacttgtcagcgggtgacagagactttggcagcttggtccgatcaccggcctatctgtagagcacgcacttgcggatccaatttaaggggaccctcaggggttattacctcccctaattaccctgtccaatatgaggacaacgcacattgcgtttgggtcattacgactactgatcctgataaagtgattaaactggcgtttgaggagtttgaattggaaaggggttacgacaccttaacagttggtgatgccggtaaggtaggggacacaaggagcgtgctgtacgtgctcacaggctccagcgtgcctgacctgatagtttctatgagtaaccagatgtggttgcacctccaatcagacgattctataggctcccctggcttcaaggctgtctatcaggagattgagaagggtgggtgtggtgatcctggaatcccagcgtatggaaaacgaactggatcctcgttccttcacggcgataccctgaccttcgaatgccctgcagctttcgaacttgttggcgaaagagttataacatgccaacagaataaccagtggagcggtaacaaaccatcttgtgtctttagctgcttttttaatttcacagccagctcagggattatactgagcccgaactaccctgaggagtatggtaataatatgaactgtgtctggttgatcattagcgaaccaggatctcgaatccacctaatttttaatgattttgacgtagagcctcagttcgattttctggctgttaaagatgacggtatatctgacatcaccgtgctgggcacattctctggcaatgaagtgccaagccagttggcaagctcaggccacatcgttcgcttagagtttcagtcagatcacagcacgaccgggcggggctttaacataacctataccactttcggccagaatgaatgtcatgaccctggcattcccattaatggccgccggttcggcgaccgatttttactgggcagttctgtgagttttcactgcgacgacggtttcgtcaagacacaaggctcggaatccatcacctgtattctgcaggatgggaacgtcgtgtggagctctacagtgccccgttgcgaggctccctgtggaggtcatttgaccgcttcatctggagtgatactaccccccgggtggcctggatactataaagactctctgcattgcgaatggattatcgaagcgaagcccggacatagtattaaaatcacgttcgacaggtttcagaccgaggtaaactatgataccctggaggtccgggatggtcccgccagttcctccccactaattggcgagtatcacgggacccaggcaccacagtttctaataagcacagggaatttcatgtacctgctgtttacaaccgacaattcacggtcctccatcggatttctgattcattacgagtcagtgaccctggagtctgactcttgtctagacccgggtatccccgtgaacgggcatcggcatggcggagacttcgggattcgctcaactgtcaccttttcttgtgaccctggttataccctcagcgatgacgaacctttggtgtgtgagcgcaatcaccagtggaaccatgccctacccagctgcgacgccctatgcggaggctacatccaaggaaagtcgggtactgtcctttctccagggttccccgacttctacccaaacagcctaaactgcacttggaccattgaggtgagccacggtaaaggcgtccaaatgatttttcacaccttccacctcgaaagctctcacgactaccttctcattaccgaggatggtagcttttcagagcccgtagcccgactgaccggatccgtactaccccataccataaaagccggacttttcgggaacttcacggctcagttgcggtttattagtgacttttcaatcagttacgaaggcttcaatatcacatttagtgagtacgacctggaaccatgcgatgaccccggagtgccggcattctcccggagaattggattccactttggcgttggcgattccttgacattttcctgtttcttaggatataggttggagggcgccacaaagctgacctgcttaggcggggggcgtagggtgtggtccgcgcctctgcccagatgtgtagccgagtgtggggcaagtgttaaagggaacgaaggcacactgcttagccctaactttccctcgaattacgacaacaaccatgagtgcatttataagattgaaactgaagccggtaaagggattcacttgagaacgcgctcctttcagctattcgagggtgatactttgaaggtttacgatgggaaagattccagctcacgaccgctgggaactttcacaaagaacgaactcctgggcctgatcctgaactctacatccaaccatctctggctggaattcaatacgaacggttccgacaccgaccaggggttccagttgacctacacgagctttgatttggtcaagtgcgaagaccctggtatccctaattatggttataggatcagagatgaagggcattttacggataccgtcgtgctgtactcctgtaaccccggctatgcaatgcacggctctaataccctgacctgcctaagcggggatcgccgggtgtgggataagcctcttccctcttgcatcgctgagtgtggaggccaaatccacgccgcaacatccggtagaatccttagtcccgggtaccccgccccttatgacaataacctccactgtacgtggattattgaagccgaccctggcaaaactatctcattgcatttcatcgttttcgataccgagatggctcatgacatcctcaaggtttgggacggaccggtggattccgacatcctgctgaaagagtggtcaggcagcgctctcccggaagacatccacagcacattcaattcgctgaccctgcagttcgattcagacttcttcatcagtaaatcaggtttttccatccaattttctacttccattgcagccacctgcaacgaccctgggatgccccaaaatggaacccgctacggtgatagcagggaggcaggtgatactgtgaccttccagtgtgacccgggatatcagctccagggacaggcaaaaatcacatgtgtgcagctgaacaatagatttttctggcaaccggatccaccgacttgcatcgccgcctgcggagggaatctgactggccccgctggcgtgattctctctcctaattaccctcagccctatccaccaggcaaggagtgtgactggcgagtgaaagtaaaccccgactttgttatagcactcattttcaagtccttcaatatggagccgtcctatgacttcttgcatatatacgagggggaggactctaatagcccactcataggttcctaccagggaagccaggcccctgaaaggattgagagtagtggaaatagcctatttttggccttccggtcagacgcgagtgtggggctttcgggctttgcaatagaatttaaagagaagccacgggaagcatgtttcgatccaggcaatattatgaatggaacccgagttggcaccgactttaaactcgggagcactatcacataccaatgcgattctggctataagatccttgaccccagttccattacctgcgtcataggcgctgacgggaagccatcttgggatcaggtgctgcctagctgcaacgccccttgcggggggcagtacaccggctcagagggcgtcgtacttagtcccaactatccacataattacaccgccggacagatttgtctctattcaataactgtaccaaaggagttcgtcgtattcggccagttcgcttacttccagaccgccctgaacgatctggcagaactttttgacgggacccatgctcaggcaagacttctgtcctctttgagtggatctcatagtggggaaacactccctcttgctacatccaatcagatcctcttgaggttctcggccaagagtggtgcttctgcccgaggattccactttgtttaccaagcagttcctaggacctcagacacccagtgctcgagcgtcccagagcctcgatatggacggagaatcgggagcgaatttagtgctggaagcattgtgcgtttcgaatgtaaccctggttacctgctccaagggtctacggctctacattgtcaaagtgttcccaacgcgcttgcacagtggaacgacactatccctagctgtgttgttccctgtagcggtaacttcacccagaggcgtggaacgatcctctcccctgggtaccccgaaccatacgggaacaacctgaactgcatctggaagattattgtcaccgagggttctgggatccagatccaggtcatcagctttgcaactgagcaaaattgggatagccttgagatccacgatggtggtgacgtgactgcacctcgtttgggatcattcagcggcactactgtccccgcccttctcaattcgacatctaatcagctgtatcttcacttccagtccgacatcagcgtggcggccgctgggtttcatttggaatacaaaacggtgggcctggctgcctgccaggagcctgcccttccttccaatagcattaaaattggagaccggtatatggtgaatgatgttcttagcttccaatgcgaaccaggctatacattgcagggtcgttctcacatcagttgtatgcccggaactgtgagaagatggaactatccctcccctctatgtatcgccacttgtggcggaacactgtcaacgctgggcggcgtgattctgagtcccggttttcctgggtcctatccgaataaccttgattgcacctggcgcatctctctcccaatcgggtatggcgcacatatccaatttttaaatttttcaactgaagcaaatcatgacttcctggaaatccaaaacgggccataccatacctccccaatgatcggccagttctccggaacagatctccccgcagcactactgtcaactactcacgagactcttattcatttttattcggatcactcacagaaccggcagggctttaagctggcttaccaggcgtacgagctgcagaattgtcctgacccccccccgttccagaacgggtatatgataaactcggattactctgtcggacagtcagtgagtttcgaatgttaccccggctatatcctgatcggccatcccgtcttaacatgccagcacgggattaaccggaactggaactacccgttcccaagatgcgacgcaccctgcgggtacaacgttacgtcgcagaatggcacaatatattcaccgggcttccctgatgagtacccgatcctgaaggattgtatttggctgatcacggtgccaccaggacatggtgtgtatatcaatttcactctactgcagaccgaggccgttaacgactatattgcggtctgggacggccctgaccagaatagcccccagctcggtgtgttctcaggtaacactgccctcgagaccgcatatagttccactaaccaagtattactaaagttccactctgactttagcaacggtggctttttcgtgcttaatttccatgcctttcagctcaagaagtgccagccgcctcccgctgtgccccaagccgagatgttaacggaggatgatgacttcgagatcggtgacttcgtgaagtaccagtgccacccaggctatactttggttggcactgacattttgacatgcaaattgagctcacaactgcagttcgaaggtagccttccaacatgcgaagcacagtgccccgcgaacgaggttaggaccggctcatccggcgtaatcctctctcctggatatcccggcaattacttcaactcccagacttgcagctggtccatcaaggtggaaccaaactataatatcacgatattcgtggacaccttccagagcgaaaaacaattcgatgccttagaggtgtttgacggctctagcggacaatctccattactagttgtcctgagtggaaatcatactgagcagtcaaacttcacttcacgctccaatcagttatatctgagatggagcactgatcatgctacgagcaagaagggctttaagatcagatatgcagcaccttattgttcacttacacaccctcttaagaatggcgggatcttgaatagaacggcaggtgcagtaggctctaaggtacactacttctgtaagcctggctatcgcatggtaggtcattccaatgcgacatgcagacgcaatccgctcggaatgtaccagtgggatagcctgaccccgttgtgccaggctgtttcatgtggcatccctgaatctccaggcaacggtagcttcacaggcaacgagtttacgctggactccaaggtcgtttacgagtgccacgagggattcaagctggagtcgtcgcaacaggcgactgcagtgtgtcaagaggatggtctttggagcaacaagggtaagccaccaacatgtaagcctgttgcatgtcctagtatcgaggcccagctctccgagcatgtcatatggaggctcgtgtctggcagtttaaacgaatatggtgcgcaagtccttctatcatgtagcccaggttattacctggaaggctggaggctcctcagatgccaagccaacggcacttggaatatcggggacgaacgcccctcatgcagggctggccattgtgggtctcccgacccaattgtgaacgggcacatctctggcgatggcttttcatatagggataccgtcgtttaccagtgcaaccccgggttccgcttagttggaaccagtgtgcgcatttgtctgcaagatcacaaatggtctggccagaccccggtctgcgtccctattacttgtggacatccaggcaatcctgcgcatgggttcaccaacgggagcgaatttaatctgaatgacgtagtgaattttacgtgcaacaccgggtacctgctgcagggggtgagtcgtgcccagtgccggtctaacggacaatggtcaagtcctttgccgacctgcagagtggtgaactgcagcgatcctggatttgtggaaaatgctatccgtcacggtcagcaaaacttccctgaaagttttgaatatgggatgtctattctttaccattgtaaaaagggcttttatctcctgggcagctctgcattaacctgcatggccaatgggctgtgggacaggtccctgcccaaatgtctggccatttcctgtggccatccaggcgtgccggcaaatgctgtactgacaggcgaactgtttacttacggtgccgttgtccattattcctgtaggggttcggaatcattgatcggaaatgacacacgcgtctgtcaggaagatagccactggagcggcgcactgcctcattgcactggtaataaccctggcttctgtggcgatccaggcactcctgcacacggaagtagacttggcgatgacttcaagaccaaaagtctgttaagattctcctgtgaaatgggccaccagctcaggggctctccagagagaacctgtctgttgaacggctcttggtctggactgcaacccgtatgcgaagctgtcctttgtcctcagcccccacctgtgcagaatggcactgtcgaagggtccgatttccgctggggttcctctataagttacagctgtatggacggctatcagttgagtcattccgcaattctttcttgcgagggtcgaggcgtgtggaagggggagatcccccagtgtctcccggtattttgtggcgacccaggaatccccgctgaaggcagactttctgggaagtcttttacttacaagagcgaggtgtttttccagtgtaaatctcctttcattctagttgggtcctcaaggcgagtatgtcaggcggacgggacctggtccggtatccagcccacctgtattgacccagcacacaacacatgtcccgatcctggcaccccacatttcggaatccaaaactcttccaggggatatgaggttggctcaactgtcttcttccgctgtagaaaaggatatcacatccagggctcgacaactcgaacctgtttagctaacctgacttggtccggtatccagaccgaatgtatccctcatgcatgccggcagccggaaaccccggctcacgctgacgtgcgtgcaatcgaccttcctactttcgggtacaccctggtttatacctgccacccaggattcttcctggcggggggcagtgaacacaggacatgtaaagccgatatgaagtggacaggaaaatctcctgtgtgtaagtctaaaggagtgagagaagtgaatgaaacagtgaccaagaccccagtcccttccgacgtgttctttgtgaatagtctgtggaagggctactacgagtatctcgggaagcggcagccagcaaccctgaccgttgactggttcaatgctactagcagcaaagtaaatgcaaccttttccgaagcatcacctgtagagctcaagctgaccggaatctataaaaaagaggaagcccacctgctacttaaggccttccagataaaaggtcaggctgatatcttcgtcagcaaatttgaaaacgacaattgggggctggacggatacgtgtcaagcggcctggaacggggagggtttacatttcagggagatatccatggcaaggactttgggaaatttaaactggaacggcaggaccccttgaaccctgaccaggactctagttcacattaccatggaacttccagtgggtccgttgcggctgctatcctggtcccctttttcgctctgattcttagcggatttgctttctatttatataagcatcgcacacgacctaaggtacagtacaacggctacgcagggcacgagaatagcaatggacaagcctctttcgaaaacccaatgtatgatacaaacttaaagcccacagaagccaaggctgtgaggttcgatactacgctcaatactgtttgcactgtggtctag

SEQ ID NO: 113307 - DNA, 10698 bp, Artificial Sequence
  Description of Artificial Sequence: Synthetic coding sequence
atgaccgcttggcggcggttccagtcattgctgctgctactgggtctgctcgtcctctgcgcccgactgctgaccgcggccaagggacaaaattgtggcggcctggtgcagggacctaatggcactatcgaatctccaggtttccctcacggttatcccaactatgcgaattgtacatggatcattatcaccggagaacggaatagaattcagctaagtttccacacattcgccctggaggaggacttcgacattctgagcgtttatgatggacagccccagcagggcaacctcaaagttagactctccgggttccagttacctagttcaattgtgtccacagggagcatcctgacgctatggtttactaccgattttgcagtgtccgcccaaggattcaaggctctgtatgaagtccttccatctcatacgtgcggaaatccaggagagattctgaagggcgtcttgcacgggaccaggtttaatatcggagataagatcaggtattcttgtttgccaggatatatccttgaggggcacgcgatccttacctgcattgtgtccccaggcaatggcgcctcatgggattttcctgcccctttctgcagagctgagggcgcgtgtggtggaacgcttagagggaccagcagctccattagctctccacattttccctctgagtacgaaaataacgctgactgcacctggacgatactcgcggaacccggagacaccattgctctggtgtttacagatttccagctcgaggaaggctatgactttctggaaatctccgggactgaggcacccagcatatggctgacaggcatgaacctgccctcacccgtgatcagctcaaaaaattggctacgcttgcactttacctccgacagcaatcataggcggaaaggatttaacgcacagttccaggtgaagaaagccatcgagcttaaatccagaggggtgaagatgctgccttccaaagacggttcgcacaagaatagtgttctgtcgcagggtggggtagcactcgtctcagatatgtgtcctgatcccggtatccccgagaatggacgccgcgccggctctgacttttcccgcgtgggcgccaacgtccaatttagctgtgaggacaattacgtccttcagggctctaagagcatcacttgccagcgcgtcactgaaaccctggcggcctggagcgatcaccggcctatctgccgagcaaggacttgtggttccaatctcaggggtccatctggcgtgattacgtcacctaattacccagtacagtatgaggataacgctcattgcgtgtgggtgattacgacaaccgatccagacaaggtgattaagttggcgtttgaagagtttgagctggaacggggatatgatacgctaaccgtgggggacgccggaaaagtcggagacaccaggagcgtgctgtatgttctgaccggcagtagtgtgcctgatcttattgtgtccatgtcaaaccaaatgtggttgcatctgcaatccgacgatagtatcggttcacctgggtttaaggccgtataccaggagatcgagaagggaggatgtggcgacccaggcattcccgcgtacggcaagcgtactggatcctcatttcttcatggcgatactctgacctttgagtgtccagccgcatttgaattggtgggcgaacgcgtgatcacttgtcaacagaataaccagtggagtggaaacaagcctagttgtgtgttttcttgctttttcaactttacagcgagctcgggcattatattgtctccaaactatcctgaggagtacggcaacaacatgaattgtgtttggctaattatctccgagccaggatctaggattcacctaatcttcaacgatttcgacgtggagccccagtttgacttcctggcagtgaaagacgacgggatttcagacatcaccgtgctcggaaccttcagtggcaatgaagttcctagtcagttagctagtagtgggcacatcgtacgcctcgaattccagagcgatcattctaccaccggaagagggtttaacattacttacaccacattcggccagaacgaatgccacgacccaggcatacctatcaacgggagacgcttcggcgatcgattcctgttgggctcatcagtgtcattccactgtgatgacggttttgtgaagactcagggttcagaatctattacatgcatactccaggatggcaatgtcgtgtggtcttcaactgtcccccgctgtgaggccccttgtggtggccatctaacggcatccagtggggtgatcctccccccaggatggcccgggtattacaaggacagtctgcactgtgagtggattatcgaagccaaacctggccacagtatcaagatcactttcgacaggttccaaactgaggtgaactatgatacacttgaggtgcgcgacggacccgcctctagctctcccctgatcggcgagtaccatggtacccaagccccacagttcctgatcagcactggtaactttatgtacttactgttcaccaccgacaactcccggtcatccatcggatttttaattcattacgaaagcgtgaccctggagtcagactcatgcttagacccagggatccccgtgaacggccacagacatgggggtgattttggcatacggtcaactgttactttctcatgcgatcccggatacaccctgtcagatgacgaacccctggtatgtgaaagaaaccaccagtggaatcatgctctgccttcctgcgatgcattatgcggggggtacatacaaggaaagtccggcaccgtactgtccccgggatttcccgatttttaccctaacagtttgaactgcacatggactatcgaggtttcccacgggaaaggcgtgcagatgatctttcacacctttcacctggagtcgtcgcatgattacctgctgataacagaagatgggagtttttccgagcccgtcgctagacttactggatcggtgctccctcatacaatcaaagctggcttattcgggaacttcaccgcgcaactgcgtttcattagcgatttctcaattagttacgaaggcttcaacattaccttcagcgagtatgacctcgagccatgcgacgaccccggagtgcctgcattttcaaggcgtatcgggttccacttcggggtgggagacagcctcacattttcatgcttcctaggatacaggctcgaaggagcaacgaaactgacatgtctcgggggcggtcggagagtttggagcgctcccttaccccgctgcgtagccgaatgcggcgccagcgtcaaaggaaacgaagggactctcctctcacctaacttcccaagtaattatgataacaaccacgaatgtatctataagatcgagacagaagcgggaaagggaattcacttgcgcactcggtcattccagttatttgagggagacaccttgaaagtgtatgacggtaaagactcatccagtcggccactcggtaccttcacaaagaacgagctgctgggactcattttaaattccacttcgaaccacttgtggctggaatttaataccaatggctcagatacagatcaggggtttcagctgacttatacgagctttgacctggtgaaatgcgaagatccggggataccaaattatgggtaccgaatccgtgacgagggtcatttcactgacactgtggttttgtattcatgcaaccctggatacgcaatgcacggatctaatacattaacatgcttgtcgggcgacaggcgagtttgggataagccactgccatcatgcatcgctgagtgcggtggacaaattcacgctgccacatctggtagaattctgagcccaggctatcccgcaccttatgacaacaacctccattgtacatggatcattgaagccgatcccggcaaaaccattagcctgcattttatcgtgtttgacacagaaatggcacacgatatccttaaggtgtgggatggccccgtcgattctgacattctgctgaaagagtggagtgggtcagccctccctgaagatatccactccacatttaactctttgacattgcaatttgactccgatttctttatatctaagtccggtttttctatacagttctctacgtctatagccgccacctgcaacgaccccggcatgccgcagaatggaactaggtacggagattctcgggaagcaggagacacggttaccttccaatgcgaccctggctaccagctgcagggacaggccaaaatcacctgtgtgcagcttaataacagattcttctggcaacccgatccacctacctgtattgcagcatgtgggggtaaccttactggaccagcaggtgtgattcttagtccgaattatcctcaaccgtaccctcccgggaaggagtgcgactggcgggtgaaggtcaatcctgacttcgtgatcgcccttatatttaagtcctttaacatggaaccaagttacgattttttgcatatttacgagggcgaggacagcaacagtccgctgatcggaagctatcagggttcccaggccccagaacggatcgagtccagtgggaattccttgttcctggccttccggagtgatgcctccgtaggactgtccggttttgccatcgagtttaaggaaaagccaagagaggcttgctttgaccccgggaacatcatgaatgggacccgcgtgggtactgattttaagttgggaagcactataacataccagtgtgacagcggatataagatactcgatcccagttccattacatgtgttatcggggccgatgggaaaccttcctgggaccaggtgctgcccagctgtaatgccccatgcggtgggcagtacactggttctgaaggtgtggttctgtcacctaattacccccacaactacactgctggccaaatctgtctgtattccattaccgttcccaaagaatttgtcgtgttcggtcagttcgcttatttccagaccgccctaaatgacttggccgaactctttgacggaacacacgctcaagctcgcctgctgagctctctgtctgggagtcattcaggcgaaactctgcccctggctacttcaaatcagatcttactgcgctttagtgcgaagtctggggcctctgctcgcggattccacttcgtctatcaggcggtgcctcgaacctctgacacacagtgcagctccgtgccagaaccacgttatgggcgcagaatcggtagcgaattctcagccggttccattgttcgcttcgaatgcaaccctgggtatctgcttcagggttcaacagctctgcactgtcaatcagtacccaacgctctggcccaatggaatgacacgatcccttcatgcgtcgtgccgtgtagcgggaatttcacccagcggcggggcactatcctctctcccggttacccagagccatatggcaataacctaaactgtatttggaagatcatagtcacagaagggagcggtattcagatacaggtgatatcgtttgctacagaacagaattgggactccctagagattcatgacgggggggacgttacagcccccagactgggaagcttttccggaaccaccgtgcccgctctactcaatagcactagcaaccagttgtatcttcacttccagtccgacatctctgtggccgccgcggggtttcatcttgagtataagactgttggattagccgcctgccaggagcccgccctgccttctaattcaattaagattggtgaccgctatatggtgaacgacgttctctcctttcagtgtgagccagggtataccctacaggggcggagtcacatctcctgtatgcctggtacagtgcgccgctggaattatccgtctccgctgtgtatcgccacctgtggaggcaccctgagtaccctaggaggcgtgattctgagcccaggctttccaggttcgtatcccaacaacctcgactgtacctggcgcatctctctccccattgggtacggagcccacatacagtttcttaatttctccactgaagccaaccacgacttcctggagatccaaaatggcccgtaccatactagtccaatgattggacagttcagcgggaccgatttgccagctgcgctgctctcgaccacccacgaaactctgatccatttttatagcgaccatagccagaatcggcagggatttaagctcgcctatcaagcttacgaactccagaattgcccggatcccccgccgtttcagaacggatatatgatcaattccgattacagtgtgggccaatcagtgtcctttgagtgctacccaggctacatcctaataggacacccagttttaacttgtcagcacggaatcaacagaaactggaactatcctttccccaggtgcgacgccccctgtgggtacaatgttacatcccaaaacggaaccatttattcgcccggatttccagacgagtatccaatccttaaagactgcatttggttgattacagtgcctccaggacatggagtgtacataaacttcaccctgctgcagaccgaggcggtgaatgattacatcgcagtctgggatggccccgatcaaaatagcccccagttgggagttttctcaggcaatacagccttagagaccgcatattccagcacgaatcaggtcctccttaaatttcactccgatttctctaatggaggtttcttcgtgctgaatttccacgcattccaactaaagaaatgtcagccaccgcccgccgtcccccaggcggaaatgttaacagaagacgacgattttgaaattggcgatttcgtcaagtaccagtgtcacccaggatatactctggttggcactgatatcctaacatgtaaactgtcctctcagctccagtttgagggttctctgcctacttgcgaggcacagtgtcccgccaacgaggtgcgtaccggatcgtccggtgtcattctcagtcctgggtaccctggaaactacttcaactcgcagacttgcagctggtcaattaaggtggagccaaactataacattacaatatttgtggacaccttccaaagcgaaaaacagtttgatgccttggaagtgtttgacggatcttccggtcagagccccctcttagttgttctctccgggaaccacaccgaacagagcaacttcaccagccgaagcaatcaactgtacttgcgatggagcacagatcatgcaaccagcaaaaagggctttaagatacgctatgccgcaccctattgctcccttactcatcccctgaagaatggggggattctaaatagaacagcaggcgctgttggatccaaggttcactatttttgcaaacccggctacagaatggtaggacattctaatgccacgtgccgacgcaatcccctgggaatgtatcagtgggactccctgacaccgctgtgtcaagctgtcagctgtgggattcccgaatctccagggaacgggagttttaccggaaatgaatttacgctggactccaaagttgtctacgagtgtcatgagggctttaaactggagtcatcccagcaggccacagccgtatgccaagaagatggtctgtggtctaacaagggaaaacctccgacctgcaagccggtggcctgtcctagtatcgaggcgcagttgtcggaacacgtaatctggaggctagtttctgggtccttgaacgagtatggggcacaggtgttgctgtcttgttccccaggatactacttagaaggatggagactcctccgctgccaagcgaatgggacgtggaatatcggcgacgagagaccctcttgccgggtcattagctgtgggtctctctctttccccccgaatggcaacaaaattgggactctgaccgtgtacggagcgacggctatcttcacctgcaacaccggttacacactggtcggttcccatgtgagggaatgtctcgctaatggtctgtggtcaggttcagagaccagatgcctagccgggcattgcggctcgccggatccaatagttaatggccacattagtggcgacggtttctcataccgggacacagtcgtctaccagtgcaaccctggctttaggcttgtcgggacatccgtacggatttgtctgcaggatcacaagtggagtggacagactccagtgtgcgtccctattacatgcggccatcctggtaatccggctcatgggttcaccaatggctctgagttcaacctcaatgacgtcgtgaattttacttgtaataccggctatctgctacagggagtctctcgagcccagtgtcgatcaaatgggcagtggtcaagcccactccccacatgccgcgtggtgaattgctcggatcctggctttgtggaaaatgcaattcggcacggccaacaaaactttcccgaatcctttgaatacggcatgtccatcctctatcactgtaaaaaaggtttttacctgctgggctcaagcgccctgacgtgcatggccaatggactgtgggaccgtagcttaccgaaatgtcttgccatctcctgcgggcaccccggcgtgccagcaaacgccgtcttaactggagagctattcacatacggagccgttgtgcattacagctgcagggggagcgaatccctcatcggcaacgatacgcgcgtctgtcaggaagatagtcactggagcggggctcttccacattgcactgggaacaatcctggcttctgtggcgaccccggcactccagcccacgggtcgcgattgggagatgacttcaagaccaagtccctcctgcgtttcagttgcgaaatgggacatcagctgcgtggtagcccagagcggacatgcctcctaaacggctcttggagcggcctccaacccgtgtgtgaggccgtcagctgtggcaatcctggcactccgacaaacgggatgattgtttcaagcgacggtattctgttctcgtcaagcgtgatctatgcttgttgggagggatataagacatccggactgatgacgcgtcattgcaccgctaacggtacatggaccggcacagccccagattgcaccatcatcagttgcggcgatcccggcacattggcaaacggcatccagtttggcactgacttcacattcaataaaactgtctcatatcaatgtaacccaggttacgtgatggaggcagttacatccgctaccatccgttgcactaaagacggtcgctggaacccatcaaaaccagtgtgtaaagcagtgctgtgcccacagcctccacccgtgcagaatgggacagtggagggaagtgattttcgctgggggtcatctatcagctactcgtgcatggatggttatcagctctcgcacagcgctatcctgtcatgtgagggaaggggggtatggaagggcgaaatcccccagtgtttgcccgtgttctgtggagacccagggatacctgctgaagggcggctctccggcaaatccttcacatataagtctgaagtattcttccaatgcaagtctccgtttatattggtgggctcatcacggcgtgtgtgccaggccgatgggacttggtccgggatccaacccacctgtattgatcctgcacacaatacgtgcccagaccccggcaccccacactttgggattcagaactcatcccgcggatatgaagtcgggtccacagtattttttagatgccgtaagggttatcatatacaaggatcgactacccgcacgtgccttgccaacctaacatggtcaggcattcaaaccgagtgtattccacacgcttgtcgccagcccgaaacaccagcccatgcagatgtgcgcgccattgacttacccaccttcggatacactctggtatatacatgccacccagggttcttcttagctgggggatccgaacacaggacctgtaaggctgacatgaagtggacaggcaagtcacccgtctgtaaaagtaaaggagtgagggaggtcaacgaaacggtgacaaagactcccgtaccgagcgatgtattttttgtgaattctctgtggaaggggtactatgagtacctcgggaaacggcagccagctaccctgaccgtggactggtttaatgccacgagcagcaaggtcaatgccactttttcagaagccagtcccgtggaattaaaactgacagggatctataagaaggaagaagctcaccttttacttaaagcttttcagattaaaggtcaagcagacatatttgttagtaagtttgagaatgacaactggggcttggatggctacgtcagtagtggtcttgaaagagggggcttcacttttcaaggggacattcatggcaaggatttcggaaagtttaagttagagcgccaagatcctctcaaccccgaccaggactcctcctctcactatcacgggacatcttccggctctgttgccgcagccatcctggttccctttttcgccttgatcctctccgggtttgcattctacctctacaagcacagaacaagacctaaggtgcagtacaacggctatgctggccatgagaactccaatgggcaggcctcttttgagaatcctatgtatgataccaacctcaagcccaccgaagctaaagcagtcaggtttgatactactctgaacactgtctgcactgtcgtgtag

SEQ ID NO: 113308 - DNA, 10695 bp, Artificial Sequence
  Description of Artificial Sequence: Synthetic coding sequence
atgaccgcctggcgtcgattccagtctctgttattgcttcttgggctactggtcctctgcgctcgcctcctgaccgcagctaagggccagaattgtggaggcctcgtgcagggtcctaacggcactatcgaatctccaggcttcccccacggttaccccaattatgcaaactgcacctggattatcattacgggtgaacgaaaccggatccagctttcgttccacactttcgctctggaagaggatttcgacatcctctctgtgtacgacggtcagcctcagcagggcaacctgaaggtccgcctgagtggcttccagctcccgtcctccattgtttcaactgggtctattttgaccctctggttcaccacagactttgcagtatccgcccagggctttaaggctctttacgaggttctgccaagccacacatgcggcaatcccggcgaaattctgaagggcgtgctacacggaacaagatttaatattggggacaagattaggtatagttgtttgccaggttatatcctggagggccacgcgattctcacatgcatcgtcagtcccggcaatggtgcaagctgggatttcccagcaccattctgtagagcagaaggcgcttgcggaggcaccctgcgaggcacgtccagcagtatttcctcaccgcactttcctagcgagtacgagaacaatgcagactgtacgtggaccatcttagctgaacctggggacaccatcgcactcgtatttacggattttcagttggaggagggttacgatttcctcgagatcagcggaacggaggcaccctctatctggctgaccggaatgaatctgccatcccctgtcatcagtagcaagaattggttgcgattgcactttacatctgacagcaatcaccgccgtaagggatttaacgctcaattccaagtgaaaaaggcaatagaacttaaaagccggggcgtaaagatgctgccttctaaagacggcagtcacaagaacagcgtcctgagccagggaggcgttgctttagtcagcgacatgtgtcctgatcccggaattcccgagaacggcaggagagctggctccgactttagagtcggcgccaatgtgcagtttagttgcgaggataactatgtcttgcagggatcaaagagcatcacatgccagcgtgttactgagaccctggcagcgtggtctgatcatagaccaatctgtcgcgcacgcacctgcggttctaacctgaggggccccagtggtgtaattaccagtcctaactaccccgtccaatatgaagacaacgctcactgcgtgtgggtcatcaccactaccgatccggataaagtgattaagctagccttcgaagagtttgagcttgagcgaggatacgatacccttacagtgggagatgctggaaaagtcggagatactaggtctgttctttacgtgctcaccggaagtagcgtgccagatcttatcgttagcatgagtaatcagatgtggctccatctgcagtccgacgattcaattgggtcaccggggtttaaagccgtgtatcaagaaattgagaaaggagggtgtggggaccctggaatccccgcttacggtaagcgcaccggaagcagctttctccatggtgataccttaacattcgaatgtcccgccgcattcgaactggtgggggagagggtgattacctgtcagcagaacaaccagtggtcgggaaacaaaccatcgtgtgtgttctcctgcttttttaacttcaccgcatcatctgggatcattctttctccaaattacccagaagagtacggcaacaacatgaattgcgtttggctcatcataagtgagccggggtcgcggattcaccttattttcaatgacttcgatgttgagccccaattcgactttctggctgtaaaggacgacgggatttctgacataaccgtgctggggacattctcaggaaacgaagtcccttcacagttagcttcatcaggtcacatagtgcggctggagtttcagagtgatcacagcactacagggagagggtttaatatcacttacaccaccttcggtcagaatgagtgccatgatccaggcatccctattaatggtcgccggttcggggatcgtttcttgctgggtagctcagtaagtttccactgcgatgacgggttcgttaagacccaggggtcagagagcatcacgtgcatactccaggacggaaatgtagtttggtcatctacagtgccgagatgcgaagccccctgtggtggacacctgactgcttcaagcggggtgattctaccccctggctggcctgggtactacaaagactctctacattgtgaatggattattgaggccaagccagggcactctatcaaaatcacgtttgacagatttcagactgaagtaaactatgacacacttgaggttagagacgggccggcatccagctcacccctgatcggcgagtaccacggcacacaggccccccagttcctcatctcgacagggaacttcatgtacctgctcttcacaaccgataacagtagatctagtatcggtttcctgatccattacgagtccgtgactttagaatctgacagctgtctcgaccccggaataccagtaaacggtcacaggcacgggggggactttggcatacggtctacagtgacattttcttgtgatccaggctatacactctctgacgatgagcctctcgtgtgcgagaggaatcatcagtggaatcacgccttgccctcctgcgatgccctgtgcggtgggtatatccagggaaagtcaggtaccgtcctctcaccaggattcccggatttctacccgaattcactgaactgcacatggacgattgaggtctcacatggtaaaggagtccagatgattttccacacttttcacctcgaatctagtcatgactatctcctaatcaccgaggacggatcattctctgaacccgtggctcggttgactggctcagtcctgccacacactattaaggcaggactgtttggcaattttaccgctcaactgaggtttatctccgatttttcaattagttatgagggattcaatattaccttcagcgagtacgatctcgaaccatgtgatgatcccggcgttccagcattttcccgccggatcggcttccattttggtgtcggtgactcgctgacattcagttgcttcctgggttatcgcttggaaggcgccacaaaactcacttgtctcggcggaggaaggcgggtgtggtcagccccacttcctcggtgtgtcgcagaatgtggagccagcgtgaagggaaatgagggtacattgctttcacctaatttcccttcgaactatgataataatcatgagtgtatctataaaattgaaacggaagcaggcaagggcatacacttgcgcacccggtcttttcaactgtttgagggtgacactttaaaggtctacgacggtaaggattcgtcgtcacgcccgctgggcaccttcacaaagaacgagctgttgggcctcatactgaactccacatctaatcacttatggctcgagttcaacacgaacgggtccgacacagatcaggggttccagctgacttatacctcgtttgatctagtgaagtgtgaggacccgggtatacccaattatgggtataggatacgggacgaggggcactttaccgacacagtagtattgtacagctgtaaccctggctatgcaatgcacgggagcaatactctgacatgtctgtcgggagacaggcgggtctgggataagccgctgccctcatgtatcgccgagtgtggcggccagatccacgctgccacctccggcaggatcctgagccctgggtaccccgcaccctacgacaacaatctgcattgtacatggatcatcgaggctgatcccggcaagaccatctctttacacttcattgtgtttgacacagaaatggcccatgatatcctcaaagtctgggatgggccagtagactctgacatcctactcaaggagtggagtggctcagctctgcctgaagatatccacagcaccttcaactcccttacacttcaatttgattctgacttctttatatcaaaatccggattctctatccaattctctacctcgattgctgcgacctgcaacgaccccgggatgccccagaatggtacccggtacggagactcgagggaagcgggtgatactgtgacattccaatgtgatcctggataccagctgcagggtcaagccaagattacatgcgtacagctgaataaccgctttttttggcagccagaccctccgacgtgtatcgccgcttgcgggggaaatctcactggccctgccggggtaatcttgagccccaactatcctcagccatatcctcccggtaaggaatgcgactggagagtaaaggtcaatccggactttgtgatcgccctcatttttaagtcattcaatatggagccctcttatgactttctacacatatacgagggcgaagatagtaattctccactgattggaagctaccagggcagccaggcccccgagaggatcgaatcttcggggaactctctctttctagccttccggagtgacgcctctgtcggtttgagtggttttgctatcgagttcaaggaaaaaccaagagaggcctgcttcgacccagggaatatcatgaacggtacacgcgtgggaaccgacttcaaactggggagcacaattacctaccagtgcgattccggctacaaaattctcgatccgtcttcgatcacctgcgtcattggggcagacggtaaaccctcttgggaccaagtcctgccctcctgcaacgcaccttgcggcggacagtacacagggtctgaaggagtggtactttcccctaattaccctcacaattacactgctggccagatttgcctgtactctatcaccgtccctaaggagtttgtggtgttcggccagtttgcttacttccagaccgcgctcaatgacttggccgagttgttcgacggaacgcacgctcaggcacgcctattgtccagtcttagcgggtcacactctggagaaacactccctttagcaacatccaatcagatcctcctgaggtttagcgccaagtccggggcctccgcgagagggttccatttcgtgtaccaggcggttcctagaacttctgacacgcaatgttcctcagttccggagccacgatatggacgacggatcgggtctgaattttccgctggcagtatcgttcgatttgagtgtaatccaggatacctgctgcaagggagcacagcactgcactgccagagtgtgcccaacgctttggctcaatggaacgatacaatcccgagctgtgtggtcccctgctcaggaaactttactcagcggcggggcaccattctttccccggggtacccggagccttatgggaataatctaaattgcatttggaaaattatcgtcaccgaaggatccggtatccaaatccaagtgatatcgttcgctacagaacagaattgggactcgttggagatccatgacggtggggatgtcacagcacctcgactgggatctttttccgggaccacagtgcctgctttacttaacagcacatccaatcaactgtatctgcactttcagagcgacatttccgtcgcagctgccggattccacctagagtataagaccgtggggcttgcagcatgtcaggagcctgccttgccctccaattctataaaaatcggggatcgatacatggtaaacgatgtgctgtccttccagtgcgaaccagggtacaccctgcagggtcggagtcacatatcctgtatgccagggacagtgcgcaggtggaactaccctagccccctctgcatcgccacatgtggaggtactctctcaaccctgggcggagtgatactgtcaccaggatttcctggatcataccccaacaatctggattgtacctggagaatctcattaccaattggttacggcgcacacattcagttcctaaatttctctacagaggctaaccacgacttcctggaaatccagaacgggccataccatactagccctatgataggacagttttcaggaactgacctgcctgcggctctgctgtctacaacccatgaaaccctcatccatttctatagtgatcacagccagaatcgacagggctttaaactcgcctatcaggcgtacgagcttcagaattgccctgatccacccccgttccagaatggctacatgattaactctgattactccgttgggcagagtgtcagcttcgagtgttatcctggttacattctgattgggcatcccgtgttaacctgccagcatggtatcaaccggaactggaactacccctttccgaggtgtgacgccccttgcggctacaatgtgaccagtcagaatggaactatctattctcctggctttcctgacgagtatccaatactcaaagactgtatatggctgataacagtacctcctggtcacggagtgtatatcaacttcacccttcttcagacggaggctgtgaatgattatattgcagtctgggacggtcctgatcagaattctccgcagctgggtgtattttctggtaatactgcccttgagaccgcttactcatccacaaaccaggtgttgctgaagtttcattccgacttcagtaatggtggatttttcgtccttaattttcacgcgtttcagctcaaaaagtgccagcctcctccagctgttccacaagccgaaatgctgacggaagacgacgacttcgagataggggacttcgtcaagtaccagtgccatcctggctacactctggttggaaccgacatcctcacttgtaagctgtcctcacagctgcagttcgaggggagtctacctacttgtgaggcccagtgccctgccaatgaagtgcggaccggttcctcaggtgtgatcttgtcccctgggtaccccggaaactactttaactctcagacatgctcatggtcaataaaggttgagccaaattataacattacgatcttcgtggatacctttcaaagtgagaaacagttcgatgcccttgaggtcttcgacgggtcctccgggcagtccccattgttagtggtgctgtccgggaatcataccgaacagtctaatttcactagtcggagcaatcagttgtatttgcggtggagtacagaccatgccacttctaagaagggattcaagataagatatgcggctccctactgttccctgacgcatcccctcaagaatggcggaattctaaaccggactgccggcgctgtcggatcgaaggtccactatttctgcaaaccgggttaccgtatggtggggcacagcaacgccacttgtagacgcaatccacttgggatgtaccaatgggactcgctcacccccctgtgtcaagccgtatcctgcggcatccccgaaagccctggtaatggaagctttaccgggaatgagttcaccctggactctaaagttgtgtacgagtgtcatgaagggtttaagctcgagtcatcacagcaggccaccgccgtttgtcaggaggatggtctctggtctaataaaggaaaaccaccaacttgtaagccggtcgcttgtccctctatcgaagctcagctatcagagcacgtaatttggcgcctcgtaagcgggagccttaacgagtacggagcccaagtccttctctcatgttctccagggtactacctggaggggtggaggctgcttaggtgtcaggccaacggcacatggaacattggcgatgaaagaccatcatgtcgggtgatttcgtgcggttctctgtctttccctcctaacgggaataaaattggaacactgacagtgtacggggccaccgcaattttcacctgcaacactggatacaccctagtgggttcacatgttcgcgagtgcctggcaaacgggttgtggtcaggctccgagacacggtgtttggcagggcattgcggaagccctgatcctattgtcaacggccacattagcggcgacgggttttcttaccgcgatacggtggtgtaccagtgcaacccaggcttccgccttgtcgggacctcggtgagaatatgcctacaagatcacaaatggtccggccaaacgcccgtgtgtgtgccaatcacttgtggtcaccccggcaatccagctcacggcttcaccaatgggtctgaatttaatttaaacgacgtcgtcaattttacctgtaacactggttatctcctccagggagttagtcgagcccagtgcaggtctaatgggcagtggtcttctccccttccaacctgtagggtggtgaattgcagtgaccccggttttgtggagaacgctatcagacacggtcagcagaactttcccgagtctttcgagtatgggatgagcattctttaccattgcaagaagggcttttatctgttagggtcttccgctctgacttgcatggccaatggcctgtgggaccggtctttacctaaatgcctggcgatctcttgtggccacccaggagtgcctgctaatgccgtgttgaccggcgagctcttcacatacggtgccgtggtacactactcctgcaggggatcggagtctctgattggcaacgacacccgggtgtgccaggaagattcacactggagcggggcactccctcactgtaccggcaacaatccgggattctgcggcgaccccggcactccagcccatggaagccgcctgggcgatgacttcaagactaagtccctgttgcgattctcctgcgagatgggacatcagctgcgtggatcccccgaacgcacatgtcttctcaacggctcatggagcggacttcaaccagtgtgcgaggcagttagttgcggaaaccccggaaccccgaccaatggaatgatcgtaagttccgatggcatcttatttagctcaagtgtcatctacgcctgctgggaaggctacaagacctcagggcttatgacaagacactgcacagccaatgggacttggacaggcacagctcccgattgtacgattatttcatgcggggaccctggaaccctcgccaatggcattcagtttgggactgattttacctttaataaaacagtgagctaccagtgtaatcctggctacgtaatggaagccgtcacatcagctaccattcgatgcactaaagacggcaggtggaacccaagcaaacccgtttgtaaagccgtcctgtgtccccagccaccgccagtgcagaacggaacagtggagggaagcgacttcaggtgggggtcttccatctcctacagctgcatggatggatatcagctctcacactccgcgatattgagctgtgaggggagaggcgtctggaagggcgaaatacctcagtgtctgcctgttttctgtggcgatcctggcattcccgctgagggacggttgagcgggaagtcctttacatataagtcagaggtcttctttcagtgtaagagcccatttatcctggtcgggtcaagcaggcgagtgtgccaagctgatgggacttggtctggcatacagcccacttgcatagatcctgctcataacacctgccctgaccctgggacaccccattttgggatccagaacagttctagaggctacgaagtggggagcaccgttttctttaggtgccgcaaaggataccacatacagggaagtactacacgcacctgcctcgccaacctcacctggtcaggcatccaaaccgaatgtattcctcacgcttgcaggcaacctgagaccccagcgcacgcagacgtgcgggcgatcgatctgcccacctttggttacaccctggtgtacacctgccacccaggtttcttccttgccggaggctctgaacaccggacctgcaaagccgacatgaagtggacgggtaaaagtcccgtctgtaaatcaaaaggagtacgggaggtcaacgagaccgttactaaaacacccgtcccttccgacgtattcttcgtgaacagtttgtggaagggttactacgagtacctgggcaagcgtcagccagctacactcaccgtggattggtttaacgcaacctcttcaaaggtgaacgctactttctccgaggcctcaccggttgagctcaaattaactggcatatacaagaaagaggaagcacacctcctccttaaggcattccagatcaaaggtcaagcggatatctttgtcagtaagttcgaaaacgacaactggggactagacggctatgttagctccggcttggagagaggtggattcaccttccagggcgatatacacggcaaagatttcggaaaatttaagctggagcggcaggatccactgaatccagaccaggacagctctagtcattatcacggtactagctctggttcggtggcggccgccatcctagtgccttttttcgccctcattctgagtggattcgctttctacctctacaaacatcggactagacctaaggttcaatataatggatatgctgggcatgagaattctaacgggcaggcttctttcgagaatccgatgtacgacaccaacctcaaaccaacagaggccaaagccgtgcggtttgacacaacccttaatactgtttgcactgtcgtgtag

SEQ ID NO: 113309 - DNA, 6330 bp, Artificial Sequence
  Description of Artificial Sequence: Synthetic coding sequence
atgactgcctggcggcgattccagagcctgctgctcctgctaggcttgctcgtgctgtgtgctaggctgttaacagctgctaaagggcaaaactgcggcggcttggtccaggggccaaatgggaccatagaatccccgggcttccctcacggataccccaactatgccaattgcacctggatcataataactggtgaacgaaatcgtatccagctgtcttttcacaccttcgccctcgaggaggattttgacatcctaagtgtttacgatgggcagcctcagcaggggaatttaaaggttcggctttccggctttcagctgcccagttccatagtcagcaccggatctattctaactctgtggttcaccacggactttgctgtgagtgctcagggattcaaggctttatatgaggtgctgccatcccatacgtgcggtaatccaggcgagatcttgaaaggggtgcttcacggcactcgcttcaatatcggggataaaattaggtactcctgcctgccaggttacatcctggagggtcacgcgatattaacttgcatagtgtcacccgggaacggagcatcttgggatttccccgcacccttctgcagggccgaaggagcttgtggagggacattgcgaggcactagctctagcatctcctctccacactttcctagtgaatacgagaacaatgccgactgtacatggaccatcctggcagagcctggcgataccatagccctggtatttacggacttccagctggaagagggatatgactttttagagatttccgggaccgaggctccatctatttggttgactggaatgaatctgccatcccccgtgatttcatccaaaaattggcttaggctgcattttacatcagacagcaatcaccggcgcaaagggttcaacgctcagttccaggtaaagaaggccatcgagctgaagtctcgcggagttaaaatgcttccctcgaaagacggttcccataagaacagcgtgctgtcacaggggggagtggcgctcgtcagcgacatgtgtcctgatccaggcattccagagaatggacgccgtgccggttccgactttagggtcggcgctaatgtgcagttctcctgcgaggataattacgtcttgcaggggtcaaaaagcattacttgccagcgggttacagaaactctcgccgcgtggagtgaccacagacccatatgcagggcgagaacctgtggcagcaacctgcgtggcccctcaggcgtcataacctctcctaattaccccgtgcagtatgaagataatgctcattgcgtgtgggtgattacaacaaccgaccctgacaaagttattaagctggcttttgaagagttcgagctcgaaagaggttacgacactttaacggtcggtgacgccggcaaggtgggtgatactcgatctgtgttgtatgtgctaacgggcagcagcgtacctgacttaatcgtgtccatgagtaatcagatgtggctgcacctgcagagcgatgacagcatcggctctcccggcttcaaagcagtttaccaggaaattgagaagggtggatgcggtgacccaggtattccagcctacggtaaacggactggatcaagcttcctgcatggagatactcttacattcgagtgcccagctgcctttgagctggtcggtgagcgggtgatcacctgtcagcagaacaaccagtggagcggcaataaaccttcatgcgtatttagctgtttcttcaacttcactgcgtcctccggcataatcctgtcaccaaattatccggaggaatacggaaacaatatgaactgtgtatggctgattatcagcgaaccgggcagtaggatccatcttattttcaacgatttcgatgtggagcctcagtttgatttcctggctgtgaaagacgacggaatatcggacatcacagtgctgggaaccttctccggtaatgaggttccgagtcagctggccagcagcggccacatcgttagactcgaattccagtcggatcattccactactggaaggggcttcaatatcacatatacgaccttcggccagaatgaatgccatgatcctggcattcctatcaacgggcggcggttcggcgaccggttcctattaggaagctccgtctcattccactgtgatgatggattcgttaagacgcagggctctgaaagcatcacgtgcatcctgcaggatggaaatgtggtctggtccagtacggtgccccggtgcgaggccccatgtggggggcacctaacagcttcatccggcgtgatactgccaccggggtggcctgggtactataaggacagcctgcactgtgagtggattattgaggccaaacctggccacagcattaagataacattcgataggtttcagaccgaggtgaactatgacacactggaagtccgggatggccctgcctcctcctcccccttaattggagaatatcacgggacccaagctccacagtttctaattagcacgggtaatttcatgtacctgctttttacaactgacaactctcggagctctataggctttcttattcactacgaatcagtgactctcgaaagcgatagctgtcttgaccccggtattcctgtcaacggtcaccgtcacggcggggactttggaattcgctccaccgtgaccttttcttgtgacccaggatacacgctgtccgacgacgaacctctcgtgtgcgagcgaaaccaccagtggaatcatgctcttccctcatgtgacgcgctttgcggcggctacattcagggcaaatccgggacagtgctgagccccgggtttccagacttttacccgaatagcctgaattgtacatggaccattgaagtgtctcatggtaagggagtgcagatgatctttcatacgttccacttggagagtagccatgattacctgctgatcactgaggacggttctttcagcgagccagtggcacggcttactggcagcgttctaccccataccatcaaagccggcctcttcggaaattttaccgctcagttgaggttcatctccgacttctcaatcagctatgaagggttcaacattactttttccgagtacgacctagagccatgtgacgacccaggagtgccagctttttccagacgtattggcttccatttcggagtgggtgactctctcacctttagttgctttctcggatatcgcctggagggtgctaccaaactcacttgtctcggtggaggcaggagagtctggtccgccccactgcctcggtgtgttgcagaatgcggagctagcgttaagggcaatgagggcacactgctgtctccgaattttccgtcaaactacgataacaatcatgaatgtatttacaagatcgagactgaggctggcaagggcatacatctccgtaccaggtccttccagctctttgaaggagacacccttaaagtgtacgacggcaaagattcctctagccgccctctaggtaccttcacaaagaatgagcttctgggcttgatcctcaattctacaagcaatcatctgtggcttgaattcaacacgaacggatcggacacagatcagggcttccagctgacgtataccagttttgacctcgttaagtgcgaggacccagggatccccaattacgggtatcgaatcagggatgaggggcacttcactgatactgtggtgctgtatagctgtaatccgggctatgccatgcacggaagtaataccctgacatgtctgtccggggacaggcgcgtctgggataagccacttccgtcttgcatagctgaatgcggtggacaaatccatgccgctacgagcgggagaatactcagccctggatacccagcaccatacgataacaatcttcattgcacctggatcattgaggctgaccctggaaagacgatctcactacattttatcgtgtttgacaccgaaatggcacacgatattctcaaggtatgggacggcccagtcgactctgacatcctcctaaaggagtggtccggcagtgccctccccgaagacatccatagcacctttaacagcttaacgctacagttcgacagcgatttcttcatctctaaaagcggatttagtatccaattttctaccagcatcgccgctacttgcaatgatccggggatgccacaaaatggtacgcggtatggggactcacgcgaggcaggcgataccgttactttccagtgcgatccaggatatcaactccagggccaagcaaagataacctgcgtccagctaaataataggtttttttggcagcctgaccctccgacttgcatcgcagcctgtggagggaatctgacaggacctgccggcgtaatcctaagccccaactacccacagccgtacccccctgggaaagagtgtgactggcgcgtcaaggttaaccctgatttcgtcattgccctgatatttaaatcattcaatatggagccttcgtatgatttcctgcacatctatgagggcgaggatagtaactcacccctgattgggtcttaccagggatcacaagcaccggaacgtatagagtccagcggcaactcactgttcctggccttcaggtccgacgcctcggttggactgtctgggtttgccatcgagttcaaggaaaagcccagagaagcatgttttgacccgggaaatataatgaacgggactcgcgtcggcactgattttaaactgggaagtaccatcacctatcaatgtgacagcggatataagatcctcgatccttccagcataacctgcgtcatcggcgccgacgggaagccaagttgggaccaggtcctccccagttgtaatgctccctgcggcggccaatacacaggatcagagggcgtggtactcagccctaactaccctcacaactacactgctgggcagatctgcctttacagtattaccgtgcctaaagagttcgtcgtgtttgggcagtttgcctatttccagactgcgctgaatgatctggccgagctgttcgacgggacacatgcgcaggccagactactgtcatcactttccggctcacattctggcgaaaccctgcctctggctacctcaaatcaaatcctgttgagattctcagcgaagtctggggcatccgcccgaggattccattttgtctaccaagctgtacccagaacaagcgacacacagtgtagttccgtgccagagccacgctacggaagacggataggctccgagttttcggcaggctccattgtccgtttcgagtgcaacccgggatatttgcttcaggggagcactgccctccactgccagagtgtgccgaatgctctggcgcagtggaacgacaccatccctagctgcgtcgttccatgcagtggaaacttcacacagagaaggggaacaattctgagtcccgggtatccagagccctatggcaataaccttaactgcatatggaaaataattgtcacggaggggtccggcatccagatccaggtcattagttttgcaacagaacagaactgggattccctggagatccatgacggaggagacgttactgcccctagactaggcagcttctccgggacaactgtacctgccctactgaactcaacgtcaaaccaactgtatctccattttcagtcagacatctccgtggcagccgccggttttcacctggagtataagacagtgggcctggctgcttgtcaggagcctgctctgcctagcaacagtatcaaaatcggcgacaggtatatggttaatgacgtcctcagcttccaatgcgaacccggctatactcttcagggtaggtcccacatctcctgcatgccgggaaccgtacggagatggaactacccctctcctctgtgtattgccacctgtggtggaaccctctctaccctgggaggcgtgatattatccccgggctttcccggctcatatccgaacaacctcgattgtacatggagaatcagtctgcctataggatatggcgcccatatacagtttcttaactttagcaccgaggcaaaccacgatttcctcgagatacagaacggaccatatcacacgtctcctatgatcggacagttttccggaacagacctgcccgctgcattactaagtacgacacacgagactctcatacatttctatagcgaccacagccagaatcgccagggattcaaacttgcttatcagggtgggtctggcaatatcgggccagccttcccatgcctggacacgccctttcaggcccgatgtcagggagaggaacggaccttcaactag

SEQ ID NO: 113310 - DNA, 10164 bp, Artificial Sequence
  Description of Artificial Sequence: Synthetic coding sequence
atgactgcctggcggcggtttcaaagcctgctactcctgctgggactccttgtgttgtgcgcacgcttgctcactgctgcgaagggccagaactgcggaggcctggttcagggacccaacggcacgattgagtccccagggtttccgcatgggtatccaaattacgcaaactgtacttggatcattataacaggtgaaaggaaccgaattcagctgtcttttcacacatttgcattggaggaggacttcgatatactgagcgtatatgatgggcagccccagcagggaaatcttaaggtaagactgtctgggtttcagcttccgtcatctatcgtgtctacaggctccattctcactttgtggttcacaactgacttcgccgtatcagcccagggctttaaggccctgtatgaagttttaccctcccacacttgcggcaaccctggagagatcttaaagggggtcctccacggaacaagattcaatatcggtgacaagatccgctactcttgcttacctggctatattctggagggccacgcaatactgacttgcatagtgtctccaggaaatggtgctagctgggatttccccgccccattctgtcgggccgagggggcatgcggcgggactttgcggggcaccagtagctccataagcagcccacatttcccctctgaatatgaaaataacgccgactgcacatggaccatattagccgaacccggagatacaattgctctggtgttcacagatttccagctcgaagaagggtacgacttcctggaaatttctggcacggaagcaccatccatctggctgaccggaatgaatctccccagccccgttatctcttccaaaaattggctgcgcctgcactttacatctgactccaatcaccgtaggaagggcttcaacgcacagttccaggtcaaaaaggctatcgagttaaagagtagaggcgtaaagatgttgcccagcaaggacgggagccacaagaactctgtgctctcccagggcggggtcgctctggtgtccgacatgtgcccagacccaggtattccagagaatggcagaagggctggcagcgacttcagagttggcgccaacgtgcagttcagctgtgaggacaactacgtgctacagggcagtaagagcataacctgtcaaagagtgacagagactcttgctgcctggtccgaccaccgccccatttgtcgcgctagaacatgtgggagcaatctgaggggcccctccggcgtgataacctccccaaattatcccgtgcagtacgaagataacgcgcattgcgtgtgggtaataaccactacagacccagataaagtgatcaagctagcgtttgaggagtttgagctggagaggggttatgataccctgactgtgggcgatgccgggaaggtcggagataccaggagtgtactctacgtgctaacaggatcttccgtgcctgaccttatcgtgtctatgtcaaaccaaatgtggctgcacctgcagtctgacgatagcataggctcaccagggttcaaggctgtttaccaggagatcgagaagggggggtgtggcgatcctggcatccccgcctacggcaagcgcactggatcctcattcctgcatggcgacaccctgacttttgaatgtcccgcagcatttgaattagttggagaaagggtgatcacttgccagcaaaacaaccagtggtcagggaacaaaccaagttgcgtattcagctgtttctttaactttaccgcttcatctggaatcatactatcacccaattaccccgaggagtatggcaacaatatgaactgcgtctggctgattatcagtgaacccggctccaggatccatttgatctttaatgactttgacgtggaacctcagttcgattttttagccgttaaggatgacgggattagtgacattacggtgctcggcactttctccggaaatgaagtgccatcgcagctggcatccagcggccacattgtgaggctggaatttcagagcgatcacagcaccaccggcagaggctttaatatcacttacacaacctttggccaaaacgaatgccatgaccctgggattccgatcaatggccggaggttcggtgatagattcctgttagggtctagtgtaagctttcactgcgacgatggctttgtgaagacacaggggagtgaatccattacctgtatcctgcaggacgggaatgtcgtctggtcttccactgttcctcggtgcgaggcgccttgtggaggtcatctgacagcctcctcaggagtaattctgcctcccgggtggccgggctactataaggattccctgcattgcgagtggattattgaggctaagcctgggcactccatcaaaattacctttgaccgcttccagaccgaggtgaactatgataccctggaggtccgtgatggcccagcaagctctagccctctgattggggagtaccacggcacacaggccccccagtttctgatctcaacaggcaacttcatgtatctgctcttcactacagacaactctcgctcctccattggctttctcattcattacgagtccgtgacactagagtctgactcttgccttgatcccggaattcccgtcaacggacacaggcacggtggagattttggcattcgcagtactgtgacttttagttgtgatccaggatatactctgagcgacgacgagccactagtctgcgaaaggaaccatcagtggaaccacgcattaccttcatgcgacgcgctctgcggtggctacatccaaggcaagagtgggaccgtgttaagtccaggcttcccagatttctacccaaacagcctgaactgtacttggaccatagaggtgtcacacggcaagggcgttcagatgatcttccacaccttccatttagagagctctcatgattatctcctgatcactgaagatggatcctttagcgaacccgtggcacggcttacaggatccgtgctgccccacacaatcaaggcgggtctatttggcaacttcactgcacagttgcgatttatttccgacttctctatcagttacgaaggattcaacatcactttttccgagtacgatctggaaccttgcgatgacccaggcgtccccgcgttttccagacgaatcgggtttcacttcggagttggcgacagtcttaccttttcttgttttttgggctacaggttggaaggtgctaccaaactcacgtgcctgggcggcggacgtagagtctggtccgcaccgcttcctcgttgtgtcgccgagtgcggagcctccgtcaaaggcaacgaggggactctgctgtctccgaacttccctagtaattacgacaataaccacgagtgcatttataaaattgagacagaagccgggaaaggaatccatctgagaacacggagcttccagctgttcgagggcgacacactgaaagtatacgacggaaaggacagctcctcccgtccgcttggaacttttacaaaaaacgaactcttggggttgatcctcaattcaacttctaaccatttatggcttgagttcaacaccaacggctccgatacagaccaaggctttcagcttacatatacgtcatttgaccttgtcaaatgtgaggaccctggtatccctaactacggctatagaatccgggatgaaggccacttcacagacactgtcgttctgtatagctgtaatccaggatacgcaatgcatggttcaaacaccctgacctgtctcagtggagatcgaagagtgtgggataaaccactccctagctgtatcgcggaatgtggcggccaaatccatgccgctacctctggtcgaattcttagccctgggtacccagctccatatgacaataacctgcattgcacctggattatcgaggccgacccaggcaagaccataagcctgcacttcatcgttttcgacacagaaatggctcacgacattctgaaggtctgggacggaccagttgatagcgatatcctcctgaaggagtggagtggaagcgcccttcctgaggacattcattctacattcaattcgctcacccttcagttcgactccgatttcttcatttccaagtctggatttagtatccagttctccacatcgattgccgctacttgtaatgaccctggcatgccacagaatggaaccaggtacggggattcacgcgaggctggcgacaccgtgactttccagtgcgaccccggctaccaactgcagggacaggcaaagatcacatgcgtccagctgaataaccggttcttctggcagccagacccacccacttgcatcgctgcttgtggaggcaacctcaccggaccagcgggagtgattctgtcgccaaactatccccagccctaccctcctggcaaagaatgcgattggcgggtcaaagtgaatcccgattttgtcatagcactcatctttaagagtttcaacatggaaccaagctacgattttctgcacatttacgagggggaggactcaaattcccccttaattggctcataccaaggtagtcaggcccctgaacggattgagtcctctggaaatagcctttttctggcctttcggagcgacgctagcgtgggcctgtcagggttcgccattgagttcaaagaaaaacctcgtgaggcctgcttcgatccagggaatattatgaatggcactcgggtgggcacggattttaaacttgggtcaacgattacttatcagtgcgatagtgggtacaaaatcttggacccatcttctatcacctgcgtcattggcgcagacgggaagccatcttgggaccaagtgttgccatcttgtaatgccccctgtggtggccagtataccggaagcgaaggcgtggtgctgtctcctaattacccccataattatacagcaggccaaatttgcttgtattctattactgtaccgaaagaatttgtcgtgtttggccaatttgcctactttcagacagcactgaatgatctggctgagctgtttgacgggacccatgcccaggccagactgctatcatccttgtcaggatcacacagtggtgaaacactgcccctggccacctccaaccaaattctgctgcggttcagtgcaaagagtggcgcctctgccagggggtttcatttcgtctatcaggctgttcctcgcacaagtgatacccagtgctcttcagtgccggaacctaggtatggacggcgcatcggcagtgagttcagcgcaggctctatagtgaggttcgagtgtaacccaggctatctcctgcaaggttctaccgctctgcactgtcagtctgtgcccaatgccttggcacagtggaacgataccataccctcatgtgtggtgccctgcagtgggaactttacccagcgccgtggcactatcttaagccccgggtaccctgagccttacgggaataatctgaattgtatatggaagatcatcgtgactgagggcagcggaatacagattcaggtcatttcttttgcaacagaacaaaattgggactccctcgagattcatgatggtggggacgtcaccgcccctcgtctaggctcctttagcggcactaccgttcccgccctcctaaactcaacaagtaatcaattgtacctccactttcaatcagatatatccgtggctgccgctggatttcatttggaatataaaactgtcgggctggctgcctgtcaggaaccggccctgccaagcaactccataaagatcggagaccgttacatggtgaacgacgtactgtcatttcagtgcgaacccggatatactctacagggcaggagccacatctcctgtatgcctggcacagtccggcgttggaactacccaagcccgctttgtatcgctacatgcgggggcaccctttcaactcttgggggagtgattctttccccaggttttcctggctcttatccgaataaccttgattgcacttggcgcatttcattaccaattggttacggtgcacatattcagtttctcaatttcagcacagaggccaaccacgattttttggagatccagaatggcccttaccatacatcccccatgatcggccagttttcaggtactgatctgcccgccgctctgctgtccaccacccatgagacccttatccacttttactcagaccatagtcaaaaccgacagggctttaagctagcgtaccaggcctacgagctgcagaactgccccgaccctccgccttttcagaatggctacatgatcaacagtgattacagcgtgggccagtcggtgtcttttgagtgctaccctggctatatacttatcggccaccccgtgctcacgtgccagcacggaatcaaccgcaactggaattatcctttccctaggtgtgacgctccctgtggatacaatgtgacatcccagaatgggaccatttattcgcctggctttccagacgaataccccatactgaaagactgcatatggctcatcacagtcccaccaggtcacggggtgtacatcaatttcacacttctgcagactgaagccgtaaacgattacattgcagtgtgggacggccccgatcagaacagccctcagctcggagtttttagcggaaatacagcacttgaaactgcgtactcttcaaccaatcaggttctgctaaaattccacagcgacttcagcaacggtggctttttcgttctaaacttccacgccttccagcttaagaagtgtcagcccccccccgcagtcccccaagccgagatgcttaccgaggacgatgactttgagatcggagactttgtaaagtaccagtgtcatccggggtatacgttggtgggcactgacatcctaacttgtaaactgagctctcaactccagtttgaaggctcactccccacttgcgaggcccagtgccctgctaatgaagtgagaaccggatcttccggcgttatcctgtccccgggatatcctggcaactattttaatagccagacgtgcagctggagtatcaaggtggaaccgaactacaacatcactatttttgtcgacacttttcaatccgaaaagcagtttgatgcactagaggtcttcgacgggtcctcagggcagagtcccctgctggtggtcctgtctgggaatcataccgagcagagcaatttcacgagccgttccaaccagctgtacttgagatggagcaccgatcatgccacatccaaaaaagggttcaaaatccgctacgctgcaccatactgttcccttacccatcccctgaaaaatggtggcatcctcaataggaccgctggggccgtggggtctaaggtccactacttttgcaagccaggctacagaatggtgggacattcaaacgcgacttgtagacgcaacccactggggatgtatcaatgggactccctcacaccactgtgccaagctgtttcctgtggcattcccgagtcgcctggtaacgggagttttaccggtaatgaatttaccctagattcaaaggtcgtgtatgagtgtcatgaaggcttcaagttggagagcagtcagcaagccactgccgtgtgtcaggaggatggtctatggagcaacaaaggcaaacctccgacctgtaaaccagtggcctgtccgagtatcgaggcacaactctcagagcacgtgatctggcgactcgtgtcaggctctctaaacgaatacggagctcaggttctgcttagctgctcccctggctactatcttgaggggtggaggctcctcagatgtcaggcaaatgggacatggaacattggtgatgaacggcctagctgtcgggctggacactgtggatcaccagaccccattgtgaatggtcatatatctggagatggattcagctacagggacacggtggtgtatcagtgcaacccaggcttccgcctcgtgggcacctcagttaggatctgtctccaggatcacaaatggtctggacaaactccagtatgtgtgccgataacgtgcggacatcccggcaatcccgctcatggctttacaaacggttcagagtttaatttgaacgatgtggtcaactttacatgtaacactggatacctgttgcaaggggtcagccgagcgcagtgcagaagtaatgggcagtggtcgtccccccttcccacctgtagagtggtaaactgcagcgaccctggctttgtggagaatgctataagacacggccaacagaacttcccagagtccttcgagtacggtatgagcatcttgtatcattgcaaaaaaggattttacctgctgggatccagtgcattaacgtgcatggccaatggtctgtgggaccgcagcctccccaagtgtttggcgattagctgtgggcatccaggggtcccagccaacgccgtgctcacgggagagcttttcacctatggcgccgtagttcattactcctgccggggatctgagagcctgatcggaaacgacacaagggtctgtcaggaggattcccattggagtggcgcactcccccactgcaccggcaacaacccaggcttctgcggagaccccggaacgccagcacatggaagcaggctcggcgacgattttaaaaccaagagtttgctgcgattttcttgcgagatgggccaccagctcagaggttcaccagagaggacatgtctccttaacggcagctggtccggactccagccggtctgcgaggctgtgctgtgtccccagcctccccctgtacagaatggcactgtggagggctctgacttcagatgggggtcatccatctcttacagctgcatggacggctaccaactgagtcattccgcaatcctgagctgcgaaggccggggcgtgtggaaaggggaaattcctcagtgtctgcccgtattctgtggcgatccgggcatccctgctgagggccggctgagcggcaaatccttcacttataaatcggaagtgtttttccagtgcaaaagcccttttatcttagttgggagcagcaggcgcgtatgtcaggcggatggaacttggtccggaatccagcccacctgcattgaccccgcacacaatacatgtccagatcccgggacccctcacttcgggatccagaacagttccaggggctacgaagtgggcagtacagtgttttttcggtgtaggaagggatatcacatccagggcagtaccacccgtacatgcctcgccaatctgacatggagcggaatccagactgagtgtattcctcacgcttgccggcagcctgagactcccgcacacgccgatgttcgcgctatcgacctgccaaccttcgggtatacattggtgtacacgtgccatccaggttttttcctggctggcggctccgaacatcgcacctgtaaggccgacatgaaatggacgggcaaaagccccgtgtgcaagtccaaaggcgtgagggaagtaaacgagacagtcaccaaaacacctgtgccaagcgacgtgttctttgtaaatagtctatggaagggttattacgaatacctgggcaagcgccagcccgcaaccctgactgtggactggttcaacgcaacaagcagcaaggtcaatgccacattttcggaggcttcccccgtcgagctgaagctgactggcatatacaagaaggaggaggcgcatctgcttcttaaagccttccaaattaagggccaggccgacatattcgtgagcaagttcgagaacgacaactgggggcttgatggttacgtcagctccggcctcgaacgggggggcttcacgttccagggagacatccacggcaaggattttggtaagttcaagttggagaggcaggacccgttaaaccccgatcaggacagctcttcacactaccacggaacatccagcggcagtgtcgctgcggccatcctagtcccatttttcgccctgatactaagtggatttgccttctatctgtacaaacatcggacaagacccaaggtgcagtataacggctacgccggacacgaaaactcaaacggtcaggccagctttgagaacccgatgtatgatacaaacctgaaacctacagaggctaaggctgttaggttcgacaccaccctcaacacagtgtgcacagtggtgtag

SEQ ID NO: 113311 - DNA, 10464 bp, Artificial Sequence
  Description of Artificial Sequence: Synthetic coding sequence
atgagattaatctctatcgcacctggcccacgatggcaggttcagtcacaccatccacgttctgccggtcaaaattgcacattccagctacacgggcccaacggaaccgtggaaagcccaggtttcccatatgggtatcctaactacgcgaactgtacctggactatcacagctgaagaacagcaccgcatccagttagtctttcagagtttcgcactggaggaggactttgacgtcttaagtgtcttcgacgggcctccccaaccggaaaatctgcggacccggctgacaggattccagctgcctgccactattgtttccgccgctacaaccctcagtcttcggctcatctccgattacgcagtctccgcccagggatttcacgccacttatgaggtgctcccatctcatacgtgtggtaatccaggacggctgccaaacggaatccagcagggcagtacgttcaacctgggcgataaggtccgctattcttgcaacctgggcttcttcctcgagggacacgcagtcctcacctgccacgcaggcagcgagaatagtgctacctgggattttcctctccccagttgcagagctgacgatgcgtgtgggggcacattgcgaggccagtctggcataattagtagcccgcacttcccatccgagtaccacaataatgccgactgtacttggacaatcctggcagagttaggcgatacaatcgcattggttttcatcgacttccagctggaggacggctacgattttctagaggtaacggggaccgaagggtcctccctgtggttcaccggcgcgtctctgcccgcacctgtgataagctccaagaactggctgcggctgcattttacctcggatgggaaccacaggcagcgggggttctccgctcagtatcaggtgaaaaaacaaatcgaactcaagtctagaggggtcaagctcatgccctcaaaggacaattcgcaaaagacctccgtgctgactcaggtcggagtctcccagggccacaatatgtgcccagaccccggtatcccggaacgcggcaagcgcctgggctccgatttcaggttggggtcaagcgtacagttcacctgcaatgaagggtacgacctacaaggctctaagcggatcacgtgtatgaaagtgtccgacatgttcgctgcttggtctgaccacagacccgtctgccgagcgcgcatgtgtgatgcacatttgagaggaccaagcggcatcatcacctcccccaactttccgattcagtacgacaataatgcccactgtgtgtggattatcacggctctgaacccttctaaggtgatcaaacttgcatttgaagaatttgacctggagcgggggtatgataccctgaccgtcggcgacggcgggcaagatggcgatcagaagacagtgctgtacatattgactggcacatccgtgcctgatctgatcgtgtccaccaatcaccagatgtggctgctcttccaaacagacggctctggctcctctctggggtttaaggccagttatgaagagattgaacaggggagctgtggggaccctggcatccctgcttatggacgccgcgagggatccagatttcatcacggtgacacgctgaagttcgaatgtcagcccgccttcgagctcgtgggacagaaagctatcacctgccaaaagaataatcagtggagtgctaaaaagcccggctgtgtgttttcatgttttttcaatttcaccagcccatctggagtagtcctttcacccaactaccccgaggactatggcaaccatctgcattgcgtttggttgattctagccaggccagagtcacgaattcatctagccttcaatgacatagacgtggagcctcaatttgatttcttagtgatcaaggacggggcgacggccgaggccccggtgctcggaactttttctgggaatcaactgccatcatccatcaccagcagtggccacgttgccagacttgagtttcagaccgaccatagcacaggcaaaagggggttcaacataacatttactacattcaggcataacgaatgccctgatcccggcgtccctgttaatgggaagaggtttggtgactcgctgcagctggggagctctatatctttcctgtgcgatgagggctttcttggcacgcagggcagcgaaacaattacctgtgtactgaaggaaggatccgttgtgtggaatagcgcagttctccgatgcgaggctccgtgcggcgggcacttaacgagcccaagtggtacaattctgagtccagggtggcccgggttctacaaggacgcccttagctgcgcttgggttatcgaggcacagccaggctacccaatcaagattaccttcgacaggtttaagacagaagtgaactacgacacactggaagttcgtgacggtaggacatactccgctccgctgataggagtctaccacgggacccaggtgccccagttcctgatcagtacgtccaactatctgtacctcctattcagcaccgacaagagccatagcgatattggtttccagcttcgctatgaaacaatcactctccagtcagatcactgtttggatcctgggattcccgtgaacggtcagaggcacgggaatgatttttacgtcggtgcactggtgacattctcatgcgactctggatatacactgagcgacggagagcctctggagtgtgaaccaaatttccagtggtctcgtgcccttccctcatgtgaggcactctgcggcggtttcatccaaggttcatctggaaccatcctctctcctgggttccccgacttttatcctaacaacttgaattgcacgtggatcatagaaacttcccatggtaagggagtgttcttcactttccatactttccatttagagagcgggcacgactacctgcttatcaccgaaaatggctcttttactcagcctttgaggcagctgaccggttcaaggctgcccgccccaatctccgccgggctgtatgggaattttaccgcgcaagtcaggtttatctccgacttctccatgtcttacgaagggtttaatatcacattcagcgagtacgacctggaaccttgtgaagagccagaggtccctgcgtattccattcggaaaggcctgcagttcggcgtcggtgataccctgacgttttcatgttttccaggatacagactggagggaactgcccggataacctgtcttggtggaaggcgtcggctttggagtagcccgcttccaagatgtgtggcggagtgcggcaacagcgtcaccggcacccagggcacccttttatcacctaattttcccgtcaattacaacaacaaccatgagtgcatctacagcattcaaactcaacctggaaaaggaattcagttgaaggcaagagcgtttgaactgtctgagggcgatgtgcttaaggtttacgatggcaacaataattccgctaggctcttgggggtcttttctcatagtgaaatgatgggagttacgcttaacagtacatctagctccctgtggctggactttatcacagacgctgaaaacaccagtaaggggttcgaactgcatttctcttcctttgagctgataaaatgtgaagatcccggcacaccaaagttcggatataaagtgcatgatgaaggacacttcgccggcagcagcgtgagttttagttgcgatcctgggtattccctccgcggttccgaagaactgctgtgcctgtctggcgaaaggcgaacgtgggacagaccactgcctacttgtgtcgccgaatgcggggggactgtgcgaggcgaggtctccgggcaggtcctgagcccagggtaccccgctccctacgaacacaacctcaattgtatatggaccatcgaagctgaagctgggtgtacaatcggcttacactttcttgtctttgatacagaagaagtgcacgatgtgttgcgcatttgggacggaccagtggagtccggcgtgttgctgaaagaactctctggacccgcactgccgaaggaccttcatagcaccttcaattctgtggtattgcaattctcaacagacttctttacctcaaaacaaggcttcgccatccagttcagcgtgtctactgcgaccagctgtaatgatccagggatcccccaaaatggatccaggtcaggagactcatgggaggctggggactctacagtattccagtgcgaccccggatatgcactccaaggttcagccgagatctcttgcgtcaagattgaaaacaggtttttctggcaaccttctcctccaacgtgtatcgcaccatgtggcggggatttgaccgggccatctggagtcattctgagccctaactacccagaaccttacccacccggaaaggagtgtgattggaaggtgacagtctctcccgactatgttattgccctggtgtttaatatatttaatctggaacctggttatgacttcctccatatctatgacggccgggactccctcagcccgctgataggcagtttttatggctctcaactgcccggtagaattgagtcatccagtaactccctgttccttgccttccgtagcgatgccagtgtttccaacgcaggctttgttattgattatacagagaatccccgcgaatcttgttttgatcccggctctattaagaatggcacccgggtaggtagtgacctcaaactcggaagttcggtaacctattactgtcatggcggctatgaagtggagggaacttctactctctcctgcatcttaggtcctgatggcaagcctgtgtggaataatccccgtccagtgtgcaccgccccttgtggaggccagtacgtgggatcagatggcgttgtgctgtcaccaaactatccccagaattacacgtccgggcagatttgtctgtactttgtgaccgtgcccaaggactacgtggtatttggccagtttgcctttttccacacggccttgaatgacgtcgtggaggtgcatgacgggcacagccaacacagtcggttactgtcttcgcttagcggctctcacactggtgagagtctgcccctggcaaccagcaaccaggttttgattaagtttagtgccaaggggcttgccccggcccgcgggttccattttgtgtatcaagccgtgccaaggacttctgcaacacagtgttcctccgtgcccgaaccgcgctatggcaagaggctaggttctgactttagcgtgggggcaatcgtacgctttgagtgcaacagtggttatgcactgcagggatctcccgaaattgagtgtcttccagtgccaggtgccctagcacagtggaatgtttctgcaccgacttgtgtggtgccatgtgggggaaacctgactgagcgaaggggaaccattctgtcacctggcttccctgaaccgtatctgaacagtctgaactgcgtctggaagatcgtagtaccagaaggtgctggaatacagattcaggttgtgtcttttgttaccgaacagaattgggattctctggaggtattcgatggagctgataacacagtgactatgctgggtagcttctccggcacaacagtcccagcgctgctgaatagtacatccaatcagctgtatcttcatttttactccgacatctctgtgtcggcggccggcttccatctcgagtacaaaactgtgggcttgtcttcctgtcccgaaccggcagtcccatcaaatggagtcaagaccggcgaacggtatctcgttaacgacgtggtgagctttcagtgtgagcctggctacgcactccagggtcacgcccatatttcttgcatgccgggcaccgttcggcgctggaactaccctccacccctgtgtatagcgcaatgcggagggactgtggaagagatggaaggggtaatccttagtccaggcttccctggtaactatccttccaatatggactgcagctggaagattgccttgcccgtcgggtttggagctcacatacaattcctgaacttctcaacggagccaaatcacgactatattgagatccgcaacggcccttacgaaacaagccggatgatggggagattctctggctccgaactgccctcaagcttgctgtcaacaagtcatgagaccacagtctattttcactccgatcatagtcagaacagacctggctttaagctggaataccaggatctgacctatagtcaccaaatttcatccttcctgaggggttttgatctgtctgaactggagcggactaattccactccgccggtggccgctagctatgtttgggatttggatccggggtgcgaggcttacgagctgcaggagtgccctgaccctgagccgttcgctaatggaatcgtcagaggggctggctataatgttggacagtctgtgaccttcgagtgcctgcctgggtatcagctcacgggccatccagtacttacttgccagcacggcaccaaccggaattgggaccaccccctcccgaaatgtgaggtgccatgcggggggaacatcactagctcgaatggaaccgtctacagtcccgggttcccctccccttattcatcaagccaagattgcgtgtggctcattactgtgcctattggacacggagttcgcctgaacctgagcctgctgcagacggaaccgtctggagattttattaccatatgggacggacctcagcagaccgcaccaaggctcggagtgttcactcgatccatggcaaaaaaaaccgtgcaaagcagcagcaatcaggtcttgttgaaatttcatagagacgctgctaccggcgggatattcgccatcgccttctctgcgtatcccctcacaaaatgcccaccacccacaatcctcccaaatgccgaggtggtgaccgagaatgaagagttcaacatcggagacatcgtgcgctacaggtgtctgccgggtttcacactggttggaaacgagattctgacatgtaaacttggcacctacctacagtttgaggggcctccacctatatgcgaggtgcactgccccaccaacgagttattgacggattcgaccggagtgatcttatcacagagctaccccggatcttatccccagttccaaacatgttcttggctggtccgagtagagcctgattacaacataagcctgaccgtggaatatttcctctcagagaagcagtacgacgagttcgagatctttgacgggccttcaggccaatcgcctctgctgaaggcactctctgggaattactctgctcctttgatcgtcacctcaagttcaaacagcgtctacctccgttggagtagtgatcacgcatacaaccggaagggctttaaaatccggtattccgcgccatattgttcactgccccgcgctccactgcacggatttattttaggccaaacatcgacccagcctgggggttcaatccacttcggatgtaacgccggctaccgtctggtgggacactctatggctatctgcacgaggcaccctcagggctaccatttgtggtcggaggcgattccgttgtgtcaggccctgagctgtggtcttccagaggcacctaaaaacggcatggtcttcgggaaggagtacacagtgggtacaaaggctatgtattcatgcagtgaagggtaccacctgcaggctggcgccgaagcaaccgccgaatgtcttgacacaggactgtggagcaatcgcaatgttccccctcaatgcgttccagtaacatgccctgacgtgagcagtatatccgttgagcatggccggtggaggttgattttcgaaacccagtaccagttccaggcccaactgatgctgatatgtgaccccgggtactattatacaggtcagagggtaatccgctgccaggccaacggtaagtggtcacttggcgattcaactcctacctgcaggattatatcatgcggagaactgccaatcccaccgaacggccatcgtatcggcaccctgtcagtatacggcgctacagctatattttcgtgtaatagtgggtacactctggtagggtcaagggtgcgggaatgcatggcgaatggcctctggtccgggagcgaggttcggtgtctggctgggcactgcgggactcctgagcccatcgttaatggtcacataaacggcgaaaattacagctatcgaggttctgttgtttaccagtgcaatgctggctttcggctgattggaatgtcagtccggatctgtcagcaagatcaccactggagcgggaaaacccctttctgcgtgttggtgtcttgcgggcaccccggctccccccctcactctcagatgagcggagacagttatactgtcggggctgtggtgagatatagctgtatcggcaagcgcacactcgtcggcaattcaactcgcatgtgcggactagatggccactggactggctctctgcctcattgcagcgggaccagcgtaggcgtctgcggggacccgggtatccctgctcacggaatccgcctgggagactcctttgacccggggaccgtgatgagattttcatgcgaggccggccacgttttgcggggttcctctgaacgcacctgtcaggcaaacggttcatggtccggctcccaaccggagtgcggggtgatctcgtgtggaaatccgggcaccccttcaaatgccagggtagtgttttcagatggactggtgttctcgtctagcatcgtgtatgagtgtcgtgagggctactatgcaacgggcctcctgtccaggcattgtagcgtaaatgggacatggacaggtagtgaccccgaatgtctggtcattaattgcggggatcccgggatcccagctaatggcctccggctgggaaatgactttagatacaacaagacggtaacctaccagtgcgttcccggttacatgatggagtcacacagggtgtctgtgctctcatgtaccaaagaccgcacatggaacggcacgaaacctgtttgtaaagctctgatgtgcaaaccaccacccctcatacctaacggcaaagtggtgggcagtgacttcatgtggggatcgtcagtcacgtatgcctgtttagagggctatcagctgtcccttcctgctgtgttcacctgtgaagggaacggttcttggaccggtgaactcccccagtgctttcccgtgttttgtggcgatcccggagttccatcgcgtggccgcagagaagatcgcggattctcttatcgcagctccgtgagctttagctgtcatccccctcttgtactggtgggcagccctaggcgtttctgtcaaagcgacggcacctggtcaggaacccagccatcctgcatcgatccaactctaaccacctgtgccgacccaggcgtgccccagttcgggattcaaaataactctcaagggtaccaggtcggaagcactgttcttttccggtgccagaaagggtaccttctccagggctctaccactcggacgtgcctcccaaacctgacgtggtctggaactcccccggattgcgtgccccatcactgccggcagcccgagacaccaacacacgcaaatgttggtgcgctcgatctgcccagcatgggctatactcttatctactcatgtcaggaaggcttttccttgaaaggggggtcggaacatcgcacttgtaaggccgatgggtcttggacaggtaagccacccatttgtcttgaagtgcgccccagtggccgtcccatcaatactgcccgcgagcctccactaacccaggctcttatccctggagatgtctttgccaagaatagtttgtggaaaggcgcttacgaatatcagggtaagaagcaaccagcaatgctcagagttaccggctttcaggtggcaaactctaaagtgaatgcaactatgatcgatcacagcggggtggagctccatctggctggaacctacaagaaggaggactttcacctgctgctccaggtttatcaaatcaccggacccgtggagatttttatgaataaattcaaagatgaccactgggccttggatgggcatgtgagctcagagtcatccggagctactttcatttaccagggcagtgttaagggccaaggatttggtcagttcggcttccagcgtcttgatctgagattgctcgaatcggatccagagtccatcggaaggcattttgccagcaactctagttcggtggctgcggccatcctggttcctttcatagcactcataattgcaggtttcgtcctctacttgtacaaacacagacggaggccgaaggtaccctttaacggttatgccggtcatgaaaataccaacgttcgggcaaccttcgaaaatcctatgtacgatcggaatatacagccaaccgatatcatggcctccgaggctgaatttaccgtaagcaccgtgtgcacagccgtgtag

SEQ ID NO: 113312 - DNA, 678 bp, Artificial Sequence
  Description of Artificial Sequence: Synthetic coding sequence
atgtgtgatgctcatctgcggggcccttccggcataatcaccagtcccaacttcccaattcaatacgacaacaatgcccactgtgtgtggataatcactgcactcaacccatctaaggccggaggagatcccggcaacatccagtgtaacaaggaggggctgagcgtggaaacacagagtctgagactgcggaatcggtcatgcttattgggaaacagtaaggacaacggctgttgtgttcccaaccccgttcatggaacgggcctgcaggtcatcaaactggccttcgaggagttcgatttagaacgaggatatgacactctcaccgtgggagacggtggacaagacggggatcagaagactgtgctatacattttaaccggcacatctgtgccagacttgattgtctctacaaatcaccagatgtggctattattccagactgacggcagtggctctagtttgggattcaaggcctcttacgaggaaattgaacaggggagttgtggcgatccaggaatccccgcctacgggcgccgggagggttctcggttccaccacggcgacactctgaaattcgaatgtcaacctgcctttgaactggtcgggcagaaagcaatcacttgtcagaagaacaaccagtggtccgcaaaaaaacctggttgcgtgtgtaaatag

SEQ ID NO: 113313 - DNA, 1281 bp, Artificial Sequence
  Description of Artificial Sequence: Synthetic coding sequence
atgctgggctctttcagcggtactactgtgcccgccctgctgaactcaacttcgaaccagctgtatctgcacttttactctgacatctctgtgtccgccgccggctttcacctggagtacaaaaccgtgggtctctccagttgtcctgaaccagccgtgccatcaaacggggtcaagacgggcgaacggtatctggtgaatgacgtagtgtcttttcagtgtgaaccaggctacgccttacaaggtcacgctcacatctcctgtatgccaggcacagtgaggaggtggaattaccctccaccactctgcatagcccagtgtgggggaaccgtcgaagaaatggagggtgtcattctgtcccccggcttccctggtaactacccttccaacatggattgctcttggaaaatcgctttgcctgtcggattcggcgctcacattcaattccttaacttttccactgaaccaaaccacgactacattgaaatccggaacggcccctatgagacttctagaatgatggggagatttagtggatccgagctcccctccagtctgctcagcacatctcacgagactaccgtgtatttccatagcgatcattcgcagaataggcctggatttaagttggaatatcaggcctatgagctgcaggaatgtcccgacccagaaccctttgccaatggaatcgtgagaggggcaggctacaatgtgggacagagcgtcacttttgagtgcttgccgggctatcagttgactggtcatcccgtgttaacctgtcaacacggaacgaatcgcaattgggaccacccccttcctaagtgtgaagtgccgtgtggcggcaatattaccagctccaacggtacagtgtattcccctggctttccatctccatatagctccagccaggattgcgtgtggctgatcacagtacccatcggtcatggtgttcggctaaacctatcattgttacaaaccgagccatctggcgactttatcacaatctgggacggaccacagcagaccgcgccacggctgggtgtattcacccggtctatggctaagaagacggtacagtccagttccaaccaggtgctactgaaattccaccgggacgcagcgacaggaggaatctttgctatagcgttctctgatcactgccgatacttcaatcagaagagtgggaaactggactttacccctagctccaccctcggacagctctgtaaaacgctgcacagatccttaccacacctgcggctccaatttctgcacctctag

SEQ ID NO: 113314 - DNA, 3504 bp, Artificial Sequence
  Description of Artificial Sequence: Synthetic coding sequence
atggtcattgttatcttgttccctgccgagtgcggcaacagtgtcaccgggacacagggcaccctccttagtccaaacttcccagtgaactataacaacaatcatgagtgtatttatagtatccagactcagccaggcaaggggatccagctgaaagctagagcatttgagttatctgaaggtgacgtgttgaaagtgtatgacggaaataacaacagcgcgcgcctcctgggtgtgttctcccacagcgaaatgatgggggtaacactgaacagcacatcatcaagtctgtggctggacttcattactgacgctgaaaatactagtaagggattcgagctgcatttttccagcttcgagctgatcaaatgcgaagatcctggcactcccaagttcggttataaggtccatgacgagggtcacttcgctgggtcgtccgtgagtttcagctgcgacccaggttactctttgcggggatccgaggaactcttgtgtcttagtggcgaaaggcgaacgtgggatcgacccctgccaacttgtgtcgctgaatgtggaggcacagtgcggggagaggtctcgggacaggtgttgagcccagggtatcctgcgccctacgaacataatcttaattgcatctggactattgaggccgaggctggctgcactatcggccttcattttctggtgttcgacaccgaggaggttcatgacgtgctgcgcatctgggacggccccgtggagagtggcgtactgttgaaagagctgtccggccccgcattaccgaaagatcttcactctaccttcaatagcgtcgttctgcaattttctaccgatttcttcacctctaaacaaggcttcgcaatacagttctccgtcagtactgcgaccagttgtaatgaccccggtataccccaaaatggcagccgtagcggagacagctgggaggctggcgattccactgttttccagtgtgaccctgggtacgccctgcagggctccgcggaaataagctgtgtaaaaattgaaaacaggttcttttggcaaccctcaccccccacatgtattgccccatgcggcggcgacttaactggcccgtcaggcgtgatcttgagtccgaattatcccgaaccttatccaccaggcaaagaatgtgactggaaggttactgtgagtccagactacgtcatcgccctggtctttaacatttttaacctggaacccggatatgacttcctccacatttacgatggccgggattccctgtcaccgctcatcggctctttttatggctcacaactgcccggccgcattgagtcatcgtctaacagcctgtttctagccttcaggagcgatgctagtgtgtctaacgcaggcttcgtgatcgattacacagagaatcctcgtgagagttgtttcgacccaggatccataaaaaatggtacgcgtgtcggatctgacctgaaattaggcagtagcgtcacctattactgccacggcggatacgaggtcgaaggaaccagcacactaagctgcatcttggggccagatggcaagccggtgtggaataatccacgcccagtctgcacagcaccatgtggaggtcagtatgtgggtagtgacggtgtggtgctgagccctaattatccacagaattatacatccggacagatctgtctctacttcgttacagttcctaaagactatgtggttttcggccagttcgctttttttcataccgcactgaacgacgtggtggaggtgcacgacgggcacagtcagcattcccggctactcagctccttgtcggggtctcacacaggcgagtcactaccactggccacaagcaatcaagtgcttatcaaatttagcgctaagggactcgcgcccgctcgcggcttccatttcgtataccaggccgttcctcggacctcagcaacacaatgctcttcagtcccagaaccgcgatatggaaaaagattgggctccgattttagtgtgggagccattgtaagatttgagtgtaattcagggtacgccctgcagggcagtccagagatcgagtgtcttccggtaccaggtgccctggcacaatggaacgtgagcgcccccacctgtgtcgtgccttgtggcggaaatctcacggaacgacgaggtacgatcttatctcctggattcccggagccttatctgaactccctcaattgtgtgtggaaaattgtagtgcccgaaggcgctggaatccagattcaggtcgtgtctttcgtcacagagcagaattgggattcactggaggttttcgacggagcagataatacagtgactatgctcggcagcttttctggcacaaccgtgccagcactcttgaactctacgtccaatcagctgtacttgcacttctattcagacatctccgtgagcgccgccggcttccacctcgaatacaaaacagtcggcctgagctcctgtccagagccagccgtcccatctaatggggtaaagaccggagagcgctatctggtgaatgatgttgtgtccttccagtgcgaacccgggtatgctcttcaggggcatgcccatatcagctgcatgcccggcaccgtgagacgatggaactacccacctccactctgcatcgcccagtgtgggggcacagtcgaggaaatggagggagtgatcctgagccccggatttcctggaaattacccatccaacatggactgttcctggaaaatagctttgcctgtgggatttggtgcacatattcagtttttgaatttttcaacagaaccaaaccacgattacatcgaaattcgcaacggtccatacgaaaccagccgaatgatgggacggtttagcggatccgaactgccttccagtctcctctcaacaagccatgagacgacagtgtattttcactctgatcactcgcagaacagaccaggattcaagttagaatatcaggcatacgagctccaggagtgtcctgatccagagccctttgctaatgggattgtcagaggtgccgggtacaatgtgggtcaatcagtgacattcgaatgccttcctggataccagttgaccggacatccagtgctgacttgtcagcacggcacgaatcgcaactgggatcatcccttacccaagtgtgaagtcccatgcggcggcaacattaccagctccaacggcacagtttactcccccggcttcccaagtccctactcttcttcccaagattgtgtctggttaatcactgtccctatcggccacggagtccggctgaatctgtcgctcctgcagaccgaaccctcgggagatttcattacaatctgggacggccctcagcagaccgcgcccaggttgggcgtgttcactcgaagcatggccaagaaaactgtccagtcttcaagtaaccaggttcttctgaaattccatagagacgccgctaccggaggcatcttcgctatagcattctcaggacacctcgcagcagtgtgtacactttag

SEQ ID NO: 113315 - DNA, 10896 bp, Artificial Sequence
  Description of Artificial Sequence: Synthetic coding sequence
atgccccgttcgcggggcagggaactcggacggtgtggctgccccgctggcagggccaggggcgagaccgggattagcgcattggtacctggagccggcagcaggtggggccgaccgcctcctccaacccctcccccactcctgctgctcttgggttgcgggcttctgtctgtttctgctgccgccggccaaaattgcacttttcaactgcacgggcccaatggaacggttgaaagcccaggcttcccctatggctaccccaattatgctaattgcacctggacaatcactgcagaggaacaacacaggattcagcttgtgttccaaagtttcgctctcgaagaggattttgacgtgctctctgtgtttgacggtcctccccaaccagaaaatctgcgcacaaggctcacaggtttccaactccccgccacgatcgtgtcagctgctaccactctcagtttgaggctgatctctgactacgccgtgagcgctcagggatttcatgcgacatacgaggtcctcccctctcacacctgcggaaacccaggtagactcccaaatggaattcaacagggcagcaccttcaatctgggcgacaaagtcaggtactcctgcaatctgggcttcttcttggagggtcacgccgtgcttacctgtcacgcagggtcggagaacagtgcaacgtgggattttcctctgccaagctgtcgggcagacgacgcctgcggcggcactctgcgagggcagtcgggtattatttcttcacctcattttccttccgagtaccataataacgccgactgtacctggactattcttgccgagctgggtgatactatagcactagtcttcatcgactttcaacttgaggacgggtacgatttcctggaggttaccggcaccgagggcagttctctttggttcaccggagcctcattaccagctcccgtcatcagcagtaaaaattggctgcgcttgcattttacatcagatggaaaccatagacagcgtggcttcagtgctcagtatcaggtcaagaagcagatcgaattgaagtctcggggggtgaaacttatgccatcaaaggataattcccagaagacctccgtcttgacccaggtgggggtttctcagggtcacaatatgtgtccagatcctggaatcccggaacggggtaagaggctgggctccgacttccgccttggttccagcgtccagttcacatgtaatgaagggtatgatttgcagggttctaaacggattacttgtatgaaggtgtcagatatgttcgcagcatggagtgatcaccgaccagtttgtcgggcacggatgtgcgatgcacacctgcgaggaccaagtgggataatcacctctccaaacttccctatccaatacgataataacgcgcactgtgtctggatcattacagcgcttaacccctcaaaggtcatcaagctagccttcgaagagttcgacttggaacggggctacgacacacttactgtgggagacggtggacaggacggtgatcaaaaaaccgtcctgtacatactcactggcaccagcgtccctgacctgatcgtgtctacgaatcaccagatgtggctgctcttccaaaccgacggaagtggaagctccttaggttttaaagcttcctatgaggaaatagaacaaggctcctgtggcgaccctggtattcctgcttacgggcgacgggaagggtcccgcttccatcacggcgacacactgaagttcgaatgccagccagcttttgagttggtggggcagaaggctattacctgccagaagaacaaccagtggagtgccaagaaacccggctgcgtctttagctgcttcttcaacttcacctcaccctcaggcgtggtgctctctcctaactatcccgaagattatggcaatcaccttcattgtgtgtggttaatcctagccagacctgagtctagaatccatctggcatttaacgatatcgacgtggaaccacaatttgattttctggtgatcaaagatggagccacagcagaagctcctgtactgggtaccttcagcggaaaccagctgccatcctcaataacatccagtggtcacgtagcccggctggagtttcagactgatcactcaaccgggaagagaggcttcaacatcacgttcactacattccggcataatgaatgtccagaccctggggttcctgtcaatggaaagcgattcggggattctctccagttgggatctagtatcagcttcctctgcgatgaagggttcctgggcactcagggttcagagacaatcacatgcgtcttgaaagagggaagtgtggtgtggaattcagccgtgctgcgttgcgaagcaccatgcgggggccacctgacttctcccagcggcaccatcctttcccccggatggccaggcttttacaaggacgccctaagctgcgcctgggtgatcgaagctcagccaggttaccccatcaaaatcaccttcgacaggttcaagactgaggtgaactacgacaccctggaagtacgcgatgggaggacctactccgcacctttaattggcgtctatcatggaactcaggtcccccaatttctcattagcaccagtaattacctgtacttattattttccactgataagagccactccgacatcggattccagctgcggtacgagactatcactctgcagagcgaccattgcctggatccaggaatccccgtgaatgggcagaggcatggcaacgatttttacgttggcgcactggtgaccttcagctgcgacagtggctacacactgagcgacggtgagcctctcgagtgtgaaccgaattttcagtggtcaagggcactcccatcctgtgaggcactgtgcggtggcttcatccagggatccagtggcaccatcttgagccccgggtttccggatttctaccctaacaacctgaattgcacctggatcatcgaaactagccatgggaagggggtctttttcacctttcacacgttccacttggagagcggacatgattatctcctaatcacggagaatggaagtttcactcaacctctgcggcaactgacaggcagtagactacctgctcccatctccgcagggttgtacggtaacttcaccgcccaggtgcgtttcatttctgactttagtatgagttacgagggattcaacataacctttagcgagtatgacctcgagccttgcgaggagccagaggtgccagcctatagcatccggaagggactgcagttcggggtcggggatactctgaccttctcctgtttccccggatacaggctagaaggaactgctaggatcacctgcctcgggggaaggcgccggttatggagttcacccctccctaggtgtgtagccgaatgcggaaactcggtcacggggactcagggaactctgttgagcccgaactttcccgtgaactataacaataaccatgagtgtatatacagcatacagacccaacccggcaaggggatccagttgaaagcccgagctttcgaattaagcgaaggcgacgtattgaaagtgtatgacggtaacaacaactccgccaggctgctcggagtgttttcccattctgagatgatgggcgtcacactgaattccacaagttctagcctgtggctggactttattactgatgcagagaatacatcaaaaggcttcgagttacacttctcctcgttcgaactcattaagtgtgaggacccaggaactccaaagtttggttacaaggttcatgacgagggccacttcgcggggtctagcgtgagtttttcatgtgaccccggttacagcctgaggggttcagaggaacttttatgtctctccggtgagcgccgtacctgggatcgcccactccctacatgcgtagcggaatgtggaggtaccgtcagaggggaagtgagtggccaggtgctgtcacccggatacccagctccttacgaacacaacctgaactgcatttggaccatcgaggcggaggcgggatgcaccatcggactgcattttctggttttcgacactgaggaggtgcatgacgtcctgcggatctgggatgggcccgtggagtctggggttctactgaaggagctgagcggccccgccctgccaaaagatctgcactcaaccttcaatagtgtagttctgcagttctccaccgacttttttaccagcaagcagggatttgccattcagttttccgtgtctaccgctacttcctgcaatgatccaggcattccgcaaaacggcagtagatctggcgatagttgggaagccggagactccaccgttttccagtgcgacccaggatacgccctgcaagggagtgctgaaatttcatgcgtgaagatcgaaaaccggttcttttggcagccctcaccacccacctgcatcgccccttgcggcggcgacctcacaggcccttctggagttattctgagcccgaattaccctgaaccttaccctcccggcaaagaatgcgattggaaagtcacagtatcgcctgattatgttatagctctggtttttaatattttcaacttggagcctggatacgattttcttcatatttacgatggccgcgattcattgtcaccattgatcggtagcttttacggctcacagctcccaggcagaatcgagtctagttccaatagtttatttctggcatttcggagcgacgcgagcgtgtccaacgccggctttgtgattgactatacagagaacccaagggaaagttgtttcgatccaggttccatcaagaacggtactcgagtcggttcagacctgaagcttggctcatcagttacgtactattgccacggcggctacgaagtggaggggacatcaaccctcagctgtatcctgggacccgatggcaagcctgtatggaacaatcctaggcctgtctgcacggccccgtgtggcgggcagtatgtgggaagtgatggtgttgtattatcgcccaactatccccaaaactacacgtcaggccaaatatgcctgtactttgttactgtgccgaaggactacgttgtctttggccagtttgccttctttcatacagcgctgaacgatgtggttgaggtgcacgatggacatagtcaacacagcaggctactgtcctcattatccggctcacatacaggtgaaagtctgcctctcgcgactagtaatcaggtcttgatcaagttctctgcaaaaggactggcccctgctcggggctttcactttgtctaccaggcggtgccccgcaccagcgcaactcagtgttccagtgtacccgagcctcggtacggcaaacgactgggatccgacttctctgtaggtgccattgtgcgcttcgaatgtaatagcggttatgcattgcaggggagccccgagattgagtgcctgcccgtgcctggcgctctggcgcagtggaatgtttcagctcctacatgcgtggtgccatgtggcggaaaccttactgaacgacgtggaaccatactctcacccggcttccccgagccgtatttgaactctctgaattgcgtgtggaaaatcgtggtcccagagggcgcaggaatacagatccaggtcgttagtttcgtgactgagcagaattgggacagtctggaggttttcgacggtgccgacaatacagtgaccatgctgggctcctttagtggcacaacagttccggccctgctcaatagcacatctaaccagctgtatttgcatttttattctgacatttccgtctctgcggctggctttcacctggaatataagacagtaggtttatcttcctgcccagagcctgcagtgccatcaaacggcgtgaaaacaggagaaaggtacctggtgaacgatgtggttagctttcagtgtgagccaggctacgcccttcaaggacatgctcatatcagctgcatgcccggcaccgtccggcggtggaactatccaccgcccctgtgcattgcccaatgtggagggactgtggaggaaatggaaggcgtcattttatccccgggatttcctgggaactatccttccaatatggactgctcatggaagatcgccctgcccgttggttttggcgcacacatacaattcttgaacttctccaccgagccaaaccacgattacatagaaatccgcaatggtccttacgaaacttctcggatgatggggcgatttagtggcagcgagctgccaagctccttgctttcaacctctcacgagaccacagtttattttcacagtgatcattctcagaatcgcccgggatttaaactagaataccaagcatatgagctgcaagagtgccctgatcccgagccttttgctaatggcatcgtccgcggagccgggtacaatgtcgggcagtctgtgacctttgaatgccttcctggataccagctcaccggtcaccctgtgctgacctgtcagcatggcaccaatcgaaactgggaccaccctcttcctaagtgcgaagtgccctgtggaggaaatatcacctcctccaacggcaccgtctactctcctgggttcccgtcgccctacagttcatcccaggattgtgtttggctgataaccgtgccaataggtcacggggtgcgcctgaacttgagcctgttgcaaaccgaaccctcaggagatttcatcacaatctgggatggccctcagcagacagcacctcggttaggggtcttcactagatctatggcaaaaaaaactgtacagtcgagctccaaccaggtgctcctgaaatttcatcgggacgctgccaccggcgggatctttgccatagcatttagcgcctatcccctgaccaagtgcccgccccctactatcctgcccaatgccgaggtggtgacagagaatgaggagtttaacattggcgacattgtgcgctacaggtgcctgcctggcttcacgctagtaggcaatgagatacttacatgcaaattggggacatatttgcagttcgagggccctcctcccatctgcgaagtgcactgcccaactaacgaactgctgaccgactcgaccggcgtgattttgtcccaatcataccctggctcttacccccaattccagacgtgttcttggctggtgcgagtagaaccagactataacatcagcttgaccgtcgaatattttctgtctgaaaagcaatacgatgaattcgagatcttcgatggcccctcaggccagtccccactccttaaggcgttaagcggaaactattccgccccactcatcgtcacttccagctcaaacagtgtgtaccttagatggtcatctgatcacgcctacaaccggaaaggttttaagatcaggtactccgccccctactgttctctgcctagagcacctttacatggcttcatactgggccaaacatccactcaacctggtggtagcattcactttggatgtaatgccgggtatcggcttgttggacactccatggccatctgtacacgtcacccgcaaggctaccacctgtggtcagaagcaattccgctgtgtcaggccctgtcctgcgggctccctgaagcccctaagaacggaatggtcttcggaaaggaatacaccgtggggactaaggccatgtacagttgctccgaagggtaccacctgcaggccggtgccgaagcaaccgctgagtgcctagatacaggcctgtggtctaatagaaacgtaccaccacagtgcgtacccgtgacctgccccgatgtcagcagcattagcgtggagcacggtaggtggaggctgattttcgaaacacagtaccagttccaagcgcaactgatgcttatctgcgaccccggttattattatacaggtcaaagagttatccgttgccaagctaatggaaagtggtctttaggcgacagcaccccaacttgcaggattatctcctgtggggagctgcccattcctccaaatggacatagaatcggcacgctttccgtatatggagctacggccatttttagctgcaattcagggtatacgctcgttggatccagagtccgagaatgtatggctaacggtctgtggagtgggagcgaggtacgatgtctggctacgcagacaaagctccacagtatcttctacaagctgctgtttgatgttctgtcctccccctcactgactaaggcaggtcactgtggcacacctgagccaatcgtcaacgggcacattaatggagagaattacagctacagagggagtgtcgtataccagtgcaatgccggattccgtttgattggaatgtctgtgcgtatctgccaacaggaccaccactggtctgggaaaacacctttctgcgtgcccattacctgtggccatcctggtaatccggtgaatggcctcacgcaaggaaaccagttcaacctgaatgatgtagtgaaatttgtatgtaaccccggttacatggccgagggggccgccaggtctcaatgcttagcctcaggtcaatggtccgatatgttacccacatgtcggattattaactgcacagatccaggccaccaggagaactccgtgcgtcaggtccatgctagcggaccacacagattcagcttcggcaccaccgtgtcctaccgctgtaaccacggtttctatttacttggcaccccggtgcttagctgtcagggagatggaacctgggataggccccgtccccagtgcttgctggtatcatgtggtcatccaggcagccctcctcattcccagatgtcaggtgattcttatacagtgggggccgtggtacgctattcatgtatcggcaaacgcacactggtgggtaatagtactcgaatgtgcggtctggatggacattggaccggcagtctgccgcactgtagtgggacatccgttggcgtgtgtggagaccctggcattccagcacatgggataaggctgggtgactccttcgaccccggaaccgttatgaggtttagttgcgaggctggccacgtgctccggggctcaagcgagagaacatgccaggccaacgggtcatggagcgggtcacagcccgagtgcggagtcatatcatgcgggaatccaggcacaccttccaacgccagggtggtgttctctgatggcctggtgttcagctcttctattgtgtacgagtgtcgagagggctattatgctactggtctcctttcaaggcattgttcagtgaatggaacatggacgggctctgaccctgaatgtctggtgatcaactgcggggatccagggatccctgccaacggcctaaggctgggcaatgactttcggtataacaaaactgtgacataccaatgcgtgcctggttacatgatggaatcccacagagtctcagtgctcagctgcacgaaagatagaacctggaacggcaccaaaccggtctgtaaggctttgatgtgcaagcccccccccctgatccccaacgggaaagtggtgggcagcgacttcatgtggggctcttccgttacgtatgcctgcctggagggataccagctgtcattgcccgctgtcttcacctgcgagggcaacggatcatggaccggagagcttccccagtgcttccccgtgttttgtggagatccaggcgtgccatctagggggcggagagaggataggggcttctcgtatcggagctccgtgagcttctcttgtcatccacccctggtgcttgtcggatcccccagacgcttctgccaatctgatggaacatggtctggaacacagccctcgtgcatagatccgaccctgactacctgtgcagatcccggagtcccccagttcggtatccagaataacagtcaaggatatcaggtgggatctactgtactttttaggtgtcagaaggggtacctgctccagggctccactacccgcacgtgcctcccgaatctgacgtggtccggcacaccaccagattgcgtcccccatcactgtaggcaacccgaaactcccacacacgctaatgttggagctctcgaccttccatctatgggttacacacttatatactcttgtcaggagggcttctcgctgaaaggtggatctgaacaccgcacctgtaaggcagacgggagttggacgggaaagcctccaatatgcctggaggtgcggccttcaggcaggcccatcaacacagctcgagaaccccctctgacccaggccctgatacccggtgatgtctttgccaagaatagcttgtggaaaggtgcatacgagtatcaaggcaagaagcagcctgccatgctgagggtgacgggattccaggttgctaattccaaagtgaacgcaaccatgattgatcattcaggcgttgagctccacttggctggtacttacaagaaggaagattttcacctgctcctgcaggtctaccaaatcaccggccctgtggagatttttatgaataaattcaaagacgaccactgggctctggacgggcacgtcagtagtgagtcaagcggtgccacatttatctaccagggtagcgtaaaaggccagggcttcggccagtttggattccagcggctggacctacgcttgctggagtctgacccagagagtattgggcgccacttcgcctccaattctagttccgtcgccgccgccatcctggttccatttattgccctaattatcgcaggcttcgtgttgtacctctataaacatagacggaggccaaaagtgcccttcaacggatatgccggacatgagaacaccaatgtgcgcgcgaccttcgagaatccaatgtatgataggaatatccagccaactgacataatggcctctgaggcggaattcactgtgtcaaccgtgtgcactgctgtttag

SEQ ID NO: 113316 - DNA, 1281 bp, Artificial Sequence
  Description of Artificial Sequence: Synthetic coding sequence
atgctggggagtttctccggaactactgttcccgcactccttaattcaacaagcaaccaactctatctgcacttttattctgatatttcagtgagcgccgcaggctttcatctcgagtacaaaacagttggactgtcgtcttgtcccgagcctgccgtccctagcaatggtgtcaagacaggcgaacggtatctggtgaacgacgtagtctcgtttcagtgcgaacccgggtatgcccttcaggggcatgcacacattagctgtatgcctggaaccgtcaggcgatggaactacccaccgcctctgtgcattgctcaatgtggcggcaccgtggaagagatggagggagtgattctttccccggggttccccggtaactacccttcaaacatggattgctcctggaagatcgctctgccggtgggtttcggagcacacattcagtttttaaacttctcaacagaacctaaccacgattatatagagatccgcaacggcccatacgagactagccgtatgatgggacgcttttccgggagtgaattgcctagcagtctcctgtcaacgagtcatgagaccaccgtgtactttcactcagatcatagtcagaatcgacccggtttcaaacttgagtaccaggcgtacgagctccaagaatgtcccgatcctgagccctttgcaaacggaattgtgcgcggcgcaggctataatgtcggacaatcggtcacatttgagtgcctgcctggctaccagctcaccggccacccagtgctcacgtgccagcatgggacaaatagaaattgggatcatcccctgcccaaatgcgaagttccatgcgggggcaacatcactagcagcaatggaacggtgtactctccgggcttcccttccccgtactcctcttctcaggattgtgtctggctaattaccgtgcctatcggtcacggtgtccgtctgaatcttagtctgttgcagacggagccttctggagactttattaccatctgggatggaccccaacagactgctcccaggctcggagtcttcactagatcaatggccaaaaaaactgtgcaaagttcatccaaccaggtccttctgaagtttcaccgcgacgccgccaccggtgggatctttgccattgctttcagtgaccactgtcgatatttcaatcagaaatctggtaaattggactttaccccctcctctaccctgggtcagctctgcaagactctccatcgttctttgcctcacctccggcttcagtttttgcatctctag

SEQ ID NO: 113317 - DNA, 11124 bp, Artificial Sequence
  Description of Artificial Sequence: Synthetic coding sequence
atgaagggcatcaggaaaggcgagtcccgagctaaagaatcaaagccctgggaaccaggaaagagaaggtgtgccaagtgcgggaggctcgatttcatccttatgaagaagatgggcattaaatccggcttcacattctggaatctggtctttctgctgaccgtttcttgtgttaagggctttatctatacttgcggaggaacattgaaagggctgaacgggaccatcgaatctcctggttttccgtacgggtacccgaatggagccaactgtacctgggtgatcattgcagaagaacggaaccgcatccaaatcgtgtttcagagttttgctctagaagaggagtacgactacctatccctttatgacggtcatccgcaccccaccaacttccgcacgagattgactggcttccatctgccccctccggtgactagcacgaagagcgttttctccctgaggttaaccagtgactttgcagtctcagcgcatggattcaaggtttactacgaggaactgcaaagctcctcctgtgggaaccccggggtgcctcccaagggcgtcctttacgggacaaggtttgacgtcggcgataagatcagatattcttgcgttaccgggtatatcctggatgggcacccacagctgacatgcatcgcgaactctgtgaacacagcctcttgggactttccagtcccaatctgcagagccgaagatgcctgcgggggaactatgagaggatcttccgggatcatctcctccccctcctttcccaacgaataccataacaacgccgactgtacctggaccattgtggctgagccaggcgacactatctcgctgatctttaccgatttccagatggaagaaaagtatgattacctggagatcgaaggatctgagccccccaccatttggctgtccgggatgaacatacctccacctataatttccaataagaactggctgaggttacacttcgtcacggattctaaccacagataccgggggttttctgcaccctatcagggctcgtcaaccctgacgcacacaactagcacaggtgaactggaggaacataatagaacaaccacaggggctattgccgttgcttcaactccagccgatgtgaccgtgtcctctgtcacggcagtgacgatccacaggctgtcggaggagcagcgtgttcaggtgacttccctgcgaaacagtggcctggacccgaatacgtcaaaagacgggctctccccgcacccggcagacacacagtccacacggcggcggcctagacacgctgaacagatcgaacgtacaaaagaactggccgtggttactcatagagtgaagaaggctatcgatttcaagtccagagggttcaagctgtttcccggtaaggataacagtaacaaattctcaatcctcaacgagggaggcattaagactgctagtaacctctgccctgaccctggcgagcccgagaacggaaagaggatcggctctgatttcagcctgggaagtacggtgcaattctcctgtgatgaagattacgtgctccaaggagcaaaatctataacgtgccagagaattgctgaggtgttcgccgcatggtctgaccacaggccagtgtgcaaggtcaaaacctgtggtagcaatcttcagggaccgagtggcacatttacatctccgaattttccttttcagtatgactccaatgctcaatgtgtctgggtaattacagccgttaatacaaataaggtcatccagataaatttcgaggagttcgaccttgaaatcggttacgacacgttaaccatcggcgacgggggagaggtcggggatcctcgcacagttctgcaggtcctcacgggaagttttgttccagatttaatagtatcgatgtcgtcacagatgtggctacatttgcaaaccgatgaaagcgtgggttcagtcggcttcaaagtgaattataaggaaattgagaaggagtcttgtggtgacccgggcactcctctctatgggatcagggaaggcgatggattcagcaatcgagacgtccttcgatttgaatgtcagtttggcttcgagctgataggcgagaaatccattgtttgtcaggaaaacaatcagtggtctgccaacattcctatttgcatctttccctgtctcagcaatttcaccgcgcctatgggaactgtgctgtcacccgattaccccgagggatacggcaacaatctgaactgcatttggacaattatctcggaccccggttcccgtatccacctgtccttcaacgattttgatctggagtcccagttcgacttcttggccgtcaaggatggagactccccagagagtcccatcctgggaaccttcacgggcgcggaggtgccatcacatcttacctctaactctcacatactgaggcttgaatttcaggcagaccattccatgtccggaaggggctttaacatcacgtacaatacttttggacataatgaatgtccagacccagggatcccaattaacgctaggagattcggggacaatttccagctgggaagctctatttctgttatttgtgaggagggattcatcaagacccagggaactgagaccatcacgtgcatcctcatggatgggaaagttatgtggtcaggcctgatccccaaatgtggagctccatgtggaggccattttagtgctccatccggagtgatattaagtcccggctggccaggctattacaaggactcccttaattgtgaatgggttatcgaggctgaacctggccactcaatcaagattactttcgagcgtttccaaacagagctcaattatgacgtgctggaggtgcacgacggcccaaaccttctcagcccgctgctcgggtcatataacggcacccaggtcccccagtttctgtttagcagcagcaatttcatctacctcctttttacgacggacaattcaagaagtaataacggtttcaaaatccactatgagtcggtgaccgtcaacacctacagttgcctggacccgggaatacccgtgcatggtagacgctatgggcacgacttttccatcgggagtacagtgtctttctcttgtgactctggatatagactgtcccacgaggagcccctgctgtgcgagaaaaaccattggtggtctcatcctttacccacgtgtgacgcactgtgtgggggagatgtgagaggaccctcaggtaccatcctaagtcctggatatcctgagttctacccaaactccctaaactgcacttggacggtggacgtgactcacggaaaaggagtgcagtttaactttcacacctttcatctcgaggaccatcacgactatcttctcatcaccgaaaacggtagcttcacccaacctctggcccggctgaccggaagcgacctgcccccgaccatcaacgctggactctacggcaatttcagggcccagttacgattcatctctgatttttcaatcagctacgaggggttcaacatcacatttagcgagtacaaccttgagccctgtgaagaccccggcattccccagtacggctctcgtatcggcttcaactttggaattggcgacactctcacgttctcatgttcatcagggtatcggctggaagggacttcggagatcatctgcctcggcggcggcaggcgggtttggagtgctcccttgccacgctgtgttgcagagtgcggagccagcgcgaccaataatgaggggattctgctgtctcccaattatccattgaactacgaaaataatcacgaatgtatttacagtattcaagtccaggcaggcaaggggataaatatcagtgcacgaacattccacctggcccagggagacgtgctgaaaatctatgatggcaaagacaagacaacccacctactgggagcgttcacaggtgcaagtatgagagggctgactctgagctctaccagcaaccagctctggctcgagttcaactctgacacagaaggcaccgacgagggattccaacttgtctacacttcttttgagttgagccattgcgaagaccctggtatcccacagttcggatacaagatctctgaccaaggtcattttgcgggatcaactatcatttacggatgcaatcccggatacacactgcatggtagctcgttgctgaagtgcatgaccggggagcggcgggcttgggactaccctttaccttcgtgtatcgctgaatgcggcgggcggttcaagggagaaagcagtggcagaattctctccccagggtatccgttcccttatgataataatttgaggtgcatgtggatgattgaagtggatcctggcaatatcgtgtcactgcagttcctggcgttcgacacagaagccagtcacgacatcctgcgggtctgggacggacccccggaaaatgatatgctacttaaggagatctcgggttcgctgatacctgaaggtatccactctactctaaatatcgtgaccatacagtttgacacagatttctacattagtaagagcggatttgccatccagttctccagctccgtggccacagcctgtcgcgacccaggcgtgcccatgaacggaacccggaatggtgacggtcgggagccaggagacaccgtggtttttcagtgcgatcctggctacgagttgcagggcgaggaaagaataacttgtatccaggtggagaatcggtatttctggcagccctcaccgcctgtgtgtatagcgccctgtggtggaaacctaacaggtagttctggcttcattctaagtcctaacttcccacatccttacccgcacagcagagattgtgattggacgatcactgtcaatgctgactacgtgatttccctcgccttcatcagtttctccatcgagccgaactatgacttcctatacatctatgacggtcccgactcgaactctcccctgatcggcagttttcaggatagcaagctgcctgaaagaatagaatcatctagcaatacaatgcacttagccttccgctccgatggctccgttagctacaccggcttccatcttgagtacaaggctaagctcagggaatcctgcttcgatccaggaaacataatgaatgggacaagactagggatggactacaagttggggagcacggtcacatactactgcgacgccggctatgtgctccaggggtattcaacgctgacttgtatcatgggtgatgacggacgtcccggatggaatagggcgctgcctagttgccatgccccatgcgggtccaggtctaccggcagcgagggcaccgtgcttagccccaattacccgaagaattactctgtgggccataattgcgtgtactctatagccgtaccaaaagagttcgttgttttcggccaattcgttttcttccagacgtcgctccatgacgtagtggaagtttacgatggcccgactcagcagtcctccctgctgtcgagtctctctggcagtcatagtggggagtctttacctctatctagtggaaatcagatcactatcaggtttactagtgtgggacccatcacagccaaaggattccacttcgtctatcaggcagtaccccggacttccagtacacagtgcagttccgttcccgagccccggtttgggaggcgaattgggaacgagtttgcagttggttcctcagttctgtttgattgcaatcctggatacatcctccacgggagtattgccatcaggtgtgaaactgtacccaattctttggctcagtggaacgattccctcccaacctgtattgtaccctgcggcggcatcctgacaaaaaggaaaggcactatcctgtcacctggatacccagagccctatgacaataatttgaattgtgtctggaagatcaccgtgcccgagggggctggtatccaggtccaggttgtgtccttcgctactgaacacaactgggactccctggatttctatgacgggggtgacaacaacgcgccacgcctcggctcgtactccggcacgaccatcccacatctcctgaatagcacttcaaataacctgtatctcaattttcagtctgatataagcgtatcggccgctgggtttcacttagagtataccgccatcggcctggacagctgtcctgagcctcagacgccttctagcggaattaaaataggagaccggtacatggtgggtgacgtcgtgagctttcagtgcgaccaaggctatagcctccaggggcattctcatattacgtgcatgcccggacctgtgcgcaggtggaactaccctatccccatctgtctcgcccagtgcggtggcgctatgtctgatttctcaggcgttattctttcccccggatttcccggtaactatccctcaagccttgattgcacatggaccatcaatctgcccattggattcggggtgcatctgcagtttgttaatttctctacagagacaatacatgactaccttgaagttagatcaggttcctcagaaacctcaactgtgattggaagactttccggccctcaaatacccagttctttattctccaccacccacgagacatccctctacttccactctgactatagccagaataagcagggcttccacatagtgtaccaggcctaccagttgcagagctgcccggacccacggccttttcggaacggttttgtaattggaaatgactttactgtcggccagaccatttcattcgagtgcttcccaggatacaccttgatcggaaacagtgccctcacatgtctgcatggcgttagcagaaattggaatcacccgctacctcggtgcgaggctctctgcggaggtaacatcactgcaatgaatgggacaatttatagtcccggataccccgatgagtacccaaatttccaggactgtttttggctggttagggtgccacccggcaacggcatatacattaactttaccgtgctgcaaacagaaccaatctatgattttatcaccgtttgggacggccccgatcagaattccccacagatagggcagttcagtggcaataccgccctggagtcagtttatagcacctctaaccaaatcctcatcaaattccacagtgattttaccaccagcgggttcttcgtcctgtcttatcatgcgtatcaactgagagtgtgtcagcctcctccccccgtacctaatgccgagatcctcaccgaagatgacgagttcgagatcggggatattatacggtaccagtgtctgcctggattcaccctggtcggaaacgcgatacttacttgtcggttaggagagcgcttgcaaatggacggtgcgcctccagtttgccaggtattatgtccggctaacgagctcaggctcgactcaaccggcgtgatcctttctcccggatatcccgactcttatccaaacctgcagatgtgcgcttggtctatctctgtcgaaaaaggatacaacatcactatgttcgtggaattcttccagaccgaaaaggaatttgatgtgttacaggtctatgacggtcccaatattcagtcccccgttttgatctcccttagtggcgactactcctccgccttcaacattaccagtaacggccatgaagtattccttcaatggtccgctgatcacggtaataataaaaaaggtttccgaattcgctacatagctttctactgttccactcctgaatcccctccccacgggtatattatatctcagaccggaggccaactcaacagtgtggttcgatgggcatgcgatcgcggatttagacttgtgggaaagtcctccgcagtttgccggaagtcttcctatggatatcacgcctgggacgccccagttcctgcttgtcaagccatctcttgcggtattcctaaggcgccaaccaacggcggaatcttgaccacagactacttagtaggcactcgagtcacgtacttctgcaacgacgggtacagattgtcctcaaaagagctaaccacagctgtttgtcagtccgacggcacctggtcaaatcacaacaagacccctagatgcgtggtcgtcacctgtccaagtattaactctttcattctggaacacggacgctggcggatagtgaacggaagccattacgagtataaaactaaggtggtgttttcatgtgatcccggataccacgggttgggcccagcaagtatcgagtgtctccctaatggcacttggtcctggcgtaatgaacggccatactgccaaattataagttgtggcgagcttcctacccctccgaacggcaacaaaattggaacccaaacgtcgtacggctccaccgccatcttcacatgcgatctgggtttcatgctcgtggggagcgctgtgcgcgaatgcctgagcagcggattatggagcgagagcgagacaaggtgcctcgccggacactgtggaatccctgagcttatcgtgaatggccaagttatcggggaaaattacggctatcgcgacactgtagtgtatcagtgcaaccctggattcagattaatcggctctagtgtgcgcatctgccagcaggaccacaactggtctggacaactgccctcctgtgttcccgtctcctgtggccacccaggttctcccatctacggacggacgtctggtaatggcttcaattttaatgatgttgtcactttttcgtgcaacatcggatacctgatgcagggacccactaaggcacagtgtcaggccaaccgccagtggtcacatccaccacccatgtgtaaggtcgtgaactgttccgaccctggaattccagctaattccaagcgggagagcaagatcgagcacggcaattttacctacggcacggtggtgttctacgattgcaaccccggatacttccttttcggttcgagcgtcctgatctgccagcccaacggccagtgggacaagccgctgcccgagtgcataatgattgactgcggccaccccggcgtgcctccaaacgctgttttgagcggggaaaagtatacattcgggtcaacagtccactactcctgcacggggaaaagaagcttattgggtcaatccagccgcacatgccaacttaatggccactggagtggctctcagcctcactgctctggcgacgctaccggaacctgcggtgaccccggcacccccggccatgggtcccgacaggagagcaatttccgtaccaagtcgactgtccgctacgcatgcgacactggctatatactgcatggaagcgaggagcggacttgcctggcaaatgggtcttggacaggtcgacaacctgagtgtaaggcggtgcagtgtggcaatcccggtacaaccgcgaacggcaaagtcttcagaattgacggaaccacctttagtagttcagttatctactcttgtatggaagggtacatcctctccggtccaagcgtgaggcaatgcaccgccaatggtacatggagtgggaccctaccaaactgcacaatcatcagctgcggggaccctggaatccctgccaatggtctccgttacggtgatgactacgtggtgggtcagaacgtgtcctacatgtgtcaacctggatacaccatggagctgaacggaagtagaatccgaacatgcactattaacggaacctggagtggagttatgccaacatgtcgggctgtgacttgtcctacccccccccagatatccaatgggagattagaaggcaccaactttgattggggattcagtatctcctatatctgctctcccgggtacgagttatccttccctgcagtgctgacctgcgttggaaacggaacctggtccggtgaggtccctcagtgcttaccgaaattctgcggcgatccaggcatcccagcacaggggaaacgagaaggcaagtcttttatttaccagtctgaggttagtttttcttgtaatttcccattcatcctggttggcagctctactagaatttgtcaggccgacggtacctggtccgggtcatctccgcattgcatcgaacccacacagacatcctgtgaaaatcccggggtgccgcggcacgggagccagaacaacacatttggcttccaagtgggttccgttgtgcaattccactgcaaaaagggacaccttctccaaggatcaaccacaagaacctgcttgccagacctaacatggtccggtattcagcccgaatgtattcctcatagctgtaagcagcctgagacacccgctcacgccaacgtggttggtatggatctgcctagccacgggtacacgctaatttacacatgccagcccggattttttctcgccggagggaccgagcaccgcgtgtgtaggtctgataatacttggacaggcaaagtgccaatctgtgaggctggatccaaaatcttggtgaaggacccgaggccagccttgggaaccccgtcaccaaagctgagcgtgcctgacgacgtcttcgctcagaattacatttggaagggttcctataactttaaagggagaaagcagccgatgacactgaccgtgacgtcattcaacgccagcactggacgcgtgaacgccactctgagcaactctaacatggaactgctgctgagcggcgtgtacaagtcccaagaagcccgcctgatgttacgcatttacctgattaaagtccccgcccacgcctctgttaagaaaatgaaggaggaaaattgggcaatggacggattcgtgagtgccgagcctgatggcgccacatacgtgtttcagggctttattcagggtaaggactatggtcagttcggcttacagcggctgggattaaacatgagtgaaggatccaattccagcaatcagccacatggtacgaactcttcctccgtggctatcgccatcctcgtcccattcttcgcccttatattcgccggatttggattttacttgtataaacaacggaccgctcccaaaacacagtatacaggatgtagcgtacatgaaaataataacggccaagctgcatttgaaaaccctatgtacgacaccaatgccaagtccgtggagggtaaggccgtgcggttcgaccctaacttaaatactgtttgtacgatggtgtag

SEQ ID NO: 113318 - DNA, 11004 bp, Artificial Sequence
  Description of Artificial Sequence: Synthetic coding sequence
atgtggtcttggtttctttgttggaagccagttcagctggatcgccagaccgctagtgggtttatctatacctgcgggggcacactgaaaggcctcaatggaacaattgaaagtcctggattcccttacggttacccgaacggggcaaattgcacgtgggtaattatcgcagaagagaggaacagaatacagattgtgtttcagagcttcgccctggaggaagaatatgattacctgagtctctatgacggtcacccccacccaacaaattttaggacccgcctgactggcttccacttgccaccgccggtaacgtctacaaagtctgtattctctctgaggctaacatctgactttgctgtgagcgcacatggttttaaggtgtactatgaggagcttcagtcatcaagttgcgggaacccgggagtgcctcctaagggagtactttacggcacaagattcgatgtgggagataaaatacgctatagctgcgtgacggggtacatcctagatgggcatccacagctaacctgtattgcaaactcggtaaacacagcaagctgggacttcccggttcccatttgcagagccgaggatgcatgcggaggcaccatgcgcggctctagtggaatcatatcatccccatcttttcccaacgaataccacaacaacgctgactgcacctggacaatcgtggcggaacctggggacactatctccttaattttcacggactttcaaatggaagaaaaatacgattatctggagatcgagggatccgagccgcccactatttggctgtcaggaatgaacattcccccccctataattagcaataagaactggctacgacttcacttcgtaaccgacagcaaccatcgctacaggggcttttcagctccataccaaggtagcagcaccctgactcacacaaccagcactggagaactggaagagcataaccgtaccactactggcgctatagcagtcgccagcacacccgcagacgtgactgtttctagcgtgaccgcagtgaccatccacagactttccgaagagcagagagtgcaagttacctctctccggaattcagggctcgaccctaatacgagtaaggacggccttagtcctcatccggcagatacacagtccactagacggagacctaggcatgccgaacagatcgaacgaaccaaggagctggctgttgtaacccatagagtcaaaaaggccatcgactttaagagcagaggcttcaagctgtttccagggaaagacaacagcaataagttctcaatcctgaacgagggaggcatcaaaactgcaagtaatctatgcccagacccgggagaacccgagaatgggaagcgtatcggcagcgatttcagcctgggcagcactgtgcaattctcatgcgatgaggactacgtactgcagggcgctaaatccatcacttgccagcgcattgctgaggtcttcgccgcctggtcggaccacaggccagtctgcaaagtgaaaacctgtgggtcaaatttgcagggaccaagtggtactttcacaagtcccaatttcccttttcaatacgactccaatgcccaatgtgtgtgggtaataacagctgttaatacaaacaaagtgattcaaattaattttgaagagttcgatcttgagatcggatatgacaccctgaccatcggagatggcggagaggtgggcgaccctcgaaccgtgctccaggtcctcacgggatctttcgttcccgacctgatcgtttcgatgtcatcacagatgtggcttcacctgcaaaccgatgagagtgttggtagtgtcgggtttaaagttaactacaaagagatcgagaaggagtcgtgtggggatccaggaacacccttatatggtatcagggagggggatggcttctccaatcgcgatgttctccggtttgagtgtcagtttgggttcgaactgattggtgagaagagtattgtttgtcaggaaaacaaccaatggagcgccaatatcccaatctgcatctttccctgcttatccaactttactgcccctatggggactgttctgtcacctgactacccggaagggtacggcaataatcttaattgcatctggactattatatccgatcctggatcccggatccatctcagcttcaatgatttcgacctggaaagccagttcgatttcctggctgtcaaagatggcgattcacctgaaagtccaatcctagggacatttacgggggccgaagtgccctctcacctaactagcaatagccatatcctgcgcttggaatttcaggctgatcactcaatgtctgggcggggattcaacattacatataatacattcggtcacaatgagtgtccagatccgggtattcccatcaacgctcgcagattcggcgacaacttccagctcggatcctctataagcgtgatttgtgaagaagggttcatcaagacacagggaacagagacgattacatgtattctaatggacgggaaggtcatgtggtccggcttgattccaaagtgcggtgccccttgcggagggcatttttccgccccaagcggagtgattctttcaccaggatggcctggctattacaaggactccttaaactgcgagtgggtgatcgaggctgagcctgggcatagcataaagatcacctttgaaagatttcagactgaactcaactatgacgttctggaggtgcatgacgggccgaatctcctttctcctctgttaggctcctacaacggcactcaggtgccccagttcctcttttcctccagcaattttatttacctgttattcactacagataatagtcgaagtaataatggcttcaagatccactatgaatcagtcacagtgaacacctatagctgcctcgatcctggaattcctgtgcacggtagaaggtacggccacgatttcagcattggcagcaccgtaagtttcagttgtgactcagggtaccgtctgagccacgaggaaccccttctctgtgagaaaaatcattggtggagccaccccctcccaacatgcgacgccttgtgcggcggggatgtgcgggggcctagcggcaccatactgtctccaggttatcccgagttctacccgaactccctgaactgtacttggactgtcgacgtgacccacgggaaaggagtgcaattcaactttcacacattccacctggaagatcatcatgactatctgcttatcaccgaaaacggctcattcacccagcccctggcgcgcctgaccggaagtgatttacccccaactataaatgcagggctctacggtaattttcgtgcccaactgaggtttatctccgatttcagcatttcatatgaggggtttaacattaccttctccgagtacaatctggagccctgcgaagacccgggcattccacagtacggatcccgaatcggtttcaactttggcattggagatacccttactttctcgtgttctagtggctacaggttggaaggcacgagtgagatcatttgcctgggcgggggtcgaagggtatggtccgctcccctgccacggtgtgtggcagaatgcggtgccagtgcgaccaataatgaaggtatcctgctgagtcccaactacccacttaattatgagaacaatcatgagtgcatttacagcatccaggtccaggccggcaaaggcattaacatcagtgctaggacctttcatctggctcagggagatgttctcaagatttatgacggtaaggacaaaactactcacttacttggggcgtttacgggagcctctatgaggggtcttactttgtctagcacctcaaatcagctgtggctggaattcaactccgatacagaaggcactgacgagggctttcagctcgtatacactagctttgagctctcgcactgtgaggatccaggaattcctcaatttggctataagatcagcgatcaagggcattttgctggttcaaccattatctacggctgcaatcctggatatactcttcacgggtcttcactgctgaagtgtatgacaggagagcgtagagcatgggattacccactgccgagctgtatagccgagtgtggtgggaggtttaaaggtgaaagctcaggcagaatcctaagccccggctaccctttcccatacgacaacaacctgcggtgcatgtggatgattgaggtagaccccggtaatattgtttcgctccagttcctcgctttcgacacagaagcaagtcacgacatcttgagagtgtgggacggtccccctgaaaacgatatgcttttaaaggaaatttccggcagtctgattcctgaagggatccacagtactcttaacatcgttactatccaattcgacacagatttctacatttctaaaagcgggttcgccattcaattttcctcgtccgtagcaaccgcatgccgggatcccggagtgcctatgaatggcacgagaaacggcgacggaagggagccaggcgacaccgtggtcttccaatgtgatccggggtacgagctacaaggtgaagaacgtatcacctgcattcaagtggagaaccgctacttttggcagcctagccccccggtgtgcatcgctccctgtggtggcaaccttaccggatccagtggattcattctcagcccaaacttcccacacccttacccacattcaagggactgcgattggactattaccgtgaatgctgattatgtcatttcacttgccttcatctcattctcgatcgagcccaattacgactttctttatatttacgatgggcctgactccaattcccccctgatcggcagtttccaggattcaaaactgcctgaaagaattgagtcttcttccaatacaatgcatttggccttccgatccgacgggagcgtgagctacaccggcttccatttggaatacaaggccaagctgcgggagagctgcttcgaccctggcaatatcatgaatggaacaagactgggaatggactataaactcggctccactgttacttattactgcgacgctggatacgttctgcaggggtactctactcttacgtgtataatgggcgacgacggacggcctggatggaatcgcgcacttcctagttgtcatgccccgtgtggcagtagatcaactggctctgaagggaccgtgctgtcccctaattaccccaagaattacagcgttggccacaactgtgtatactctatagcagtgcctaaggagttcgtcgtctttggacagtttgtgttcttccagactagcctccatgatgtcgttgaggtatacgacggaccaacacagcagtcatctctcctctcaagtctttcaggttcacattcgggcgaatccttacccctgtcgtccggtaatcagataactatcagatttacatcggtgggtcccattacggccaaaggctttcactttgtttaccaggccgtgccacgcacgtcctcaactcagtgttcgagcgtgcccgagccgcgctttgggagacggatcggcaacgaattcgccgtcggttcttccgtgttgttcgattgtaatcccggatacatactccatgggagcatagccataagatgcgagaccgttccaaatagcctggcccagtggaatgattcactcccaacttgtattgtcccttgtggaggcatcctgactaagagaaaaggaactatactaagccccggttaccctgagccctacgataataacttaaattgtgtctggaaaattaccgtgcccgagggtgctggtatacaggtccaggtcgtgagctttgctacagagcacaactgggactcgcttgacttttacgacggcggagataacaatgctccccggctgggaagctattctggtactaccattccacatctgctcaacagtactagcaacaatctctacttgaatttccagtccgatatttctgtgtccgcagcagggttccacctcgagtacaccgcaatcggacttgacagctgtcctgaaccacagacgccatcttctggcatcaagatcggggaccggtatatggtcggcgatgtagtttcctttcagtgtgatcagggttactccctacagggacattcccacataacctgcatgccaggaccagtgcgcaggtggaactatcctatccccatttgccttgctcaatgtggcggcgccatgtccgacttctcaggcgttatactgagtcccggatttcctggtaattatccctcatcattggactgcacctggacgatcaatctgcccataggcttcggcgtacatctccagtttgtgaatttttcaacagagacgattcatgattacctggaggtgcgctctggaagctccgaaacttctacagtgatcggtaggcttagtggtcctcagattccatcctccctgtttagtactactcatgagacaagtctatacttccactccgattactcccaaaacaaacagggcttccatatagtctatcaggcctaccagctgcagtcctgccctgaccccagacccttccgaaatggcttcgtgataggcaacgatttcaccgtgggccagacgatctcctttgaatgtttccctgggtacaccctcatagggaactctgcccttacctgtcttcacggagtcagccgcaattggaatcacccccttccaaggtgtgaggctctttgcggggggaatatcaccgccatgaacggaacaatctatagcccgggttatcccgatgagtatcccaatttccaggattgcttctggcttgtgagggttccacctgggaatgggatctacataaacttcaccgttctgcagaccgaacctatctatgactttatcacagtatgggatggcccggaccagaactccccccagattggacaattctccggaaacacagccctagagagcgtgtactcaacgagcaaccagatcctgatcaagttccactccgacttcacaacgtccgggttctttgtgctatcttatcatgcttaccagctccgggtttgtcaaccaccaccacctgtccccaatgccgaaatcctcacagaagacgatgagtttgagattggagatattataagataccagtgcctgccaggttttacactcgtcggaaatgcaatcctgacttgcaggctgggcgagagacttcagatggatggtgcaccccctgtatgccaagtcctgtgccctgcaaatgagttgcgcctggactctactggtgttatcctctcccctggttacccagattcctacccaaacctgcagatgtgtgcatggtccataagtgtagagaagggctacaatatcaccatgtttgtcgagtttttccagaccgaaaaggaattcgacgttctccaggtctatgatggacctaatattcagagcccagtcctaatttccctcagtggtgactatagctcagcctttaacattacttcgaatgggcacgaagtattcctgcagtggtctgcagatcatggcaacaataagaaagggttcagaattaggtacattgccttttattgttctacccccgagagcccccctcacgggtatatcatcagccaaaccggcggtcaactcaatagtgtagtgcgctgggcctgtgaccgaggttttaggctcgtgggcaaaagcagcgccgtatgtagaaaatcctcttatggctatcatgcctgggatgcccccgttccggcttgtcaggccatcagctgcggtatccccaaagctccaacaaacggaggtattctgactaccgactatttggttggcacacgggtgacatacttttgtaacgacggatatcggctttccagcaaagagctgacgactgctgtgtgccagtctgatggaacgtggtcaaaccacaataaaaccccacgatgcgtagttgtgacgtgcccatctattaacagttttatcctggagcacgggcgctggaggatcgtgaatggcagtcactacgagtacaagacaaaagtagtattctcgtgtgacccagggtaccatggtttaggccccgcctctatagagtgtttacccaacgggacctggagctggcggaatgaacgcccctactgccagattattagttgcggggagcttccgactcctcccaatggaaataaaatcggcactcagacgtcctacgggtctacagcgatcttcacgtgtgacctgggttttatgctggtaggttctgcagtgagggagtgtctaagtagcggactctggtcggaaagtgaaacacgctgtctggcgggccactgtggtataccagagctgatagtaaacggccaagtgatcggcgagaactacggctaccgagacacagtcgtatatcaatgtaatcctggtttcaggttgatcggctcctcggtccgcatctgccagcaggaccataactggtcgggccagctgccctcatgcgtgccagtttcttgcgggcaccctggaagccccatttacggccgcacatcagggaatggcttcaactttaacgatgtagtaaccttctcttgcaacatcgggtatctcatgcagggaccgactaaggcgcagtgccaggcaaacagacaatggagccaccctcccccaatgtgcaaggtggtcaattgctccgaccctggaattcctgcgaactccaagagagaatcaaaaatcgagcacggcaactttacttacgggacagtcgtcttctatgattgcaacccgggttattttttatttggcagtagtgttttgatctgtcagcccaatggccagtgggataaacccctgccggagtgtataatgatcgactgcgggcaccctggcgtcccccctaatgcggtgctgagcggagaaaagtacaccttcggctccacggtgcactattcttgcacgggcaagagatcccttcttggacagtctagtcgaacttgccaacttaacggacactggtccggatcacaaccccactgttctggagacgctactggcacctgcggagacccaggcacacccgggcacggctcacgtcaggagtctaatttccgcacaaaaagcacagtgcgatacgcatgcgatacaggctacatcctgcatggaagcgaggagcgcacttgcctcgccaacggatcttggactggtcggcagcctgaatgcaaggctgtgcagtgtgggaatcctggcacgacagccaacgggaaggtgtttcgcatcgacggcactaccttctcctcttccgttatctattcttgtatggaaggctacatcctctccggcccaagtgtgagacaatgcactgctaatggcacatggtctggaacactccccaactgtactataatttcatgcggagaccccggcattccagcgaatgggctgcgttatggagatgactatgtcgtgggccagaatgtgtcctatatgtgccaacccggatataccatggaactgaacgggagtcgcattcgtacgtgtacgataaatggcacgtggtcgggtgtaatgcctacttgtcgagctgtgacgtgccctacccccccccagatctccaatggccgtctggaggggaccaactttgactggggattttcaatcagttatatttgtagcccagggtacgagttgtccttccctgccgttctgacttgcgtcgggaatggcacctggagcggggaagtcccacagtgtctgcctaaattttgcggggatcccgggatccctgctcagggaaagcgcgaagggaaaagctttatctaccagtcagaggtgtcattttcttgtaactttcccttcatcctggtgggctcgtccactaggatctgtcaggctgatggaacttggtcaggatccagcccacactgcatcgaaccaacacagacaagttgcgaaaatccaggcgtgccacggcacgggagccagaacaatacttttggcttccaagtaggtagtgtggtacagtttcattgcaagaaaggacatctgctccaaggttccaccactcgcacgtgtttacccgacttgacctggtccgggattcaaccagagtgtattccccactcatgcaagcagcctgagaccccagcacatgctaatgtggtgggtatggacctgccctctcatggttatacgttaatctacacatgtcagcccggttttttcctggctggcggcactgaacatagggtctgccggtcagacaacacttggacaggaaaggtgcccatctgcgaagcgggtagcaagattctggtcaaagacccgaggcccgcactgggcactccttccccaaaactctcagtgccagatgatgtgtttgctcagaactatatttggaagggaagctacaatttcaagggtcgcaagcaaccgatgactctgaccgttacgagctttaatgcctctaccggacgcgtcaatgccacgctttctaatagcaatatggagttgctcctgagcggagtgtacaaatctcaagaagcgcggctgatgctgcgcatctacttaataaaggtgccggcccacgcgtctgtcaaaaaaatgaaggaggaaaattgggctatggacggcttcgttagtgcggaaccggacggcgcaacttacgttttccagggcttcattcagggcaaagactacggtcagttcgggctgcaaagactggggctgaatatgtctgaagggagcaacagctctaatcagcctcacgggacaaattccagcagcgttgccatcgctatcttggtccctttcttcgccctaattttcgctggatttggcttctatctatacaaacagcgcaccgcacccaaaacccaatacactgggtgttcagtgcatgaaaacaataacggacaggcagccttcgaaaatcccatgtacgatactaacgctaagtctgtggagggtaaagcggtgcgcttcgaccccaatctcaataccgtgtgtacgatggtgtag

SEQ ID NO: 113319 - DNA, 10914 bp, Artificial Sequence
  Description of Artificial Sequence: Synthetic coding sequence
atgaagggcattagaaagggcgaatctcgggccaaggaaagcaagccttgggaacctgggaaacgaaggtgtgccaagtgcgggcggctggacttcatccttatgaaaaagatgggaataaaatccggattcaccttctggaatctagtgttcctcctcaccgtcagttgtgttaagggcttcatctatacctgcggcggcaccctgaagggactcaacggtactatcgaaagcccgggcttcccttacggatatcccaacggagccaactgcacttgggtgataattgcggaggagagaaataggatccagatcgtcttccagagttttgcccttgaggaggagtatgattacctctccctgtacgacggccatccccacccaactaattttaggaccagactcaccgggtttcacctgcccccacccgtgacatcaacgaagagcgtgttcagcttaagactgaccagtgattttgccgtaagcgcccatggatttaaagtatactacgaagagttacagagcagctcgtgtggcaaccctggtgtcccacctaaaggtgtcttgtacggaacccgttttgacgtgggagacaagattagatactcctgcgtcaccggttacatcctcgatgggcaccctcagctgacatgtatcgccaactccgtgaatacagcatcttgggatttccccgttccgatatgccgagccgaggatgcgtgtggcggtaccatgcgcggctcctcagggatcattagctctcctagcttccctaacgagtatcataataacgctgactgcacatggactatagtggccgaacccggtgacaccatctccctcatcttcactgactttcagatggaggagaaatacgattatctggaaattgaaggctcagagccgccaacaatttggctgagtggaatgaacatccctcccccaattatttcaaacaaaaattggctgcgactgcactttgtcaccgattctaatcacagatatcggggcttcagcgcaccttaccaaggtagtagcacgttaactcacacgacgagtacaggtgaactggaggagcataacagaactaccaccggagccattgcagtggcttctacgccggctgatgtgaccgtcagcagtgtaacggccgtgaccatccacaggttgtctgaagaacagagggtgcaggtcactagtctacgcaattctgggctcgatcctaatacatccaaggatgggctgagtccccatcctgccgacacacagtctactaggcggcgcccccgccatgccgaacaaatcgaaaggacaaaggaactggccgtggtgacccatagggtgaagaaagcgatcgacttcaagagccgaggctttaagctgttcccaggcaaggacaattccaacaagttctctatactgaacgaaggaggcataaagactgcttccaacctctgcccagacccgggtgaacccgaaaacggcaaaagaatcggatctgacttcagccttggaagtaccgttcagttcagttgtgatgaagactatgtactgcagggcgcgaagagcatcacttgccaacgaattgctgaagttttcgctgcctggagtgaccaccgtccggtgtgcaaagttaagacgtgcggatccaatctgcagggcccctccggaactttcacctccccaaattttccctttcagtacgatagcaacgctcaatgcgtgtgggtgatcaccgccgttaacaccaacaaagtcattcagattaacttcgaagaattcgatctggaaatagggtacgatactctgaccattggcgacggaggcgaagttggagatcccaggactgtgctgcaggttctcaccgggagctttgtgcctgacctgatcgtatccatgagcagccagatgtggctgcatttgcagactgacgaaagtgtgggaagcgttggattcaaggtcaactacaaggagatcgagaaggagtcctgtggggacccagggacccccctgtatgggatacgcgaaggtgatggatttagcaatagagacgttctgcgcttcgaatgccagtttggctttgagctgatcggagaaaagtccattgtgtgtcaggagaataaccagtggtcagcaaatatccctatatgtattttcccctgcctttctaacttcacagcccctatgggtaccgtgctgtctcccgattatcccgaaggatacggcaataacttgaattgcatctggaccatcatcagcgaccctggctcaaggattcatctgagtttcaacgattttgatctggagagtcagttcgacttccttgcggtgaaagatggcgactctcccgaaagtccgatccttggcaccttcactggggccgaagtcccctcccatctgaccagcaacagtcatatcctcagactggaatttcaggcagatcattcgatgagtgggagaggattcaatatcacctataatacattcggtcacaatgagtgtcccgaccccggaattccaataaatgccagaagattcggtgataacttccagcttggatctagcataagcgtgatttgcgaggaggggtttatcaagacacaagggaccgagacgatcacctgtatcctcatggacggcaaggtgatgtggtcgggccttattccgaagtgcggagccccatgtggaggtcacttttcggcaccatctggtgtcattttaagcccggggtggccagggtattataaggactccctaaactgtgagtgggtgatcgaagccgagccaggacacagtataaaaatcaccttcgagagattccagaccgaactgaactatgatgttttggaagtgcacgacggccccaatttgctctccccactgcttggaagctacaatgggacccaggtcccccaatttctgttttcctcaagtaattttatttacctcttattcactactgacaactcccgctctaataacggcttcaagatccactatgaaagcgtgacagtcaacacctatagctgtctggatcctgggatcccagtgcacggaagaaggtacggccatgattttagcataggctcaaccgtgtcattctcctgtgatagcgggtatagactttcacacgaggaaccactgttgtgcgaaaaaaatcattggtggagccaccccctgcctacttgcgatgccttgtgcggcggcgatgtgagaggcccctctggcaccatcctgtctcctggttatcctgaattctacccaaacagtcttaattgcacgtggactgtggatgtaacccacggcaagggcgttcagtttaacttccacacgtttcaccttgaggaccaccacgactacctgctgatcaccgagaatgggtctttcacccagcccctggctcggctgacgggaagcgatttacccccaacaataaacgcaggcctgtacggcaattttcgcgctcagctacgctttattagcgactttagcatttcttatgaggggttcaacatcacgttcagcgaatataatctggaaccctgtgaagatccgggcatccctcaatacggtagccgtatcggcttcaactttggtatcggtgatactctgacgttctcctgcagtagcggataccggctagaagggacgtccgaaatcatctgcctgggtggtggccgccgggtgtggagcgcccccttgccacgttgtgtcgccgaatgtggtgcaagcgctacgaacaatgaaggaatcttgctcagcccgaactatcctctcaattatgagaataatcatgaatgtatttattctatacaagtgcaggcaggaaagggcatcaatatctccgctcgaacgttccacctcgctcaaggcgatgttctcaagatatacgatggcaaagacaagaccacccacctgctaggcgcttttaccggggcgtccatgcggggcttgacactctcctctacatccaatcagctctggctcgagtttaactctgacaccgagggtaccgatgaagggttccagctggtgtacacctcatttgagttgtcacattgcgaagatccaggaattccccaattcgggtacaagatttcagaccagggacacttcgctggaagtacgattatatatggatgcaatcccgggtataccctacacggatctagcttgcttaagtgcatgactggggaaaggcgtgcttgggattaccctcttccgtcctgcattgccgagtgtggcggccggtttaaaggcgagagtagtggccgaatactctccccaggataccccttcccctacgataataacctacgttgtatgtggatgattgaggtggacccagggaacatcgtctccctccagtttctcgcctttgacacggaagcttcccatgatatcttacgcgtgtgggatgggcctcctgagaacgacatgcttctgaaagagataagtggctcgctgatccccgaaggaatccattccaccctgaatatcgtgacaatccagttcgacaccgatttttacatatctaaatctggatttgctatccagttttcgtcctccgtcgccacggcctgtagagacccaggggtgccaatgaatggtacacgcaacggggacggaagagagcctggagacacagtggtctttcaatgtgatcccggatacgagctgcaaggggaggaacgcataacttgcatccaggtggagaaccgctacttctggcagcccagccctcccgtctgcatcgctccttgtgggggaaacttaacagggtcatctgggttcattctctcaccgaatttcccacacccttacccacacagtcgtgattgcgattggaccatcaccgtaaatgccgattatgtgatcagtctcgccttcatcagctttagcatcgaacctaattacgatttcctgtacatctacgatgggcccgactccaatagccctctgataggctccttccaagactccaagttaccggagcgtattgagtcttcttcaaacaccatgcacctggcatttcgcagtgatggttctgtatcttatactgggtttcatctggagtataaagctaaactgcgggaatcttgtttcgaccctgggaatatcatgaacggcacacggctaggcatggactataaattggggtctacagtgacctactattgcgatgcgggctacgtgctccagggctactcgactctgacttgtattatgggcgacgacggacggcctgggtggaacagggctctgccttcttgccacgccccttgcgggagtcgatccactggtagcgagggcacagtgcttagtccaaactacccaaagaattactccgttgggcataactgcgtctattctattgccgtgcccaaagaattcgctgtccctcgcacaagcagtacccagtgctcttcagtgccagaacccaggttcggaagacgcattggtaacgaattcgctgtcggaagttccgtactctttgattgcaatcccgggtacatcctgcacgggtccatcgctatacgctgtgagaccgtgcctaactcattggcgcagtggaatgactcactcccaacctgcattgtgccctgcggcggcatccttactaaacgcaaggggaccattttgagccccggatatccagagccttatgataacaacctcaactgcgtctggaagatcactgtgccagaaggcgctggcattcaggtacaggtggtgtccttcgccacagagcataattgggattctctggatttttatgacggcggcgacaataacgcccccagactgggttcctatagcgggaccaccatccctcatttgctgaacagtacgtccaataatctttatcttaatttccaaagtgacataagtgtcagcgcagccgggttccatctggagtataccgccattgggctggactcgtgtccggaaccgcaaaccccttcctccggaattaagattggagataggtatatggtaggggacgttgttagctttcagtgcgatcaagggtacagcctacaaggccactcccatataacgtgcatgccagggcctgtgcgtcgatggaattaccctatccctatttgtctagcccagtgcggaggtgctatgtcagacttttcaggcgtaatcctcagccccggattcccagggaactatccatcttccctggattgtacgtggacaatcaacctgcccatcgggttcggcgtccacttgcaatttgtgaacttctctacagagacaatccatgactatctagaggttaggtctggcagctccgaaacctcaaccgtcataggcagactatccggtccccagattccttccagtctgttttccaccacccatgagacatctctgtatttccattccgattattcccagaacaaacagggcttccacatcgtctaccaggcataccagctgcagtcttgcccagatccaagaccctttcgcaacggctttgtgatcgggaacgactttactgtggggcagacgatatcattcgagtgttttcctggctacacattgatcgggaactccgcactaacatgcctccacggagtgtcgcgcaattggaatcacccactcccccgctgtgaggccttgtgcggcggtaacatcactgccatgaacggcaccatctactctccagggtaccctgatgagtaccccaattttcaggattgcttctggttggtgcgtgtgcctcccggaaacggaatttacattaattttaccgttctacagaccgaaccaatctacgactttattaccgtttgggacggccccgatcaaaactccccgcaaatcgggcagttcagtggaaatactgccctggagtctgtttactcaacttcgaaccagatcttgattaagttccatagtgactttaccacgtctggcttcttcgtcctttcctaccatgcttatcagttgcgggtctgtcagcctcctcccccagtccccaatgccgaaattctaacagaggatgacgaattcgaaatcggcgatatcattaggtaccagtgtctccctggcttcacccttgtgggaaatgccatcctgacttgtcgcctaggggagcgcctccaaatggacggcgctccccctgtatgccaggtgctctgtcccgcaaacgagctgcgcctggattctacaggcgtcatattaagccctggatatcccgactcctacccgaatcttcagatgtgcgcatggtccatttcagttgagaagggttataacatcactatgtttgtagagtttttccagactgaaaaggagttcgatgtgctgcaagtttacgatggtccgaacatccaaagcccggtcctgattagcttgtcgggagactactccagcgccttcaacataacttcgaatggccatgaggtgtttctgcagtggtctgccgatcatggcaacaacaagaaaggttttcgaattcgttacatcgccttctattgcagcactcccgagtccccaccgcatgggtacatcatttcacagaccggcggacagcttaattccgtggtaaggtgggcgtgtgatcgaggtttccgtctcgttggcaagtcctcagctgtgtgtaggaagtctagctatggatatcatgcatgggatgcccccgtgcctgcttgtcaagctatctcatgtgggattccaaaagctcccaccaacgggggaatccttacgacagactatctggttggaacaagggtcacctatttttgcaatgatggttatcgcctatcttcaaaagaactaactaccgcagtctgtcagtcagacgggacttggtcaaatcacaataagactcccaggtgcgttgtcgtcacctgtccaagtatcaacagtttcatccttgaacacgggcggtggagaatcgtgaacggtagccactatgagtataagaccaaggtggtattttcatgcgacccaggctaccacggactgggacctgcttctattgaatgcctgcctaatggcacatggagttggagaaatgagagaccttattgccagatcatctcctgtggggaacttcctactcctccaaatggcaataaaatcgggacgcagacttcttacggcagcacagccatctttacttgtgacctgggcttcatgctggtcgggtcagctgtccgggaatgtctcagctccggactttggtctgagagcgaaacccgatgtcttgccggccattgcggaatcccagaactgatcgtgaacgggcaggtgattggtgagaactacggatatcgcgatacagtcgtgtaccagtgcaacccaggcttcaggttaatcggatccagtgtccgaatttgccagcaggaccacaattggtctgggcagctgccctcatgtgtccccgtgagctgcggtcacccaggatcgcccatctacggaaggacttcggggaacggtttcaactttaatgatgtggtgaccttctcttgtaatatcggatacttgatgcaagggccgaccaaggcccaatgccaggccaatcgccagtggtcccatcccccgcctatgtgtaaagtagtgaactgtagcgaccccggtatccctgccaatagcaaaagggagtccaagatcgaacacgggaacttcacatacggaactgtcgtattctatgactgcaacccgggttattttttattcggttcttcagtcctgatctgccagcctaacgggcaatgggacaagccactgcccgagtgcataatgattgactgcggccacccgggggtgccccctaatgctgtgttatcaggtgagaaatacacgtttggttcaactgtccactactcgtgtaccggaaaacgctctctgctgggccaaagctcgcgcacctgccagcttaatggccattggagtgggtcccagccacattgttctggcgatgccaccggaacttgcggagatcccgggacccctggccacgggtcccgtcaggagagcaacttccggacgaaaagcacggtcaggtacgcgtgcgatacgggctatattctgcacggctccgaagagcggacttgcctggcgaacggttcatggactggcaggcagccagagtgtaaggctgttcaatgcggtaaccctgggaccacggctaatggcaaagttttccgcatcgacgggacaaccttttctagctcagtgatttatagctgcatggagggatatattctcagcggtccctccgttcgccagtgtactgctaatgggacctggagtggaacgctgcctaattgcaccattatctcttgcggcgatcctggaattcctgcgaacggccttagatatggggatgattatgttgtgggccagaatgtctcatacatgtgccagccgggctatactatggagctgaacggctcccgcattagaacctgcactattaatggaacttggtccggggtcatgcccacgtgcagggccgtcacttgtcctacccccccgcaaatcagcaatgggaggctcgaaggaacaaactttgattggggctttagcatatcctatatttgctccccaggatatgagctgtcttttccagccgtgctaacctgtgtcggtaatggcacttggagcggggaagtgcctcaatgtctgccaaaattttgcggcgatcccgggatccccgcacaaggaaagagagaaggcaagtctttcatatatcaatccgaggtgagttttagctgtaacttcccattcatcctggtcgggagttcgacccggatctgtcaggcagatggcacctggagtggcagcagtccgcactgcatcgaacccacacagacgtcctgtgagaatcctggggtgccacgccatggcagccagaataatactttcgggtttcaagtcggctcagtggtgcagttccattgtaaaaaggggcatctgctgcaaggaagcaccacacggacatgtctcccagaccttacatggtccggcatacagcctgaatgtatcccccacagctgcaagcaaccagagaccccggcacacgccaacgtggtgggaatggacctgccctcacatggctatacactgatatacacgtgccaacctggctttttcttggccggcggcaccgagcatagagtgtgccggagcgataacacctggacgggcaaggtgcccatttgtgaggctggatcgaagattttagttaaggacccacgacccgccctggggaccccctcaccaaaactatcagtgcccgacgatgtcttcgctcagaactacatctggaaggggtcttacaattttaaggggcggaagcagcctatgacactcaccgtgactagctttaacgcctccactggtagagttaatgccacactctccaatagcaatatggaactcctgttgagcggggtatataagtcccaggaggctagactaatgctgcgcatctatctcatcaaagtgcctgctcatgctagcgtgaagaaaatgaaagaggagaattgggcaatggatggatttgtctctgccgaacccgatggggcaacttatgtgtttcagggcttcatccagggaaaggactatgggcagttcggtctgcagagactcggtctcaatatgtccgagggttccaactcaagcaaccaaccccatggcacaaacagttcctccgtcgctatcgcgattcttgttccattcttcgccctgatttttgccggatttggcttctacctatataagcagcggacagcgcccaagacacagtacacgggctgcagcgtgcacgagaacaacaatggacaggccgcattcgaaaatccaatgtatgatacgaatgctaaaagcgtggaaggtaaggcggtgagatttgaccccaatctcaatacagtgtgcactatggtgtag

SEQ ID NO: 113320 - DNA, 10617 bp, Artificial Sequence
  Description of Artificial Sequence: Synthetic coding sequence
atgaaaggaattcggaaaggcgaaagtagggccaaagagagtaagccttgggagcccggtaagagaaggtgtgcaaagtgcgggcggttggatttcatactgatgaagaagatggggatcaagtccggatttaccttctggaatctagtgtttctcctgaccgtgtcctgtgtgaaaggtttcatctatacttgtggcgggacattaaaaggactcaacggcacaattgagagccccggtttcccctatggctatccgaacggagccaattgcacttgggtcattatcgccgaggagagaaataggatccaaatagtctttcagtccttcgccctggaagaggagtacgattacctctccctctatgatgggcatccccatccaactaacttcagaacacgcctgactggttttcatcttcctccccccgtaacttcaactaagagcgtattcagcctcaggttgactagcgattttgctgtcagcgcgcacggattcaaggtgtactatgaagaactccagagcagttcatgtggaaatccaggggtcccacctaaaggcgtcctgtatggtacccggttcgacgtcggcgacaagatccggtattcttgtgtaaccggttatattcttgatggccatcctcagctcacctgcattgccaacagcgtcaatacagcctcctgggacttcccggtgccgatctgcagagccgaggacgcatgcggaggtaccatgcgcggctccagcggaattatctctagcccttcattccccaacgaataccacaataacgccgactgcacctggacaatcgttgctgaacctggcgacactatcagcctaatcttcacggattttcagatggaagagaagtatgactacctggagattgagggctcagagccccctaccatatggctctcagggatgaacattccacccccaataatttcaaataaaaactggctgaggttgcactttgtcactgattccaaccaccgttaccggggctttagtgcaccttatcaggtcaagaaagcgatagatttcaagtcacggggttttaaactcttccctggaaaagacaattctaacaaattcagtatattgaatgagggggggatcaaaactgcctccaacctgtgccctgaccctggagaacctgaaaacgggaaaaggataggaagtgatttctccctgggttctaccgtacaattcagctgcgacgaggattacgtgctgcagggcgccaagtccattacctgtcaaaggatagccgaggtgtttgccgcatggtctgaccaccgccctgtgtgcaaagtgaaaacttgtgggtcaaacctgcaggggccatcaggcacgtttacttctcctaacttcccgtttcagtacgacagtaacgctcaatgcgtgtgggtgatcactgccgtgaataccaacaaagtcatccagatcaatttcgaggaatttgaccttgagatcggctatgacactctgacaatcggagacgggggcgaggtgggagaccctcggaccgtcctacaagtcctgacagggtcgttcgtgcccgacttgattgtgagtatgagttcccagatgtggcttcaccttcagaccgatgaatccgtgggcagcgtggggttcaaggtgaattataaggagatcgaaaaggaaagctgcggcgacccggggacgcccttatacggtatacgcgagggagatggctttagcaaccgagacgtgcttcggtttgaatgtcagtttggctttgagctcattggggaaaagagcattgtgtgccaggaaaacaatcagtggagtgccaacatcccgatctgcattttcccctgtctcagcaacttcactgctccaatgggcacagtgctatctcccgattatcctgagggctatggtaataacttaaactgtatttggacaataatctctgaccctggaagccgaattcacctctcattcaatgattttgacctagagtcccagttcgactttttagcagtgaaggacggggacagccctgaatcccctattctggggacttttacaggtgcagaggtgcccagtcacctgactagcaactcccacattctgcgcttggaatttcaggctgaccactcaatgtccggtcgggggtttaatatcacatataatacctttggacataacgaatgccctgatcctgggatcccaatcaacgcccgaaggtttggtgacaattttcagcttggatctagcatttccgtaatttgcgaagaaggctttattaagacacaaggcactgaaaccattacttgcattttgatggacggtaaagtgatgtggtcaggccttattccaaagtgtggcgcaccgtgcgggggacactttagcgctccctccggcgtcattctctctcctggttggcctggctactataaagattctctgaactgtgagtgggtgatagaggctgagccaggccactccataaagatcactttcgagaggttccagacagagctcaactatgatgtgctggaggttcacgatggccctaacttactctcacccctcctgggttcttacaacggcacccaggtgcctcagttcctgttttcatcctccaattttatctaccttttattcaccaccgataattccaggtctaacaacggattcaagatccattacgagtcagtcacagtgaacacttattcatgtctggatcctggtatccccgtgcatggccgccgatacggtcacgacttttccataggttctaccgtttcttttagctgcgacagtggttaccgcctgagtcacgaagaacctttgctttgcgagaagaaccactggtggtcccatccactacctacttgcgacgcactgtgtggaggcgatgtgcgagggcctagcggcaccattctgtctcctgggtatccagaattttaccctaacagccttaactgcacctggacagtcgatgtgactcatggtaagggggtgcaattcaatttccacaccttccatttggaggatcaccacgactacctcctgataactgagaatggcagctttacccagccactggcacggcttacaggttcagacttaccgcccactatcaatgccggactgtacgggaattttcgagcacagctgagattcatcagcgatttctcaattagctacgaaggattcaacatcacattctctgaatataacctggagccgtgtgaggatccaggcattccacaatatggctctcggatcgggttcaactttggcataggggatacattaactttctcttgttcttcaggatacagacttgaagggacatccgagattatttgcctgggaggcggaaggcgggtttggagcgccccactccccagatgcgtggctgagtgcggggctagtgctactaacaatgaaggcatcctgctctcccccaattaccccctgaattatgagaacaatcacgagtgtatttactcaatccaagtccaagccggcaagggtatcaacatcagtgcccgtaccttccatttagcccagggtgatgtattgaagatatacgacggaaaggataaaacaacgcacttgctgggcgctttcacaggggcctcgatgcgaggacttacccttagctccaccagtaaccagctctggctggaattcaacagcgataccgagggtaccgacgaaggttttcagctggtatacaccagcttcgaactgagccattgcgaggatcctggcatcccccagtttggctataaaatttccgaccagggtcacttcgctggttcgactataatttatgggtgcaaccccggatatacactgcacgggtcaagcctcttaaaatgtatgaccggcgaaagaagggcatgggactatccactgccctcatgcattgcagaatgtggcgggcgttttaaaggcgaatcctccggtagaatactgagtcccgggtatcccttcccttatgataacaacctccggtgcatgtggatgatcgaagtggatcccggaaatatcgtcagccttcaattccttgcttttgataccgaggccagccacgacatcctgcgggtgtgggatggaccccctgagaacgatatgttgctgaaggagatctcaggttcccttattcctgagggcattcattctactttaaacattgtaaccattcagtttgatacagacttctatatatcgaaatcagggttcgccatccagtttagttcttcagtagccactgcctgtagggaccccggcgtcccgatgaacggtacacggaacggagacggaagagaacccggcgacactgtcgtgtttcagtgtgatccgggatacgaacttcagggggaggaaaggattacgtgtatccaggtagaaaaccgctacttctggcaaccttctccacctgtgtgtatcgctccttgtggcggaaacctgactggatcatccggcttcattctgagcccgaactttcctcacccttatcctcatagcagagattgtgattggactattaccgtcaacgctgattacgtgatcagcctggcttttatcagctttagcatagagcccaactacgattttctctacatctatgatggacctgattcaaatagccccttgataggctctttccaggactccaagcttcccgaacgaatcgaatcatcctctaatactatgcatttagctttccgatccgatggttcagttagttacactggcttccacctggagtacaaagcaaaactgcgcgaaagttgtttcgacccagggaatataatgaatggtactagattggggatggattacaagctcggcagtacggtgacctactactgcgatgccgggtatgtcctgcagggttatagcacgcttacctgtattatgggggacgacgggcggcctggttggaaccgtgcactgccgagttgtcacgctccttgtggctctcgaagtacaggcagcgaaggcacagttctgtccccgaactatccaaagaactacagtgttggccacaactgcgtgtatagcattgccgtacctaaggagttcgttgtattcggtcaattcgtgttcttccagaccagcctccatgacgtggtcgaagtgtacgacggccccactcagcagtcctcattattgtcctccctgtccggcagccactccggcgagagtctgcctctgtcatccggcaaccagatcactattagattcaccagcgtaggccctatcaccgctaaaggctttcacttcgtgtatcaggccgttccacggaccagcagtacgcagtgcagctctgtgcctgaaccgaggtttggccgaaggattggaaatgagttcgccgtgggctcttccgtcctgttcgactgtaatcccggatatatccttcatggtagcatcgccatccggtgtgagactgtgccgaattctctggctcaatggaatgatagcttgcctacatgtattgtcccttgcgggggaatactgaccaaaaggaaaggcaccattctctcaccaggataccccgaaccctacgacaataacttgaactgtgtatggaaaatcaccgtgcctgagggggctggtatacaggtccaggtggtgtccttcgcaaccgagcataactgggatagcttagacttttatgacggaggtgacaacaatgccccgcggctcgggtcatactccggcactacaataccgcatctgctgaactcaacgtcaaataatttgtatctgaacttccagtccgatatctcagtatccgcagccggtttccatctggagtataccgctattgggttggattcgtgccccgagccacagactccgtcctctggtattaagatcggagatcgctatatggtgggggatgtggtgtcctttcagtgcgaccaagggtattccttgcaaggccactctcacattacatgtatgcccgggcctgtgcggaggtggaactatcctattcctatctgtttggcccagtgcggcggtgctatgtccgatttcagcggggtgatattgtcacctgggttccctggcaactacccctcttccctcgattgcacatggacaataaacctccctattggattcggcgtgcacctgcaattcgtgaatttcagtacagagactatccatgactacctggaagtgaggagtggctcaagtgaaaccagcactgtgattggccggctcagtggcccacagattccttcttcactatttagcacgacccacgagaccagcctgtacttccactcagactactcgcagaataaacaaggtttccacattgtgtaccaggcctatcagctgcagtcttgtccggacccaagacctttcaggaacgggttcgtgatcggcaacgatttcacagttggtcagaccatcagcttcgaatgcttcccaggctataccttgatcggaaacagcgctctgacatgtctgcacggcgtttcccgcaattggaaccatcccctgcccagatgcgaggctttatgcggcggcaatataaccgcgatgaatggcaccatctattcacctggataccccgacgaatatcctaattttcaggactgcttctggctggtgcgagtccccccagggaatgggatctatattaatttcacggtcctccagaccgagcccatatacgactttatcaccgtctgggacgggccagaccagaattccccacaaatcgggcagttcagcggcaatactgccctcgaatccgtctatagtacgagcaaccagatcctcatcaaattccactccgactttactacatccggattctttgtgttgtcttaccatgcttaccagctgcgggtgtgccaacctccgcctcccgtgcctaacgccgagatcctcactgaggacgacgaatttgagatcggtgatatcatccggtatcaatgtcttcctggctttacccttgttggcaacgctattctgacctgccggctaggtgaaagacttcagatggacggggcgcccccagtttgtcaggtcctgtgtcctgccaacgagctcaggctggactccaccggggtgattctcagcccgggctatccagattcatatccaaacctgcagatgtgcgcatggagtatcagcgtggagaagggatacaatataaccatgttcgtagaattttttcagacagagaaggagttcgacgttttacaggtctacgatggtcccaatatccagagtccagtactgatttctctgtccggggattactcctcagctttcaacattactagtaacgggcatgaagtgttcctccagtggagtgctgaccacggaaacaacaaaaagggttttcgtatccgatatatcgcattctattgtagcacccctgaaagtccaccccatgggtatatcatatcacagaccgggggccaactaaattcggttgtgaggtgggcctgcgatcgaggcttcagactcgtgggaaagtcctcagcggtttgcaggaaatcatcctatggttatcacgcttgggacgcgccggtccctgcctgtcaggcgatcagctgtggcattccaaaagcccccaccaatggtggcattctgactacagactacctggtgggtacacgggttacttacttttgtaatgatggatacaggctaagtagcaaggagcttacaacggccgtctgtcagtctgacgggacatggtctaaccataataagacaccacgctgcgttgtgatatcatgcggggaactgccaactcctcctaacgggaacaaaatcggcacacaaacatcctacgggtccaccgctatcttcacgtgcgacctcgggttcatgttagtgggctctgccgtgcgcgagtgcctgtcaagtggtctgtggtcagagagtgaaaccaggtgtctcgctggccattgcgggatccccgagttaatcgtgaacggtcaggttataggagaaaattacggctatcgggacacagtggtttaccagtgtaatccaggatttaggttaatcggatcttccgtgaggatctgtcagcaagatcataattggtcagggcaactgcctagctgtgtacctgtgagttgtggacacccaggttccccgatttacggccggaccagcggaaatggattcaactttaatgatgtagtcaccttctcatgcaacatcggctatctgatgcagggccccacaaaggcgcaatgccaggccaatcgacagtggtcacaccccccaccaatgtgcaaggttgtgaattgctcggatcctgggattcccgctaactcgaaacgcgaatcaaaaatcgaacacggtaacttcacctatggcacggtggtgttctatgactgcaaccctggctatttcctgttcggatcgtccgtcctaatatgccaacctaatggacagtgggataaaccactccctgagtgtatcatgatcgactgcggacatcccggcgtgccaccaaacgctgttctctctggtgaaaaatatacctttggatccaccgtgcattattcatgtaccgggaagcgctctctccttggacaatcttctcgtacctgccagttgaacggccactggtctggtagccagccgcattgcagcggagatgccaccggaacgtgtggcgatcccggaacccccggccatggcagccgccaggagagcaactttcgcactaagagtacagtgagatatgcttgtgatactgggtatattctgcatggctctgaggagaggacctgtctagctaatggctcatggaccggtcgccagcccgagtgtaaggctgtgcagtgcggaaatccggggaccacagccaacggaaaagtgttcagaatagacggtacaacattctccagttctgttatatattcttgtatggagggatacatactgtcaggtccgagtgtgaggcagtgcaccgctaacggaacatggtctgggactctgccaaactgcacgattattagctgcggggacccagggattcctgcgaatggactgcggtacggcgatgattacgtggttgggcagaacgtttcttatatgtgccagcctggatataccatggagctcaatgggtcccgcatacgaacctgcactatcaacggcacctggagcggcgtgatgccgacctgtcgtgctgtgacatgtcctacaccgccacaaatctctaatggtcgtttagaggggactaactttgattggggcttcagtatctcttacatctgttccccaggatacgagctctcctttcctgccgtgctgacgtgtgttggaaatggaacctggtctggagaggtgcctcagtgccttcccaaattctgtggcgaccccggcattcccgcccaaggtaagcgagaggggaagtcctttatctatcagtcggaagtgagtttttcatgtaacttccccttcattctggtcgggagctccaccagaatctgtcaggcagacgggacctggtccggtagctcaccacactgcatcgagccgacacaaaccagctgtgagaatccgggggttcctagacatggttctcagaataacactttcgggtttcaggtaggaagcgtggttcagtttcattgtaaaaaaggccatctgctgcaaggctccacaacgagaacttgcttaccggacttaacatggtccgggatccagcctgagtgtatccctcactcttgcaaacagccagaaacacccgcacacgccaacgttgtgggtatggatttgccctcacatggctacaccctgatctacacctgccagcccggcttcttccttgctggtgggacggagcaccgcgtttgcagatccgataacacatggacaggaaaagtgcctatatgcgaagcggggtcaaagattctagttaaggatccccgccccgcactcggcacccccagccctaaactatcagtgcccgacgatgtgtttgcgcagaactacatttggaaggggagctacaacttcaaggggcgcaagcagccaatgaccctgacagtgacgagttttaatgcaagtaccggcagagtgaatgctaccctgtctaactccaacatggaactcctgctgagcggtgtttacaaatcgcaagaggcccgccttatgcttcgcatctacctgatcaaagttccggcacacgcttctgtgaagaagatgaaagaggagaattgggcgatggacgggttcgtgtcagctgaacctgacggagctacctacgtgttccaagggttcattcagggaaaggactacggacagtttggactgcagaggctagggctcaacatgtctgaaggatcaaactctagtaaccagcctcacggcacaaactcttcatcagtggccatcgccatcctggtgccattctttgctctcatctttgctggatttggattctacctgtataagcaaagaactgcaccaaagacccaatataccggctgttcagttcacgagaacaataatggccaggccgccttcgaaaatccgatgtacgacactaacgcaaagagcgtagaaggaaaagccgtcaggttcgatcccaatttaaatacggtctgcacaatggtgtag

SEQ ID NO: 113321 - DNA, 2511 bp, Artificial Sequence
  Description of Artificial Sequence: Synthetic coding sequence
atggcaggtctcaattgtggcgtctcgatagccctgctcggcgttttactgctcggggcagcccgactgccacggggggccgaagccttcgaaattgcactacctcgggaaagcaacatcaccgtcctcatcaagctcgggacgcccaccctgctggccaagccgtgttacatagtcatcagcaagcgacatataactatgctgtccatcaagagtggcgagagaatagtgtttaccttttcttgccagtctcctgagaaccatttcgtgattgaaatccagaaaaatattgattgcatgtcaggtccttgtccattcggggaggtgcaactgcagccatctacatctttacttcctaccctgaatagaaccttcatctgggacgttaaggcgcataaatcaattggcctcgagctgcagtttagcataccccgcctgcgacagatcggccctggagagtcgtgtccagacggcgtcacccactccatcagtggtagaattgacgccactgtagtgcggattggcacgttctgttcaaatgggacagtgagccgaattaagatgcaggagggggtcaagatggcacttcatctgccttggttccatccgcgaaacgtgtctggcttttcgattgcgaatcggtctagcatcaaacgtctctgtattatcgaatctgtctttgaaggcgaaggctcggccactctgatgagtgctaactatcctgaaggattcccggaagatgagctgatgacctggcaattcgtagtgcccgctcacttgcgtgcatcagtgtcattcctgaacttcaatctaagtaactgtgagcggaaggaggaaagggtcgaatattatattcctggcagcaccactaaccccgaggtttttaaacttgaggacaagcagccaggcaacatggcgggtaacttcaatctgagtctccaaggatgcgatcaggacgctcaaagccccggaattctccggttacagtttcaggtgttggtgcagcatccacagaacgaatctaacaaaatttatgtcgtggacctgagtaatgagcgggccatgtccttaactatcgaaccacgacccgtgaaacagtctcgcaaatttgttccgggatgctttgtttgcctcgaaagcagaacgtgctcgagtaatctcaccctgaccagcggaagcaaacataaaattagtttcctatgtgatgacctgactaggttgtggatgaacgtcgaaaagaccatttcctgtacagatcatcgatattgccagagaaagtcgtatagcctacaagtgccgagcgatatcctccacctcccagttgagctccatgatttttcctggaagctgctcgtaccaaaggatcggctgtcactggtattggtccccgcgcagaaactacagcagcacactcatgagaaaccatgtaatacgtccttttcttacctggtggcatctgcaatacctagtcaggatctgtacttcgggtctttctgtcccggtggaagtataaagcaaatccaggttaaacagaatatcagtgtcaccttgcgcacattcgctccaagcttccaacaggaggcatcacgtcagggccttacggtcagcttcataccatactttaaggaagaaggcgttttcaccgtaaccccagacaccaaatcaaaggtctatcttagaaccccgaattgggatagaggtttgccgagtctgacgagtgtatcctggaatataagtgtcccccgtgatcaagtcgcttgcttgaccttttttaaggaacgcagcggagtggtgtgtcagactggccgggctttcatgataattcaagagcaacggacgagagcagaggagattttttctcttgacgaagatgtcctgcccaaaccttcgttccatcatcactcgttctgggttaacatttcaaactgtagtcctacatcaggcaaacagctcgacctacttttttccgtcacccttacaccgaggacggtagacctcactgtgatcctgatcgccgctgtgggcggcggcgttcttctactgagcgcacttggcctcatcatatgctgtgtgaaaaaaaagaagaaaaaaaccaataagggtcccgccgtgggaatctacaacgacaacattaatactgaaatgccacggcagcccaagaagttccagaagggcagaaaagacaacgacagtcatgtgtacgccgtgatcgaagatacgatggtctacggacatctcctccaggattcctctggatcatttctgcagcctgaagttgacacatatagaccttttcaggggaccatgggggtgtgccccccctccccacctactatatgtagccgtgccccaaccgcaaagctcgcaaccgaggaaccaccacccaggtcccctcccgagtccgaatcagaaccctacactttttctcaccccaacaacggtgacgtatcaagcaaggacaccgacattccacttctcaatactcaggaacccatggagcccgccgagtag

SEQ ID NO: 113322 - DNA, 1032 bp, Artificial Sequence
  Description of Artificial Sequence: Synthetic coding sequence
atggctggtctcaattgcggagtctcgatcgccttgctaggcgtgctcctcttaggcgctgcaagactgccacggggggctgaggccttcgagattgccctcccccgcgaaagcaacataacagtgctgattaagctgggaactcccacactgctagctaagccgtgttacatcgtgatatccaaacgtcacattaccatgctgagtatcaagagcggtgagcgaattgttttcactttctcttgccagagtcccgagaaccacttcgtaattgagatccagaagaatattgactgcatgagcggcccttgcccattcggtgaagtacagcttcagccaagcacttcattgctccccactcttaaccgtacttttatctgggacgtaaaagctcacaagtctatcgggctggagttacagttttcaattcctcggttacgacagatcggtccaggcgagtcctgcccagacggcgttactcattcaatcagcggtcgtatcgacgctacagtggtaagaatcggcactttctgttccaatggaactgtgagcaggatcaagatgcaggaaggtgtgaagatggccctgcacctgccttggtttcacccccgtaacgttagcggcttctccattgcaaaccggagttccattaagaggctgtgcatcattgagtctgtctttgaaggggaggggagtgccaccctgatgtccgccaattaccctgaggggttcccagaggacgaactgatgacctggcagttcgtggtgcccgcccacttgcgcgcctcagtgagttttctgaacttcaatttgagtaactgcgaacggaaggaggaaagagtcgagtactatatccctggctccacaaccaatccggaggtattcaagctagaggataagcagcccggtaacatggccggaaatttcaatctctccctccaaggttgcgatcaagacgcccagagccccgggatcctccgcctacagttccaggtactggtccagcatccccaaaacgaaagctcggagtag

SEQ ID NO: 113323 - DNA, 513 bp, Artificial Sequence
  Description of Artificial Sequence: Synthetic coding sequence
atgatgaacatgagtcttccttttctgtggagtctcctcacactactcatctttgctgaggtcaacggcgaagcaggcgaacttgaattgcagaggcagaagaggtccattaatctgcagcaaccacggatggccaccgagagagggaacctcgttttcctcaccgggtccgcccagaacatcgagtttagaactggttcgctggggaaaattaaactgaatgatgaggacctttctgagtgtctccaccaaatccaaaagaataaagaagatattatagagctgaagggtagtgctataggactaccacagaacatttccagccagatctaccaactaaattccaagttggtagacttggagaggaagtttcagggcctgcagcaaacagtcgataagaaagtgtgcagctctaacccgtgccaaaatggcggcacctgtctcaatcttcacgactcattcttttgcatctgtcctccacagtggaaggtttcccatctgcttttcggctag

SEQ ID NO: 113324 - DNA, 10872 bp, Artificial Sequence
  Description of Artificial Sequence: Synthetic coding sequence
atgatgaacatgagccttccattcctgtggtcgctgctcacacttctaatcttcgcagaggtgaacggagaggctggtgaactcgagctccagcgccagaagaggtcaatcaaccttcagcagccccggatggcaaccgaacgaggcaacctcgtcttccttaccggctcggctcagaatatagaattcaggaccgggagcctcggcaagatcaaattgaacgatgaggatttgagcgaatgcttgcaccagatccagaagaacaaagaagacattatcgagctgaaagggtcggccatagggctgccacagaatatcagctcgcagatctaccaattgaacagcaaacttgttgacttggaacgaaaatttcagggtcttcagcagacagttgacaagaaggtgtgttctagcaatccatgccagaacggcgggacttgccttaaccttcacgattcctttttttgcatctgtccaccgcagtggaagggaccactgtgtagcgccgacgttaacgaatgtgagatctactccggtaccccgttgtcttgtcagaatggggggacttgcgtcaatacaatgggaagctatagctgccactgcccacctgaaacatatgggcctcagtgcgcatccaaatacgacgactgcgaagggggatccgtagcaagatgcgtccatgggatctgcgaagacctgatgcgtgaacaggccggggagcccaagtactcttgtgtgtgtgacgctggatggatgttcagccccaattcacctgcttgtacacttgacagggatgaatgctcgttccagccgggcccatgttctacgcttgtccagtgcttcaatactcaggggtctttttactgtggggcttgccctacaggttggcagggcaatggttacatctgcgaggacattaacgagtgtgaaatcaataatggcgggtgctccgtggccccaccggtggagtgcgtaaacacccctggctcatcccactgccaggcctgcccgcccggataccagggtgatggtagggtgtgcaccctgacagatatctgtagcgtttcaaatggcggctgccaccctgatgctagctgttcaagcaccctaggctcccttccactctgtacgtgtttgcctgggtatactggtaatggatacggccctaacggatgcgtgcagctgtcgaacatttgtctgtcccacccctgcttgaacggccagtgtatagacactgtatccggttatttttgcaagtgcgactccggatggaccggtgtgaattgcaccgagaatattaacgagtgtctgtccaacccatgtctgaacgggggaacctgcgtggatggtgtggacagctttagctgtgagtgtacacgcttgtggaccggtgccctgtgtcaggtaccacagcaggtgtgtggggagtccctttccggtatcaacgggtccttttcgtatcgatctccagacgttgggtacgtacatgatgtgaattgcttttgggtgatcaagacagaaatgggtaaagttctacggataacgtttacatttttccggctcgagagtatggataactgtcctcacgaatttctgcaggtatacgatggtgacagctccagcgctttccagctcgggcggttttgcggctcatccctaccccacgagctattgtcgagtgataacgctctgtactttcacttgtactccgaacatctccggaatggtcgcggatttacagtgagatgggagacccaacagcccgagtgtggcggtatccttactggtccttacggcagtattaaaagtcctggataccctggaaactaccctccggggagggactgcgtatggatagtggtaacgagtcctgatctactggtcacatttaccttcggcacccttagcctggaacaccatgatgactgcaacaaggactacctggaaatccgagacggaccactgtaccaggatccccttttaggcaaattttgcactactttcagtgttccgcccctgcagaccacggggccctttgctaggattcacttccactccgactcccagatctctgatcagggcttccacattacatatctgacatcccccagcgacttaaggtgcgggggaaactacaccgacccagaaggagaactgtttcttcccgagcttagtggacctttcacgcacacccgccagtgcgtttacatgatgaaacaaccccaaggcgaacaaattcagatcaattttacacacgtggagctgcaatgccagtccgatagcagtcaaaattacatcgaggtgcgcgacggggagacccttctcggaaaggtgtgtggtaacggaacaatttctcatatcaaatctatcactaattcagtctggattcgctttaagattgacgctagtgtggagaaggcaagttttagggcagtctaccaggtcgcttgtggggacgagctgaccggagaaggcgtgattcgcagtccattcttcccaaatgtgtaccccggggagcgcacctgcaggtggacaatccaccagcctcaatcacaggtgatcctgctcaacttcactgtattcgagattggctcttctgcacattgtgaaacagattacgtggagatcggctctagcagcatccttggatcccctgagaataagaagtattgcggaaccgatatcccaagtttcatcacttcagtatataactttctgtatgtgaccttcgtgaagagcagttccactgagaatcacggctttatggccaaattttctgcggaggacctggcatgcggcgagatcttgactgaatccaccggtactatacagagcccaggtcaccctaatgtgtatccccatggtattaactgtacatggcacattctggtgcagcctaaccatctcattcatctgatgtttgaaacatttcatctggagttccactacaactgcacaaatgattatctagaagtctacgacacagattctgaaacctcattaggcaggtactgtggtaagtcaatcccaccatccctcacatcgtctggcaactcacttatgcttgttttcgtcactgacagtgatcttgcctacgaagggtttctaatcaattatgaggcaatctccgccgctacagcgtgtctgcaagattatactgatgatttggggacatttacctcccccaatttcccgaataattaccctaacaactgggaatgcatctacagaatcaccgtgagaaccggtcaattgatcgcagtccacttcacaaatttctcactcgaagaggccatagggaactattatacagattttctcgaaataagagacggcggctacgagaagtcccccctcctgggtatcttctatggatcaaacttgcccccaactatcatttcccatagtaacaagctgtggctgaaatttaagtccgaccagattgatactcgttcaggattcagcgcctactgggacggtagttcgactggttgtggtgggaacttaacaaccagcagtggcacttttatcagtcccaactatcctatgccatactaccactcaagtgagtgctactggtggcttaagagctctcatggctcagcctttgaactcgagttcaaagattttcatctcgagcaccatcctaattgtactcttgattacttggcagtgtatgatggtccaagctccaacagtcacctgcttacccagctctgcggagatgagaagcccccactgattcggagctccggcgattccatgttcatcaagctgcgcaccgatgaagggcagcagggccggggctttaaagccgagtataggcaaacttgcgaaaacgtcgtgatagtgaaccaaacatacggcatcttggaatctatcggctaccccaatccttattccgaaaatcaacactgtaattggaccatcagggccacgactggcaacacagtcaattacacttttctcgctttcgacttggaacaccacatcaattgtagcactgactacttagagctttacgacgggcctcgacagatggggagatattgcggcgtggatctgccacctcccgggtccactacatcgtctaaactccaggtactgcttctgacagatggggtcggaagacgagaaaaaggctttcagatgcagtggtttgtttacgggtgcggcggggaattatctggggcaacaggaagtttcagttctcccgggtttccaaataggtacccccccaacaaagagtgcatctggtatatcaggacagatcctggaagtagcattcagctcaccatccatgacttcgacgttgaatatcactcaagatgcaacttcgatgtcctcgaaatttacggaggcccagattttcattcaccgcggatagcccagctgtgtacccagagatcccccgaaaaccccatgcaagttagttcaacaggtaatgagcttgctattcggtttaagacagatttgagcatcaatggaaggggattcaatgccagttggcaggctgtgaccggagggtgtgggggcatcttccaggcccctagtggcgagatccacagccctaattatccatctccttacagatccaatacagactgttcctgggtgatcagggtcgaccgaaaccaccgcgtcctgctcaattttactgatttcgatctggagccacaggacagctgcatcatggcctacgatggacttagcagcacgatgtctcgactggcacgaacctgtggtagagagcagctggcaaatccaatagtctcctcaggcaatagcttgttcctaagatttcagagtggaccctcccggcagaacaggggatttcgcgcccagttcaggcaggcctgcgggggacacattctgacttcctctttcgatacagtaagctcccctcgctttcctgccaattaccccaataaccaaaactgctcttggatcattcaagctcagccgcctctcaaccatatcaccctttcgtttacccactttgaactggaaagatccacaacgtgcgcaagagacttcgtggagatcctggatggggggcacgaggatgctccattacgcggacgatattgcgggaccgacatgcctcatccaatcacatccttcagtagcgccttaacacttagattcgtgtctgactcctccatctcagccggagggttccataccaccgttaccgccagcgtgagcgcctgcggaggaacattctatatggctgaagggatttttaacagtccggggtacccagacatttatcccccgaacgtggagtgtgtgtggaacatcgtatctagtcccggcaacagactgcagctgagcttcattagtttccagttggaggactctcaggactgctcccgcgatttcgtggaaatacgtgaaggaaatgcaacaggacacctcgtgggaagatactgtggcaattcatttccgctgaactacagctccatcgtgggccatactctttgggtgcggtttatcagtgacgggtcagggagtggcacaggttttcaggcaaccttcatgaagatatttggcaacgataacatcgtgggcacgcatggtaaggtggcaagccctttctggcccgaaaactacccgcacaactcaaattaccaatggacagtgaacgtgaacgccagtcacgtcgtgcacggacgcattctagagatggatatcgaagaaattcagaactgctattatgataagctccgaatatatgatgggccatcaatccacgccaggctgataggggcttattgcggcactcagacggagtccttttcctctaccggcaattcactgacgtttcacttttactccgatagttcaatctccggcaaggggtttttacttgagtggttcgcggttgacgccccggacggcgtcttgcctactatcgcccccggtgcatgcgggggctttctgcggactggggatgccccagtgttcctgttttccccaggctggccagattcctactccaatagagtggactgcacttggctgattcaggccccagattcgactgtggagctgaacatcctgtccttggatatcgagtctcaccgtacctgcgcttacgatagcttagttattagggatggagataacaatcttgctcagcaacttgccgttctctgcggcagggaaattcccggacctattagaagcacaggtgaatatatgttcatacgcttcacttctgactccagtgtgacgagagcaggcttcaacgcaagcttccacaaatcatgcggcgggtacctgcacgctgatagaggaataattacaagccccaaatatccggagacctacccaagcaatctcaactgcagctggcatgtgttagtgcagtccggtctcaccatcgccgtgcacttcgagcaaccctttcagattcctaatggagatagctcctgtaaccagggcgactatctcgttttgcgcaacgggcccgatatttgctcccctcctctgggcccccccggtgggaatgggcacttctgcggcagccatgccagctccactctgtttacatcggacaaccaaatgtttgttcagttcataagcgatcactcgaacgaaggccagggatttaagatcaagtacgaagctaagtctcttgcttgcggtggaaacgtctatatccacgatgcggactctgctggatatgttacatctccaaatcacccccacaattatcccccacatgcagactgcatctggattcttgccgccccccccgagactcgcattcagttgcagtttgaggacagatttgacatcgaggtcacccctaattgcacatccaactatctcgagttgagagacggcgttgactcagatgccccaattctctcaaaattttgtggaacttctttgcccagctcccagtggtcctctggagaagtcatgtacctgcgatttcggtccgacaattcacctacccacgtgggttttaaagccaagtactcaatcgcacagtgcggagggagagttcccggacagtctggggtggtggaatctatcggccaccctaccctcccttacagagacaacctgttctgcgagtggcacctgcaagggctgtctgggcactacctgacaatctctttcgaggacttcaatctccaaaatagtagcggatgcgaaaaagatttcgtcgaaatttgggataatcacactagtgggaatattctcggacgatactgtgggaatacaatccccgatagtatcgacactagcagcaacacagccgtcgtccgatttgtaacagatggtagtgtcaccgcctcgggattccggctgcgttttgagagctccatggaagaatgcggcggtgacttgcagggatctattggcacctttacctcccctaactacccaaatcctaacccccacgggcgcatttgcgaatggcgcatcacagctccagaaggcagaaggatcacgttaatgtttaataacctgaggcttgccacgcacccaagctgcaacaacgaacatgttatagtgtttaatggcataagaagcaattctccccagttggagaaattgtgttctagcgttaacgtctctaacgagatcaaaagttctggtaacacaatgaaggttatcttctttactgacgggagcagaccatatgggggtttcaccgcgtcctacacctcttccgaggatgccgtgtgcggcggatcactgcctaacaccccagaggggaactttacaagccctggatacgacggagtccggaactattcccgtaacctgaactgcgagtggaccttgtcaaaccctaatcagggcaactcttccatcagtatacattttgaagacttctatttggaatcacaccaggattgccagtttgacgtactcgagttcagagtcggcgatgcagatggacctctgatgtggcgcttgtgcggcccttcaaaacctaccctgccactggtgatcccttactcgcaggtgtggatacattttgtaaccaatgaaagagtggagcatattgggttccatgcaaagtactcattcaccgactgcggcggtatccagatcggtgatagtggagtgatcacaagccccaactatcccaacgcatacgatagtctcacacattgtagctctctgctggaggcgcctcagggacacaccatcacgctgaccttttccgattttgacatcgaacctcacactacgtgcgcttgggactctgttaccgtgagaaatggagggtcaccagaatctcccatcatcggacagtattgcggtaactcaaatccccggacaatacagtccggttctaatcagttagtcgtgacctttaatagcgaccactccctccagggaggggggttctatgcgacttggaatacacagactctcggctgtggcggaatttttcattctgacaacggaacgattcgaagccctcactggcctcagaattttcccgagaattccagatgttcttggaccgctatcacgcacaaatccaagcacttagagataagcttcgataacaatttcctgatcccaagtggggacgggcagtgtcagaactcctttgtcaaagtctgggccggaaccgaagaagtggataaggccctgctggccactggatgtgggaacgtggccccaggcccggtgatcacgccgtcaaataccttcaccgctgtctttcagtctcaggaggcccccgcccaagggttctctgccagcttcgtctcccgctgcgggagcaactttacagggccaagcggttatatcatttctcccaactaccctaagcagtatgacaacaacatgaattgcacctacgtgatagaagccaaccctctctccgtagttctgctgacgtttgtgtctttccatctcgaggcacgctcagctgtgaccggaagctgcgtcaatgacggcgtccatatcattaggggatactcggttatgagtactccttttgcaacagtgtgtggcgatgagatgccagcacccctgacaatcgctgggccagtactgcttaacttctacagcaatgaacagatcacagactttggttttaaattttcctatcggatcattagttgcggtggcgtttttaacttctcgtctggcatcatcacctcccctgcatacagctacgcagattacccgaacgatatgcactgcctgtacaccattactgtgtcggatgataaagtcattgaactgaagttcagtgacttcgacgtggtgccctccaccagctgttcacacgactatctggctatatatgacggcgccaatactagcgaccccctgcttggaaagttttgtggttccaaacgccctcctaatgtgaaatcctccaataacagcatgctccttgttttcaagactgatagttttcaaaccgcaaaaggttggaagatgtcctttaggcagactttgggaccccagcagggctgtgggggctatctgactgggagtaacaataccttcgcttcgcctgatagtgatagtaatggcatgtacgacaagaacctcaattgtgtgtggattattatcgcaccagttaacaaagttattcatcttaccttcaatacttttgcactcgaagccgccagtacccgccagaggtgtttgtacgactacgtcaaactctatgacggcgatagcgaaaacgccaatctggctgggactttctgcggctcaacggttcccgcaccatttatttcttctggaaactttctcaccgttcaatttatctctgatctgacattggagcgggagggttttaacgctacgtacactatcatggatatgccttgcggaggtacttacaacgcaacatggaccccccagaacataagttcccccaactcttctgacccggatgtcccattctcaatctgcacctgggtgatcgacagccctccccatcagcaggttaaaattactgtgtgggccttacaactgacttcacaagattgcacccagaactatttgcagctgcaagactcgcctcaggggcacggtaactctcgctttcagttctgcggtcggaatgcgtctgctgtgccagtcttctattccagcatgagcacagccatggtgattttcaaatcaggtgtagtcaataggaacagccgcatgtcatttacctaccagatagccgactgcaatcgcgactatcataaagctttcggtaacttacggtctccgggttggcctgacaactacgataacgacaaggactgcacagtgaccctaaccgcgccccagaatcacaccatctcattgttttttcactctctgggcattgagaacagtgtggaatgtaggaacgactttctggaagtgagaaatggcagcaattcaaattcacctctgctcggcaagtattgtggtacgctgttgccgaaccctgtgttttcccagaataacgaactgtaccttcggtttaagagcgattccgttacatctgacagagggtacgaaatcatttggactagctcaccatcagggtgtggaggcaccctttacggagatagaggctcttttacatctcctggataccctggaacataccccaataatacctactgcgagtgggtgctcgtggctccagccggccgactcgttacaatcaatttttattttatttccattgacgaccctggcgactgtgtgcagaattacctgacactctatgacggtcccaacgctagctccccttcgagtggtccatattgtggtggggacacaagtattgcgcccttcgtggcttcttccaaccaggtgttcatcaagtttcatgctgactacgccagaagaccttccgcattcaggctgacctgggacagctag

SEQ ID NO: 113325 - DNA, 318 bp, Artificial Sequence
  Description of Artificial Sequence: Synthetic coding sequence
aacagtaaattggtggatctggagcgtaagtttcaagggctgcagcagaccgtggataagaaagtgtgctcttcgaatccttgtcagaacggcggcacatgtttaaacctgcacgatagcttcttttgtatttgccctccccagtggaaaggccctttgtgtagcgctgatgttaacgaatgcgagatttatagtggtaccccgctgagctgccagaatggagggacatgcgtgaacaccatgggtagctacagaaacccgtgtagcaacattccgaaagaaccagaggagggaagtcgcgattggcatagagagtag

SEQ ID NO: 113326 - DNA, 267 bp, Artificial Sequence
  Description of Artificial Sequence: Synthetic coding sequence
tcaacgggaaatgagcttgcgatacgtttcaaaacggacctgagtatcaatggccgcggctttaacgccagctggcaggcagttactggtgggtgcggagggatttttcaggctcccagcggagagatccatagcccaaactatccgtccccctacagatccaacaccgattgttcgtgggtgatcagagtggatcgtaaccaccgcgtgttactgaattttacggattttgatctcgagccacaagactcttgcatcatggtgtag

SEQ ID NO: 113327 - DNA, 1395 bp, Artificial Sequence
  Description of Artificial Sequence: Synthetic coding sequence
atgtctcattcgtggaatgttctgtggctaaccttttgctccgattcaaatggcatgtatgataagaacctaaactgtgtttggatcatcatagcccctgtgaacaaggtgattcatctgaccttcaataccttcgccctggaggcagctagtaccaggcagcggtgtctatatgattacgtcaaactgtacgacggcgactctgaaaacgcaaatctggccggaaccttctgcggaagtactgtgccggctcccttcatcagttcgggcaactttctcacagtgcaattcataagcgacctgaccttagagagagagggctttaacgctacctatacaattatggatatgccttgtggtggcacttataatgccacatggacgccccagaacatttccagtccaaactcaagcgaccctgacgtccccttctctatctgtacatgggtcattgattccccccctcaccaacaggtaaaaatcaccgtgtgggcgctgcagctcacttctcaggattgtacacagaattatctacagttacaggactcccctcagggccacgggaacagccgttttcagttctgtggtaggaatgcttccgctgtgcctgtattttactcaagcatgtcaacagcaatggttatcttcaagagtggggtagtcaatcgcaatagccggatgtctttcacatatcagattgccgattgcaacagggattaccataaggctttcggtaacttgcgctcacctggctggccagacaactatgacaatgacaaggattgcaccgtgactctcacagcgccacagaaccacactatcagcctgtttttccactcactagggatagaaaattctgtagaatgcagaaacgatttcttggaagttcggaatggctccaattccaattcccccctgttggggaaatactgtggtacactgctgcctaaccctgtgttcagccaaaacaatgaactgtacttaaggttcaagtcagattcggtcacttccgatcgcgggtacgaaataatctggacatcctcaccttcaggttgcggcgggactctctacggcgatcgaggaagctttacctcacctggatatcccggtacgtatccaaacaatacatactgtgaatgggtgttagtggcgccggcgggccgacttgtcacaatcaatttttattttattagcatcgatgaccctggcgactgtgtgcagaattacctgacattatacgacggccctaacgctagcagtccgtcctctggaccctattgcggtggagacacatctatagcgcctttcgtcgcctcttccaaccaagtctttattaaattccatgcggactatgcccggcggccatccgcatttcgcctgacctgggacagctag

SEQ ID NO: 113328 - DNA, 864 bp, Artificial Sequence
  Description of Artificial Sequence: Synthetic coding sequence
atggagctagagcgcatcgtgtctgctgccttgttggcctttgtgcagactcatctaccggaagccgacctttctgggttagatgaggtgatcttttcttatgtccttggagttctggaggacctcgggcccagtggcccatctgaagaaaactttgatatggaagctttcaccgagatgatggaagcttatgttccgggctttgctcatattcctcgtggcaccattggtgacatgatgcagaagctttcaggccagctctctgacgcccgcaataaagagaacctgcagccccagtccagtggcgtgcagggccaggtgccgatctcacctgaaccactgcagcgcccagaaatgctgaaagaagagacaagaagctctgctgccgcagctgccgatacccaggatgaggcaacaggagctgaggaagagctcctgcctggagttgacgtgcttctcgaggttttccccacatgcagtgtggaacaggcacagtgggttcttgcaaaggcccgaggcgacctggaggaagcagtgcaaatgctggtcgaaggtaaggaagaaggacctgccgcatgggagggccctaatcaggaccttccgcggcgtctacgaggaccccagaaggacgaactcaaaagttttatcctccagaagtacatgatggttgatagcgccgaggaccaaaagatacaccgcccaatggcccccaaggaagcacccaaaaagctgattcgatatatcgacaaccaagtagtctccactaaaggtgagcgcttcaaagacgttaggaaccctgaagcggaggaaatgaaggccacatacatcaacttgaaacccgctcgtaaataccgcttccactag

SEQ ID NO: 113329 - DNA, 1365 bp, Artificial Sequence
  Description of Artificial Sequence: Synthetic coding sequence
atggctgctgccccaggagggtccgctcagcccgccgggcccggaccacgcctggggttcagtacagctgacagcggggtggggatgtcaggcctgaaccctgggccagccgtccccatgaaggaccatgacgccatcaagctgtttgtcggccagattcccaggggcctcgacgagcaggatctgaaaccactcttcgaggagttcggcagaatttacgagctgacagtacttaaggaccgcctcacaggcctgcataagggctgtgctttcctgacatattgcgcacgggattcagcactgaaggctcagtcagccctccatgagcagaaaactttacctggtatgaacaggcccattcaagtgaagccagcggcctcagaaggacgcggagaggaccgaaaactgttcgtcggaatgctgggcaagcagcagggagaggaggacgtgaggagattatttcagcctttcggacacattgaggaatgcactgtgctccgctcgccagatggaacaagcaaaggctgtgccttcgtgaagttcggatcgcagggtgaggctcaagcagcaatacggggtctccatgggtctcgcaccatggccggggccagttcctcactggttgttaagttggcggatacagatcgcgagcgagcattaagacgaatgcagcagatggccggacatctgggcgctttccaccctgcacctctgcctttgggcgcctgcggcgcttatacaacggcaatcctgcaacaccaggccgccctccttgctgccgcccaaggtccaggactcggacccgtggctgcagttgctgcacagatgcagcacgtcgccgcctttagcttggtggccgctcccctgttgcctgctgcagccgccaacagtcctcctggcagcggccccggtactttgcctggtttacctgcccctatcggcgtgaacggattcgggccactgactccccagacaaacggtcaacccggttcagacaccctgtacaacaacgggctgagtccctacccggcgcagtcaccaggcgtggccgacccattacagcaggcgtatgcaggaatgcatcattacgcaggtcccgaagggtgtaacctgtttatctatcatctgccccaggaattcggcgacgctgaactcatccagacttttctcccatttggggccgtcgtgtccgcgaaagtgttcgtcgaccgcgcaactaatcagtcaaaatgcttcggtttcgtatcctttgataatccaacctccgcccagaccgccatacaggccatgaatgggttccagatcgggatgaagcgcctgaaggttcagctgaaacggcccaaggacgccaacaggccctattag

SEQ ID NO: 113330 - DNA, 1398 bp, Artificial Sequence
  Description of Artificial Sequence: Synthetic coding sequence
atgaaagaacccgatgcaatcaaattgtttgtgggccagattccacgtcatctcgaagaaaaggacctcaaacctatattcgaacagttcgggagaatctttgaattgaccgtgataaaagataagtacacaggattgcataaggggtgcgccttccttacctactgcgcaagggatagcgccctgaaagctcaatccgcgctgcacgagcaaaaaacgctgccgggcatgaatcgtcccattcaggtgaagccagccgattcagagtcccgaggagaagacagaaaactgttcgtagggatgttaggcaagcagcagacggacgaggacgtgcggaagatgttcgagcctttcggcaccatagatgagtgtaccgttctgcggggtccagatggtaccagcaaggggtgtgcttttgtgaaattccagacgcatgcagaggctcaggccgctatcaacacattacatagttcccggacattaccgggtgccagctcgtcactcgtggttaagtttgcagatacagaaaaagaaaggggcttgagacggatgcaacaggttgcaacacagcttggaatgttttccccgattgctctgcagttcggggcttatagtgcgtatactcaagcactaatgcagcagcaggctgccctggtggccgcgcactccgcatatctctccccgatggctacaatggctgccgtgcagatgcaacatatggcagccattaatgcaaatgggctcatcgcgactccaatcacaccctccagcggaacttcaacacctcctgccatcgcagccacacccgtgtcagctatacctgctgccctcggcgtgaatggctacagccccgtgcccacacagcccaccggccagcctgcaccggacgccctctatccaaacggggtccacccatatcccgcccagtcccctgccgccccggtggatcccctccagcaagcctacgccgggatgcaacactataccgccgcttaccctgccgcatattccttggtggcacctgccttccctcagccccccgctctcgtcgcacaacaaccacctcctccccctcagcagcagcagcagcaacagcagcagcagcagcagcagcagcagcgtgagggtcctgatggctgcaacatctttatttaccacctccctcaggaattcacagatagcgagattctacaaatgttcgttcccttcggccacgttatatccgcgaaggtatttgtagaccgcgctactaatcaaagcaaatgcttcggctttgtgagctttgacaatccagcatccgcccaggccgcaatccaggcaatgaatggttttcaaattggcatgaaaaggcttaaggtgcagctcaaacggccaaaagacgcaaaccggccttattag

SEQ ID NO: 113331 - DNA, 1248 bp, Artificial Sequence
  Description of Artificial Sequence: Synthetic coding sequence
atgaaagaacctgatgctattaagctatttgtggggcagatccctcggcaccttgaggaaaaagacttaaagccaatcttcgagcaattcggcaggatattcgaactgactgtgattaaagacaagtacactggactccacaaagggtgtgccttccttacatattgcgcacgggattctgccctaaaagcccagtcggccctccatgaacagaagaccctaccaggaatgaacagacctatccaagttaaaccagcagattcagagagccgaggtgaggaccggaaactgttcgttggcatgctgggtaagcaacagacagatgaggacgtacgaaaaatgttcgagccgttcggcactatcgacgagtgtaccgtgttgagaggccccgatggtacctctaagggctgcgccttcgtgaaattccaaactcacgcagaggctcaggccgccataaatacactgcatagctctaggaccctccctggcgcctctagttcccttgtcgttaagttcgctgataccgaaaaggagcgcggactgaggcgcatgcagcaggtggcgacacagcttggaatgttttctccgattgccctacagtttggagcatattctgcgtatacccaggcactgatgcaacagcaggctgcgcttgtagctgcacattctgcttatctgtctcccatggcgaccatggccgccgtgcagatgcaacacatggcagccattaatgcaaacggccttatagctacccccatcacaccttcatccgcacagtccccggccgctcccgtggaccccctgcaacaggcctacgccggcatgcagcactatacagcagcatatccagctgcctacagtctggtggcaccggctttcccacagccccctgccttagtggcgcagcagcctccgccccctcctcagcagcaacagcaacaacaacagcagcagcagcagcaacagcagagggaagggcccgacggatgcaacatctttatttatcacctgccacaggagtttacagacagcgaaatacttcaaatgtttgtgccatttgggcacgttatctcagccaaagtgttcgtcgacagggcaactaaccagtccaaatgttttggttttgtttctttcgataatccggcttccgctcaagccgcgattcaggcaatgaacggcttccaaatcggtatgaaacgcttgaaggtgcaactgaaacggcccaaggacgccaatcgaccctattag

SEQ ID NO: 113332 - DNA, 900 bp, Artificial Sequence
  Description of Artificial Sequence: Synthetic coding sequence
atgaaggaacccgacgcgatcaaactgttcgtgggtcagattccacggcatctggaagagaaagaccttaaacctatcttcgaacaattcggtagaatttttgagctaactgtaattaaggataagtacaccggcctgcataagggatgcgcttttctaacatattgcgcgcgggatagtgctctaaaggcacagtccgcactgcacgagcagaagacactgcccggaatgaacagacccatacaagtgaaacccgcggactcagaaagtagaggggacagaaagctgtttgtcggaatgttgggtaagcagcaaaccgatgaggatgttcgaaagatgttcgaaccatttggaactattgacgagtgcacagttctccggggcccagatgggacaagcaaggggtgtgcattcgttaagtttcagacacacgccgaagcccaggccgcaattaacacactacactccagtcggaccttgccgggcgcctctagcagtctcgtcgtcaagtttgctgacaccgagaaagaaaggggtttaagaagaatgcagcaggttgctactcaactgggtatgttctccccaatagccttgcagtttggcgcctactccgcttacacccaagctctgatgcagcaacaggctgctctggtggcagcccatagcgcttacctctctcctatggccactatggcggccgtacaaatgcagcacatggccgctattaatgccaatggcctgattgccacacctatcactccctcaagcgcaaaaggtcacggctatgcttccctagccccccgcgcccatttcctactagatgccctgttggcattcgtgcgggaaagaggtaccggcagcaaggctccagggtacctgccctccgccggattactgtag

SEQ ID NO: 113333 - DNA, 783 bp, Artificial Sequence
  Description of Artificial Sequence: Synthetic coding sequence
atgcagcaagtggcaactcaactcggcatgttctctcccatagccttgcagtttggcgcatattcggcctatactcaggcccttatgcagcaacaggccgcactggtggctgcacactcagcctacctatcccctatggcaaccatggctgcagttcaaatgcaacacatggccgcaatcaatgccaatggtctgatagctactcccatcactccatcgtctggaacctcaacaccccccgccatcgccgcaacccccgtcagtgctatacccgctgccttaggtgtgaatggctactcacccgtacccacgcagccgacgggacagcctgcaccagatgccctgtatccaaacggtgttcacccataccctgcagcatacccagcagcatatagcctggtcgcgcccgcattcccacagccacctgctctcgtggctcaacagccaccaccccctccccagcaacagcaacagcagcagcagcagcagcagcagcagcagcaacgcgaaggcccagatggctgcaacatattcatatatcacttgcctcaggaattcacagacagcgaaattctccagatgtttgtccctttcggacatgttatatccgccaaggtgttcgtggacagagctacgaaccaaagtaaatgcttcggctttgtatcctttgacaatcctgcatcagcacaggccgctatccaggccatgaacggattccaaattggtatgaagagactgaaagtacagttaaaacgccctaaagacgccaaccggccttattag

SEQ ID NO: 113334 - DNA, 1401 bp, Artificial Sequence
  Description of Artificial Sequence: Synthetic coding sequence
tgagttgaggaatcagccgcaggcgaacaaagcagcggtacccagatcccccggcatctggaggagaaagacctgaaacccatctttgagcagtttggtagaatattcgaacttacggtcattaaagacaagtatacggggttgcacaaggggtgtgcttttctgacttactgtgccagggatagcgcgcttaaagcccagagcgcccttcacgaacagaaaaccctcccgggtatgaacaggcccatccaggtcaaacccgctgatagcgagtcccgaggggaccggaagctttttgtaggcatgctagggaagcagcagacagacgaagatgtacgcaaaatgtttgagccattcgggaccatagatgagtgcacggtactgcggggccctgatgggacatctaaaggctgcgcctttgtcaagtttcagactcacgccgaagctcaggcagccattaataccctgcactccagcaggacactgcctggcgcatcatctagtctggtggttaagtttgccgacaccgagaaggaaagagggcttaggaggatgcaacaggtggcaactcagctagggatgtttagcccaatagccctccagttcggggcctattccgcatatacacaagcactcatgcaacagcaggctgcactggtggctgctcacagtgcttatctgtcaccaatggctaccatggccgcagttcagatgcagcacatggccgcgataaacgccaacggcctgattgccacaccaattactccctcctcaggcacctctactcctcctgcaattgcagctacacctgtttcggccatacccgccgccctgggagttaatggttattcgccagtacctacgcagccaaccggtcagccagcccccgacgccctttacccaaacggagtgcatccctaccccgctcagtccccagccgctcctgtcgaccccctgcagcaggcttatgccggcatgcagcactacaccgccgcgtacccagcagcctactccctcgtggcgcctgcatttcctcagccgccagcactggtggcacaacagcctccccctcccccccagcagcagcaacaacagcagcagcagcagcagcaacagcagcagcgggagggacccgatggctgcaatatctttatttaccatctgcctcaggaattcacagactcggagatactgcaaatgttcgtgccctttgggcatgtgatctccgctaaggtttttgttgatcgggccaccaatcaaagcaaatgcttcggatttgtgagttttgacaatccagcctccgctcaggccgccatccaagccatgaacggttttcaaatcggcatgaagcggctaaaagtgcagctcaagagacccaaagacgcaaatcgaccttattag

SEQ ID NO: 113335 - DNA, 1347 bp, Artificial Sequence
  Description of Artificial Sequence: Synthetic coding sequence
atgtacattaagatggcgactctggccaatggacaggcagataacgcttctctctcaaccaacggcctggggtccagcccaggcagcgcagggcatatgaacgggttatctcactctccaggaaacccctcgaccatccctatgaaggaccatgatgcaatcaagcttttcattggacagattcctaggaaccttgatgaaaaggatttgaaaccactgttcgaggaattcggtaagatctatgaactcactgtgctgaaagaccgctttaccggtatgcataagggctgtgcctttctaacctactgtgagagggagagtgcccttaaggcccagtccgccttgcacgagcaaaagactctgcccggcatgaacaggccaatccaagtgaaacctgcagattcagagtctagaggagaggaccgaaagctgttcgtgggcatgctgaataagcaacaatcggaggacgatgttcgtagactttttgaagcgttcggcaatattgaggaatgcaccatacttcgcgggccagacggaaattcaaaaggatgcgcctttgtgaagtattccagtcatgccgaggcgcaagccgcaatcaatgccctgcacggcagccagactatgccaggggctagcagcagcctcgtcgtcaaattcgctgacacagataaagagcgcactatgcgccgaatgcagcagatggcaggacagatggggatgtttaatcctatggcaattccttttggggcatacggcgcatacgcccaggcactcatgcagcaacaggctgccctcatggcatcagtggcccagggaggctatttaaatcctatggctgcttttgccgcagctcagatgcaacagatggctgcattaaatatgaatggcctggccgctgctcctatgaccccaacgtcgggtggttccacgccacctgggattactgcgcctgctgtccccagcattcccagtcccataggggtcaacggcttcaccggtttgcctccgcaggccaacgggcagcctgcagctgaggctgtgttcgccaatgggattcacccatatccagctcagtcacctacagccgcagatcccctccagcaggcctatgctggcgtgcagcagtacgcaggccctgctgcctatccagctgcctatggacagatatctcaagctttcccccagcccccaccgatgattcctcagcagcagagggaggggttcgtgtccttcgacaatccagcctcggcccagaccgctatacaagcaatgaacggattccagatcggcatgaagagattgaaagtccagctcaagcgaccgaaagacgccaacaggccctactag

SEQ ID NO: 113336 - DNA, 639 bp, Artificial Sequence
  Description of Artificial Sequence: Synthetic coding sequence
gtgagcgctgagggccccgagagggccgcacgagcagaggacagcgctagagatgagcctgccgaccccggtgaagcatgtggacagagggaacccaaggataggaagctgtttgtgggtatgctgaacaagcagcaatcagaggacgatgtacgaaggttgttcgaagccttcggcaacattgaagagtgtacaatcctcagagggcccgatggcaactcaaaagggtgtgcctttgtgaagtactcttctcatgctgaggcacaggctgcaatcaacgcgctgcacggctctcaaacaatgcctggcgctagcagttctcttgttgtgaagtttgcagataccgacaaagaaagaactatgagaaggatgcagcagatggcgggccagatggggatgtttaatccaatggctatcccttttggagcctatggcgcttatgcacaggcgcttatgcagcagcaggccgccctcatggcctctgtcgcccaaggtggatatttgaatcccatggctgcgttcgccgccgcgcagatgcagcagatggcagcacttaacatgtggcccggcggaagaacctacgaccctaatctccgatggcagcatccgtccgggcatcattgcacaagcagggcctag

SEQ ID NO: 113337 - DNA, 1461 bp, Artificial Sequence
  Description of Artificial Sequence: Synthetic coding sequence
atgtatatcaagatggcgaccctggccaatggacaagctgataatgctagcctgtcgaccaatggactcggttctagtcctggctctgctggccacatgaatggcctctcccattctcccggaaatccctctactattcctatgaaggaccacgatgccatcaaactttttattgggcagatcccacgaaacttagatgagaaagaccttaaaccactcttcgaagaattcgggaagatctacgagctcaccgttttgaaagaccggttcacggggatgcacaaggggtgcgcttttctgacttattgtgaaagagaaagcgcactcaaagcccaatccgctctccatgaacagaagacattaccagggatgaaccgccctattcaggtcaagcctgccgactctgagtcgcgtggcggtagtagctgtttgaggcagccaccctcacaggatagaaaactatttgtcgggatgcttaacaaacagcagagcgaagacgacgttcggagactgtttgaggcatttggaaatatagaagagtgcactatactgaggggtccagacggcaactctaaggggtgtgcatttgtgaaatatagcagtcacgcagaggcacaagctgccatcaacgcactgcacggttcccagaccatgcctggggcaagttcaagcctcgtagttaaattcgctgacacggacaaggaaaggaccatgcggagaatgcagcagatggccggccagatggggatgttcaatcccatggccatcccgttcggtgcatatggtgcctatgctcaggctctaatgcaacagcaggccgcgcttatggcctccgtagctcaggggggttacctgaaccccatggccgccttcgccgctgcacaaatgcagcagatggccgccctcaatatgaacggactggccgccgccccaatgaccccgacttctggtgggagtacccctccagggattaccgctccagctgtgccatcaattccatctccaatcggggtgaacggctttaccgggctacctccacaggccaatggacaaccagccgccgaggccgtctttgccaacggcattcacccctaccctgctcagagtcctactgctgccgatcctttgcaacaagcttatgctggggtccagcagtacgctgggcctgctgcctacccagccgcctatgggcagatctcacaggctttcccacagccaccaccaatgataccccaacaacagagggagggacctgagggctgcaacctgttcatctatcacctccctcaggagttcggggatgcagaactgatgcagatgtttcttccatttggatttgtatcattcgataaccctgcctccgcccagactgctatccaggccatgaatggatttcagattggaatgaaaaggctaaaggttcaactgaagaggccaaaggacgcgaataggccatattag

SEQ ID NO: 113338 - DNA, 1458 bp, Artificial Sequence
  Description of Artificial Sequence: Synthetic coding sequence
atgtatattaagatggccacattggccaatggacaagccgataatgcctcactctctaccaatggtcttggcagcagcccagggtctgcgggccacatgaacgggctgtcccattcccctggcaacccaagcacgattccaatgaaagatcacgacgccatcaaattgttcatcggccagattcctcggaaccttgacgaaaaggacttgaaacctcttttcgaggagtttggcaagatatacgaattgacggtactgaaggacagatttaccgggatgcacaaaggttgcgcgttcctgacctactgtgagcgcgagagtgccttaaaagcacaatcagcgcttcatgaacagaagacccttccaggaatgaatagacccatccaggtgaaacccgccgatagcgagtctagaggtggttcctcctgcttgaggcagccaccgtctcaggaccgcaagctgtttgttgggatgctaaataagcaacaatcagaggatgacgtgcggaggcttttcgaagctttcggtaatattgaggagtgcacgatccttaggggccccgacggaaatagtaagggatgtgccttcgtcaaatactcttcccacgcagaagcccaagctgccataaacgccctgcatgggtcacagactatgcccggagcctccagttcacttgtagtaaagtttgccgatacagataaggaacgaaccatgagaagaatgcaacagatggccggccaaatgggtatgtttaatcccatggcaattccctttggggcatacggtgcttacgcccaagctatgcagcagcaagctgccctgatggcgtctgtcgcccagggcgggtacttgaatcccatggctgcattcgctgccgcccagatgcaacagatggccgctttgaatatgaatggtcttgccgccgcacccatgactccgacctccggaggtagcacacccccaggcataacagctccagcggtaccaagcatccccagtccaatcggggtcaacggctttactggtctgccacctcaggctaacgggcagccagcagcagaggccgtgtttgccaatgggatacacccatatccggctcagagcccaaccgccgcggaccctctccagcaagcatacgcgggagttcaacagtacgccggtccagcagcctaccccgccgcatatggtcagatcagtcaagcctttccccaaccacccccaatgattccccagcagcaaagagaagggccagaggggtgtaacctgtttatctaccatcttccccaggaatttggtgacgctgaactgatgcagatgttcctaccttttggcttcgtgagtttcgataaccccgcaagtgcacagaccgcaatccaggccatgaatggcttccagattggcatgaagagactcaaagtgcagctaaagagacccaaagatgctaatcggccttattag

SEQ ID NO: 113339 - DNA, 1455 bp, Artificial Sequence
  Description of Artificial Sequence: Synthetic coding sequence
atgtatatcaagatggccaccctcgccaacggacaggctgacaatgcctcactcagtaccaacgggttagggagctctccaggctcggccggtcacatgaacggactttcccactctcccgggaatcccagtactatcccaatgaaggatcacgacgctattaagctgtttatcggccaaatccctcgcaatctcgatgagaaagacctcaagcccttatttgaagaatttggtaaaatctatgagttgacagtgctcaaggataggttcactgggatgcataaggggtgcgccttcttgacgtattgcgaacgtgaatccgccctaaaggcccagtctgcactgcacgagcagaaaaccctgccgggtatgaaccgacccatccaagtgaagcctgccgactcagagagtcgcggagggtcttcctgcttgagacagccgccatcacataggaagttattcgtcggcatgcttaataagcaacagtcggaggacgacgtccgccgactgttcgaggcttttgggaatattgaggaatgcactatcctcagaggacctgatgggaactccaagggctgcgcgttcgtgaaatatagtagccacgccgaagctcaggccgccataaacgcacttcacggttcccagaccatgcccggtgcttcttctagccttgtggttaaatttgcagacacagataaggagcgtacaatgcgtcgcatgcagcagatggcaggccagatggggatgttcaacccaatggcgatccctttcggcgcctacggcgcctatgcccaagctatgcaacagcaggccgccctgatggctagcgttgctcagggcggctacctgaacccaatggccgcctttgccgctgcccaaatgcaacagatggccgccctgaacatgaacggcctggccgctgcaccgatgaccccaaccagcggggggagcacaccaccaggaattacagcgccagcagtcccatctatccccagtcccatcggggtaaacggattcactggcctaccacctcaggcaaatggccagcccgccgccgaggccgtcttcgcgaatgggatccacccctatccagctcagtctcccaccgcagcagatccacttcagcaggcctacgctggcgtccagcagtatgctggccctgccgcttaccctgccgcgtatggccaaattagtcaggccttcccacaaccaccacccatgatacctcagcagcagagggagggtccagaggggtgtaatctatttatctatcacctcccgcaggaatttggggacgccgagctgatgcagatgttcctcccttttggtttcgtgtctttcgataacccggctagtgcacagacggcgatccaagccatgaatgggttccagatagggatgaaacgcctaaaggtacagttaaaaaggccgaaagacgctaatcggccttactag

SEQ ID NO: 113340 - DNA, 1458 bp, Artificial Sequence
  Description of Artificial Sequence: Synthetic coding sequence
atggcaaggctcactgaaagcgaggcaaggaggcaacagcagcagctgctacagccacgccccagtccggtgggaagttcaggaccagagccccccggcgggcagcctgacggtatgaaggatttagacgcaatcaaactattcgtgggtcagattcctaggcatttggacgaaaaagacctgaaaccgctgttcgaacagtttggtagaatctatgagctcaccgtgttaaaggacccgtatacaggtatgcataagggatgtgcctttctcacgtactgtgcacgggactccgctatcaaggcccagactgctctgcacgaacagaaaacccttccaggcatggcacgtccgatccaggtcaagcctgctgatagcgagtcccgcggcggcagagatagaaagctgtttgtgggaatgctgaataagcagcagtccgaagaggacgtcctgcggctgtttcagccatttggagttatcgatgaatgcaccgtactcagaggccctgatggtagcagcaaggggtgcgctttcgttaaattctcaagtcataccgaggcccaggccgctatacatgccctccacggcagccagaccatgcctggcgctagctctagcctcgtggtgaagttcgccgacacagataaagaacgaaccctgaggcggatgcagcagatggtcggccagctcggcatcctgacccccagcctgacattaccgttctcgccatacagcgcgtatgcccaggctctgatgcagcagcaaaccactgtcctcagcactagtggatcatacctgagtcctggagttgcctttagtccctgccatattcaacagatcggagccgtgtcattaaacgggttgcccgccacgccgatagcccccgcctcagggcttcactctcctccactccttggcaccacagctgtccccgggctggtggctcccatcacaaatggctttgcaggcgtcgttccttttccgggcgggcaccccgccttagaaactgtatatgcgaacggactggtcccctacccagcacagtcccccaccgtggccgagactctgcacccggccttcagcggagtgcaacagtacactgccatgtatcctactgcggctattactccgatcgcccactctgtcccgcagccaccacctctgctgcaacaacaacaaagggaaggcccagaaggttgcaacctctttatttatcacctgccccaggaattcggagacactgagctgacacagatgttcttacctttcgggaatattatttcttcaaaggtcttcatggatagggccaccaaccagagtaagtgcttcggattcgtttccttcgacaaccctgcctctgcccaggcagcaattcaggcgatgaacgggttccaaattggtatgaaacgcttgaaggtccagctgaagcggcccaaggacccaggccatccttactag

SEQ ID NO: 113341 - DNA, 963 bp, Artificial Sequence
  Description of Artificial Sequence: Synthetic coding sequence
atggcacggcctatacaggtgaagccagcagacagcgagagcaggggaggccgcgacaggaaacttttcgtgggcatgcttaacaagcagcaatcagaagaggatgtactccgcctctttcagcccttcggcgttattgacgaatgtacagttctacgagggccggacggcagctccaaggggtgcgcatttgtaaaattcagttcccatacggaggctcaagctgcaattcatgccttgcatgggagccagaccatgccaggggcatctagttcgcttgtggttaaatttgccgatactgacaaagagcgaacactgagaagaatgcaacagatggtgggccagctcggaattctgactccgtctctgacactgcctttctctccttacagtgcctacgctcaagccctgatgcagcagcagactactgttctcagtacctccggctcttatctctccccaggggtcgcattcagtccatgccatatccagcagatcggtgccgtgagcctgaatggcctgccagcaacacctatcgccccagcttccgggctgcattctcccccactgttggggactactgccgtgccgggactagtggcccccattacaaacgggtttgccggggtggttccgtttcctggtgggcacccagccctagaaacagtgtacgcaaacggcttggtgccataccccgcgcagagtccaacggtcgccgaaaccctacacccagcttttagcggcgtgcagcagtacactgcaatgtaccctactgcagcaattaccccaatagcacacagcgtaccccagcctcctccattactccaacagcagcaacgggagggggtttggcggcacggggccgatgctgatgtccctactttgcgacaatatcacttccttcagggcgtgtacggaagttcatatcagcctgagcaggtgttcaggctgcgggagctctag

SEQ ID NO: 113342 - DNA, 1230 bp, Artificial Sequence
  Description of Artificial Sequence: Synthetic coding sequence
atggccagactcacagagagtgaagccaggaggcagcagcagcagttgctgcagcctaggccttcccccgtgggctcctctggacccgaaccaccaggtgggcagcccgatggcatgaaggacttggatgcaattaagctgtttgtgggccagatccccaggcacctggacgagaaagacctgaagccgctgttcgagcagttcggacggatttacgaactcacagtgctgaaggatccttacaccggcatgcacaaaggatgcgcctttctcacttattgtgcacgcgactctgccatcaaggcccagacagccctccatgagcaaaagacgttgccaggaatggcacggcccatccaagttaaacctgctgactctgagagccggggcggcagagaccggaaattatttgtggggatgctgaataagcagcagtctgaggaagacgtgctaagacttttccagccattcggagtcattgacgaatgcacggtattgagggggccagatggatcttcaaaaggctgtgccttcgttaaattcagtagtcatactgaagcccaggccgcaatacatgcactgcacggtagtcagacaatgcctggagctagctcgtctttggtggtcaagtttgcggacacagacaaggagcgtactctgcgacggatgcagcaaatggtggggcagctgggcattctgacacctagcctcaccttgcccttctcaccctactcggcatacgctcaggcattgatgcaacagcaaacgaccgtactaagcacaagcggatcctatctgagccccggagttgctttctctccatgtcacattcagcaaatcggagcggtctccctcaatggtctcccggccactccgattgctcccgcatctggcgttgtgccctttcctggggggcatcccgccctggaaaccgtttacgcaaacggcttggttccataccctgctcagagcccaactgtggctgagaccctgcacccagcattcagcggcgtgcagcagtataccgctatgtaccctacagcagcgataacacccatcgcgcatagtgttcctcaaccacctcccctgctccagcagcagcagagagaaggagtatggaggcacggtgcagacgccgacgtcccaaccctaaggcagtaccattttttgcaaggggtgtatggatctagctatcaacccgagcaggtctttaggctgcgcgaactgtag

SEQ ID NO: 113343 - DNA, 1446 bp, Artificial Sequence
  Description of Artificial Sequence: Synthetic coding sequence
atggcagcggccccaggtgggtctgcccagccagctggccccggaccgcgccttggattctctacagccgacagcggtgtaggtatgagcgggttgaatccagggcctgccgtccctatgaaggatcacgatgcaattaagttgtttgtcggtcagatacctcgcggccttgatgaacaggatttgaagcccctgttcgaagagtttgggagaatctacgagcttaccgtgctgaaggaccgacttacgggcctacacaagggctgtgcatttcttacgtactgtgcccgagactctgccctcaaagcccaaagcgcactccatgagcagaagaccctgcccgggatgaaccggcctatccaggtcaaaccagctgcctccgagggtcggggcgaagacagaaagctctttgtgggaatgctgggaaaacaacaaggcgaggaggacgtgagaaggctatttcagccattcggacatatagaagagtgcaccgtgcttcgatctcctgatggcacctcgaaggggtgtgcctttgtaaaatttggctcccaaggagaggcgcaggccgcaatcagaggcctccacgggtcacgaactatggccggagcctctagtagcttggtggtcaagctggctgacactgatagggagcgggcactcaggcggatgcagcagatggccggtcacctgggtgccttccatcccgccccactgccgctgggggcgtgcggggcgtacacaaccgctattctccaacatcaggctgcactgctcgcagccgcccaaggccccgggctgggtcccgtggccgctgttgccgcccagatgcagcatgtcgccgcattcagcctcgtggctgccccactacttcccgccgccgcagctaattctccccccggaagtgggcctggcacactgccgggactcccggcgcctattggtgtgaatggattcggccctctgacaccacagactaacggccagcccggatccgatacactgtacaacaatgggctgtcaccctaccctgcccagtctccaggtgtggccgatccccttcagcaggcttacgccgggatgcatcattacgctgctgcttatccctccgcctacgctcctgtttcaaccgcatttccacagcagccttctgctctaccgcagcaacagcgcgagggtccagagggatgtaacctgtttatttaccatctgcctcaggaatttggggacgccgaattgattcagacatttctgccttttggtgccgtggtgtcggctaaggtgtttgtggaccgcgccacgaatcagtctaagtgcttcgggtttgtgtcatttgataatcccacctctgcccagacggcaattcaagccatgaacgggttccaaattggcatgaagagattaaaggttcaactgaagaggcctaaagacgccaacaggccctattag

SEQ ID NO: 113344 - DNA, 1107 bp, Artificial Sequence
  Description of Artificial Sequence: Synthetic coding sequence
atgatctcggatcctccttccaataactcttggaatagcgtgctctacctgctggaagacaggaagctgttcgtgggcatgctaggcaagcagcagggcgaagaggacgtgagaaggctctttcaaccctttgggcatatagaggagtgcactgtgctaagaagccctgatggcacctccaaaggatgtgcctttgtgaagttcggttcccagggggaagcacaggcggccattagaggtctgcacggtagcagaacaatggcgggcgcatcttcctctctcgtggtcaaactggccgacactgaccgagagagagccctcaggagaatgcaacagatggctggacatctcggggcatttcaccccgcgccactgcccctgggagcctgtggggcttacactacagccatccttcagcaccaggctgccctcttggcagctgcacagggaccaggattaggcccagttgcagccgtagctgcacagatgcagcatgttgctgcctttagtttggtcgctgccccgctgcttcccgctgcagcagcaaattccccgccgggaagtggtcccggcacactccccggccttccagctccaattggcgtcaacggttttgggccccttacgccacagaccaacggacagccaggcagcgacacactctataacaacgggctgtcgccttatcccgcacaatccccgggcgtggcagatcccctgcaacaggcgtatgctgggatgcaccactacgccgccgcgtacccatccgcttatgcaccggtttctaccgccttcccccagcagcccagcgccctcccccaacagcagcgcgaggggcccgaggggtgcaacttattcatctatcacctcccccaggaattcggcgatgctgaactaattcagacctttctgcctttcggtgcggtcgtctcggccaaagtgttcgttgatcgtgcaactaatcagtccaagtgttttggctttgtgtcatttgataaccccaccagtgctcagaccgctatacaggcaatgaatggatttcagattgggatgaagagactcaaggtgcagttaaagaggcctaaggatgccaacaggccatattag

SEQ ID NO: 113345 - DNA, 1365 bp, Artificial Sequence
  Description of Artificial Sequence: Synthetic coding sequence
atggctgctgccccggggggcagcgctcagccagcagggccaggcccccggctggggttcagtacggcagacagtggagtaggaatgtcgggcctgaacccaggcccggcggtccccatgaaggatcacgatgctatcaaactgttcgtggggcaaattccccgcggactggatgaacaggacctcaaaccccttttcgaagaattcggccggatttacgagttgaccgtactcaaggacagactcaccggactgcacaaggggtgtgcttttttgacttactgtgccagagacagtgccctgaaagctcaatcggccctccacgaacaaaagactctgcccggaatgaaccggcctatacaagtcaagcccgcggcatccgagggccgcggagaggaccgcaagctgtttgtggggatgctcggaaagcagcagggagaagaggacgtcagaaggctattccaacctttcggccacatcgaggagtgcacagtgcttaggagcccagatgggacaagtaaagggtgcgcctttgtgaagttcggatcccaaggggaggcccaggcggccatccgtggcctccacgggagcaggaccatggccggggcctccagctcactggtcgtgaagttggccgatacagatcgcgaaagggctctccgacggatgcagcaaatggctgggcatctgggtgcttttcatcccgcccctctcccactgggagcttgtggagcctacactactgctatcctgcaacaccaagcggctctgctggctgccgcacaaggcccaggactgggtccggttgctgcagtggcagctcaaatgcagcatgttgctgccttctccttagtcgctgccccccttctacctgcagcagcagccaattccccccctgggtccggtccaggaaccctacccggtctccctgcccccatcggcgtaaacggcttcggacccttgacccctcagaccaacggtcagccagggtcagatacattatataacaacggccttagtccttatccagcccagtctcctggcgtggcagacccacttcagcaggcgtacgccggcatgcatcattacgcaggccccgaaggctgcaatttgttcatttatcacttacctcaggagtttggagatgcagagcttattcaaacctttctccccttcggcgccgttgtgagcgcaaaggtgttcgttgatagggccactaaccaaagcaaatgctttggttttgtctctttcgacaatccaacgtcagctcagaccgccatccaagcaatgaatggattccagattggcatgaaaagactcaaagtgcagctgaaaaggccaaaggatgcaaaccggccctactag

SEQ ID NO: 113346 - DNA, 1029 bp, Artificial Sequence
  Description of Artificial Sequence: Synthetic coding sequence
atgctaggaaagcagcagggtgaagaggacgtgagaaggctctttcagccattcgggcacattgaagaatgcactgtgttacgctcacccgacggaacatccaaaggatgcgcttttgtgaagtttgggagccagggcgaagcgcaggctgccatcagaggactgcacgggtcacggacaatggccggcgcctcatcatcattggtcgtcaaactggccgacactgatcgggagagagccctccggaggatgcagcagatggctggccacctgggggccttccaccccgcccctttgccacttggagcatgcggggcttatactacagccattctccagcaccaggctgcactgctggctgcagcccagggcccaggactgggccctgtggccgccgttgccgcacagatgcagcatgtggctgcttttagcctggttgctgcaccattgctgccagctgccgccgccaattccccaccgggatcaggaccagggactctcccgggcttgccggctcccattggggtcaacggctttggacccctcacaccacaaactaacggccaaccaggaagtgacacactctacaacaacgggctgtctccatacccggctcaatcccctggagtcgctgaccctcttcaacaggcgtacgcagggatgcaccactatgccgcagcctatccaagcgcatacgccccagtatctacggcatttcctcagcagccctctgctctgccgcaacagcagcgggaaggcccggagggctgtaacctgttcatctatcatttaccccaggaatttggcgatgccgagctcatccaaacgttcctgccctttggcgccgtggtgtcagccaaagtgttcgttgatcgtgcgaccaaccagagcaaatgctttgggttcgtatcatttgataaccccacctcagcacagaccgctattcaggccatgaacggatttcaaattgggatgaaacgcctaaaggtgcagctgaaaagacccaaggacgcgaacaggccctattag

SEQ ID NO: 113347 - DNA, 1035 bp, Artificial Sequence
  Description of Artificial Sequence: Synthetic coding sequence
atgaatcgacctatacaggttaagccagccgccagtgagggacggggcgaagataggaaactcttcgtcgggatgcttggcaagcagcagggagaggaggacgtgcgccgcctgttccaaccctttgggcatatcgaggaatgtactgtgctgcgctcacccgacggtacctcaaaggggtgcgcctttgtgaaattcgggagccagggagaggcccaagctgcaatccggggcctgcacgggtcacgcaccatggcaggagcatcctctagtctggtcgtcaaacttgcggacaccgaccgagagcgtgccctgcgcagaatgcagcagatggccgggcacctgggtgcattccacccagctcccctgccattgggcgcctgtggagcctacactacagccattctccagcatcaggcagctctgttagctgctgcacaggggcctggcctgggccccgtagcggccgtcgccgcccaaatgcagcatgtggctgccttcagcctagtggctgcacctcttcttcccgcagctgctaacagcccacctgggtcgggccccggcaccctgccaggcctgcctgctcctatcggtgttaacggattcggtcccctcaccccacagacaaatgggcagccaggctccgataccctgtacaataacgggttgtcaccttaccctgcagcatacccatcagcttacgcacccgtgagcacggcatttccccagcaacccagcgcactaccgcagcagcagcgagagggcccagagggctgtaatctgtttatttaccacctgccccaagaatttggcgatgcagaactgatacagacattcttgcctttcggggcggttgtgtcagccaaagtctttgtcgatcgagcaaccaaccaatctaagtgtttcggatttgttagctttgacaatccgacttccgcacagaccgccattcaggcgatgaacggattccaaattggaatgaagagactaaaggtgcagctgaaacgtcctaaggatgccaacagaccgtattag

SEQ ID NO: 113348 - DNA, 1980 bp, Artificial Sequence
  Description of Artificial Sequence: Synthetic coding sequence
atgctatacaagcagttacggcaggcttgtgaagaccacgtccaagctcagatactgcccttccgcgaagactctttagatagcgtgctcttcttgaaaaagatcaacacttgctggcaggatcactgccggcagatgatcatgatccgctctatattcctctttttggaccggacctacgtcttacaaaactctaccctcccaagtatctgggatatgggtctcgagttatttagaacacacattatcagcgataaaatggtgcagtctaaaaccatcgacgggatcctgctcctgatagagagggagcgaagcggcgaagctgttgataggtcattgcttagatccctcctcggaatgttaagcgatctccaagtgtacaaggatagcttcgaactcaagtttctggaagagaccaactgcttgtatgcagcagagggccagaggttgatgcaggagcgggaggtgccagaatatctgaaccacgtctcaaagcggctggaggaagagggcgaccgggttatcacctatctcgaccattctacgcagaaacctctgattgcctgtgtggaaaagcagctgttgggtgaacatctgactgccattctgcagaagggcctggaccacctgttggatgagaatcgcgtccctgatctcgcgcagatgtatcaactctttagtagagtacgggggggtcagcaggccttactgcaacactggagtgaatatattaaaacattcggaacagctatagtcattaaccctgagaaagacaaagacatggtgcaagacctactggatttcaaggacaaggtcgaccacgtaatcgaagtatgttttcagaagaacgagcgattcgtgaatctaatgaaagagagctttgaaacatttataaacaagcgaccaaacaaacctgcagagctcatagcaaagcatgtagattcaaaactgcgcgctggtaataaggaagccacagacgaggagctcgaacgcacgctggataagataatgatcttattcaggttcatacatggcaaagatgtctttgaggcattctacaaaaaagacctggccaaacgacttcttgttggcaagtcagcgtctgttgacgctgaaaagtcaatgctgagcaagttaaagcacgaatgtggcgccgcgttcacatctaaactggaggggatgtttaaagatatggagctaagtaaggacatcatggttcactttaaacaacatatgcagaaccagtctgattccgggcccatcgatcttaccgtgaacatcctgacgatggggtactggcctacttacacccccatggaagtgcacctcacccccgaaatgatcaaactacaagaagtattcaaagctttctacctcggtaagcactccggacgaaaactgcaatggcaaactactctcggccacgctgtgctaaaggcggagttcaaggagggcaagaaggaattccaggtctctctcttccaaaccttggtcctgctgatgtttaacgaaggggacggcttcagctttgaagagatcaagatggccactggtattgaagatagcgaattaaggcggaccctgcagagtctggcttgtggtaaagcaagggtgctgattaagtctcccaagggcaaggaagttgaagatggcgataagttcatattcaacggcgaattcaaacacaagttgttccggataaagataaatcagatacagatgaaagagacagtcgaagagcaagtaagtacaacggaaagggtctttcaggacagacaatatcaaatcgacgctgcaatcgttaggataatgaagatgcgtaagacactgggtcataaccttcttgtcagcgagctgtataatcagctaaaattccccgttaagcctggagaccttaaaaaacgaatcgagtccctaatcgacagagattatatggaaagagataaagataatcctaaccaatatcattacgtggcatag

SEQ ID NO: 113349 - DNA, 2280 bp, Artificial Sequence
  Description of Artificial Sequence: Synthetic coding sequence
atggccgacgaggccccgcggaaggggtccttttccgccctggtggggcggacgaatggtctgaccaagcccgcagcactggcagcagccccagccaaacctgggggggctgggggcagtaagaagctggttattaaaaactttagagacaggccacgattgccggacaactacacacaagatacatggcggaaacttcacgaggcggtgcgagccgtccaaagctccactagtatccgatacaacctcgaagagctgtaccaggctgtggagaatctgtgcagccataaggtgagtcccatgctgtacaaacaactacggcaagcttgtgaggatcatgtccaggcccagattttacctttccgcgaggactccctggacagcgtgctgttcctgaagaaaattaacacttgttggcaggaccactgccgccagatgatcatgatcagatctatctttctgttcctggaccgcacctatgtgttgcagaactccaccctgccttctatctgggacatgggtcttgaactgtttcgcactcacattatctctgataaaatggtgcagagcaaaactattgacggaatccttttgctgattgaacgagaacgcagcggggaagccgtcgaccgcagcttattgagaagtttgctcggaatgctgtcagaccttcaggtgtataaagactcgtttgaactcaagtttctcgaagagacaaattgcctctatgcagccgagggccagcgcctgatgcaagaacgggaagtgcccgagtacctgaaccatgtgtctaagcgcctggaagaagagggggatagggtgatcacctacctggatcactccactcaaaagcctctcattgcatgcgtcgagaagcaactgttgggagaacacctgacagctattcttcagaagggactggatcacctcctggatgagaatagagtcccagacctggctcaaatgtaccagctttttagcagagtgcgcggcgggcagcaggcactgctgcagcattggtccgagtatatcaagacattcgggaccgctattgtcatcaaccctgagaaagataaggatatggtccaggatctacttgactttaaggataaagttgaccacgtgatcgaggtctgctttcaaaaaaacgaaagatttgtgaacctgatgaaggagagttttgaaacctttattaacaagcgaccaaataagcccgcagaactgatcgccaagcacgttgacagtaaactcagggcaggcaacaaggaggccacggacgaggagctcgagagaactctcgataaaataatgatacttttcaggtttatacacggtaaagacgtctttgaagctttctataagaaagacctggccaagcggcttctggtcggcaagagtgcgtctgtagatgccgagaagtctatgttaagcaaattgaaacatgaatgtggtgccgcattcacttcaaaactcgaaggaatgtttaaagacatggaactgtccaaggatatcatggtgcatttcaaacaacacatgcagaatcagagcgactcaggcccaattgacctgactgtcaatatcctaacaatggggtactggcccacctatacccctatggaagtccacctcacaccagaaatgataaagctgcaggaagtgttcaaagctttctatcttgggaagcacagcggaaggaagctgcagtggcagactacactcgggcatgccgtgttaaaagctgaattcaaagagggcaagaaggagtttcaggtgagtctttttcagacactagtccttctgatgttcaatgagggtgacggtttttctttcgaagagatcaaaatggccaccggtattgaggatagcgaacttagaagaacgctacagagcctggcatgtggcaaggccagggtgctgatcaaatctcccaagggtaaagaagttgaagacggtgataaatttatcttcaatggagagtttaagcataaactattccggatcaagataaatcagattcagatgaaggaaacagtagaagaacaggtgagcaccactgaaagggtgtttcaggaccgccagtaccaaattgacgccgccattgtcaggatcatgaaaatgcgtaagacactcggccataatctgctagtaagcgaattatataatcagctgaagtttccagtgaaaccgggcgacctaaagaaacggatagagagtctgatcgacagggattatatggaacgggataaagacaaccctaatcagtatcattacgtggcctag

SEQ ID NO: 113350 - DNA, 1980 bp, Artificial Sequence
  Description of Artificial Sequence: Synthetic coding sequence
atgctgtacaaacaactgagacaagcttgcgaagaccatgtgcaggcccagatacttccttttagggaggatagtttggacagcgtcttgtttctgaagaagatcaacacatgctggcaggatcattgccggcagatgatcatgatcagatccatattcttattcctggacagaacgtatgtgctgcaaaatagcacgctgccatcaatctgggacatgggcctggagttatttagaactcacattattagcgataagatggttcagtctaaaaccatcgatggcatccttcttttaatcgagagggagcgctctggagaagcggtcgatcgcagtctgctgcggagccttctaggtatgctctcggacttgcaggtatataaggattccttcgagctcaagttcttagaggagacaaattgtctgtacgcagcagaagggcaacgcctgatgcaggaaagggaagtacctgagtatttaaaccatgtgtccaaacgcctggaagaagagggcgaccgggtgattacatatcttgatcactccacccagaagcctcttattgcctgcgtcgagaaacaactgctgggggaacatctgactgccatactgcagaaagggctcgaccacctgctcgacgaaaacagggtccctgaccttgcacagatgtaccagcttttttcacgcgtgcgcggaggacagcaggcactactgcagcattggagcgagtacatcaagacttttggtaccgccatcgtaatcaatccagagaaagacaaggacatggtacaagatctccttgacttcaaagacaaggtcgaccacgttatcgaagtgtgcttccaaaagaatgaaaggttcgtgaacttaatgaaagaaagcttcgaaacctttatcaataagcgtcctaataagcccgctgagttgatcgccaaacacgtagatagcaagctgcgggcggggaacaaggaggctactgatgaagaattagaacgtaccctcgacaagataatgattctgttccggttcatacacggcaaggacgtgtttgaagctttttataaaaaagatctggctaagcgcctgctggtggggaagtccgcaagcgtggacgctgagaagagtatgttaagcaagctgaaacatgagtgcggggcggcctttaccagtaaacttgaggggatgttcaaggatatggagttgagcaaagacatcatggtgcacttcaagcagcacatgcaaaaccagtccgacagcggacccattgatctgactgttaatatattgacaatgggctactggccgacctatactccaatggaagtgcatctcacaccagaaatgattaagctccaggaggtgtttaaagcattttatctgggcaaacattcaggtagaaagcttcagtggcagaccacgcttggccatgccgtgcttaaggctgagtttaaagaggggaaaaaagagtttcaggtgagcctctttcaaaccttggtgctcctgatgttcaacgaaggagatggcttttctttcgaggaaatcaaaatggctaccggaatagaggactctgagttacgacgcaccctgcagtccttggcatgcggaaaggctcgggtcctgatcaaatcacccaaagggaaggaggttgaggacggagataagttcattttcaatggagaatttaaacacaaactgtttaggattaagattaatcaaattcagatgaaagaaactgtggaagagcaagtgtcaactacagaacgagtgttccaggataggcagtatcagatcgatgctgcaatcgtccgcataatgaaaatgcggaaaactctgggacataatttactcgtgtcagaattgtataaccagctgaagtttcctgtgaagcctggcgacctgaaaaagaggattgagtctctgatagaccgggactacatggagagagacaaggataatccaaatcagtaccattacgtcgcctag

SEQ ID NO: 113351 - DNA, 1980 bp, Artificial Sequence
  Description of Artificial Sequence: Synthetic coding sequence
atgctttataagcaactccgtcaggcctgcgaggaccatgttcaggcgcagatcttgccattcagggaagattctcttgattctgtgttgttcctgaaaaagattaatacctgctggcaggaccactgccgtcagatgataatgattcgtagcatttttcttttcttggatagaacatacgtgctccagaacagcactctgccaagcatatgggatatgggactggagctctttagaacccatataatatctgacaaaatggtccagtcgaaaacgatcgacggcatccttcttctgattgagagagaacgctctggcgaggcagttgacagaagcttgctaaggtcccttctgggtatgctctccgatctgcaggtctacaaggactcttttgaattgaaatttctggaggagacaaattgcctgtatgctgcagagggtcagcgacttatgcaagaacgagaggtaccagaatacctcaatcacgtgagtaagcgcttggaagaggagggcgacagggttatcacctacttagatcattccacacagaaaccgttgatcgcatgcgtggagaagcagctgttgggagaacaccttaccgctatactgcagaaaggtctggaccatctcttggacgaaaaccgggtgcccgatctggcccagatgtatcaactgttttctcgggtgagagggggtcaacaggcgctcctgcagcattggagcgagtatattaagacttttggaactgcaatcgtcatcaacccagagaaggacaaggacatggtccaggacctgctggatttcaaagacaaggtcgaccacgtcattgaggtgtgcttccagaagaatgaacggttcgtcaacctcatgaaagagagctttgaaacattcattaacaaaaggcccaacaaacctgccgaacttattgcaaaacatgtggacagtaagctgcgggccggcaataaggaagccacagacgaggagctcgagagaacactcgataagatcatgatactgtttcgcttcatccatgggaaagatgtttttgaagctttttataagaaggacctcgcaaaacggctgctggtggggaaatccgctagcgtcgacgccgagaagtcaatgctgagcaaacttaaacacgagtgcggtgctgccttcacatcaaaactcgaaggaatgttcaaagacatggagctgtccaaagatataatggtgcactttaaacagcacatgcagaatcagtcagattctggaccaattgatctgactgtgaatatcttgacaatgggctactggcccacgtacacccccatggaagtgcaccttactcctgaaatgataaagctacaggaggtgttcaaagccttttatttagggaaacatagtggccgcaagctccagtggcagacaacactgggccatgccgtcctgaaagccgagtttaaggagggcaagaaagagtttcaggtctccctcttccagactctggtacttcttatgtttaacgaaggtgatggattctcctttgaagaaataaagatggccacgggaatagaggatagcgagctgcggaggactctgcagagtctggcgtgcggtaaagcccgggtgttaataaagagtcctaaaggcaaggaggttgaggacggcgacaagttcatctttaacggtgagttcaagcataagttgtttcgtattaaaattaatcagattcagatgaaggaaaccgtggaagagcaggtgtccacgaccgaacgtgtattccaagataggcagtaccagatagacgcggccatagtgcgtatcatgaaaatgaggaagaccctgggacataatctgctggttagcgagttgtataatcagttgaagtttcctgttaagccaggggacctgaagaagagaatcgaaagtctgatcgatcgagactacatggaaagggataaggacaatcctaatcaatatcattatgtggcatag

SEQ ID NO: 113352 - DNA, 2703 bp, Artificial Sequence
  Description of Artificial Sequence: Synthetic coding sequence
atgaagagcgtgtgccctgtgacttcaggatttagcagccctagtccctcagccgccgccgctgcgcaggaagtcagatcagcaactgacggtaatacctccaccactccacccactagcgcaaaaaaaaggaaactgaatagttccagttcgtcctcctctaatagctccaacgaacgcgaggattttgactcgacctcgagttcgagcagcacgccccccctgcagcctcgggactctgcaagccccagcaccagctcattctgccttggagttagcgtggcggcatccagccacgtgcctattcagaagaagcttcggttcgaagatacgctggagttcgtcgggttcgacgcaaagatggccgaggaatcctccagttccagcagctccagctccccaaccgccgcgacctcacaacagcagcagctcaagaacaaatccattctaatttctagcgtggcgtctgtgcaccacgctaatggactggcaaaatcttccaccaccgtttcatcttttgcaaactcaaagcctggatctgctaaaaagttggtgataaagaacttcaaggacaagcccaaactccctgaaaactacaccgatgaaacctggcagaagttgaaagaggctgttgaggccatccaaaatagcacttctataaagtacaacttagaagaactctaccaagccgtggagaacctgtgctcctacaaaattagcgccaatttgtacaaacagctgcgccagatctgtgaggaccacattaaggcccagattcaccagtttcgagaagactctctcgattccgtgctgttcctaaaaaagattgaccggtgttggcaaaatcactgccggcaaatgattatgattcggtctatattcctgtttttggatcgcacatatgtgcttcagaactcgatgctaccctctatctgggacatgggcctcgaactctttcgcgcccacattattagcgaccagaaagtccagaataaaactatagacggcatactgctcctaattgagagggaacggaatggcgaagcgattgatcggtccctgctgagatctctgctcagtatgttaagcgatttacagatataccaggactctttcgagcaacggtttttggaagagactaaccgcctgtatgccgccgaggggcagaaactgatgcaggagcgtgaagtgccggagtacctgcaccatgtgaacaaacgcctcgaagaggaggcagacagattgataacgtacctcgaccagaccacacagaagagtttaatcgcaaccgtagagaagcagctcctgggggagcatctaaccgccattttacagaaaggtttgaacaatctattagacgaaaatcgcattcaggatctcagtctcttatatcaacttttttcgcgcgtgcgcggcggggttcaggtcctgctgcagcagtggatcgagtacataaaggccttcggcagtactatagttatcaaccccgagaaagacaagacaatggtgcaggagttgcttgacttcaaggacaaggtggaccacattatcgatatttgttttctcaagaacgaaaaatttatcaatgctatgaaggaggcctttgaaacattcataaataagaggcctaataagccggcggagctgatcgcgaagtacgttgatagcaagttgcgcgctggcaataaggaagcaaccgacgaggaactggagaagatgctggacaaaatcatgatcatctttaggtttatctacggcaaagacgtgtttgaggcattttataagaaagatctggctaagagactactggtcggaaagagcgcctcagtggatgctgaaaagtcaatgctctcaaaattgaaacacgaatgtggcgccgccttcacctctaaattggagggaatgttcaaagacatggagctcagcaaggatatcatgatccagttcaaacagtatatgcagaaccaaaacgtccccggcaatatcgaactgacagtcaacattctgacaatgggctactggcccacctatgtgcctatggaggtccacctcccccctgagatggtgaaactgcaggaaatcttcaaaacattctatctggggaagcatagcggcaggaagctgcagtggcaaagcactctcgggcactgcgtcctgaaagcggagttcaaggagggaaaaaaagaactccaggtaagtctatttcagacattggtgttgttgatgtttaatgagggtgaagagttctctctggaagagatcaaacaggctactggaattgaggacggggaactgaggcggacactgcagtccctggcttgtggcaaggctcgcgtgcttgccaaaaatccaaaaggaaaggatattgaggacggcgacaagttcatctgcaatgacgatttcaagcataagttgtttcgaattaaaataaaccaaatccagatgaaggaaacagttgaagaacaggccagcaccacggaacgagtatttcaggatcgccagtaccagatagacgcagccattgtgcggatcatgaagatgcgcaagactctatctcataacctgctggtgtcagaggtgtataatcaattgaagtttccagtaaaacctgctgatttgaagaagcggatcgagtctctaatagatagagactacatggagcgagataaggagaaccctaaccagtacaactatatcgcctag

SEQ ID NO: 113353 - DNA, 2688 bp, Artificial Sequence
  Description of Artificial Sequence: Synthetic coding sequence
atgtttcccaccgggttcagctccccttctccttctgccgccgctgcagcccaggaggtacggtcggctacagatggcaacacatcgaccacgccccccacctctgccaagaaacggaagctgaacagctctagtagcagctccagcaatagctccaatgaaagagaagacttcgacagcacgagttccagtagcagtaccccacctctacagcctagggacagcgctagtccatccactagctctttttgcctgggcgtttccgttgccgcctccagccacgtgcctatccagaagaaattgcggttcgaggacaccttggaatttgtgggattcgatgccaaaatggcagaagagtcttccagctctagctctagcagttcgcccactgctgccacatcccagcagcaacagctgaaaaacaagagcatcctgatctcatcagtcgccagcgtgcaccacgccaacggcctggccaaatcctcaacaacggtttccagtttcgcaaattccaaaccaggttccgcaaagaaactagtgatcaaaaactttaaggacaaaccgaaactccctgaaaactacacagacgaaacatggcaaaagctgaaggaggctgtggaagccattcagaatagcactagtattaaatataacctggaggagctttatcaagcggtggagaacctgtgttcttataaaatctcagccaacctatacaaacagctgcgtcagatatgcgaggatcacattaaggcacaaattcatcagtttagggaagactcgctggactcggtgctttttctgaagaagatagaccgctgttggcaaaatcactgtagacaaatgatcatgattcgaagcatcttccttttccttgaccgaacttatgtgctacaaaattccatgctcccttcaatctgggatatgggcttagagctgtttcgggcacatattatcagtgaccagaaggtccagaacaagacgatcgacgggatacttcttttgatagagagggagcgaaatggggaggctatcgaccggagtctgctgaggagcctcctgtcaatgctcagcgacctccagatataccaggatagctttgaacaaagatttttggaggagacgaatcggctctacgcagcagagggtcaaaagctaatgcaggagagagaagtacctgaatacctccatcatgtgaacaaaagacttgaagaagaggctgacagattgattacctatctggatcagacaactcagaaatcactcatagctaccgtggagaaacaattgcttggagagcaccttaccgccatcctgcagaaagggctcaataaccttttggacgagaaccggatccaagacctctctctcctataccagctgttttctcgtgtccgaggtggagtacaggttcttctgcagcaatggattgaatatatcaaagcattcggcagcactatcgtgattaatcccgagaaggacaagaccatggttcaggagctgctggatttcaaggacaaagtggaccacattatcgatatctgcttcctcaaaaacgagaagttcatcaatgccatgaaggaggcatttgagactttcattaacaagcggccaaataaaccggcagagcttattgcgaaatatgtagattctaagcttcgggctgggaacaaagaagccactgatgaagagttggagaagatgctggataaaatcatgatcatctttagatttatatatggtaaagatgttttcgaagcattctacaagaaggatctcgccaagcgcctgctggtagggaaatcggcaagcgtggacgcagaaaagtcgatgctcagtaaactaaagcacgagtgcggagcagccttcacttccaagcttgaaggtatgttcaaagatatggaattaagtaaagatatcatgatacagttcaagcaatacatgcagaaccagaacgtcccgggcaacattgagctgaccgtaaacatcttaacaatgggttactggcccacctatgtcccaatggaggtgcatctgccacctgagatggttaaattgcaggaaatcttcaagacattctatttgggcaaacatagtgggaggaagcttcagtggcaatctactttgggacactgtgtgttgaaggctgagtttaaagagggcaagaaggagctccaagtctcacttttccagaccctggtgctgcttatgttcaacgagggcgaagaattctctttagaagaaataaagcaggccacggggattgaggacggtgagcttaggcggacgctgcagtcattggcatgcggtaaagccagggtgctggctaaaaatcccaagggcaaggacattgaggacggggacaagttcatttgcaacgatgacttcaaacacaaattatttagaattaagataaatcagatccagatgaaagagacagtagaggagcaagccagcaccacagaaagagtgtttcaggatcggcaataccaaatcgacgctgccatagtgcggatcatgaagatgagaaagacattgagccacaacctgctggtttccgaggtctacaaccagctcaagttcccggtgaagccagctgacctgaaaaagagaatcgaatccttgatagaccgcgactacatggagcgggataaagaaaatcctaaccaatataactatatcgcgtag

SEQ ID NO: 113354 - DNA, 705 bp, Artificial Sequence
  Description of Artificial Sequence: Synthetic coding sequence
atgattgatccagacttcgcggataagcccaaactgcccgagaactacaccgatgaaacctggcaaaagcttaaggaggctgttgaggctattcagaatagcacatcaattaagtataacctcgaggagttatatcaggctgttgagaatctgtgtagctacaagatctccgctaacctgtacaaacagctgaggcagatctgtgaagaccatataaaagctcaaatccatcagtttagagaggactcccttgactcagtgttgtttctcaagaagatcgataggtgctggcagaaccattgtaggcagatgatcatgattcgctccatttttctcttcttggatcgcacatacgtcctgcaaaactctatgctgccgagcatatgggatatgggtctcgagttgtttcgagctcacatcatctccgatcaaaaagtgcagaacaagacaatagacggtattctgctgctgatcgagagagaacgtaacggggaagcaattgacaggagtctgttacggtcactccttagtatgctgtcagacctgcaaatctaccaggattcgtttgagcagcgctttcttgaggagaccaaccgactgtacgctgccgagggtcagaagttaatgcaggagcgggaggtccccgagtatttacatcacgtgaataaaagactggaagaggaggcagataggctcataacatag

SEQ ID NO: 113355 - DNA, 2742 bp, Artificial Sequence
  Description of Artificial Sequence: Synthetic coding sequence
atgatgtcacagagcagcgggtccggcgatggaaacgatgatgaagccacaacttccaaagacgggggcttctcctcccctagtcccagcgccgctgcagccgcgcaggaagtcagaagcgccactgatggaaacacgtctaccactccccctactagtgctaaaaagaggaaacttaattcctccagcagcagcagtagcaactcgagtaacgagcgagaggatttcgactctacctccagttcatcttccactccacctctacaacctcgtgacagtgcctctccaagcacgtcctccttctgcctgggagtgagtgtggccgcgtcttcccacgtccctatccagaagaagctgagattcgaggacacgctggagtttgtgggcttcgacgccaaaatggcggaggaaagttcgagctcctcaagcagctcttcccccacggcggctacttcacagcagcagcaactaaaaaacaagtctatactgatttcgagcgttgcatcggtgcatcacgcgaatgggttagcaaaatcatcgaccacagtgtctagcttcgccaacagtaaaccaggaagcgccaaaaaactcgttatcaaaaattttaaggataaaccaaagctgccggaaaattataccgacgagacctggcagaagctcaaggaggctgtcgaagccatacagaattccacaagcatcaagtacaacttggaggagctgtaccaagcagtggaaaacctgtgttcttataaaatttccgccaatctttacaaacagctgagacagatctgcgaggaccacatcaaggcgcagatccaccaatttcgggaggacagcctggattcagtgttattcttgaagaagattgaccgatgctggcaaaaccactgccgccagatgattatgatccggtccatattcttgtttctagacaggacatatgtgctgcagaatagcatgctcccatccatctgggatatggggctggagctgttccgggcccatattatcagcgaccaaaaggtgcagaataagaccattgacggcattcttctgctgattgagagggagagaaatggtgaggccattgataggagcctacttagaagcctcttgagcatgctgtcagatctacagatataccaggactcgttcgagcaacgcttcctggaagagactaatcgactgtacgccgcggagggccaaaagctcatgcaagagcgtgaggtgccagagtacctgcaccatgtgaataaacgcctggaggaagaggccgatcggttaatcacatatctggaccaaaccactcagaaatccctcattgctacggtggagaagcagctcctgggggaacatcttacagccattctccagaaaggcttgaacaatctgttggatgagaaccggatccaggacctgtccttgctttatcaattgttcagcagggtgcgtgggggtgtacaggttctgctacagcagtggatcgagtacattaaggcttttggatctacgatcgtcattaacccagagaaagataagaccatggtccaggaattgctggatttcaaggacaaggtggaccacattattgatatttgtttcctgaagaacgagaaattcataaatgcaatgaaggaagcttttgaaacttttataaacaaacgcccgaataagcccgccgaactgattgctaagtatgtcgactcaaaactcagggccggaaacaaggaagcaaccgacgaggaacttgaaaaaatgttggacaaaatcatgatcatctttcggttcatctatggtaaggatgtatttgaggccttctataaaaaggatttggctaaaagactgttagtgggcaaatcagctagcgttgacgcagaaaagtccatgctaagtaaactcaaacatgagtgcggcgctgcctttacaagtaagctggagggcatgttcaaagacatggaattaagtaaggacattatgatccaatttaaacaatacatgcagaaccagaatgtccccggcaatatcgagctaactgtcaacatcttgactatgggatattggcctacctatgtacccatggaagtgcacctgccaccagagatggtcaaattgcaggaaatcttcaagactttttacttgggaaagcactccgggcgcaaacttcaatggcagtccacactgggccattgcgtactgaaggcggagttcaaggaagggaaaaaagaactgcaggtcagcctatttcagactctggtgctcctgatgttcaacgaaggagaagaattcagcttggaagagattaaacaggcaaccggtattgaggatggggagctgcgaaggactcttcagtcactggcctgtggaaaagcccgggtcctggcgaaaaaccccaaggggaaggacatagaagatggggataagtttatctgcaatgatgactttaagcataaactctttcgaataaaaataaaccaaattcagatgaaggagaccgtagaggagcaggctagcacaaccgagcgagtctttcaagaccgacagtaccagatagacgccgccattgtcagaattatgaagatgaggaaaacattgtcgcacaatctgcttgtcagtgaggtgtataatcaactgaagtttcctgtcaagccagccgacctcaaaaagagaattgagagccttattgacagggattacatggaaagggacaaggagaatccaaaccagtataactatatagcttag

SEQ ID NO: 113356 - DNA, 2343 bp, Artificial Sequence
  Description of Artificial Sequence: Synthetic coding sequence
atggccacgtcaaacctgctaaagaataaaggctcattgcagtttgaggacaagtgggactttatgaggcctatcgtgctcaaacttttgcgccaagagtctgtgaccaagcagcaatggtttgacctgttctcagatgtacacgctgtatgcctgtgggacgataaagggccagccaaaatccaccaagcccttaaggaagatattctggagttcattaaacaggcccaggcccgggtcctaagccatcaggatgataccgccctgctgaaagcctatattgtagaatggaggaaattttttacacagtgcgacatcctgccgaagcctttttgccagttggaaattacgcttatgggaaagcagggcagtaacaagaaatctaacgtggaggactccattgttcgcaagctgatgcttgacacctggaatgaatcaatcttctctaacatcaagaatcgattgcaggacagcgcaatgaaactggttcacgcagagcgcctgggagaagctttcgattcacaactggttattggagttagagagagctacgttaacctctgctccaacccggaggataaattgcagatttatagggacaacttcgaaaaagcctacttggattctactgagagattctacaggacccaggccccatcctacctacagcaaaacggggtgcagaattacatgaagtacgctgacgctaagctcaaagaagaggaaaagagggcactgcgctacctggagaccaggcgggagtgcaatagtgtggaggctcttatggagtgctgcgttaatgccctggtcacaagcttcaaagagacaattctggccgagtgtcaaggcatgattaaaagaaatgagaccgaaaagttgcacctaatgttctctctgatggacaaggtgcccaatggaattgagccgatgctcaaggatctggaggaacacatcattagtgctgggttagctgacatggtggcagctgccgagactatcacaactgatagcgagaagtacgttgagcagttgctgaccctatttaacaggttttcaaagctcgtcaaggaagcctttcaggatgacccccgttttcttactgccagagacaaggcatacaaggctgtggtcaatgatgccactatcttcaaactcgagttgccactgaaacagaaaggggtcggcctgaagacgcaacccgaatccaaatgcccggagcttctggccaattattgcgatatgcttttacggaaaacccctttatccaagaaactgacgtctgaggagatagaagctaagctgaaagaagtgctgctggttttgaagtacgtgcaaaacaaagatgtgttcatgaggtatcacaaggcccacttgacccgacgattaattctcgacatatctgcggattctgagatcgaagaaaatatggtggagtggctgagagaggtcggaatgcctgccgactatgtcaacaagttagcacggatgtttcaggacataaaagtgtcagaggatcttaaccaggctttcaaagaaatgcacaagaacaacaaactggccttgccagctgactccgtcaatatcaaaatcctgaatgccggcgcttggtcacggagttccgaaaaagtattcgtctcccttccaactgaactggaggacctcatcccggaggttgaggagttttataagaagaaccacagcggccgcaagctgcattggcatcacctgatgagcaacggcatcatcacctttaagaacgaggtgggtcagtacgacctagaggtcactaccttccagcttgccgtgttgtttgcttggaaccaacgtccacgggaaaagatcagcttcgaaaatctgaaactggctaccgaactgccagatgccgaattgcgtcgaacgttgtggagcctggtggccttccctaagctcaagcgtcaggttctcctgtacgaaccacaggtgaatagccctaaggattttaccgagggcacccttttctccgtgaaccaggaattctcactcattaagaacgccaaagttcagaaacgtggcaaaatcaacttaatcggtagactccaactaacgactgagcggatgagggaagaagagaatgagggaatcgtccaactccggattttgcgtacccaggaggccatcatacagattatgaaaatgaggaagaagatctctaacgcacagttgcaaacagaactggtggagatcctaaaaaatatgttcctgccacagaagaagatgatcaaagagcaaattgagtggctgattgagcacaagtacatcaggagggacgagagcgatattaatactttcatctatatggcttag

SEQ ID NO: 113357 - DNA, 2343 bp, Artificial Sequence
  Description of Artificial Sequence: Synthetic coding sequence
atggcgactagtaatctgttaaaaaacaaaggttcgctgcaattcgaggacaaatgggacttcatgcgccccatagttctgaagctgttgcgtcaggaatcggttacgaaacagcaatggtttgacctgttttctgatgtgcacgctgtttgtctgtgggacgacaaagggccggcaaaaatacaccaggcattgaaagaggacatcttggagttcatcaagcaggcacaagcgagagtattgtcccaccaggacgacacagctctgctgaaggcctatattgtagaatggaggaagttctttacacagtgcgacatcctccccaagcccttctgtcagctggaaataactcttatgggaaagcaaggttcaaataaaaagtccaacgtggaagatagcatagttcgtaaactgatgttagatacctggaacgagagcattttttctaatatcaagaaccgtctccaagatagcgcaatgaaactggtccacgccgagcgactgggtgaagctttcgactctcagctggtgattggcgtgagagagagttatgtcaacctttgttctaaccccgaggataagttgcagatttatagggacaactttgaaaaggcctatctggactccactgaacgattttatcgtacccaagcgcccagttatctccagcagaacggagtgcagaattatatgaaatacgccgatgccaagctgaaagaggaggaaaagagggccttgaggtatcttgaaacccgtcgggagtgtaatagtgtggaggctttgatggagtgttgcgtgaatgcgctggtaacaagcttcaaagagacaattctagcagagtgccagggaatgatcaagcggaatgaaactgagaaactgcatctgatgttcagcctcatggataaagtgccaaacggcatcgagccaatgctgaaggacctcgaagaacacattattagtgctggtctggcggacatggttgctgcagctgaaacaattactacagactcagaaaaatacgttgagcagttattgacattgtttaaccgatttagcaagctggtcaaggaagcatttcaggacgatccccggtttctgacggccagggataaggcctacaaggcggtggtcaacgacgctacaatcttcaagttggaactgcctctgaagcaaaaaggtgttggcctcaaaacacagccggaatctaaatgccctgaactgttagcaaattattgtgacatgctgctgagaaaaacacctcttagcaagaagctgacgagcgaggagatcgaagcaaagcttaaagaggtcctcctcgtcttgaaatatgttcagaacaaggacgtcttcatgagatatcacaaggctcatctgaccaggcgacttatcctggatatctcagcagactcagaaatagaggagaacatggtggagtggttgcgtgaggtgggcatgcctgccgactacgtcaataagctggctcggatgtttcaggatataaaggtgagtgaggatctgaaccaagccttcaaggaaatgcataaaaataacaagctggccctgcccgccgatagtgtgaacatcaaaattctcaatgcaggcgcttggtcccggtcaagtgagaaagtgttcgtgagcctgcctaccgagttggaggatctgattcctgaagttgaagaattttataagaaaaatcattccggcagaaagttgcattggcaccacctgatgagcaacggtataattactttcaagaatgaagttggacagtacgatctggaggtgaccaccttccagctggccgtgctgtttgcttggaatcaacgaccccgggaaaaaatttcatttgagaacctgaaactcgctactgagctgccagatgcggagctccgtcgcaccctgtggtccctggtagcatttcctaagctcaagagacaggtgctactatatgagcctcaggtgaatagtcctaaggatttcacggaaggcacacttttttctgttaaccaggagttcagtctgatcaagaatgcgaaggttcaaaaacgagggaagatcaaccttatcgggaggctgcagttgaccacagagaggatgcgggaggaggaaaatgagggaattgtgcaactgcgtattctgagaacacaggaagcaatcatacaaataatgaagatgaggaagaagatcagcaacgctcagcttcagaccgagcttgtggagattttaaaaaatatgtttttgcctcagaaaaaaatgatcaaggaacagatcgagtggctgatcgagcacaaatacattcgccgcgatgaaagtgacattaatacctttatctacatggcgtag

SEQ ID NO: 113358 - DNA, 5097 bp, Artificial Sequence
  Description of Artificial Sequence: Synthetic coding sequence
atggtcggtgagcttagataccgggaattcagagtacctcttggtccaggactccacgcttaccctgacgagctcatccgccagcgggtgggacatgatgggcacccggagtaccagataagatggttaatattgaggaggggagacgaaggggacggagggtcaggtcaggtggactgcaaagccgagcacattctgctgtggatgtctaaagatgagatctacgccaactgccacaagatgttgggcgaggatggccaggttattggcccctctcaagaatccgccggtgaagtaggagccctggacaaatccgtgctggaagaaatggaaactgacgtgaagagtttaattcagagggcgcttagacaattggaagaatgcgttgggacaattccccccgcccctctcctgcataccgtgcatgtcttgagtgcttatgcatcaatcgagcctctgacgggggtgttcaaggatcccagagtgcttgacttgctgatgcacatgctgtccagccctgactatcagattagatggtcagcgggcaggatgatccaagcactgtcaagccacgacgccggcaccaggactcagatcctgctgtctcttagccagcaggaggcaattgaaaaacacctggactttgactcccggtgtgcactgttagccctgtttgctcaggcgaccctgtcagagcatccgatgagctttgagggcatccagttaccacaagtacctgggagggtgctgttctcactggtgaagaggtatctgcacgttacatcactactggatcagctaaacgattcggcagctgaacctggcgcccagaatacatcagctcccgaggagctcagtggggagcgggggcagctcgaactcgagttttctatggccatgggaacgctgatttctgagctggtgcaggcaatgagatgggaccaggccagcgacaggccccgttccagcgcccggtcgcctgggagcattttccaaccgcagcttgcagacgtgtcacccggtttaccagctgcccaagcacagcccagctttagacgtagccggcgcttccgtccaaggtccgagttcgccagcggtaacacttatgctctgtatgtgagggacacccttcagcctggcatgcgggtaaggatgctcgatgattacgaagagataagcgccggcgacgagggagagttcagacagtccaacaacggcgtaccacctgtgcaggtgttctgggagtctaccgggcgcacttattgggtacactggcatatgctggagattttgggattcgaggaggacattgaggatatggtggaagcggacgaatatcagggagcagtagcgtccagagtactaggtcgtgctctcccagcatggcgctggcggcctatgacggagctgtacgccgtgccatatgtgcttcccgaggatgaagataccgaagaatgcgaacacctcacattagccgaatggtgggagttgctgttcttcataaagaagctggacgggcccgaccatcaggaagttttgcagatcctacaagaaaatctggacggtgagattctcgatgatgagatactcgcagaactggccgtgccaattgagcttgcacaagacctgctcctgacactgccacagcggctaaacgattccgccctgagggatctcataaactgccacgtgtacaaaaagtacgggcccgaggccctggccggcaaccaggcctatcctagtctactggaggctcaggaagatgtcttgcttctggacgctcaagcccaggcgaaagatagcgaagatgccgccaaggttgaggccaaggagccaccgtcccaaagtccaaacacaccccttcagcggctggttgagggatatggtcccgccggtaaaattctgctcgatctggagcaagccctgtcttcggagggaacgcaggagaataaggtaaagcccctgcttcttcaacttcagaggcaacctcagcctttcctcgcccttatgcagagcctagacacaccagagaccaaccggaccctccacctgactgtactgagaatcctcaagcagctggtggactttccagaagcccttcttttgccatggcatgaggcagttgatgcttgcatggcatgccttcgatcccctaatactgacagagaagtcctgcaggaattaatcttctttctccatcgactcacatcggtgagtcgggactatgcagtcgtgctcaaccagcttggagctcgggatgcaataagcaaagctctcgagaaacatctgggaaagcttgagctggctcaagaattaagggacatggtgtttaagtgcgagaagcatgcccatttatatcggaaattgatcactaatatactcggagggtgcatccagatggtgttaggccagattgaagatcaccgacggacgcatcagccaattaatattccgttttttgatgtgtttcttcgctacctctgccaaggttcttccgtggaagtgaaggaagacaagtgctgggaaaaagttgaagtttcgagtaaccctcaccgggcctcgaaactgaccgatcataatcctaaaacctactgggagtctaatgggagtgccggctcgcattacattactcttcacatgcgccgcggcatcttaatacgccagctaaccctgttggtagctagcgaagactccagctatatgcccgcaagggtagtggtatgcggcggggactcaactagcagcctccacaccgaattgaactctgtgaacgtcatgccaagcgcctcacgggtaatcttgctggagaacctgactcgcttttggcctattatccagatacggatcaaacggtgtcagcaagggggtattgacacccgcatccgagggcttgagatcttgggtcctaagccaaccttctggccggtttttcgagagcagctgtgccgtcatactcgccttttttatatggtcagagctcaggcctggtcacaggatatggccgaggacagacggtcactcttacatttatcttcccgtctgaatggagctttgaggcaagaacagaactttgctgacagattcctgccagacgatgaggcggctcaagccttaggaaaaacatgttgggaggctttggtcagcccggttgtccaaaatatcacgagtccagacgaggacggcattagccctctagggtggttgctcgatcagtatttggagtgtcaggaggcagtcttcaacccccaaagcagagggcctgccttctttagcagggttagacggctaactcaccttttagttcatgtggagccttgtgaggctcctccccctgttgtggccaccccacgacccaaggggcgtaaccgctcccacgattggagtagcctcgcaacccgcggcctccccagcagcattatgcgaaacttgacgcggtgctggagggccgtggtcgagaaacaagttaacaacttcctgacaagctcctggcgggacgatgacttcgtccctcggtactgcgagcactttaatatcctccagaacagttcatcagaactcttcgggcctcgggcggccttcctgctcgccctgcagaatggctgcgctggtgccctcctgaagcttccatttttgaaggctgcccatgtttccgagcaatttgcccgccatatcgatcagcagattcaggggtccagaattggcggcgcgcaggagatggaaagactcgcacagctccagcagtgtctgcaggcggtgctgatattctcagggttggaaattgcaacaacctttgaacactactaccaacattacatggctgataggctactgggagtggtatcctcctggcttgagggggcggtcttagaacagatcggaccctgctttccgaatcgtctgccacagcagatgctccagtccctgtccactagtaaggaactccagaggcagtttcacgtttaccagttgcagcaactggaccaagagctgctcaagctagaagatacggagaaaaaaattcaagtgggcctcggcgcctctggaaaggaacataagtcagaaaaggaggaagaggccggagccgcagcagtggtagatgtggcggagggcgaggaggaggaggaggaaaacgaggacttgtactatgagggggctatgccagaggtcagcgtcctcgtgttgtctcgtcatagctggccagtcgcctctatctgtcataccctgaaccctcggacgtgtctgccctcctaccttagggggacattgaataggtactctaatttttacaataagtctcagagccaccccgctctggagagaggctctcagagacgtctgcagtggacctggttgggctgggctgagctgcaatttggcaatcagacacttcacgttagcacagtccagatgtggctgctcctgtatctaaacgatctgaaggcagtctccgtggaatccctcttagcctttagcggactgtctgccgatatgctgaatcaagcaattggacccttgacatcctctagaggtcctttagatctgcacgaacagaaggatatccctgggggagtgctaaaaatccgagacgggagcaaagaaccaaggtcaagatgggacattgttcggctcatccctccccagacgtatctgcaggccgaaggcgaagatggacaaaacttggaaaagagacgcaatttgctcaactgcctaattgtacgaattttgaaggctcatggtgatgaagggctccacatcgatcagctggtttgcctggttctggaggcttggcagaaaggcccttgtccccctagggggttggtgagtagcctcggtaaaggttctgcttgcagcagcactgatgtcctcagctgtattcttcatctcctcggcaagggcaccctgagaagacacgatgacagaccccaagtcctgtcatacgctgtgcccgtgaccgttatggagcctcatactgagtccctgaatccagggtccagcggacctaatcccccgctgacctttcatactctccaaattaggtctcgcggagtgccgtatgcctcgtgcacagccacgcaatcatttagtaccttcagatag

SEQ ID NO: 113359 - DNA, 5349 bp, Artificial Sequence
  Description of Artificial Sequence: Synthetic coding sequence
atgagcagaggattctggcttgccgagcctcttgccggaactggcccgcaccctgcgccagtcgctgccgacagtcgtggctgctcatccgtgccccgcagacacgccccatctcgcctctctgtgtcaactccctctaggggtcctggagcgagaatggtgggcgagctccggtacagggagttccgcgttcctcttggcccgggactacacgcctaccccgacgagctgatccgtcagagagtgggccacgatggtcatcccgaatatcaaatccgctggttgatcctgagaagaggagacgaaggcgacgggggttctggccaggttgactgtaaagctgagcacattctcctttggatgtcgaaagacgaaatctacgccaactgtcataagatgctaggggaagatgggcaggtgatcgggccaagccaggagagcgctggcgaagtcggcgcactggataagagtgtgcttgaggagatggaaaccgacgttaagtcactcattcagcgcgcccttcgccagctggaggagtgtgtggggactatccctcccgcccccctgctacacactgttcatgtcctgtctgcttacgccagcatcgagcctctgactggcgtttttaaagatccgcgggtccttgatctgctcatgcatatgctcagcagtccagattaccaaatacggtggtcagctggaaggatgatccaggccctgtcaagtcacgatgccggcgaaggacagtgcggggaagaaggcaaggccggcgaaggcctagggagactacgcgattcacaggacaccgtcgcaggcgcaagtgatctcatcagaacacggacacagatcctcctgtcgctcagtcagcaggaagcgatcgaaaagcatcttgacttcgactcacggtgtgcgctcttggcactcttcgcccaggccactctgtcagaacatcccatgtcatttgaaggaattcagctgccccaggtccctggacgcgtgctctttagcctcgtcaagcggtatttacatgtgacaagcctcctggaccagttgaacgacagcgcggccgagccaggcgcacagaacacatcagcgccggaagagctctccggggaacgcggacaactcgagctggagttctctatggcaatgggcacattaatcagcgaactcgtccaggctatgagatgggaccaagcgagcgaccgcccccgatcgtcggcccgatctccagggagcatttttcagccgcaattggccgatgtgagccccggtttgccagcggcccaggctcagccctcttttagacggagtcgaagatttaggcctaggtctgagttcgcctccgggaacacttacgccctgtatgtgcgcgacacgctccagcccggtatgcgcgtccgaatgctagacgactacgaggagatcagtgccggggatgagggggaattccgtcagagcaataacggggtacccccggtccaagtgttttgggaatccacaggcaggacatactgggtgcactggcacatgttagaaatcctggggttcgaggaagacatcgaggatatggtcgaggccgatgagtaccaaggggccgtcgcctctagagtcctgggacgagctctgccagcttggcgctggcgccctatgaccgagctttacgccgttccttacgtgctccccgaggatgaagataccgaggaatgcgagcacctgacgctggccgagtggtgggaactgctgttttttataaaaaaactagacggccccgatcaccaggaagtgctgcagattctgcaggagaatttagacggtgaaatcttggacgatgaaatcctggccgagcttgccgtccccattgaacttgcacaggacctactattgaccttgccccaacggctgaacgactctgccctgagggacttgattaactgtcatgtgtacaagaaatacgggcctgaggccttggccggcaatcaggcttacccgtccctgctcgaggcacaagaagacgtgctgctgctggatgcccaggcccaggccaaggattcagaggatgccgcaaaagtggaggcgaaggagccacctagccaatctcccaatactccgctccagcgtctggttgagggatatggaccggcagggaaaatactgcttgaccttgaacaagccctgtccagtgagggcactcaagaaaataaggtcaaacctctgctgctgcaactgcagaggcagccccagccgtttctggctctaatgcagagcctggacacaccagaaactaacaggactttgcacctaacagtgctgcggatcttgaaacagttggtcgacttcccagaggccttactgctgccctggcacgaggcggtagatgcctgcatggcctgtttacggagtccaaataccgaccgcgaagtgctgcaggagctgatctttttcttgcacagactgacctccgtgtctcgcgactacgccgtggtgctcaatcagctgggcgcccgcgacgcaatcagcaaagcactggagaaacacctgggtaaactagagctggcccaggagctgagggacatggtcttcaagtgcgaaaaacatgcccatctgtatcgtaagcttatcaccaatatactgggcgggtgcatccagatggtgctcggacagattgaggaccatagaagaacacaccagccgatcaatattcctttcttcgatgtgttcctgagatacctatgtcagggctcgagcgttgaggtcaaagaagataagtgctgggaaaaggtcgaggtcagcagtaacccacatcgggctagcaagctgacggaccataaccccaagacatattgggaaagtaacggttcagcagggtcacactacattacgcttcacatgagacgcgggattctcatccggcaacttacactgttagtggcatcggaggacagcagctatatgccagccagggttgtcgtctgtggtggcgattccacctctagtctgcataccgaactgaatagtgtgaatgttatgccatctgcctcgcgagttatcctcctcgaaaatctaacgaggttctggcccatcatccagatcaggatcaagagatgccagcagggcggcatcgacacccgcatccgaggcctcgagatacttgggccgaagccgaccttctggcccgtgttccgggagcaactctgtagacatacgagactgttctacatggtgagagcccaggcttggtcccaggacatggcggaggaccgcaggtcacttctgcacctctcatcacgcttgaacggcgccctccggcaggagcagaacttcgctgaccgctttctgcctgacgacgaggcagcacaggcccttggcaaaacttgttgggaggcactggtgtctcctgtcgtccagaacataacctctcccgacgaagacggaattagtccgcttggttggcttctggatcaatatcttgagtgccaggaggctgtgtttaaccctcagtcccgaggtccggcattcttttcccgggttcgtcgtctgactcatctgctagtccatgttgaaccctgtgaagcacctccacccgtagtagccactccccgaccgaagggccggaaccgctctcacgactggtcatcattagccactagaggactgccctccagtatcatgcgcaatctgactcgctgctggcgagctgtggtggaaaaacaggtgaacaattttctcacctcttcttggagggacgatgatttcgttccacgttactgcgagcattttaacatcctgcaaaattcctcctcagagctattcgggccccgcgcagcctttctgctggcattacagaatggctgtgctggcgccctgctgaagttacccttcttaaaggcggctcacgtgtctgagcagttcgctcggcatattgaccagcagatccaaggctctcggattggcggcgcacaggagatggagcgcctggcgcaactgcaacagtgtttgcaggcagtactgatcttttccggactggaaatcgcaacaacatttgagcattattatcagcactatatggccgaccgtcttctgggtgttgtgtcgtcttggctggaaggtgcggtcttggaacagattggaccctgctttccgaacaggctgccccagcagatgctgcaatctctcagtacatccaaggagctccagcggcagttccacgtatatcagctgcagcagctcgatcaggaactgctaaaattggaagacactgaaaagaaaatacaggtggggttgggggcctccggcaaagaacacaagtccgaaaaggaagaggaggctggagccgcagcagttgtcgacgtggctgagggagaagaagaggaggaagaaaatgaggacctctattacgaaggcgccatgccggaggtgagtgtgctggtcctctcccggcactcttggccggttgccagcatttgccacaccctgaacccgaggacatgcctgccttcctacttacggggtaccctgaataggtattccaacttttataataagtcacagtcgcaccccgcgctggagcgcggtagccagcgacgtctacagtggacatggttggggtgggctgaattgcagttcggtaaccaaaccctccacgtcagcaccgtgcaaatgtggttgcttttatatttgaatgatttgaaagccgtttctgttgagtcactacttgccttctccggtttgtccgccgatatgttaaatcaggcaattggccctttgacctcctcgcggggccccctggatctgcacgaacaaaaagatattccaggcggagtgctcaaaatccgcgatggctctaaagagcccaggtcccggtgggatattgttcggctcatccctcctcaaacgtacctccaagccgaaggggaagacggccagaacctcgagaagcggcgcaacctgctgaattgtcttattgtgaggattctgaaagcccacggcgatgagggactgcacattgaccaacttgtctgcctggttctcgaagcttggcaaaagggcccatgccctccgcgtggactcgtctccagcctagggaagggctctgcgtgctcctctaccgatgtgctctcctgcattctccatttgcttggtaaaggcacccttcgccggcatgatgaccgcccccaagtactgtcgtatgcagttcctgttacggtcatggaaccccatactgagtccctcaatcccggatccagtgggccaaaccctcccttgacattccatacactccagataaggtctcggggagtcccttacgcttcgtgcaccgccacacagagcttcagcacattcagatag

SEQ ID NO: 113360 - DNA, 435 bp, Artificial Sequence
  Description of Artificial Sequence: Synthetic coding sequence
atgggggttctgcaagtggtcaaacagagcgtgcagattccggtgttcgtgatgatccgaccacgaggtggagatttcctgtatagcgatagagagatcgaggtcatgaaagcggacataagattggccaaactgtacggagccgacggacttgtctttggagccctaacagaagacggacatatcgataaggagttgtgcatgtccctgatggctatttgccggcccctacccgtgacatttcatcgggccttcgacatggtccacgacccaatggctgccctggaaacacttctgactctgggctttgaacgggttctgactagcgggtgcgattcttctgccctagaagggctgccactgattaaaaggctgatcgaacaagccaaggggcgtatcgttgtcatgccaggcggcgggatcactgacaggtag

SEQ ID NO: 113361 - DNA, 822 bp, Artificial Sequence
  Description of Artificial Sequence: Synthetic coding sequence
atgaagaggcagggtgcttcttccgaaaggaagagggcccgaattccatccgggaaagcgggtgctgcaaacgggttcttgatggaagtttgcgtggatagcgtcgagtcagcagtgaacgctgaaagaggcggagcggatcggatcgagttgtgcagtggtctgtcagagggaggaaccactccctcaatgggcgttctccaggtggtgaagcagtcagtacagatccctgtttttgttatgatcaggcctaggggcggtgacttcctttactcagaccgggaaatcgaggttatgaaggccgacatccgactggcgaagctctacggcgccgatggtctcgttttcggagcccttaccgaggatggccacatcgacaaagaactctgcatgtctctgatggctatctgccgcccactgcccgtgacttttcatcgtgctttcgatatggtgcatgaccctatggccgcccttgagaccttgctgacattaggatttgaaagagtcctgacctcagggtgcgactccagcgcccttgagggtcttccgcttataaagcggctcattgagcaggccaagggtagaattgtggttatgcctgggggtggaatcaccgatagaaacctgcagcgcatcctagagggctccggagctaccgagttccattgctcggcccgatccacccgcgattcaggcatgaaattcaggaattcttccgtggccatgggtgcctcactgtcctgctcagagtacagcctaaaggtgacagacgtaactaaagtaaggacgcttaacgccattgccaagaacattcttgtttag

SEQ ID NO: 113362 - DNA, 1122 bp, Artificial Sequence
  Description of Artificial Sequence: Synthetic coding sequence
atgtccttgttgctccttcttttgctcgtgtcatactatgtggggacactgggaactcatactgagataaagagggttgccgaggaaaaggtgacgctcccttgtcaccaccaactggggctcccggaaaaagacacactggatatcgagtggctcttaaccgacaatgaagggaatcaaaaagtggtgatcacatactccagcaggcacgtgtataacaacctgactgaggaacagaagggccgtgtcgcttttgccagcaacttcctggcgggggacgccagcttacaaatagaacccttgaaaccatctgacgagggcaggtacacctgtaaggtgaaaaactctggtaggtacgtgtggtcccatgtaatcctgaaagtgcttgtgagaccgagcaagcccaaatgtgagctggagggggaacttacagaaggcagcgacctcacgctacaatgcgaatcctccagcggcacagagccaatcgtgtattactggcaacggatcagagaaaaagaaggagaagatgaacgattaccccctaagtcaagaatcgattataatcaccccggtagggtgctactacagaatctgaccatgagctactctggactgtaccagtgcactgccggcaacgaggccggcaaggagtcttgtgtggttcgagttaccgtacagtatgtgcagagcattggaatggtagctggggcagttactgggatcgtcgctggggctcttttaattttcttgctggtctggctgctcatacgaagaaaagacaaagagaggtacgaggaagaagagcggcctaacgaaatcagagaggatgcagaggcaccgaaggctcgattggtgaagcccagcagttcatccagcggctcccggagcagtaggtctggatccagctctacgcgctccactgcaaattccgccagtcggagtcaaaggacgcttagcacagatgctgctccccagcctggcctggccacccaggcctattcgctggtcggacctgaggtccgaggatctgaacccaagaaggtccaccacgccaatctgaccaaggctgagacaacacctagtatgattccaagccagtctcgcgcatttcaaaccgtctag

SEQ ID NO: 113363 - DNA, 597 bp, Artificial Sequence
  Description of Artificial Sequence: Synthetic coding sequence
atgcaccaccgcaatgattcccagcgactcggaaaggccgggtgccctccagagccatccctgcagatggccaatacaaacttcttgagcaccctgagtccagaacattgccggcctcttgctggcgagtgcatgaacaagcttaaatgtggggcagcggaagccgagatcatgaacttgccagaacgggtgggaacgtttagtgcaattcccgccctgggtggaatatctttgccccccggagtcatcgtgatgaccgctctccattcccctgccgccgcaagtgctgcagtgaccgactcggccttccagattgctaatctggccgattgccctcagaaccattccagttctagctctagttcttctggaggcgcaggcggagcgaaccccgctaaaaagaaacgcaagcgatgcggagtatgtgtaccttgcaagagattaatcaactgtggggtatgctccagttgcaggaatcggaaaacagggcaccagatttgcaagttcaggaaatgtgaagagctgaagaaaaagcccggaacttcactagagagaactccggtgccatcggccgaggcattcaggtggttcttctag

SEQ ID NO: 113364 - DNA, 597 bp, Artificial Sequence
  Description of Artificial Sequence: Synthetic coding sequence
atgcatcacaggaacgactctcagagacttggtaaggctggctgtcccccagagccgagcctccaaatggcgaacactaactttctgagcactctgtcacccgaacattgtcgccctctggcaggcgaatgcatgaacaagctcaagtgcggcgcggctgaggccgaaatcatgaaccttcccgaaagggtagggactttctcagccattccggcgttggggggtatcagcctgccccccggggtgattgtgatgaccgccctgcactctcctgctgccgcgagcgcagcagtcaccgatagtgccttccagatcgccaacctggccgattgcccccagaaccactcctcttcaagctcgtcctcatctggtggcgcagggggtgctaatcctgccaagaagaaacggaagcgctgcggcgtttgtgtgccgtgtaagaggttgattaattgtggggtgtgttctagctgtagaaatcgcaagaccggacaccagatatgtaagttccgcaagtgcgaggagcttaagaaaaagccaggcacatctctggagcgcacgccggtgcccagtgcagaagcctttcgctggtttttctag

SEQ ID NO: 113365 - DNA, 969 bp, Artificial Sequence
  Description of Artificial Sequence: Synthetic coding sequence
atgtctagcctcggaggcggatcccaggatgccggcggatcctccagcagcagtactaatggcagcgggggctctggtagttctggacccaaagcaggagctgccgataagtcagccgtggtggccgccgcagccccggccagtgtggccgacgataccccccccccagaacgtcggaacaagagtggaatcatttctgaacctctgaacaagtccctccgccggagtcgcccactgagtcactatagctcttttggatcctccggtgggtccggcgggggatctatgatgggcggagagtctgcggacaaggccactgcagcagctgccgccgcttccctgctggcgaacggacacgatttagctgccgctatggccgtcgataagagcaatccaacctcaaagcataaatctggagcagtggcttcgctgctgtccaaggccgaacgcgccactgaattggcagccgaaggccagttgacccttcagcagtttgcacaatccaccgaaatgctcaagagagtcgtccaagaacatctacccctgatgtccgaggctggcgccggcttacccgatatggaagccgtagccggtgcagaggccctaaacggccagtccgactttccttatctcggagctttcccaataaatcccggactctttattatgacccctgccggagtatttctggcagagagtgcactccacatggcgggccttgccgagtatcccatgcagggcgagctggcgtccgcaattagcagcggcaagaaaaaaagaaagagatgcggtatgtgtgccccctgtaggagaaggattaactgcgaacaatgctctagctgcagaaaccgcaagactggccatcagatctgtaagtttcgcaaatgcgaggagctcaaaaagaaaccatcagctgcgcttgaaaaggtcatgctgcctactggtgctgcgtttcggtggtttcagtag

SEQ ID NO: 113366 - DNA, 210 bp, Artificial Sequence
  Description of Artificial Sequence: Synthetic coding sequence
atgtcatccttgggaggtgggagtcaggacgccggggggtcatccagctcgagtaccaatgggtccggtgggtctggcagttctggcccgaaagctggcgctgccgacaaaagcgcggttgtcgccgctgcggcacccgcttcagtcgctgacgatactcctcctcctgagagacggaacaagtccggaatcattagtgagccattgtag

SEQ ID NO: 113367 - DNA, 243 bp, Artificial Sequence
  Description of Artificial Sequence: Synthetic coding sequence
atgtcttccctcgggggaggtagtcaagatgcaggaggatcgtccagtagttcgacgaatggtagcgggggtagtggatcatctggacctaaagctggggccgcagacaaaagcgccgtcgttgctgctgcagcccctgcctcggtggcagatgacacccccccccccgagaggagaaacaagagcggaattatttccgaacccctgaataagagtctgcgtagaagtcggccactctcgtag

SEQ ID NO: 113368 - DNA, 546 bp, Artificial Sequence
  Description of Artificial Sequence: Synthetic coding sequence
atgtcgtcacttggaggtgggtctcaggatgctggcggttcaagtagttctagtactaatgggtctggcggttcgggtagctccgggcctaaggccggcgccgctgacaaaagcgctgtcgttgccgcggcagcaccagcctccgtggcagatgacacaccaccgcctgagcgtagaaataaatctggtattatttctgagccgttaaataagtccctgcggagaagccggcccctctcccactattcttccttcggcagttccggaggtagtgggggaggatctatgatggggggagaaagtgctgacaaagcaactgctgcagctgctgccgccagcctacttgcaaatggtcacgacctcgcagccgccatggccgtcgataagagcaaccccacttctaagcataagagcggagccgtcgccagcctcctgagcaaagcggaaagggctaccgagttagccgctgagggacagctgaccctgcagcagttcgcacaatcaacagaaatgctcaaaagggtggtgcaggagcacctgccctag

SEQ ID NO: 113369 - DNA, 252 bp, Artificial Sequence
  Description of Artificial Sequence: Synthetic coding sequence
atgagttccctggggggggggagccaggatgccgggggaagctcctcgtcttccacaaacggcagcggtggaagcgggtcatcgggtcctaaagcaggcgctgccgataagagcgctgtggtggccgcagcggctccggcaagtgtggcagatgataccccaccacctgagcgccggaataagagcggaatcatcagcgagccgcttaataaatccctgagaaggtctcgccccctgtcacattacagttag

SEQ ID NO: 113370 - DNA, 486 bp, Artificial Sequence
  Description of Artificial Sequence: Synthetic coding sequence
atgagctccttaggtgggggcagccaagatgctgggggctcttccagctctagcacaaacggttccggaggctcaggctcttcagggcctaaggctggggctgctgacaaatccgcagtcgtggctgctgcggccccagcctccgtggcagatgataccccaccgcctgaacgccgcaataagtctggtatcatctcggagcctttaaataagagtcttcggcgcagccggcccctctcccactactcctcctttggaagctctggtggaagtggaggcggcagtatgatgggtggagagtccgccgacaaagccaccgccgcagccgcagccgcatcattgctggcgaatggccatgatctggccgccgctatggccgtggataaaagtaatcctaccagcaaacacaagagcggcgcggtggcatctcttctgtcgaaggctgagagagcgacagagctggctgctgaagggcaactgacctag

SEQ ID NO: 113371 - DNA, 309 bp, Artificial Sequence
  Description of Artificial Sequence: Synthetic coding sequence
atgtcttcgcttgggggcggtagccaggatgccggaggaagcagtagcagtagcaccaacggctctggcggctccgggagttctggacccaaggctggcgccgccgacaagtcggccgttgtcgctgccgctgcccccgcctctgtggccgatgacactcctcctccggagaggcgtaacaaatccggcataattagtgaacccctaaataagtccctgcggcgttcaagacccctgagccactattctagtttcgggtcctcaggtggatcaggcggcggttctatgatgggcggcgagtccgcttag

SEQ ID NO: 113372 - DNA, 36 bp, Artificial Sequence
  Description of Artificial Sequence: Synthetic coding sequence
atgtccagcttaggagggggttcccaggacgcttag

SEQ ID NO: 113373 - DNA, 297 bp, Artificial Sequence
  Description of Artificial Sequence: Synthetic coding sequence
atgtcttctcttgggggcggtagccaagacgccggggggtctagtagttcgtcgacaaacggcagcggtggatccggtagttccggtcctaaagccggtgcagccgataagagcgctgtggtcgctgcagccgccccagcatccgttgccgatgatactcccccacctgaacggcggaacaaatctggtattatcagcgagccactgaataaaagccttcggagatcaagaccgttgagtcactattctagcttcggatcctccggcggctctggtggcggttcaatgatgggctag

SEQ ID NO: 113374 - DNA, 969 bp, Artificial Sequence
  Description of Artificial Sequence: Synthetic coding sequence
atgagtagtctgggtggagggtctcaagacgcagggggatcttcttcctcctccacaaatggatccggcgggagtggcagcagtggtccaaaggccggagccgcagacaagtccgccgtggtggctgctgctgcccccgcctctgtggctgacgatacccccccccctgagcgaaggaacaagtctggaattatctctgagcctcttaataaaagcctcagacgaagccgccctttatcacactactcctcctttggatctagcgggggctccggaggcggctccatgatgggaggagaatccgctgacaaggcgacggccgctgcagccgccgccagtctgctggccaatggccatgacttggcagccgcgatggccgtggataagagcaacccaaccagtaagcacaaatctggggcagtggctagcctgctgagcaaggcggaaagggccactgagctggctgccgaggggcagcttacgctgcagcagtttgctcaatcaaccgaaatgctgaaaagagtcgttcaggaacacctgccgctcatgtccgaagcaggagccggactccctgatatggaagctgttgccggagccgaggccctcaatggacagagcgattttccttacctaggggccttcccaattaatcctggtctgttcatcatgacgcctgcaggcgtattccttgccgagagcgctctccatatggccggactggccgagtaccccatgcagggggagctcgcttctgctatctcatctggcaagaaaaagcgcaagagatgcgggatgtgcgccccatgtaggaggaggattaactgcgagcagtgctcttcttgcaggaaccggaagacgggccatcaaatctgcaaatttcggaaatgcgaggagctgaagaaaaagccatccgctgccctggaaaaggtcatgcttcctactggcgcggccttcagatggtttcagtag

SEQ ID NO: 113375 - DNA, 594 bp, Artificial Sequence
  Description of Artificial Sequence: Synthetic coding sequence
atgtcatctttgggaggaggatcccaggacgcagggggatccagctcaagcagcactaacggcagtgggggctccgggtcttccggtcctaaggccggggcagccgataagagtgcagtcgtggccgccgccgccccagcaagcgtggcggacgacacacctccgcctgaaaggagaaacaagtctgggatcatcagcgagcctctgaataaatctctcaggaggtctcggccactgagtcactactcttcttttggcagctctggcggcagcggtggcggctccatgatgggtggtgagagcgccgacaaggccaccgcagccgctgctgccgcgtctcttctcgccaacggccacgacctcgctgccgcaatggccgttgataagagcaatcctaccagcaaacataaatccggtgccgttgcgagcctgctatctaaagcagagcgcgcgaccgagcttgctgctgagggacagctcacgctccagcaatttgcgcaatccacagagatgctcaaacgggtagttcaagagcacttgccactgatgagtgaagccggggccgggctgcccgacatggaagcggtcgcttag

SEQ ID NO: 113376 - DNA, 27 bp, Artificial Sequence
  Description of Artificial Sequence: Synthetic coding sequence
atgagttctttggggggcggaagctag

SEQ ID NO: 113377 - DNA, 222 bp, Artificial Sequence
  Description of Artificial Sequence: Synthetic coding sequence
atgtctagcttggggggcgggagtcaagatgctggaggaagcagcagttccagcactaatggaagtggaggtagcgggagctctggccctaaggccggggccgctgataagtctgctgtggtggccgccgcggctccagcaagtgttgccgacgatactccaccccccgagagacgaaataagagcggcatcatctctgagccccttaataaatcactctag

SEQ ID NO: 113378 - DNA, 414 bp, Artificial Sequence
  Description of Artificial Sequence: Synthetic coding sequence
atgagctctctcgggggcggtagccaggacgccggcggaagctcctccagcagcaccaatggttctggaggatcgggatcatccggacctaaagccggagccgcagataaaagcgcagtggtggctgccgccgctccggccagcgtcgccgacgatacacctcctcccgagaggcggaataaaagtggcatcattagcgaaccactgaacaaaagtctgagacggtctagacctctgtctcactactcctcgttcggaagttctggtggttcgggcgggggtagcatgatgggcggggagtctgccgacaaagcaacagccgcggcagctgccgccagcctgctggcgaatgggcacgatctggcagccgcaatggccgttgataagagtaacccaacctccaagcataagtag

SEQ ID NO: 113379 - DNA, 2073 bp, Artificial Sequence
  Description of Artificial Sequence: Synthetic coding sequence
atgaagctgagcatgaaaaataatatcatcaatacacagcagtctttcgtcacaatgccgaatgtaatcgtacccgacatagagaaggagatcaggcggatggaaaacggcgcctgttctagtttctccgaagatgatgatagtgcaagcaccagcgaggaatctgaaaacgaaaatcctcacgcccgcggttccttctcatacaaatcccttcgtaaaggcggcccaagccagcgtgaacagtacctccccggggcgattgccctcttcaatgtgaacaacagtagcaataaagatcaggaaccggaagagaaaaaaaaaaagaagaaggaaaagaagtccaagtccgacgataagaatgagaataagaacgaccccgagaaaaaaaagaaaaaaaaggacaaagaaaaaaagaagaaggaggagaagtctaaggataagaaagaggaggaaaaaaaggaggtagtggtgatcgatcccagcggaaacacctattataattggctcttctgcatcactttgcctgtaatgtacaattggacgatggttatcgctcgcgcctgttttgacgagctccagagtgattatctggaatactggcttattcttgattatgtctccgacatcgtttaccttatcgatatgttcgtgcgcactagaactggatatcttgagcagggcctcctggttaaagaggaattgaaactgatcaataaatataagtctaacctacagtttaaattagatgtactctcgctcattcccaccgaccttctctacttcaaactggggtggaattaccccgagatacggctgaacagactcctgcggttttcaagaatgttcgaattctttcagcggactgaaactagaaccaactatccgaacatctttcgcatcagcaatctggtgatgtacatcgtcataatcatacattggaacgcatgtgtattttattcaatttccaaggccatcggttttggaaacgacacctgggtgtacccagacatcaacgaccctgaattcggaaggctcgcacggaagtacgtgtatagcctgtattggtctaccctcactctgacaacaataggggaaacgcctcctccagttcgggactccgagtacgtgttcgttgtagtagatttcctgatcggcgtcctcatcttcgcgaccattgtgggtaatattggctccatgataagtaatatgaacgctgctagggctgaattccaggctcgtatcgatgcaatcaagcagtacatgcacttcagaaacgtctctaaggacatggaaaagcgtgttattaagtggttcgactatctctggacaaataagaagaccgtcgacgaaaaggaagtgttgaagtacctgcccgacaaattacgtgctgagatagcaattaatgttcacctcgatactctgaaaaaagtgcgcatctttgcggactgtgaggcaggactgctggtggagctggttctgaaattgcaaccgcaggtgtattcgccaggtgactatatttgtaagaagggcgatattgggcgtgaaatgtacataattaaagagggaaagctcgcagtcgtagctgacgatggggtgacacagtttgtggtgctgagcgatggatcatatttcggtgagataagcattttaaacataaaaggttcaaaagcaggtaacagaaggacagccaacatcaagtcaatcggttacagtgacctgttttgtctttccaaagacgacctgatggaggctctgaccgagtatcccgacgcgaagaccatgctcgaggagaaagggaaacagatcctgatgaaggatggcctcctggatctgaacatcgcaaatgccggctctgaccccaaagacctcgaagaaaaggttaccaggatggaaggttctgttgacctcctacagacccgtttcgcacgcatcctggccgagtacgagagcatgcagcagaaactgaagcagcgcttaaccaaggtggagaagttcctcaagcccctaatcgataccgagttctcctccattgaaggccctggcgccgaaagtggaccgattgactctacctag

SEQ ID NO: 113380 - DNA, 2280 bp, Artificial Sequence
  Description of Artificial Sequence: Synthetic coding sequence
atggaaagccgcagttccccgcggttggaatgtagcggggcaatttcagctcactgctcactgcatctgcccgattcatcagactttcaactgattttcgtatttcttgttgagatgggattccaccatgtagggcaagcggggctggaactgctaatttcaagtgatctgccaacctccgctagccagtccgcaggcatcacggacatgaaattaagcatgaagaataatatcataaatactcagcaatctttcgtgaccatgcctaacgtgatagtacccgatatagaaaaggaaatcagaagaatggagaacggcgcctgttcctcattctccgaagatgacgattcagccagtacttccgaagaaagcgagaacgagaatccacacgcgagaggcagttttagctacaaaagtttgcggaaaggcggacccagtcagagagagcagtacctccctggcgcgatcgccttgttcaacgttaataatagtagtaataaagaccaagaaccagaggaaaagaagaagaagaaaaaggagaagaaatcaaagtccgacgataagaatgagaacaaaaacgacccagagaaaaagaaaaaaaagaaggataaagagaagaaaaaaaaggaggagaagtcgaaagataagaaggaggaggagaagaaggaagtggtggtgatcgacccgtctggcaacacatactacaactggttgttttgcataacactgcctgtcatgtacaattggacgatggttattgcaagagcctgctttgatgaactccagtccgactatctcgagtactggctgatactcgattacgtgagcgacatcgtgtatcttatagatatgtttgtcagaacccgcactggttaccttgagcagggccttcttgtgaaggaagagctgaagctaattaacaagtataaatccaacctccagttcaaactggacgttcttagcctaataccaacagacctgctgtactttaagctgggatggaattatcccgagatccgcttaaatagattgttgcggttctctaggatgtttgaattcttccagcggaccgaaacccggacaaattaccccaatatcttccggatcagcaacctcgtgatgtatatcgttattattattcattggaatgcctgcgttttctactcaatcagtaaggccatcggcttcggcaatgatacatgggtttatcctgacattaacgatcctgagtttggaagactggcacggaaatatgtttactccctgtattggagcaccttgactttgactaccatcggggaaactccacctcccgtgcgtgactccgaatatgtattcgtggtggtggacttcctgatcggcgtgctcatctttgccactattgtcggcaacattggatctatgatttcaaatatgaacgcagcacgcgccgagttccaggcgcgaattgatgccataaaacagtacatgcattttcgtaatgtttcaaaggacatggaaaagagagttatcaaatggttcgactacctatggaccaacaagaaaacagtagacgagaaggaagttctgaaatacctgccagacaagctgagggccgaaatcgctatcaacgtgcacctggatacactgaagaaggtcaggatatttgccgattgtgaagccggactgcttgtggaactggtgcttaagctccaacctcaagtgtacagtcctggcgactacatctgtaagaagggagacatcggtcgcgaaatgtatattatcaaggaagggaaactcgccgtggtggccgatgacggcgtcacacagtttgtggttttatccgatgggtcctacttcggggaaatttctatcctgaatattaagggaagtaaggccggcaatcggcggacagccaatataaagtctattggatactcagatctattctgcttgagtaaagatgacctgatggaagcattgactgagtaccccgacgctaagactatgcttgaggaaaaaggtaaacagatcctgatgaaagatggacttctggacctgaacatcgctaacgctgggagcgacccaaaagacctcgaggagaaagtgacacggatggagggcagtgtggacttgctgcagacacgtttcgctcggatcttggcagaatacgaatcaatgcaacaaaagctgaagcagaggctgaccaaggtggagaagtttctgaaaccattgatcgacactgaattttcctctattgagggtcccggagcagagtccgggcccatcgactcgacatag

SEQ ID NO: 113381 - DNA, 2073 bp, Artificial Sequence
  Description of Artificial Sequence: Synthetic coding sequence
atgaagctcagcatgaaaaacaacatcattaatacccaacaaagcttcgttacaatgcctaatgtaattgtgcctgatatagaaaaggagataagacggatggaaaacggagcctgtagtagtttcagcgaagacgatgactccgcctcaacctctgaagaaagtgaaaacgagaacccacatgctcggggatcgttttcctataagagcctgaggaaaggtggacccagtcaaagagaacagtacctgcctggggctatcgcactctttaacgtcaataacagtagcaacaaagatcaagagccggaagagaaaaagaaaaagaaaaaggagaaaaaatccaagtcggacgacaaaaacgagaacaaaaatgacccagaaaagaaaaagaaaaagaaggataaggagaagaaaaagaaggaagagaaatccaaagataaaaaggaagaggagaagaaggaggtggtcgtcatagatcccagtgggaatacatattataattggttgttctgcataacactgccagtgatgtataattggacaatggtgatcgcccgtgcctgtttcgatgagctgcagagcgactatctcgagtactggctgatcctggactatgtcagcgatatcgtgtatctgattgatatgttcgtgaggactagaactggctatttggagcagggcttactggttaaagaggagcttaaattgattaacaaatacaaatccaatcttcagttcaagcttgacgtgttaagtctcattcctacagacttgctgtattttaagctcggctggaattacccagaaatccgactcaaccgcctgctgaggttcagcaggatgtttgagttttttcagcgaaccgagaccagaaccaattaccccaatatatttagaatctctaatctcgttatgtatatagtcatcataatccactggaacgcatgcgttttttactctatttcaaaggctattggttttgggaatgatacatgggtgtatccggatattaatgatcccgagtttggtcggctggcccggaagtatgtgtattccctatattggtccactctgaccctaacgaccattggagagactccccccccagtgcgagatagcgaatatgtgtttgtggtggttgatttcctcataggggtgttgattttcgctactatcgtgggaaatatcggctcaatgatctctaacatgaatgccgctagagcagagttccaggctcgaatagacgcgataaagcaatacatgcattttcgcaacgtttctaaagatatggaaaagagggttatcaaatggttcgattacctatggaccaacaagaaaacggttgatgaaaaggaggtccttaagtatcttccagataagttacgggcagaaattgccatcaatgttcatttggacactctcaagaaagtgaggatatttgccgactgtgaggctgggctgctggttgaactcgtgctgaagctccagcctcaggtatattcccctggggactacatctgcaaaaaaggggatatcggcagagaaatgtatattataaaagaggggaaactcgcagtggtcgccgatgatggcgtgactcagttcgtagtattgtccgacggatcatacttcggtgagatctcaatcctcaacatcaaggggtctaaggcaggcaaccgcagaacggcaaacattaaatcaatcggttattctgacctcttctgcctgagcaaagacgatctcatggaagcccttactgagtatcctgacgcaaagaccatgctcgaagagaagggcaagcagatactcatgaaagatggcctccttgacctcaacattgctaacgccggatctgatcctaaggacctagaggagaaggtgacacgcatggaaggttcggtggacttgctacaaactcgatttgcccggatcttggcagagtacgagagtatgcagcagaaactcaaacagaggttaactaaggtcgagaagtttctgaagcctttaattgacaccgagtttagtagtatcgagggcccaggcgcggagagcggccctatagattccacctag

SEQ ID NO: 113382 - DNA, 387 bp, Artificial Sequence
  Description of Artificial Sequence: Synthetic coding sequence
atgaagttatcaatgaagaacaacataatcaatacacagcagtctttcgtgaccatgccaaatgtgatcgtgcccgacatcgagaaggagatcagaaggatggagaacggggcttgttctagcttctccgaggacgacgatagtgcctccactagtgaagaatcagaaaacgagaatccacatgcgcggggaagctttagttataagtccctgcggaaaggggggccctcccagagagagcagtacctccccggagccatagcgctgttcaacgtcaacaacagcagcaataaagaccaggagcccgaagaaaaaaaaaagaaaaagaaagaaaaaaaaagcaagagcgacgataaaaacgaaaacaaaaacgaccctgagaagtag

SEQ ID NO: 113383 - DNA, 300 bp, Artificial Sequence
  Description of Artificial Sequence: Synthetic coding sequence
atgaagttgtccatgaaaaacaacatcatcaatacacaacagtcatttgtcacgatgccgaatgtgattgtgccagatatcgagaaggaaataagacgcatggaaaatggggcctgctcttctttcagcgaggatgatgacagcgctagcacatcagaagagtccgaaaacgaaaacccgcatgcgagggggtctttcagctataagtcactgcggaaggggggaccgtcccagagagaacagtacctgccaggcgctatcgccctctttaatgtgaataatagttcaaacaaagattag

SEQ ID NO: 113384 - DNA, 2073 bp, Artificial Sequence
  Description of Artificial Sequence: Synthetic coding sequence
atgaaactgagcatgaaaaacaacatcatcaatacacaacaatccttcgtgactatgcccaatgttatcgtgccagatattgagaaggagattaggcggatggaaaacggggcgtgttcttctttcagtgaggatgatgattccgccagtaccagcgaggagagtgaaaacgagaatcctcatgcccgtggtagcttttcctacaagagtctcaggaaggggggcccttctcagcgggagcagtatctgcccggagccatagcactcttcaatgtgaacaatagttctaataaggaccaggaaccggaggagaaaaagaagaaaaaaaaggagaagaaatcaaaaagtgatgataaaaatgaaaacaaaaatgatcctgagaaaaagaaaaagaaaaaggacaaagagaagaaaaagaaggaggaaaagtctaaggacaaaaaggaagaggaaaaaaaggaagtcgtggttattgatccttctggcaatacctactataactggctcttctgcattaccctgcccgtgatgtataactggaccatggtgatagccagggcatgcttcgacgagttgcagtcggattatcttgagtattggctcattctggattacgtcagcgatattgtgtacctgattgatatgttcgtacgaacccggaccggctacctagagcaggggctcctggttaaagaagaattgaagcttatcaacaaatacaagtcaaatctgcaatttaaactggacgttttgtcactgatacccactgaccttctttatttcaagctggggtggaactatcccgagattcgcctgaaccgactgctcagattcagtcggatgttcgaattcttccagagaacggaaaccaggacaaactaccctaatatcttccggatctccaaccttgtgatgtacatcgtgatcatcatccattggaacgcttgcgtgttctatagcatttccaaagcaatcgggtttgggaacgacacatgggtttaccctgatatcaacgacccggagtttggccgactcgctcgcaagtatgtgtattctttgtactggtccacgctgaccctgactaccataggtgagacacctccgcccgtacgcgattcagagtacgtattcgtggtggtggactttcttatcggcgttttgattttcgcaactatcgttggcaatataggatccatgatctcaaacatgaacgccgcacgagccgagtttcaagcacgtatagatgctattaagcagtacatgcactttcgcaacgtgtccaaggacatggagaaacgggttattaagtggttcgattacttatggacgaataaaaaaacagtggacgagaaggaggttctgaaatacctgcctgataaactgcgagcagagatcgccatcaatgttcatttggacacccttaagaaggtgcgcatcttcgctgactgtgaagctggcctcctggtagaattggtgctgaaacttcagccacaagtgtatagccctggagactacatctgcaagaaaggggacatcggacgggagatgtacatcattaaggagggcaaactcgcggtggtggccgacgatggcgtgacccagttcgtggtactgtccgatgggtcctatttcggagagatatcaatccttaacatcaaaggctccaaggccggtaatcgaaggactgccaatattaaatccattgggtattcggatctcttctgcctgagtaaagacgatcttatggaagctctcacagaatatcccgatgcaaagacaatgctggaagaaaaaggaaagcagattttgatgaaggatgggttgctggatctcaacattgcgaatgctggctccgacccaaaggatctggaagaaaaagtgacccggatggaaggctcagttgacctgctgcagactcggtttgcacgtatcttggcagagtacgagtcaatgcaacaaaagttgaaacagcgcctaacgaaggtcgagaaattcctgaaacccctgatcgataccgaattcagcagtatcgagggacccggcgccgaatctggaccaattgatagcacctag

SEQ ID NO: 113385 - DNA, 300 bp, Artificial Sequence
  Description of Artificial Sequence: Synthetic coding sequence
atgaagctcagtatgaaaaacaacattatcaacacccagcagtccttcgtcacaatgcccaacgttattgtcccggacattgagaaagaaattcgaaggatggagaatggtgcgtgctcctcattctccgaggacgacgactctgcctccacatctgaagagtccgagaatgagaaccctcatgctagaggctcattttcttataaatcactgcggaaggggggcccaagtcaacgcgaacagtacttacccggagcaattgcgctgtttaacgtgaataactcatccaataaggactag

SEQ ID NO: 113386 - DNA, 2073 bp, Artificial Sequence
  Description of Artificial Sequence: Synthetic coding sequence
atgaagctgagtatgaagaacaacatcattaacactcagcagagctttgtaacgatgccaaatgttatcgtccctgacattgaaaaagaaattaggagaatggagaacggggcgtgttcctctttcagtgaggatgatgattcagcatctacatcggaggagtctgagaacgagaatccccatgctaggggtagcttcagttacaaaagtctgcggaagggcgggccctctcaacgagaacaatatctgccgggagcaattgccctgttcaacgttaacaactcttctaataaagaccaggaacctgaggagaaaaagaagaaaaagaaagagaaaaaatccaagagtgacgacaaaaacgagaataagaacgaccctgaaaagaagaaaaagaaaaaagacaaggagaaaaagaaaaaggaggagaagtccaaagacaagaaggaagaggagaagaaggaggtggtagtcatagatccttccggaaacacctattacaactggctgttctgcatcacactccccgtgatgtacaattggaccatggtgatagcaagggcctgcttcgacgagctgcagtcagattacctcgaatattggctcatcttagactatgttagtgacatcgtgtacttgattgacatgttcgtgcggacacgcactggctatctagagcagggactgctggtgaaggaggagctgaaattaatcaataaatacaaatcaaatctgcagtttaaactggatgtgctgagtttaattcccacagacctgctatactttaagctggggtggaattaccccgagattcgcctcaacagattactgcgcttcagccgtatgtttgagttctttcagcgaaccgagacgcgaaccaattaccccaatatctttaggatcagcaacctcgtgatgtatattgtgattattatccactggaacgcttgcgtcttctattcgatttccaaagcaatcggttttggaaatgacacatgggtatacccggatattaacgatccagagttcggcagactcgccaggaagtacgtttactctctatattggagtaccttgaccctgacaacgattggggaaacacccccccccgtgcgagatagcgagtacgtgtttgtagtcgttgattttctgataggagtgttaatctttgctactatcgtgggtaatataggctctatgataagtaatatgaacgccgctcgggccgaattccaggccaggatcgacgccatcaagcagtatatgcactttagaaatgtaagtaaagacatggagaaacgggtcattaaatggttcgattatttatggactaacaaaaagaccgttgacgagaaggaagtcctgaagtacctcccggacaaactaagagccgagattgctatcaacgttcaccttgatacactcaaaaaggtgcgaatttttgcggattgtgaagctggcctgctggtggaactggtactgaaactgcagccgcaggtttattctccaggcgattacatatgcaagaagggagatattggccgcgagatgtatattatcaaagagggcaaattggccgtcgtcgctgacgacggagtgactcagtttgtggtcctgtccgatgggtcatattttggcgagatatctatcctgaatatcaagggaagtaaggcaggcaaccgtaggacagcaaacattaagtctataggttattctgacctattttgcttgtctaaagacgacctcatggaagccctgactgagtacccggacgccaaaaccatgttggaggagaaaggaaagcagattctgatgaaggacggcctgctcgacctgaacatagccaatgcaggctccgaccctaaggacctcgaagagaaggtaacacggatggagggtagcgtcgacctacttcaaacacgcttcgcccgcattctggcagaatatgaatctatgcaacagaagctgaagcagcgactcactaaagtagagaaattcctgaagcctttgatcgatactgaatttagttcaattgagggcccaggtgctgagtcaggccctattgatagcacctag

SEQ ID NO: 113387 - DNA, 1995 bp, Artificial Sequence
  Description of Artificial Sequence: Synthetic coding sequence
atgaccgagaagactaacggggtgaaatctagtccggccaacaaccataatcaccatgctcctccagctattaaggccaatggtaaggacgaccatcgcacatcctctcggcctcactccgctgcagacgatgacacctcaagcgagctacaaagattggccgatgtcgacgccccgcagcaggggcgatcaggctttcgtcggattgtgcgtctcgtcggtataatcagggaatgggccaataagaatttccgcgaagaggaaccgagaccggatagttttctcgaacggttccgtggaccagaactccagactgtgacaacccaggagggagatggaaaaggcgacaaagatggcgaggacaagggtacgaagaagaagttcgagttatttgtccttgatcctgcaggggattggtattactgttggctattcgtgatcgccatgcccgtcttgtacaactggtgcctgctggtggcacgggcttgctttagtgatttgcaaaaaggatattatttggtctggctggttctggattatgttagtgacgtggtatacatagccgacctgtttataagacttaggacaggattcctggaacaagggctgttagtgaaggacaccaagaagctgcgtgacaactatatccacactctgcagtttaaactggacgtggcctccatcatacctacagatctgatctatttcgccgtcgatattcactcgcccgaggtccgctttaatcgcctactgcactttgctcgcatgttcgagttcttcgaccggacagagacgcgcacaaactatcctaatatattcaggatctctaacctggtactgtacattttggtgatcatacactggaatgcatgcatatattacgccataagcaaaagcattggatttggagtcgatacctgggtgtatccaaacatcacagatcccgaatatgggtacctcgcccgagaatacatatactgtctctactggagcacactgacacttactacgataggagagacaccacccccagtcaaggacgaggagtacctgttcgtgatctttgacttcttgatcggggtgctgatctttgccaccatagtcggtaacgtgggcagtatgatcagtaacatgaatgcaaccagggccgagttccaggcaaagatagacgctgtgaaacattacatgcagtttcgcaaggtcagcaaaggcatggaagctaaagttattcgctggtttgactatctgtggacgaataaaaaaaccgtggacgagagggaaattcttaagaatctcccagctaaactccgggcggagatcgccattaatgtccacctctcaacacttaagaaagtaagaatcttccacgactgtgaggccgggctgctggtggaactggtcctcaagctgaggcctcaggttttcagccccggtgattatatctgcagaaagggggatatcggaaaggagatgtatatcattaaagagggaaaactcgcagtcgtcgctgatgacggcgtcactcagtacgcgctgttgtcagctggcagctgtttcggtgagatcagtatacttaacatcaagggttctaaaatggggaataggaggaccgccaatatccgctctcttgggtatagcgacctgttttgccttagtaaggatgatctgatggaagcggtcacagaatatccagatgccaagaaggtcctggaggagagagggcgggagatactgatgaaagaaggacttctcgacgagaatgaagtagctacttctatggaggtggatgtccaggaaaagctcggacaacttgaaactaacatggagaccctatacacccgcttcggcagactgctggctgaatacaccggtgcccagcagaagctgaagcagcggatcaccgtcctggagaccaaaatgaagcagaataacgaggacgactacctttcagatggtatgaattcaccggagctcgccgcagcagatgaaccttag

SEQ ID NO: 113388 - DNA, 2085 bp, Artificial Sequence
  Description of Artificial Sequence: Synthetic coding sequence
atggcaaagattaacacccagtatagtcatccgtcacgaacccatctgaaggtgaaaaccagtgaccgtgacctaaacagagccgagaatggactgtcgagagcccatagctctagcgaagaaaccagttcagtactccaacctggtatcgccatggaaacaaggggactggcggattccggccagggctcctttactggccagggaatcgcgagactgtctcgattaatcttcctgttacgcaggtgggccgccagacatgtgcaccaccaagaccagggaccagatagctttcctgatcgcttccggggagctgagctgaaagaggtttcttcacaggaaagcaacgctcaagctaatgttggttcacaggagcctgccgacagggggaggtcagcatggcccctggcaaagtgtaacaccaatacctccaataatactgaggaggagaaaaagactaagaagaaagacgccattgtggtggatccgagttcaaacctgtactataggtggcttaccgctatcgcgctcccagtattctataactggtacctgcttatctgccgggcctgttttgacgagctacagtccgagtacctgatgctgtggctggtgttggactacagcgccgatgttctctatgtgctcgatgtgctcgtaagggcccggaccgggttcctggaacaggggctgatggtctccgacacgaatcggctgtggcagcattataagacaacaacccagtttaaattagatgttctttcgctggtcccaacagacctggcatatcttaaggtgggaaccaattatcctgaggtgaggtttaacagattgcttaaattctcccggctcttcgagttcttcgaccggaccgaaactagaacaaattacccaaatatgtttaggatagggaacttggtgctatacattctcatcatcatccactggaacgcctgcatatacttcgccatctctaagtttattgggtttggcaccgatagttgggtctaccccaatatttctatcccagagcacggaaggctaagccgcaaatacatatattccctctactggtcaaccctgactctgaccacaatcggggagaccccccccccagtgaaggatgaggagtatctattcgtggtggtggattttttggtcggcgttttgatctttgctactatcgtaggaaacgtggggtctatgatcagcaatatgaacgcatctcgcgcagaattccaggctaaaatcgacagcataaagcagtacatgcaattcagaaaagtgactaaagatttggaaacaagggtcatcaggtggttcgactatttatgggctaataaaaaaactgtggatgaaaaggaagtgctcaagtcactgcctgataaattaaaggcagagatagctattaatgtacatctggacacacttaaaaaggttaggatttttcaggattgtgaggcgggcttgctggtcgaactcgtgctgaagttacgacctactgtgttcagtcccggagattatatctgtaagaagggcgacatcggtaaagagatgtacataattaacgaggggaaactggccgtagtcgccgacgacggtgtgactcagttcgtcgttctgtctgacggatcttattttggcgagatcagcatcctgaacattaagggaagtaaaagcggtaacaggagaacggctaatatcaggtccatcggatactcagacctgttctgtttgagcaaggacgatctgatggaagcccttacagagtaccctgaggccaaaaaggccctggaagagaagggaagacagatcctgatgaaagataatttaatcgacgaagaactggcacgggctggagccgaccccaaagacctggaggagaaggtggaacaactcggcagcagtttggacactttgcagacccgcttcgcccgtcttctagcagaatacaatgcaacacaaatgaaaatgaaacaacggctttcacagctggagtcacaggttaagggtggcggcgacaagccccttgccgatggagaggtccctggcgacgccaccaaaacggaggacaagcaacagtag

SEQ ID NO: 113389 - DNA, 2085 bp, Artificial Sequence
  Description of Artificial Sequence: Synthetic coding sequence
atggccaagatcaacacacagtactctcatccttcccggactcacttaaaagtcaagaccagcgatagagaccttaatcgcgccgagaacggtctgtcgcgggctcattcctcctctgaggagacgagtagcgtgcttcagcctggcattgccatggagacccgcgggttggccgacagtgggcaaggatcctttactgggcagggcattgcacgcctctctaggctgatattcttgttgcgcagatgggccgcccggcacgtacatcaccaggaccaggggcctgacagctttccagacagatttcggggggcagagcttaaagaggtcagctctcaggaatcgaatgctcaggctaacgttggttcacaagaacctgccgatcgagggaggagcgcttggccactggccaagtgtaatactaacaccagtaataatacagaagaagaaaagaaaacaaagaagaaagacgcgatcgtggtcgatccatcatccaatctttactaccggtggctgacagccattgctctacctgtattttataattggtacttgttgatttgtcgggcatgttttgatgagttgcagtctgaatacctgatgctctggttggtgttagactattctgccgatgtactctacgtgttggatgtcctggtccgagcccgaaccggctttctcgagcaaggcctgatggtgtcggacactaacaggctgtggcaacactataaaacaactacgcagttcaaactcgatgtactctccctcgtgcccaccgatctcgcgtatctcaaagtgggtaccaattatccagaagtgagattcaatcgccttctcaagtttagccgcctgtttgagttctttgatcggaccgaaactcgcacaaattaccccaatatgtttcggattggaaacttggtgctatacatcttaataattatccattggaacgcctgtatctatttcgcaatcagtaagtttatcggcttcggtactgattcctgggtctatccaaacattagcatcccagagcacggcagactttcccggaagtatatttattcactctactggagcactctgacactaaccacgatcggtgaaacgccgcctccggtgaaggacgaagaatatctgtttgtggttgtggacttcttggttggcgtgttaatctttgccaccatagtggggaacgtcgggtctatgatatcaaatatgaacgccagtagggccgaattccaagccaaaatcgattccataaaacagtacatgcagtttcggaaagtaactaaagatctggaaactagagtcatcaggtggttcgattatctctgggctaataagaaaactgtcgacgagaaggaggtgctaaaatccctcccagacaagctgaaggccgaaatcgcgatcaatgtccatctggacacattgaaaaaagtgcggatcttccaggattgcgaagcaggactactcgtggagctggtcctgaaactccggccaaccgtgttcagccctggcgattacatctgcaagaaaggtgacataggaaaagaaatgtatatcatcaacgagggcaagctggccgttgtagccgacgatggggttacccagtttgtcgtattgtcagacggctcatactttggggaaatctccatactaaatatcaaagggagcaaatccggaaacaggaggactgccaacattcggtcaattggctactcggacctgttttgcctgagcaaggacgatctgatggaggcactgaccgaatatcctgaagctaaaaaagctcttgaggagaagggcagacagatcctcatgaaggacaatttaatcgatgaggaacttgcccgcgccggagccgacccgaaggacctcgaagaaaaagtcgagcaattagggtcttcactggacacactgcagacacggtttgctcgccttctggcagaatataatgcaactcaaatgaagatgaagcagagattgagccagctggagagccaggtaaaaggtgggggcgataaaccactggctgacggagaagtccctggggacgctaccaagactgaggataaacagcagtag

SEQ ID NO: 113390 - DNA, 2031 bp, Artificial Sequence
  Description of Artificial Sequence: Synthetic coding sequence
atggctaagataaatacacagtacagtcatccttcccggacccacctcaaggtgaaaacgagtgatagagatttgaatcgggctgaaaacgggttatcacgcgcacattcttcgtccgaggaaactagcagcgtgctgcagcccggtattgccatggagacgagaggcttggccgattcaggacaaggatcctttaccggccagggcatcgccagactttcaagactaatttttcttttgcgcagatgggccgctcgtcatgtacaccaccaagaccaagggcctgatagcttccccgaccgattccgcggtgcggaactgaaagaagtgtccagccaggagtcgaatgcgcaggccaatgtgggttcgcaggaaccagctgacagaggccgaaggaaaaaaactaagaagaaagatgctatcgttgttgacccctcctctaatctctactacaggtggcttacagccattgcgctccccgtgttttacaactggtatctgctcatctgtagggcctgctttgacgagctccagagcgaatacctcatgctctggttggtgctggactacagcgccgacgtactctacgttttggatgtcctagtgcgggcccggaccgggttcctggaacaggggctcatggtcagtgacaccaatcggctctggcaacactacaagaccactacacagtttaagcttgatgtgctgtcactcgtgccaactgatcttgcttacctgaaggtgggaacgaactatcctgaggtgcgattcaaccgacttttgaagttctccaggctgttcgagttttttgacagaactgaaacccggacaaactatcccaacatgtttaggataggaaatctcgtgctttatatccttatcatcatccactggaatgcctgcatttacttcgccataagtaaattcatcggattcggaaccgactcttgggtttacccaaatatttctatcccggagcacgggagactgtcaaggaaatacatctacagcctgtactggagtactttgacgcttaccactattggagaaactccgccacccgtaaaggacgaagagtatctgtttgtggtggtggacttcctcgtgggtgtgctgatttttgcaactattgtggggaatgtgggttccatgatcagcaacatgaatgcttccagagctgagttccaagccaagattgattccatcaagcagtatatgcagttcaggaaggtcaccaaggacctggaaactagagtcatcaggtggttcgactatctgtgggctaataagaaaactgttgacgaaaaagaggtactcaaatctcttcccgacaagctcaaggccgagattgccatcaatgtacatctggacactctgaaaaaagttcggatctttcaagattgtgaggctgggctgctcgtggaactcgtactgaaacttcgcccgaccgtgttctccccaggtgactacatttgtaaaaaaggtgatataggaaaggagatgtatattatcaatgagggcaaactggcagtcgttgctgatgacggcgtcacacagtttgtagtgctgtcagacggttcctacttcggcgagatttctatcctaaatatcaagggcagcaagagcggtaaccgcagaaccgccaacatacgaagcatcggatatagcgacttattttgtttgtcaaaagatgatcttatggaggcactgactgagtatcctgaggctaagaaagcactggaggagaaaggccgccaaattttgatgaaagacaatctgattgatgaagagttggcacgagcaggtgctgaccccaaggacctggaggagaaagtggaacaactgggaagctccttggacacgctgcagacacggtttgcccggctcctggccgaatataacgccactcagatgaaaatgaagcaaagattgtctcaattagaatcccaagtcaagggagggggagataaacccctggctgacggagaagtcccgggcgacgccactaaaactgaggataaacagcagtag

SEQ ID NO: 113391 - DNA, 3756 bp, Artificial Sequence
  Description of Artificial Sequence: Synthetic coding sequence
atgctgggctgggtccagagagtcttgccgcagccacccggcacgcctagaaaaacaaaaatgcaggaggaggaggaggtggagcccgagcctgagatggaggctgaggtggagccagaacccaacccagaagaggccgaaaccgagtccgaaagcatgccccctgaagagtccttcaaggaggaggaagttgccgtagcagatccctccccccaagaaacgaaggaagcagccttaacttcaacaatcagtctcagggcacagggggcagagatttctgagatgaatagccccagccgaagagtcttaacatggctcatgaaaggcgttgagaaagttattccccagcctgtgcacagcataacggaagatcccgcccagatactagggcatggtagcacaggagatacgggctgcactgatgaacccaacgaggctttggaagcgcaggacacgcgcccaggcctccggctgctgctctggctggaacagaacctcgagcgcgtgctgccccagcccccaaagagcagcgaggtatggagggacgagcccgcagtagccactggcgccgcctccgatccagccccaccgggccgaccacaagaaatgggccctaaactccaggccagagagacgcccagtttgcctactccaatacccctgcaacctaaagaagagcccaaggaggctccagctccggagccacagcccggaagccaggcgcagacaagtagtttgccacctacacgagatcctgccaggcttgttgcgtgggtcttacatcgcctggagatggccctgccgcagcccgtgttacacggcaaaattggcgagcaggaacccgattctccagggatatgtgatgtccaaaccatttccatccttccaggtggccaggtagagcccgacctggtcctagaagaagtagagcccccttgggaagacgctcaccaagatgtctccactagcccgcagggaaccgaggtggtgcctgcttacgaagaagaaaataaagctgtggaaaagatgccccgcgaactgtcccgcattgaagaggagaaggaagatgaggaagaggaggaagaagaggaggaggaggaagaggaagaagaagtcaccgaggtgctgctggacagctgcgtggtatcccaggtgggggtcggccaatcggaagaagacggcactcgtccccagtctacatctgatcagaagctttgggaggaggtaggcgaggaggccaagaaggaggcagaagagaaagccaaagaggaggccgaagaggttgctgaggaggaagccgagaaggagccacaagactgggccgagacaaaagaagagcctgaagccgaggccgaggccgctagctcgggcgttcctgccaccaaacagcatcccgaggttcaggtggaagataccgacgccgacagctgtcccctcatggctgaggagaaccctcccagcaccgttctgcctccaccaagcccggccaaatccgataccctgattgtcccctcttccgcatccggaacccataggaaaaaactccccagcgaggacgacgaggctgaggaacttaaagccctgtcccctgccgagtcgcctgtggtcgcctggtctgatccaactacaccgaaagataccgacggccaggacagggctgcctctaccgcgtccaccaatagtgcaatcataaacgaccggctgcaagaattggtgaaactattcaaggaacggacagagaaagtcaaggaaaagcttattgacccagacgttaccagcgatgaagaatctcccaagccttcccctgccaaaaaggcaccagagcctgcaccagacactaaacctgctgaggcggaacccgtagaggaggaacattactgcgacatgctgtgttgcaagtttaaacaccggccctggaaaaagtaccagtttccacaaagtatcgatcctctgacaaatctgatgtatgtgctctggttattcttcgtggtgatggcttggaactggaactgttggcttattccagtcaggtgggccttcccgtaccagaccccagataatattcaccattggttgctgatggactacctttgtgacttaatttactttttggacataaccgtctttcagacacggttgcagtttgtcaggggaggagacatcataaccgataagaaggatatgagaaataactacctcaaatctcgtagattcaaaatggatctattatctctcttgccattggacttcctctacctcaaagtgggcgtgaatcccctattgcggctgccaaggtgcctgaagtatatggcctttttcgagtttaattcacggttagagtcaatcctgagcaaggcctacgtttaccgcgtcattaggaccaccgcatacctgctgtacagtcttcatctgaacagctgcctgtactactgggccagcgcataccagggcttaggatctacacactgggtctatgatggcgtggggaattcctacatcaggtgctactacttcgccgtcaagactctaatcacaatcggtggcttgcccgatcccaagaccctgttcgagattgttttccagctcctgaattacttcactggtgtcttcgcctttagtgtgatgatcggtcagatgcgggacgtggtgggagctgccacagctgggcagacctattacagaagctgcatggatagcaccgtaaagtacatgaatttctataagatacccaagtctgtgcaaaatagagtcaaaacatggtacgaatatacctggcactctcagggtatgctcgatgaaagtgagctcatggtccaactgccggacaagatgcggttagatctagcaattgacgtgaattacaatatcgtgtctaaggtagcactgttccagggttgtgaccggcagatgattttcgatatgctgaaaaggctccgctccgttgtatatctgcctaatgactacgtatgtaagaaaggcgaaattggacgtgagatgtacatcattcaggctggccaggtccaggtgctgggagggcccgacggaaaatcagtcttggtcactctcaaggcaggttctgtttttggagaaatctcattgctggcggtgggggggggcaaccgccgcacagccaacgtcgtggctcacggcttcaccaatctattcatcctagacaaaaaagacctcaatgaaattctggtgcactatcccgagagtcagaagctgctccgaaagaaggctcgcaggatgttgcgctccaataataagcccaaggaggagaagtcggtcttgatcctacccccccgagcgggaacacctaaactcttcaacgcagctctggccatgacaggcaaaatgggggggaaaggtgccaaaggtggaaaattggcccacttgcgggcgagactgaaggaactggccgccttggaagccgcagccaaacagcaagaactcgtggagcaggctaaatcatctcaggatgttaagggtgaggaggggtcggccgctccagaccaacatactcacccgaaggaagctgccacggaccctcctgcgcctcgcacacccccagagccccccgggtcccccccatccagccctccacccgccagcttgggaaggcctgagggggaagaggaaggtcctgctgagccagaggagcatagcgtccgcatttgtatgagtcccgggccggagcctggagagcagattctctctgtaaagatgcccgaggaacgcgaggaaaaagccgagtag

SEQ ID NO: 113392 - DNA, 900 bp, Artificial Sequence
  Description of Artificial Sequence: Synthetic coding sequence
atgctggggtgggtgcagcgggttcttcctcagccgccggggactccgcggaaaaccaaaatgcaggaggaggaagaggtagagcccgaacccgagatggaagccgaggtcgagcccgaaccaaaccccgaggaggctgagacagaaagcgaaagtatgccccctgaagaaagtttcaaagaagaggaggttgcagtcgctgacccctcaccacaggagacaaaagaagccgctctgacttctacaatctcattacgagcacagggcgcagaaatttccgagatgaactctccatccagacgggtgctaacttggttgatgaaaggagttgagaaagtgatcccacaacccgtgcatagtattactgaggacccggcgcagatcttgggccatggatctaccggggataccggctgtacggacgagccaaatgaggcactggaggcacaggacacgagacctggactacgactgctattgtggctggagcagaatttagaacgtgtgctccctcaacctcctaaaagctccgaagtgtggcgcgatgaacctgcagtggccaccggagcagcttccgaccccgcaccaccggggagaccccaggaaatgggcccaaagttgcaagcccgcgagaccccaagtctccccactccaatccccctgcagcctaaggaggagcctaaagaggcccccgctccagagccccagccggggagtcaggctcaaacctcctccctccctcctacaagggatcctgcaaggctcgtggcctgggtgctgcaccgtttggaaatggctctgcctcagccagtgctgcatggtaagatcggcgaacaggagcccgactccccgggcatttgtgatgtccagacgcgggtcatgggcgctggaggcctgtag

SEQ ID NO: 113393 - DNA, 2430 bp, Artificial Sequence
  Description of Artificial Sequence: Synthetic coding sequence
atgttcaaaagtctgactaaagtcaataaggttaagcccatcggcgagaataatgagaacgagcagagctccaggagaaatgaggagggcagccatccctcaaaccaatcccaacaaactacagcccaagaagagaacaagggcgaagagaagagcctcaagactaagtccaccccagtaaccagtgaagaacctcataccaatatccaggataagctgtccaaaaagaacagcagcggggacttaacgaccaatccagaccctcagaacgctgcggaacccaccgggactgtcccagaacagaaggaaatggatcccggcaaggagggccccaacagtcctcagaacaaacccccagccgctcccgtcatcaacgaatacgccgacgcccagctgcacaacttagtaaagcgcatgcgacagcgaaccgccctctataagaagaaattagtggagggagatctgagcagtcccgaagcttcaccccagacagcaaagccaacagccgtgccacctgtcaaggagtccgacgacaagccgacagaacactattataggctgctgtggttcaaagttaagaaaatgcctcttacggagtacctgaagagaataaagctccccaactccatcgacagctataccgacagactgtacctcttgtggctactgctggtaacactcgcctacaattggaactgctgtttcattcctctccgtcttgtgtttccttatcaaaccgccgataacattcattactggctgatcgccgatattatctgcgacataatttatttatacgacatgctcttcattcaacccagattacagttcgtgaggggcggtgatattatcgtagactcaaatgaattaagaaaacattatcggacatcaaccaagttccagctcgacgttgcgtcgatcattccattcgatatctgctatctcttctttgggtttaacccaatgttcagagccaataggatgctgaaatacacgtccttcttcgagtttaaccaccacttggaatccatcatggataaggcctacatttaccgggtgatcaggacgacaggatatctcctctttatccttcatatcaatgcctgcgtatactattgggcctctaactacgaaggcatcggtactacgaggtgggtctacgacggcgagggcaacgagtatcttcgctgctactactgggcggttcgtactctgattaccatcggcgggctgcctgagccacagaccctgtttgagattgtgttccagttgctgaattttttctccggtgtcttcgtgttcagtagcctcatcgggcagatgagggacgtcattggcgccgcgaccgcaaaccagaactacttcagagcctgcatggatgatactattgcttacatgaataactactccattccgaaactagttcagaagagagtgcgaacctggtatgagtatacatgggactcacagagaatgctggatgaaagtgaccttctcaagaccctgcccactacggtccaactagctcttgcaatcgatgtgaatttcagcataatcagtaaggtggatttatttaagggctgcgacactcagatgatttatgacatgctcttgagactgaagtcagtgctgtatctgccaggggactttgtttgtaagaagggcgagatcgggaaggagatgtacatcatcaaacatggggaggtacaggtgcttggcggaccggacgggacaaaggttctggttacactaaaggcaggatctgtgttcggcgaaatatcccttctcgcggccggtggaggaaataggcgcacagccaacgtggttgcacacggttttgccaacttactcaccctcgataaaaagacgttgcaggaaatcctggttcactacccagactccgagcggattctgatgaagaaagctagggttttgctgaagcagaaggcaaagacagcagaagccacgcctccaaggaaggacctagccctgctttttcctccaaaagaggaaactcccaaactcttcaaaacactactcggagggaccggtaaagcttcactggccagactgttgaagctgaaaagggagcaggctgcacaaaagaaagagaatagtgaagggggagaggaggaaggtaaagagaacgaagacaagcaaaaagaaaatgaggacaaacagaaggaaaatgaagacaagggcaaggagaatgaggacaaggataagggacgcgagcctgaagagaagcccttggatcgacccgaatgcaccgcttcaccaatcgccgtagaggaggagccacatagcgtgcgccgcactgtcctgcctcgcggcacaagtcgtcagtctttaatcatttccatggcaccatcagccgagggaggagaggaagtgctgacaatagaggtgaaggagaaagcgaagcagtag

SEQ ID NO: 113394 - DNA, 4188 bp, Artificial Sequence
  Description of Artificial Sequence: Synthetic coding sequence
atgctcttaccacttccacctcagtcctccaagcccgtgcccaagaagagccaatcctccaagattgtgcctagtcatcacgatcctagcgaaaaaacaggagaaaattgtcagacaaaaatcagtccatcatccctccaagagtctccgtcctctctacaaggggccctcaagaaacgttctgcctttgaagaccttacaaacgcaagtcaatgtcagcctgtgcagcctaagaaagaggcaaacaaggagttcgtaaaagtcgtgagcaaaaagataaaccgtaacactcacgccctgggccttgctaagaaaaataagcgaaacctgaaatggcacaagctcgaggttacgccagttgttgcctccaccactgtcgtaccaaacattatggagaaacctcttattctggatatttcaacaacttcgaagacccccaatacggaggaggccagtctgtttcgaaaacccctcgtccttaaagaggagcccaccattgaagacgagacgctgataaataagtctctgagcctaaaaaaatgtagcaaccacgaagaagtctcgcttctggaaaaactccagcctctccaagaggaaagtgacagcgatgatgccttcgtcatcgaacctatgacctttaaaaagacacacaagacagaggaggcggctatcacaaaaaaaacactaagcttgaagaaaaagatgtgcgcctctcagagaaaacaaagctgccaggaagaaagcctggcggtgcaggacgtcaatatggaagaggattcatttttcatggagtctatgtcctttaaaaagaagcctaagacagaggaaagcataccgacacacaaactgagcagcctcaagaagaagtgtacgatatatgggaaaatctgccatttcaggaaaccacccgtccttcaaactactatatgcggagccatgtcaagtataaaaaaaccaacgactgagaaagagacccttttccaggaactgagtgtcctgcaggagaagcacactacggagcacgagatgtcaatcctgaagaagtcactagccctgcagaagaccaacttcaaggaagactctctggtgaaagaaagtctagcgtttaaaaaaaagccttccactgaggaagccattatgatgcccgtgatactgaaagaacagtgcatgaccgaagggaagcggtcaaggctgaagcctttggtgctgcaggaaatcaccagcggggaaaaaagcttaattatgaaacccctgtcaataaaagagaagccatccaccgagaaagagagcttttctcaggaaccatctgcgttgcagaaaaaacatacaactcaggaggaggtgtctattttgaaggaaccgagctcgctgctgaaatcccctactgaagaatccccttttgacgaggcactcgcttttacgaaaaaatgtacaatagaagaggcccctcccactaagaaacccctgatccttaaacgtaagcatgccacacagggaaccatgagccacctaaaaaaacccctcatcttacagactacctcaggggaaaagtccctaattaaggagcctctgccctttaaggaggaaaaggttagtttgaaaaaaaagtgcacaactcaggaaatgatgagcatttgcccagagcttctggactttcaagacatgattggcgaagataagaatagcttttttatggagccaatgtcattccgaaaaaacccaaccacggaagaaacagttctgaccaagacaagcctgtcacttcaagaaaagaaaattacacagggtaaaatgtcacacctcaagaagccactggtgctgcaaaaaattaccagtgaagaggaaagtttctataagaagctcctgccgttcaaaatgaagtccacgacggaggaaaagtttttgtctcaggaaccaagcgctctcaaagagaaacatactaccctgcaggaggtgagtctgtccaaagaatctctcgctattcaggagaaggctaccacagaagaagagttctcccaagagttgttttctctccatgtgaagcacacaaacaagagtggctcactgtttcaagaggccctggttcttcaggagaagacagacgcagaggaggacagtctcaagaaccttctcgccctgcaggaaaaatccaccatggaagaggagtcccttataaacaagctgctggctttaaaagaggagcttagcgcggaggcagccaccaatatccagacccagctgagtctgaaaaaaaaaagtacctcccacggtaaggtctttttcctaaaaaagcaattggccctgaatgagactatcaacgaggaagagtttttgaacaagcaacccctggcccttgagggataccctagcatcgccgaaggcgaaacgctgtttaagaaactgctggcaatgcaggaggagcctagtatagaaaaagaagcagtgctgaaggagccaaccatcgataccgaggctcacttcaaggaacctctcgcactacaggaggaaccatccacggagaaagaggccgtgctaaaagaaccctcggttgacacggaggctcactttaaggaaactctggcactgcaggagaaacctagcatcgagcaagaggcactgttcaaacggcacagtgccctgtgggagaagccttccaccgaaaaagagactatctttaaggagagcttagatctgcaagaaaaaccttccatcaagaaggaaaccctactgaagaaaccactggctctgaaaatgtctactatcaatgaggcggtcctattcgaagatatgatagcactcaacgagaagcctaccaccggcaaggaactgagttttaaggagccactagccctgcaggagtcccctacatataaagaagataccttcctgaagacgctcctggtgccccaggtgggaactagtcctaacgtgagtagcacagcacccgagagcattactagtaagagttcaattgctacaatgacatcagtgggaaagtcagggactattaacgaagccttcctattcgaagacatgattacacttaatgagaagcctacaaccgggaaagagctctccttcaaagagccgctggctctgcaggagtcccctacgtgtaaggaggataccttcctggagacctttttgatccctcagatcggaaccagtccctatgtgttcagtaccacgcccgaaagtatcacagaaaagtcctccattgcaactatgactagtgtaggcaaaagcagaaccacgactgagtcctccgcctgcgagtcagcgtcagacaaaccagtaagcccccaagctaaggggacacccaaggaaataacacctcgggaggatatcgatgaggacagttcggatccgtcgttcaacccaatgtacgcgaaagaaatcttctcctatatgaaggaacgcgaagaacagttcattctgacagactacatgaacagacagatcgagatcacaagtgacatgcgggctattctagttgactggctcgtcgaggttcaggtgtctttcgaaatgactcacgaaaccctgtatctcgcagtaaagcttgtggatctgtatctgatgaaagcagtgtgtaagaaggataaactgcaactcttaggtgcaacggcatttatgattgctgccaagttcgaggagcataattcaccccgggtcgacgacttcgtgtacatctgtgatgacaactatcagcggtctgaagtgctgtcaatggaaattaacatactcaatgtgctaaagtgcgatattaatatccctattgcctaccatttcttgagaaggtacgcacggtgcatccataccaacatgaaaacattgacactgagcagatatatctgcgaaatgactctccaagaataccactacgtgcaggagaaggctagtaaactcgccgccgcatccctactgctggcgctgtacatgaagaaactcggatattgggtgcccttcctggaacattattctggctattctatctccgaactgcaccccttagtaagacaattgaataagctcctcacgttctctagctatgattctctcaaagccgtgtactataaatactcccatccagtgttcttcgaagtggctaaaatccctgcgctagatatgctcaaactcgaagaaattcttaattgtgattgcgaggctcaggggctggtcttgtag

SEQ ID NO: 113395 - DNA, 876 bp, Artificial Sequence
  Description of Artificial Sequence: Synthetic coding sequence
atgttgttacctctgccacctcagtccagcaaaccggtaccgaagaaatctcaatcatctaaaatcgtaccgagccaccacgatcctagcgagaaaacaggcgagaactgtcagactaaaatctccccaagtagcctacaggaatccccatcttctcttcagggcgcccttaaaaagaggtctgcattcgaggatttaacaaatgtctcctttgaaatgacacacgaaaccctgtacctggcagtcaagctggttgacttgtacctgatgaaagcagtgtgcaagaaggacaagcttcaacttttaggggcgaccgcttttatgatagcagcaaagtttgaagagcacaacagccctcgggtggatgacttcgtttacatttgcgatgacaactaccagcggtccgaagtattgtcaatggagatcaatattctgaacgtgctgaaatgcgacataaatatcccaatcgcctatcatttcctacgccggtatgctcggtgtattcatacgaatatgaaaacgttgaccctgtcccggtatatctgcgaaatgaccctgcaggaataccactatgtgcaggaaaaggcctcaaagttggcggctgcctccttactgcttgcactctacatgaaaaagctgggttactgggtccccttccttgagcattactcaggctatagtatctccgaactgcaccccttagtgcgacagttaaataaactactgacattctcttcatatgactccctgaaggcggtatattataagtactcccatcctgtctttttcgaggtagcaaagatacccgcccttgatatgctaaaattagaagagattttgaactgtgactgcgaggcccaaggcctggttttgtag

SEQ ID NO: 113396 - DNA, 876 bp, Artificial Sequence
  Description of Artificial Sequence: Synthetic coding sequence
atgttactcccgctgcccccccagtccagtaagccggtgcctaagaagtcccaaagctccaaaattgttccatcccatcatgaccctagcgaaaagactggtgagaattgccagactaagattagcccttccagtctgcaggaatccccttcctccctgcaaggcgctctgaagaaacgatccgctttcgaagacctgactaatgtgagctttgagatgactcatgagacactgtacttagccgtgaagctggttgatctttacttgatgaaagctgtctgcaaaaaggacaaactccagcttctgggtgctaccgccttcatgatcgccgcgaaattcgaggagcacaattcacccagggttgatgactttgtttacatttgcgatgataattaccagcggtcggaagtcctgtccatggagatcaacatactaaacgttctgaagtgcgacataaatattcccatcgcataccatttcctgaggaggtatgcccgctgcattcacactaacatgaagactctgactctgagtcgctatatttgcgaaatgacactgcaagaataccactatgttcaggagaaagcttctaaactggcagcggctagcctgctcttggcgttatacatgaagaaactcggttactgggttccttttttggaacactactctgggtactctatctcagagctgcaccccctggtccgccagctgaataagttactcaccttctcatcgtacgattcactgaaagccgtgtactacaaatattcacacccggttttttttgaggtcgcaaagatccctgccttggatatgttaaagttagaagaaattctcaattgcgattgtgaagcacagggactggtcctctag

SEQ ID NO: 113397 - DNA, 4188 bp, Artificial Sequence
  Description of Artificial Sequence: Synthetic coding sequence
atgctgctgcccttgccccctcagtcctcaaaacctgtgcccaaaaagagtcaatcttccaagattgtgccaagccaccacgatccaagcgagaagacaggcgagaactgccagaccaagatatctccgtccagcttgcaggaaagtccttcctctcttcagggggcactgaagaaaagatctgccttcgaggacctgacaaacgcatcgcaatgtcagccagtgcagcccaagaaggaggccaataaagagttcgttaaagtggtcagtaaaaagatcaatcgcaatacacacgctttgggcttagccaaaaagaataaacggaatctaaaatggcacaagctggaggtgacacctgtggtggccagcactacagtcgtgcccaatatcatggagaagcctctgatactcgatatctctaccacctcgaagacaccaaataccgaggaagcctccctgttccgtaagccgctcgttctgaaggaagagcctaccatcgaagacgagaccctcataaacaagtccctgagcctgaagaagtgttcaaatcacgaggaagtctcactcctggaaaaattacagcctctccaggaagaatccgattccgatgacgcatttgtgatcgagccgatgacctttaagaaaacacacaagaccgaggaggccgcgatcacaaaaaaaaccctgtcccttaagaagaagatgtgcgcctctcaacggaaacagagctgtcaggaggagtcccttgctgtgcaggacgtgaacatggaggaggattccttcttcatggaatccatgtctttcaaaaagaagcccaaaacagaagagagtatacccacacacaagctctcctcactgaaaaaaaagtgtaccatttatggtaagatctgccacttcaggaaacctcccgtgcttcagaccacgatttgcggggccatgagcagcatcaagaagccaacgactgagaaggaaaccctgtttcaggaactaagcgtgttacaggagaaacacactacggaacatgaaatgtcaatccttaaaaaaagtttggcactccagaagactaactttaaggaggattccctggtcaaggagtctctggccttcaagaaaaagccctctacagaggaagcaattatgatgcctgtgatattgaaggagcagtgtatgacggagggcaagcgatcccgattgaagccattggtcttacaagaaatcacctctggcgaaaaaagcctcataatgaagcccctatcgattaaagagaaaccaagtacagagaaagagtcattcagccaagaaccgagcgcactccagaaaaagcacaccacgcaggaagaggtttctattcttaaggaacctagttctctgctgaagtcgcccacggaggaatctcctttcgacgaagctttggcattcaccaaaaagtgcaccatcgaagaagccccacccaccaagaaacctctgatcctcaagcggaaacacgcaacacaagggactatgtcccacttaaagaaacctctgatactgcagactacttcgggggagaaatctctgattaaggagcccctgccatttaaggaagagaaagtgagcctcaagaaaaaatgtaccacccaggagatgatgagcatctgccctgaactgcttgactttcaggatatgattggtgaggataaaaactccttttttatggagccaatgtcatttcgcaagaatccgactactgaagagacagtgctcaccaaaacaagcttaagcctacaggaaaagaagatcacccagggaaagatgtcccacctgaaaaagccattagttttgcagaagatcaccagcgaggaagagtccttctataagaaattactgccatttaaaatgaaatcgacaacggaagaaaagttcctttctcaggaaccatctgctcttaaagagaagcacactaccctccaggaagtctcgctcagcaaggagtctctggctattcaggaaaaagcaaccactgaggaagaatttagccaggagctcttctccctccacgttaagcacacaaacaagtctggtagcctgttccaggaagcactggtgctgcaggagaagacggatgcggaagaggatagccttaaaaatttgctggcgttgcaggagaaaagcactatggaagaggagtctctgataaacaaactacttgcacttaaggaagagctgtctgccgaggctgcaaccaacattcaaacacagctgagtctgaagaagaaatctacttcccatggcaaagtattctttctgaaaaagcagttggcactcaatgagacaataaacgaagaggagtttttgaataagcagccactggccctggaaggctacccaagcatagccgagggagaaactctttttaagaagctgctggcaatgcaagaggaaccttccatcgagaaggaggcagtgctgaaagaaccgaccattgatactgaggcccactttaaagaacctctggctcttcaggaagagccaagtaccgagaaggaagctgttctgaaggaacctagcgtagatacggaggcgcactttaaagagactctggccctgcaggagaagccaagcattgaacaggaggcattattcaagagacactcggccttgtgggaaaagccttctacagagaaggagacaatttttaaggaaagtttggacctccaggagaaaccatcaattaagaaagagacactgttaaagaagcctttagcactgaagatgtctaccataaacgaggcagtgctttttgaagacatgatagccttgaacgaaaaaccgaccacaggaaaagagttaagctttaaagagcctctggcactgcaggaaagtccgacttacaaagaggacactttcctgaaaaccctcctcgtgccccaggtggggacaagccccaacgtgtcttctacggcgcccgaaagcatcacatctaaaagctctattgccacaatgactagcgtgggaaaatcagggaccattaacgaggctttcttgtttgaagatatgataaccttgaacgagaagcccactacaggcaaggagctgtctttcaaggagcccctggcattacaagagagccccacgtgcaaggaggatacatttctcgagacatttctcatccctcagatcggcactagtccctacgtctttagcaccactcctgagtcgattacagaaaaaagcagtattgcaacaatgacttccgtggggaagtctcggactactacggagagtagtgcttgtgagagcgcgagtgacaagcccgtttctccccaggccaagggcacccctaaggagattacaccacgggaggacatagacgaggattcttcagaccctagttttaatcctatgtacgcaaaggaaatattcagctacatgaaagaacgcgaggagcaattcatcctcacagattacatgaaccggcagatcgagatcacctccgatatgcgggcaattctggttgactggctcgtggaagtacaggtgtctttcgagatgactcacgaaaccctttacctcgctgttaaactggtggatctgtatctaatgaaagcggtgtgtaagaaagacaagctgcagctgctgggcgctaccgcctttatgattgctgccaagtttgaggagcacaactccccacgggttgacgatttcgtctacatctgcgacgataattatcagcggtccgaagtactatcgatggagataaacattttgaatgtgctgaagtgcgacataaatattcctatcgcttaccactttctgcgcagatatgcccggtgtatccacacaaacatgaagaccctcaccctcagtcgctacatctgtgagatgaccctccaggaatatcactacgtgcaggagaaggcttctaagctcgctgcagcatctcttcttctcgccctgtatatgaaaaaactgggatactgggtcccattcctggagcactactccggctattccatttcagaacttcatcccctcgttcgtcaactgaacaagctgctgacgttttcctcatatgactcactgaaggctgtgtactacaagtacagtcatcccgtctttttcgaggttgcaaagattcctgcactagatatgttgaagcttgaagaaatactcaattgtgactgtgaagcccagggcttagtcctgtag

SEQ ID NO: 113398 - DNA, 336 bp, Artificial Sequence
  Description of Artificial Sequence: Synthetic coding sequence
atgctgttaccgttacctccccagtcctccaagcctgtgccaaaaaaaagccagagctccaagatcgtcccatcacaccatgatccatcggagaagactggcgaaaactgccagacaaagatcagtcccagcagcctgcaagagagcccatcttctcttcaaggagcactcaaaaagcgaagcgccttcgaagacctgaccaacgcctctcagtgccagcctgtgcagcccaagaaagaggctaataaggagtttgtcaaagtggttagtaagaagattaatcggaatacacatgccttaggcctggccaagaagaacaaacgtaacctgaaatag

SEQ ID NO: 113399 - DNA, 1083 bp, Artificial Sequence
  Description of Artificial Sequence: Synthetic coding sequence
atggcctccgcaactgcaccggctgcggcagtcccgaccttggcctcacccctggagcagctgagacacctggctgaggagctcaggctgctgcttccccgcgttcgagtaggcgaggcccaggaaacaacagaggaattcaaccgcgaaatgttctggcgcaggctgaatgaggccgctgtgactgtgagccgggaagccaccactctgaccattgtgttcagccaactgcccctgcctagtcctcaggagacacagaagttctgtgaacaggttcacgcggccatcaaggccttcatcgccgtctattatcttcttcctaaggatcaagggatcacccttagaaagttggttaggggagccactttggatattgtggacggaatggcccagctcatggaggtattatcggttacgcccacacaatcccctgagaataacgatctgataagctataacagtgtctgggtggcgtgtcagcagatgccacagatccctcgggataacaaggccgctgccctgcttatgttgacaaagaatgtcgactttgtgaaggatgcccacgaggaaatggagcaggccgtcgaggaatgtgatccatacagcgggttactcaacgacactgaagagaacaacagcgataatcataatcacgaggatgacgtcttgggattcccatccaaccaggatctgtattggagcgaagatgaccaggaactgatcatcccatgcttggccctcgtacgggcaagcaaagcttgcttaaaaaagattagaatgttagtggccgagaacggcaaaaaggaccaggtcgcacagctggacgatattgtggatatctctgatgaaatctctccgtcagtcgatgaccttgccctctccatttaccctccaatgtgtcaccttacagtccgcatcaatagtgccaagctggtgagtgtgctgaagaaggccctcgaaatcaccaaggccagccacgtgacacctcagcccgaggatagttggattccgttactgatcaatgctattgatcattgtatgaatcggattaaggaactgacgcagagtgagttggaactgtag

SEQ ID NO: 113400 - DNA, 600 bp, Artificial Sequence
  Description of Artificial Sequence: Synthetic coding sequence
atgccccagatcccccgggacaataaagctgcagccctgctgatgttgacaaagaatgtggactttgtaaaagatgcccatgaggaaatggaacaggctgtcgaggagtgtgatccctactctggcctactgaacgataccgaggaaaacaattcagacaatcacaatcacgaagatgacgtgctggggttcccttctaatcaggacctctactggtcagaggatgaccaggagcttattatcccctgtctggcccttgttagagccagtaaagcatgtttgaagaagataagaatgttggtggcggaaaacggtaaaaaggatcaggttgcacagctggatgacatagtggacatttccgatgagatttccccaagtgtagacgatctggccctgtcaatttaccctccaatgtgccacttaacagtccggataaatagcgctaaactcgtgagcgtcctgaaaaaggccctggaaattactaaagcctctcatgtaacccctcagccggaagacagttggattccactgttgattaacgcaatcgatcactgcatgaatcgcatcaaggagcttacccaatctgaactcgagctatag

SEQ ID NO: 113401 - DNA, 699 bp, Artificial Sequence
  Description of Artificial Sequence: Synthetic coding sequence
atggcccagctgatggaggtcctgtccgtgacgccgacacagtctcccgagaacaatgaccttatcagttacaattccgtgtgggtcgcctgtcagcagatgccccaaattccacgcgacaataaggctgccgctctactcatgctgacgaagaatgtcgacttcgttaaggacgcacacgaggaaatggagcaggctgtagaagagtgcgacccctatagcggcctgctgaatgatactgaagagaacaacagtgacaaccacaaccatgaggacgacgttctcggcttccctagcaatcaggacctttactggtccgaggacgatcaagagctgatcattccttgcctggcactcgtccgggcttccaaggcgtgtctgaagaagatacgaatgctagtcgccgagaacggcaagaaagaccaggtcgcccagctggacgatattgtagacataagtgacgaaatttctcccagtgttgatgaccttgcccttagtatctacccacccatgtgtcacctaacagtgcgaatcaactctgccaagttagtcagcgtattaaagaaagccctggaaatcacgaaagcatctcatgtgaccccccagcccgaggatagctggatccccctcctaatcaacgccatcgaccattgtatgaacagaattaaagagctgacacagtccgagttagagctgtag

SEQ ID NO: 113402 - DNA, 3936 bp, Artificial Sequence
  Description of Artificial Sequence: Synthetic coding sequence
atgtctttactccagtctgccttggatttcctggcgggtccgggcagcttggggggggcctctggccgggaccagtctgacttcgttgggcagaccgtcgaactgggtgagcttcgcttacgcgtgcgccgcgtactggcagaagggggcttcgcatttgtctatgaggcccaggacgttgggagcggacgggagtacgcactaaagaggctcttgtccaacgaggaggaaaagaaccgtgctatcatacaggaggtttgctttatgaaaaagctttccgggcaccccaatatagtccagttttgttcagcggcctctatcgggaaagaggagtcagacacaggccaggccgaattccttttgctgaccgaactgtgcaagggacagctcgtggagtttctgaagaagatggagagccgaggccccctgagctgcgacacagttttgaaaatcttctatcagacctgcagagctgtgcagcacatgcatcgtcagaaaccgcctatcatccatagagaccttaaggtcgaaaatctcctactgtctaatcagggaaccatcaagctctgcgacttcggatctgcaacaacaatatcacattacccagactacagctggagtgctcagagacgggctctagtggaggaggagattacacggaacactacccctatgtaccggaccccagaaatcattgacctgtatagcaactttccaattggtgaaaagcaggacatatgggccctcggttgcatcttgtacctcctctgctttagacagcacccgtttgaggatggagctaagctgcgcatcgttaacggcaagtacagtattccacctcacgatactcagtataccgtatttcactccctgattagagccatgttgcaggtaaaccctgaagagagactatcaatcgcggaagtcgtgcaccaactgcaggagatcgccgcggctcgcaacgtcaatccaaaaagcccaatcacggaactgctggagcagaatggtggttatggatccgcaaccctttctcgagggccaccgccccctgtgggcccagctgggagtggctatagcggtggactggccctagcggagtatgaccaaccttatggcggctttttggatatactgagagggggaacagagaggttgttcaccaatttaaaagacacgagttccaaggttattcagtcagtcgccaattatgctaaaggtgaccttgacatcagctatatcaccagtcgcattgctgtcatgtcttttcccgcggagggcgttgagtctgccctcaagaacaatatagaggacgtacgcctgtttcttgattcaaaacatcccgggcactatgcggtttacaacctttcaccacgaacctacaggcccagccgctttcacaaccgggttagcgagtgcgggtgggctgcgcggcgcgccccacatctgcataccctgtacaatatttgccgtaacatgcacgcctggctaaggcaagaccacaagaacgtgtgtgtcgtgcactgtatggatggcagggccgccagtgccgtggccgtgtgttcttttttgtgtttttgccgcctttttagcaccgccgaggctgctgtatacatgttctccatgaaacggtgtccacccggaatctggccatcccacaagcgctacatcgagtacatgtgcgatatggtggccgaagaacccataacaccacactctaagccaatcttggtccgggccgtggttatgaccccagtaccacttttttctaaacagcggtctggatgtagacccttttgcgaggtctatgtgggtgacgagagggttgcatcaacttcacaggaatatgataaaatgcgcgatttcaagatcgaggacggcaaggctgttatccccttaggcgtcactgtccagggagacgtgctcatcgtcatataccatgctcgcagcacattaggcggccggttgcaggcaaaaatggcttcaatgaaaatgttccagatccaattccataccggattcgtgcctcgcaacgccacaaccgtgaagttcgctaagtacgacctcgacgcctgtgacattcaggagaagtacccagatctcttccaagtaaacctggaggtagaggtggaaccaagagaccggcctagccgcgaagcacctccctgggaaaactctagtatgagaggactgaatccaaaaattctcttctctagccgtgaggagcaacaggacatactctcaaaattcggaaagcccgagctgccacgacagcccggctctaccgcccaatatgatgccggggctggttctcctgaggcagaaccaactgattccgacagccctccctcctcttcagcagacgcgtccagattcctccacactcttgattggcaggaggaaaaagaggccgagacaggcgctgaaaatgcaagcagcaaggagtcggaatccgcactgatggaagaccgcgatgagtccgaagtgagcgacgagggcggaagcccgatttccagtgagggacaggagcctagggccgacccagaacctcccggactcgcagccggcctggtgcaacaggacctcgtatttgaggtagaaacacccgctgtgctaccagagccagtgccgcaggaggacggagttgatctgcttggtctccactccgaggtaggggccggtcctgccgtgcctccccaagcttgtaaggcccccagcagcaataccgatctcctgagctgcctacttggaccccccgaagcagcttcacaaggaccccccgaagatctgctgtccgaggacccattactgctggcatcccccgccccccctctcagtgtccagtccacaccccgtggcggccctccggccgccgccgaccctttcggaccgctcttgccgtcctctggtaacaattcacagccttgctcgaatcccgacctttttggcgagtttctgaactccgattccgtgaccgtcccaccatctttcccttctgcccactctgctcctcctccctcatgttctgccgattttctgcacctgggcgatctgccgggagagcccagcaaaatgaccgcttcttcatctaaccccgaccttttgggaggctgggccgcatggaccgaaactgcagcatcagctgtagcacccacccctgcaactgagggccccttgtttagtccagggggacagccagccccctgcggcagtcaggccagctggacaaaatcccagaatccagatccttttgccgacctcggtgatctgtctagcggcctgcagggatcccccgcgggctttcctcctggcgggtttatacccaaaacagcaaccactccaaagggatcctcatcgtggcaaacctcccggccccctgcacagggcgcttcatggccccctcaggccaaaccccctcctaaggcctgcacccagcctcggccaaattatgcgtctaatttcagtgtgatcggtgccagagaagagcggggcgtcagggcgcccagttttgctcagaagcctaaggtttctgaaaatgattttgaagaccttctgtccaatcaggggttcagcagtcgaagtgacaaaaaaggccccaaaaccatagccgagatgcgaaaacaggaccttgcaaaagatacagacccactaaagctcaaacttctagattggattgaagggaaagagcgaaatatccgagctctgctgagcacgttacacacagttctatgggatggcgagtcccggtggactcctgtggggatggccgaccttgtggctcccgagcaggtcaagaaacactaccgccgggcggtgctagcggttcaccccgacaaagccgccggccagccatatgagcagcacgccaagatgatatttatggaactgaatgatgcctggtctgagttcgagaatcagggtagtaggccattgttttag

SEQ ID NO: 113403 - DNA, 1764 bp, Artificial Sequence
  Description of Artificial Sequence: Synthetic coding sequence
atgagtttgctgcaatctgccctagattttttggccggccctggttcactcggcggcgcttccggaagagatcagtccgacttcgtgggtcagaccgttgagttgggagaactccgcctgcgcgtgagacgcgtcctcgcagagggcggctttgcgttcgtgtatgaggcgcaggacgtaggtagcgggcgcgagtacgcgctgaaaaggctcttgagtaatgaggaagaaaagaaccgggccataatacaggaggtctgcttcatgaagaagctatctgggcaccccaacattgtgcaattctgcagtgctgcgtctataggtaaggaggaatctgatacgggccaggctgagttcttgctactgactgagcctccagggctggccgcagggctcgtacaacaggatctggtgttcgaagtcgaaaccccagctgtcctgccagagcctgtaccccaggaggatggcgtggacttgctggggttgcactcggaggtgggagcaggcccagctgtgccacctcaggcttgcaaggccccctctagcaacaccgacttgctttcttgtctgttgggacctcctgaggcagctagtcaggggccacctgaggatctgctctccgaagatcccctcctgctggcctccccagccccacccttgagtgtgcagtctacgccaaggggtggaccacctgccgctgccgaccctttcggtcccctgctgcccagctcaggcaacaactcccagccatgtagtaatcccgatttatttggcgaattcctgaatagcgattcagtcactgtaccaccaagctttccttccgcacatagcgctcctccaccttcatgcagcgcggattttcttcatctcggggatctgccaggggaaccatccaaaatgaccgcgtcgtccagcaaccccgatcttttgggcgggtgggccgcatggacggagaccgccgcaagcgcagttgcacctactcccgccacagagggacctcttttcagcccagggggccagcctgcaccgtgcggcagccaagcctcatggactaagagtcagaatcctgatccattcgcagacttgggggacctgagctctggactgcagggttctcccgcaggcttccctcccgggggatttatccctaaaaccgccaccacccctaaaggctcttcaagctggcagacatcgcgccctccagcacagggagcttcttggcctcctcaggctaagcccccccctaaggcctgcactcagccccgtccaaactacgcctccaacttcagtgtgattggcgcgagagaggagagaggcgtgagggcaccatcctttgcacaaaaacctaaggtcagcgaaaatgactttgaggatctgctgtccaatcaggggtttagcagcaggtcggacaaaaagggaccgaagaccattgcggagatgcgcaagcaagatcttgccaaggacacagaccctctgaaattaaaactactggactggatagagggcaaggagagaaatatccgcgcactgttgagcaccctgcatacagtcctgtgggacggagaatcacgatggacccccgtgggcatggccgatctggtggctcctgagcaggtcaagaaacactatcgcagagctgtgctggccgttcatccagacaaggccgctggccagccttacgaacagcatgctaaaatgatctttatggaactgaacgatgcatggtctgaattcgagaatcagggttctcgcccgctgttctag

SEQ ID NO: 113404 - DNA, 2238 bp, Artificial Sequence
  Description of Artificial Sequence: Synthetic coding sequence
atgcccttccccgtaacgacccaaggctctcagcagactcagccacctcagaaacactatggcatcacctctcctatttctctggcagcacccaaggagactgactgcgtcctaacacaaaagctcattgagaccttgaaaccatttggtgtgttcgaggaggaggaagaacttcagcgacgaattctaattctgggtaaactcaacaatttagtgaaggaatggattcgggaaatctccgagtctaagaatctcccccagagtgtcatcgaaaatgtcggaggcaagatttttacttttgggtcctaccggctcggcgtccatactaaaggcgccgatattgacgctttgtgcgtggctccccgccacgttgaccggagtgacttcttcacttccttctatgacaagttgaagctacaggaggaagtgaaggatctgagagccgtcgaagaggccttcgtgccggtcatcaagttgtgcttcgacgggatcgaaatcgatattctgttcgctcgcctggcgctccaaacaattcctgaagatttggacctccgggatgacagtttactgaaaaacctcgacattagatgcatcaggtccctcaacgggtgtcgtgtaactgatgagatccttcatctggtgcctaacatcgacaatttcagattgactcttagagctatcaaactctgggctaaaaggcataacatttacagtaacatactgggatttctcggcggagtttcttgggctatgttagtcgctcggacctgccagctgtatccaaatgctattgcatccacccttgtccacaaattttttttggtctttagcaagtgggagtggcccaaccccgtgctcttaaagcagccggaagaatgcaatctgaatctccctgtgtgggatcccagagtaaacccaagtgaccgctaccatttgatgcctatcatcacgccagcatatccccaacaaaattctacatacaacgtgagcgtgagtacccggatggttatggtggaggagtttaagcaagggctggccatcaccgatgagattctcctgtcgaaagctgagtggagcaaactgtttgaagcacccaatttttttcagaagtacaaacactacatcgtgctcctggcatccgccccgactgagaaacaacgcctcgagtgggtgggcctggtggagtcaaagattcgcatcttggtgggttcgctcgagaagaacgagttcattaccctcgcgcacgtgaacccccagtcattcccagcacccaaagaaaatcccgacaaggaagaattccgaaccatgtgggttataggcctcgtgtttaagaagaccgagaatagcgagaatctctcggtcgatctgacatatgacatccagtccttcaccgacacagtctatcgccaggcgattaactcaaaaatgttcgaagtggatatgaagatagcagcaatgcacgtgaagagaaaacagctgcatcagctgctgccgaatcacgtgcttcaaaagaagaaaaagcattctaccgagggagttaaattaaccgcgcttaacgacagttcactcgacttgtctatggacagcgacaattctatgtccgtgccgtcacctacaagtgcgaccaaaacatctcctttgaacagctctgggtcgtctcagggaaggaactcccccgcccctgccgtcaccgctgcatctgtcacaaatatacaagcaaccgaggtcagcgtaccgcaagtcaactcctctgaatcttccgggggcacatccagcgaaagcatcccgcaaacagctacacaaccagccatcagccctcctccgaagcccaccgtgtcaagagtggtcagttcgacaagattagtcaacccacctcccaggagttctggaaacgcggcaacatccggcaacgctgccaccaaaatcccaactcctattgttggcgtgaagcgaacttcttccccccataaggaggagagtccaaagaaaacaaaaacagaggaagacgagaccagcgaagacgccaactgccttgccctgtccggacacgataagaccgaagcgaaagagcagttagatacagagacatccacaacccaatccgagactattcagaccgctgcctccctcctggcctctcaaaagacgagttcaaccgacctatccgacattcccgcccttcctgctaaccccataccagtgatcaagaactctatcaaacttcggctgaaccgctag

SEQ ID NO: 113405 - DNA, 1080 bp, Artificial Sequence
  Description of Artificial Sequence: Synthetic coding sequence
atgaaggaaaacaaagagaacagctcaccatccgtgacaagtgccaacctcgatcacactaagccatgctggtactgggataagaaggatctggcccacacaccaagccaactcgagggcttagatcctgcaactgaagccaggtaccggcgcgagggtgcccgattcatcttcgacgtgggcacgaggctcggcctgcactacgacaccctggccactgggataatatattttcatcggttttacatgtttcatagcttcaagcagtttccccggtatgtgactggggcttgctgcctctttctcgccggcaaagtggaggagacccccaaaaaatgtaaagacattattaagacggctcggagtctgctgaacgatgttcaatttggccaatttggtgacgatccaaaagaagaggtgatggtgcttgagaggatcctcctgcagactattaaatttgacctgcaggtagagcatccataccagttcctgctaaagtatgccaaacagctgaagggcgacaagaacaagattcagaagcttgtgcaaatggcctggaccttcgtgaacgacagaacgtcgctatgcaccactctctccttgcagtgggaaccagagatcatcgccgtggcggtgatgtatcttgccggcagactgtgcaaatttgaaatacaagaatggacctctaagccgatgtatagacggtggtgggagcagttcgtgcaggatgtccctgtggatgttctcgaggatatttgccatcagatcctagatctgtactctcagggtaaacaacagatgccacaccacaccccccaccagcttcagcaacctccttccctgcaaccgactcctcaggtgccgcaggtgcagcagtcccagcctagtcagtctagcgagcccagccagccccagcagaaagacccgcagcagcctgcacagcaacagcagcccgcacagcagccgaaaaagccatccccgcaacccagttctccccggcaggttaaaagagccgtagtcgtctcgcctaaggaggaaaataaagccgctggaaaggcttcccttaagcatacttggtag

SEQ ID NO: 113406 - DNA, 1743 bp, Artificial Sequence
  Description of Artificial Sequence: Synthetic coding sequence
atgaaggagaataaagagaattccagcccctccgttacttccgcaaatctggaccatactaagccatgttggtactgggataagaaggatctggcccacactcctagtcaactggaaggactggatcctgctaccgaggccaggtatagaagagaaggggcccgcttcatttttgatgtcgggacccgtctcggcctgcactatgatactctggccacaggcatcatctattttcatcgtttctacatgttccatagttttaagcaatttccccggtacgtgactggcgcatgctgcctgttcctggctggcaaggttgaggaaaccccaaaaaagtgcaaggatatcatcaaaaccgctcgttccctgttaaacgacgtccagttcggccagtttggtgatgacccaaaagaggaggtaatggtcctcgagaggatattactccagaccatcaagttcgatctgcaggtcgaacatccataccagttcctgcttaaatatgcgaaacagcttaagggggacaagaataaaatacagaaactggtacagatggcatggacctttgtgaatgactccctgtgtacaactcttagtcttcagtgggaaccagaaattatcgcggtggccgtcatgtacttagccggccggctctgtaagtttgagatccaagagtggacctccaagcccatgtaccgacgctggtgggagcagtttgtacaggacgttcccgtcgacgtgctagaagatatttgtcatcagatcttagacctctatagccagggcaaacaacaaatgccccaccacacccctcatcagctgcaacagccccctagccttcaacccaccccacaggtcccgcaagttcagcaaagccagccaagccaaagctcagagccgtctcagcctcaacagaaagacccgcagcagcccgctcaacagcaacagcctgcccagcagccaaagaaaccttcccctcagccatcgagcccacgacaggtcaagagagcagtggtcgtcagccctaaggaggaaaacaaagccgcagagcctccgcctcccaaaattcccaagattgaaactacacatcccccgctgccgcccgcccaccctccaccagaccgtaagccccccctggcagcagccctaggcgaggctgagccccctggccctgtggatgctaccgacctgccgaaagtccagattccccccccggcccaccccgcaccagttcatcagccccccccactaccccacagacctccaccccctccgcccagtagttacatgaccggtatgtcaactacatcctcctatatgtccggtgaggggtaccaatccttacagtccatgatgaagaccgagggaccgtcctacggcgctttacccccggcatacggaccacccgcacatctgccttatcatccccatgtgtatcctcccaatcctccaccccctccagtgcctccaccaccagcgagttttcctccgcccgccattccgccgccgacacctggctatcctccgcccccccccacgtacaatcctaacttcccccctcctcctccaaggctgccaccaacacacgccgttcccccacatccacctcccggcctgggtctgccgccagccagctatcccccaccagccgtgcctcccggcgggcagcctccagtgcccccccccattccaccaccagggatgccacctgtgggtggtttgggacgcgccgcctggatgcgatag

SEQ ID NO: 113407 - DNA, 1803 bp, Artificial Sequence
  Description of Artificial Sequence: Synthetic coding sequence
atgaaggaaaacaaggagaatagttctccttcagtgacgagcgccaacctggaccacaccaagccttgctggtattgggacaagaaagatttggctcacacccctagtcagctcgagggtctcgaccctgccacagaggctcgctatcgccgtgagggtgctcgattcatcttcgatgtcggtacgagacttggcctacactacgatacgctagccaccggaattatctactttcatcggttctatatgttccattcatttaagcagtttccccgctatgtgaccggagcctgctgtcttttcttggcaggtaaggttgaggaaacgccgaagaagtgcaaagatatcatcaagaccgcaaggtccctgctcaacgacgtgcaattcggacagttcggagatgacccaaaagaagaggtgatggtcctggaacgtatcttactccagactattaagtttgacctacaggtggagcacccttatcagtttcttctgaaatatgccaaacagctaaaaggcgataagaataagattcagaaactggtgcaaatggcctggacgtttgtgaatgacagtctttgtaccacgctctctctccagtgggagcctgagatcattgcagtagcagtaatgtacctggctgggcgcctgtgtaaattcgaaatccaggaatggacatctaagccaatgtaccgcagatggtgggagcaatttgtccaggatgtgcccgtggacgtgctcgaggatatatgccatcagatcctagacctgtattcacaggggaagcagcaaatgcctcaccatacgccccaccagctgcagcagcctccctcgttacaacctacccctcaggtcccacaggtgcaacaatctcagccctctcaatcctcagaaccctcgcagccccaacagaaagatccgcagcagccagctcaacagcagcagcccgcccagcagcctaaaaagcccagccctcagccttctagtcctcgacaggtcaaacgggccgtggtgtctggtttaaagcaggccctcggacgggccggtttccccgggggggggaataccaccgtggttagtcccaaagaagaaaataaggctgccgagcctccaccccccaagatccccaagattgagaccactcacccccccctacctccggcccaccctcccccagatcgcaagccgccccttgccgcagctctgggggaagctgaacctccaggaccagtcgatgcgacagacctccccaaggttcagatcccacctcctgctcatccggctccagttcatcagccgcctccattacctcatcgccctccccctcctcctccctcttcctatatgacgggcatgagtacaacttccagttacatgtcgggagagggctaccagagccttcagtcaatgatgaaaactgagggtccaagttatggcgcactgccacctgcatacgggccaccggcccatttgccatatcatccccacgtttaccccccaaacccaccgcctccgccggttccgccacccccagcgagctttccgcctcccgctataccacctcccacccccggctacccacctcctcctccaacctataatccaaactttccgccgccaccgcccagactcccaccaacacacgccgtgccaccccacccacctcctggtttgggcctcccacctgcctcatacccccctcccgctgtgccaccaggcggtcagccaccagtccccccaccaatacccccccccggcatgcctcccgtaggtggtctagggcgtgctgcctggatgaggtag

SEQ ID NO: 113408 - DNA, 333 bp, Artificial Sequence
  Description of Artificial Sequence: Synthetic coding sequence
atgaaggaaaataaagaaaattcctcaccctctgtgacaagtgctaatttagatcatactaaaccctgctggtattgggataagaaagacctcgctcacaccccaagccaactggaaggcttagacccagctactgaagcacgctaccggagggaaggagccagattcatctttgacgtcggaacaagactgggcctccactacgacacactggccacgggcattatctactttcaccggttctacatgtttcattccttcaaacaatttccacgctacgtgaccggggcatgttgccttttcttggccggtaaagtggaggagacaccctag

SEQ ID NO: 113409 - DNA, 684 bp, Artificial Sequence
  Description of Artificial Sequence: Synthetic coding sequence
atgaaagagaataaggagaattccagtccatccgtgacctctgctaatctcgatcatacgaagccctgttggtactgggacaagaaagacctcgcacacactccttcccagctggaaggattagatcctgcaaccgaggcgaggtaccggcgggagggtgccaggttcatcttcgatgtgggaactaggctgggactgcactacgatacactcgctaccggcattatctatttccaccgcttctatatgttccactcttttaagcagttcccacgctatgtaacaggggcctgttgtcttttcctcgccggaaaggttgaagagactcctaaaaagtgcaaagatattattaagacagcccgttccctgcttaatgacgtgcaattcggccaattcggtgacgatccaaaagaggaggtaatggtcctcgagagaattctgctgcaaaccatcaaatttgatttgcaggtagagcacccatatcaattcttactgaagtacgccaaacagctcaagggggataagaacaagattcagaagctggtacagatggcttggacgtttgtcaacgattctctttgcaccaccctttctttgcaatgggaacccgagataattgcggtggccgtaatgtacctagctggtagattgtgcaagtttgaaatacaagagtggacgagctag

SEQ ID NO: 113410 - DNA, 519 bp, Artificial Sequence
  Description of Artificial Sequence: Synthetic coding sequence
atggcttctgggccacactcaacagcaacagccgcagcagctgcaagttctgcggcaccctcagctggtgggagctcttccggcaccaccaccaccacaaccacaacgacaggcggcatcttgataggggaccggctttatagcgaggtcagccttacaatcgaccacagtctgattccggaggaacggctctcacctactcccagcatgcaggatggactggatttgccttcagagaccgatctacgcattctcgggtgcgagctcattcaggccgcgggcattctcctccggctgccccaggttgctatggcaacaggacaggtgctatttcataggtttttttatagcaaatccttcgttaagcacagcttcgagatcgttgcgatggcttgtatcaacctcgcgagtaaaattgaagaagcccctaggcggattcgagacgttataaacgtgtttcaccatcttcggcaacttaggggaaaatcggatcagctgcacttaccgaagcctgggtag

SEQ ID NO: 113411 - DNA, 1581 bp, Artificial Sequence
  Description of Artificial Sequence: Synthetic coding sequence
atggcatctgggccacacagtacagccacggctgccgcagccgcctcgagtgccgcacctagcgccggaggaagttcttccgggaccactactacaactaccacaactactggtggtattcttattggtgaccggctgtacagtgaggtgtccctcaccattgatcactcacttatccccgaggaacgactcagccctacacctagtatgcaggatgggctggaccttccatccgaaacggatctgcgaatcctgggatgtgagctgattcaggccgcgggaattctgttgcgcctcccccaagtcgccatggccaccggccaagtcctcttccatcgatttttctacagcaaaagcttcgtcaagcacagttttgagatagttgctatggcttgcattaacttggcctccaaaatagaagaggccccaaggcgcatacgagacgtgattaatgtgttccatcatctgaggcagctgaggggaaaacggacaccatctccactgatcctggaccagaactacattaacaccaaaaaccaggttataaaggctgagagacgcgtgctgaaggagctgggcttttgtgttcatgtgaagcaccctcacaagataatagtcatgtaccttcaggtgttggagtgtgagcggaatcagacactggtgcagacagcgtggaattacatgaacgactcactacggaccaacgttttcgtccgatttcaaccagagacgattgcgtgcgcatgcatttatcttgccgctcgagcattgcagatcccactacccactagacctcactggttcctactgtttgggacaaccgaggaggaaattcaagagatatgcattgagactctgaggctctatacgagaaaaaagccaaactacgagctgcttgagaaagaagtcgaaaaacgtaaggtagctctgcaggaagccaagctgaaggctaaagggctcaacccggacggcacacccgcccttagcaccctgggaggcttttcccctgcctccaagccctctagtcctagagaagtaaaagctgaggaaaagtctcctatctcaatcaacgtaaagacggttaaaaaagaaccagaggacaggcagcaagcctcaaagagtccatacaatggcgttagaaaagattcaaagcggtcacggaacagccgatcagcttcccgctcacgcagccgaaccagaagtcgctcccgatcgcacactcctagacgacactataacaacaggcggtcccgaagtggcacctattctagtcgatcacggtcaaggagcagatcgcactcggaatctccccgtcgccatcacaatcacgggagccctcatctgaaagcaaagcacacccgggatgatttaaagtcctcaaacagacacggccataagcgcaagaagtcacggtcccggtcccagtctaaatcccgcgaccactcagatgccgctaagaagcacaggcacgagcgcggacaccaccgagaccgtcgcgaacgttctaggtctttcgagcgcagccataaaagcaaacatcacggggggtcgagatctggccacgggaggcacagacgctag

SEQ ID NO: 113412 - DNA, 1563 bp, Artificial Sequence
  Description of Artificial Sequence: Synthetic coding sequence
atggcagccgctgcggccgccgctggggctgctggctctgcagctcccgctgcggctgcaggcgctccaggatcaggtggagccccctccggaagccagggagtgctgattggtgaccgtttatatagcggcgtcctcattaccctggaaaactgcctgctgcctgacgacaagcttcgctttacaccttcgatgtcctccggtctggacaccgacacggagacggacttacgtgtggtgggttgtgagttaattcaggcagccggcatactcctgcgtctgccccaggtggccatggcaaccggccaagtactgttccagcggtttttctataccaaaagctttgtgaaacactcaatggaacatgtgtcgatggcctgtgtgcacctggcctctaagatcgaggaagccccgagacgcattcgagacgtgatcaatgtgttccatagactcagacagctcagagataagaagaagccagttcctttgctactggaccaggattacgttaatctcaaaaaccagataataaaagctgaacggagggtcctgaaggagcttggtttttgcgtgcacgttaagcacccccataagatcatagtgatgtacttgcaggtgctggaatgcgagcggaaccagcatctggtgcaaacatcgtggaattacatgaacgatagccttcgtactgatgtgtttgtgaggttccagcccgaatcaattgcatgtgcctgtatttacctcgcagctagaacactggaaattccacttccaaaccgtccccattggtttttgctctttggagccactgaggaagaaatacaagagatctgcctgaagatcttacagctttacgcgaggaaaaaggtggacctaacacacttggaaggagaggtcgagaagcggaagcacgctatcgaagaagcgaaagcgcaggcccgcggcctcctgccagggggcacacaggtgctggatggcacctcggggttcagcccagcccccaaactggtggagagccctaaagaaggcaaggggtctaagccaagccccttgtccgtgaagaacacaaagcgacggctagagggtgcaaagaaagccaaagctgactctcctgtgaacgggctgccaaaaggtcgagagtcacgcagcaggagcagatcaagggagcagtcctactcccgaagccctagccgctccgcctcaccaaagagacgtaagtctgatagcggcagtacctcagggggcagtaagtcccaatcccggtctcggtcccgctctgacagcccacctcgtcaggctcctagaagcgctccttataaaggcagcgaaattcgcggttctagaaagagtaaggactgcaagtacccccaaaagccccataaatcacggagccggtcaagcagccgttcgcgttccaggtctcgtgagcgcgctgacaacccagggaagtataaaaagaagtctcactactaccgcgatcagcgtagagagcggtcaaggtcatatgagcgcacaggtcgaagatatgaacgggaccaccccgggcactctcgacacaggcgttag

SEQ ID NO: 113413 - DNA, 681 bp, Artificial Sequence
  Description of Artificial Sequence: Synthetic coding sequence
atggcagcagctgcagccgcagctggcgccgccggcagtgcagcccctgccgccgcggctggcgctcccgggtctggaggcgcgccatctggcagccaaggcgttctgattggcgatcggctgtactcgggggtccttatcacactcgagaactgcctgcttcccgacgacaaactcaggttcactccgtcaatgagttcaggtctggatacggatacagaaactgatcttagggtggtcggttgtgaactcatccaggcggctggcatccttttacggctgccccaagtggctatggctacaggtcaggttctcttccaacggttcttctacacgaagtcattcgtgaagcactctatggaacacgtgtccatggcctgcgtccaccttgcctcgaaaatagaggaagctcctagaagaatccgggatgtgatcaacgtgtttcaccgtctcaggcagctgagagacaagaagaaacctgtacctctcctgctggaccaagactatgtaaatctgaaaaatcaaatcataaaggctgaacgacgagtgctaaaagaactggggttctgcgtgcacgttaagcacccacataaaatcatagtcatgtacctgcaggtgcttgagtgtgaaagaaaccaacacctagtgcagacctcctgggttgcctcagagggaaaatag

SEQ ID NO: 113414 - DNA, 1044 bp, Artificial Sequence
  Description of Artificial Sequence: Synthetic coding sequence
atgaacgacagtctccgaacagatgtgtttgtacgctttcagccggaatctattgcctgcgcgtgtatctatctcgcagcacggacactagaaataccactacctaataggcctcactggttcttgctgttcggagcaaccgaggaggagatccaggaaatctgcttaaagattttgcagctgtatgcccggaaaaaagttgatctaacccatctcgaaggggaagtggagaagagaaaacatgcaatcgaagagggccctagccccgggcctgtggcgtggggacacactggagccggttggtacttaggagttctgagttgcccacaggctggttgttgggattacagcctcgagtgttccggcgccatttgggaccactgcaagcttaggctgcccgattccggcgactcctgtgcatctgcttctcaggtggcaggaatcgcgggagcacatcaccacgcccagagtctggctgttctgccggtggagagccctaaagagggaaaaggtagcaaaccatctccgctatccgtgaagaatacgaagcgcaggctcgaaggagctaagaaagctaaagcagatagcccagttaacggtctgcccaaaggcagggagtcccgctcacgtagcaggtcccgcgaacagtcatacagtcgctcaccctctaggtctgcaagtcccaagaggagaaaatccgactctggttccacatccggagggtctaagagtcaatctagaagccgctcacgtagcgatagccctcccagacaagctccaaggtccgcaccatacaaaggctctgagatccggggcagtcggaagtccaaggactgcaagtatccccagaagccacataagtctcgcagccggagttcatcccgaagccgaagccgatcccgggagcgggccgacaacccagggaagtataaaaagaaaagccattactacagggaccagcgcagagagcggtctcgttcatacgagaggacagggcgccgttatgaaagagatcaccccggtcatagccgtcataggcgatag

SEQ ID NO: 113415 - DNA, 2856 bp, Artificial Sequence
  Description of Artificial Sequence: Synthetic coding sequence
atggcagccgcagcagctgcggcggctgccgtgggcgttaggctccgcgattgttgtagtcgcggcgccgttctgcttctgttctttagtctgtctcccaggcccccagccgcggctgcgtggctcctgggcctccgacctgaagatacagcaggagggcgcgtgagtctggaagggggtacattgcgggccgcggagggcacctcctttctgctacgggtctattttcagcccggccctccagcaaccgctgcacctgtgccttcaccgactttaaactccggagaaaatggaactggcgattgggccccgagactggtgtttatcgaggaaccacccggaggcggaggggtggctccgtccgccgtgcctactcgcccacccggaccacagagatgccgcgaacagagcgactgggcttccgatgtcgaggtgcttggccctctccggcccgggggcgtcgccggctccgccttagttcaggtccgagtgcgtgagctccgaaagggtgaagcggagcggggtggcgctgggggagggggcaagctgttctcgttatgcgcttgggacggcagagcttggcaccaccacggggccgcgggcggctttctgctccgggtgaggccccgtctttatggtcccggcggcgatctgctcccaccggcgtggcttcgagcactgggtgcacttctcctgcttgcattgagcgcactgttttcgggactgcgactgagtctgctctccctggaccccgtggaactgcgtgtgctccggaattctggcagcgcagccgaacaggagcaagcacgaagggttcaggcagtccgcgggcggggaacccacctgctgtgtacgctgttgctcgggcaggctggagccaacgccgcattggcaggttggctgtatacaagccttcctcctggatttgggggcaccggcgaggactatagtgaagaagggatccacttcccctggctgcctgcacttgtctgtacaggagccgttttcctgggagcagagatctgcccttactccgtgtgttccagacacggtctggcaatcgcaagccatagtgtgtgcttgaccagattgctgatggccgccgcctttcccgtttgttaccctctgggccgactgctagactgggccttgagacaggaaataagtaccttttacaccagggagaagctcctcgagacgctgagagccgccgacccttactctgatctcgtcaaggaagagttgaatatcattcaaggagccctggagctgagaacaaaggtggtggaagaagtgctcacccccttgggcgactgttttatgctgcggagcgatgccgtcttggattttgccacggtctctgagattctgcgcagtggctacaccaggatccccgtgtatgaaggcgaccagcgtcacaacattgttgacatcctcttcgtgaaggatctagccttcgtcgatccggacgattgcacacctctcctgacagtcacccgcttttataacagaccactccactgtgtgttcaacgacaccaggcttgacacagtgctggaagaattcaagaagggtaaatcccacctggccatcgtgcagagagttaataacgagggggaaggagatccattttatgaagtgatgggaatagtcactctggaagatattatcgaggaaattatcaaaagcgaaatattggatgaaacggacctctacacggataacagaaagaaacagcgggtaccgcagcgtgaacgaaagcggcacgacttctccttgttcaagttatccgacaccgaaatgagggtgaaaatctcaccgcagttactactggccactcatagattcatggctaccgaagtggagcctttcaagagcttgtacttgtccgagaaaattttgctgcggcttctgaaacaccctaacgtcatccaagaactgaaattcgatgaaaagaataagaaagcccccgagcactacctctaccagcgcaatcggcccgtggactatttcgtgctcttactgcagggaaaggttgaggtggaggtcggtaaagagggcctgcgatttgaaaacggagctttcacctattatggggtgcctgcaataatgactacggcgtgctccgataacgacgttcgcaaggtggggtccttggccgggtctagcgtgttccttaaccgctcgccctctcgctgctcagggctcaacaggtcggaaagcccgaatagagagaggagtgattttggcggtagtaacacccagttatactctagttctaataatttatacatgccagattactctgtgcatatcctaagtgatgtgcagttcgtgaaaatcacccggcagcagtaccagaacgctcttaccgcttgtcacatggactcgtcaccccagtcgccggatatggaagcctttaccgatggagatagtactaaggcccccacgactcggggtaccccacaaacaccaaaggacgacccagctatcacccttctgaataataggaactccctgccctgtagccgcagtgacggcctaaggagcccgagcgaagttgtgtacctaaggatggaagagctcgcttttacacaggaagagatgacagatttcgaagaacactctacccagcagctgacactgtccccagccgccgtgcccaccagagcagcgtcggacagcgagtgttgcaacataaatctggatacagagacaagcccatgcagcagcgatttcgaggaaaatgttggcaagaaactattgcggaccctgtcagggcaaaagcgaaagcgatcccccgagggcgaaaggacatcagaagataactctaacctgaccccattgattacctag

SEQ ID NO: 113416 - DNA, 2493 bp, Artificial Sequence
  Description of Artificial Sequence: Synthetic coding sequence
atggctgctgccgcagccgccgcggccgcggtaggagttaggttgcgggattgttgcagtcgcggagccgtgctgctgttatttttttcactgtcacctcgccccccggccgcggcagcgtggttactcggcttgaggccagaagacacagcaggcgggcgagttagtctcgaaggcgggacgttacgcgccgccgaggggactagttttcttttacgtgtttatttccagccaggtccaccgagatgtagagaacagagcgactgggcatccgacgtggaggtgcttggcccgctcaggcctgggggagtggctggatccgctctagtgcagctgtttagtctatgtgcctgggatggtagagcttggcatcatcatggagcagctggagggttcttgctaagggtgagacccaggctctacgggccagggggagacttgctacctccggcctggctgagggcccttggagccctccttctcctggctctgtctgccctctttagtggccttcgtctgagcctgctcagtctggatcccgtggaactccgtgtgctccgcaattctggcagcgcagccgagcaggagcaggcccggcgagtacaggcagtcagagggcgcggtacacacctcctgtgcaccctcctgctgggccaagctggagctaatgccgccctcgcggggtggttatatacatctttgccacctggtttcggcggtaccggggaggattactcagaagaaggcatacattttccatggctccctgccctcgtgtgtacaggcgccgtgtttctgggagcagaaatatgcccttactccgtttgtagccgacacggtcttgccatcgcctctcactccgtgtgtctcacaaggcttcttatggctgcagccttccccgtttgctaccctctcgggagattattggattgggccctgcgccaggagatttcaacattttatacaagagagaaactgctcgagacactcagggcggccgacccatattctgatttggtgaaggaagagttgaatatcattcaaggcgccctggagctgcgcacaaaggtggtggaggaagtactgactccactgggcgattgcttcatgctgagaagcgatgctgtgttggattttgccacggtgtcagagattctccgctccggctacactcggattcccgtttacgagggcgatcagcggcacaacatcgttgacatcttatttgttaaggaccttgccttcgtggacccggacgattgcacaccattgttgactgtcactaggttctataaccgcccactgcactgcgtatttaatgacacccgcctggataccgtcctagaggaattcaaaaagggtaaaagtcacctggcaatcgtccaacgggtgaacaatgagggcgaaggcgatcctttctacgaggtaatgggaatcgtgactctggaagatataatcgaagagattatcaaaagcgagatcctcgacgagaccgacctgtacaccgataatcgtaagaaacaacgtgttccgcaacgcgagagaaaacgccacgacttctcgctgttcaaactgtccgacaccgaaatgcgcgtgaaaatcagccctcagctgctacttgcaacacataggttcatggccaccgaagtggaacctttcaaaagcctttacctgtcagagaaaattttgctacgcctactgaagcacccaaacgtgatccaggagctcaaatttgacgaaaagaataaaaaggccccagaacactatctgtaccaaaggaataggcccgtggactacttcgtgttgctcctccagggaaaggtggaggtggaagtgggtaaagagggactccggttcgaaaacggagcctttacttactacggggtgcccgctattatgacaacggcttgctctgataacgatgttcggaaggtaggatccctcgcgggctcctccgtcttcctgaacaggtcgccttcacgctgcagtggcctgaacagatccgagtcgccaaatagggaacgtagcgactttgggggaagtaacactcagctttattcatcaagcaacaacctgtatatgccagactactctgtgcacatcctcagtgatgtgcaattcgtgaagatcaccagacagcagtaccagaatgccctcacggcatgccacatggattcatctcctcagtcccccgacatggaggccttcacagacggggactcgaccaaggctccaacaactcgagggactccgcagacgccgaaggatgatccagccattacccttttgaacaataggaatagcctgccatcctcggattctgaatgttgtaatataaatctggataccgagactagcccttgttcttcagacttcgaagaaaacgttggtaagaagctgttaagaaccctgtctggtcaaaagcggaagagatctccagagggcgaacgcacaagtgaggacaactcaaatctgaccccactaatcacctag

SEQ ID NO: 113417 - DNA, 1824 bp, Artificial Sequence
  Description of Artificial Sequence: Synthetic coding sequence
atggcggcggcgtttccagtctgctacccgttagggcggctgcttgattgggccctccgacaagagatatcgaccttttacacaagggagaaactccttgagaccctcagagctgctgacccctactctgaccttgtcaaggaagagttaaatatcattcagggggctctggagctcagaactaaggtcgtggaggaggtcctcaccccgctgggggattgctttatgctgaggtctgatgccgtgctggattttgcaacagtgtctgagatattgaggtcaggttacacacgcatccctgtctatgaaggagatcagagacataatatcgtggacatattgtttgtcaaagatctggcttttgtggatccggacgattgcacccccctcctgaccgtgacccggttttataataggcctctgcactgcgtttttaacgatacaaggctcgataccgtattggaagagtttaagaaggggaagtcccacttggccattgtgcagagggtgaacaatgaaggagaaggcgaccccttttacgaggttatgggcatcgttactctcgaagacatcattgaagagatcataaaaagcgagattctcgacgagaccgatctctacactgacaatcggaagaaacagagggttccccaacgcgaacgcaagcggcacgatttctctctcttcaaactttctgacacggagatgcgagtaaaaatttcacctcagctactgttagctacccacaggttcatggcaacagaggtcgagccctttaagtccctttacctgagtgagaagattctcctgagactattgaagcaccctaatgtcatacaggaactgaagttcgacgagaagaacaagaaagctccagagcattacctgtaccagagaaacagaccagtggactattttgtgctactgttgcagggcaaggtggaggtggaggtcgggaaagaaggcctgcgttttgagaatggtgcatttacctactatggagtcccagctataatgaccacagcatgttccgacaatgacgtccgaaaggtgggttcacttgctggaagttctgtttttttgccagtatctgtctccagaacttttgccgtcagtagaggcgattcactggccggcagtccagtgaaccgatctcctagtaggtgttcggggctaaaccggtccgagtcccccaaccgagagagatccgatttcggagggtcaaacacccagctgtattcttcttcaaataacctctatatgcccgactacagtgtccacatcctcagcgatgtgcagtttgtgaagatcactcggcaacagtaccaaaatgcgctgacggcctgccatatggactcttcgccccagtcacctgatatggaagcgtttacggatggagacagcaccaaggcaccgaccactcggggaactccccaaacccctaaagacgatccggcaattacactgctgaacaatagaaattctctgccgtgctctcggtctgatggactccgttctccatcggaggtggtctatctgcgtatggaagagctcgcatttactcaggaggagatgactgatttcgaagaacatagcacacaacagctgacgttatcgccagctgcagttcccacacgggccgcatcagacagtgaatgctgcaatatcaaccttgatacagaaactagcccgtgctcaagcgatttcgaggagaacgtgggcaagaagttactgcgaacactctcaggccagaagcgaaagaggagccctgagggtgagaggacgtccgaggacaattcaaacttgaccccactgattacatag

SEQ ID NO: 113418 - DNA, 2643 bp, Artificial Sequence
  Description of Artificial Sequence: Synthetic coding sequence
atggcagctgccgctgctgctgccgccgccgttggcgtgaggctgagggattgttgttcccgcggtgccgtgctgctcctgttttttagtctgagtcctcgccccccagctgccgccgcctggcttttggggctccggccggaggacacggccggggggcgtgtgtccctggaggggggaacgctacgggcagcagaaggtacctcctttctgctgagagtgtacttccagcctggtcccccgcggtgtcgtgagcaatctgactgggcctctgacgtcgaggtgcttgggccacttaggccgggcggtgtcgccggctcggcactagtgcagcttttctcattatgcgcttgggatggtagggcttggcatcaccacggagcagccgggggctttctcctgcgcgtgcgaccccgcctttatggcccagggggcgatctcctgccgccagcttggctgagagccttaggggcactactgctgcttgcactctccgccttgttcagtggtcttcggttgagtctcctctctttagaccccgtggagcttcgagtgctgagaaacagtggtagtgctgctgaacaggaacaggctagacgggtacaggccgtccgaggcagagggactcatctcctgtgcacattactgttaggacaggctggcgctaacgcagccctggcaggatggctgtatacgtccctaccccccgggtttggaggcacaggcgaggactatagtgaggagggtatccattttccatggcttcccgctctcgtgtgtactggcgcggtcttcctgggggcggaaatctgcccctactctgtttgcagccgccatggtctggcgatcgccagccacagcgtgtgcttaacaaggctactcatggcagccgcattccctgtctgttatccattggggcgactgctggattgggcgttgcgccaggagatctccactttctacaccagggagaagcttctcgagactctaagggcggctgatccctactctgacctcgtaaaagaagagcttaacatcattcaaggagccttggagctgaggacaaaagtcgtcgaggaagtactgaccccgctgggtgattgtttcatgctgaggagcgatgccgtgctggattttgctaccgtaagcgagatactgagatcaggttacacccggataccagtatacgaaggagatcagaggcacaatatcgttgatattctgtttgtgaaggatctggcgttcgttgaccctgatgactgtacccctttgcttacagtgacccgattttataacaggcccctgcactgtgtatttaacgatacccgtctggatacagtcctggaggagttcaagaaaggcaagagccatttggcaattgtccagagagtcaataatgagggcgaaggagatccgttctatgaggtcatgggtatcgtcactttggaggacataatagaagaaattatcaaatcggagatcctcgacgaaaccgacctgtacacagataaccgaaaaaaacagcgcgttcctcagcgggagcgcaagagacacgacttctccttgttcaaactgagcgatactgaaatgagggtcaaaatcagcccgcaattactgctggctactcatcggtttatggctactgaggtcgaaccatttaagagcctgtacctgagcgagaagatccttctcagactgctcaaacatcccaacgtgatccaagaactgaaattcgacgagaagaacaagaaggcaccagagcactatctgtaccaacggaataggcctgtcgattactttgtcctgttgctccaaggtaaggttgaagtcgaagtaggcaaggagggcctgcgattcgaaaatggggccttcacatattacggagtacctgctatcatgacgacagcttgttcggacaatgatgtgaggaaagtcggtagcctggctgggagtagcgtgtttctgaaccgcagcccttcccgatgttccgggctcaacagatcagagtccccaaaccgcgaacgctcagactttggaggcagcaatactcagctgtactccagttctaataacctgtacatgccggattattctgtgcacatcttatctgacgtgcaatttgtcaagataacacgacagcaatatcagaatgctctgactgcatgtcacatggacagctccccccaatccccagacatggaagcatttacagacggagactcaacaaaggctcctaccacccggggcacaccacagactcctaaggacgacccagctattacactgttaaataaccgaaattccttgccttgtagcagaagcgatggcttacgctcaccttctgaggtagtgtacctgcgcatggaagagcttgcctttacccaggaggagatgacggactttgaagaacacagcacacagcagctcaccctgtccccagctgctgtgcctactagggccgctagcgactccgagtgctgcaacattaacttagacactgaaacttctccttgctcgagcgattttgaagagaacgttgggaagaagttgctgcggacactgtcaggccagaaacggaaacgcagccccgagggggagagaaccagtgaggataatagtaacttaacacccttgataacctag

SEQ ID NO: 113419 - DNA, 1215 bp, Artificial Sequence
  Description of Artificial Sequence: Synthetic coding sequence
atgggaattgttactctcgaagacatcattgaagaaattataaagtcggagattctcgatgaaactgatttgtacacggacaaccgcaaaaaacagcgggtgccccagagagagcggaaaaggcacgacttctcgctattcaagctgtcagacacagagatgcgcgtgaaaattagtccgcagctgctccttgcaacacacaggtttatggccacagaggtcgagccgttcaagagtctgtacctgagcgagaagattttgttaaggctgcttaaacatcctaacgtgatccaagagttgaagtttgatgagaagaataaaaaagccccagagcattatttgtaccagcgaaaccgaccggttgactatttcgttctactgctgcagggaaaggtggaggtggaagtaggaaaggaagggttgagattcgaaaacggcgcatttacttactacggtgtgcccgccataatgacaaccgcttgcagcgacaacgatgtgcgcaaagttggtagcctggccggctcgtccgtgtttctgaatcggtctccgagccgatgcagcggccttaacagatctgagtccccgaatagagagcgctcggattttggcggatccaatacacagctgtattcctcaagtaataatctctatatgccggactacagtgttcatattctatcagatgttcagtttgtgaaaattacgcgtcagcaataccaaaatgcccttaccgcttgtcacatggactccagtcctcagagcccagacatggaggctttcacagacggcgactccacaaaggcccccaccacaaggggaaccccacagacccccaaggatgaccctgcaatcacactgttgaataatagaaacagcctcccgtgtagcaggtccgatggcttgcggtccccctcagaagtcgtatacctccgcatggaagagcttgccttcacacaggaggaaatgacagattttgaagagcactccacccagcagctgacactaagccctgcagccgtacctacacgcgccgcctctgattccgagtgctgcaatatcaacttggacacagaaaccagtccttgttccagcgattttgaggagaatgtgggaaagaagctgctccgcacactgtccggacaaaaacggaagaggtctccggagggggagcggacttcagaggataacagcaacctaacaccattgatcacttag

SEQ ID NO: 113420 - DNA, 2562 bp, Artificial Sequence
  Description of Artificial Sequence: Synthetic coding sequence
atgattggatgcggcgcctgtgaacccaaggttaagatggctggcggtcaggctgctgcggcattgcctacatggaagatggccgcccggcggtctttgtctgcaagaggtcgaggaatcctccaggccgctgcaggtcggctcctgcccctgctgctgttgtcatgttgttgtggtgccggaggctgtgcagcagtcggagagaatgaggagacggtcattattggactgcgcctggaagacacaaatgacgtgtctttcatggaagggggcgccctccgcgtgagtgagagaacacgtgtcaaactgcgggtttatgggcagaatatcaacaatgagacttggtcacggatcgccttcacagagcacgaacgccggaggcactctcccggagagagagggctgggagggcctgctccaccggaaccagacagtgggccgcaaagatgtggcatcagaacctccgacattatcattctaccgcacatcatccttaacagacgcacgagcggcataattgagattgagataaaaccactgcgcaaaatggagaagagcaagagctactatttgtgtacatccctgtccaccccagccctaggtgccggcgggtcaggcagtactggcggggctgtgggggggaaaggcgggtccggcgtcgccggcctgccccctccgccttgggccgaaacgacctggatctatcacgatggcgaggatacaaagatgatcgtgggcgaggagaagaagttcctgctgcctttttggttgcaggtaatttttattagcctactcctttgtctttcaggcatgttctctggcctgaacttggggttaatggctcttgatcctatggagctccggatcgtgcagaattgtgggacggagaaggagaagaactatgccaagcgaatagaacctgtgagacggcaaggtaactatctgctttgcagcctgctactcggcaatgttctcgtgaacacaactctgacaatcctcctggatgatattgcaggctccgggctcgtggcagtggttgtgtccaccattggcattgtgatcttcggagaaattgttccacaggcgatatgcagtaggcacggtctggctgtgggcgcaaacacaatctttcttaccaagtttttcatgatgatgacattccctgccagttaccccgtgtctaagctgttggactgtgtactcggccaggagattggtaccgtgtataatcgagagaagctgcttgagatgctccgagtcacggatccgtacaacgatctcgtcaaggaggagctgaacattattcaaggtgccctcgagctgcgcacaaagaccgtggaggacgtgatgacccccctgcgagattgtttcatgatcaccggcgaggctatattagatttcaataccatgtcagagatcatggagtccggctacactagaatacccgtgttcgagggcgagaggagtaatatcgtagatctgctgttcgtgaaagacttagctttcgtcgacccagacgattgtacaccactcaaaacaatcacaaaattttataaccacccactgcattttgtgttcaacgacacaaaactggatgccatgttagaagaatttaagaaggggaagagccatcttgctatcgtgcagcgtgtgaataacgaaggagagggcgaccccttttacgaagtgctggggatcgtgactctcgaagacgtaatagaggagataatcaagtcggagatcctggacgagaccgacctgtacaccgataacagaactaagaaaaaggtggcccaccgggaaagaaagcaagacttcagcgccttcaagcagactgatagtgaaatgaaggttaagatatctccccagctgttgttggccatgcatcggtttctggctaccgaggttgaagccttttccccatcccagatgtcagagaagattttacttcgcctcctcaagcaccctaatgtcatccaggaacttaaatacgatgaaaagaacaagaaagccccagagtattacttatatcagcgaaacaagccggttgactatttcgtactcattctgcaggggaaagtcgaggtggaagctggaaaagagggcatgaaatttgaagcaagtgctttctcctattatggcgtgatggccttaaccgcaagtccaggggagaataagtcacctcctagaccctgtggtttgaatcactccgattctttatccaggagcgaccggatcgatgcggtgactcccactcttggatcatcaaacaaccagcttaattcatccttactgcaggtgtacattcctgattacagcgtccgcgccctcagtgatctccagttcgttaaaatctcccggcagcagtaccagaatgctctgatggcttccagaatggacaaaacaccccaatcctccgactccgagaatacgaaaattgagctgactctgaccgaactacatgacggattgcccgacgaaacggcgaatttactgaacgaacagaactgcgtgacccactctaaagcgaatcactctctccacaacgaaggtgccatttag

SEQ ID NO: 113421 - DNA, 1659 bp, Artificial Sequence
  Description of Artificial Sequence: Synthetic coding sequence
atgattgggtgtggcgcctgtgaaccaaaggttaagatggctggggggcaagccgccgccgctcttcctacctggaaaatggccgctcgtagatcattgtcggcgagggggagggggatcctccaggctgccgcgggccgtctattgccactcctgctgctttcatgctgttgcggcgccggcggttgtgccgccgttggcgagaacgaggagactgtcattattggacttcggcttgaagacactaatgatgtgtctttcatggaaggcggtgcacttagagtgagcgaacgtaccagggtaaagctgcgagtatatggacagaatattaataatgaaacgtggagcaggatcgcattcacggagcacgaacggagaagacatagtcccggcgagcgcggactcggcggccccgccccacccgagcccgactcagggccgcaacgctgtgggattaggaccagcgacatcattatccttcctcacattatcctgaacagacggacttctgggataatagaaatcgagatcaagccattacggaaaatggagaagtcaaagtcatattatctgtgcacttcattgtccacccccgcgctgggcgcaggcggatcagggtctacgggcggagccgtgggtggcaaaggtggatctggcgtggctgggcttccccctccaccttgggccgaaaccacatggatttatcacgacggagaagacacaaagatgattgttggtgaagaaaaaaagttcctgttgcccttctggctacaagtgatctttatctctcttttactttgcctctcgggtatgtttagtggacttaacctgggcctcatggcactggacccaatggagttgcgcattgtgcagaattgcgggacagagaaggagaagaattatgctaaaaggatagagccagtaaggagacaggggaactatctgctatgctcactactgcttggtaatgttctggtaaacacaacgttgacgattctgctcgacgatatcgccggctcagggctggtagcagtagtggtatccactatcgggatcgttatcttcggagagatcgtgccccaggctatatgcagtcgccacggtctggcagtcggcgctaacactatctttctgaccaaatttttcatgatgatgacatttccagctagctaccctgtcagcaaacttctggactgcgtcctgggccaagagatcggtactgtgtataatcgtgagaaacttctagaaatgctccgggtcacagatccctataatgacctggtgaaagaggagctgaacatcattcagggcgcccttgagctgcgcacgaagaccgttgaggacgtgatgacacccctccgcgactgctttatgattaccggcgaggctatcttagacttcaacactatgtcagagataatggaaagcggttacacccggatccccgtttttgagggtgagcgtagcaatatagtcgatttgctgtttgtgaaggacttagcattcgtcgaccctgacgactgtactcccctaaagacgattaccaaattttacaaccacccgctacattttgtttttaacgacaccaaactggacgccatgcttgaggagttcaaaaaggagcacaccaataaaaagccaaagtcctatcagcactag

SEQ ID NO: 113422 - DNA, 2628 bp, Artificial Sequence
  Description of Artificial Sequence: Synthetic coding sequence
atgattggatgtggtgcctgtgagcccaaggtcaaaatggcagggggccaagcagctgccgctctgcccacatggaaaatggctgctagaaggagtctcagtgcacgagggcgtgggatcttgcaggccgcggctggccgactccttccactcctgctgctgagctgttgttgtggggccggaggttgtgctgcggtgggagagaatgaggaaaccgtcattattgggttgaggcttgaagacaccaatgatgtgagcttcatggaagggggcgctcttcgggtctcagaacggactagggtgaaacttagggtatatggacagaatattaacaatgaaacatggtcccggatcgcctttacagaacacgagaggagaaggcattctcccggtgaaagggggctgggaggccctgcccctccagagccagattcaggcccccagcgatgcggtatccggactagtgacattattatactgcctcacattatccttaatcgtcgcacttctggcatcattgagattgagatcaaaccactccggaagatggaaaaatctaaatcatactatctttgtacctccctaagcactcccgccttgggcgccggaggatctgggagtactggtggagcggtcggcggaaaaggcgggagcggagtggctgggctacccccgcctccatgggccgaaactacatggatctatcatgacggagaggatacaaaaatgatagtgggagaggagaaaaaatttctgcttcccttttggttacaggtcatttttatttccctgctgctgtgccttagcgggatgttctctgggttgaacctcggcctgatggccttggaccccatggagcttaggatagtccagaattgtggcacagagaaagagaaaaactacgcaaagcggatcgagccagttaggagacagggcaattacctgttatgtagcctgctcctgggaaatgttctagtcaacacgaccctgacgatcctgttggatgacatcgcaggatcgggtctggtcgctgtggtagtgagcactataggaattgttattttcggcgagatcgtgcctcaggcaatctgctcccgtcacggactcgccgtgggagccaacaccattttcctcacgaagttttttatgatgatgacctttccagcctcctaccctgtttctaaacttctggactgcgtgttaggacaggaaatagggaccgtgtacaaccgagagaagctgctggagatgctgagggtcacggacccgtacaacgacctggtaaaggaggagttgaatataatccagggagccctggagctgagaaccaaaacggtagaagatgtgatgaccccgctcagggattgctttatgatcacaggagaagctatcctggatttcaacactatgtccgagattatggaaagtggttacaccagaatcccggtgtttgagggggagcgctccaacatcgtggacctgctgtttgtgaaggatctggccttcgtggacccggatgactgtacaccgttgaaaaccattaccaaattctataaccaccccttgcacttcgtcttcaacgacacaaaacttgacgcaatgctggaagagtttaaaaaaggcaaaagccacctggccatcgtgcagagggtaaataatgaaggtgaaggcgatcctttttatgaggttttaggcattgtgaccctggaggatgttattgaagaaatcatcaagagtgaaattttagacgaaactgacttatataccgacaaccgtaccaagaagaaagtggcccacagagaacgaaagcaggactttagtgctttcaagcagaccgactccgaaatgaaggtcaaaatctcccctcaactcctgcttgcaatgcacaggttccttgctacagaagtagaggcattctcccctagtcagatgagtgagaaaatactgttgcgcctactcaagcatcccaacgtcatccaggagcttaaatacgatgagaaaaacaaaaaggctccagagtactacctgtaccaacggaacaaaccagtcgactacttcgttttgatcctacaggggaaggtggaggtggaggccggtaaggaaggcatgaagttcgaggcctccgccttttcttactatggcgttatggcactgactgcatctccagtgccgctgtcactctctagaactttcgtggtgtcacgaacagagttacttgcagcaggctccccgggagagaataaatcgccaccccgcccttgcggtctgaaccactcagattccctgtccaggagtgaccgcattgatgccgtcactcccacgctggggagcagcaataaccaactcaattcaagcttactgcaggtatacattccggattattcggtgagagcactgtccgatctgcagttcgttaagatctctaggcagcagtaccagaatgctcttatggctagtagaatggacaagactccacagtcctcggatagtgagaacacgaagatagagcttactttaacagagctgcatgacggactgccggacgaaacagctaacctgcttaacgaacagaactgtgtgacccacagtaaagccaaccactctctccacaatgagggggcgatatag

SEQ ID NO: 113423 - DNA, 2565 bp, Artificial Sequence
  Description of Artificial Sequence: Synthetic coding sequence
atgatcggttgtggggcttgtgaaccgaaagtgaaaatggcaggggggcaggctgccgccgcgttgcccacatggaagatggccgccaggagatcactttccgctagagggagaggtattctgcaggcagctgccggtcgactgctcccgctactgctcctcagctgttgttgcggcgccggcggctgcgccgccgtgggagaaaatgaggagaccgtcattatcggcctgcgcctcgaagacacaaacgatgtgagcttcatggagggtggtgctctgagagtgtctgagcggaccagggtaaagctgagggtgtatgggcagaatataaacaatgagacctggtccagaattgcatttacagagcatgagagacggaggcactctcccggtgagcggggcctcggtggacccgctccacctgagccggattccggtccccaacggtgcggcatcagaacctccgacatcataatcctcccccacatcattctgaataggaggacttcgggaatcatcgagatagaaattaaacccctaaggaaaatggagaaatccaagtcctactacctgtgcacatcactttccacaccagccttgggcgcaggtggcagcggctcaacagggggggccgtcgggggtaaagggggtagtggcgtagcaggactcccacccccgccttgggctgagacaacctggatttaccacgacggggaagacactaagatgatcgtgggcgaagaaaagaagttcctgctgcccttttggttacaggtgatttttataagcttgctgctatgtctgtccgggatgttcagcgggctgaaccttggactgatggctctagacccaatggaattgaggatcgtgcagaattgcggaactgaaaaagagaagaactacgcaaaacgcattgaacccgttcgaaggcaaggaaattatctgttatgctcccttcttctcggcaatgtactggtaaacacaacactcacaattctgttagatgacatcgccgggtctgggctggtagccgtcgtggtgtcaacaattgggatagtgatcttcggggagatagtgccccaggctatatgttctaggcacgggttagccgtcggtgctaacacaatcttcttgaccaagttttttatgatgatgacattccctgctagctacccagtcagtaagctcctcgattgtgtgcttgggcaggagatagggaccgtctacaatcgagagaagttgcttgagatgctgagagtgaccgatccttacaatgacctcgtgaaggaggagctcaacatcatccagggcgctctggaattgaggaccaaaaccgtcgaggacgtcatgactccgctgcgggactgctttatgattacgggtgaggccatcctcgactttaacaccatgagtgagatcatggaaagcggctacacacgaatccccgtttttgagggagagcggtctaatatagtcgatcttctctttgtgaaggatctggcattcgttgatcccgacgactgtactcccttaaaaactatcacaaaattttacaatcatcccttgcatttcgtgtttaatgataccaaactggacgccatgttggaagaatttaaaaaaggaaagagccatctggcaatcgtacaacgcgttaacaacgagggagagggagaccctttctatgaagttctcggaatagtcaccctcgaggatgtcatcgaggaaattatcaagtccgaaatcttagatgagacagacctgtatactgacaaccggacgaagaagaaagtggcacatagagaacggaaacaggacttttcagcctttaagcagacagactccgaaatgaaggtaaaaatctcccctcaactcttattggccatgcaccttgttttcatttccattgaagtagaagccttttccccatcccagatgtcggaaaagatcctcctgcgtctgctgaagcaccctaatgtcatccaagagctgaaatatgacgaaaaaaacaagaaggcaccagaatattatctatatcaacgaaacaagcccgtggactatttcgtcctcatcttgcaggggaaagtggaggtagaggcaggcaaggaaggcatgaagtttgaggccagtgcattcagctattatggtgtcatggctctgaccgcaagtccaggcgaaaacaagtcccccccacgaccgtgtggcctgaatcacagcgattcactgtcccgctctgataggatcgatgctgtcacacctacccttgggtctagcaacaaccagctgaacagttcactgctgcaggtgtacattccagattattctgtccgggccctgagtgatctgcagttcgttaaaatctctaggcagcaatatcaaaacgcgcttatggccagccgcatggacaaaacacctcaatctagtgactcagaaaacacaaagatcgagctgaccttaacagagctgcatgacggtctacctgacgagactgccaatctgctgaatgagcaaaactgcgtaacccattcaaaggccaatcatagccttcacaatgagggggctatatag

SEQ ID NO: 113424 - DNA, 2631 bp, Artificial Sequence
  Description of Artificial Sequence: Synthetic coding sequence
atgatcggttgtggggcttgtgagccaaaggtcaagatggccggcggacaggccgcggctgccctccccacctggaaaatggccgctcgcaggagtctgagcgcacgaggacggggcatcttacaggcagctgcagggcggctcctccctctactgttactgtcctgctgttgcggagccggcgggtgcgctgccgtaggagagaatgaagagactgtgattatcggccttcggttggaagatacaaacgatgttagtttcatggagggaggcgctctccgcgttagtgaacgcacaagagtcaagctgagggtctacggccagaatattaacaacgaaacatggagtagaattgcattcacagagcatgagaggcgaagacacagcccgggtgaacggggtttggggggacctgctccccccgaaccagacagtggaccccagcggtgcgggatccggacatccgacatcattattctaccccacattattctcaatagacgcaccagcgggattatagagatagaaatcaagccactgagaaagatggagaagtccaaaagttattacctctgtacgtctttatccacacctgccctgggcgccggggggtctggctctacagggggtgccgttggcggcaaaggaggatcaggtgtagcagggcttcctccccccccttgggccgaaactacatggatctatcacgatggtgaggatactaagatgatcgtgggggaggagaagaagtttctcctgcccttttggctgcaggttatcttcatatctttgctgctttgccttagcggcatgttttccggtctcaacctggggcttatggccctagacccaatggagctaaggattgttcagaactgcgggactgaaaaagaaaaaaactacgctaaacgaattgaaccagtccggagacaggggaattacttgctttgctctcttcttttgggtaatgtgctcgtgaataccacactaacaatcctcctggatgacatcgccggcagcggtctggtggctgtcgtcgtgagcacaatcggcattgtgatcttcggcgaaattgtgccgcaggctatttgttctaggcacggactagctgtgggagctaatactatcttcctcaccaagttttttatgatgatgaccttcccggccagctacccagtgagtaaacttctggactgcgtgttggggcaggagattggaaccgtgtacaacagagagaagctgttagaaatgttgagagttacagatccttataatgatcttgttaaagaagagctgaatatcattcagggcgctctcgagctgaggaccaaaactgtcgaggacgtgatgaccccactccgagattgttttatgatcactggggaagccattttagactttaacacaatgtccgagatcatggagtccggctacactaggatacctgtttttgaaggcgaaagaagcaatattgtggatctcttgtttgtgaaagacctcgccttcgtcgacccagacgactgtacaccgctcaaaactatcacaaagttctataaccatcccctgcacttcgttttcaatgacacaaaactcgacgcgatgctggaagaattcaagaagggcaagtctcatttggctattgtacaaagagtgaataatgaaggcgagggggacccattctatgaagtgctggggattgtaacccttgaggacgttatcgaggagatcatcaaatccgagatccttgatgagacagacctatatacagataatcgcacaaagaagaaagttgctcacagggagcgcaaacaggatttttccgccttcaagcagactgacagcgagatgaaggtcaaaattagcccacagttattattggccatgcacctagtgttcataagcattgaagtcgaagcctttagcccctcccagatgtcggagaagattctcctgaggctcttgaagcacccgaacgtcatacaggagctcaaatatgatgagaagaacaaaaaagcgcctgagtattatctctaccagcgaaataagccagtggattatttcgtgttgatcttgcaggggaaagtggaagtcgaagccggcaaggagggaatgaagtttgaagcgtctgccttctcgtattacggcgtgatggccttgacagcatctccagtccccctgtcgctgtcacgcacctttgtcgtatctagaacagagctgctggccgccggaagtccgggggagaataaatccccacctcggccatgcggcctgaatcactcagactcactctccagaagtgatcgcatcgacgccgtgacacctactcttggtagctccaataatcagctgaattcaagcctcttacaggtgtacatcccagactacagcgttcgagcattatctgacctacagttcgtgaagattagtagacagcagtaccagaatgccttgatggcatctagaatggataagaccccccagtcctccgatagcgaaaacacgaaaatagagcttaccctgacagaactccacgatgggctccccgatgaaacggccaatcttcttaatgaacaaaattgcgtcactcattctaaagctaaccacagtttacataatgagggggccatttag

SEQ ID NO: 113425 - DNA, 1725 bp, Artificial Sequence
  Description of Artificial Sequence: Synthetic coding sequence
atgatcggatgcggggcttgtgagcctaaagtgaaaatggccgggggccaggccgccgccgccctcccaacctggaaaatggcggcgcgtcgcagcttaagcgctcgcggcagaggaattcttcaggcagccgcaggacgattgctcccattactgctgctttcctgctgctgcggagccggagggtgcgctgcggtaggcgagaatgaggaaactgtgatcattggactccgtttagaggatacaaatgacgtcagtttcatggagggcggcgcattgcgggtgtcagagcgcacaagagtgaagcttcgcgtgtacggacagaacattaacaatgaaacctggagtcgcatcgcatttacagaacacgagcggagaaggcacagtcccggtgagcgcggccttggaggaccggctccacctgaaccagattccgggcctcagagatgcggcatccgtacctccgatatcattatcctaccgcatattatcttaaatagaaggacatccggcataatagagattgaaatcaagcctctgaggaagatggaaaaatccaagagctattatctatgcacatctctgtcaacaccagctcttggagccggggggtccggctcaacgggcggcgcggtcggcgggaagggcgggtctggtgttgccggactccccccccctccctgggccgagaccacttggatctaccacgatggagaggacacgaagatgatagtaggggaggaaaaaaaattcctcctccctttctggctgcaggtgatcttcatttcgctactgctatgtttgtccgggatgtttagcggattgaacttgggccttatggcacttgatcctatggagctgcgtatcgtgcagaattgtggcacagagaaagaaaagaactatgcaaaacgcatcgaaccagtgaggagacagggaaactaccttctatgctccctattgcttggcaacgtcttagttaacacaacactgaccattctgcttgacgacatcgctggaagcggacttgtagccgtggttgtgtccaccattggcatagtgatctttggtgaaatcgtaccacaggctatttgttctagacatggtcttgctgtgggcgctaacactatcttcctaactaaattcttcatgatgatgacctttcctgcctcctaccccgtttccaagctgttggattgtgtactaggtcaggagatcggtacagtgtacaatcgcgaaaaactgttggagatgttacgagtgactgacccatataatgatctcgttaaagaagaactcaatatcatccagggagcactggaattgcggacaaaaacggtggaggacgtcatgacccccttacgagattgtttcatgattactggagaggctatcctggacttcaacaccatgtctgagattatggaatccggctatacccggatccctgtattcgagggggagcgctcaaacatagtggacttgctgtttgtgaaggatctggcgtttgtggacccagacgactgcacgccgctgaagacaattaccaagttctacaatcatcccctgcatttcgtctttaacgacacaaaactggacgcaatgttggaggagtttaagaaagagcataccaataagaaaccaaaatcatatcaacactgcaacgaacaaaactgcgttacccatagcaaagctaatcattcgctgcataatgaaggcgccatttag

SEQ ID NO: 113426 - DNA, 2124 bp, Artificial Sequence
  Description of Artificial Sequence: Synthetic coding sequence
atggccgcagccgttgccgcagccggcagactggggtggctcttcgcagccctatgtctgggtaacgccgcaggcgaggctgctccgggcccccgagtcctggggttttgcctggaggaggatggagccgcaggcgcgggatgggtgagaggcggcgccgcgcgggacacaccagacgccacattccttctgaggttatttggtccaggcttcgcgaattcatcatggtcttgggtggccccggaaggcgccggctgtcgggaggaggcagcctcaccagccggggagtggagagctctgcttcgtctacgcttacgagccgaagccgtacgcccccatagtgccctcctggccgttcgggtcgagcccggcggtggagctgctgaggaagctgcacctccatgggcgttgggacttggggcggctgggctgctggcacttgcggctctagctagagggctccagttgagcgctctggccttggcaccggcggaagtccaggtacttagagagtccggcagcgaagcagagcgggctgccgcacgaaggctggagcccgccaggcggtgggcgggctgtgccctgggcgctctattgctgctcgcttccttggcccaagccgcactggctgtccttctttatagagccgcaggccagcgtgccgtgcctgcagttctgggctcagcgggactggtcttcctggttggagaggtcgtgcccgccgccgtatcagggcgctggaccctcgctttggctccacgtgcccttggcctgtctcggctggccgtgctgctcacattgcccgtggccttacctgtggggcagctgctcgaacttgcagctaggcccggtcgattgcgggaacgcgtcctggagttggcccgagggggaggggatccatactctgacttgtctaaaggggtgttacggtgtcgaactgtggaagacgtcttgacgccattggaagactgctttatgcttgatgccagtacagtgctggattttggagttctggcaagcataatgcagtctggtcacactcgtatacctgtctacgaggaggaaagatcaaatattgttgatatgttgtacctgaaggacctagccttcgttgaccccgaggattgcacaccacttagtacaatcaccagattctacaaccatcctctgcacttcgtttttaatgatacaaaacttgacgccgtgctagaggagttcaagagaggcaagtctcaccttgctatcgtacagaaagtgaacaatgagggagagggagatccattttatgaggttctgggtttggtgacactggaagatgtgatcgaagaaattatcaggtctgagatcctggacgagtccgaagactacagggacacagtggtcaagcggaagcccgcgtccctcatggcccccttaaaaagaaaggaagaattttcactgtttaaggtaagcgatgacgagtacaaggtcaccatcagccctcagctgctgctggcaacacaacggtttctgagtcgcgaagtcgacgtgtttagcccccttaggatctcagagaaggtgttgcttcatctccttaagcatccatctgtgaatcaagaggtgcggttcgatgaaagcaatcgtctcgccacacatcactatctctatcagcgttcccagcccgttgactactttattttgatactgcagggacgtgtcgaggttgaaattggtaaagaaggattgaagttcgagaatggggctttcacatactacggagtcagcgccttgacagtaccgtccagcgtgcaccagtcccctgtatcctctctgcagccaataaggcacgaccttcagcccgatcccggagatggcactcactcgtctgcctattgtccagattataccgtccgagccctctctgatttacagctaatcaaagtgactcgcctgcagtacttgaacgcccttcttgccacccgcgcacagaacctccctcagagcccggaaaacactgatttacaggtaatacctggatcacaaactcgactcctgggagaaaaaacaactacagctgctggcagctcccactctagacccggagttcctgtcgagggtagccctggccgcaatccaggcgtgtag

SEQ ID NO: 113427 - DNA, 1980 bp, Artificial Sequence
  Description of Artificial Sequence: Synthetic coding sequence
atggccgccgccgtggccgctgctggaagactcgggtggctgtttgctgccctttgtcttggtaatgcggcaggagaagccgccccagggccaagagtgctgggtttttgcctggaagaggatggcgcagctggggccggctgggtgcgaggcggcgctgccagagatacacccgacgcaacgttcttacttaggttgtttggtccagggtttgccaattcttcatggagctgggtggctccagaaggagccggatgccgggaggaagctgcctccccagcaggcgagtggagagccttactccggctgcgccttagagcagaggctgttcgtccgcattctgctctgctggctgtccgggtcgagcctggtggcggggcagcagaagaagccgcccccccctgggccctcggcctcggcgccgcaggacttcttgccttggccgccctggcgcgagggctgcagctgtccgctctggcgctggcgccggccgaggtccaggtgctgcgagaatccgggtccgaggcagagcgggctgcagcacgccgtttggaacccgctcgtagatgggcgggttgcgctctgggtgctctgttgctattagcgtccctggcccaggctgccttagcggtgcttctctacagggccgctggccagcgtgccgtgccagcagtgctagggagtgccggcctggtgtttctggtgggagaagtcgtgcccgctgccgtgagcgggagatggacgctggcacttgcgcctcgcgctctggggttgagcaggctggccgtattgttaaccctgcccgtggctctgccagtgggacagcttttggaactggcggctagacccgggagactacgagagagagtgttagagctagctagaggtggaggagacccttacagcgacctgtccaagggagtgctaaggtgccgcaccgtagaggatgtgctgaccccacttgaagattgtttcatgctggacgcatctactgtgttagactttggagtgttagcctcgataatgcagtcgggccacacccggattcccgtctatgaagaggaacgctcaaatatcgtcgacatgctgtacttgaaagatctcgcctttgtggaccctgaggactgtaccccactgtccacaattacccggttctacaatcaccctttgcattttgtgtttaatgacaccaaacttgatgcggtgctggaggaatttaaacggggcgatactgttgtcaaaaggaaacccgcttccctgatggccccgctgaagagaaaagaagagttttccctctttaaagtatctgacgatgaatacaaggtcactatctctcctcagctgcttctggctactcagaggtttttgagtagagaggtggacgtcttttctcccttgaggatcagtgagaaggtgctgttacatcttctgaagcacccctccgtgaaccaagaggtgcggtttgatgaaagcaatcgcttagcaacccatcactatttataccagaggagccaacccgttgactattttattctcattttgcaggggagagtggaggttgaaatagggaaggaaggcctcaaatttgagaatggcgctttcacctattatggtgtgagcgccctcacagtaccttcctccgtgcaccaaagcccagtgtccagcttgcagccaattcggcacgacctccagcctgatcccggcgacgggacacactcttctgcctactgcccagactacactgtcagggccctgagcgacttgcagctcatcaaggtgacacggcttcagtacctgaacgctcttctagccactcgggcacagaatctcccacaatcacctgaaaacacagacctccaggtaatccccggatctcaaacccggttactgggtgagaaaactaccaccgctgctggcagtagccattcccgccctggggtcccagtcgaggggtctcctggcagaaacccaggcgtgtag

SEQ ID NO: 113428 - DNA, 2043 bp, Artificial Sequence
  Description of Artificial Sequence: Synthetic coding sequence
atggccgccgctgtggctgctgccggaaggctgggctggcttttcgccgccttgtgtctgggcaatgccgcaggcgaggccgcacctggacctagagtgttaggtttctgtctcgaagaagacggggcagctggggccggctgggttagggggggcgccgcgcgggacactccggatgccacctttctgctccgcctgtttggaccggggtttgctaactctagttggtcatgggtagctcctgagggcgccggttgtcgggaagaggcagcctctccagcaggcgagtggagggccctcctgagacttcgtcttagagctgaggccgttcgccctcatagtgccctgttggccgtccgagttgagcctggtggaggagcggcagaggaggccgctcccccatgggccttgggcctgggcgcagccggcctcctcgccctcgctgctctggctagggggctgcaattgtccgcactcgcacttgcacccgcagaagttcaggtactaagagagagcggatctgaggcagagagggccgccgccagaaggctggagccagcacgccgatgggctggctgcgccctgggggccttgttgctgttggccagccttgcccaagccgcccttgccgtactcctgtacagggcggccggtcagcgggcagtgccagcagtactcggaagcgccgggcttgtgttcctcgtgggcgaagtggtccccgccgccgtctcaggcaggtggaccttagccctggccccccgtgcactgggcctatccaggctggcagtgctactcaccctccccgtggcactacctgtcggccaacttcttgaactggccgcccggccaggtcgtttacgcgagagagtactcgaactagccagagggggcggagacccttattccgatctgtccaaaggcgtgttgaggtgcagaacagtagaggacgtgttgacccctctggaggactgctttatgttggatgcaagtaccgtgctggatttcggggtactggcttctatcatgcaaagtggccatactaggattcctgtttatgaagaggaacgctcaaatattgtagatatgctatacttaaaggaccttgcctttgtggaccctgaagattgtacgccgctctccaccataaccagattctataaccaccccctgcatttcgtgttcaatgatactaagttggacgcagtgctcgaagaattcaagcggggggataccgtcgtgaagcggaaacccgcttcactgatggctcccctcaagagaaaggaggaattctccctgtttaaagtcagtgacgacgagtataaggtgaccatctctccccagctgctgctagctactcagaggttcctatcccgggaggtggacgtctttagcccactccgcatttctgagaaggtgctcctgcacttgcttaaacatccatctgttaaccaggaagtaaggtttgatgaaagcaatcgcctggcaacccaccactatctttaccagcgtagtcagccagtggactattttatacttatactccagggtcgggtggaagtggagattggcaaagaagggttgaaattcgagaacggtgcttttacctactacggcgtgtctgcacttacggtgccttcttctgtccaccagagtcctgtatcaagcttacaacccatccgacatgatctgcagcccgatccaggagacggcacccactccagcgcctactgcccagactatacggtgcgcgccttgtccgacctgcagcttattaaggtgaccagattgcagtatctgaatgcattgttggcgactcgggcccagaacctacctcagtcaccagaaaacacagacctccaggtgattcctgggagccagactcgattactgggcgagaagaccaccacagccgccggaagcagccactccaggcctagcctgcctcttcttccacgcggtagagacagtgctgcttacagtgattcggacctattcggactctcccacctagtctcagccgtgacagcttttgtttggccatag

SEQ ID NO: 113429 - DNA, 2328 bp, Artificial Sequence
  Description of Artificial Sequence: Synthetic coding sequence
atggcacccgtgggcggcggtggcagaccggtggggggacccgcgaggggtcgcctgctgttagccgctcccgttctgctcgttctgttatgggcacttggagcaagaggacagggcagccctcagcagggcacaatcgtcggcatgcgtttggccagctgcaataaaagttgcggcaccaatccggacggaataatctttgtttccgaagggagcaccgttaacctgcggctttacggctactctttgggcaacatttctagtaatctgatatcctttaccgaggtcgatgacgcagagaccctgcataagagcacctcctgtctggagctcaccaaagacctcgtggtacagcagctggtaaatgtgagtagaggaaatacgtcaggtgttttagtggtcctgaccaagttccttcggaggagcgagagcatgaagctgtatgcgctgtgcacccgtgctcagcccgacggcccttggctgaagtggacagacaaagatagcctcctatttatggtagaagaacctggaaggtttttgccgctttggctgcacattctcctgattacagtgctcctggtcttgagcggaatttttagcggccttaacctcgggctgatggcgttggaccctatggagctacgtatagtccagaattgcggaaccgagaaggagcgaagatacgccaggaaaatcgagccaatcaggagaaaagggaactatctgctgtgcagtctgctgcttggtaacgtactggtaaatacatccctgactatactgcttgacaacctcatcggatcaggcttaatggccgtggcctcctcaactatcggaatcgtaatttttggagaaatcttgccacaggccctgtgttctagacacgggcttgcggtgggtgccaatacgatcttgctcaccaaattcttcatgctgctgactttccctctgtccttccccataagcaagcttctcgacttctttctgggccaggaaatcaggacagtctacaatagagagaagttgatggagatgcttaaggtgacagaaccatataatgacttggtaaaggaagaactgaacatgattcagggggctttagaactccgaactaaaactgtcgaggacatcatgactcagctgcaggactgtttcatgatccgctctgatgcgatactggatttcaatacaatgagcgagataatggagagcgggtatactcgcattcccgtgttcgaggatgaacaaagcaatattgttgacattctttacgtgaaggacctagcttttgtggacccagacgactgcacacctctgaagactatcacaaggttctacaaccacccagtgcatttcgtgttccatgatactaagttggacgctatgctggaggaatttaagaagggaaaaagtcatctcgcaattgttcagaaggtcaacaatgagggagagggagacccgttctacgaagtgctaggcttggttaccctcgaggatgttatagaagaaattattaagtcagaaatcctggatgaaagtgacatgtacactgataaccgttccagaaagagggtctccgaaaagaacaaacgagattttagcgcattcaaagacgccgacaacgagctgaaagtgaaaatctcgccccagttactcctcgccgcccatcggtttcttgctacagaggtcagccagttttcaccctctttaatcagcgaaaagatcctgctccggttgttgaagtaccccgacgtgatacaggagctaaaattcgatgaacataataagtattacgctcgccactatttgtatacacggaataagcccgctgattattttatcctgatcctccagggcaaagtggaagtggaggcgggcaaggagaatatgaaatttgagacgggggcgttctcatactatggcacaatggcccttactagcgtcccttcagacagatcccctgcacaccctacacctttatcaagatccgcctctctctcataccccgataggactgatgtgagcacggctgcaactctcgccggctcttccaatcagtttggctcttcagtgctggggcagtacatctccgatttttcagtccgcgcactggtggatctgcagtacatcaaaatcacccgccagcagtatcaaaatggactgctggcatcgaggatggagaattccccccaattccctattgatggctgtacgactcacatggaaaatcttgccgaaaagtccgagctgcccgtcgtcgatgaaaccacgacacttctgaatgagcgtaacagccttcttcataaagcatcacacgagaatgcaatatag

SEQ ID NO: 113430 - DNA, 792 bp, Artificial Sequence
  Description of Artificial Sequence: Synthetic coding sequence
atgtataccgacaacagatctcggaaaagagtctcagagaagaataagagggactttagtgctttcaaagatgctgataatgaactgaaggtcaagattagccctcaactgctgctggcagctcaccgattcctggccaccgaggttagccagttttctcccagtttaatctccgagaagatccttttgcgactgctgaaatatcccgacgtgatacaagagctcaaattcgatgaacacaacaagtactacgctaggcactacctgtacactcgaaacaagcctgccgattattttatccttatactgcagggtaaggtggaggtggaagctggtaaggaaaatatgaaatttgagaccggagcattcagctactatggaaccatggctctgacatcggtgcccagcgaccgctcccccgctcaccctacaccgctatcacgaagtgcctccctcagctacccagaccggaccgacgtgtctacggcagctactcttgcaggaagtagcaaccagttcggcagtagcgtactaggacagtacatatcagatttcagcgttagggccctggtggacttacagtacattaagccccagtcctggccctgcttctcacggccaggtgatcgagtgtgcttacccgcacccccgtctatgaatagctccctaccgcacgcagaccactctgccgcggtaccagagagagccgccggattttcccacggagaacagcctagcgtcagtcaccgcagagtacatcatccgcatggagagcttgggagggaagtgtag

SEQ ID NO: 113431 - DNA, 2193 bp, Artificial Sequence
  Description of Artificial Sequence: Synthetic coding sequence
atggcatcggggaggggtgcgtctagcagatggttctttactcgggaacagctggagaacactccatcccgccgatgtggagtggaggctgataaagagttgagttgtagacaacaagccgccaatctaatacaggagatgggacagaggctcaacgtgtcgcagctgaccatcaatacagccatagtctacatgcaccgcttctatatgcaccactccttcacaaagtttaataaaaacataatctcttccacagcactgttcctggctgccaaagtcgaagagcaggcgagaaagctcgagcatgtgattaaggtggctcatgcatgtctgcacccactggaacccctgctggatactaaatgtgatgcatatttacagcagactcaggaactcgtaatactggagaccattatgctacagactctcggttttgaaatcaccatcgagcatccgcatactgacgtggtgaaatgtacacaactggtgcgggcttccaaggatcttgcgcagacatcctattttatggccaccaattccctccacctgacaaccttctgcctgcagtacaagccaacggtgattgcctgcgtgtgtatacatctcgcctgtaagtggtcaaattgggagatcccggtgagtactgatggtaaacattggtgggaatacgttgatccaaccgtaaccctcgaattgctggatgagctcacccatgaatttttgcagatcctggagaaaacgcctaacaggctcaagaagatccggaattggcgcgcaaaccaggccgcacgaaagccaaaggtggacggacaagtcagcgagacacccttgctgggctcgagtctggtgcagaatagtattctagtggactccgtcactggggtgccaactaacccgtcatttcaaaaaccttcaacttccgctttccccgctcccgtcccattgaatagcggcaacatctcagtgcaagactcgcatacgtccgacaatctgagcatgctggctactgggatgccctcaacgtcttacggcctctcttcccaccaggagtggcctcagcaccaggactcggctcgcacagagcagctgtattcacaaaagcaggagacttcactgtccggatcacaatacaatatcaactttcagcaggggccctctatcagtctgcatagcggcttacaccataggcctgacaagattagcgatcatagctccgtgaagcaggagtacactcacaaagcaggctctagcaaacatcacggccccattagcacaacacctggcattatccctcaaaagatgtcgctcgacaagtacagggagaagcgaaagctggaaaccctggaccttgacgtgagggaccattacatcgccgcacaggttgaacagcagcacaagcagggccagtctcaagcagcctctagcagttccgtaacatcccccataaagatgaagatcccaatcgcaaacacggagaaatacatggcggataaaaaggagaaaagcggcagcttgaaactaaggatccctatcccccccaccgacaagagcgcatcgaaggaagagttaaaaatgaaaataaaagtcagcagctctgagcgacactcctccagcgatgaagggtccggcaagtcaaagcactccagtccacatatctcccgagaccataaagaaaagcataaagaacacccaagcagccgccatcatacatctagccataaacattctcactcccacagtggctcttcctcgggggggagtaaacacagcgcagacggtatcccaccaaccgtacttagatcccccgttggcctcagctcagatggcatttccagcagcagttcctccagccgaaagcgtctgcacgtcaacgacgcaagccacaatcaccactccaaaatgagtaaaagcagtaaaagcagtgggtccagcagctcctccagctcctctgtgaagcaatacattagttctcataatagcgtgtttaaccaccccttaccacccccaccacctgtcacctatcaggtgggttacggacatctgtccacattagtcaaactggacaaaaaacccgtcgaaaccaatggccccgatgctaatcacgaatattcaacttccagccagcacatggactacaaagatactttcgacatgttggacagcctactgtccgcccaaggcatgaatatgtag

SEQ ID NO: 113432 - DNA, 1992 bp, Artificial Sequence
  Description of Artificial Sequence: Synthetic coding sequence
atggcttccggaagaggtgcttcaagtcgttggttctttacgcgagagcaactcgagaacacaccaagtagaagatgtggtgtcgaggctgataaagaactcagctgcagacagcaggccgcaaacttgattcaggaaatgggccaacgcctgaatgtgagccagctaactataaatactgctatcgtttatatgcataggttctacatgcaccacagctttactaaattcaacaaaaatattatatccagtacagccctgtttctagctgccaaagtggaggaacaggcccgcaaactggaacacgtaatcaaagtcgctcacgcctgcctacaccccctggaacccctgctggacactaagtgcgatgcttacctccagcagacccaggagctggtaatcctggagactattatgctccagactttaggttttgaaatcactattgaacacccgcacacagatgtcgtgaaatgtacgcagttagttagggcaagcaaagacctagcccagacgtcctatttcatggccacaaattctctgcacctgactacattctgcctgcagtataagccgaccgtaatagcctgcgtatgtattcatttggcttgtaaatggagcaactgggagatccctgtgagcaccgacggcaaacactggtgggagtatgtagatccaaccgtgaccctagagctgctggatgagctaacccacgagttcctgcagattctggagaagacaccgaacagattaaaaaaaattcggaattggcgtgccaaccaggcagcccgtaaacccaaggtcgatggccaggtgtctgagacacccctgttgggctcttctttggtgcagaatagcatcctcgtagactctgtcaccggggtccccacaaacccatcctttcagaaacccagtaccagcgcttttcctgccccagttcctctgaattcagggaacatctctgtgcaggattctcacacttccgacaatctaagcatgctcgcgaccgggatgccctctacctcttacgggcttagcagtcaccaagagtggccacagcaccaggacagcgcacgtacagagcagttgtactctcagaagcaggagactagtcttagcggttcccagtacaatattaacttccagcaggggccttctatttcactgcattcaggacttcatcaccgaccagataagatatccgatcactcatccgttaaacaggagtatacacataaagcggggtcaagtaagcaccacggccccatcagcaccacccccgggattatcccgcagaagatgtcgttagacaagtatagagagaaacgcaagcttgaaaccctcgacttggacgtccgcgaccattatatcgccgcccaggtcgagcagcagcacaagcagggtcaatcacaggctgcctctagcagctccgtcacctcccctatcaagatgaaaattcctatcgctaatactgaaaaatacatggctgataaaaaggagaaatcagggtcactcaaactgcggatacctatcccaccgacagataagagtgcgagcaaagaggagctcaagatgaaaatcaaggtctccagtagcgagcgtcatagctccagcgacgaaggcagtggcaaatcaaagcactcatccccacatatcagccgagatcataaagagaagcacaaagaacacccctcttccaggcaccacacctccagccacaagcattctcattcccactcagggagctcctccggaggatccaaacattcagccgacgggatcccccccaccgtgctcaggagccctgtggggctgagtagtgacggtatctctagttctagttccagctccaggaaacgcctccatgttaacgacgcctcacataaccatcacagcaagatgtcaaaaagtagtaagtcatccggagggctccgtactagccagcatcctcgcgaaaccgggcaagaggcctccggggaccagcggtcttag

SEQ ID NO: 113433 - DNA, 1467 bp, Artificial Sequence
  Description of Artificial Sequence: Synthetic coding sequence
atggccactaatagcctccatctgaccacattctgcttgcagtacaagcctacagtaattgcttgtgtatgtatccacttggcctgcaaatggtcgaattgggagattccggtgtctaccgatggcaagcactggtgggagtatgttgaccctactgtgaccctggaattacttgacgaacttacccacgaatttctgcagattctagagaagacacccaacaggctaaaaaagatccgcaactggcgtgctaatcaggctgcccgcaagcccaaggtggacggccaggtctctgaaacccccctcctaggatcttctcttgtacagaactcaatcctggttgactccgtcacgggggtcccaacaaatccatcatttcagaagccgtctacctccgctttccctgcaccagttccactaaactccggcaacatttccgtccaggattcccatactagtgataacctctcaatgcttgccactggaatgccaagcacaagttatgggctgtcttctcaccaagagtggcctcaacaccaggattccgctagaactgagcagctatactcacagaaacaggagacctccctatccggctcgcagtacaatataaattttcaacagggcccttccatctccctgcatagcggccttcaccatagacctgataagatatcagaccattctagcgtgaaacaggagtatactcataaggccggctctagtaaacaccatggacctatcagcacgacaccgggcattatccctcagaaaatgagcctggacaagtatcgtgagaagagaaagctggaaaccttggatctggatgtccgggaccactatatcgctgctcaggtggagcagcaacacaaacaggggcagtcccaggcagcaagtagttcctccgtgacctcccccataaagatgaaaattcccatcgctaacaccgaaaagtatatggccgacaagaaggagaagtcaggttcactcaagctccggataccaatcccccctacagataagagtgccagtaaggaggagctgaagatgaagattaaagtgtcctcatctgagcggcatagcagtagcgacgagggaagtggtaaatcaaaacattctagtccacacataagtcgcgaccacaaagagaaacacaaggagcacccgagttcacggcaccacaccagttctcataagcacagccatagccatagtgggagttcctcaggagggtctaaacattccgcggacgggatccctcctacagttctgcggtcaccagtgggccttagtagcgatggtatctccagctcatcaagttcttcccgaaagcgcctccatgttaatgacgcgagccataatcaccattccaaaatgagcaagtcctccaaaagttcaggcggccttcgcacgtcacagcatccaagggagaccggtcaggaagcctccggggatcagcgctcctag

SEQ ID NO: 113434 - DNA, 864 bp, Artificial Sequence
  Description of Artificial Sequence: Synthetic coding sequence
atggagttcaacccaagtgatcacccgcgggcctcaacgatcttcctttccaaatctcagaccgatgtcagggaaaagcgcaagtccctgttcataaaccatcatcctccaggtcaaattgcacgaaaatactcttcatgctcgactattttcctcgacgactccaccgtttcgcaacctaatttaaagtacaccattaaatgtgtggcactggccatctattaccacattaagaatagggatcccgacggtcggatgctgttagacatctttgacgagaacttacaccccttaagcaaatcggaagtcccccccgactacgacaagcacaaccctgaacaaaagcaaatctacagattcgtgaggacgctgttttcagcagcccagcttaccgccgagtgcgccatagtgacattggtgtacctggaaagactgctgacttatgccgagatcgacatttgccctgccaattggaagagaatcgtgctgggagccatcctactcgcttccaaggtgtgggacgatcaggccgtatggaatgtagactactgccagattctgaaggacataacagtggaggacatgaacgaactggaacggcaatttttggagttgttgcagtttaatattaacgtgccttcttccgtctacgctaaatattactttgatctccgatcattggcagaagccaataatctcagctttccactagaaccactctctagagaaagagcccacaaattggaggcaattagtaggctttgtgaggacaagtacaaggatctaagacgcagtgcccgcaagaggagcgccagcgcagacaacctgacattacccagatggtctccggcaatcattagttag

SEQ ID NO: 113435 - DNA, 951 bp, Artificial Sequence
  Description of Artificial Sequence: Synthetic coding sequence
atgggtaatacaacctcttgttgtgtgtcttctagtccaaagctgcgtcggaacgctcattccagactcgaatcctataggcccgacaccgatctgtctcgggaggatacaggttgcaatttgcagcacatctccgatcgcgagaacattgatgtaagggaaaaacggaagtcattgtttatcaaccatcacccacctggccagatagcaaggaaatattcgagttgtagcaccattttcctggacgatagcacagtctcacaaccaaatttgaaatacaccattaaatgtgttgcgttagcaatttactaccacattaagaatcgcgatccagatggacgtatgctgcttgatatctttgacgaaaatctgcaccccctgtcaaaatctgaagtcccgcccgactacgataagcataaccctgaacagaagcagatttaccggttcgtgcggaccctcttctccgctgcccagctgaccgcagaatgtgcaattgtcaccttagtgtacctagaacggctcctgacctacgccgaaattgacatatgccccgccaattggaaaagaatcgtattgggagccatcctcctggcctccaaggtgtgggatgaccaggcggtatggaacgtggattattgtcagatcctgaaagatataactgtggaggacatgaatgagttggaaagacagttcctcgagctgttgcagttcaatatcaacgtgccgtcttctgtgtacgcaaaatactacttcgacttgcgatcactggccgaggccaacaatctgtcattccccctggaacccttgagcagggaacgggctcataagttggaagcgatttcccggctatgtgaggacaaatataaggaccttagaagaagtgccagaaagaggagcgccagtgctgacaatctgaccttaccccgctggtccccagcaatcatctcgtag

SEQ ID NO: 113436 - DNA, 1026 bp, Artificial Sequence
  Description of Artificial Sequence: Synthetic coding sequence
atgggaaacacaacctcgtgttgcgtctcgtcatccccgaagctgcggagaaatgcacacagccggctagaaagctatcgccccgacaccgacttaagtagagaagacaccggatgcaatctccagcacattagcgatagagaaaacatagatgaccttaatatggagtttaatccaagtgaccatccccgcgcaagtacaatcttcctcagcaaaagccagacagatgtcagggagaaacggaaatctctgttcattaatcatcacccccctggccagattgcccggaagtactccagctgttctaccatcttcctggacgacagcacagtttcccagccgaacctcaaatacacaattaaatgcgtcgcacttgccatctactatcatattaaaaatagagaccccgacggtcggatgctgctggatatctttgacgaaaacctccaccccctgtccaaatccgaagtgcctcccgactacgacaagcacaaccctgagcagaagcagatctaccgctttgtaaggacactgttttcagccgcccagctcacagccgagtgtgccatcgttacgctcgtttacctggagagattgttgacgtatgcagagattgatatctgccccgccaactggaaacgaattgtcctgggggccattctgctggcatcaaaggtgtgggacgatcaagccgtttggaatgtcgattattgccagatccttaaggacatcaccgtggaagatatgaatgagctcgaaaggcagttcttggagctattacagttcaacatcaatgtcccatcaagcgtgtacgccaagtattactttgatctgcgtagtttggccgaggccaacaacctctcatttccactcgagcctcttagtagagaaagagcccataaactcgaggcaataagcaggctgtgcgaggacaagtacaaggaccttaggcgaagcgcacggaaacggagtgcctccgctgataacctgaccctcccacgctggagccctgccattatctcctag

SEQ ID NO: 113437 - DNA, 864 bp, Artificial Sequence
  Description of Artificial Sequence: Synthetic coding sequence
atggagttcaatcccagcgaccatccaagggcctctacgatattccttagcaagtctcagacagacgttcgtgagaaacgcaagagtttgtttattaatcaccacccacctggacagattgcccgtaagtatagtagctgtagcactatatttttggatgacagcaccgtgagtcaacccaacctcaaatacactattaagtgtgtcgccctggccatctattaccacatcaagaaccgagatccggatggcagaatgcttctggacatctttgatgaaaacctgcatccgctgtctaagagcgaggttccgcctgattatgacaaacacaatcctgagcagaaacagatttaccgctttgttagaactctgttttccgcggcgcagctaactgctgagtgcgctattgtgactctggtttacctggagcggctgctcacatacgccgaaatcgacatctgtcccgcgaattggaagcgcattgtactgggtgctatcctgttagccagcaaggtctgggatgatcaggccgtttggaatgtagactactgtcagatcctgaaagacatcaccgttgaggatatgaacgagctagagcgtcagtttctagaacttctgcaattcaatatcaatgtgcctagcagcgtgtacgccaagtattatttcgatttgagaagcctggctgaagctaacaacctgtcttttccactggagcctcttagcagggagcgggctcataaactcgaagctattagtaggctgtgtgaggacaagtacaaggatctccggaggtcagcaaggaagcgtagtgccagcgcagataacctcacactgcccaggtggtcccctgccatcatttcgtag

SEQ ID NO: 113438 - DNA, 627 bp, Artificial Sequence
  Description of Artificial Sequence: Synthetic coding sequence
atggatccggatggaaggatgctgcttgatatctttgacgagaatctacacccactttctaaatccgaagtgccgccggactatgacaaacacaatcccgagcagaaacagatttaccgctttgttcgcacgctgttctctgccgcccagttgaccgccgagtgtgcaattgttaccttggtctatctggagaggctgctcacctatgccgaaattgacatctgcccagccaactggaagcgaatcgtgctgggcgcgatcctgttagccagtaaggtttgggacgaccaggctgtgtggaacgttgattactgtcagattcttaaggatatcactgtcgaagacatgaatgaactcgagaggcagtttcttgagctgttgcaattcaatattaacgtaccctcaagtgtgtatgccaaatattattttgacctgagatcactggcagaagcaaataaccttagctttcccctggagcctctctctcgagagagggctcataagctggaggcaatcagccgactctgcgaggataagtacaaggatctcagacggagtgccaggaaacgcagcgcctccgcagataaccttaccctgcctaggtggagccccgccattattagctag

SEQ ID NO: 113439 - DNA, 1026 bp, Artificial Sequence
  Description of Artificial Sequence: Synthetic coding sequence
atgggaaataccacaagttgctgcgtgtcatcatcgccaaaactccgacggaacgcacattctaggttggagagttatagacctgataccgatttgtcccgggaagataccggttgcaacctgcaacatatttctgatcgggaaaacattgatgatctcaacatggagttcaaccctagcgatcacccccgggcttctacgatctttctgtctaaaagccagacagacgtgcgtgaaaagcgcaaaagcttgtttatcaatcatcatccccccggccagatcgcccgtaaatactcaagctgtagcacaatcttccttgacgattccactgtgtcacagccaaacctgaaatacaccatcaaatgcgtagcactcgcgatatactaccacatcaagaatagagaccccgatggacgaatgctgcttgatattttcgacgagaacctgcacccgctgagtaaatccgaggtccctcccgactacgacaagcataatccagagcagaagcagatttaccgttttgtgagaacgctcttctctgctgcacagctaaccgccgagtgtgccatagtgaccttggtctacctggaaagactgctgacctatgccgagatcgacatctgtcctgcgaactggaaaaggatagtcctgggggctattctgctggcatcaaaagtatgggacgaccaggccgtgtggaatgtcgactactgtcaaattctgaaagacataactgtggaggacatgaacgagctcgagcgtcagtttctagaacttctgcaatttaatatcaacgtcccatcttccgtgtatgccaagtactattttgatctgagatccttggctgaggctaataatttatccttccctctagagcccctctctagggagcgcgctcataagcttgaagcaattagtcggttgtgtgaggacaaatacaaggacctccgcagatctgcacgcaaaagaagtgcctcagctgataatctgactctccctcggtggtcgcctgccataatttcctag

SEQ ID NO: 113440 - DNA, 942 bp, Artificial Sequence
  Description of Artificial Sequence: Synthetic coding sequence
atggaacccatgtaccaggacagagccagagatacccagactgacgagatcgtcgcattaaaaaaagtacgcatggataaagagaaagatggtattcccatcagtagtctgagggaaattacgctgctgttgcggcttcggcatcctaacattgtcgagttaaaagaagtggtggtgggcaatcacttggaatccatcttccttgttatgggctattgcgaacaagaccttgcctctctgctagagaatatgccaacaccctttagtgaagcacaggtcaagtgcattgtgcttcaagtgctgaggggcctgcagtacctccataggaactttattattcatagagacctgaaagtgagcaacttactaatgaccgacaaaggctgcgttaagaccgctgatttcgggctagcacgggcctatggggttccagtgaaaccgatgacccccaaagttgttaccctatggtacagggcccctgagctgctacttggcacgactacacagaccacctccattgatatgtgggctgtgggatgtatcctggccgagctcctggctcatcggcccttgctgcccggaacctccgagatccatcagatcgacctcattgtgcagctgcttgggaccccatctgagaatatctggccagggtttagcaagctccctctggtggggcagtatagtctccggaagcagccttacaacaatcttaagcataagttcccttggttgtctgaggccggcttgcggctcttacacttcctgtttatgtacgaccccaagaaacgggcgactgctggcgattgtctcgagtcaagctatttcaaagaaaagccactgccctgcgaacccgagttgatgcccacttttcctcatcaccggaataaaagggctgcccccgccacctcagaaggtcaatctaagagatgtaagccatag

SEQ ID NO: 113441 - DNA, 1083 bp, Artificial Sequence
  Description of Artificial Sequence: Synthetic coding sequence
atggccgaaccagacctggagtgtgagcagataaggcttaagtgcatccgaaaagaaggcttctttaccgtgccacccgagcaccgcctgggcaggtgtagatccgtcaaggagttcgagaagttgaataggattggggaagggacttacggtattgtctatcgcgccagagacactcagacagacgaaatagtggcattgaaaaaagtccgaatggacaaagagaaggacggcatcccaattagttcgctgcgcgagatcactctactactgaggctgaggcatccaaacattgtggagctaaaagaggtcgtagtcgggaatcatctcgagagtatcttcttggtgatggggtattgcgagcaggatctggctagtctcttagaaaacatgcctacacctttctctgaggcacaagtcaaatgtatagtgcttcaggtgctgagaggcttgcaatatttacatcggaacttcatcatccaccgtgacctcaaagtctccaatctactgatgaccgacaagggatgtgtaaagacagcggacttcggacttgcacgagcgtacggagtccccgtcaagcccatgactcctaaggtggtgaccctgtggtatagggctcctgaactgctgctgggcacaacaacacaaacaactagcatcgatatgtgggcagtagggtgcatactggccgaactgctcgctcaccgtcctctccttcctggtacatctgagattcaccagatcgatttaattgtacaattactgggcacaccaagcgagaatatctggcctggcttctccaagttgcctctcgtcggacagtactcactccgaaagcagccttataacaatcttaagcataagttcccctggctgagcgaggccggccttcggctccttcactttctcttcatgtacgaccctaagaaaagggccactgccggcgattgcttggaaagcagctatttcaaggaaaagccactcccttgcgagcctgagttaatgccgacattcccacatcaccggaataaaagagccgcaccggcaacctctgagggtcaaagcaagcggtgtaagccctag

SEQ ID NO: 113442 - DNA, 819 bp, Artificial Sequence
  Description of Artificial Sequence: Synthetic coding sequence
atggacaaggaaaaggatggcatccccatctcctcactgagggaaatcacattgctgctgcgcttacgccacccaaacatcgtggaattgaaggaagtggtcgtgggcaaccacctcgaatctattttcctagttatgggatactgcgaacaagatctggccagtctgcttgaaaatatgccaaccccttttagcgaagcccaagtgaaatgcattgttctgcaagtgctgagaggactgcagtacttacatagaaactttatcattcatcgcgacctaaaggtgagcaacctgcttatgaccgacaagggctgtgtgaaaactgctgacttcggtctggcacgcgcctatggggttccagtgaagccaatgacaccgaaggtggttacactttggtaccgggcgccagagctactgctaggcactactacccagaccacatccattgatatgtgggcagtgggttgcattctggcggaactgctggcacataggcccttactgcctggcacctccgaaattcaccaaatcgacctgattgtgcaattgctggggaccccctccgaaaatatttggcctgggttttctaagctacccctcgtcggacagtatagcctaaggaaacagccttacaataatctgaagcacaagtttccttggctcagcgaggccggactgcgcctgctccatttcttgttcatgtacgaccccaagaaacgagcaacagccggagactgccttgagagttcatactttaaggagaaacccttgcgcttacctatctccggtgtctgtgagggctgtcgagaaccagggtag

SEQ ID NO: 113443 - DNA, 504 bp, Artificial Sequence
  Description of Artificial Sequence: Synthetic coding sequence
atggggaagaccgaggaaaagggcaacggaaaaggcgcttttcaagaaagaaagggtccattaggcgctgtccggaaggaggcaggcgctggcgcccaggatgcaggcgccgccgaaggggccgccgtgaagaaaatgactttcagcgagcatccctacaataacctgaggaaacgttttggggctctgctgtccgatcagggatttgacctgatgaacaagttcctgacctatttccccggccggaggatttccgccgaggacgggctgaaacatgagtatttcagggagacccctctacccatagatccatccatgtttcctacctggcctgccaaatctgagcagcaacgagtgaaacgcgggacctccccacgcccgcccgaggggggtctgggttacagccagctgggggacgatgatcttaaagaaacaggattccacctgactacaacaaaccaaggcgcttctgccgccggccccggattctcactgaagttttag

SEQ ID NO: 113444 - DNA, 2241 bp, Artificial Sequence
  Description of Artificial Sequence: Synthetic coding sequence
atgagtcagtcggatgaccgcgactcaaaacgggacagtctagaagagggagagctgcgagaccattgtatggaaattacgatccgcaattcgccatatcgaagggaggatagtatggaggaccggggcgaggaagacgatagtctggcaatcaagcccccccagcagatgtctcgtaaagaaaaggtgcatcatagaaaagatgagaagcgcaaggaaaaatgtaggcaccactcacattctgcagagggaggcaagcacgccagggtgaaagaaagagagcacgagagaagaaagcgccacagggaggagcaagataaagcgcggagggagtgggagcggcagaagagacgggagatggcaagagaacacagccgaagagaacgagatagactggagcagctcgaacgcaaacgagaacgcgaacgaaagatgagagaacagcaaaaggagcagcgggagcaaaaggagcgtgaacgacgagctgaggaacgaaggaaggagcgagaggcgagacgggaagtttctgcccaccaccgcaccatgcgagaggattatagcgacaaagttaaagcgagtcactggagcaggtctcctccgagacctcccagggagcgcttcgaactgggagacggccgcaagcccgtcaaagaagagaaaatggaggaacgggatctgctctccgatcttcaggatatttcagattctgaaagaaagacaagcagtgccgagtcgtcctccgccgagtcgggcagcgggtccgaggaagaggaagaggaggaggaggaggaggaggaagagggcagtacctcggaagaatccgaggaggaagaggaggaggaagaggaggaggaagaggaaaccggctccaactccgaggaggcatccgaacagtcggcggaggaagttagtgaagaggagatgtccgaggacgaggagcgcgagaacgagaaccatctgctcgtcgtcccagaatctagatttgatagagactctggcgaatctgaagaggccgaggaggaggttggcgaaggcaccccccagtcctccgccctgactgagggagattatgtgcccgactctcctgccttacttcccatcgaactgaagcaggaactccctaagtatttgccagccctgcagggttgcagatctgtggaggaatttcagtgtttaaataggattgaagaaggcacgtacggtgtggtgtatagggcaaaggataagaagaccgacgaaatcgtagcccttaaacgactgaagatggagaaagagaaggagggctttcctataacttctttacgagagatcaatacaattttgaaagcacaacaccccaatattgtgaccgtaagggagatagttgtcggatccaacatggacaaaatttatattgtgatgaactatgttgagcacgacttaaagagcttgatggagaccatgaaacagccttttttgccaggagaagtcaagacactcatgatccaactgttgagaggtgtgaaacacttacatgacaactggatcctgcatcgcgaccttaagacttctaatctcctcctctctcacgcaggaattttaaaggtgggtgattttgggctcgcacgcgaatacggatcgcctctcaaagcttacactcctgtcgtggtcacccagtggtacagagcaccggaactcctcctgggcgccaaggaatacagcacggctgttgatatgtggtctgtgggctgcatctttggagagcttttgacgcagaaaccactgtttcctggcaattccgagattgatcagattaacaaagtatttaaggagttagggacgccctcagaaaagatatggcctggttactctgaactgcctgttgttaagaagatgacattctcggagcacccctataacaatctcaggaaacgcttcggggctctgttgtcagaccagggatttgacctaatgaacaagtttctgacttactttcctgggcgacggatctcggccgaagatgggctgaaacacgaatatttcagagagactcctctgccgatcgaccccagcatgtttccaacctggccagccaaatccgagcagcaacgcgtcaagcggggcaccagcccccgccctcccgaggggggcttaggctactcacagttgggggacgacgacctcaaagaaacagggtttcacctgacgacgactaaccagggcgcttccgcggcaggaccaggcttttcattgaaattctag

SEQ ID NO: 113445 - DNA, 2340 bp, Artificial Sequence
  Description of Artificial Sequence: Synthetic coding sequence
atgggcgacgaaaaggactcttggaaagtgaagaccctggacgaaatcttgcaagagaagaagaggaggaaagagcaggaagaaaaggccgaaatcaagcggctcaagaacagtgatgaccgggacagcaaacgagacagcctggaagaaggggagctgcgcgatcactgtatggagataaccattcgtaattctccataccgcagggaagactctatggaggatcgaggagaagaagacgactccctggccatcaagccaccgcagcagatgtctcgaaaggagaaggtgcaccacagaaaagacgagaagcgaaaggagaagtggaaacatgcacgcgtgaaagagagagaacatgaacgacggaagaggcatcgtgaggaacaagataaagcacgaagggagtgggaaaggcagaaacgacgcgagatggcccgggagcattcccgccgcgagagggggaacgacggggtgtgcctgttcagggacaggctggaacagctggaacgtaagagagaacgggagaggaaaatgcgtgaacagcagaaggagcagcgggagcagaaggagagagagagaagagcggaggagcggaggaaggagcgcgaagccagacgtgaggtatcagcccaccataggacaatgcgagaagactactcggacaaagtgaaagcctcccactggtcaagatcccccccaagaccccccagagagaggtttgaacttggggatggcagaaagccagtgaaagaggagaagatggaagagcgcgacttgttgtcggatctgcaggatatcagcgattctgagcggaaaacgtcaagcgcagaatccagttcagcagaatccgggtcgggctccgaggaggaagaagaagaagaggaagaagaggaagaagaagggagtacatccgaagagagcgaggaagaagaagaggaggaggaggaagaggaagaggaaacaggctccaatagtgaggaagcatctgaacagtctgctgaggaagtgtcagaggaggagatgtctgaggatgaagaaagagagaatgaaaaccacctcctcgtggtgcccgaatccaggttcgatcgagactccggtgagtccgaggaagctgaagaggaagtgggagaagggacgcctcaatcctcggctctgactgagggggattacgtcccggactcaccagcccttctgccgattgaactgaagcaggaactccctaagtacctgcccgctctgcagggctgtcggagcgtggaagagtttcagtgtcttaatcgcatcgaagaaggcacctacggtgtggtctaccgcgccaaagacaagaaaaccgacgaaatcgtggccctgaagcgtttgaagatggaaaaagagaaagagggcttccctataactagcctgagggagatcaatacaatcctgaaggcgcagcaccccaatatagtaactgtgcgggagatcgtggtcgggagcaacatggacaagatttatatcgtaatgaattatgtcgagcacgaccttaaatccttgatggagaccatgaagcagcctttcctgccaggcgaggtaaagactctcatgatccagctccttcgcggggtaaaacatttacatgacaattggattctgcatcgagacttgaaaacttccaatctcctactgagtcatgcgggtatcctgaaggtgggagacttcggtttggcacgagaatatggcagcccactaaaagcttataccccggtcgtggtcacacagtggtaccgcgctcctgaattattactgggggccaaagaatatagcaccgccgttgatatgtggtctgtgggatgcatcttcggcgaactcctgacacaaaaacccttgtttccgggcaacagcgaaatagatcaaattaataaggtcttcaaagagctggggactcctagcgagaagatctggcctggttacagcgaactccccgttgtgaagaagatgacgttcagcgagcacccgtacaataacctcaggaagagattcggagcccttttgtccgaccaaggcttcgacttgatgaataagtttctcacatatttccctggacggcgtattagtgccgaagatggtttgaaacacgagtatttccgtgaaacccctctgcctattgatcccagcatgttcccgacttggcccgccaagtcagagcaacagcgagtaaagagggggacatcgcctcgcccaccggaaggtggcctgggatacagccagctcggcgatgacgacctgaaggagaccgggtttcacctcacgacaacaaatcagggggcgtctgctgcagggccaggattctccctgaagttttag

SEQ ID NO: 113446 - DNA, 2313 bp, Artificial Sequence
  Description of Artificial Sequence: Synthetic coding sequence
atgggagatgaaaaggatagctggaaagtaaagacccttgacgaaatactacaagagaagaagcggagaaaagagcaggaggagaaggccgagataaaacgactcaagaacagtgacgaccgcgactctaaaagagatagtctcgaggagggtgaactgcgggatcattgtatggaaataacgatacgaaacagtccatacaggagggaagactccatggaggaccggggtgaggaggatgacagtctggccataaagcccccccagcaaatgtcaagaaaagagaaggtgcaccaccgcaaagacgagaagcggaaagagaaatggaaacacgcacgggtgaaagagcgcgaacacgaacgtcgtaagcgacaccgtgaagagcaggacaaggctaggagggagtgggaaaggcaaaaaaggcgcgagatggccagggaacatagccgtcgggagcgcgataggctcgagcagctggaaaggaaaagagagcgagagcggaaaatgagagagcagcagaaagaacagcgagagcagaaggaacgcgaacgtagggccgaggagaggcggaaggaaagggaagctcggcgggaggtctctgcgcatcacagaaccatgcgggaggactacagcgacaaggtgaaagcctctcactggtccaggtctcccccaaggccaccaagggagagatttgagctcggggatgggcgtaagccggttaaagaagagaaaatggaggaacgcgacctcctgtccgacctgcaggacatcagcgacagtgaaaggaagacctcaagcgccgagtcatctagcgcagaatcaggtagcgggagcgaggaggaagaggaggaggaggaagaggaggaggaggagggcagcacatctgaagagagcgaggaggaagaggaggaagaagaagaagaagaggaggaaaccggatctaacagtgaagaggcttccgagcagtctgctgaagaggtgagtgaggaggagatgtccgaagacgaggagcgcgaaaacgagaaccatctcctggtcgttccagagagtcgatttgacagagattcaggagagtctgaggaggcagaggaggaggtgggcgaggggaccccacagtcctctgctttgaccgagggcgactatgtccctgatagccccgccctgttacctatcgagcttaagcaggagcttcctaagtatcttcccgccctgcaaggttgtaggtcagtcgaggagttccagtgcctcaataggattgaagagggtacttatggggtggtctacagagcaaaagacaaaaaaaccgacgagatcgtagcactgaaacgcctcaaaatggagaaggagaaggaaggctttcctatcacgtccttgcgcgaaatcaacactattttgaaagcgcagcacccaaatattgtcaccgtgcgggaaatagtggtgggcagcaacatggataaaatttatatagttatgaactatgtggagcacgatctcaagtcgcttatggagaccatgaaacagcctttcttgcctggcgaggtgaagacactgatgattcaactgcttagaggtgttaaacacctgcacgataactggatcctgcatcgggacctgaagacttcaaatctcctactgtctcatgccggtatcctaaaagtcggcgacttcgggcttgcccgcgagtacggatcccctctgaaagcgtatacccctgtggtggtgacccagtggtacagagctcccgagttgctgctcggagccaaagagtactccactgctgttgatatgtggtccgtcgggtgcatatttggcgagctgcttactcagaaacccttgtttcccgggaatagtgagatcgatcaaatcaataaagtgttcaaagagctcggaactccatcagagaagatttggcctgggtactcggagctgcccgttgtgaaaaagatgacatttagcgaacacccctacaacaatctgaggaaacgtttcggagccctgctttccgaccagggattcgacctaatgaacaagttcttgacttacttcccaggccgtcgtatcagtgctgaggatggactaaagcatgagtattttagagagactcctcttcccattgacccttcaatgttccctacgtggcccgccaagtccgagcagcagcgagtgaaacggggaactagtccccgcccacccgagggcggtctcggatatagccagctcggagatgatgacttaaaagaaactggctttcatctgacaacaacgaaccaaggagcctcggctgcaggccccggcttctcactgaagttctag

SEQ ID NO: 113447 - DNA, 2241 bp, Artificial Sequence
  Description of Artificial Sequence: Synthetic coding sequence
atgtcgcagtccgacgacagggattccaaacgggatagtctcgaggagggcgaactaagggatcattgtatggagattactatcagaaattccccgtatcgcagagaagactctatggaagatagaggcgaggaagatgattctttagccattaaacctcctcagcagatgagccgaaaggaaaaagtccaccataggaaagacgagaagcgaaaagagaagtgccggcaccacagccatagcgctgagggaggaaaacacgcacgggtaaaggaaagagaacatgaacgccggaaacgccacagggaggagcaggataaagccagacgggagtgggaacggcaaaagagacgagaaatggccagagagcactcaagacgggagcgcgatcggctcgagcagctcgagcgaaagcgcgagagggaaagaaaaatgcgcgagcagcagaaggagcagagggaacaaaaggaacgcgagaggcgagcagaagaaaggcgcaaggagagagaggctcgccgtgaagtgtctgcccaccaccgtaccatgcgggaggattacagtgataaagttaaagcatcccactggtcaaggagtcctccccgcccgccaagagaacgcttcgagctgggagatgggaggaagcccgtgaaagaggaaaagatggaggaacgggacctactttccgacctgcaggatatcagcgactctgagcggaagacatcctctgccgagtcctccagcgcagagtctggctcagggtccgaagaagaggaggaggaggaggaggaagaggaagaggagggatccacgagtgaagagtcagaggaagaagaggaagaggaagaggaggaagaagaagaaacagggtccaactctgaagaggcatcagaacagagcgcagaagaagtttctgaagaggaaatgagcgaagatgaggagcgggaaaacgagaatcacctgctggttgtccctgaaagtcgctttgatagggactcgggagaatccgaggaagcggaagaagaggtgggcgagggaaccccgcaatccagcgccctgaccgagggagattacgtccctgatagtcctgccctactgccgattgagctgaaacaggagctcccaaagtacttgccggcactgcaggggtgccgctccgttgaggaattccagtgccttaatcgcatagaggaaggaacttatggagttgtgtatagagctaaagataagaaaacagatgaaattgtggcactgaaacggttgaagatggaaaaagagaaagagggcttcccgattacaagcctacgcgaaattaatacgatcctgaaagcccagcaccccaacatcgtcaccgtcagagagatagtcgtcggctcaaatatggacaagatctacattgttatgaattacgttgaacacgacttaaagagtctaatggaaaccatgaagcagccctttctaccgggggaagtcaagactcttatgatccagttactgagaggagtgaaacatctgcacgacaattggatcctccaccgggacctcaagacgtcaaatctgttgctcagccatgctggtattctaaaggtcggcgacttcgggctggctagggaatacgggtctccgctcaaggcatatactcctgtcgtggttactcagtggtacagggctcccgaactgctccttggtgccaaggagtactctaccgccgtagacatgtggagtgtggggtgtatctttggagagctcctgacacagaagccgctttttccgggaaattctgagattgaccaaattaataaggttttcaaagaactgggaacccccagcgaaaagatatggccgggatattcggagctaccagtggtgaaaaaaatgacatttagtgaacacccatataataacctgagaaagagattcggagcacttctgtccgatcagggattcgatctcatgaacaagtttctgacctatttcccagggcgaaggataagcgcagaggatggactgaagcatgagtatttcagagagacccctctccccattgatcctagcatgttccccacatggccggccaagtcggagcagcaaagggttaaaagaggaaccagtcccaggcctccagaaggtggcctggggtactctcagttgggagatgacgatttgaaggagactggctttcacctaacgacaactaatcaaggggctagcgcggcgggtcctggattttccttaaagttttag

SEQ ID NO: 113448 - DNA, 2352 bp, Artificial Sequence
  Description of Artificial Sequence: Synthetic coding sequence
atgggcgatgaaaaggacagctggaaagttaaaaccctcgacgaaattctccaggaaaaaaagcgtcgaaaagagcaggaggagaaggccgagatcaagcgcttaaagaattcagacgacagggactcaaaaagagatagtcttgaggagggagagttaagagaccattgcatggagataaccattcggaactccccttaccggagagaagatagcatggaagatcggggcgaagaggacgattctttggctattaagcccccccaacagatgagcaggaaagagaaagtgcaccataggaaagatgagaagaggaaggagaagtggaagcacgcaagggttaaagaaagggagcatgagaggcgaaaaagacacagagaagaacaggacaaggcgaggagagagtgggagagacagaaaagacgggaaatggcaagggagcactcccgcagggagcgcgataggttggagcaactcgagcggaaacgtgaacgtgagagaaagatgagagaacaacagaaggagcagcgagaacagaaggagagggagagaagggctgaggagcgcaggaaagagcgggaagcccgaagggaagtgtcagcgcaccacaggaccatgagggaagactacagtgacaaggtaaaggcctcccactggagcaggtctccccctcgtccacctcgtgaacggttcgaactcggtgatgggcggaaacctggggaagcacggcctgccccggctcagaaacctgcccaattaaaggaagaaaagatggaagagcgcgaccttctgtccgacctgcaggacatcagcgattctgagagaaagacatcgagcgcggagtcttccagcgccgaatctgggtccggctctgaggaagaggaagaggaggaggaggaagaagaagaggaaggcagcaccagcgaggagagcgaggaagaggaggaagaggaggaggaggaagaagaagaaactggttccaatagtgaagaggcatcagaacagtctgcagaggaggtctctgaggaggagatgtctgaagacgaggagcgcgagaatgagaaccaccttctggtggtgccggaaagcaggttcgaccgcgactccggagaatccgaggaagccgaagaggaggtaggagagggtactcctcaatcctcggcactcacagaaggagattatgttccagacagccctgccttgctacccatagaactaaagcaggaactgccaaaatatcttccagcactccagggctgtcggagtgtggaagaattccagtgtttaaaccgaatcgaggaggggacatatggtgtggtgtaccgcgccaaggataagaaaactgacgaaattgtggcactcaaacgtttgaagatggagaaagaaaaagagggcttcccaatcaccagcctgcgggagatcaacactattttgaaagcacaacacccaaacatagtgacagtacgtgaaatcgtggtgggttccaacatggataagatatacatcgtgatgaactacgtcgagcacgacctgaaatccctgatggagactatgaagcaacctttcctgccaggcgaggtgaaaacactgatgatccagttgctcagaggcgtcaaacacctgcatgacaactggatcctgcacagggatcttaaaacctcgaacctattattgtcacacgcaggcattctcaaggttggggactttggacttgcgagagagtatggctctcccctgaaagcttacaccccagtcgttgtaactcagtggtatcgcgcaccagaactcctattaggagctaaggagtattcaaccgcagtggacatgtggtccgttggttgtatctttggcgagctccttacccagaaacccctgtttcctggcaatagtgagattgatcagattaacaaggtttttaaagaattaggaactcctagcgagaaaatttggccaggttacagtgagctgcccgtggttaagaaaatgactttctccgagcatccttataacaacctgagaaaaagattcggagcactcctgagtgatcagggtttcgatcttatgaacaagttcctgacctactttcctggccggaggatttctgcggaagacggtttgaagcatgaatatttcagggagacccccctcccaatcgacccttctatgtttcccacttggccagcaaagagtgagcagcaacgcgtgaagcggggcacctcgccacggccacctgaaggcgggctgggctactcacaattaggcgacgacgacctgaaggagacgggttttcacctcactacaacgaaccaaggagccagcgccgcaggccctggtttcagcctgaagttttag

SEQ ID NO: 113449 - DNA, 699 bp, Artificial Sequence
  Description of Artificial Sequence: Synthetic coding sequence
atgggcgacgagaaagatagttggaaagtaaaaactctggacgaaatactacaggagaagaaaagaagaaaagagcaggaagaaaaggccgaaattaagagactgaagaacagcgacgacagagatagtaagcgtgattcactcgaggaaggggaactccgcgatcattgtatggaaataacgatacgaaactcaccctatcgtcgcgaggacagcatggaggacagaggcgaggaggacgactccctcgctataaagccaccccagcaaatgagtagaaaagaaaaagtgcaccaccgcaaggacgaaaagagaaaagaaaaatggaaacatgcacgggtgaaagagagagaacatgagaggcggaaacgacatcgcgaagaacaggataaggcacgccgcgagtgggaaagacagaaacggagagagatggccagggaacactccagacgagagtcagtctgcacttcaccaaacgacgaaaggggactacagagacagtccgaaagccaaccactcgagagccagccagcaagcgcagctgccggggctgtgagagtgggcagacgtcctgaagctagtaagagacgtgagaatggacggaagggtcccgctgtccgactgaccggacaccagaggcaacgggaagaagatcagctcggtagagtactcgtttccggaatccggctcagattttag

SEQ ID NO: 113450 - DNA, 2241 bp, Artificial Sequence
  Description of Artificial Sequence: Synthetic coding sequence
atgtctcagtccgatgatagggacagcaagcgcgacagcctggaggaaggcgaactccgggaccattgcatggaaattactatacgcaactctccgtatcgtagggaggattctatggaggatagaggcgaggaggatgacagtctcgccatcaagcccccacagcagatgtcccgaaaggagaaggtccatcacagaaaagatgaaaagaggaaagagaaatgtagacatcatagccattcagctgaagggggcaagcatgctagagtgaaggagagggagcacgagcggcgcaaacggcaccgggaagagcaggataaagctcgccgagaatgggaacgccagaagaggcgggagatggctagggagcatagccgcagggagagagacagactagaacaattggagcgcaaaagggagagagagaggaaaatgcgggagcagcagaaagaacaacgggagcagaaggaacgtgaacggagagcagaagaacgcaggaaagagcgtgaggctagacgagaagtgtctgcccaccacaggactatgagagaggattacagtgacaaagtgaaggcctctcattggtctagaagtccacccagacctccacgtgagcgcttcgagttaggcgatgggcgcaagcctgttaaggaagagaagatggaagaaagagatctgctgtctgatctgcaggatattagtgattcggaacggaagacttctagcgccgagtcctcaagtgccgagtctgggagtggatctgaagaagaagaggaggaggaagaagaggaagaggaagagggatccacctccgaagaaagtgaggaagaggaggaggaggaagaggaagaagaagaagagacaggaagcaattccgaggaggcctcagagcaatcggccgaggaggtatcagaggaggagatgagcgaggatgaagagagagaaaacgagaatcacttgcttgtggtgcctgaatccagatttgaccgcgactcgggagaatccgaggaggctgaagaggaagtgggtgaaggcaccccacagagctccgctttgaccgaaggggattacgtgcccgattcccctgcactccttccgattgaactgaagcaggagctgccgaagtacttacccgcactgcagggatgccgctctgtggaggagtttcagtgcctcaaccgcattgaagaaggcacctatggcgttgtgtaccgtgctaaagacaagaagactgatgagatagtagctctcaagaggctcaagatggagaaggagaaagagggctttccaatcacaagcttgcgcgaaatcaacaccatccttaaagcccagcaccccaatatcgtcactgtgcgtgaaatcgtcgttggctcaaatatggataaaatttatatcgttatgaattatgtggaacatgacctgaaaagcctcatggagacgatgaaacagcccttcctccctggagaggtgaagactctgatgatccagttgctcaggggggttaaacatctgcatgacaattggattctgcaccgcgacttgaaaaccagtaacctgctactaagtcatgccggcatactcaaggttggagacttcggtctggcccgggaatatggaagccctctgaaggcctatacgccggtggtcgtcacccagtggtacagagcccctgagttactgctgggagccaaagagtacagcactgccgtagatatgtggtccgtggggtgtatcttcggtgagctgctgactcagaaacctcttttccccggcaacagcgaaatcgatcagattaacaaggtgttcaaagagctgggcaccccatctgaaaaaatctggcctgggtactctgagctgcccgtggtcaagaagatgacattttcagagcatccatacaataaccttaggaaaagattcggcgctctactttctgaccagggctttgatctcatgaacaagttcctaacatacttccccgggcgcagaatatccgctgaggatggcctaaagcacgaatattttagggagacccctctgcctattgacccctccatgttccccacctggccggccaagagcgagcagcagagggtaaagagggggacctcaccccgtccccctgagggcggcctgggctacagtcagctcggagatgatgacctcaaagaaaccggcttccacctgaccactactaatcagggggctagcgctgccgggcccggcttttcgctgaagttctag

SEQ ID NO: 113451 - DNA, 114 bp, Artificial Sequence
  Description of Artificial Sequence: Synthetic coding sequence
atgggggacgaaaaggattcgtggaaggtcaaaaccctggacgagattctacaggagaagaaaaggcggaaggaacaggaggaaaaggcagaaattaaaagactaaagaattag

SEQ ID NO: 113452 - DNA, 2343 bp, Artificial Sequence
  Description of Artificial Sequence: Synthetic coding sequence
atgggtgacgagaaggattcgtggaaagttaaaacgttagacgaaattttgcaggagaaaaaacggcggaaagagcaggaggaaaaggctgagatcaagaggctgaagaacagcgacgacagggactcaaagcgcgattcgcttgaggagggtgaacttcgggatcactgtatggagatcactatccgcaattccccataccgccgggaggacagcatggaggaccggggagaggaagatgactctctggctatcaaacccccgcagcagatgagtcggaaggaaaaagtccaccatcgaaaagacgagaagcgaaaggaaaaatgccgccaccatagtcacagcgctgaaggtggcaagcatgctcgggtaaaagaaagagaacacgagaggcggaagcgccatagggaagaacaggacaaagcgcgccgcgaatgggagcggcaaaaacgtagagagatggccagagagcacagccggagggaacgcgataggctggaacagctggagcggaagagggaacgcgagagaaagatgagagagcagcagaaagagcagagggaacaaaaagaaagggagagacgtgccgaagagcgccgtaaggagagggaggctagaagagaggtgagtgcccatcaccggacaatgcgcgaagactacagcgataaggtaaaggcttcgcattggtctcggtccccccccaggccccctcgcgaacgatttgaactcggggacgggcggaagcctgttaaggaagagaagatggaggagagagatctcctcagcgatctgcaggacatttcggacagtgagcggaagactagcagcgctgagagttcttcagctgaaagcggcagcgggtccgaggaggaggaagaggaagaggaggaggaggaggaagaggggtccacttcagaggagtccgaagaggaggaagaagaagaggaggaggaggaggaggaaacagggtcaaatagtgaagaagctagcgagcagtctgcagaggaagtgtcggaggaggagatgtctgaggatgaggaacgtgagaatgagaaccatttgctcgtggtcccagagtcacgctttgaccgggattccggagaatccgaggaggccgaggaagaggtgggagaagggacaccacaatcgagcgcgttaaccgagggcgactacgtgcctgattcccctgccctcctgcccatcgagttaaagcaggagctgcctaagtatcttccagcacttcagggctgtagatcagttgaggagtttcaatgcttgaatcgcattgaagaagggacctacggggtggtctacagggcgaaagataagaaaaccgatgaaatcgttgcactcaagagactgaaaatggagaaagagaaggaggggttcccaataaccagcctgcgggaaatcaacactatactcaaagcccagcacccgaatattgtgaccgtcagagaaatcgtggtcggctcaaacatggataagatttacatcgtgatgaactacgtggaacatgatctcaagagcctcatggaaaccatgaagcagcccttcctgcccggagaggtgaaaacgctgatgattcagttgctcaggggagtgaaacacctccacgacaactggattctccaccgcgatctcaaaacatctaaccttctattatctcatgcagggatcctgaaagtaggcgatttcggcctagccagagagtacgggagccctcttaaagcttatactccagtggtcgtgacccaatggtacagggcccctgaactgctgctcggcgccaaggagtatagcacggctgttgatatgtggtctgtgggctgcatcttcggcgaacttctgacccagaagccactgtttcccgggaacagcgagattgatcagatcaataaggtgttcaaagagttgggaacacctagcgaaaaaatctggcccgggtactctgagctccccgtggtcaagaagatgactttcagcgagcacccatataataatttgaggaaaagatttggtgccttattgagtgaccagggctttgacctgatgaataaattcctgacctatttcccgggccggagaatttccgccgaggacggcctgaagcatgagtacttccgggaaacgccactcccaattgacccttctatgtttccgacatggcccgcgaagagtgagcagcaaagggtaaagagaggaactagcccaagaccgcctgagggagggttgggctatagccaattgggtgacgacgacttaaaggaaacgggctttcatttaactacaactaatcagggagcatccgccgccggacctggcttttccctaaagttctag

SEQ ID NO: 113453 - DNA, 456 bp, Artificial Sequence
  Description of Artificial Sequence: Synthetic coding sequence
atgggggatgaaaaagacagttggaaagtcaagactttggacgagatcctgcaagagaaaaagcgtcggaaagagcaggaggaaaaggctgaaatcaaacgtttaaagaacagcgacgaccgcgactcaaaacgcgattcactggaagagggcgagctccgagatcattgtatggagatcaccataagaaactcaccttaccgccgcgaagactcaatggaggaccggggagaagaggacgacagtctagcaatcaagccacctcagcagatgagtaggaaagaaaaagtgcaccacaggaaagatgaaaagcggaaagaaaagtggaaacatgcccgcgttaaagagagggaacacgaacgccgaaaacgccatcgagaagagcaggataaggcccgcagggaatgggagcgacagaaaagacgtgagatggcccgtgagcatagcaggcgatag

SEQ ID NO: 113454 - DNA, 1263 bp, Artificial Sequence
  Description of Artificial Sequence: Synthetic coding sequence
atgggtgacgagaaagattcatggaaggtgaagacactggatgaaattttgcaggagaagaaaagacggaaagagcaggaggagaaggctgagatcaaaaggctgaaaaacagcgatgaccgcgactccaaacgggactccctggaagaaggggagttacgggaccattgcatggaaataacaattcggaattctccgtaccggcgcgaggattctatggaagatcggggagaggaggatgacagcctggccatcaaaccaccccagcaaatgtcacggaaggagaaagtgcaccaccgaaaggatgagaaacgaaaagaaaaatgccgccaccactcacacagtgctgaggggggcaagcatgctagagtaaaggaaagggaacatgaacggaggaaacgtcacagagaggaacaggacaaggcccggagggaatgggagagacagaagcgccgcgagatggcgagagagcacagccgcagggagagagataggttagaacaactggagagaaagcgcgaacgtgagagaaaaatgcgcgaacaacagaaagagcagagagagcagaaagaaagggaaaggcgggcggaggaacgtcgaaaagaacgggaagcccgtagagaagtgtctgcgcaccaccgcactatgagggaggattatagcgacaaagtgaaggcttcccactggtctcgctcacccccccggcccccacgggagcggtttgaacttggggatggtaggaaacccggcgaggcacgcccagcccccgcgcagaaacccgcccagctgaaggaggagaagatggaagagcgcgacctgcttagcgatctgcaggatatttccgattcagagcgcaagacttctagcgcggagtctagttctgccgaatcaggctccggcagcgaagaggaagaagaagaagaagaagaggaagaagaagagggcagcacctcggaggagtccgaagaagaggaagaagaagaggaggaggaggaggaagagaccggcagcaatagtgaggaagccagtgagcagagcgcagaagaagtgtccgaagaggagatgtctgaagatgaggagcgcgagaacgaaaaccacctgctagtggtgcctgaatcgcggttcgacagagactccggcgaaagcgaagaggccgaagaggaggtgggacttccagagagacgcggagtccctgtccccgaacaggacagaggagggcacctgtggagtggactgcagtccaagaggcaggagaacaggtag

SEQ ID NO: 113455 - DNA, 1686 bp, Artificial Sequence
  Description of Artificial Sequence: Synthetic coding sequence
atggctatcgccacatctacacagctagcgcgcgcgctgtatgacaataccgccgaaagccctcaggaactctccttccggaggggcgacgtgttgagggtactgcagagggagggtgctggtggcttggacgggtggtgcttgtgcagtctacacggccagcagggcattgtgcccgccaaccgggtgaagctcttgcctgccggaccagctcccaaacccagcttaagtccagccagtccagctcagccaggctctccctaccccgcccctgatcacagcaacgaggaccaggaagtgtacgttgtgcctccacccgccaggccctgtccaacatccggaccgccagcaggcccttgtccgccctctcctgatctgatatataaaattccgcgcgcatctggaacacagctcgctgcaccgcgagatgcgctggaggtgtacgatgtcccccctaccgcactgcgtgttcccagctcaggcccatacgactgcccagcgtcgttttcacaccctctgacacgagtcgcgcctcaaccgccgggcgaagacgatgctccttatgacgtgcctctcacccctaaaccccctgccgaactggagcctgatctcgaatgggagggaggccgagaacccgggccaccaatatatgctgctccctcaaacctcaagagggccagcgccctactcaatctgtatgaagcccccgaagagctgctggccgacggggagggtggcggaaccgacgaggggatctacgatgtgcctttgcttggccctgaggcccctccttcgccagaaccgcctggagccctggcctcgcacgatcaggacactctggcacagctactggctcgatccccccccccacctcaccggccgagactccccagcgccgagagtctgtcccggcgcccattgccagctctgcctgtgccagaggcaccatcaccgagtcccgtgcccagcccagcacccgggcggaagggcagcatacaggaccggcccctgccaccgccgccaccacgactgcctgggtatggaggtccgaaggttgagggagatccagagggcagggaaatggaagacgaccctgctggacaccataatgagtatgaaggaatacccatggcggaggaatacgactacgtacacctcaaaggaatggataaagcgcaagggagccgtcctcctgatcaagcatgcaccggtgaccccgagcttcccgagagggggatgcccgcacctcaggaggccttgtctcctggcgaaccactggtggtgtctaccggggacctgcagcttctgtatttttacgccggacagtgccaaagccactattccgccctacaggcggccgtcgccgcccttatgtctagcacccaggctaatcaaccaccccgactatttgtgccccactccaagcgtgtggtggtcgccgcccatcgcctcgtgtttgtgggcgacaccttgggccgactggcagccagcgcaccgctgcgtgcacaggtgagggcagctggaaccgcgctcggtcaagccctaagagcaaccgtgctcgccgtgaagggtgctgcattaggctatccatcttctcctgccatacaggagatggttcagtgtgtgactgagttggcagggcaggcacttcagttcacaacgctgttgacctctcttgcaccttag

SEQ ID NO: 113456 - DNA, 684 bp, Artificial Sequence
  Description of Artificial Sequence: Synthetic coding sequence
atgaacggtaccatatatgccaatgagtgtcagcagattcgtcatccaaactcgaaaacgttggggacggtgacacccaggaagcccgtcctcagcgttagcgctagaaagattaaggacaacgccgcagattggcataacctgatactgaagtgggaaaccctcaatgatgcaggctttactaccgcaaacaatatagccaatctgaagattagcctccttaacaaagataagatcgagctggatagttcatctcctgcatctaaagagaacgaggaaaaagtgtgcctggagtacaacgaggagttagagaaactttgcgaagaactgcaggccacactggatggccttaccaagatccaagtgaagatggagaagttatcaagtacaaccaaaggaatatgcgaattggaaaattatcactacggtgaagaatccaagaggccaccccttttccacacgtggccgactacccatttttatgaagtttctcataaactactggagatgtatcgaaaggagcttcttttgaagaggactgtagctaaagaactcgctcacacaggcgatccagacttaactctctcttacctctccatgtggctgcatcaaccatatgtcgagtctgactcaagactccatttagaaagcatgctgctggagacaggacatcgggccctgtag

SEQ ID NO: 113457 - DNA, 357 bp, Artificial Sequence
  Description of Artificial Sequence: Synthetic coding sequence
atggaggctaagactcttggcaccgttacaccaaggaagcctgtgctgtcagtgtccgctcgaaaaattaaagataacgccgctgactggcacaatcttatcctgaagtgggagacactcaacgatgccggctttaccacggctaataacatcgctaatctcaagatatccctgctaaacaaggataagattgaactagacagctcttcaccagcctccaaggaaaacgaggagaaggtttgcctggagtacaacgaggaactggagaagctctgcgaggagcttcaagcgacattagatggtctcatgagatttaggattagcagctggagatgcactggcaggagctgctcctag

SEQ ID NO: 113458 - DNA, 639 bp, Artificial Sequence
  Description of Artificial Sequence: Synthetic coding sequence
atggaggccaagacattggggacagtcactcccagaaagcccgtgcttagtgtgagcgcacggaagataaaagacaatgccgccgactggcacaatctgattttaaaatgggagacgctgaacgatgccggcttcactactgcgaacaatattgcgaatcttaaaatctcattgctgaataaagacaaaatagagctggacagctctagtcccgccagtaaagagaatgaagaaaaggtgtgtctggagtataatgaggagctcgagaagctttgcgaagaactgcaagctaccttagatggcctgaccaaaatccaagtgaagatggaaaagctttcaagtacaactaaggggatctgtgagctcgaaaactatcactatggcgaggagagtaaacggccaccacttttccatacatggcccaccacacatttctatgaagtcagccacaaactgctggaaatgtacagaaaagaactcctgcttaaacgtaccgtagccaaagaactagcacacaccggtgatcccgacctgacactgtcctatctctcaatgtggcttcaccagccctacgtggagtccgactcccggctgcacctggagagcatgctcttggaaaccgggcacagagccctgtag

SEQ ID NO: 113459 - DNA, 918 bp, Artificial Sequence
  Description of Artificial Sequence: Synthetic coding sequence
atggatatgtttcaaaaagtcgagaaaatcggggaaggaacatacggggtagtatataaggctaagaatagagagactggccagctggtcgctctcaagaagatccggctggatcttgaaatggagggggtgccaagtactgctataagagagatcagcctgctgaaagagttgaagcaccccaatatcgtgagactcttggatgtggtgcacaacgagagaaaattatatctggtcttcgagtttttgtctcaggacctgaaaaaatatatggatagcacacccggttctgaactgcctctgcatcttattaaatcttatctctttcaactcctgcagggcgtctccttttgtcatagccatagggtcattcacagagatcttaagccacagaaccttctgataaacgagctcggggccattaaactggctgattttggtctggccagagccttcggcgtgccattgaggacatacacccacgaggtggtgactctctggtatagagctccagaaatcctcctgggctctaaattttacaccaccgccgtggacatttggtccattggctgtattttcgcggaaatggtcactcgtaaggctctgtttcctggggacagcgaaattgatcagttattccgtatattccggatgttggggacacccagcgaggatacctggcctggggtgacccagcttccagactacaagggttcattccctaagtggaccaggaaaggcctggaagaaatcgtcccgaatctggagcccgaggggagagatctcttaatgcagctgctgcagtacgacccttcacaaaggatcactgccaagacggctcttgcccacccatacttcagttcacctgagccttcacccgccgccaggcagtacgtgctgcagagatttcggcactag

SEQ ID NO: 113460 - DNA, 918 bp, Artificial Sequence
  Description of Artificial Sequence: Synthetic coding sequence
atggatatgttccaaaaagtggagaaaattggcgaaggtacttacggtgtggtgtacaaagcgaaaaatagagaaacgggacagttggtagcattgaagaagataagattggacctggagatggagggtgtccccagcactgccatccgggagataagcttgttgaaggagctgaagcatcccaacattgttagactgttagacgttgtgcacaacgagcgcaaactgtatctggtgttcgagttcctgtcacaggacttgaagaaatatatggatagtaccccaggatcggagttacctctccatcttatcaagagctatctcttccagctgctgcagggagtgagcttttgtcacagccatagagtcattcatagagacctgaagccacagaacctgttgattaatgagctgggagcgatcaaattagcggactttgggctggcacgggcattcggagtgcctcttcggacctatactcacgaggtcgttaccctttggtatcgcgcacccgagatcctactcggatccaagttttacacaaccgcggtggacatctggtccattggctgcatctttgcagaaatggtgacccgcaaggctctatttcctggagatagcgagatagaccaactgtttcgcatttttaggatgcttgggaccccatccgaggatacatggcccggagtgactcaacttcccgattataaaggatcattccccaagtggaccagaaagggactcgaggagatagtacctaatctggagccagagggccgggatcttctgatgcagctgctccagtacgatccctctcagcgcattaccgccaaaaccgctctggcgcatccctacttcagctcaccagagccgagtcccgcagcccgccagtacgtgcttcagcgtttccggcattag

SEQ ID NO: 113461 - DNA, 879 bp, Artificial Sequence
  Description of Artificial Sequence: Synthetic coding sequence
atgcagaagtacgagaagttagaaaagataggcgaagggacctacggcacggtgttcaaggcaaagaatcgggaaacacacgaaatcgtcgcattgaaacgagtgaggctcgacgatgatgacgaaggtgtgcctagcagcgctttacgcgagatctgcttgctaaaggaacttaaacacaagaacatagtgagactccacgacgtgctgcactcggataaaaagctgacactcgtctttgagttttgcgatcaggacctgaagaaatatttcgattcgtgcaacggtgatttggaccccgagatagtgaagagttttctgttccagctattaaaagggctcggcttctgtcactccagaaacgtgctgcaccgcgatctcaagccacagaatctgctgattaataggaatggcgagctcaagctggctgatttcggtctcgcgcgcgctttcggcatccccgtgagatgttactctgctgaagttgtaactttgtggtatcgccctccagatgttctgttcggagcgaagttgtactctacctctattgacatgtggtccgcgggctgcattttcgcagaattggccaacgcaggcagacccctattcccggggaacgatgttgatgatcaattgaagaggattttcagactgttaggaacaccaaccgaagaacagtggcctagcatgaccaaattgcccgattacaaaccatatcccatgtacccagctacaacctctctggtgaacgttgtccccaagttgaatgctaccgggcgcgatctgctccaaaatctgttgaagtgcaacccggttcagcgcatctcggctgaagaagccctacagcacccttacttctccgatttttgtcctccctag

SEQ ID NO: 113462 - DNA, 783 bp, Artificial Sequence
  Description of Artificial Sequence: Synthetic coding sequence
atgcaaaagtacgaaaaactggagaagattggggaaggcacgtacgggactgtctttaaggccaaaaaccgagaaactcatgagattgtcgcattaaagcgggttcgccttgatgacgacgatgagggggtgccttccagcgcgcttcgggagatttgtctgctcaaagagttaaagcataagaatatcgtgagactgcacgatgtgcttcattccgataagaagctcacactggttttcgagttctgtgatcaggacctcaaaaaatactttgactcttgcaatggcgacctggacccggaaatcgtgaagaatggcgagctgaaactggccgattttgggctggcaagagcctttggcataccagtgcgatgttatagtgcggaagtagtcactctctggtacagaccgccagatgtgcttttcggcgccaaattatattccaccagcattgacatgtggagtgctggctgcatctttgccgagctggcaaatgcggggagacctcttttcccagggaatgatgttgatgaccagctcaagagaattttcaggcttctggggacacccaccgaagagcaatggccatctatgactaagctgcctgattataagccttaccccatgtacccagcaacaacctctctggtgaacgttgtgccaaagctgaatgccactggaagggatctgctgcagaatctcctgaagtgtaaccctgtgcagcgcatctccgctgaagaagccctccaacacccctatttttctgacttctgccccccctag

SEQ ID NO: 113463 - DNA, 1104 bp, Artificial Sequence
  Description of Artificial Sequence: Synthetic coding sequence
atgggcactgtgctttccctgtcacctgcctcctcagcaaagggcagacgccccggagggctgcctgaggaaaaaaagaaggccccacccgcgggggacgaggcccttggaggttatggtgcaccacccgtgggaaagggcggcaagggcgaatcaaggctcaaacgccccagcgtgctgataagtgctttaacctggaagaggctcgtcgccgcgtccgcaaagaagaagaaaggatccaagaaagtcacccctaagccagctagtaccggccctgatccactggtgcaacagcgcaatcgcgagaatcttctgaggaagggcagagacccccctgacggaggggggactgcaaagccattagccgtgcccgtgccgacagtgccagctgccgccgccacctgcgaacctccctctggtgggtccgcggccgcccagccacccggaagcggcggtgggaaaccccctccgccaccacccccggcacctcaagtcgccccgcctgtgccaggcgggagtccaaggcgggtgatcgtacaggctagcacaggtgaactgctcagatgtcttggcgatttcgtctgccgaagatgctaccggcttaaagagctgtccccaggggagttggtcggctggtttaggggagtcgatcggagtctgctgctccagggatggcaagaccaggcatttatcactccggcaaacctcgtctttgtgtatcttctgtgtcgggaatctttgagaggggacgagttggcctcagcagcagagttgcaggctgctttcctgacttgcttatatctcgcctacagttacatgggcaacgagattagctatccactcaagccgtttctggtggaacctgataaagagaggttctggcaaaggtgcttacgcctcattcaacggctgagcccacagatgttgcgcctgaatgcagacccccacttctttacccaggtattccaagacctaaaaaatgagggggaggctgctgcctctggcggaggacctccctcaggcggtgctcctgcggcaagcagcgcagctcgcgactcttgcgccgcgggaaccaaacactggacgatgaacctcgacagatag

SEQ ID NO: 113464 - DNA, 1779 bp, Artificial Sequence
  Description of Artificial Sequence: Synthetic coding sequence
atggaaatgtatgagacactcggcaaagttggtgaagggtcctacggtacggtcatgaagtgtaaacacaagaacactggccaaatcgtagccattaaaatcttctatgaacggccggagcaatctgtgaacaagatcgccatgcgggaaattaaatttctgaaacagttccatcatgaaaacctcgtgaacctcatagaggtgtttcgtcagaagaagaaaatccatcttgtgttcgaattcatagaccatactgtcctggacgaactccaacactattgccatggcctggagagtaagcgtctgcggaagtacctcttccagatcctgagagcaatcgattacttacattctaacaacatcatccacagggatataaagccagaaaatatcctagtatcgcagagcggaattactaaactctgcgatttcgggttcgctcgaactctggcagctccaggcgatatttacactgactatgttgcaactagatggtatcgggcccctgagctggtgttgaaggacacaagttacgggaagcctgtggatatctgggccctgggatgtatgatcattgagatggctactggtaacccctacctgccctcttccagcgacctggacttgctccataaaatcgtactcaaagtaggaaatttatctcctcatctacagaatattttctccaagtctcccatcttcgccggagtggtgctcccgcaggtacagcaccctaagaacgcccgtaagaagtacccaaagctgaacggcttgttagctgacattgtgcacgcatgcttgcagatagatcctgctgaccggatttccagcagcgaccttttgcaccatgagtactttaccagagatggttttatcgagaagttcatgcccgagttaaaggccaagctcctgcaagaggccaaggtcaattccctcatcaaacctaaggagtcatctaaggaaaacgagctccggaaagacgaacgcaaaacagtgtacaccaatactttactcagtagttcagtgctcggcaaggagattgagaaggaaaagaagcctaaggagataaaggtccgggtcatcaaagtcaaaggtggacggggcgacatttctgagcccaagaaaaaggaatacgagggtggcctgggacagcaggatgctaacgaaaacgtacatccaatgtctcccgacacaaaactggtgacaatagagcctcccaaccccataaatccctcaaccaactgcaatggtctgaaggaaaaccctcattgtggaggcagcgtcactatgcccccgattaatctcacaaatagcaacttaatggccgcaaatctgagctctaacttattccatccttcagtgcgactaaccgaaagggcgaaaaagcggcgaacatcctcccaatctatcggacaggtaatgcctaactcgaggcaggaggacccaggcccaatccagtcacagatggaaaaagggatttttaacgagagaacggggcacagcgatcagatggctaacgagaataaaagaaaattgaatttcagccgatctgaccggaaggaatttcacttccccgagcttccagtcacgatccaaagtaaagacaccaaagggatggaggtgaaacagataaaaatgcttaaacgggagtctaagaaaacggaatcatcaaaaatccctacgctgttgaatgttgaccaaaatcaggagaagcaggaaggtggagacggacattgtgaagggaaaaatctcaagagaaataggttctttttttggtag

SEQ ID NO: 113465 - DNA, 1368 bp, Artificial Sequence
  Description of Artificial Sequence: Synthetic coding sequence
atggaaatgtatgaaaccctgggcaaagtcggtgaggggtcatatggcacagttatgaagtgtaaacacaaaaacacaggccagatcgttgctattaaaatcttctacgagagaccggagcaatctgttaataaaatcgccatgagggaaatcaagttcttaaagcagttccatcatgagaacctggtcaacctcatcgaggtgttccgacagaagaagaaaatccacttggtctttgaattcatagaccacactgtgctggacgaactccaacattattgtcatggccttgagtcaaagagattgcggaagtacctttttcaaatcctgcgggcaatcgattaccttcatagcaacaacatcatccatcgggatatcaagcctgaaaacattctggtcagtcagtcagggataacgaaactgtgtgactttgggttcgcacggactctcgccgcgcctggcgatatctatacggactacgtggctaccagatggtatcgggcgccggagctcgtgttgaaagatacaagttatggtaaacctgtggatatctgggcactcggttgcatgatcatagaaatggcgaccgggaatccataccttccaagttcttccgatcttgatctcctgcataagatcgtgctgaaagtcggcaatttgtctcctcatcttcaaaatattttctccaagtctcccatatttgcaggggtggtgctgccacaggtacaacacccgaagaacgctcggaaaaagtacccgaagctgaacgggcttctagcggatatcgtgcatgcttgtctgcagatcgacccagcagaccgtatctctagttcggatttactgcaccacgaatactttacaagggatggtttcatcgaaaagtttatgccggagctgaaagcgaaacttttgcaggaggccaaggtgaacagcttgataaaaccaaaagagtcaagtaaggaaaacgagctcagaaaggacgagcggaagactgtatatacaaataccctactcagttcgagcgtgctgggtaaggagatcgaaaaagagaagaaacccaaggagataaaagtcagggtgattaaagtgaagggcggcaggggcgacatctcggaaccaaaaaaaaaggagtatgagggaggtctggggcaacaggatgctaacgagaacgtccaccccatgagcccggacacaaagctcgtgacaatcgaacctcccaaccccattaaccctagcacgaactgtaacggcctcaaagagaatcctcattgtgggggatctgtgacaatgcccccaatcaacctgaccaattcaaacctaatggcagccaatctgagctctaatctcttccacccatccgtgcgctag

SEQ ID NO: 113466 - DNA, 1092 bp, Artificial Sequence
  Description of Artificial Sequence: Synthetic coding sequence
atgccagagctgaaggccaaactgttacaggaagcaaaagtcaatagccttatcaagcctaaggaatcaagtaaggaaaacgaactaagaaaggacgaacgcaagacggtatacaccaatacgttactttcctcgtccgtactaggtaaggagatcgagaaagagaaaaagccgaaggagatcaaagttcgcgttattaaggtaaagggaggaaggggtgacatttctgagccaaagaagaaggagtatgagggaggcctcggtcaacaggacgctaatgagaatgttcaccccatgagccccgatacaaagctggtgaccattgagccaccaaatccgattaacccttctaccaactgcaatggtctgaaagagaatccgcactgcggaggatcggtgactatgccaccaatcaacctgactaactcaaatctgatggcagctaacctgtcatctaatttgttccaccccagcgtgagactgaccgagcgggccaagaagcgccgcacctcttctcagtccattggccaggtgatgccgaattcccggcaggaagatcccgggcctatccagtctcagatggagaagggcatttttaacgagcggactggccatagtgaccaaatggcaaatgaaaacaagagaaagttgaatttttctcgctccgacagaaaggagtttcactttcctgaactgccggtcaccatacaatctaaggacaccaagggcatggaagtgaagcagattaagatgctcaaaagagagtctaaaaagacagaaagcagtaaaatccctaccctgctcaatgtggatcagaatcaggagaaacaagaattcatcccgctttccctgctctctgcatgttgcccaatttttacgaatatatgtagccagctgacaattagatacgtatttatctctggcatgaagacagaccagtacagtgagctggtcccagtagaatggggcatcgcagaaaaaatccccaagaatgtagaagccactctcgagttggggaatcgccagaggttcgaacagtttggcgagcttaggcgacggcaggagaatgtggggaagtttgggacattctag

SEQ ID NO: 113467 - DNA, 1773 bp, Artificial Sequence
  Description of Artificial Sequence: Synthetic coding sequence
atggaaatgtacgagactctcggcaaagtcggcgaggggagctatggaacagtgatgaaatgcaaacataaaaacaccggccagattgtcgccatcaagattttttacgaaagaccggaacagagcgtgaataagattgctatgagagaaatcaagttcctgaaacagttccatcacgaaaacttggtgaatttgatcgaggttttccggcaaaaaaagaagatccacctggttttcgagttcatagatcatacagtcctagacgaattgcagcattactgtcacggactcgaatccaaaaggctgcgcaagtacttgttccaaatcctccgtgccattgactacttacacagcaacaatattattcatagggacatcaagcctgagaacatcctagtctctcaatcgggtatcaccaagctgtgtgattttggcttcgcacgaaccttagccgcccccggcgacatctataccgactacgttgcaacccgttggtatcgtgctcctgagctcgtgttgaaggacaccagttatggcaagccggtggacatttgggctctgggttgcatgattattgagatggctaccgggaatccgtatctgccatcttcaagcgatctggacctgttgcacaagattgttttgaaggtagggaatttaagtccccacctgcagaacattttttcgaagtctccaatcttcgcaggggtcgttttaccacaggtgcagcatccgaaaaacgcaagaaagaaatacccgaagctaaatggcttgctggcggacatcgtgcatgcatgtttgcagattgatcctgctgatcgcataagctcgagcgacctactccaccatgagtatttcaccagagacgggtttatcgagaaatttatgcctgagcttaaggcaaagctcctccaagaagctaaagtgaactctctgatcaagcccaaggagagcagtaaggagaacgaattgaggaaggacgagagaaaaactgtgtatacaaacaccctcctatcctccagcgtgctgggcaaggagatcgagaaggagaaaaagccaaaggagattaaagtccgcgtgatcaaggtcaaaggcggccggggggacatttcagagccaaagaaaaaggagtacgaaggcggcctgggtcagcaagatgcaaacgagaatgtgcatccaatgagtcccgatacgaagctggttaccattgagccaccaaatcctatcaatccctcgaccaactgcaatggccttaaagaaaatccacactgcggaggatctgtaacaatgcccccaattaatctgactaactccaatttgatggctgccaacctgtcgtctaatctgttccatccctcagtgcggctgaccgagagagcaaagaagcgacgcactagttctcaaagcataggtcaggtcatgcctaattctcgccaggaagatcctggacctattcagtctcagatggagaaaggtatatttaacgagcgtaccggccattctgaccagatggctaacgagaacaagagaaagctcaactttagccggagtgataggaaggagtttcacttccctgagttgcccgtgaccatccaatccaaagataccaaaggtatggaggttaagcagattaaaatgctcaaaagggaaagcaagaagactgagtcgtccaagataccgacactactcaatgtggatcagaatcaggagaaacaggagaacaccgggaatgcgcagaccgagagaaaaaagaacctgcccgatgttgagtag

SEQ ID NO: 113468 - DNA, 1368 bp, Artificial Sequence
  Description of Artificial Sequence: Synthetic coding sequence
atggaaatgtatgagacactcggcaaggtcggtgaggggagctatggaaccgtgatgaaatgtaagcataagaacaccggacagattgtcgccattaaaatattttacgagcggcctgagcagtccgttaacaaaatagcaatgcgagagatcaagttccttaagcagtttcatcatgaaaatttggtgaacctgatcgaagtgtttagacagaaaaaaaaaatccacctcgtgttcgagtttatagatcacacagttcttgacgaacttcagcactactgccatgggctggaaagcaaacgtctgcggaaatatctcttccaaatcctgcgggccattgactatttgcattctaataacataattcacagggatatcaaacccgaaaatatcttggtaagtcaatctggaataacgaaactgtgcgatttcgggttcgccagaaccctggccgctccgggcgatatttacaccgattatgtggcaacacgctggtaccgcgcacccgagctggtactgaaagatacaagttacggcaagccggtcgacatctgggccctgggctgcatgatcatcgagatggccaccgggaacccctaccttccctcaagctctgatctagatctgctgcataaaattgtgctgaaagttggcaatttatcgccacacctgcagaacatttttagtaagagtcctatattcgccggtgtcgtgttgcctcaggtgcagcacccgaagaatgctaggaagaaatatcccaaattaaacgggctcctcgcagatattgtgcacgcctgcctgcaaatcgaccccgcggatcggatcagttcgagtgacctgttgcaccacgaatattttactcgggacggatttattgagaaattcatgccggagcttaaggccaaacttctgcaggaggcgaaagtaaacagcctcataaaacccaaggaatcttccaaggagaatgaactgcggaaagacgaaagaaaaactgtgtataccaacaccctcctctcctcatctgtgttgggtaaggaaatcgagaaggaaaagaagccaaaggagatcaaggttcgcgtaattaaagtgaaaggcgggcgaggagatatttctgaacccaaaaaaaaagagtatgaaggcgggctgggtcagcaggatgctaacgagaacgtgcatccgatgtcacctgacacaaagctagttactatagagcccccaaaccctataaatccctccacaaattgtaacggactgaaggaaaatccccattgtggtggcagtgtgactatgccccctatcaatcttacaaattctaatctgatggctgccaacctttcatccaatctttttcacccatcggtgcggtag

SEQ ID NO: 113469 - DNA, 876 bp, Artificial Sequence
  Description of Artificial Sequence: Synthetic coding sequence
atgccagagcttaaagccaagcttctccaggaagcaaaagtaaacagtttgataaaacctaaggagtcctctaaggaaaacgagctgcggaaggatgaacgcaaaacagtgtataccaataccctgctgtcctcttcagtcctgggaaaagaaattgagaaagagaaaaagcccaaggaaataaaggtacgggtgattaaagtcaaggggggccgcggcgacatatccgaacctaagaagaaagagtatgagggaggtttaggccagcaggacgccaatgagaatgtgcaccctatgtctcccgatactaaattggttacaatcgaacctcccaaccctatcaacccaagcaccaactgcaacggtctgaaggaaaatccacactgcggcgggagcgtgactatgcctcccatcaacttaacgaattctaatctgatggccgctaatcttagttctaatctgttccacccgtccgtgaggctaactgagagagcaaagaaacgcagaaccagttcacagagtatcggccaggtgatgcctaacagcagacaggaggaccctggacccatacagagccagatggaaaaagggatcttcaacgaacgcaccggccactctgaccaaatggccaatgagaataagagaaaattgaatttttcacgcagcgatagaaaggagttccatttccctgaactgcctgtgaccattcagtccaaagacaccaaggggatggaggttaagcagataaaaatgctgaagcgggagagcaagaaaactgaatcctctaaaatcccaaccctgctgaatgttgatcagaatcaggagaagcaagaagtgagactgtaccaaaggcatgaagaccgccccatacaatag

SEQ ID NO: 113470 - DNA, 3093 bp, Artificial Sequence
  Description of Artificial Sequence: Synthetic coding sequence
atgaaaatccccaacatcgggaatgtcatgaacaagtttgagatactcggtgtcgtgggggagggagcttacggtgttgtgctgaaatgccgacacaaggagacccatgagattgtggccatcaagaagttcaaagatagtgaagagaatgaagaagtcaaggagactacactgcgcgagctgaaaatgctaaggacactgaagcaggagaatatcgtggagctcaaagaagccttcagacggagaggaaaactctacctcgtgttcgagtatgtggaaaagaacatgctggagctcctggaagagatgccaaacggcgtccctccggaaaaagtaaagtcttatatataccagctgattaaagctattcattggtgtcacaaaaatgatattgtgcatcgagatattaagcctgagaatctgttgatcagccacaacgatgttctgaagctttgtgattttggctttgccaggaacttgtctgaaggcaacaatgcaaattataccgaatatgtggccacccggtggtacagaagtcccgagttacttctgggcgctccatatggcaaaagcgtggacatgtggagtgtgggatgtattctcggagagctctctgacggacaacctttatttcctggggaaagtgaaattgatcagctgtttacgatccagaaggttctggggccgcttccctcagagcagatgaaattgttttattctaacccaaggttccacggactgagattcccggcggtaaatcaccctcagtccctggagaggcgctatcttggtatcctgaactccgtactgctcgatttaatgaaaaatctactgaagctggaccccgccgatcgttatctgaccgaacaatgtctgaatcatcccacctttcagacacagcggctgctggaccggtcaccatcccgtagtgctaagcgaaaaccatatcatgtcgaaagtagcactctgtcgaataggaatcaggcaggtaagtctacagctctccagtcacatcataggtctaacagcaaagatatccaaaatttgagcgtcggcttgccaagggccgacgagggcttgcccgctaatgagagtttcctaaacggaaatttggccggtgccagtctctccccgctgcatacaaaaacgtaccaggccagttcccagcccggctcaacaagcaaggatttgacaaacaacaacatccctcatctgcttagtcccaaagaggctaagtcaaagactgagttcgattttaatatcgatcctaagcctagtgagggaccagggacgaagtacctaaagtccaactcccgctctcagcagaaccgtcatagttttatggagtcctcacaatctaaggctggtactctgcaacccaacgagaagcaaagtcggcactcatatatagacaccattcctcagtcctctcgctcaccatcttacagaacgaaagctaaatcccacggagctctctccgacagcaaatcggtgtcaaacctgtccgaggcacgggcccagattgcggaaccttcaacgagtaggtacttcccatcaagttgtttagaccttaactccccaacttctccgacccctacccggcacagtgacaccaggactctgttgtcacccagtggccggaacaatcgtaacgaaggtaccctggatagcaggagaaccaccactaggcacagtaagaccatggaagaattaaagttgcccgagcatatggacagtagtcatagtcattcacttagcgcgcctcacgagtctttctcttacggactgggatacacctccccattctcttcacagcagcgcccccaccggcacagtatgtatgtgaccagagataaagtgcgcgcgaagggtctcgacggctctttaagcattggacaggggatggccgcaagagccaactcccttcagcttctcagtccccaacccggcgagcagcttcctccggaaatgaccgtagcgagaagttcggttaaagagacctcgcgggaaggaacatcttcattccatactaggcagaaaagtgaagggggcgtttatcacgatccccactccgacgatggtaccgctcccaaagaaaataggcatctctataatgaccctgtgcctagaagggtggggtctttctaccgagtgccgtcaccacgcccagacaactcttttcacgagaataacgtgtcgacccgggtcagtagtctgccttctgagtcttcgagcggcactaaccactcaaagagacaaccggcctttgatccttggaagagcccggagaatattagtcattctgaacagctgaaggaaaaggagaagcaaggattttttagaagcatgaaaaagaaaaaaaaaaaatctcagactgtgcccaactcagatagccccgatctgctcacattgcagaaatctatccactcagcatcgacacccagcagccggccgaaagaatggcggccagaaaagattagcgacctgcaaactcagagccagcccctcaagtcactgaggaagctgctgcacctgagttccgcttcgaaccatcctgccagctctgacccaaggttccagccactcactgctcaacagaccaagaactccttctccgagatccgtatccatcccttatcccaggcgagcggggggtcctctaacattcgacaggagcccgctcccaaaggccgaccggcccttcaactgcccgatgggggttgtgacggtcgacggcaacggcaccatagcggcccacaggatcgccggtttatgctccgtactaccgagcaacagggcgagtacttctgctgcggtgacccaaaaaagccccataccccttgcgtccccaatcgcgccctccacaggcctatcagcagcccagctccataccccgtcctgcaggtgcggggcacatccatgtgcccgaccctgcaggtcaggggtactgatgctttttcctgtcccacccagcagtctggattttcgttttttgtaagacacgtgatgagggaggccctgattcaccgagcacaggtgaatcaggcggcacttttgacctatcatgagaacgcagcgctgaccggcaaatag

SEQ ID NO: 113471 - DNA, 3093 bp, Artificial Sequence
  Description of Artificial Sequence: Synthetic coding sequence
atgaagattcctaatatcggaaacgttatgaacaaattcgagattctgggcgtggttggggaaggagcctacggagttgtgctcaagtgtcggcacaaagagacccatgagattgtcgcgatcaagaagttcaaggatagtgaagagaacgaggaggtaaaagaaactaccctgcgtgagttaaaaatgctgaggactttaaagcaagagaatattgtagagctgaaagaggcctttaggcggagaggcaaattatatttggtcttcgagtatgtggagaaaaatatgcttgagctgctcgaagaaatgcccaatggcgtgcctcctgagaaagtgaaatcgtacatttatcagctgatcaaggcgatacattggtgtcacaagaacgatatcgttcaccgtgatatcaagccagaaaatctgctgatctcccacaacgatgtgcttaagctttgcgattttgggttcgctcgaaatttgagcgaaggcaataacgcaaattacacggagtacgtggctacgcggtggtatcggtctccagaactgctgctcggtgccccttatggaaagagtgtcgacatgtggagcgtcgggtgtatcctcggtgaactaagcgacggacagccgctattcccaggggaaagcgaaatagaccagctttttactattcagaaagtgctcggaccactaccaagcgagcagatgaagctattctactccaatccccggttccatggactacgcttcccagccgtgaaccatccacaaagcctggagcgccggtacctgggaatactgaatagcgtgttactggatctaatgaagaatttactcaagctcgacccagcagataggtatctgaccgaacagtgcctgaatcatcccactttccagacacagcgactgctcgaccgttcccccagccgaagcgccaagcggaaaccttaccacgtcgagtcttccacactgtctaaccgtaatcaggcaggcaaatctacagcacttcagagccatcaccggtctaattctaaagatatccagaatctctcagtggggctgcctagggcagacgagggcctgcccgccaatgagtcctttttaaacggcaacttagctggtgcctcactcagtccactccataccaagacttatcaggcctcttcccaacctggctcaacgagcaaagacctaaccaataacaacattcctcacctcctgtctcccaaggaggccaaaagtaagacagagtttgattttaatatagaccccaagccctctgagggacctggaaccaagtaccttaaatcgaactctagatcacagcaaaatcgccattcatttatggaatctagtcagagtaaagcgggcaccctgcagccaaacgaaaagcagagccggcattcctacatagacaccatcccccaatcctcccgatcccccagctatcgcacaaaagccaagagtcatggagctctaagcgatagtaagtccgtcagtaacctgtctgaggcccgtgcccagattgcagaaccctccaccagccgatacttcccatctagctgcctggacctgaattctccgacttcccccacaccaacgaggcattccgacaccaggactttgcttagcccctcgggacggaacaatcgtaatgagggaaccctggactcaaggcggacgaccacacgccatagtaaaaccatggaggagctgaaactgcctgaacacatggacagcagtcattcgcactcgctgagcgctccccacgaaagcttttcctacggtcttggctacacttctccctttagtagtcaacagaggcctcaccggcacagcatgtatgtcacaagagataaggtgcgtgcaaaaggattggacggttcgctgagtatcggacaggggatggctgctagggcaaatagtctccagctgctttctcctcagccaggcgaacagctgccgccagaaatgacagtggcgcggtcttctgtaaaggaaacttcacgggagggcacctctagctttcacactaggcagaagtcagaaggaggagtataccacgatccccactctgatgacggtaccgccccgaaggagaaccgtcacctatacaatgatccagtgccccggagagtcggctcattttaccgagtcccatccccccgcccggacaatagctttcatgagaacaatgtgtccacccgagtgagcagcctcccgagtgagtcatcctccggtaccaatcactccaagaggcagccggcgtttgatccatggaagtcgccagaaaacattagccatagcgagcagctgaaagaaaaagaaaaacagggattcttcagatccatgaagaaaaaaaagaagaaatcacagaccgtgcccaatagtgactcacccgacttactaacattgcagaagagcatccactcggccagtactccgtcatctaggccaaaggagtggcgccccgaaaagatctcagacctgcagacacagagtcaaccgcttaagagcctcagaaaattactccacctctctagtgccagtaaccatccggcttcttctgacccgaggtttcagccactcacagcgcagcagactaagaattcattcagtgagattagaatacatccactgtcacaggcctctgggggtagtagcaacattagacaggagccagcacccaaggggcggcccgctctgcagctccccgatggtggatgcgacggtagaaggcagcgtcaccattccggcccccaggaccggcggtttatgttacgcaccacggagcagcaaggggagtatttttgttgcggggatcccaaaaaacctcatacaccgtgcgtacccaaccgcgcgctccaccgtccaatcagcagccctgccccctaccctgtgctccaggtccgcggcacctctatgtgccccaccctgcaggttcgcggtacagatgcgttcagctgtcctactcagcagagcggctttagcttttttgtacgtcatgttatgagagaggccctgatccatcgagctcaggtgaatcaggcagcactgctgacatatcatgaaaacgcagctctaaccggcaagtag

SEQ ID NO: 113472 - DNA, 1956 bp, Artificial Sequence
  Description of Artificial Sequence: Synthetic coding sequence
atgtccctccctcgtcttctgaaagtgaatatacggacgtatgacaacagcatccctattagtgaatctagtcgtaaatcttggaaccagaaacatttcgccctgacattcccaaagcccttgcaaaggggcacaaatgacaaatcgagaccccttaagagccagataaccgtgacacggcacgataagcggaagctggaagaagggcagaaaccagctcacaagtggatcaggcacagtttcagaaagatcctccaatggccaccaatctatacagctgcaagagagcaaactccctttaggcacttgtatacctccaaaacacacttaaagaaggctgagtataagaagagcaaagacgaaaagggtgggacaccactaaagaaagatagtaaaaaaaaaggcgggagctacgctaccaacccagaatcaaagcagatagtcgaagagaagacaaagagacagaatgaggcggacaagacaccgctcaagagttctcacgagaatgaacagagtaagaagagcaaatcctctagtgaaacaaatcctgagtcccagaattccaagaccgtgagcaagaattgtagccaaaaggacaagaaagactcgaagaacagcaagaaaacaaataccgaatttctgcataccaagaacaacccaaaaaaagatttaaaacggtcaaagacatccaacgaccctatatcagagatttgctctgagaacagcctgaatgtcgactttcttatgctggtgggacagtctgacgacgagtcaattaacttcgatgcctggctgaggaactattctcagaataattcaaagaattactccctcaagtatactaagtataccaaaaaggatacaaaaaagaatgccaaaaagagcagcgatgctgaatcagaggattctaaggacgccaagaaggacagcaagaaggtgaagaaaaacgtcaagaaggacgacaagaaaaaagatgtcaagaaagataccgaatcaactgacgcagagtctggcgatagtaaagatgagaggaaagacactaagaaagataagaaaaaacttaagaaagatgataagaagaaggacaccaagaagtaccctgagtccactgataccgagtcaggggatgccaaggatgcaagaaatgatagcagaaacctcaaaaaggcctccaaaaatgacgataaaaaaaaggatgccaagaagatcacattttcaacagattccgagtcagagctcgagtcaaaggagagccaaaaggacgagaagaaggataaaaaggacagtaagacagacaacaaaaagtcggttaaaaatgatgaagagtccacagatgccgatagtgagcccaaaggcgattcaaagaagggaaagaaggatgaaaagaagggcaagaaggattctaaaaaagacgacaagaaaaaagatgctaagaagaacgccgagtccaccgaaatggagtccgacctggagctaaagaaagataaaaagcactccaaagagaagaaggggagcaaaaaggacattaaaaaggatgcccgtaaggacactgagagcacagatgccgagtttgacgagagtagcaagactggtttcaaaacttcaaccaagatcaagggatctgacaccgagtctgaggagtctctctataagccgggtgccaagaagaaaatcgacgagagcgacggaacatctgcgaactcgaaaatggagggactcgagagtaaacgaggattcagaatgtccagtaaaaagactacctttaatgaaaaaggagaaaaggctagcactggccgtgttcctcccagccgggagaaaccaccactgcctgcctgtgagccatccttgccatctcctaaggtgcggcggctttgctggtgcaaaatgcccccaccaccccctaaaccacggtacgcacccttgcccgaggccccttggatccacaaactgctttag

SEQ ID NO: 113473 - DNA, 1974 bp, Artificial Sequence
  Description of Artificial Sequence: Synthetic coding sequence
atgagtctccccagactgctcaaggtaaacatccgcacttacgacaacagtatacctatcagcgagagttctcgaaaatcatggaaccagaaacactttgcattgaccttccccaagccattacagcggggtaccaatgacaagtccaggcctttgaaaagtcagattaccgtgaccaggcatgataagcgaaagctggaggagggtcagaaaccagctcataaatggatccggcactcctttcggaagatcctccagtggcctcctatttacaccgctgcaagggagcagacaccctttcggcacctgtataccagcaaaacccatcttaagaaggccgagtacaaaaaatcaaaagacgagaaaggcggcactccgctgaaaaaagattctaaaaaaaagggcgggtcctatgcgaccaatccggagtccaaacagatcgtggaagagaaaactaagcgccagaatgaagccgacaagaccccactgaaatcttcacatgagaatgagcaaagcaagaaatccaaatcatcgagcgagaccaatcccgagtcccagaacagcaaaacggtctcgaaaaattgttctcaaaaggataaaaaggatagcaagaactcaaagaagacaaacaccgagttcttgcatacaaagaataatccaaagaaagacttgaaaagatccaagacatctaatgaccctatttccgagatttgtagcgagaacagtctgaatgtcgactttctcatgttggtcggtcaatctgatgatgagtctataaacttcgatgcttggctcaggaattacagccaaaataactctaaaaattattccctaaaatacaccaagtatactaaaaaggacactaagaagaacgcaaagaagagctctgatgcggagtccgaagactccaaagacgctaaaaaggactccaagaaagtcaaaaaaaacgtgaagaaagatgataagaagaaggatgtgaagaaggacaccgagagtactgacgccgagtcaggggacagcaaggatgaaaggaaggatacaaagaaagataaaaagaagctgaagaaggatgataagaagaaagataccaaaaaatacccagaaagtacagacacagagtccggcgacgctaaggatgctcgcaatgattcaagaaatttaaaaaaagcaagtaaaaacgacgataaaaagaaggacgctaagaagattacattctcgactgactccgaaagcgagctagagtctaaggagtcccagaaggatgaaaagaaagacaagaaggattcaaaaacggataataagaagtcagtaaagaacgacgaggagtccacagacgcggactctgaaccgaagggtgattcaaaaaagggaaaaaaagatgaaaagaaggggaagaaagactccaagaaggatgacaaaaaaaaagatgctaagaagaacgcagagagcactgagatggagtcagatctggagctgaagaaagacaagaagcacagcaaagaaaaaaaaggtagcaaaaaagacataaaaaaggatgctcgtaaagacacagaaagtacggacgcagagtttgatgagtcctccaagactgggtttaaaacgtctaccaagattaaagggtctgacacagagtcagaggagtccctttacaagcctggcgctaagaagaaaattgacgagagcgatggtactagcgccaatagcaagatggagggactggagagtaagagggggttccggatgtctagtaaaaagacaacttttaatgagaaaggggaaaaggctagcaccggccgtgtgcccccatcacgcgaaaaaccgccgctcccggcttgtgaaccctctctgcctagccccaaagtgagaagactgtgctggtgcaagatgccgccccctccccccaaacctcgatacgcaccactaatccagagacgacagcgcttgggcgtgaggcgctgccagctattgatgtag

SEQ ID NO: 113474 - DNA, 1086 bp, Artificial Sequence
  Description of Artificial Sequence: Synthetic coding sequence
atgcaagagaaagatgcttcctcacagggcttcctcccccatttccagcactttgctacccaggcaatacatgtgggacaggatcctgaacagtggaccagtagggcggtggttccacccatcagtctgagtaccaccttcaagcagggagcccccggccagcactccgggttcgaatactccagatcaggcaaccccacccgaaactgccttgagaaggcggtagctgcgctcgatggagctaagtactgtctggcgttcgcttcaggacttgctgccacggtgacaatcacacatctactgaaggcaggtgaccagatcatttgcatggacgacgtttacggaggcacaaacagatattttcggcaggtcgccagtgaatttggactgaagatcagttttgtggattgctcaaagattaaactgctggaggcagcgatcaccccagagacaaagcgacccttggccctgggagccgatataagcatgtattcagcaaccaaatatatgaatggccattccgacgttgtgatgggtctcgtctcagtaaactgtgagagcctacataacaggcttcggtttttgcagaacagtcttggagccgtgccgtctccaattgactgttacctgtgtaacagaggcctcaaaactctgcacgtccgaatggagaagcactttaagaatgggatggccgtggcacagtttcttgaaagcaatccttgggtcgagaaagtgatttatcccggcctgccctcccaccctcagcatgagttggtgaagcgacaatgcaccggatgtaccgggatggtcaccttctatatcaaggggactttgcagcatgctgaaatatttctaaagaatctcaaattatttacgctcgcggagtctttgggcgggtttgaaagcctcgctgagctgcctgcgattatgacccatgcctcggtgttgaagaatgatagggatgtgctgggcattagtgatactctcatcaggttatccgttggtctcgaagacgaagaggacctgttagaagatttggatcaggcactgaaggcggcgcacccaccaagcggctcccacagttag

SEQ ID NO: 113475 - DNA, 1218 bp, Artificial Sequence
  Description of Artificial Sequence: Synthetic coding sequence
atgcaggaaaaggacgctagttcccagggattcctgccacatttccaacactttgccacccaggccatccacgtggggcaagatcctgagcagtggacctcccgagccgtagtgcctcccatcagcctctcgactacttttaagcaaggcgcaccggggcaacactccggtttcgaatatagtcggagtgggaaccccacgaggaactgtttggaaaaagcggtggccgcccttgacggggctaaatattgccttgccttcgctagcgggctcgccgccacagttacaattacacacctactgaaggccggcgaccagataatctgcatggacgacgtctacggaggcacaaatcgatacttcaggcaggtggcctctgaattcggacttaaaatctccttcgtggattgtagtaaaataaagctccttgaagcagctatcacacccgaaactaagctggtatggatcgagacgcctaccaaccccacacagaaagtgatagacatcgagggctgtgctcacattgttcacaagcatggggatataatcctcgtggtggacaataccttcatgtccccctacttccagcgccccctggcactgggtgccgatatctcaatgtattccgccactaagtacatgaacggacactccgatgtggtgatgggtctggttagcgtgaactgtgaaagcctacacaatcgattacggttcctgcaaaattcattgggggccgtgccctcccctatagactgttatctgtgcaaccgcggcctgaagaccctgcacgtacggatggagaagcatttcaagaatggaatggccgttgcccagttccttgagtcaaacccctgggtggagaaggtgatctaccccggccttccatctcatccacagcacgagctggtcaagcgccagtgtaccgggtgtacaggtatggtgacattctatatcaaaggcacactccagcatgccgagatttttttgaaaaatctgaagttgttcaccttggctgaatcgttggggggctttgagtcccttgctgaactcccggccatcatgacacacgcaagcgtgttgaaaaatgaccgtgacgtgctcggcatcagcgacaccctaattaggctgtcggtgggtctggaggatgaagaggaccttttggaagacctcgaccaagccttgaaagctgcccacccaccctccgggtctcacagttag

SEQ ID NO: 113476 - DNA, 1122 bp, Artificial Sequence
  Description of Artificial Sequence: Synthetic coding sequence
atgcaggagaaggacgcctcatcacagggatttctgccgcacttccagcacttcgccacccaggctatacatgttgggcaggatcctgagcagtggactagccgggccgtggtcccaccaatcagcctcagtactaccttcaaacagggcgccccaggccagcactctggcttcgagtacagccggagcgggaacccgacaaggaactgtttggagaaggccgtggccgctttagatggggctaaatactgcactaacaggtacttccggcaggtcgcttcagagttcggcttgaaaatcagtttcgttgactgtagcaaaattaagctgctcgaagccgccatcactcccgagacgaaactggtatggatcgagacacccaccaatcctacccagaaggtcattgacatcgagggctgcgcacacattgtgcataagcacggtgatatcatccttgtagtcgataacacatttatgagtccatacttccagcgacctctggctctgggggcagatattagcatgtatagcgcaaccaagtacatgaatgggcattcagatgttgtcatgggactggtctcagtgaactgtgagagccttcataaccgcttacggttcttgcaaaacagtttgggcgccgtgcccagccctatcgactgctatctgtgtaacagggggctgaagactctccacgtaagaatggaaaaacactttaaaaacgggatggctgtggcacagtttttggaatccaacccctgggtggaaaaagttatctaccccggcttaccgagccacccacagcacgagttggtgaagagacaatgtacagggtgcacaggcatggtgacattttatattaaaggcactctgcagcacgccgaaatattcttaaaaaatctgaagcttttcacactagccgaatctcttggaggttttgagtctttagccgagttgcctgccatcatgactcacgcatctgtcctcaaaaacgacagagatgtgctgggcatctccgatacgcttattagattatctgtgggcctggaagacgaagaggacctgctcgaggatctggaccaggcactgaaggctgctcatcctcccagtggatcacacagttag

SEQ ID NO: 113477 - DNA, 1656 bp, Artificial Sequence
  Description of Artificial Sequence: Synthetic coding sequence
atgccttcggagactccacaggcagaggtcggtccaactggttgtccacataggagtggtcctcactcggcaaaaggcagtctagaaaaggggtctcctgaagacaaagaggcaaaggaacctctatggattcgccctgacgcgccttcacgctgcacttggcagctaggccgaccagctagcgaaagcccccaccaccacaccgctcctgccaaatcaccaaaaatccttccagatatcctcaaaaagatcggcgatactcccatggtccgtataaataaaattggcaaaaagttcggcctgaagtgcgaacttctggccaaatgcgaatttttcaacgccggaggatccgttaaagataggatcagtctgagaatgatcgaagatgctgagagagacggaacattgaagcccggcgatactataatcgaaccaacctccgggaataccggcatcgggctggccctggcagcggctgtgagaggctacaggtgcattatagtcatgcctgaaaagatgtcgagcgagaaggtggatgttttaagggccctgggcgctgaaattgttcggacccccacaaacgccaggtttgacagtcccgaatcacatgtgggggtagcctggcggctgaaaaatgagataccaaattcacatatactcgaccaatacagaaatgcttctaaccctttggcacactatgataccaccgccgacgagattttgcagcagtgcgacggtaaattagacatgctggtggcgtccgtgggcactggcgggaccattacagggatcgcgcggaagctgaaagagaaatgtcctgggtgccgcattattggagtcgatcccgaggggagtatccttgccgagcccgaggaattgaatcagacagagcagactacatacgaggtagaaggaattggatatgactttattcctacggtattggatcggacagttgtggataaatggtttaagagtaacgacgaggaagcctttacttttgccagaatgctgattgcgcaagagggtctgctctgtggaggatcagctggatccactgtggcagtggccgtcaaagccgcccaggagctgcaggaaggacaacgctgcgttgtcatcctgcctgactctgtgcggaactacatgacaaaatttctcagtgacagatggatgctccagaaggggttcttaaaggaggaggaccttacggagaaaaaaccatggtggtggcacctccgagtccaggagctgggcctatccgccccgctgactgtacttccaaccataacctgcggccataccattgaaatcttgagggaaaaaggcttcgaccaggctccggtcgtcgacgaagctggtgtcattttgggtatggtgaccctggggaacatgctgtcctcactgctcgctggaaaggttcagccctcggaccaggtgggaaaggtgatctacaaacagttcaagcagatacgactgaccgatactctagggcgactcagccatatactggagatggatcattttgccctcgtcgtacacgagcaaatccagtaccactcgaccggaaaatcaagtcagaggcagatggtctttggagtggttaccgctattgatctgctgaatttcgtggccgcccaggaaagggaccagaagtag

SEQ ID NO: 113478 - DNA, 1656 bp, Artificial Sequence
  Description of Artificial Sequence: Synthetic coding sequence
atgccatcagagacaccccaggctgaagtggggccaaccggatgtcctcatcgatctgggcctcactccgccaagggaagccttgaaaaggggtcccccgaggacaaggaggccaaggagcccctgtggattagaccagacgcaccatctcggtgcacatggcagctgggccgaccagcctccgagagtcctcatcaccatacagcgccagcaaaatcccctaagatcttacctgacattctcaaaaagattggtgatacgccaatggttcggatcaataaaatcgggaagaaatttgggttgaagtgtgagctcttagctaagtgcgaattcttcaacgctggagggtcggtcaaggataggatctcactcaggatgattgaagacgcagagcgggacggaacactgaagccgggagacactattatagaaccgacaagcggcaacactggaatcggattggcgttggccgctgctgtacgcggctatagatgcatcattgtcatgccggaaaaaatgtcgagcgagaaggtcgacgtcctgagggctctcggagccgagattgtgcgaaccccaacaaacgcccgctttgatagcccagagagccacgtgggagtggcctggagactcaagaacgaaattcccaactcacatatcctggaccagtataggaacgcgtctaaccctctcgctcactatgacaccacagcagacgaaattttgcagcagtgcgacggaaaacttgatatgctcgtcgcttctgtcggtactggcggaaccattacagggatagctcggaagctgaaagaaaagtgtcccggatgcagaatcatcggcgtcgaccccgagggcagtatccttgccgagccagaggagctgaaccagacagaacaaacaacttatgaggtagaagggatagggtatgacttcataccaacggtcctcgatcgcacggtcgtggataaatggttcaagagcaacgacgaggaagcttttaccttcgcgcggatgttgatcgcacaggaaggcctcctatgtggaggctcggctggaagtacagtggccgtcgcagtcaaggctgctcaggaactccaggagggccaacgctgtgttgtgatcctgcccgactccgttaggaattatatgaccaagtttctatctgaccggtggatgttacagaagggtttcttgaaagaggaagaccttactgaaaaaaagccctggtggtggcatctgcgggtccaggagctcggtctcagtgcgcctcttacagtgttacctactatcacttgtggacatactatcgaaattctgcgcgagaaaggctttgaccaagctcctgttgtggacgaagccggagtcattctgggcatggttaccctcggaaacatgctttcctcccttctggctgggaaagttcaaccctcagaccaggtgggtaaggtcatttacaaacaattcaagcagatccgcttaaccgacaccctgggcaggctgtcacatatccttgaaatggaccatttcgctctggtggtgcacgagcagatacaataccacagcaccgggaagagctcccaaagacaaatggttttcggggtggttacggcgatcgatctcctgaacttcgtggccgcacaggaaagagaccagaagtag

SEQ ID NO: 113479 - DNA, 1656 bp, Artificial Sequence
  Description of Artificial Sequence: Synthetic coding sequence
atgcccagtgagactccccaagctgaggttggtcctacgggatgcccgcaccggtccggtccgcactctgctaagggttccttagagaagggttcccctgaggacaaggaggcaaaggaacctctctggattcgccccgacgcgccgtccaggtgcacctggcagctcggtaggcctgcaagtgagagtccacaccatcacaccgctcccgctaagtcacctaagattctgcccgacatattgaaaaagatcggggacacccccatggtcaggatcaacaagattggcaagaaatttggtctcaaatgtgaactgttagcaaagtgcgagttctttaacgccggaggtagtgtcaaagataggatctcactgagaatgatcgaagacgccgagcgcgacggtactctgaagcccggcgatactatcatcgagccaacttctggaaacacaggaatcggccttgcacttgccgcggcagtgcgtggctaccgttgtatcattgtgatgcccgagaagatgagctccgaaaaagttgatgtacttagagcattgggagccgaaattgtgaggacacccactaatgctcgattcgacagtcctgagtcccatgtcggcgttgcctggcggctcaaaaacgaaatcccaaactcacacattctagaccaatatcgaaacgcctccaatccattagcacattatgataccacagctgacgagattctgcagcagtgcgatggaaagctagatatgctggtcgcttctgtaggaaccggcggaaccattacaggaattgcccgaaagttaaaggagaaatgccctggatgtaggattattggcgtcgaccccgagggttcaatactcgcagaacccgaagagctgaaccagaccgagcaaaccacatacgaggtggaagggattgggtacgactttatacctactgtgcttgatcgcaccgtggtggacaaatggtttaagtccaacgacgaagaggcattcacattcgcacgaatgttaattgcacaagaaggcctactgtgtggtggttctgccgggagcaccgttgccgtggcggtcaaggcagctcaagagctccaagaaggccaacgatgcgtcgtcattttacccgactctgtaagaaattatatgactaagtttctcagtgatcgatggatgctgcagaaagggttcctgaaggaagaggacctgacagagaagaaaccttggtggtggcacctcagggtgcaagaactgggtctcagcgccccattgactgtcttgcctacaatcacctgcggccacaccatcgagatccttcgtgaaaaaggtttcgaccaagccccagtggtcgatgaggctggggtcatcctgggtatggtcaccctcggtaatatgctctcaagcttattggctggaaaggtgcagccttcggaccaggtcggaaaggtcatatacaagcagttcaaacagatacgcttgacggacactttaggaaggctctcacatatcctggagatggaccattttgccctcgtggttcatgaacagatccagtaccacagcacgggcaagtcaagtcagcggcaaatggtatttggggtggttaccgcaattgaccttctgaatttcgtggccgcccaggagagagaccagaagtag

SEQ ID NO: 113480 - DNA, 1656 bp, Artificial Sequence
  Description of Artificial Sequence: Synthetic coding sequence
atgccttcggaaaccccacaggcagaggtgggcccaacagggtgtccccatcggtcagggccacactcagccaagggatcgcttgaaaaaggcagcccggaggataaagaagccaaagaacccctgtggatcaggcccgacgctccatctcgctgcacatggcaactgggaaggcctgcttctgagtcgccacatcaccacacagcgcctgctaaaagtccgaagatcctgccggacatactgaaaaagatcggagacacacccatggtcagaatcaacaagattggaaaaaagtttggtttaaagtgcgagcttttggctaaatgtgagttttttaatgcaggcggctcggtaaaagacagaatctccttgcgtatgatcgaagacgcggaaagggatggcactctgaagcccggagacactattattgagcctaccagcgggaatacggggattggcctggcattggccgcggcagtgcggggatacaggtgcatcattgtgatgcctgagaagatgagcagcgagaaggtcgacgtacttcgcgccttgggcgccgagatcgtacgcactcccacaaacgcccgctttgatagccctgagtctcacgtcggcgttgcatggcggttaaagaacgagatccccaatagtcatattcttgatcaatacagaaatgccagcaacccgcttgcccattatgacaccacagcagatgaaatccttcagcagtgcgatggtaaactggatatgctagtagccagtgtgggcacaggcggaactatcacgggcatagcccgaaagctgaaggaaaagtgccctggctgccggattataggagtggatccggagggtagcatcctcgccgaaccggaggaactgaatcagacagagcagaccacatacgaggtggagggtattggttacgacttcatacctactgtgcttgacagaactgtagtcgataaatggtttaagagcaacgacgaagaggcattcaccttcgccagaatgctgattgctcaggaggggttattatgtggtggctctgctgggagtactgtagctgtcgccgtgaaagctgcccaggaactccaggagggacaaaggtgcgtggtgatcctgccagatagtgtgcgcaactacatgaccaagttcctgagcgatcggtggatgctgcagaaaggattccttaaagaggaggaccttaccgagaaaaagccctggtggtggcaccttcgagttcaggagctgggattgtcagctccattaactgtgctacccaccatcacctgcggacacacgattgagatcttgcgtgagaagggcttcgatcaggcccccgtggttgacgaggctggtgttattctcggcatggtgaccctcggtaatatgctgagttctctgctcgcgggaaaggttcagccctcagaccaggtagggaaagtgatttataaacagttcaagcagatccgactgaccgatacactgggccgcttgtctcatattctagagatggaccatttcgcactggttgttcacgagcaaatccagtaccattcgaccggcaaaagcagccagcgccagatggtctttggtgtcgttacagcaatcgacctgctgaacttcgtggccgcgcaggagcgcgatcagaagtag

SEQ ID NO: 113481 - DNA, 1698 bp, Artificial Sequence
  Description of Artificial Sequence: Synthetic coding sequence
atgccctccgaaacgccgcaggccgaggttggaccgaccggctgcccacatcgcagcggcccgcatagcgctaaggggtcattagaaaagggttctcctgaagataaggaagcgaaggagcccctgtggatccggccagatgcaccttcaaggtgcacctggcaactagggagaccggcgagcgagagtccccaccaccacacagcgcctgctaagagtcccaagatcctccctgacattttgaaaaaaataggggacacacccatggttcggatcaacaaaatcggtaaaaaattcgggctgaagtgtgagttgcttgcgaagtgcgaattttttaacgccggcggttcagttaaagacagaatttccctgagaatgatcgaggacgccgagcgggacggaaccctgaaacccggtgataccatcattgagcctaccagcggcaacacagggatcggactggcgctcgcagctgctgtacgagggtatcgctgtattatagtgatgcctgaaaagatgagttccgagaaggttgatgttctgagggcattaggagctgagattgtcagaacaccaaccaacgcacgattcgacagtccggaatcccacgtgggcgtcgcgtggagactcaaaaacgaaattcccaacagtcatatcctcgaccaatatagaaatgcttcaaaccctctggcgcattacgacactacagcagatgagatcctgcagcagtgtgatggcaaacttgacatgttggtggcctctgttggcacaggaggcacaatcaccggcattgcgaggaagcttaaggaaaagtgtcctggatgccgaatcatcggagtcgatcctgagggaagtatcctcgccgaacctgaggagctgaaccagactgagcagactacctacgaggtcgaaggcataggctacgactttatacccaccgtgctcgaccggacagttgtggataaatggttcaagtctaacgatgaggaagcattcacctttgcacggatgctaatcgctcaggaggggctgttgtgcggaggatccgctggctcaaccgtggccgtcgcggtgaaggccgctcaggaattgcaggagggtcagaggtgcgtggtcattttgcccgatagcgtccggaactacatgacaaaattcctctctgacaggtggatgctgcagaagggcttcctaaaagaggaggacttaacagaaaagaaaccctggtggtggcatctgagagtgcaggaacttggactaagcgccccgctgacagttctcccgacaattacctgtggacataccatcgaaatcctgcgtgagaaagggtttgatcaagcacctgttgtggacgaggccggggtgatattgggcatggttacgcttgggaacatgcttagttccctcctggcaggaaaagttcaaccttctgaccaggtgggcaaagtgatctataagcagtttaagcaaatccggttaaccgataccctcgggcggttgtctcacattttagagatggaccactttgcattggtggtacacgagcagatccaaagccaagatcaggcctgggccggagtggtgggaggccccgcagaccactctaccggaaagagctcacagcgacagatggtgttcggtgtcgtcactgctattgacctacttaatttcgtcgcggcccaagagcgggaccagaagtag

SEQ ID NO: 113482 - DNA, 534 bp, Artificial Sequence
  Description of Artificial Sequence: Synthetic coding sequence
atgccaagtgagacccctcaggcagaggtaggtcccacaggatgccctcaccggtctgggcctcactcagccaagggatcactcgaaaagggtagtccagaagataaagaagccaaggagccactgtggatacgccccgatgcgcccagccgttgcacctggcaactaggtagaccagcatctgaaagcccccatcaccacacggccccagccaaatcccccaaaattctgcctgacattcttaagaaaatcggggacacacccatggtgcggattaacaagatcggaaaaaagtttggcctgaaatgtgaattgcttgctaagtgtgagttcttcaatgccggtggttccgttaaagacagaatttcgctgaggatgatagaagacgccgaaagagatggtacactgaagccgggggacacgataatcgagcccacaagcggtaacactggaataggcttggccttagccgcagccgtcagaggctatagatgtatcattgtaatgccagagaaaatgtcatctgagaagtag

SEQ ID NO: 113483 - DNA, 1527 bp, Artificial Sequence
  Description of Artificial Sequence: Synthetic coding sequence
atgccttctgaaacacctcaggcggaggtaggcccaactgggtgtccccacagatccggcccccaccatcatacggccccagcaaagagcccgaaaatcttgcctgacatccttaaaaagatcggcgacaccccgatggttcggattaataagattggcaagaaatttggacttaaatgtgagctgctggctaagtgtgagtttttcaacgcagggggctctgtaaaggatagaatttccctgagaatgatcgaagatgccgagcgtgatggaactctgaagcctggtgacaccatcatcgaacctacctctggtaataccggaatcgggctcgctttagccgctgccgttcgcggctatcgctgtatcatcgtgatgccagagaaaatgtcatccgaaaaggtggatgtgttgcgtgcccttggcgctgagattgttagaacacccactaacgctcggtttgactcgccagagagccatgttggggtggcctggcggctgaaaaacgagatccctaactcccacatcctcgaccagtatcgaaacgcatctaaccctctggcccactacgacaccaccgcagatgaaatcctgcagcagtgcgacgggaagttggatatgcttgtcgcttcggtgggcactggtggcaccattaccggcatcgcaaggaaactgaaagaaaaatgccccggatgcaggatcatcggcgtcgaccctgaaggtagtatcctggcggaacccgaggagttgaaccaaacggaacaaactacctatgaggtggaaggaatcggttacgacttcataccgacagtgctagacagaaccgtggtggacaagtggttcaaatccaacgatgaggaagctttcaccttcgcccgcatgctcattgcacaggagggcctgctctgtggaggatccgcaggctccacagtggcagtagctgtaaaggccgcccaggagctgcaagagggacaacggtgtgttgtcatactgccagattccgttcgcaattatatgacaaagttcctcagtgatcgctggatgttacaaaaaggcttcctgaaggaggaagacttgacagaaaagaaaccctggtggtggcacttgcgcgtacaggagctcggcctctcagctcctctgacagtgctgcctactatcacttgtggccacactattgaaatccttcgtgagaaaggctttgatcaggctccagtggtcgacgaagccggagtgatccttggtatggtcacgttaggaaacatgctgagtagtctcctagcgggcaaagttcaacctagtgaccaggttggcaaggtcatatacaagcagtttaagcagattaggcttactgacacacttgggcggctgtcccatatactggagatggatcatttcgcgctggtggttcatgagcagattcagtatcactccaccggcaagtcttctcagagacagatggtctttggtgttgtcacggccatagatctactgaattttgtggctgctcaagaaagggaccaaaaatag

SEQ ID NO: 113484 - DNA, 1392 bp, Artificial Sequence
  Description of Artificial Sequence: Synthetic coding sequence
atggtgaggattaataagataggcaaaaagtttgggctgaaatgtgagctgctggcaaagtgtgaattcttcaacgccgggggctcagtcaaagacagaatctcattgcgcatgatcgaagatgcagagcgggacggcactctgaaacctggggacaccatcatagagcctacatcaggcaataccggaattggcttggcgctcgctgccgccgttagagggtatcgttgtatcatcgttatgcctgagaagatgtccagcgaaaaggtggacgtcctgcgtgcattgggcgctgagatcgtccgtaccccaactaacgctcgctttgactctcctgagtctcacgttggcgtggcctggcgactgaaaaacgaaatcccaaactcacatatactcgatcaataccgtaatgctagcaatccgctggcacactatgacactacagccgacgagatcctccagcagtgcgatggaaagctggatatgcttgtcgcatctgtgggaactggcggtactataacaggcattgcaaggaaactcaaagaaaaatgccctggctgtcggattataggcgtggatcctgagggaagcatcctggccgagcccgaggaactgaaccagactgaacagaccacctatgaagtggagggaatcgggtatgactttattcccactgttctggatcggaccgttgttgataagtggttcaagagcaacgatgaagaggcgttcacctttgcccggatgctcatcgcccaagagggccttttgtgtggcggaagcgcaggctctacagtcgcagtggcagtgaaggctgctcaggaactgcaggagggacaaagatgcgtagtcattcttcctgactctgtcaggaactacatgaccaagttcctgagcgacagatggatgcttcagaagggatttcttaaggaggaggacttgacagaaaagaaaccatggtggtggcatctgagagtgcaagaactagggctgtccgctcccctgacggtgctcccgaccatcacatgcgggcacactatcgagattctgcgcgaaaaaggctttgaccaggcaccagttgtagatgaggcaggtgtgatactggggatggtgacgcttgggaacatgctcagctctctcctggctggcaaagtccaaccctccgatcaggtggggaaggtaatctacaagcagttcaagcaaatccgcctgactgacacgttgggccgactgtctcatatcctcgagatggatcatttcgcactagttgtgcatgaacaaattcagtatcactctactgggaagtcgtcccagagacagatggtctttggagtggttactgcgattgacctgttaaactttgtggccgcacaagagcgggaccagaagtag

SEQ ID NO: 113485 - DNA, 312 bp, Artificial Sequence
  Description of Artificial Sequence: Synthetic coding sequence
atgatggccgagccgtggcaggcgctgcagttgcttctggctatcctgctgacattgatggcgttgccctaccaggcgagaaagaagacctttcttagcgtgcatgaggtgatggcagtcgagaactatgcaaaagactccctgcagtggatcaccgatcagtacaataaagagtctgacgataagtaccatttcaggatctttagggtactcaaagtgcagcgccagcaggtcaactgctttttcagtgttttcgctgtcccctggtttgagcagtacaaaattcttaataagtcctgcagcagtgattag

SEQ ID NO: 113486 - DNA, 417 bp, Artificial Sequence
  Description of Artificial Sequence: Synthetic coding sequence
atgatggccgaaccctggcaggctctgcagcttctcctggcgatccttttgacgctcatggctctgccctaccaagctcgcaagaaaactttcctctctgtgcatgaagtaatggccgttgagaattacgccaaagactctctccagtggatcactgatcagtataacaaagaaagcgatgataagtaccacttccgcatctttcgggttttgaaggtccagcgccaggtcaccgatcacttggaatatcacctgaacgtggaaatgcagtggactacgtgtcagaaaccagagaccacaaactgtgtcccacaggaacgggaattacacaagcaggtcaactgttttttctccgtgttcgcggtcccgtggtttgagcagtacaagatactcaataagtcttgctcaagtgattag

SEQ ID NO: 113487 - DNA, 297 bp, Artificial Sequence
  Description of Artificial Sequence: Synthetic coding sequence
atgatcccgggtggcttaagtgaagcgaagccggccactcctgaaatccaggagatcgttgataaagtcaagccgcagctggaagagaagacaaatgaaacatatggcaagctcgaagccgtccagtacaaaacccaggtagtcgccggcacaaactactacatcaaggtgagggccggcgataacaagtacatgcacctgaaggttttcaagagcttgcccggacagaacgaagatctggtgctgacgggctatcaagttgataaaaataaagatgatgaactcaccggcttttag

SEQ ID NO: 113488 - DNA, 297 bp, Artificial Sequence
  Description of Artificial Sequence: Synthetic coding sequence
atgatgtgtggcgccccctccgctacgcagcccgcaactgccgagacccagcacattgcagatcaggtccgctctcagctggaagagaaggagaacaaaaagtttcctgtctttaaagcggtcagcttcaaatcacaggtggtcgcaggaacaaactacttcatcaaggtgcatgtgggggacgaggacttcgtgcacctgcgggtgtttcagtcgcttccacacgagaataaacccttgacactgtcaaattaccagacgaataaggccaagcatgacgaacttacctatttctag

SEQ ID NO: 113489 - DNA, 441 bp, Artificial Sequence
  Description of Artificial Sequence: Synthetic coding sequence
atggctggacccttgcgggctccattgctcttattggccatactggctgtcgctctggctgtgagcccagccgccgggagctcccctggaaaaccaccacgcttagtgggtgggccaatggatgcaagtgtggaggaagagggggtgcgccgggccttggatttcgctgtcggagaatacaacaaagcttcgaatgatatgtaccactcaagagctcttcaggtggtgagagctcgcaaacagattgtcgccggcgtcaactactttctggatgtagagctcggtcgcacaacctgtacgaagacccagccaaatctagataactgtcctttccacgatcaacctcatctgaagaggaaagctttttgttcattccagatatatgccgtgccatggcagggcacaatgaccctttccaaatcgacttgtcaggatgcatag

SEQ ID NO: 113490 - DNA, 441 bp, Artificial Sequence
  Description of Artificial Sequence: Synthetic coding sequence
atggccggcccactgagagctcccctcttactattagcaattttagcggtggcactcgcggtctcccctgctgctggcagctccccagggaagccaccccggcttgtgggcggcccgatggacgcgagtgtggaggaggaaggcgtgaggcgggccctcgacttcgccgttggtgagtacaataaggcctccaacgatatgtaccacagcagagctcttcaggtagttcgagccagaaaacagattgtcgccggcgttaactattttctagacgtggaattgggtaggacaacatgtactaaaacccagcctaacttagacaactgcccgttccacgatcagccccacctgaagcggaaggcattctgttctttccaaatatatgcagtcccatggcagggaactatgaccctgagtaaatctacatgtcaggatgcctag

SEQ ID NO: 113491 - DNA, 441 bp, Artificial Sequence
  Description of Artificial Sequence: Synthetic coding sequence
atggcaggccctttgagggcccccctgctgctgcttgctatactagccgtcgcacttgctgtctcaccagctgcagggtccagccccgggaagccacccagattggtgggaggacccatggacgcttccgttgaggaggagggagtccgtcgtgccctcgacttcgcagtcggcgaatacaacaaagccagcaacgacatgtaccattcgcgagccctgcaggtcgttcgggcccgtaagcaaattgtggccggtgtcaactactttctcgatgtagaactggggagaacgacatgcaccaaaactcagccaaatctcgataactgtccgttccacgaccagccccacctgaagagaaaagcattctgctcgttccagatctacgcagtgccctggcagggcactatgacgctttcaaagagcacctgtcaggacgcctag

SEQ ID NO: 113492 - DNA, 429 bp, Artificial Sequence
  Description of Artificial Sequence: Synthetic coding sequence
atgatgtggccaatgcatacccccctgctactgcttactgcattgatggtcgccgtcgcgggaagcgcttctgcccaatcccgaaccctggctggcggcatccacgcgaccgatctgaacgataagtcagtgcagtgcgccctggattttgccattagtgaatacaacaaagtcattaacaaggacgaatactactccaggcccctgcaggtaatggcggcgtatcagcagatagtcgggggggtcaactattatttcaatgtcaagtttggtcgcactacttgcacaaaatcccaaccgaacctcgataattgcccgtttaatgatcagcccaaattgaaagaggaggagttttgtagcttccagatcaatgaggttccttgggaggacaaaataagcatcctcaactacaaatgccgcaaggtgtag

SEQ ID NO: 113493 - DNA, 1578 bp, Artificial Sequence
  Description of Artificial Sequence: Synthetic coding sequence
atggcgacactactacggtctaaactgtccaacgtcgctacttcagtgagcaacaagagccaggccaaaatgtctggaatgttcgctaggatgggctttcaagccgccacagatgaggaagcagtaggcttcgcacattgcgacgatcttgacttcgaacatagacagggtttacagatggacatcttgaaggctgagggtgagccatgcggcgacgagggagccgaagctcctgtagagggggacatccactaccaacgcggaagcggggcccctctcccaccatccggtagcaaggaccaggtgggtgggggaggcgagttcgggggacatgacaagccaaagatcactgcatgggaggcagggtggaatgtgacaaatgctatccagggcatgtttgtcctgggattaccttatgcaatcctgcacggcggctatttgggactgtttcttatcatctttgcagccgtggtgtgctgctatacagggaaaatcttgattgcctgcctgtacgaggagaacgaagatggagaggttgtaagggtgcgggacagttatgtggctatcgccaacgcttgttgcgctccacgattccccactcttggagggcgggtggtgaacgtagctcagataattgagctggttatgacttgtatcctgtatgtagtggtgagcggcaacctgatgtacaactcttttcctggtctaccagttagtcagaagagctggtctatcatcgccacagcagtcctcctgccatgtgctttcctgaaaaacctgaaggcagtcagcaaatttagcctcctttgcaccctagcacactttgtgatcaacatcctcgtgatcgcttattgcctgagccgcgcaagagactgggcatgggaaaaggtgaagttctatatcgacgtgaagaaatttccaatctctatcgggatcatcgtcttcagctatacatcacagatctttttacccagtctggagggcaatatgcagcaaccctctgagtttcactgtatgatgaattggactcacatcgccgcttgcgtgctgaaaggcctgttcgcattggtcgcctacttaacatgggccgatgagaccaaagaggttatcaccgataacctgcctgggtccatccgggcggtagttaacatcttcctggtggcaaaggctctgctgtcctaccccttaccattcttcgccgccgtggaggtcctggagaaatctttatttcaagaaggcagtcgagctttctttccagcctgctattcgggtgatggcaggctgaagtcatggggacttactttgaggtgcgctctggttgtgttcaccctcctgatggcaatctacgtaccacactttgcccttctgatggggctaacgggctcgctgacgggggccggcctttgtttccttctcccaagtctcttccatttgcggctcctgtggcggaagctactgtggcaccaggtgttcttcgatgttgccatctttgtcatcggcggaatctgttccgtcagcggatttgtgcactcgctggagggtttaatcgaggcgtatcgcactaacgcggaggattag

SEQ ID NO: 113494 - DNA, 426 bp, Artificial Sequence
  Description of Artificial Sequence: Synthetic coding sequence
atggcttggcccctctgcacactgctgttactactggccactcaggccgtggccctggcctggtctccgcaggaggaagatagaatcatcgaggggggtatctacgatgccgatctcaacgacgagagagtccaacgtgccctgcacttcgtgatttccgaatataataaagctacggaggatgaatactatagacggttactccgggtcctccgggcacgggagcagatcgtcggaggtgtgaattattttttcgacatcgaagtgggacgcactatctgcactaaatcacagccaaatctcgatacctgcgcatttcatgaacagcccgaacttcaaaagaaacaactatgctcgtttcagatctatgaagtgccatgggaagatcgaatgagccttgtgaatagcaggtgccaggaagcctag

SEQ ID NO: 113495 - DNA, 426 bp, Artificial Sequence
  Description of Artificial Sequence: Synthetic coding sequence
atggctcaatacctctccacactgctgttgcttctcgcaactctcgccgttgccctcgcctggtccccaaaggaggaggacaggattataccgggaggcatctacaatgctgacttgaatgatgaatgggtgcagcgcgcgctgcactttgccatttcagaatataacaaggcaacaaaggacgactattatcggagacccttacgagtgctgagggccaggcaacagactgtaggaggagtcaactacttttttgatgtcgaggtgggtcgaacaatatgtacaaaatcccagcctaatttggatacatgtgcctttcacgaacagcctgagttgcaaaagaagcagctctgttcctttgagatttacgaggtgccttgggagaataggcgcagcctcgtaaaaagcagatgccaagagagttag

SEQ ID NO: 113496 - DNA, 426 bp, Artificial Sequence
  Description of Artificial Sequence: Synthetic coding sequence
atggcccagtacctgagcaccttgttactgctcttggccaccttagctgtggctttagcatggagcccgaaagaggaagatcggattattccaggagggatctacaacgccgaccttaacgatgagtgggtccagcgggcactccattttgcaatctctgagtacaacaaagcaaccaaagatgactattaccggcgccctctgcgggtccttcgcgcccgccagcagaccgtcggcggtgtgaattatttttttgatgtggaggttgggcggacaatctgtacaaagtcacaaccaaatcttgacacttgcgcttttcacgagcagcctgaactgcagaaaaaacaactgtgtagttttgagatatatgaggtgccatgggagaatcgtcgaagtctcgtcaaatccagatgccaggaatcttag

SEQ ID NO: 113497 - DNA, 582 bp, Artificial Sequence
  Description of Artificial Sequence: Synthetic coding sequence
atgccaaactggggaggcgggaaaaagtgtggcgtgtgtcagaagaccgtgtatttcgccgaggaggttcagtgcgaggggaattccttccacaaatcgtgctttctttgcatggtgtgtaagaaaaatctggattctaccactgtggctgtgcatggcgaggaaatttactgcaaatcatgttacggcaagaaatacgggcctaaaggatatgggtacggacaaggtgctggtacattatctacagacaaaggcgagagcctcggaatcaaacacgaggaggcacctggccatagaccaaccacaaaccctaacgcttccaagttcgctcagaagataggcggatcggaacggtgtccacgttgctcacaggccgtttacgctgccgaaaaggtaattggagctgggaagtcttggcataaagcctgttttcggtgcgccaaatgtggaaaaggactggaatcaaccacgctggctgacaaggacggcgaaatttattgcaaagggtgctacgcgaaaaatttcggacccaaggggttcgggttcggacagggtgccggagctctggttcattctgaatag

SEQ ID NO: 113498 - DNA, 582 bp, Artificial Sequence
  Description of Artificial Sequence: Synthetic coding sequence
atgcccaactggggcgggggaaagaagtgcggagtttgccagaagaccgtatatttcgccgaagaagtgcagtgtgagggtaatagtttccacaaaagctgttttctgtgtatggtctgtaagaagaatttggacagcaccaccgttgctgtgcacggcgaagaaatctactgtaagagctgctacggtaaaaagtatggcccgaaggggtacggttacgggcaaggggcaggaaccctgagcactgacaaaggagaatcacttggaataaaacatgaagaagcgccaggccaccgtcccaccactaaccccaatgcttccaagttcgctcagaagataggagggagcgaacggtgcccccggtgttcccaggccgtgtacgcagcagagaaagtaatcggcgcaggcaagtcttggcacaaagcctgcttccgttgcgcaaaatgtggcaaaggtttagaaagcaccaccctggctgataaagacggagagatatactgcaagggctgctacgcaaagaacttcggccctaaaggtttcggattcggacagggggcaggcgccctggtccactcagagtag

SEQ ID NO: 113499 - DNA, 582 bp, Artificial Sequence
  Description of Artificial Sequence: Synthetic coding sequence
atgccaaattgggggggcggcaagaagtgcggagtatgtcagaaaacggtttatttcgccgaggaagtgcagtgtgaggggaacagctttcataagtcctgttttctctgtatggtgtgcaagaaaaacctggactcaactaccgttgctgtgcacggcgaggaaatttattgtaaatcctgttacggcaagaaatacgggcctaagggatatggctacgggcagggcgccgggactttgagcaccgacaaaggggagagcctgggcattaaacacgaagaggccccggggcacaggcctacgaccaaccctaatgccagtaagtttgctcagaaaattggaggaagtgagcgctgtccaaggtgctcacaggcagtttatgcggctgaaaaggttattggcgcaggcaaatcatggcacaaagcctgttttagatgtgctaagtgtggcaagggcctggagtctacaacgttggctgacaaagatggggagatttattgcaaagggtgttatgccaagaatttcgggccaaaaggatttgggtttggccagggcgctggcgcactggtgcactctgaatag

SEQ ID NO: 113500 - DNA, 582 bp, Artificial Sequence
  Description of Artificial Sequence: Synthetic coding sequence
atgccaaactggggaggcggaaaaaaatgcggagtatgccagaagactgtgtacttcgcagaggaggtgcaatgtgaaggaaattcctttcataagtcatgcttcctctgcatggtctgcaaaaagaacctggactcaacaactgtcgcagtgcacggggaagagatttattgtaagagctgctacgggaagaagtatggccccaagggctatggttatggccaaggggccgggaccttgagtacagacaagggcgagagtctaggtatcaagcacgaagaagcaccgggtcaccggcccactactaatcccaacgccagtaaatttgcgcagaagattggggggagtgaacgctgtcctcgctgttcacaggcagtatacgctgctgagaaagtcataggcgctgggaagtcctggcacaaggcatgcttccgatgtgccaaatgtgggaaaggcttagagagcaccaccttggccgataaagacggagaaatttactgtaagggatgctacgccaagaacttcgggcccaagggattcggctttggtcagggcgctggcgccctggtgcacagcgagtag

SEQ ID NO: 113501 - DNA, 513 bp, Artificial Sequence
  Description of Artificial Sequence: Synthetic coding sequence
atgcccaactggggtggagggaagaagtgtggcgtgtgccagaagacagtttactttgcagaggaagttcagtgcgaaggcaatagctttcacaagagttgttttctgtgtatggtctgcaagaagaacctagatagcactactgttgcagtgcacggagaggagatctattgcaaatcttgttacggcaaaaagtacgggccaaaagggtacgggtatggacagggcgccggtacgaatcccaacgcttccaaattcgcacagaagattggcggctctgaaagatgtccccgttgtagtcaggctgtgtacgccgcagaaaaggtcatcggtgcaggcaaatcatggcacaaagcatgcttcagatgcgctaaatgcggaaaggggctggaaagtacaacactggctgacaaagacggtgaaatctattgcaagggctgctacgcaaagaactttggacctaagggctttgggtttggccaaggtgccggagctcttgtccactctgaatag

SEQ ID NO: 113502 - DNA, 582 bp, Artificial Sequence
  Description of Artificial Sequence: Synthetic coding sequence
atgcccgtgtgggggggcgggaataaatgcggagcgtgtggccgtacagtgtaccatgcagaggaggtccaatgtgacggacgcagctttcaccggtgttgcttcttgtgcatggtgtgtaggaaaaatctcgacagtacgaccgtggccatccatgatgaggaaatttactgtaaaagctgttacggaaagaagtatggccccaaaggttacgggtacggacaaggggctgggaccctgaatatggatagaggcgaacggcttggcattaaacctgaatccgttcagccgcaccgcccgacgactaaccccaacacatctaaattcgcacagaaatacggtggcgctgagaaatgctcaaggtgtggcgacagcgtgtatgcagcagagaaaattataggagccggtaagccctggcacaagaactgcttccgatgtgccaaatgtggaaaatctctggaaagtacaaccttgacagagaaggagggcgagatctactgcaaaggctgctatgcaaaaaattttggccctaaggggtttggatatggacagggtgctggcgctcttgtgcatgcccagtag

SEQ ID NO: 113503 - DNA, 582 bp, Artificial Sequence
  Description of Artificial Sequence: Synthetic coding sequence
atgccagtttggggtggtggtaataagtgcggcgcgtgcggcaggacagtgtaccacgctgaggaggtacagtgcgacggcaggtcatttcaccgctgttgctttctgtgtatggtttgccgtaagaatctagacagcaccacggtcgccatccatgatgaggaaatttactgcaagtcctgctacggcaaaaaatacggccctaagggttacggctatgggcagggcgctggcactctcaatatggatcgcggggagcggcttggtatcaaaccagaatctgtccagccccacaggccaactacaaatcccaatacgtcaaagttcgcacagaaatatggtggagcagaaaagtgttcccgctgcggtgactctgtttacgctgctgagaagatcataggagcgggtaaaccatggcacaagaattgcttcaggtgcgccaagtgcgggaagtctctggaatccactactctgactgagaaagagggtgaaatttactgcaagggctgttatgccaagaatttcggcccgaagggctttggctacgggcagggagcgggagccctggtgcacgcacagtag

SEQ ID NO: 113504 - DNA, 585 bp, Artificial Sequence
  Description of Artificial Sequence: Synthetic coding sequence
atgccgaattggggtggtggagctaaatgcggcgcttgcgaaaagaccgtgtaccatgctgaagaaattcagtgtaacgggaggtcgtttcacaagacctgtttccattgtatggcttgtagaaaagccttggatagtaccacagtggccgctcatgaatcagagatttactgtaaagtctgttatggccggcggtacggacccaaggggatcgggtatggccaaggcgctgggtgcttatctactgacaccggagagcacctgggtttgcagttccagcaatctcctaagccggctcggtcagtaacaacatccaaccccagcaaatttacagccaagtttggcgaaagcgaaaagtgcccgcgatgcgggaagagtgtgtatgccgcggagaaggtgatgggtggaggaaaaccatggcataagacctgtttcagatgtgctatctgtggcaaatcactggaatccaccaacgtaactgacaaggatggagaactatattgcaaggtgtgctacgcgaaaaatttcggcccgacaggcatcgggtttggcgggcttacacagcaggtggaaaaaaaagagtag

SEQ ID NO: 113505 - DNA, 585 bp, Artificial Sequence
  Description of Artificial Sequence: Synthetic coding sequence
atgccaaactggggcggtggcgcaaaatgtggtgcctgtgagaaaacagtttatcatgccgaagagatccaatgcaacggtaggagcttccataagacctgtttccactgcatggcttgccgaaaagcactcgactcaacgacggtggccgcgcacgaatctgaaatttactgcaaggtttgttatggcagacgctacggccctaagggcatcggctatggtcagggggccggctgtctcagcaccgatacaggagaacatttgggactgcagtttcagcaatcaccgaagcctgcacgctcagtgaccacctctaacccatctaagtttacagctaaatttggggagtcagaaaagtgtccacgctgcggcaagagcgtgtacgcagccgaaaaggtcatggggggagggaagccctggcacaagacttgctttcgctgtgctatctgtggtaaatccctggaaagtaccaacgtcaccgacaaggatggtgagctgtactgcaaagtctgttatgctaagaatttcggacctacaggcatcgggtttggcgggttaactcagcaggttgagaaaaaggagtag

SEQ ID NO: 113506 - DNA, 1365 bp, Artificial Sequence
  Description of Artificial Sequence: Synthetic coding sequence
atgttcctcgcccagaggtcactttgtagcctctccggacgagctaagttcctgaagaccatatcctcttcgaagattctgggattttctactagcgcaaaaatgagtctcaagtttacaaatgcaaagcgaattgaaggactcgattcaaatgtctggattgagtttactaagttggccgccgatccctcggtggtgaacctgggacagggcttcccagatatttctccaccgacttacgtcaaagaagaactgtccaaaatcgccgctatcgatagcctcaatcagtatactcgtggcttcggccatccctctctggtaaaggccctgagctatttatatgagaaattataccaaaaacaaatcgattcaaacaaagaaattctcgtgaccgtgggggcgtacggttcccttttcaataccatccaggcgcttattgacgaaggggatgaggtgattctgatcgtgcccttctacgattgctatgaacccatggtgcgcatggccggggccacgccggtgtttataccattaaggtctaagccagtgtatgggaaaaggtggagcagctctgactggaccctggatcctcaggagttggaatctaagtttaacagcaagactaaggctattattctgaatacacctcataacccactgggaaaagtgtacaaccgagaggaactccaagtgatagcagacctgtgcattaaatacgatactctgtgtatatccgatgaggtttacgagtggctggtgtactcaggaaacaagcacctgaagatcgccacgtttccagggatgtgggagcggaccatcacaatcggctctgctggcaaaaccttctctgtgaccgggtggaaactgggatggtcgattggtccgaaccatttgattaagcacctccagaccgtgcaacagaacacaatttacacctgtgcaaccccacttcaggaagcacttgcccaagcattttggatcgatatcaaaagaatggacgacccagagtgttacttcaattcattacccaaagaactggaagtcaaaagagaccgaatggtccggctgctggaatccgtggggcttaagcccatcgtgcctgacggaggttatttcattattgccgacgtgtccctgttggatcctgacctgagcgacatgaagaacaacgagccctatgattataagtttgttaagtggatgacgaagcacaagaagctgtctgccatccccgtgtccgcattttgcaattctgaaactaaatctcagttcgaaaagtttgttcgtttctgttttatcaagaaagactctacactcgatgcggccgaggagataattaaggcatggtctgttcagaagagttag

SEQ ID NO: 113507 - DNA, 504 bp, Artificial Sequence
  Description of Artificial Sequence: Synthetic coding sequence
atgtttctggcccagcgctccttatgtagtctctctggtagagctaagttcctgaagacaatttcgagctctaaaattttaggctttagcaccagtgcaaaaatgagtctgaagtttaccaatgccaagcgcatcgagggacttgacagtaacgtgtggattgagtttacaaaacttgccgccgatccctccgtggtgaatctgggccagggtttccctgacatatcccccccgacatatgtgaaggaggagcttagtaagattgccgccatagatagcctcaaccagtataccagagggtttggacaccctagcttagtgaaggctctgagttatctgtatgagaaactttaccaaaaacagatagatagcaacaaagagatcctagtcactgtaggcgcctacggatccttattcaatacaattcaagcgctaattgacgagggcgacgagtacaacgcttgtacagtgaaattcactaatttaaagtgcactgctggttag

SEQ ID NO: 113508 - DNA, 789 bp, Artificial Sequence
  Description of Artificial Sequence: Synthetic coding sequence
atgtttctcgctcagcggagcctttgctcgctcagcggcagggctaagttccttaaaacgatttcaagtagcaagatactgggcttctcaactagtgccaagatgtccctgaagttcaccaatgccaagcgaatcgagggactggacagtaacgtatggattgaatttacaaagcttgccgccgatccgtccgtcgtaaacctgggtcaggggtttcccgatatctcaccgcccacgtacgtgaaggaggagctgtcaaagatcgctgccattgatagcctaaaccagtatacgcggggttttggtcacccttctctggtgaaagctctgtcctacctgtacgagaaactgtatcagaagcaaatagattcaaacaaagagattttagtgaccgtgggggcctacggatccctttttaataccattcaggctttaatcgacgagggagatgaggtgatactcattgtgcctttctacgattgttacgagccaatggtccggatggccggagccacccctgttttcattcccctgagaagcaagcccgtgtacgggaaaagatggtcgtcctccgattggaccctcgacccacaggaactcgagtctaagtttaacagtaagaccaaggccatcattctcaatacacctcataatcctctcggcaaagtgtataatagggaggagctgcaggtgatcgctgatctgtgtataaagtatgacactctgtgtatttctgacgaggtgtatgaatggctcgtgtactctggaaacaaacacctcaagatttag

SEQ ID NO: 113509 - DNA, 1263 bp, Artificial Sequence
  Description of Artificial Sequence: Synthetic coding sequence
atgtcacttaagttcacaaatgctaagcgcattgaggggctggatagcaacgtgtggattgaatttacaaaactggcggctgacccttccgtcgtaaatctgggccagggattccctgatataagcccccccacctacgtgaaggaagaattgtctaagattgccgcaattgacagtctgaaccagtataccagagggttcggtcacccatcattggtgaaggcgctatcttacctgtacgaaaagctctaccagaagcaaattgatagtaacaaagagatcctcgtgaccgtcggggcatatgggagtttgtttaacaccatccaggccctgattgatgagggcgacgaggtgatcctgatcgtgcccttctacgattgctacgagccaatggttcggatggccggagccacccctgtctttatccctctgaggtcaaagcccgtgtacggcaagaggtggagctcaagcgattggaccctggacccgcaggaactggagtctaaattcaattcaaagactaaagctatcatcctgaatacaccccacaaccctcttggtaaggtttataaccgagaagagctacaggtgatcgctgatctctgcatcaagtacgataccctgtgcattagtgacgaggtgtatgagtggttggtctattcaggcaataagcatctgaaaatcgccacctttcccggaatgtgggagcggacaattaccatcggaagtgccggcaagacatttagcgttacaggctggaagcttggttggtctataggtcccaaccaccttatcaaacatttacagacagttcagcagaatactatctatacctgcgctacacctttgcaggaagctctggcacaggccttctggatagacataaaaaggatggacgaccctgagtgttatttcaattcgctaccaaaggagctggaggtcaagagagaccgaatggtcaggctgctcgaaagcgtgggcttaaaaccgatagtccccgacggcggatacttcatcatcgccgacgtctcattgttggatccagatttatctgatatgaaaaacaacgaaccttacgattacaaatttgtaaaatggatgaccaagcataaaaagctgtccgcaattcctgtcagtgccttctgcaattcggagactaagagccagtttgagaaatttgtgaggttttgcttcatcaaaaaggactctaccctagacgccgccgaggaaatcattaaagcttggtccgtgcagaagagctag

SEQ ID NO: 113510 - DNA, 1269 bp, Artificial Sequence
  Description of Artificial Sequence: Synthetic coding sequence
atggctaagcagctacaggcccgtcggttagatggaattgattataacccgtgggtagagttcgtgaagctcgcgtcggagcacgatgtcgtgaatttgggacaaggctttcccgacttcccaccccctgattttgctgtggaggctttccaacacgctgtttccggtgactttatgctgaatcaatatacaaagaccttcggctacccacccctcaccaagattctggctagcttctttggtgaattgctgggacaagagatcgaccctctgcgtaacgtgctcgtgaccgttggcgggtatggggccctgtttactgcatttcaggccctcgtcgacgagggggatgaagtcatcataatcgagccattcttcgactgttacgaaccaatgacaatgatggctggaggacgcccagtttttgttagcttgaagccagggccaattcagaacggagagctgggttcctcaagtaactggcaacttgaccccatggaattagcagggaagttcacgagccggactaaagccttggtgctaaacacgccaaataatccactgggtaaagttttttcaagggaagaattagagcttgttgcaagcttatgtcagcagcatgacgtggtgtgtattactgacgaagtttaccaatggatggtttatgacgggcatcagcacatatctatcgcctccctccctggaatgtgggaaaggacgctgacgataggctctgcgggaaagaccttttccgctaccggctggaaagtggggtgggtcttgggtccagatcatatcatgaagcatctcaggacggtccaccagaactctgtcttccactgccccacccagtcccaagctgccgtggccgaatcctttgaacgtgagcaactgctctttcgtcaaccctcttcttatttcgttcagtttcctcaggccatgcaacggtgccgggatcatatgatccgctcgttgcagtctgtgggcctcaaacctattatcccgcaggggtcctattttctcatcaccgatatctcagattttaagcgaaagatgcctgacctccctggggccgtcgatgagccttatgacaggcggtttgtgaagtggatgataaagaacaaaggcttggtggccataccagtctccatcttttacagtgtccctcatcagaagcactttgatcactatataaggttctgttttgtgaaagatgaggccacactgcaggctatggatgagaagctcagaaaatggaaggtggaactgtag

SEQ ID NO: 113511 - DNA, 1119 bp, Artificial Sequence
  Description of Artificial Sequence: Synthetic coding sequence
atggccaaacaactgcaggcgcgacgactcgatggcattgactacaatccctgggtggagtttgttaaactggcttccgaacatgacgtggtgaacctggggcagggattcccagatttccctcctccagactttgccgttgaggcttttcaacacgctgtgtcaggcgacttcatgttaaaccagtataccaagacattcgtgatcattatcgaaccattcttcgattgctacgagcccatgacaatgatggcaggcggccgcccagtgttcgtgtccctgaagcccggccctatccagaatggagagctgggatcatccagcaactggcaattagatcctatggagcttgcgggaaagttcaccagtcggaccaaagccttggtattaaatacccccaataaccctctcggaaaggtgttttccagggaggagcttgaattggttgcttcgctctgtcagcaacacgatgtcgtatgcatcacagatgaggtgtaccagtggatggtgtacgatggacaccaacacatctcgattgcaagtctgccgggcatgtgggagcgtaccctgaccatagggagcgcgggaaagacgttctctgcaaccggctggaaagtggggtgggtgctgggccctgaccatatcatgaaacacctgcgaacagtgcatcaaaacagtgtgtttcattgccccacccagtctcaggcagctgttgccgaatcattcgagagagaacagcttctgtttagacagccttcctcttatttcgtgcagttccctcaggcgatgcaaagatgtcgcgaccacatgattagatccctgcagtccgtggggctcaagcccattattcctcaggggtcttattttttgatcactgatattagtgactttaaaagaaagatgcctgatctacccggcgcagtggacgagccatatgataggcgctttgtcaagtggatgatcaagaacaaaggtcttgtcgctatcccggtgagcattttctatagcgtgccccatcaaaaacacttcgaccactacatacggttttgtttcgttaaggatgaagccacacttcaggctatggatgaaaagctcaggaaatggaaagtggagttatag

SEQ ID NO: 113512 - DNA, 480 bp, Artificial Sequence
  Description of Artificial Sequence: Synthetic coding sequence
gccatggctaagcagctgcaggcaaggaggttggacgggattgattacaacccatgggtcgaattcgttaagcttgcctctgaacatgacgtcgttaacctgggacagggcttccccgactttcccccgcctgactttgcagtggaagcttttcagcacgctgttagcggggatttcatgttaaaccagtacactaaaactttcgtctctctgtgttatcctggttggtccgcaatggtgcgttcctggtccacagctgctctgaccctgcccgtaagtagcggcccacccaccagcgcatccggcgtcacgggcaccacaggctggtctcaatcctggctggagtcctcattctttgatcctaaaaaaaagaagattatatggggatatcccccccttaccaagatattagcaagtttcttcggggaactcctgggtcaagagatcgatcccctgaggaatgtgctggtcaccgtgtag

SEQ ID NO: 113513 - DNA, 555 bp, Artificial Sequence
  Description of Artificial Sequence: Synthetic coding sequence
atggcaaaacagttgcaggcacggagactggatggcattgattataacccatgggtcgaatttgtgaagctggcctcagagcacgacgtcgttaacctgggccaagggtttccagacttcccgccaccagattttgccgtcgaggccttccagcacgccgttagcggggacttcatgctgaaccagtacacaaagacattcggatatcctcctcttaccaagatcttagcttccttttttggcgaattgttggggcaagagatcgaccccctgcggaatgtgttggttacagtaggcgggtatggcgcactgtttaccgcgttccaggcgttagtggatgagggagacgaggtcattataatagaacctttttttgactgttacgagccaatgacaatgatggctggggggaggcctgtgttcgtctccctgaaaccaggccccatacagaatggagagctgggaagctcttcaaattggcagttggatcccatggagcttgcaggaaagttcaccagccggaccaaagctcttgtcctgaacacccccaattag

SEQ ID NO: 113514 - DNA, 480 bp, Artificial Sequence
  Description of Artificial Sequence: Synthetic coding sequence
gccatggcgaaacagctacaggctaggcgactggatggcatagactacaacccctgggtggaattcgtcaagctggcctcggagcacgacgtggtaaacttaggccaaggatttcctgacttccctccaccagactttgctgttgaagcttttcaacacgctgtctcgggcgactttatgttgaaccagtacaccaagacattcgtgtctctgtgctatcccggatggagcgctatggtgcggtcttggtcgacagctgctctcactctgccggttagttcaggtccaccaacttccgcttctggagtgacaggcaccacgggctggtctcagtcatggttagagtcctccttcttcgaccccaaaaaaaaaaaaataatttggggttatccaccattgactaagatccttgcttccttttttggcgagctgttaggccaggagatcgaccccctcaggaatgttttagtgactgtgtag

SEQ ID NO: 113515 - DNA, 1551 bp, Artificial Sequence
  Description of Artificial Sequence: Synthetic coding sequence
atgtttcggacggctgcagctatctcagtgcacctggtggggcccctgcaggggagaaaggctggggctccactcacttggttcctgcaccagacgcaggtggccgaaaaaaacgtcggatccccagcaccccgccctacatcccacttgggcctggctaatccacaagagcgcaaagtcccccagggaccgcagagtccatgtgaggttcccgctgctgaggggatactgaggacaggcggtgccaaactgcctattcagggccaccccgccaaattggcaatggcaaagcagctccaggcccgacggctggatggaatcgattacaatccttgggtcgagttcgtgaaattagcctccgagcatgacgtggttaatctcggccagggcttccccgacttcccccctccggactttgcagttgaggcctttcagcacgctgtcagtggtgatttcatgttaaaccagtatacgaagactttcggttacccacccctgactaagattttggcatctttttttggggagctgttagggcaggagattgatccccttcgtaacgtcctggttacggttggtgggtacggcgctctttttaccgccttccaggcattagtcgacgaaggagacgaggttatcattattgaacctttctttgattgttacgaacctatgactatgatggctggcggccgacccgttttcgtctccctgaagccaggtcctatccagaatggtgaacttggatctagcagcaactggcaactggacccaatggaattagcgggtaaatttacatccaggactaaagcgctggttctgaataccccgaacaacccccttggaaaggtttttagcagagaagagctggagctggtggcctcattgtgccagcagcacgacgtggtatgcatcactgatgaagtgtatcaatggatggtgtatgatgggcatcagcatataagcatcgcaagcttgcctgggatgtgggagcgtacgttgactatcggaagtgcgggcaagacattttctgccaccggatggaaggtgggatgggtgttgggccctgaccacatcatgaagcacctcagaactgtacaccagaatagtgtttttcactgtccaacccagtctcaagccgcagtggcagaatcattcgagagggaacagttgttatttagacagccttcttcgtacttcgtgcaatttccacaggccatgcagcgatgccgcgaccacatgatccgatcccttcagagcgtgggactcaagccaatcatcccacagggatcctactttttaattactgatatttccgactttaaacggaagatgccagatctacctggggccgtcgacgagccatatgacaggagattcgtaaaatggatgataaaaaacaagggtttagttgcaattcctgtcagtatcttttacagtgtgcctcaccagaaacactttgaccattatatcaggttctgtttcgtaaaggacgaagccactctccaagcgatggacgagaagttgcgcaaatggaaggtggagctttag

SEQ ID NO: 113516 - DNA, 756 bp, Artificial Sequence
  Description of Artificial Sequence: Synthetic coding sequence
atggccaaacagctgcaggcacgcagactggacgggatagattataacccctgggtggaattcgttaagcttgcttctgaacatgacgttgtcaatttaggccagggattccctgacttcccaccaccagattttgccgttgaggcctttcaacatgctgtatccggtgacttcatgctaaatcagtacaccaaaacttttggataccccccgctcaccaaaattctggcatccttcttcggagagctcttgggccaggaaatcgaccctctgagaaacgtactagttaccgtaggtggctatggagctttgttcaccgccttccaagccttggtcgacgagggcgacgaggtcatcatcatcgagccattctttgactgttatgagccaatgacgatgatggccggtgggcgccctgtgtttgtgagtttgaaaccagggccaattcagaacggagagcttggaagctctagtaactggcagctggaccctatggagttggcgggcaaattcacttccaggacgaaggcattggttctgaataccccaaataaccccctgggtaaggtcttctcccgggaggagcttgagctggtggccagcctctgtcagcagcacgacgtagtgtgcatcacagatgaggtttaccaatggatggtctatgatgggcatcagcacatttcaattgccagcctgcccgggatgtgggagcggaccttgacaatcggtagcgccggcaaaactttttccgcttag

SEQ ID NO: 113517 - DNA, 603 bp, Artificial Sequence
  Description of Artificial Sequence: Synthetic coding sequence
atggagcagacggaggtcttaaagccgcgaaccctcgcagacctgattcgaattctgcaccaacttttcgccggtgacgaagtgaatgtcgaggaggttcaggccatcatggaggcctacgagtctgaccctaccgagtgggccatgtacgcaaagtttgatcagtatcgctacacccgcaatctggtcgaccagggcaatgggaagtttaatctgatgatactttgttggggtgagggacacggtagcagcatccatgatcataccaatagtcactgttttctaaagatgcttcaggggaatttaaaggagaccctcttcgcctggcccgacaaaaaaagtaatgagatggtgaaaaagtcagagcgagtactgcgcgaaaatcaatgcgcttacatcaacgatagcattggcctgcacagggtagagaacatttcgcacaccgagccagcagtgagccttcacctctacagcccaccattcgacacctgtcacgcatttgatcagcgaactgggcacaaaaataaggtgacgatgacattccatagcaaatttggcattcgtactcctaacgctacctccggctccctcgaaaataattag

SEQ ID NO: 113518 - DNA, 3111 bp, Artificial Sequence
  Description of Artificial Sequence: Synthetic coding sequence
atgtacctcgtggcaggggatcggggtttagccgggtgcggacatttgttggtcagcctcctgggtttgctgctactactggcccgtagcgggacacgcgctcttgtttgcctgccttgtgatgagagcaagtgtgaggaacctcgcaattgcccaggttccatagtacagggcgtgtgcggctgttgctatacatgcgcctcgcagcggaatgagtcatgcggagggacattcggtatctacggcacctgcgacaggggattacgctgcgttattcgcccaccgctgaacggagactcgctcacagaatatgaagccggggtgtgtgaagacgaaaactggacagacgaccagctacttggattcaaaccctgtaatgaaaatctaatcgctgggtgtaacatcattaacggtaaatgtgaatgcaatacaattcgaacctgctctaatccgtttgagtttcctagccaggatatgtgtctcagcgccctgaaacgaattgaggaggaaaaacccgactgtagcaaagcacggtgtgaggtgcagttcagccctcgatgtcctgaggattcagtgctgatcgaaggctatgcacccccaggggagtgctgcccattgccatcaaggtgcgtgtgtaacccagcaggctgccttagaaaagtgtgccagcctggcaacctgaacatcttggtgtccaaggcgagcgggaagccaggggagtgttgcgacctatatgagtgtaagccagtgttcggagtggattgccggacagttgagtgtcccccagtccagcaaaccgcttgcccccccgacagttacgaaactcaagtccggttgactgctgacggttgctgcacactgcccactagatgtgaatgcctatcagggctgtgtgggttccctgtgtgtgaagttggctccactccccggattgtgtcgaggggtgacggtactccgggtaaatgctgtgacgtcttcgagtgcgtaaacgacacaaagcccgcgtgcgtgttcaacaatgtggaatattatgatggcgacatgtttcggatggataattgccggttttgccgatgccaggggggcgtcgcaatatgctttaccgcacaatgcggtgaaataaactgcgaacgttactacgtgcctgagggcgaatgttgccccgtgtgtgaggaccccgtgtaccctttcaataatccagctgggtgttatgccaacggtctcatactggcgcacggcgacagatggcgcgaggatgactgcactttctgtcagtgtgttaacggggagcgacactgcgtcgccacagtatgcggccagacatgtacaaacccagtgaaggtccccggcgaatgttgtccagtgtgcgaggaacctacaataattaccgtggatccaccggcctgtggagaattatctaattgtactctgactggaaaggattgcattaacggattcaaacgtgaccacaatggctgtcgaacttgccagtgcattaacacagaggagctgtgcagtgaacgtaagcagggctgcactctgaattgtcccttcggattcctcaccgatgcacagaactgcgagatttgtgaatgcaggcctagacccaagaagtgccgacctattatctgcgacaaatattgcccattaggactacttaagaacaagcacggatgcgatatctgtagatgcaagaaatgtcccgaattgtcatgctccaaaatttgtccgctgggttttcaacaggattcccatggctgcctgatctgtaagtgccgagaagcttcagcctcagctggccccccgatattgtcagggacctgtttgacagtagacggacatcaccataaaaatgaggagtcctggcacgatggatgccgagagtgttattgtctcaacggacgggagatgtgtgctctgataacgtgtcccgtccccgcctgtggaaatcctaccatccaccccggtcagtgctgtccctcttgtgcagatgactttgtcgtccagaaacccgagctgtctactcccagcatttgccacgctcccggtggcgaatactttgtcgaaggcgagacttggaacattgactcttgtacccagtgtacctgccatagtggcagagtgttgtgcgagaccgaagtttgcccccccctactctgccagaatccaagtcgcactcaagatagttgttgtccgcagtgtacggaccaaccttttagaccttctctttctaggaacaattcagtacctaattactgtaagaatgacgagggcgatatatttcttgcagctgaaagctggaagccagatgtctgtacgagctgcatttgcatcgattcagtgattagctgtttctccgaaagttgcccatctgtgagctgtgagcgtcctgtgcttcgcaaaggacagtgttgcccttactgcatcgaggatacgattccgaagaaggtcgtgtgccattttagcggaaaagcctatgcggatgaagagcgctgggacctggactcctgcacccattgttattgtctccagggccagaccttgtgctctactgtgtcatgtccacccctgccttgcgtggagcccatcaacgttgagggctcttgttgcccgatgtgccccgagatgtacgtgcctgaaccgactaacattccgatcgaaaagaccaaccacaggggcgaggttgacctggaggtccccttgtggccgactcccagcgagaatgacatcgtgcacctgcctagggatatgggacacctacaagtggactacagggacaacaggctgcacccttcagaagatagctccctggacagcattgcctcagtggtcgtccccatcatcatttgcttgtctatcataatcgctttccttttcatcaaccagaaaaagcaatggatccccctgctgtgttggtacaggactcctacaaaaccgtcgtctctcaataaccagttagtctctgtggattgcaagaaaggcaccagggtccaggtggactccagccagcgtatgctccgcattgctgagcccgacgcccggtttagcggattctatagcatgcagaaacagaatcatttgcaggccgataacttctaccagactgtgtag

SEQ ID NO: 113519 - DNA, 498 bp, Artificial Sequence
  Description of Artificial Sequence: Synthetic coding sequence
atggctgatttcgatgaaatttacgaggaagaggaggacgaagagagggccctggaggagcagctgctcaaatactctcccgatccagtggtggtacgcggctccggtcatgtgactgtgttcggcctgtcaaataagttcgagtcagagtttccctcttcactgaccggaaaagtagccccagaggagttcaaggcctctattaaccgcgtgaatagttgtcttaaaaaaaacctgcctgtgaatgtgagatggctgctgtgcggttgtctttgttgctgttgcaccctcggctgcagtatgtggcccgttatctgtttgagcaagcgaacccgtaggtctatcgaaaaattgctggaatgggaaaacaacaggctgtatcacaagctgtgtctgcattggaggctgtcgaaacgaaagtgcgaaacgaataacatgatggaatacgtaatcctcatcgagttcttaccaaagacacctatcttccggcccgattag

SEQ ID NO: 113520 - DNA, 234 bp, Artificial Sequence
  Description of Artificial Sequence: Synthetic coding sequence
atgcctaaatgtccaaagtgtaataaggaagtgtactttgctgaacgcgtgacatcccttggaaaagactggcatcggccatgtttgaagtgcgagaaatgcgggaagactctcacatcaggcgggcacgcagagcatgagggcaagccttactgcaatcacccatgttacgccgccatgtttgggccgaagggttttggaaggggcggcgctgagagtcatacgttcaaatag

SEQ ID NO: 113521 - DNA, 234 bp, Artificial Sequence
  Description of Artificial Sequence: Synthetic coding sequence
atgccgaagtgcccgaaatgtaataaggaagtgtactttgctgaacgagtgacctcactgggtaaggactggcacagaccttgtctcaaatgtgagaagtgcggaaagacccttacgtccgggggacatgccgagcatgaggggaagccctattgcaatcacccctgctacgccgcgatgtttggtcccaagggttttgggagggggggagctgagtcccacacgttcaaatag

SEQ ID NO: 113522 - DNA, 234 bp, Artificial Sequence
  Description of Artificial Sequence: Synthetic coding sequence
atgcccaagtgtcctaagtgcaataaagaggtgtacttcgccgagcgggtcactagcctgggaaaggactggcatcgcccctgtttgaagtgcgaaaagtgtggcaaaacgttaacctcaggaggacacgcagaacatgaaggaaagccatactgcaatcatccatgttacgctgctatgttcggccccaagggcttcggaagaggaggcgcggaaagtcacacatttaaatag

SEQ ID NO: 113523 - DNA, 627 bp, Artificial Sequence
  Description of Artificial Sequence: Synthetic coding sequence
atggctagtaaatgtccaaaatgtgataaaaccgtgtacttcgccgagaaggtctcaagcctaggcaaagactggcacaagttctgcctcaagtgtgaacgatgttccaagacactgacccctggtggccacgccgaacacgacggcaaaccattctgccataaaccgtgttacgctacgctgttcggacccaagggagtgaatattgggggagccgggtcctacatctacgaaaaacccctggcagagggcccgcaggttaccggcccgatcgaagtgccagctgcccgggcagaggaacggaaagctagtggaccacccaaaggacccagccgcgcgagtagcgtgaccaccttcaccggagagccaaatacatgtccacgatgttctaaaaaagtctattttgccgagaaagtcactagcctgggcaaagactggcaccgcccatgcctgcggtgcgagcgctgcgggaagacgctgacacccggcggacatgcagagcatgatggtcagccatactgtcataagccatgttatggcattttattcggaccaaaaggagtgaatactggtgctgtggggtcctatatctacgatcgtgatcccgaggggaaagtgcagccatag

SEQ ID NO: 113524 - DNA, 849 bp, Artificial Sequence
  Description of Artificial Sequence: Synthetic coding sequence
atgcccccccaccacctgctgccttggctcgcccaagtcccatctgccgagggggagttggttcgtttggtgtccagagcaggcggtcggggcgcttgtttctggcccgcagtcaccatggaaatggccgtggccgccgggtgcgtatgtaaaggtggtgggtgctgccacagggagccatctcaagaccatcatgaaagccaggaacacagaggacccctagtcggcagccagacctgcctggtccatcaggcagagggtactgctgaaaaagtcagctccctgggcaaagattggcataagttttgtctgaagtgtgagagatgttcaaagactttgacacctggcgggcacgcagagcacgatgggaaacccttctgtcacaaaccctgctacgctaccctgttcgggcccaaaggtgtgaacatcggcggcgcaggtagctacatttacgagaaacccctcgctgagggtccccaggttacaggccctatcgaagtgccagcagcacgcgctgaggaacgtaaggcctcaggtccccctaaagggcccagtcgcgccagcagtgtgacgacatttacgggagaaccaaacacttgtccccggtgttctaagaaggtatactttgccgagaaggtcaccagcctgggtaaggattggcataggccctgtttgaggtgcgaacgttgtggcaagacgcttacacccggggggcacgcagagcacgatgggcagccctactgtcataagccatgctacggcattctgtttgggcctaagggggttaataccggcgccgtaggctcatacatctatgacagagaccccgaaggcaaagtccagccttag

SEQ ID NO: 113525 - DNA, 315 bp, Artificial Sequence
  Description of Artificial Sequence: Synthetic coding sequence
tgaccaggcggggagcgtgctgaaggcgcaggacgcccgggagctccaaccatggcaagtaagtgcccaaaatgcgacaagactgtgtatttcgcggagaaggtgacttcactgggaaaagactggcacagaccctgtctccgatgcgagcggtgtgggaaaactttgaccccaggcggacatgctgagcacgacggccaaccctactgtcacaagccttgttatgggatactctttggccctaagggagtcaacaccggcgctgtcggctcgtatatctacgatagggacccagaaggaaaagtgcagccttag

SEQ ID NO: 113526 - DNA, 537 bp, Artificial Sequence
  Description of Artificial Sequence: Synthetic coding sequence
atggaaataaagcatctcctgttcctggtggcagctgcctgcttgcttcctatgttgtctatgaagaagaaatcagcaagagaccagtttaacaaactggtcacagacctacccaatgtgcaggaggagattgtcaatattcacaacgccctccggcggagggtggtgccacctgcctcaaacatgctgaagatgagctggtccgaggaggcagcacagaacgctaggatatttagtaaatattgcgacatgactgagagcaaccctctggagagaaggctcccaaataccttctgtggcgagaacatgcatatgaccagctatcccgtcagctggagcagcgtcatcggcgtctggtacagtgagtccacctctttcaaacacggagagtggacgactaccgatgacgacatcacaaccgaccactacacacaaattgtgtgggccacttcttaccttatcggctgtgctattgcgagttgtagacaacaaggatcaccaaggtacctttacgtgtgtcattattgccatgattag

SEQ ID NO: 113527 - DNA, 750 bp, Artificial Sequence
  Description of Artificial Sequence: Synthetic coding sequence
atggagattaagcatcttctgttcctcgtggcagcagcctgtctgctcccaatgctgtccatgaagaaaaagtcagccagagatcagttcaacaagttagtgacagacctccccaacgtgcaggaagagatagtgaatattcataacgccctcagaaggcgcgtcgttccccctgcctccaatatgctgaagatgagttggtctgaggaggcggctcagaatgcccggattttctctaagtactgcgacatgactgagagtaatccgttggagcgtaggctgcccaatactttttgtggtgaaaatatgcacatgacgagctaccctgtgtcatggtcttccgtgattggagtgtggtacagcgaaagcacttcattcaaacatggcgagtggactacaacagacgacgacatcacgactgaccattacacacagatcgtttgggcaacatcctatttaataggatgcgcaattgcaagctgccgtcagcagggatcccccagatatctgtatgtgtgccattattgccacgagggaaatgatccagagactaagaacgagccctacaagacaggggtcccatgcgaggcttgtccatccaattgcgaggataaactatgcactaacccctgtatctactacgatgagtattttgactgtgatatccaggtccactatctcgggtgtaatcacagcactaccattctcttttgcaaggcgacttgtctgtgcgatacagagattaagtag

SEQ ID NO: 113528 - DNA, 750 bp, Artificial Sequence
  Description of Artificial Sequence: Synthetic coding sequence
atggaaatcaaacacctgctcttcctggtcgcggcagcgtgcttgttgcctatgttaagtatgaaaaagaaaagtgcaagagatcagtttaacaaactggtcacagacctgcccaacgtccaagaagaaatagtgaacatccacaacgctctgaggaggcgcgtggttcctcccgcctctaatatgctcaaaatgtcttggtctgaggaggctgcacagaatgctaggattttctccaagtactgcgatatgaccgaatccaatcccctcgagcggaggctacctaataccttttgcggcgaaaatatgcacatgacatcctatccagtgtcctggtcctccgtgatcggcgtttggtactccgaaagtacctcttttaagcacggggaatggaccacaacagacgacgacatcactactgatcactacacgcaaatagtctgggccacgtcttatttgatcgggtgtgccattgcctcatgtcgacagcaaggcagcccgaggtacctctacgtatgtcactattgccacgaaggtaatgatcctgaaactaagaacgagccttataaaactggagtaccatgtgaagcctgtccctcgaattgcgaagataagctgtgtacaaatccctgtatctattacgatgagtatttcgactgcgacattcaggttcactacctgggttgtaaccacagcacaactatcctattctgcaaagcaacatgtctgtgcgataccgagataaaatag

SEQ ID NO: 113529 - DNA, 750 bp, Artificial Sequence
  Description of Artificial Sequence: Synthetic coding sequence
atggaaattaagcatctgctgtttctggttgccgccgcgtgcctactgccaatgctcagcatgaagaagaagtcagcacgcgaccagttcaataagctggtaacagatctacccaacgtccaggaagagatcgtcaacatccataatgcgttgaggcgtagggtggtacctccagcatcaaacatgcttaagatgtcctggtctgaagaggctgcacagaatgccaggatcttcagcaagtactgtgatatgacagaatctaacccattggagagaaggttgccaaatactttttgtggagaaaatatgcacatgaccagctacccagtgtcatggagcagcgtgatcggggtttggtactccgagagtacctcattcaaacatggcgaatggactaccactgacgatgatatcacaacagatcactatactcagattgtttgggcaacaagttacctgattggttgtgctatagcgtcctgtcgtcaacagggatctcctcggtacctgtatgtgtgccattactgccatgagggcaacgaccctgagacgaagaatgaaccttacaaaacaggcgttccttgtgaggcctgccccagtaactgcgaggataaactctgtaccaatccatgcatatactacgacgagtattttgactgcgatatccaggttcactacctaggttgtaaccacagcactactattttattttgcaaagccacctgtctgtgtgataccgaaattaaatag

SEQ ID NO: 113530 - DNA, 537 bp, Artificial Sequence
  Description of Artificial Sequence: Synthetic coding sequence
atggagataaagcatctcctttttctggtcgcagcagcatgtctgctgccgatgttaagcatgaagaagaaaagtgcccgcgaccagttcaataagctcgtgaccgaccttcctaacgtacaagaagaaatcgtcaacatccataacgctctgagacgcagggttgttccaccggcctctaatatgttgaaaatgtcctggtctgaggaagccgctcaaaatgctaggatcttctcgaagtactgcgatatgacagaatccaatccacttgagcggaggctgcccaataccttttgtggggagaatatgcacatgacgagctatcccgtttcctggagctcagtgattggagtgtggtactccgagtctacctcctttaaacatggggaatggacaactaccgatgacgatattaccacggatcattatactcagatcgtatgggccacctcatacctgattggctgcgcaattgcaagctgccgccagcagggctcacctcggtacctgtacgtttgtcattattgtcacgactag

SEQ ID NO: 113531 - DNA, 537 bp, Artificial Sequence
  Description of Artificial Sequence: Synthetic coding sequence
atggagataaaacacttgttgtttttagtggctgcagcatgtctgctgccaatgttgagcatgaagaagaagagtgcacgagaccagttcaacaaactagtgactgatctgcctaatgtacaagaggaaattgtgaacattcataatgccttgcgtagaagagtggtgccacccgctagcaatatgctcaaaatgagctggtctgaagaggccgcacagaacgctagaatcttttccaaatactgcgatatgacagaatctaatcccttagaaagaaggctgccaaacacattctgtggggaaaacatgcacatgacttcttaccccgtcagttggtcttctgtcatcggggtgtggtattccgaatccacctctttcaaacacggagaatggacaacaacggatgatgatatcacaaccgatcattatacacaaatcgtgtgggcaacttcctatttgatcggttgcgctatcgccagttgccgccaacagggctccccacggtacctgtacgtctgtcattattgtcacgactag

SEQ ID NO: 113532 - DNA, 669 bp, Artificial Sequence
  Description of Artificial Sequence: Synthetic coding sequence
atggcaggcaaaccaaaactccattacttcaacggaagaggacgcatggagcccatccggtggttgttagccgctgctggagtcgaattcgaggaaaagttcatcggaagcgccgaagacttaggtaagctcaggaatgatggctctttaatgtttcagcaggtgccaatggtggagattgatggcatgaagctggtgcagacccgggccattctaaattacatcgcctccaaatataacctgtatggaaaggatataaaagagcgtgcccttatcgacatgtacactgaggggatggctgacctgaacgaaatgatcctgttactgcctctgtgtcgtcccgaagaaaaggatgctaagatcgccttgatcaaagagaagacaaagtccagatattttccagctttcgaaaaggtgctgcagagtcatgggcaggattatcttgtggggaacaaactttctcgtgccgacatctcattggtggagctcctttattatgtggaggaactcgatagcagcctgattagcaacttccctctgctgaaagccctgaaaacccgcatctctaacctgccgacagtaaagaagttcctgcagcctgggagtcctcgaaagcctcccgcagacgcaaaggccctggaagaggctcgcaagatatttcgtttttag

SEQ ID NO: 113533 - DNA, 732 bp, Artificial Sequence
  Description of Artificial Sequence: Synthetic coding sequence
atggctctgctgcccgtcctgttcctcgtgacagttctcttaccatccctccccgctgaaggcaaagacccagcattcactgccctcctgaccacgcagcttcaggtgcaaagggaaatcgtgaataaacacaacgagttgcgaaaagctgtcagcccacccgctagtaacatgttgaagatggaatggtctcgagaagtgactactaatgcgcagaggtgggcaaacaaatgtaccctgcagcattctgaccccgaggatcggaaaacttccaccagatgcggagagaatttgtacatgagcagcgatccaacgtcatggagctccgcaatccaatcctggtacgatgaaatcctcgactttgtgtacggagtaggccccaagagccctaatgccgttgtgggtcactacacacagttagtctggtattctacctaccaggttggatgcggcatcgcatattgtcctaaccaggattcactgaagtactattatgtctgccagtattgtccagctggcaacaatatgaatagaaagaatacaccatatcagcaaggcaccccctgcgcaggctgcccggatgattgtgacaaaggcttgtgtaccaactcctgccaataccaggacctgctgagcaattgtgattccctaaaaaacaccgcgggctgtgagcatgaactgttaaaagagaagtgcaaggctacctgtctgtgcgagaataagatttattag

SEQ ID NO: 113534 - DNA, 1494 bp, Artificial Sequence
  Description of Artificial Sequence: Synthetic coding sequence
atgtcctgcgtcctggggggggttatccctcttggcctcctttttctggtctgtggaagccagggctacctcctcccaaacgtgactctcctcgaagaactgctgagcaaataccagcacaatgaatcgcattccagagtgcggcgcgcaatccccagggaagataaggaagagatccttatgttgcataacaagctcaggggacaggtgcagccccaggcctccaacatggaatacatgacttgggacgatgaattagagaagagcgcagcggcttgggcatcccagtgtatctgggagcacggacccacaagcctcctggtgagcattgggcagaatctgggagcccattggggaaggtaccggagccccggtttccatgtgcagagttggtatgacgaagtgaaggactacacttacccatatccttcggagtgtaatccatggtgtcccgagaggtgcagcgggcccatgtgcacccattacacgcagatcgtgtgggctacaaccaacaagataggctgtgccgtgaatacttgcaggaaaatgaccgtctggggggaggtgtgggagaacgctgtctatttcgtgtgcaactatagccccaaggggaactggatcggcgaagccccctacaagaatggccgcccttgcagtgaatgccctccatcctacgggggatcttgcagaaacaatctctgctacagagaagagacctatacccctaagccagaaacagatgaaatgaacgaagtcgagaccgcccctattcctgaagagaaccacgtgtggctccagcccagagtgatgcgccctacaaagccaaaaaaaacttccgccgtgaactacatgacccaagtggttaggtgcgatacaaaaatgaaggaccgctgtaagggctctacctgtaacaggtatcagtgccccgctggctgcctgaatcacaaagcgaagatatttgggacccttttctacgagtcctcaagttcgatctgcagggccgccattcattatggaatccttgacgacaaaggaggtctggttgacatcacaagaaacggaaaggtgcctttttttgttaagtcagagagacacggagtccaatctctgtctaaatacaagccctctagttcctttatggtgtcgaaggtgaaagtgcaggaccttgactgttataccaccgtggctcagctgtgtcccttcgaaaagcccgccacccactgcccaaggattcactgcccggcccattgcaaggatgagccaagttactgggccccagtgtttggtacgaatatctacgccgatacttccagcatatgcaaaactgcggtacatgcaggcgtgataagcaacgagtccgggggcgacgtcgacgtgatgcctgtcgataagaagaagacttacgtcggctctctgcgcaacggagttcagagtgaaagcttgggaactccgagggacggaaaagcattcagaatttttgccgtgaggcagtag

SEQ ID NO: 113535 - DNA, 1269 bp, Artificial Sequence
  Description of Artificial Sequence: Synthetic coding sequence
atggcaccctggcccccaaagggtttggtgccagcgatgctgtggggactgtccctctttctgaacttgccgggcccaatatggctgcaaccgtcaccaccaccccagtcaagcccacccccacagccccacccgtgtcacacttgtagaggcctcgtggatagcttcaacaagggccttgaaaggacaatcagggacaatttcggaggggggaatactgcctgggaggaggaaaacctgagcaagtataaagactctgagacgcggctggtggaggtcttggaaggcgtgtgctccaaaagcgatttcgaatgccatagactgttggagttaagcgaggagctggtcgagtcttggtggttccacaagcaacaagaggcgcccgacctctttcaatggctgtgttccgatagtctcaagctatgttgcccagccggtacatttggcccctcttgtcttccttgccctggcggtacagagaggccttgcggcggctacggccagtgtgagggcgagggcacgcgcgggggatctggccattgcgattgccaggctggctatggtggggaagcttgcgggcagtgcggcctgggatacttcgaggctgaacgtaacgcttctcatcttgtgtgtagcgcctgctttggcccatgtgcccgttgtagtggccccgaagaaagcaactgtcttcagtgcaagaagggatgggccctccatcatctcaagtgtgttgatatagatgaatgcggaacggagggtgcgaattgtggcgctgaccagttctgtgttaatacagaaggcagttacgaatgcagagattgtgcaaaggcatgtctcgggtgcatgggggcggggcccggccgatgtaaaaaatgctcgccaggttaccaacaggtggggtctaaatgcttggatgtggatgaatgcgaaaccgaggtgtgccccggagagaataagcaatgtgaaaacaccgagggaggctataggtgcatctgcgctgaaggctacaagcaaatggaaggaatctgtgtgaaggaacagatacccggagcattcccgatcctgacagacttgacgcccgagacaactcgccggtggaagctgggcagtcacccacactcgacatatgttaaaatgaaaatgcaaagggatgaagccacattcccaggcctgtatggcaagcaagtagctaaactgggcagccagtccaggcagtcagacagaggtacgaggctgatccattctcaacaggccagttctcagcggtag

SEQ ID NO: 113536 - DNA, 1263 bp, Artificial Sequence
  Description of Artificial Sequence: Synthetic coding sequence
atggccccgtggcctccaaaaggccttgtgcccgctatgttatggggcttgtccttgtttctcaacctgcctggaccaatatggcttcagcccagcccacccccacagagttctcctccaccacagccccacccttgtcacacgtgtaggggcctagtggattcttttaacaaggggcttgagcgcacaattagagacaattttggcggcggaaacaccgcgtgggaagaggaaaacctgagcaagtacaaagactctgagactcgcttagttgaagtgctggaaggagtctgcagtaaatcggattttgagtgtcacaggctgctagaactctctgaagaactggtcgagtcttggtggttccataaacagcaggaggcccctgatctgttccagtggctttgttctgactctcttaaattatgctgcccagccggaacttttggcccttcttgcttgccttgtcccggaggtaccgagcgtccatgcggggggtacggccaatgcgagggagaaggtacacgcgggggatctgggcattgtgattgtcaagccggatacgggggagaagcgtgcggtcagtgtgggcttggttactttgaggcagaaaggaatgcatcacacctggtctgttctgcatgctttggtccatgtgctagatgttcaggccccgaggagagcaattgccttcagtgcaagaaaggttgggccctccatcacttgaaatgcgtggacatcgatgaatgtggtaccgagggcgcaaattgcggcgccgatcagttttgcgttaatacagagggaagctacgagtgcagggactgcgctaaggcctgcctaggctgcatgggcgcgggaccaggacgttgtaaaaaatgttccccaggatatcagcaggtaggtagcaagtgtctggacgtcgatgaatgtgaaaccgaggtatgcccaggggaaaacaaacagtgtgagaacacagaaggcggctacaggtgtatatgcgctgagggctacaagcaaatggaagggatctgtgtcaaggaacaaatacccgagtccgctgggttcttcagcgaaatgaccgaggacgaacttgtggtgctgcagcaaatgttcttcgggatcatcatctgtgccctggccacgctagccgcaaagggggatctggtgtttaccgcgatctttattggagcagtggctgccatgactggctattggttatcagaacggtcagaccgggtgctggaaggatttatcaagggccgatag

SEQ ID NO: 113537 - DNA, 1263 bp, Artificial Sequence
  Description of Artificial Sequence: Synthetic coding sequence
atggcgccttggccccctaagggtctcgtcccagcaatgttatggggtctttccttattcctgaatttgccaggccctatttggctgcagcctagtccaccccctcagtcttccccaccgccccaaccacacccttgccacacatgtcgcggcttagttgattcctttaacaagggcctggaaaggacaatccgcgataacttcggcggcgggaatacagcctgggaagaagaaaacctgagcaaatataaggactccgagacaaggcttgtggaggtgctggagggcgtttgttccaaaagtgattttgagtgccaccgcttgctggagttgagcgaagaactggtcgaatcgtggtggtttcataagcagcaggaagctcccgatctctttcagtggctctgtagcgacagtctgaagctttgctgcccggccggaacctttggacccagctgtttgccatgccctgggggcacagaaagaccatgtggcggatacggccaatgcgaaggggaagggaccagaggggggtctggacattgcgattgtcaggctggctatggtggcgaggcctgcggacagtgtggactcgggtactttgaggcagagcgcaatgcaagccatctggtctgcagcgcctgcttcggaccatgtgcacggtgctcggggcccgaagaatcgaattgcctgcaatgcaagaaaggctgggcattgcaccatctgaaatgtgtggacatcgatgagtgtggcacggagggcgccaactgtggagcggaccagttttgcgtgaatacagagggaagttatgaatgccgagattgcgccaaagcgtgccttggttgcatgggcgctggacccgggcggtgtaagaagtgcagcccaggttaccagcaggtgggctctaaatgtctggatgtggacgaatgcgagaccgaagtgtgtcccggcgagaataagcagtgcgagaatacggaaggtgggtatcggtgcatttgcgctgagggttataaacaaatggagggcatttgtgttaaggagcagattcccgaatcagccggtttcttttcggaaatgacagaggacgagttggtcgtactacagcagatgttcttcgggattatcatttgtgccctggctacgctcgcggctaagggcgacttggtgttcacagcaattttcataggagcagttgctgcaatgactggttactggctgagtgagcgaagcgacagggtgcttgaaggttttataaagggacggtag

SEQ ID NO: 113538 - DNA, 1263 bp, Artificial Sequence
  Description of Artificial Sequence: Synthetic coding sequence
atggctccatggccgccaaaggggctggtaccggccatgctttggggactctctttatttttaaatcttcccggccccatttggctgcagccaagccccccacctcaatcttcacctccccctcagccgcatccgtgccacacctgcaggggcctcgtggacagtttcaataaggggttagaacgtaccatcagggacaacttcggcggcggcaacaccgcttgggaagaggagaacttgagcaaatacaaggacagcgagacccgcttggtggaagtcttggagggggtctgctccaagtccgactttgaatgtcaccgactgctagaactgtccgaggagctggttgagtcatggtggttccataaacagcaggaagctccagacctcttccagtggctgtgctccgatagtctcaagctgtgttgcccagcagggacctttggaccctcctgcttaccgtgccccggagggactgagaggccttgcggagggtacggtcagtgtgagggtgaagggacccgtggaggaagcggacactgcgactgtcaagcgggctatggaggcgaagcctgtggacagtgcggactgggttacttcgaagctgaacgaaacgcctctcacctggtttgcagcgcctgcttcggcccatgcgcacgctgttccggaccggaggagtccaattgcttacaatgcaaaaaaggatgggctctccatcacttgaaatgtgtggacattgacgagtgcggtacggaaggtgcaaattgtggagccgaccagttctgtgtgaacaccgagggaagttacgagtgcagggactgtgcaaaagcttgcctgggttgtatgggggctggtccaggtcgatgtaagaaatgttcaccaggttatcaacaagtcggatcaaaatgtctggatgttgatgagtgcgaaacagaggtctgtccaggggaaaataaacagtgtgaaaatactgaggggggatacagatgtatttgcgcagagggctataaacagatggagggaatttgtgtgaaagagcagataccggaatcagccggattttttagcgagatgactgaggacgagctagtcgtccttcagcaaatgttttttgggattattatttgcgctctggcaaccttggctgccaaaggagatcttgtgttcaccgccatctttattggagcggttgcagccatgacgggctactggctgtctgagcggtcagatagggtactggagggctttataaaagggcgttag

SEQ ID NO: 113539 - DNA, 1140 bp, Artificial Sequence
  Description of Artificial Sequence: Synthetic coding sequence
atgtcttctcgtatagctagggcccttgccctagttgtcacactcctgcacctgactaggctcgctctctccacttgccccgccgcttgtcactgtcctctggaggctcccaagtgcgccccaggagttggcctagtgagggatggatgcggctgctgcaaagtgtgtgccaaacagctcaatgaggactgcagtaaaacacagccatgcgatcataccaagggcctagaatgcaattttggcgcctccagcactgctttgaaaggtatctgcagggctcagagcgaaggccggccatgcgagtacaacagcaggatctaccaaaacggggagtcctttcagcccaactgtaaacatcaatgcacatgcatagatggcgctgtgggatgtattccactgtgtccacaggaactcagcctgcccaatcttgggtgccctaaccctagactggtcaaggtcactggacagtgttgcgaggagtgggtgtgtgacgaggattccataaaagatcctatggaagaccaggatggcctccttgggaaggagctgggattcgacgcatctgaggtggaactgacaagaaacaacgagctgattgccgttgggaagggaagctctctaaaacggctaccagttttcggcatggagccgagaattctgtacaaccctctgcaggggcagaagtgtattgtgcagactactagttggagccagtgttccaagacctgtggcaccggtataagtactcgcgtgacaaatgacaatccagaatgcaggctcgtgaaggagacccgaatctgtgaagtcaggccgtgtgggcaacctgtgtacagttcactgaagaaagggaagaagtgctctaagacaaaaaagtcccccgagccggttaggtttacttacgcgggatgtctctccgtgaagaaataccgaccaaagtactgtggctcttgcgtggacgggagatgttgtacccctcagctgacgcggtgcgaagacgccgtgcccttaaggcgctggggtgacatattccaggaacggcatgacgatcctgtgaaatgtaattacaattgccctcacgcaaacgaggccgcatttccattctacagactgtttaatgatattcacaaattcagggactag

SEQ ID NO: 113540 - DNA, 1146 bp, Artificial Sequence
  Description of Artificial Sequence: Synthetic coding sequence
atgagtagccgtatcgctagagctcttgccctagtcgtcactctcctgcacctcacaaggttggctctctcaacctgtccagccgcttgtcactgcccccttgaggcgccgaagtgcgctcccggagtagggctagtacgggatggttgcggttgctgcaaagtgtgcgccaagcagctgaacgaggattgcagcaaaacacagccttgcgatcacaccaagggcttagagtgtaatttcggtgcatcatctacagcgctgaagggtatttgccgggcccagagtgaaggtcggccctgtgagtacaactcaagaatatatcagaacggcgagtcgttccagccgaactgcaagcatcagtgtacctgcatagatggagcagtcggttgcatcccgctttgtccccaggaattgtcgctgcccaatctcggttgccccaacccgagactggtgaaggtcacaggccagtgttgtgaggaatgggtgtgcgacgaagattcaatcaaggacccaatggaggaccaggatggtcttctgggcaaggagttgggatttgacgcctctgaagttgaactcacaagaaataacgagctcatagcagtgggtaaaggctcctccttaaaacgactgcctgtattcggtatggagcctaggatcctgtacaaccccttgcaagggcagaaatgtatcgtgcaaacaaccagttggagtcagtgctcaaagacttgtggaacagggatcagcacgcgggtcaccaacgacaatcctgaatgcaggctggtcaaagagactagaatctgcgaggtgcggccctgcggccagcccgtgtacagttctttaaagaaagggaaaaaatgcagcaaaacaaaaaaaagccctgagcccgtgaggttcacctacgccggctgcttatcagttaaaaagtatagacccaaatattgcggtagctgtgtagacggccggtgctgcacgccccaacttacgaggacagtaaagatgcgctttcgctgtgaggatggcgaaaccttttcaaagaatgtgatgatgattcagtcttgtaagtgcaattacaactgcccccacgcaaatgaagccgcgtttcccttttaccgtttgttcaatgatatccacaagttcagggattag

SEQ ID NO: 113541 - DNA, 1074 bp, Artificial Sequence
  Description of Artificial Sequence: Synthetic coding sequence
atgtcctccaggatcgcgagggcattggccctggtcgtaacactcctgcatctgaccagactggcgcttagcacctgcggttgctgcaaggtttgtgcaaagcagttaaacgaggactgcagcaaaacccagccctgtgatcacacaaaaggacttgagtgcaatttcggagctagctcgaccgccctgaaaggaatttgtcgcgcccaaagcgaaggacgaccatgtgagtataattccaggatttaccagaacggggagtctttccagccgaattgcaagcaccagtgtacctgcattgacggagctgtgggctgcattccgctttgccctcaggaactgagtcttcccaatctgggatgccccaacccacggctcgtaaaggtcaccgggcagtgctgcgaggagtgggtgtgcgacgaggacagtattaaagacccgatggaggaccaagacggcttgctgggaaaggagctcggcttcgacgcttccgaagtggagcttacaagaaataacgagctcattgctgtcggtaaggggtcatcattgaagcggctgcccgttttcgggatggagccacgcatcctctataatcctctgcagggccagaagtgcatcgtccagactacttcatggagccagtgttccaaaacctgtgggacaggaatcagtacgcgcgtcacgaatgataatccagagtgtcggctagtgaaagagaccagaatttgcgaagtgaggccgtgtggacagcccgtgtatagtagtctgaagaaagggaagaagtgttctaagacaaagaaatctccagaacccgtaagattcacttatgccggctgcctatctgtgaagaaataccgccctaagtattgtggatcctgcgtggacggacggtgttgtacaccacagttaacgaggacagttaagatgcgtttccggtgcgaagatggcgagaccttttcaaagaacgtgatgatgattcagagttgcaagtgcaattacaactgccctcatgcaaacgaagctgcgtttcctttctaccggttgtttaatgatatccacaaattcagggattag

SEQ ID NO: 113542 - DNA, 1014 bp, Artificial Sequence
  Description of Artificial Sequence: Synthetic coding sequence
atggatgaaacaggaaatctgaccgtgtcatcggccacatgccacgacaccattgatgactttagaaaccaggtgtactctactctgtattctatgatcagtgtagtagggtttttcggaaacggattcgtgctgtatgttcttatcaagacataccacaaaaagagtgcattccaggtctacatgatcaatctcgcggtggccgatttattgtgtgtgtgtacactgccgctgcgtgttgtgtattacgttcataaagggatttggctgttcggtgatttcttatgcaggctgtctacgtacgccctttacgtcaatctgtattgctcaatcttcttcatgactgccatgtcctttttccgctgtatcgctatcgtatttccagtgcagaatatcaatctcgtaacccagaagaaggccagatttgtctgcgtgggaatctggatctttgtcatactcactagcagcccatttctcatggctaaaccgcaaaaggatgaaaagaacaacacaaaatgtttcgaacctccacaggacaatcaaacaaaaaaccacgtacttgtcttacattacgtgtctctgttcgttggttttattattcctttcgttattatcattgtatgttatacaatgatcattctaaccctgcttaagaaatcaatgaagaaaaatctgtccagtcataaaaaggccatcggcatgatcatggtggtaactgctgctttccttgtctcatttatgccttaccacatccaaagaactatccaccttcacttcttgcacaacgaaactaagccctgcgactctgtgttgagaatgcagaagtcagttgtcatcaccttgagcctagcagcaagcaattgttgcttcgacccgctcttgtacttcttttccggcggcaatttccgaaagcgcctgtctaccttccgaaagcattcactgtcctcagtcacatatgttcccaggaagaaggcgtcactccccgagaagggcgaggagatatgcaaagtttag

SEQ ID NO: 113543 - DNA, 1041 bp, Artificial Sequence
  Description of Artificial Sequence: Synthetic coding sequence
atggagagaaaattcatgtcattgcagccatcaatatctgtgagcgagatggagccaaacggaacttttagtaataataatagccgcaattgcaccatcgaaaattttaaacgcgagttcttcccaatcgtgtacctgataatatttttctggggggtgctgggcaatgggctgtctatctacgtctttctgcagccatacaagaaatccacctcggtgaatgtcttcatgctgaacctcgcaatatcagatctcctgttcatctcaacactcccttttagagcagattactatctgcgagggagtaactggattttcggggatctggcatgcaggatcatgagctactcactgtatgtgaatatgtattcttccatttattttctcaccgtgctttctgtcgttcggttcctggcaatggtacacccatttcgcctgcttcatgtgacttcaattcgttctgcctggatactgtgtggcatcatttggatcctgattatggccagttctatcatgctgcttgacagtggatcagaacagaatggtagcgtcaccagttgtctcgagcttaacctgtataagattgctaaacttcaaacaatgaactatattgcactggttgtgggttgcctcctgcccttttttacgctctcaatctgctacctcctgattattagggtgctgctcaaagtggaagttcccgagtccggactccgtgtctcacaccgaaaggccctgaccacaattataatcactttaattatttttttcctgtgctttctgccatatcatacacttagaacagtgcacctcacaacctggaaggttggcctgtgtaaagataggctccataaggcattggtcatcactctggctctcgcagccgccaatgcctgcttcaatcctctcctatattattttgcaggggaaaattttaaagaccgactcaagtcggctctgagaaaggggcatccacaaaaagctaaaactaagtgtgtgttcccagtttccgtgtggctccgtaaagaaacccgggtgtag

SEQ ID NO: 113544 - DNA, 2181 bp, Artificial Sequence
  Description of Artificial Sequence: Synthetic coding sequence
atggcagattccagtggacagcaggggaagggacggcgagtccagccccagtggtcacccccagccggcacccagccatgtagactacatctgtacaactctctgacacgtaataaggaagtcttcataccccaggacggaaaaaaggtcacctggtattgttgcggtcccactgtgtacgacgccagtcacatggggcatgcccggtcatacatttcattcgatattctgaggagagtgttgaaggattattttaaatttgacgtattttactgtatgaatataactgacatcgacgacaaaataataaaaagagcccgccagaaccatctctttgaacagtatagagaaaagcgacccgaagcagcacagctgttggaggatgtccaggcagcactcaagccattttcagtgaagctcaatgagaccaccgaccccgataaaaagcaaatgttggagagaattcaacacgcagtgcagcttgccactgagcctctcgagaaagctgtgcagtcgcgcctgacgggcgaagaggtgaatagctgtgttgaggtcctgctcgaggaggccaaggatctgctatcagattggttggactcaactctgggttgtgacgttacagacaacagtatattcagcaagctgcccaaattttgggaaggagattttcatcgggatatggaagctttgaatgtgttacctccagatgtgctgacccgtgtgtccgaatatgtgcccgaaattgtgaattttgtgcagaaaatagtcgataacggctatggttatgtgtctaacggtagcgtttatttcgacacagccaaattcgcttcttctgaaaagcactcctacgggaagctggtgcccgaggctgtgggagaccaaaaggccttacaggaaggcgagggagatttaagtatatctgccgacagactatcagagaagaggagccctaacgattttgccctttggaaagcctctaaaccgggtgaaccaagctggccctgtccctggggcaagggtagacccggatggcacattgagtgctccgccatggcaggtacgcttctgggagcctcaatggatattcatggtggcgggtttgacctgagatttcctcaccacgataacgagcttgcacagtctgaggcatacttcgagaatgattgctgggtccgatatttcttgcataccgggcacttaacaatagctggatgcaaaatgtctaagtcactgaagaattttatcaccatcaaggacgctttgaaaaaacactccgccaggcaactgcggctggcctttctgatgcacagctggaaagatacactggactactctagcaatactatggagtcggcattacagtacgagaaatttctgaatgaattcttcctgaacgtaaaggacattctaagagctcccgtggacattactggacagttcgaaaagtggggcgaggaagaagccgagctgaataaaaatttctacgataaaaagaccgctatccataaggcgctgtgtgacaacgtggacactaggactgtgatggaggagatgcgagccctcgtgagtcagtgcaatctctacatggccgctcgaaaggcggtacgcaagcgtcctaatcaggccttactagagaacatcgccctgtaccttacccacatgcttaaaatattcggggcggtcgaggaggattcatcactggggttcccagtgggcggccccggaacgagcctcagcctcgaggcaactgtcatgccctatctccaagtccttagtgagttccgcgaaggggtcagaaaaatagctagggagcagaaagtccctgaaatcctgcagcttagcgatgctcttagagacaacatcctgccagaattgggagtgagattcgaggatcacgagggacttcccaccgtcgtgaagctggtcgacagaaacactctgctgaaggaacgcgaggagaaacggagggttgaggaagagaagagaaagaagaaagaagaggccgcacggcgaaaacaagaacaagaggcagcaaaattggcaaagatgaagatccctccatctgaaatgttcctgtctgagaccgataagtacagtaaattcgacgagaacgtatcaatggtctgccctcatatgacatggagggccaaaagtagcgcgaaagggaagccccgcagttag

SEQ ID NO: 113545 - DNA, 2496 bp, Artificial Sequence
  Description of Artificial Sequence: Synthetic coding sequence
atggccgactccagtgggcagcaggctcccgactaccgtagtattctgagtatttcagacgaggcagctcgcgcacaggctcttaatgaacacttgtccacaagatcctatgtccaggggtattcgctctcacaggctgacgtggacgccttccgacagctttcagcacctccggctgaccctcagctctttcacgtggccagatggttccgccacattgaagccttgctgggatccccatgtggcaaggggcaaccgtgtagactccaggccagtaaaggaagaagggtccagccacagtggtcccctccagccgggacccagccttgtcgccttcatctctacaactccctaactcgtaacaaggaagtgtttattccccaagatggcaaaaaagttacttggtactgttgcgggcccacagtgtatgatgcgagccatatgggacatgctcggtcatacatcagcttcgacatcctgaggcgagtactgaaagattacttcaagttcgacgttttctactgcatgaatatcaccgacatcgatgacaagattataaagcgcgctaggcagaatcatcttttcgaacagtatagagagaagcggcccgaagccgcccagctcttggaagacgtgcaggcggccttgaagccatttagcgtcaagttaaacgaaaccacagaccccgataaaaaacagatgttggagaggatccagcatgccgtccaactggccactgaacctctggaaaaggcagtgcaaagccgtctaaccggagaggaggttaattcctgcgtggaggtgctgctcgaagaggcaaaggatctgctgagtgactggctagacagcaccctggggtgtgacgtcaccgacaatagcatcttttctaaactccccaagttctgggagggagactttcaccgagacatggaggctcttaatgtgttgcctccagatgtcctgaccagagtgagcgagtacgtgccggagatcgtgaacttcgtacaaaagatcgtggacaatggatacggatatgtatcgaacggcagtgtctattttgacacagcaaagttcgcaagctcggaaaagcacagctacggaaagttagtgccagaggccgtcggtgaccagaaggcactgcaggaaggcgaaggggacttatcaatatccgcagacaggctctcagagaagagatccccgaacgacttcgccctatggaaagcctccaagccaggggagccctcttggccctgcccctgggggaagggcaggccgggctggcatatagagtgctcagcgatggcggggactctgctcggcgcttctatggacatacatggtggcggctttgacctgcgctttccacatcacgacaacgaacttgcccagtccgaagcctactttgagaacgattgctgggttaggtatttcttacacaccggccacctcaccattgctggctgcaagatgtctaaatccctgaagaattttatcaccatcaaagatgcgctcaaaaagcatagcgccagacagttgagacttgccttcctgatgcattcatggaaagacaccctagattactcgtccaacactatggagagcgccctccagtacgaaaaatttctcaatgaatttttcctgaacgtgaaggacatactgcgcgcgcctgttgatattaccggtcagttcgagaagtggggtgaggaggaggcagaactgaataagaatttttatgataagaaaacagctattcacaaggctctttgtgacaatgtcgacactcggaccgtaatggaagagatgagggcactggtgtcccagtgtaatctttatatggccgctcggaaggcagtgaggaagaggcccaatcaggctctattagagaacatagccctctatctcactcacatgctcaaaatcttcggcgccgtcgaggaggacagtagtctgggcttccccgtgggcggccctggcacgtctttgtctctggaagctactgtgatgccttacctacaagtgctgtcggagtttcgcgagggcgtgaggaagatagccagagaacagaaggtaccggagatattgcagctttctgacgccctgcgagataacatccttccagaattgggggtgcgatttgaagatcacgaaggccttccaacagtagtgaagcttgttgaccgtaacacacttctgaaggaacgggaggaaaagaggcgggtcgaggaagagaagagaaagaagaaagaggaggccgcaaggcgaaagcaggagcaagaggccgccaagctggccaagatgaagatccccccctccgaaatgttcctaagtgagactgataaatattctaaatttgacgagaacgggctccccactcatgacatggaaggcaaagagcttagcaagggccaggcaaagaaactgaaaaaactgtttgaggcccaggagaaactgtataaggagtatctgcagatggctcagaatggctcctttcaatag

SEQ ID NO: 113546 - DNA, 2247 bp, Artificial Sequence
  Description of Artificial Sequence: Synthetic coding sequence
atggcagacagctccgggcaacaagggaaagggcgccgagtccagccacagtggagtcctcccgctggtacccagccatgccgcctccacctctacaactctcttaccaggaataaagaggtatttattccccaagatggcaagaaggtgacatggtattgctgcggacccactgtgtacgatgcaagccatatggggcacgctcgcagttatatcagtttcgatatcctgcgcagggtgctcaaggactattttaaatttgacgtcttctactgtatgaacattacagacatcgatgataagatcatcaaacgtgcccgacaaaaccatctgttcgaacaatatcgagagaagagaccggaagccgcccagctgctagaggatgttcaggcagcactgaaacccttctctgtcaagctcaatgaaacgactgacccagataaaaaacagatgcttgagcgaattcagcatgcagtacagttggctaccgaacccttagagaaagctgttcagagtcgcttaactggtgaggaggttaactcctgcgtggaggtgctcttggaagaggccaaagacttactgagcgattggctggactctacgctcggctgcgacgttactgataattccatattcagtaaactacccaaattttgggagggggatttccatagggacatggaggccctgaacgttcttccgccagatgtgctgactcgcgtgtctgaatacgtgcccgagattgttaactttgtacaaaagattgtagacaacggatacggatacgtgagtaacggctccgtctacttcgataccgccaaattcgcaagtagtgaaaaacattcctatggcaaactggtccccgaagcggtgggtgaccagaaggcactgcaagaaggagagggggacttatcaatcagtgctgatcgcctctcagaaaaacgctccccgaatgattttgcgttatggaaggcctccaagcctggcgaaccctcctggccttgtccatgggggaagggcagacccggatggcacatcgagtgcagcgcgatggcaggtacgctgttgggggcatctatggatattcacggcgggggcttcgacttgagatttccacaccatgacaatgaactagcacagtcagaggcctatttcgaaaatgactgttgggttagatactttctgcacaccggtcacttgacaatcgcagggtgcaagatgtccaaaagcctgaaaaatttcatcaccataaaggacgccctgaagaagcactctgctcggcagctgagactggctttcctcatgcactcctggaaggatactctcgattattcctcaaatacgatggagtctgcacttcagtatgagaaattcctcaacgaattcttcctcaacgtgaaggacatccttcgggctcccgtggacatcacaggccagtttgagaaatggggagaggaggaggctgaactcaacaagaatttttacgacaagaagaccgcaatacacaaggctctctgcgataacgtggacacacgcactgtaatggaggagatgcgggctttagtaagtcaatgtaacctttatatggccgcgagaaaggccgtacgaaaacgtcccaaccaagccttactggaaaacatcgctttatatctgactcatatgctaaagatattcggtgccgtggaggaagactcctcccttggatttccagtgggaggcccaggaaccagcctgagtctcgaagcaacagtgatgccatatctgcaggtgctgagtgaatttagagaaggagttagaaagatcgcccgtgaacaaaaggtgcccgaaattctacagctgtctgacgcactccgagataacattttaccagagctcggcgtgcgctttgaggaccatgagggtctccctaccgtcgtcaagctcgtcgacaggaacacactgctgaaagagagagaggagaaaagacgggtggaggaagaaaaaaggaaaaaaaaagaggaggccgctcgtaggaaacaagaacaggaggccgccaaactggccaagatgaaaatccctccctctgaaatgtttctttcagagacagacaaatattcaaaatttgacgagaatggcctgcctactcacgatatggaaggcaaagaactgagcaagggccaggcgaaaaagctgaagaagctgttcgaagcacaggaaaaactctacaaggagtacctccagatggctcagaatggcagctttcaatag

SEQ ID NO: 113547 - DNA, 2217 bp, Artificial Sequence
  Description of Artificial Sequence: Synthetic coding sequence
atgcagactccaccactgcagcagcctcatcaggagcaagtgttcttagcgtttctggttatagtcattccctcttttctgaccaaagaagtattcattccccaagacggcaagaaggtcacttggtactgttgcggtcctactgtctatgatgcctctcacatggggcatgcaagaagctatatatctttcgacatcctgagaagggtcctgaaagactactttaagtttgatgttttttactgtatgaatataactgatattgatgacaaaataattaagcgcgctcgtcagaatcacctctttgagcagtacagagaaaagagaccagaggcagcacagcttcttgaagacgtgcaggctgctctgaagccctttagcgtcaaactcaacgaaactacagatcctgataagaaacaaatgctcgaacgaatccaacacgcggttcagctggctacagagccgttggagaaagccgtccaatcccgtcttacaggcgaggaagtcaacagttgtgttgaggttttgttggaagaagccaaagatctgctcagcgactggctggactctactctcggatgtgacgtgacggacaacagcatattctctaagctgcctaagttctgggagggtgactttcacagggatatggaagcgctaaacgtcctacccccagacgtgcttacacgggtctccgagtacgttcccgagatagtgaattttgtacagaagatcgtcgataacgggtatgggtatgtgtctaatggtagtgtgtacttcgacaccgcaaaattcgcatcctcggaaaaacactcctatggcaagcttgtgcccgaagccgtgggggatcaaaaggcccttcaggaaggagagggtgacctcagtataagcgccgatcggcttagcgagaagcggtcccctaacgacttcgctctgtggaaggcgtccaagcctggcgaaccctcctggccatgtccttgggggaaggggcgacctggttggcacatcgaatgtagcgccatggcaggcaccctgttgggcgcttccatggatatccatggtgggggctttgatctcagatttcctcatcacgataatgaactggctcagagtgaggcatattttgagaacgactgctgggtaaggtactttctccatactggtcatttgacaatagccggctgtaaaatgagtaaatccttaaaaaactttatcactattaaagatgcattaaaaaaacatagcgctagacagttgcgattggcgtttcttatgcattcatggaaagataccctggattacagctctaacacaatggaatctgcactccagtacgaaaagttcctgaatgagtttttcttgaacgtgaaagacatcctgagggctccagtcgatattacaggacagttcgagaagtggggcgaagaagaagccgaactaaacaagaacttttacgataagaagacggctatccataaggcgctgtgcgacaacgtggatacaagaaccgtgatggaggaaatgcgagccttagtgagtcagtgcaacctgtatatggctgcacgaaaggcagtgcgcaaaaggcctaatcaggcgctccttgaaaatatcgcactttatctcacccatatgttaaagatttttggcgcggtggaggaagattccagcctcggcttcccagtgggagggcctggcacatcgctgtctctggaggccactgtaatgccatacctgcaagttttgagcgaatttcgggagggtgtgaggaaaattgctcgcgaacaaaaggttccagagatcctccaactctctgatgctcttcgtgacaatattctgccggagttgggtgtgcgatttgaagaccacgaaggccttcctacggtagtcaaactcgtggaccggaacacgctactgaaggagagggaagagaagaggagagtagaggaggagaagagaaaaaagaaggaagaagctgctagacgaaagcaagaacaggaagccgctaagctcgcaaagatgaagatcccaccttctgagatgtttctgagcgagaccgacaagtatagcaaatttgatgagaacggattaccaacacatgatatggagggtaaggaactatcaaaggggcaagctaaaaagttgaagaagctgtttgaggctcaggagaagctgtacaaagaatatctccagatggctcagaatgggtccttccaatag

SEQ ID NO: 113548 - DNA, 2220 bp, Artificial Sequence
  Description of Artificial Sequence: Synthetic coding sequence
atggaaccaaccagtggcccgtttaggacggacctcggctaccacctggtcggatgttcaagcggcaaaggaagaagagtgcagccacaatggtccccccctgcaggaacacagccatgcaggctccacctgtataactctttgacaaggaacaaggaagtgtttatccctcaggacggtaagaaagtgacatggtactgttgcggccctaccgtgtacgatgccagtcacatgggacatgcgcgaagctacatatcattcgatatcctgcgacgggtattgaaggactatttcaaatttgatgtgttttactgcatgaatataacagacatagacgacaaaatcatcaaacgcgcccggcagaatcatctgtttgagcagtacagggaaaagcggcccgaagctgctcagctgctcgaggacgtgcaggcggctctcaagcctttcagcgtgaaattaaacgagactactgacccagataagaagcagatgctggagaggattcagcacgctgttcaactggccacggagcccttagagaaagcggtgcagtctcggctaaccggtgaggaggtgaactcctgtgtggaagtgttgctggaagaggctaaagacctgctgtccgactggctagatagtacgttaggctgcgacgtgacggacaatagtatctttagcaagctgccaaaattttgggagggtgattttcacagggacatggaagccctgaatgttctccctccagacgtgctgaccagagtgtcagaatacgtgcccgagattgtcaatttcgtgcagaagattgtcgacaacggctatggatacgtatctaatggttccgtctacttcgacaccgccaaattcgcctcgagcgaaaaacatagctacggaaaactggtgccagaggctgtgggggatcagaaggcgctgcaagaaggagagggtgatctctccattagcgctgatcggttgtcggaaaaacggtcccctaatgacttcgccctgtggaaagcctcgaagccgggcgaaccgtcgtggccttgtccatgggggaagggtcgaccaggatggcacattgagtgctccgcaatggcaggcactctgctcggcgccagtatggacatccacggggggggtttcgacttgagattccctcatcatgacaacgagctggcccagtcggaagcctattttgaaaatgactgttgggtaaggtatttcttacacacgggacacctcactatcgccggttgcaaaatgtccaaaagcctgaaaaatttcatcaccatcaaggacgccttgaaaaaacacagcgcaagacagttgaggctcgcctttctgatgcatagttggaaggacacacttgactacagttccaatacgatggagagcgccctccagtatgagaagtttcttaatgaattttttctgaatgtgaaggacattctacgggctccagtcgatattacaggccaattcgagaaatggggtgaagaagaggccgaactcaataaaaatttctatgacaaaaagactgccatccacaaagccctttgtgataacgtcgatactcggacagtaatggaagaaatgcgagcattagtgagccagtgcaacctgtacatggctgcccggaaagctgtacgaaaacgtccgaaccaggctctgttagaaaacatcgctttatatcttacacacatgctgaagatcttcggagccgtggaagaggatagtagtctaggcttcccggtgggcggtccaggcaccagcctctcactggaggcaaccgtgatgccttacttgcaggtgctgtcagaattcagagagggggtgcgaaagatcgcgagagagcaaaaggtgcctgagattctgcagctgagtgatgcgttacgagacaacatcttacccgaattgggagttcgcttcgaggatcatgaagggttgcctaccgtggtgaaactcgtagaccgaaatactctattaaaggaacgcgaggaaaaaagaagggtcgaagaagagaagcgcaaaaagaaggaggaagctgcacgacggaaacaggagcaggaggctgctaagctggccaagatgaagatccccccttcagagatgtttctcagcgagacagacaaatactccaaatttgatgaaaacgtgagcatggtttgcccacacatgacctggcgcgcaaagtctagtgccaaagggaaacctcggtcgtag

SEQ ID NO: 113549 - DNA, 1695 bp, Artificial Sequence
  Description of Artificial Sequence: Synthetic coding sequence
atgctccgtactactaggggccctggcctgggtcccccacttctccaagcagcccttggactgggtagagctggatggcattggcctgccggaagagcagctagcgggggacgggggcgcgcatggttgcagcccactggaagggagactggggtgcaggtctacaacagtctcactggaaggaaggagcccctgatcgtagctcacgccgaagcagcaagctggtatagttgtggcccaactgtgtacgaccacgctcatctgggacatgcgtgttcttacgtaagattcgacatcattcgacgcattctcactaaggtgttcggctgttctatcgttatggtgatgggaatcactgatgtggacgataagataatcaaacgtgcaaatgagatgaacatctccccagcatctttggccagcctgtacgaggaggactttaagcaagatatggcagccctcaaggtcctgcctccaacagtttatctgcgggttacagaaaacattccccaaattatatcttttatcgagggcatcattgcgcgaggaaatgcttattctactgccaaaggcaatgtatacttcgacctcaaatcacggggagataagtacgggaaattggtaggggtggtccctggaccagtcggagaacctgccgattccgataagagacacgcttctgacttcgccctctggaaagctgctaagccacaggaagtgttttgggcatcaccctgggggcccggcagacctgggtggcacatcgaatgctctgctattgcctcgatggttttcggttctcagctggacattcacagcggagggattgaccttgcctttcctcaccacgagaacgagattgctcaatgcgaagtcttccatcagtgcgaacagtgggggaactactttctccatagcggccacctgcacgccaaggggaaagaggaaaagatgtcgaagagtctaaagaactatattactattaaggatttcttgaagacatttagtcccgatgtgttcagattcttctgtctcaggtctagttacagaagtgccattgactactcagatagtgcaatgctgcaggctcaacagctcctgttggggctgggtagctttcttgaagacgcgcgggcctatatgaagggtcaactggcctgcggatcggtgcgggaggcaatgctctgggaaagattaagctccaccaagcgagcagtgaaagctgctctggccgatgacttcgacacaccaagggtggttgacgctatcttggggctggcccaccacggtaatgggcagctcagggcgagtctgaaagagcccgaagggcctagatcaccagcagtcttcggtgccatcattagttattttgaacagttttttgagaccgtcggcatttctctggctaaccaacagtatgtgtccggagatggatcagaggccacattacatggtgtggtggacgagctcgtccggtttagacagaaggtacgacaatttgctctggctatgcctgaggccaccggcgatgctcggcgccagcagctacttgaaaggcaacctctcttggaggcatgtgatactttaaggcgcggcctgacagcccacggcatcaatattaaagatagaagctctaccacctcgacgtgggagttattagaccaaagaacgaaagaccagaagtctgccggttag

SEQ ID NO: 113550 - DNA, 549 bp, Artificial Sequence
  Description of Artificial Sequence: Synthetic coding sequence
atggtgttcggctcacaactggacatacactccggaggcattgacctcgcatttcctcaccatgagaacgagatagctcagtgtgaggtcttccatcaatgtgaacagtggggcaattatttcctacatagtgggcatctgcacgcaaaggggaaggaagagaagatgtccaagagcctcaaaaattatatcactattaaggactttctgaaaacatttagcccagatgttttcagattcttctgcctcaggtccagttaccgatccgcaatcgattattcagattccgctatgttgcaagcacagcagctgctgctggggttggggtcattcttggaggacgcccgagcctatatgaaagggcagctggcctgcggctccgtgagggaggcaatgctctgggagcggttgagctccacaaagcgggcagttaaggcagcactggcagacgacttcgataccccaagggtggtggatgccatacttggcctggcacaccacggaaacggacagttgcgcgcttccctgaagaagcctgggagcgcctag

SEQ ID NO: 113551 - DNA, 441 bp, Artificial Sequence
  Description of Artificial Sequence: Synthetic coding sequence
atggcccagaagcgacccgcctgcaccctgaagcccgaatgcgtccagcagctgctggtttgttcgcaggaggccaagaagagcgcatactgcccatactcccattttccagtgggggctgctctactcacccaggaaggacgaattttcaaaggctgtaacatagaaaacgcttgttatcccctgggcatctgtgccgaaaggactgcgatccagaaggccgtgagtgagggttacaaggacttccgtgcaatagctatcgcctccgacatgcaagatgattttatctctccttgcggcgcgtgccgccaggtgatgagggagttcggaaccaattggccagtctacatgaccaaacctgatggtacatatatcgtgatgaccgtgcaggagctcctgccctcaagctttggccccgaggacttgcaaaagacacaatag

SEQ ID NO: 113552 - DNA, 687 bp, Artificial Sequence
  Description of Artificial Sequence: Synthetic coding sequence
atgctgagccggtgtaggagtgggctcctccatgtcctggggctgtcttttcttttacagacacgcaggcccattctgttatgcagtccgcgcctgatgaagccactggtggtctttgtcctgggcggcccaggggcaggaaagggaacacagtgcgcccgcatcgtggaaaagtatggatatacccatctcagtgccggcgagctgctgagggatgagcgcaaaaatccagattctcagtatggcgaactgatcgagaagtacatcaaagaaggtaagattgtcccagtggagatcaccatttccctgctcaaaagggagatggaccagacgatggccgccaatgctcagaagaacaagttcttaatcgatggattccctaggaatcaagacaatctccagggatggaacaaaacgatggatggaaaggctgacgtgtcatttgtgctcttctttgattgtaataacgaaatctgtattgaacggtgtttagaaagagggaagtctagcggacgtagcgatgacaatcgtgaaagtctggaaaaaaggattcagacgtatctgcagtcaactaagcccataatagacctgtatgaagagatgggaaaggtgaaaaagatcgacgcctctaaatcggttgatgaggtgttcgatgaggttgtgcagatatttgataaggaggggtag

SEQ ID NO: 113553 - DNA, 540 bp, Artificial Sequence
  Description of Artificial Sequence: Synthetic coding sequence
atgttatcgcgttgcaggtccggtttgctgcacgtgctaggactgtcgtttctgctccagactaggagacctatcctgctgtgctctccacgactcatgaagcctctggtggtgttcgtattgggcggccccggcgccggtaaaggtacccagtgcgcccgtattgtggaggaaatggatcagaccatggcagcaaatgctcaaaaaaataagtttctaatagacggctttccaagaaatcaggataatcttcaaggatggaataaaactatggatggaaaggctgacgtcagctttgtgctattttttgactgcaataacgagatctgtattgaacgatgtctggagcgcggcaaatcatctgggcgaagcgacgataatagagagagcttggagaaaaggatccagacttatttgcagagcacaaagccaattatcgatttgtatgaggagatggggaaggtgaagaagattgacgcatccaaaagtgttgatgaggtgtttgacgaagtagtgcagatcttcgacaaagaggggtag

SEQ ID NO: 113554 - DNA, 1230 bp, Artificial Sequence
  Description of Artificial Sequence: Synthetic coding sequence
atggctttcgcacgccgtctcttaagaggaccacttagcggtcccctgttgggacggaggggtgtttgcgccggcgcaatggccccaccgaggcgttttgtgctcgaacttccagattgtacactcgcgcactttgctctcggggccgatgccccaggcgatgccgacgccccggatcctaggctagcggccttgctaggacccccagaaaggtcctacagcctctgcgtgccagtgactcccgatgcagggtgtggtgctcgcgtgcgtgccgcccgtctgcaccagaggctgttacatcagctacgccgggggccattccagagatgccagcttctccggctgctgtgctactgccctggtgggcaagctgggggcgctcagcaggggtttctgctgagggatcctttagacgaccctgacacgcgtcaggccctcctagagcttcttggtgcatgccaggaggcaccaagaccccatttaggcgagtttgaggcagaccctaggggccagttgtggcagcgtctgtgggaggtccaggacggaaggagactccaggtcggctgcgctcaagtggtccctgtgccagaaccccctctacatcctgtggtgccagatctaccatcgtccgtcgtgtttcctgatagggaggctgcgcgagccgtcctggaagaatgcacatcattcattcccgaggcccgagctgtcctggacctggtggatcaatgccctaagcagatccagaaagggaagtttcaggtggttgcaatcgagggacttgatgccaccggcaagaccaccgttacccagagcgtagccgatagcctgaaagcagtattactgaagtcccccccaagctgtatcggacagtggcgaaagattttcgatgatgagccgacgatcattagacgagccttctattccctgggcaattacatcgtggcaagtgaaatcgccaaagagtcagcaaagagtccggtcattgtggatcgttactggcacagtacagccacttacgcaattgcaacagaagtgtctggaggcctgcagcacctgccacccgctcaccaccccgtctatcagtggcccgaagacttgctcaagcccgaccttatcctgctgctgactgtctcgcctgaggaacgtctgcagagactgcaggggcgcgggatggaaaaaactagagaggaagcggagttggaagctaactcagtgttcaggcaaaagtag

SEQ ID NO: 113555 - DNA, 1350 bp, Artificial Sequence
  Description of Artificial Sequence: Synthetic coding sequence
atggcttttgccagaaggctgctaagaggtcccctgtccggccctctgctaggacgaaggggtgtctgcgcgggagctatggccccacccaggcgctttgtcctcgaacttccggattgcacactggcccactttgccttaggggctgatgcccccggagatgccgatgctccagaccctcggctcgctgccttgcttggaccacctgaaaggtcttactccctgtgtgtacctgtgactccagatgcgggttgtggggctagagtgcgcgctgcgaggctccatcagcgcttactgcatcaattacgtcgaggaccttttcagcgatgtcagctgctgcgcctgctgtgttactgtccagggggacaggccggaggtgcacagcaaggcttcctcctccgcgaccccctcgacgaccctgatactcggcaggcgctcctggagctgctgggtgcttgccaggaagccccccgcccccacctcggggaatttgaagccgatccccgggggcagctctggcaacgcctctgggaagtacaagatggccggcggctgcaggttgggtgtgcgcaagttgttcccgtacccgagccccctctgcaccccgtggtgcccgatctgcctagttctgtggtcttccccgatagagaagccgcccgggccgtgctggaggaatgtacttcttttattcccgaggcgcgcgccgtgctcgatctggtcgatcagtgcccaaagcaaattcagaagggtaaattccaggtggtggcaatagaggggctggatgccacgggtaaaaccaccgtgactcaatcagttgctgatagtttgaaggccgtcttgctcaagagcccaccatcgtgtataggacaatggcgaaagatttttgacgacgaacctacaatcatccgtcgggcattctattcgctgggaaactatatcgtcgcctccgagattgcaaaggagtctgccaaatcccctgtgatcgttgatcgctactggcattcgacggctacttacgctatagcaacagaagtctccggcgggttacagcatcttccccccgcacaccatccggtgtatcagtggcccgaggatctactaaaaccggatttaatccttctcctgacggtgtcgcctgaggaacgcctgcagagattgcaaggcagagggatggagaaaactcgcgaagaggctgaattagaggccaatagtgtgtttcgccagaaagtcgagatgtcgtaccaacgtatggagaaccctgggtgtcatgtagtggacgccagcccgtcccgggaaaaggtgttgcagacggtcctctcgttaattcaaaactctttctctgaaccatag

SEQ ID NO: 113556 - DNA, 1101 bp, Artificial Sequence
  Description of Artificial Sequence: Synthetic coding sequence
atggcctttgcaaggagactactgcggggccccctgtccggtcctctcctggggcggcggggggtgtgtgcaggcgctatggctcctccaagaaggttcgtactggagctccccgactgtactttagcccactttgctctgggtgcagatgctccaggcgacgctgacgcccccgatcctaggctggccgctctcctgggaccgccagaacgtagttatagtctatgtgtgccagtgactccagacgccggctgcggagctcgggtgagagccgcccggctgcaccagcgcctcctgcaccaactgaggcgcggccccttccaacgctgccagctgctgcggttattatgctactgcccaggcgggcaagccgggggggcccagcagggctttcttttgcgggacccactggatgaccctgatacaagacaggcactgctggagctgctgggggcctgtcaggaggcccctcgaccgcacctgggcgagtttgaagccgatcctcgaggtcagttgtggcagagactgtgggaggtccaggacggcaggagattgcaggttggctgcgctcaggtcgtacccgttccagagccccccctccaccccgtggtgccagacctaccctccagcgtagtttttccggatcgggaggcagcacgagcagtcttagaagagtgcacgagtttcatcccggaggcccgcgcagttctggatttggtggatcaatgccctaaacagatccagaaggggaagttccaggtggtggctattgaagggctggatgcaacaggtaaaacaaccgtaacccaatcagttgcagactccctgaaggccgtgctgttaaagtcccctccaagctgcattggacagtggcggaagatcttcgacgacgagcctacaattataagacgcgccttctactctcttggaaattacatcgtcgcaagtgaaatcgcaaaagagtctgctaagtctcctgttatagttgacaggtcccagctcggcggaactttatatcacccctctcttcacctgcttgggagtgaagtctgcgggaccggcattttagacagcagtcatagttcacagggcctagaatag

SEQ ID NO: 113557 - DNA, 813 bp, Artificial Sequence
  Description of Artificial Sequence: Synthetic coding sequence
atgggcaacacgagttcagagagggccgccttagaaaggcacggcggccacaagacaccccggagggattcctccggagggactaaggatggcgatcgcccaaagatactgatggattcccctgaggatgcggacctgttccatagcgaggagattaaggccccagagaaagaggaattcctggcgtggcaacatgacttggaagttaacgacaaggccccagcccaggccaggcctactgtgttccgctggacgggaggtggaaaggaggtgtatctaagtgggtccttcaataattggtctaagttaccgctgacacgaagtcataacaacttcgtcgccatattggatctgcctgaaggcgaacaccagtataaatttttcgtcgatggccagtggacccacgacccctctgaacccatagtcacctcccagctcgggaccgtgaataacatcattcaggttaagaagacagacttcgaggtcttcgacgcacttatggttgacagtcagaagtgcagcgacgtgtctgagctgtcctcttctcccccagggccttaccaccaggaaccttacgtctgtaaaccagaggagcgattccgggctccccccattctgcccccgcaccttctccaggtgatccttaataaggacacagggatttcctgcgaccctgcactgctgcccgagcccaaccacgttatgcttaatcacttatacgccctctctattaaggacggagtgatggttctgtcagccacgcaccggtacaaaaaaaagtatgttaccaccttactgtataagcccatttag

SEQ ID NO: 113558 - DNA, 588 bp, Artificial Sequence
  Description of Artificial Sequence: Synthetic coding sequence
atgggccagatagaatgggctatgtgggccaatgaacaggccctggcctccggtttaatactcatcactggcgggattgtggctactgccggccgattcacccaatggtatttcggcgcatactctattgtagcaggcgtttttgtatgcctgctcgaataccccagagggaagcgaaaaaagggaagcactatggagaggtggggccaaaagtatatgactgcagtcgtcaagcttttcggtcctttcactaggaactattatgtaagagcggtgcttcacctgctgttaagcgtgcctgctggctttctgttggctacaatcttgggcacagcttgtcttgccattgcatcaggcatctatctgctggctgcagttaggggtgaacagtggacccctatcgaaccaaaaccacgagagcggcctcagatcgggggtaccattaagcaacccccctcaaatcctcctcctaggccccctgccgaggcaaggaagaagccctccgaagaggaagcagcggtagccgccggcggccctccaggaggacctcaggtcaacccaattccagtaacagacgaagtcgtgtag

SEQ ID NO: 113559 - DNA, 1713 bp, Artificial Sequence
  Description of Artificial Sequence: Synthetic coding sequence
atgggcaactgggcggtaaatgaggggctgtctatttttgtaattctcgtatggctgggtctcaacgtgtttcttttcgtgtggtattaccgcgtttatgatatcccccctaaattcttctatacaaggaaactactcggaagtgccctcgccttagccagagcccctgccgcctgcctgaactttaactgcatgctcattttattgcctgtttgcagaaacctgttaagtttcctgcggggcagctcggcctgctgcagcacaagggtgcgtcggcaattggaccgcaatcttactttccataagatggtcgcctggatgattgccctccactctgctattcacacaatcgcccacctcttcaatgttgagtggtgtgtgaacgccagagtcaacaacagtgacccttattccgtggctctgtccgaattgggagacagacagaacgagtcatacttgaattttgcacgaaaacgaatcaagaatcctgaaggaggcctgtacctcgcggtgactctccttgcaggaattacaggggtggtgatcaccttatgtctgatcctcattatcacgtcttctaccaagaccattaggagatcttatttcgaagtgttctggtatactcatcatctttttgttatcttcttcatcggcctggcaatacacggtgcagaacgcatagtgcgggggcagaccgccgagtctttggccgttcacaatatcacagtgtgtgagcagaaaatctctgagtggggcaaaatcaaggaatgtccaattccacagttcgccggtaacccacccatgacctggaagtggatcgtcggacccatgtttctgtacctgtgtgaaaggcttgtgcgtttctggcggtcccagcagaaggtggtcataactaaagtggtgacccaccctttcaagacaatcgagctgcagatgaagaagaaaggcttcaagatggaggtcgggcagtatatctttgtgaaatgcccaaaggtgtctaaacttgagtggcatccgtttaccctgacctctgccccagaggaagatttctttagcatccacattaggatcgttggagattggacagaagggctgttcaatgcgtgcggatgtgacaagcaggaattccaggacgcatggaagctgccgaaaatcgccgttgacgggccgtttggtactgcgagtgaggacgtgttttcctatgaagtggtgatgcttgtaggggcaggcattggtgttacccctttcgcgagcatacttaaatcagtttggtataagtactgcaacaacgcgacaaacctgaaactcaaaaaaatttacttctattggttatgccgcgacacgcacgcttttgagtggtttgccgacctacttcagctgcttgagagccaaatgcaagaacggaataacgctgggttcctgagttataatatttatctcaccgggtgggatgaatctcaggcgaaccacttcgctgtgcaccatgatgaggaaaaggatgtcataactggacttaagcagaaaactctttacggccggcccaactgggataatgagtttaagaccattgcatcccagcaccccaacactcgcatcggtgttttcctctgcggtcccgaggctcttgcagagaccctcagcaaacagagcatcagcaactcggagtctgggcccagaggtgtccactttatttttaacaaagagaacttctag

SEQ ID NO: 113560 - DNA, 912 bp, Artificial Sequence
  Description of Artificial Sequence: Synthetic coding sequence
atgacttggaaatggattgtgggtcccatgtttctctatctgtgcgaacgcctggtccgcttttggcggtcccagcagaaggtggtgatcacaaaggttgttacccacccgtttaagactatcgaactgcagatgaaaaagaaagggttcaagatggaagtaggccagtatatcttcgtgaaatgtcccaaggtgtcaaaattagaatggcatccattcactttaacctctgcacccgaggaggactttttctctatacacatccgcatcgtgggagattggaccgaaggcttgttcaatgcgtgcggatgcgacaagcaggagtttcaggatgcctggaagttgcctaagatagcagtagatggcccgttcggaaccgccagcgaagatgtttttagctacgaggtggtgatgctggtgggagccggcatcggcgttacgccatttgcttctatcctaaagagtgtgtggtacaaatattgtaataacgcaactaacttgaagctgaaaaagatctacttttattggttgtgtcgagatacccacgctttcgagtggttcgccgacctgctgcagctgctggaatcccagatgcaggaacggaataacgcaggattcctgtcctacaatatctatctcaccgggtgggatgaatctcaagccaaccatttcgctgtgcatcacgacgaagagaaggacgtcattactggactgaaacagaaaaccctgtacggaagaccaaactgggataatgagttcaagaccattgcgagccagcacccaaatacccggattggagttttcctctgcggaccagaggcactggccgaaaccctgtccaagcagtctatctccaactctgagtcaggtccccggggggttcactttattttcaacaaagagaacttttag

SEQ ID NO: 113561 - DNA, 1617 bp, Artificial Sequence
  Description of Artificial Sequence: Synthetic coding sequence
atgggcaattgggcggtgaacgagggtctttccattttcgtcataagtgccttggctttggcgcgggcacccgctgcatgtctgaattttaactgtatgttgattctgttgcccgtgtgcaggaacctgctgagttttcttcgtggctcctccgcatgttgtagcacccgggtacggcgccaactggaccggaatcttacttttcataaaatggtggcctggatgatagccttgcatagcgccatccacaccatcgcccacctctttaacgtcgagtggtgcgtgaacgctcgtgtgaacaacagtgatccctactccgtcgctctttctgagttgggagacaggcagaatgaatcatatctgaacttcgcacgtaagcggatcaagaatcctgagggaggtctgtatctggctgtcaccctactcgctgggattacaggcgtggtaatcactctatgcctgatcctgatcatcactagctctaccaaaaccatccggcgctcatacttcgaagtattctggtatacccatcacctgttcgtcattttttttattggactcgcaattcacggcgccgaacgcatagttcggggccaaaccgcggaaagcctcgccgtccacaatataaccgtctgcgagcaaaagatttcagaatggggaaaaattaaggaatgtccaataccacagttcgccggaaacccccctatgacttggaagtggattgtcggacccatgttcttgtacctgtgcgagagactggtgcgattttggagatcacagcagaaggtcgtgatcactaaggtcgtgacccatccattcaaaactatcgagttgcaaatgaagaagaaaggtttcaagatggaggtgggacaatatatattcgtcaagtgccctaaggtgtctaaactcgaatggcacccttttaccttaacttccgctcccgaggaggacttcttctctatccacatcagaatagtaggagactggacagagggcctgtttaacgcatgtggctgtgacaagcaggagtttcaggatgcatggaagcttccaaagatagctgtcgacggtcctttcggtacagcctctgaagacgtttttagctatgaggtggtgatgctcgtgggggctggaatcggtgttacaccatttgcttcaatcctcaagtctgtgtggtacaagtactgcaataacgccacaaatctaaagctaaagaaaatttatttctattggctctgccgcgacacccacgccttcgaatggtttgccgacctgctccagcttctggaaagtcagatgcaggaacgaaataacgccgggtttctgtcatataacatttacctgactggatgggacgaaagtcaagctaatcatttcgccgtgcaccacgacgaggagaaagacgttataacaggcctcaagcagaagacgttatacgggaggccaaactgggacaacgaatttaagacgatcgccagccagcatcccaacacccgaatcggagtgtttctgtgcgggcccgaagccctggccgaaactttgtccaaacagagcatctctaattccgagtccggtccccggggggttcatttcatctttaacaaggagaacttttag

SEQ ID NO: 113562 - DNA, 714 bp, Artificial Sequence
  Description of Artificial Sequence: Synthetic coding sequence
atgaattctcggcggcgggaaccaattaccttgcaggaccctgaggccaaataccctctgccactcatcgagaaagaaaaaattagtcataatacaagacggtttcgcttcggtctaccctctccagatcatgtgctcggcttgccagtcgggaattatgttcagctcctcgccaagattgataatgaactcgtagttagagcttacacccctgttagttctgacgacgatcgcggtttcgtggacctgatcatcaagatttactttaaaaacgtgcatccacagtaccccgagggcggcaagatgacacagtatttggagaacatgaagattggcgagacaattttcttccgcggacccagaggacggctcttttaccatggccctggtaatttaggaataagaccggaccagaccagcgagcccaagaagacgttagccgaccaccttgggatgattgcaggcggcactggaatcacaccaatgttgcagctgatccggcacatcactaaggatcccagtgataggacccgcatgagtctgattttcgcaaaccaaaccgaagaggacatcctcgtgcgcaaggaactggaggaaattgcaaggacacaccccgaccagtttaatctctggtacaccctggatcggcctcctattgggccatggtcggctgagggtgccacccttttgtccaattcagcgcaatttcattag

SEQ ID NO: 113563 - DNA, 831 bp, Artificial Sequence
  Description of Artificial Sequence: Synthetic coding sequence
atgaatagcaggagaagagaaccgatcactctgcaagatcccgaggccaaatacccgctgccattgattgagaaagaaaaaatctcacacaacacacgccggttccgtttcggcctgcccagcccagaccatgtccttggcttaccggttggaaattacgtgcagctgctggctaaaattgataacgaattggtggtccgggcttatacccccgtgtcctccgatgacgaccggggctttgttgatctaatcattaaaatttacttcaaaaatgttcacccccagtatcctgaaggaggtaaaatgacccagtacctggaaaacatgaagattggggaaacgatcttttttcgggggcccagagggagactcttttaccacggtcctgggaatctgggcattaggccagaccagacctctgagccaaagaaaaccttagccgatcacttaggcatgattgcaggtgggactggtattacacccatgctccaactcatcaggcatataacaaaagatcctagcgatagaacacggatgtccttgatcttcgctaaccagactgaagaagacatccttgtccggaaagagctggaggagatcgctagaacacatcctgatcagttcaacttgtggtatacactcgaccgcccccctattggctggaaatattcctccggcttcgtgactgccgatatgatcaaagagcaccttccacctcccgccaaatcgactctcatcctcgtgtgtggaccacctcccctgatccaaacagcagcccatcccaacctggagaaacttggctacactcaggatatgatctttacgtattag

SEQ ID NO: 113564 - DNA, 351 bp, Artificial Sequence
  Description of Artificial Sequence: Synthetic coding sequence
atgaactcgaggcgacgggagcccatcacactgcaagaccctgaggcaaagtacccattgcctctcattgagaaagagaagatctcccataatacaaggaggtttaggttcggcttaccctcgccggatcacgtcctgggcctacccgtcggcaactatgttcagttgctggccaagattgataacgagctggtagtccgggcgtatacacctgtgtccagcgacgacgacaggggattcgtagatttgatcattaaaatctactttaagaacgtgcacccccaataccctgagggcggcaagatgacacagtatctggagaatatgaagataggcgagaccatcttctag

SEQ ID NO: 113565 - DNA, 714 bp, Artificial Sequence
  Description of Artificial Sequence: Synthetic coding sequence
atgaacagtaggcgcagagagcctataacgctccaggacccggaagcgaagtatcctctccccctgatcgagaaggaaaaaatctctcataacaccagacgctttcggtttggcctgccatctccagatcatgttctggggctcccggtagggaactacgttcaactgctcgcaaagattgacaacgagcttgttgtcagagcatacacaccagtctcgagcgatgatgacaggggttttgttgacctgattattaaaatctactttaagaacgtgcatccacagtatccagagggtggcaagatgacacaatatctcgaaaacatgaaaatcggcgagaccatcttttttcgcggccccaggggcaggctcttttatcacggcccagggaacctggggattcgcccagaccaaacatctgagcccaagaagaccttagcagatcatctgggaatgatcgctggtggaaccggcattacacctatgctgcaactcatccggcatattaccaaggatccatccgaccgcactaggatgagtctgatctttgccaatcagacggaggaagatatcctggtgcggaaggagctggaagaaatcgcccggacacatcccgaccagtttaacctctggtacaccctggacagaccgcctatcggaccatggagcgccgaaggggccacgctgctctctaactctgctcagtttcattag

SEQ ID NO: 113566 - DNA, 441 bp, Artificial Sequence
  Description of Artificial Sequence: Synthetic coding sequence
atgaattctaggcggcgagaaccaatcacgctccaggacccagaggctaagtacccgctccctcttattgagaaggagaagatttctcataacacacgccggtttcgatttggccttcccagccccgaccacgttctcggactgccggttggcaactacgtgcaactcttagccaagatcgacaacgaattggtcgtgcgagcctatactccggtgtcctcagatgatgatcgggggttcgtagacctaatcatcaagatatacttcaagaacgtgcacccccagtaccctgagggcggcaaaatgacgcagtacctggagaacatgaaaataggagaaaccatcttttttaggggtccgcgaggccgcctgttctatcatgggcctggcaatttaggtattagaccggaccagacttcggagccaaagaaaacactgtag

SEQ ID NO: 113567 - DNA, 516 bp, Artificial Sequence
  Description of Artificial Sequence: Synthetic coding sequence
atgaattccaggaggcgcgagccaatcaccctgcaggacccagaggctaaataccctcttcccttaatcgagaaagagaaaattagtcataacactcgtagattcaggtttggcctgccttccccggaccatgtactgggcctgccagtgggcaattacgtgcaactgcttgcgaagatagataacgagcttgtcgtgagagcctatacacccgtatcatctgatgacgacaggggctttgtggatctcatcatcaagatctacttcaaaaacgtgcacccacagtaccccgaaggcggcaagatgacccagtacttggagaatatgaagatcggggagacgatattctttagagggccccggggtaggttattttaccacggacctgggaacctgggaatcagacctgatcagacatccgaacctaagaaaacgctggctgaccacttggggatgattgccgggggaaccggcatcacacccatgctgcagctcatccggcatataacgaaatag

SEQ ID NO: 113568 - DNA, 831 bp, Artificial Sequence
  Description of Artificial Sequence: Synthetic coding sequence
atgaacagccggcgtagagagcctatcactctgcaagatccagaggccaaatatccactacccctgatcgaaaaggagaaaatatcccataacacaaggcggttcaggttcggtctgccaagtcctgaccatgttcttgggctgcctgtcgggaattatgtgcagttgcttgctaaaattgataatgaactggtggtccgcgcttacactccagtatcctctgatgacgaccggggatttgtggatcttatcattaagatatattttaaaaatgtccacccccagtatccagagggcgggaagatgacccaatacctcgaaaatatgaagatcggggagaccatattctttagaggccctcgcgggcgacttttctatcatggacctggcaatctgggcatccgacctgaccagacctctgaaccgaagaagactctggccgaccatctgggtatgatcgctggcggaactggcattaccccaatgttacagctaataagacatattacaaaagatccctcagatcgtacgcggatgtcactgatcttcgctaatcagacagaggaggacattctcgtccgcaaagagctggaggagatcgccaggactcacccagatcagttcaacctgtggtacaccctggataggcctcccattggttggaaatactcctcgggattcgtaaccgccgatatgattaaggagcacttaccacctcccgccaagtctacgctgattctggtctgtgggccccctcctttaattcagaccgcagcacatcccaatctggaaaaactgggctacacacaggatatgatcttcacttactag

SEQ ID NO: 113569 - DNA, 906 bp, Artificial Sequence
  Description of Artificial Sequence: Synthetic coding sequence
atgggggcccagttaagcactcttggacacatggtcctgttccctgtatggtttctctattctcttctaatgaagctttttcagagaagcactcccgccatcacactggagagtcctgatattaagtatcccctgaggctaattgatcgagagatcatctctcacgacacccggcggttcaggttcgccctcccctccccccagcatatactgggtttaccagtgggacagcacatatacctgtcagcacggatcgatggcaatcttgtggtgagaccctatacgccaattagtagcgatgacgataagggattcgtggacttggtcattaaagtctattttaaggacacacacccaaagttcccagctggaggcaagatgagccagtatctggaaagcatgcagattggtgatacaatcgagttccgcggtccatcagggcttctggtatatcaaggcaaaggaaagtttgccataaggccagataagaaaagtaatcctataatccgtaccgtgaagtccgtcggcatgatcgcaggggggactggcattacaccgatgcttcaggtaattcgagccatcatgaaggaccctgatgatcatactgtttgccacttactgtttgcgaatcaaaccgagaaggatattctgctccggccggaacttgaagagctgcgcaataagcattccgccagattcaagctttggtatacattggatcgggcacccgaggcctgggattacggtcagggattcgtgaatgaggagatgatcagagatcacctgcctcctcctgaggaagagcctttggtgttgatgtgcggccctccgcccatgatacagtacgcatgccttcctaacctggaccatgtaggtcaccctaccgaaagatgcttcgtgttttag

SEQ ID NO: 113570 - DNA, 1005 bp, Artificial Sequence
  Description of Artificial Sequence: Synthetic coding sequence
atgaacagatccctccttgtaggatgcatgcagagcaaagacatctggggcagggaggagtctatctgtgagaggctgaaacaggacgggctggacgtggaacgagccgaatcctgggagcttggacatatggtgctctttccggtgtggttcctgtatagtctcctgatgaagctgttccagcggtcaacacccgctatcaccttggagagcccagacatcaagtaccctttacgactcatcgatcgggagataatcagccacgacacccggcggttccggttcgccctgccctcaccacagcacatcctgggcctgccggttgggcagcatatctatctgagtgcccgcatcgacggtaatctggttgtgcgtccatataccccaatttcatccgacgacgataagggcttcgtggacctcgttataaaggtatattttaaggacactcacccaaagtttcccgcaggcggaaaaatgagccaatatctcgaaagcatgcagatcggtgacacaatcgaatttcgtggacctagcgggctgctcgtctatcagggaaagggcaaattcgctatcagaccagacaaaaaatcaaacccaatcatccggaccgtgaagtccgtcggcatgatagcaggtggcacaggcatcactccaatgctgcaggtgatcagagctatcatgaaggaccctgacgaccataccgtgtgtcacctgttgttcgctaatcaaacagaaaaagatatcctcttgcgtcctgagcttgaagaactgcgaaataagcacagcgcacgatttaagctctggtacacactagaccgggctcccgaagcctgggattatgggcagggcttcgtaaacgaggagatgattcgagatcacctcccaccgccagaggaggagccgctggtactgatgtgcggaccgccgccaatgattcagtatgcatgcctgcctaacctggaccacgtcgggcaccctacagagaggtgttttgtattctag

SEQ ID NO: 113571 - DNA, 837 bp, Artificial Sequence
  Description of Artificial Sequence: Synthetic coding sequence
atgaaactttttcagcggtctacacccgcaataaccttggaatccccagacattaagtatcctttaagactcatagatcgggaaataatctcccacgatacaaggaggttcagatttgctctgccatctcctcagcacattctgggcttacccgtgggtcagcacatctacctctctgccaggatcgatggtaacctggtcgttagaccttataccccaatatcaagcgacgatgacaaaggattcgtggatctggtgataaaagtgtacttcaaagacacgcatcctaaattccccgccggcggaaaaatgagccagtatcttgaatccatgcagataggagacacaattgagttcagagggccatctggcctgcttgtgtaccagggtaaagggaagttcgccattcggccagacaagaaatctaacccgataatccgcaccgtcaagagtgtaggtatgatcgccggggggacgggcattacacccatgcttcaagtgatcagagccattatgaaggatcccgacgaccatactgtgtgccatcttctcttcgctaatcaaaccgagaaggacatcctgctccgccccgaactggaagagttaaggaacaagcattctgctcggttcaagttgtggtacacattggaccgggctcccgaagcctgggattatgggcaggggtttgtgaatgaggaaatgattcgagaccatctgcctccaccggaggaggaacctttagtcctgatgtgcggcccacctcctatgatccaatatgcctgtttgccaaatctggatcatgtagggcatccaaccgaaagatgtttcgtcttttag

SEQ ID NO: 113572 - DNA, 837 bp, Artificial Sequence
  Description of Artificial Sequence: Synthetic coding sequence
atgaaactcttccagagaagcacgccagcaatcacgctggagagtcctgatatcaagtaccccttacgccttattgatagggaaataatttcccacgacacccgacgcttcagattcgccctccccagcccacaacacatcctcggcctcccggtaggacagcacatctacctgtctgccaggatagatggaaacttagtggttcggccctacactcccatctcctctgatgatgacaagggctttgtagaccttgtgatcaaagtatacttcaaggacacgcatccaaaatttcccgccggcggtaagatgtcacaatacctcgagagcatgcagattggggacacaattgaattccgaggtcccagtggattattggtataccagggcaaagggaaattcgccataaggccggacaaaaagtccaatcccattatcaggactgtgaagtccgtaggaatgattgcaggcggcactggcatcaccccaatgttacaggttattcgagccataatgaaggatccagacgaccacactgtgtgccatctcctgttcgcaaatcagaccgagaaagacatactcctgcgtcccgaactcgaagaactgcgtaacaagcacagcgcccgttttaaactgtggtacacacttgaccgggctcctgaggcttgggactatggccaggggtttgtgaatgaagagatgattagggaccatctccccccgcctgaggaagagcccctggtgctcatgtgcggtccaccccctatgatacagtatgcctgcctgcctaatcttgaccatgtaggccacccaactgagcgctgcttcgtcttttag

SEQ ID NO: 113573 - DNA, 837 bp, Artificial Sequence
  Description of Artificial Sequence: Synthetic coding sequence
atgaaactcttccagaggtctacaccagcgatcaccctagaatcaccagatataaagtatccactgagactgattgaccgggagataatctcccacgacacccggagattccgttttgccctgcctagccctcagcacatactgggcctgccagtcgggcaacatatttatctgagtgcgagaatagatggcaacctggtggtgcggccttacaccccgatctcatcagatgacgataaaggcttcgtggatcttgtcattaaggtttattttaaggacactcacccgaagttcccggctggaggcaaaatgtcacagtacctagagtcaatgcaaattggggacaccatcgaattccgagggccatccggattactggtctatcagggcaaggggaaattcgcgatccgacccgacaaaaaatctaatccaattatacggaccgttaagtcagtgggtatgattgctggcgggacagggattaccccaatgctccaggtcatcagggctattatgaaggatccagatgaccacactgtctgccacctactgtttgccaatcagacagagaaggatatccttctgcggcccgagctggaagagctgcgaaataagcacagcgcacggttcaaactttggtataccttggatagggctcccgaagcttgggactacggacagggatttgtgaacgaggagatgatccgagatcatctcccaccgcccgaggaggagcctcttgtgctgatgtgtggtcctcctcccatgattcaatacgcttgcctccccaacctcgaccacgttggtcatccaaccgaaaggtgctttgtgttttag

SEQ ID NO: 113574 - DNA, 837 bp, Artificial Sequence
  Description of Artificial Sequence: Synthetic coding sequence
atgaagctgtttcagcgctccactccagccattacactggaaagccccgatatcaagtacccattgagacttattgaccgggagataatctcacacgacacacggcggttcagatttgccctcccgtcaccacagcacattttggggttacctgtagggcaacatatctatctctcagcaagaattgacggaaacttagtggtacgcccctatacccccatcagtagtgacgacgacaaaggattcgttgatctcgtcatcaaggtctacttcaaggacacacaccctaaatttcccgccggcggcaaaatgtcgcagtacttggaatccatgcagatcggagataccatcgagttcagaggtccaagcggactgctggtctaccaaggtaagggtaaattcgcaattcgccccgacaaaaaatcaaatccaattatcaggacagtgaagtcagtggggatgatcgccggcggaaccggcataacccctatgttgcaggttatacgcgctatcatgaaagacccagatgaccatacagtttgtcatctgctctttgctaaccagactgaaaaagacatcctgttacgcccagaactggaggaactgaggaacaagcattcagcccggttcaagctatggtacacactggaccgcgcacccgaggcctgggattatggacaggggtttgtcaatgaggagatgattcgggatcatctgccaccgccagaagaggaacccttggtactgatgtgcggacccccccccatgattcagtacgcctgtctgcctaatctggatcacgttggccacccaacggaacggtgcttcgtcttctag

SEQ ID NO: 113575 - DNA, 444 bp, Artificial Sequence
  Description of Artificial Sequence: Synthetic coding sequence
atgaaactctttcagagatccacccccgccatcactttggagagcccggacattaagtaccccctgcgactgattgacagagagataatcagtcacgacacgaggcgatttcgtttcgccttaccgtcaccgcagcacatcctgggcctgccagtgggccagcatatttatctgtcagccagaatagatggaaacctggtggtccgtccttatacacccatctcgagcgatgacgacaaaggattcgtggacctggtgataaaggtctactttaaggatacgcacccaaaattccctgccggcggcaagatgagccagtacctcgaatcaatgcagattggagacacaatagaattcagggggccctctggattgctggtgtatcaggggaagggcaagtttgccataagacctgataagaagtccaaccccataatacgatag

SEQ ID NO: 113576 - DNA, 330 bp, Artificial Sequence
  Description of Artificial Sequence: Synthetic coding sequence
atggattggatcagactgaccaagtcgggcaaggatctaacgggcctcaaggggcggctaattgaagtcactgaggaggagcttaagaagcacaacaagaaggatgactgctggatatgcatcagggggttcgtgtacaatgtgtccccctatatggagtaccatcccggaggtgaagatgaacttatgcgggcagccgggagcgacggcaccgaactgtttgatcaggtccacagatgggtcaactatgaatctatgttaaaggagtgtctagtggggcgtatggctattaagcccgctgtgctgaaaggcaagctgtggcacctgtag

SEQ ID NO: 113577 - DNA, 1566 bp, Artificial Sequence
  Description of Artificial Sequence: Synthetic coding sequence
atgctcaacgtaccctcgcagtcttttcctgcaccccgctctcagcaacgggtggcctctggtggacggtccaaagtcccattgaagcaggggcgctccctgatggactggatccgcctgactaagagtggaaaggacctaactgggctgaaaggccggttgatagaagtaacggaagaagaactaaagaaacacaacaaaaaagacgattgttggatttgtattcggggattcgtgtataacgtcagtccctatatggaataccaccccgggggcgaggatgagcttatgcgtgccgccgggagcgacggtacagagttgttcgatcaggtccaccgttgggtgaattatgagtcgatgctgaaggagtgcctggtggggagaatggctatcaaacctgccgtattgaaagattacagggaagaggaaaagaaggtcctcaacgggatgcttccaaaaagtcaggtgaccgatacattagccaaagaaggaccatcgtatccatcttacgattggttccaaactgattctcttgtcacgattgcaatttatacaaagcagaaggacataaatttagacagcatcattgtggatcatcagaatgacagttttcgcgcagagacaatcatcaaggactgtctttacctgattcacataggtctctcgcacgaggtacaggaggacttctccgtccgtgtggttgaatctgtggggaaaatcgagattgtgctccaaaaaaaagagaacacctcctgggatttcttgggccaccctctgaaaaatcacaattccctgatcccgcgcaaagacacaggcctctattaccggaagtgccagttaatatcaaaagaggatgttactcacgacaccagactgttctgtttaatgctgcccccatcaacgcatttacaggtgccgatcggacagcatgtgtacttaaaactgcccattacaggcaccgagattgtaaagccttacactccggtctccggatcgttgttgtccgaatttaaggagcccgtgttacccaacaacaaatatatttacttcctgatcaaaatttaccctactggcctctttacacccgagctcgatcgcctccagattggggacttcgtttccgtgagctcgccggagggaaattttaagatttcaaagtttcaggagctggaagatctgtttctcctcgcggctggaacgggtttcacgcctatggtgaagattctgaattatgccctgaccgacattccttctctaaggaaggtgaaactgatgtttttcaataagacagaggacgacatcatttggagatcgcaactcgagaagctcgccttcaaggataagagactagacgtggaatttgtactaagcgcccccatctctgagtggaacggtaagcagggacacatttctccggccctcctgtcagaatttctcaagcgtaatctcgataaatccaaagtcctcgtctgcatctgtgggccagttccatttaccgaacagggggtcagactgctgcacgacctgaactttagcaagaacgagattcattcgttcactgcgtag

SEQ ID NO: 113578 - DNA, 297 bp, Artificial Sequence
  Description of Artificial Sequence: Synthetic coding sequence
atggccgaacagagcgacgaagctgttaaatactacacccttgaggagatccaaaagcacaatcatagtaaaagcacatggctgattttgcatcacaaggtgtacgatttaacgaagttcttagaggagcatccagggggagaagaggtgctcagggagcaggccggcggggatgctaccgagaacttcgaagatgtcggccactccacagacgctcgagaaatgtccaagacctttatcatcggcgagctgcatcccgacgatcggcccaaactcaataagccccccaagccatag

SEQ ID NO: 113579 - DNA, 405 bp, Artificial Sequence
  Description of Artificial Sequence: Synthetic coding sequence
atggcagaacagtcagatgaggccgtgaaatattacactctagaagaaatacagaaacataatcattccaaaagcacctggctaattctccaccacaaggtgtacgatctgacaaaattcctggaggagcaccctggtggagaagaggtgctcagagaacaggctggtggggacgcgacagagaatttcgaagacgtggggcattcgaccgacgcaagggaaatgagcaaaactttcatcataggcgagctgcatcctgatgatcgtcccaaactcaataagccccctgaaacccttattaccaccatcgactccagctcctcatggtggaccaattgggtgatccctgcaattagcgccgttgccgtggcactgatgtacagactgtacatggcggaggattag

SEQ ID NO: 113580 - DNA, 375 bp, Artificial Sequence
  Description of Artificial Sequence: Synthetic coding sequence
atggccgagcagagcgacgaagctgtcaaatattatactcttgaagagattcagaagcacaatcactctaaatctacatggctgattctgcaccataaagtatatgacttgacaaagtttctcgaggaacatcccggaggcgaggaagtcctgcgggaacaggctggtggtgatgctaccgagaattttgaagacgtgggccactcaacggatgcacgcgaaatgtctaagacctttattatcggagagctgcaccccgagacactcatcactacaattgacagctcctcctcttggtggaccaattgggtcatacctgccatctcagcagtggccgtggcgctgatgtatagactgtatatggcagaggactag

SEQ ID NO: 113581 - DNA, 297 bp, Artificial Sequence
  Description of Artificial Sequence: Synthetic coding sequence
atggctgaacagtcagacgaagcagttaagtactatacactcgaggaaatccaaaaacataatcattctaaaagcacctggctcatccttcaccacaaggtgtacgatttgacaaagtttttggaggaacatcctggtggcgaggaggtcctgagggaacaggctgggggcgacgcaacagagaattttgaggatgtcggacatagcacagacgcccgggagatgtcaaaaacatttattattggcgagcttcacccggacgaccgcccaaaactcaataaacctccggagccctag

SEQ ID NO: 113582 - DNA, 453 bp, Artificial Sequence
  Description of Artificial Sequence: Synthetic coding sequence
atgagtggcagtatggcgacagcagaggccagcgggtctgatggaaagggccaggaggtagagacatccgtcacatactatagactcgaagaagtcgccaagaggaacagcttgaaagagttgtggctggtgatccacggtagggtctatgacgtgaccaggttcctgaacgagcatcccggcggggaggaggttctcctcgagcaggctggagtcgacgcatcggagtcattcgaggatgtggggcactcttccgatgccagggaaatgctcaaacaatattatatcggtgacatccacccttccgatctcaaacccgagagcgggagtaaggacccgagtaagaatgacacctgtaagtcctgttgggcctactggatcctgcctatcatcggagctgttttgctgggcttcttataccggtattacaccagtgaatccaaatcgtcgtag

SEQ ID NO: 113583 - DNA, 441 bp, Artificial Sequence
  Description of Artificial Sequence: Synthetic coding sequence
atggctaccgcagaagctagtgggtcagacggaaaggggcaggaagtagagaccagcgtgacctattacagactggaagaagttgccaagcgcaattccctcaaggaactctggctcgttattcacgggagggtttacgacgtcacgagattcctcaacgagcaccccggcggagaagaggtcctgctggagcaagctggggtcgatgcatctgagtcgttcgaggatgtggggcattcatccgacgccagggaaatgctcaaacagtattacatcggtgacatccacccaagtgacctgaaacctgaatctggaagtaaagatccatccaaaaatgacacctgtaagtcatgctgggcttattggatcctgccaatcattggggcagtgctgctcggcttcttgtaccggtactatactagcgaaagcaagagcagctag

SEQ ID NO: 113584 - DNA, 756 bp, Artificial Sequence
  Description of Artificial Sequence: Synthetic coding sequence
atggaggggggggcagccgctgctactcctacggcgttaccgtactatgtggccttctcacaactccttggcctcaccctggtggctatgaccggggcctggctgggcctgtaccgaggaggtatcgcatgggaatcagacctgcagttcaacgcacaccctctgtgcatggtgatcggcttgatttttttacaggggaatgcactactggtctacagggtgtttagaaacgaggccaagaggacaactaaagtgctacacggtctgcttcacatctttgctcttgtcatagctctggttggtctggttgccgtgtttgactatcaccgcaaaaagggttacgccgatctatatagcttgcatagctggtgcgggattctcgtttttgtgctttactttgtgcagtggctcgtggggttctctttctttctgttccccggggccagcttctcactgcggagcaggtaccggccccagcatatttttttcggagccactatttttttgctgagcgttggaactgcgctcctggggctcaaagaagccttgctcttcaatcttggcggaaaatactcggccttcgaacctgaaggagtcctcgcgaacgtactcggtctgctgttagcatgttttgggggggctgttctgtatatcttaacccgggctgattggaagcggccctcacaagcggaagagcaggccctgtctatggacttcaagaccctaaccgagggcgatagccctgggtcgcaatag

SEQ ID NO: 113585 - DNA, 756 bp, Artificial Sequence
  Description of Artificial Sequence: Synthetic coding sequence
atggaaggcggcgccgcagctgccaccccgaccgctttaccctactacgtcgccttcagtcaattgctgggacttaccctcgtagccatgacaggcgcttggcttgggctgtacagggggggaattgcttgggagagtgatctccaattcaatgcccaccccctgtgcatggtgattggcctcatttttttacagggcaatgccctactggtctaccgcgtgttccgaaatgaagcaaagcgcacgacaaaagtcctgcacggcttactgcacatttttgccttggtgatcgcactggttggactcgtggctgtttttgattatcatcggaagaagggatatgccgacctctactccctgcattcctggtgcgggattttggtcttcgtcctgtactttgtccagtggttggtgggatttagtttttttcttttcccaggtgctagctttagccttagaagtaggtacagacctcagcacattttcttcggagctactatatttctgttgtctgtgggcacagctttacttgggcttaaggaggccctcctgtttaatctgggggggaagtatagtgcttttgagcctgagggggtgctggccaacgttctcgggctgcttctagcctgctttggcggagccgtgctttacattcttacccgggccgattggaagcggccatcgcaggccgaggagcaggcactgtccatggacttcaaaacccttaccgagggcgacagtcccggtagtcagtag

SEQ ID NO: 113586 - DNA, 756 bp, Artificial Sequence
  Description of Artificial Sequence: Synthetic coding sequence
atggagggaggggctgctgcagctacacccacagcactcccctattacgtggccttttcacaactgctcggcctgaccctcgtagccatgaccggcgcctggctcggactgtacaggggcggcatcgcttgggaatccgacctgcagtttaatgcacatcccctttgcatggtcattggactgatttttctccagggtaatgccctactggtttatcgggtctttcgcaatgaagccaagagaaccactaaggtgctgcatggcctgttgcacatcttcgccctggtgatcgcactggtgggcctagtggccgtgttcgactaccacaggaaaaagggctacgcagacctttatagcctacattcatggtgcggtattctggtattcgtcttgtacttcgtgcagtggctggttgggttctctttcttcttgtttccaggagcttccttttccctgaggtctcggtaccgcccacagcatatattcttcggagcgaccatattccttctctccgtgggtaccgcattgctcggattaaaagaggctttgctctttaatctgggcggcaagtattccgcgttcgagcccgaaggtgtcctggcgaacgtacttgggctgcttcttgcctgctttgggggcgctgttctttacatcctcaccagggctgattggaaacggccaagtcaggccgaggagcaggccctgtcgatggactttaaaaccctgaccgaaggtgactcgccgggcagtcagtag

SEQ ID NO: 113587 - DNA, 417 bp, Artificial Sequence
  Description of Artificial Sequence: Synthetic coding sequence
atggagggtggagcagctgcagccactcccaccgcactgccatattacgttgccttcagccaattactgggactaactctggttgcaatgactggtgcttggttaggactgtatagaggtgggatagcgtgggaatcagacctacaatttaatgcgcaccctctgtgtatggtcatcgggctcattttcttgcaaggcaatgccttgctcgtttaccgagtgttcagaaatgaggccaagcggaccaccaaggtgctgcatggactgctccacatttttgcactggtgatcgcactcgttggcctggtggctgtttttgactatcatcggaaaaagggctacgcagacttatactcgctacactcatggtgtgggattctggtgttcgttttatacttcgtacaggggcaggtgtag

SEQ ID NO: 113588 - DNA, 957 bp, Artificial Sequence
  Description of Artificial Sequence: Synthetic coding sequence
atgaaacaaaagaccaaacccgggactggcccgctgtcctcattagagttcggcgtcagctttctcgccccctctccacacatggaactacttgcctcctgccccaggtcccgactttctccctggggggggtgggcgccccctcccagtcatagccgggacctgcgacccttgcctcaagatgacggagtttgcttgtcgatggaggggggcgccgccgccgccacacccaccgccctgccctactacgtggcctttagtcagctgctgggcctgactctcgtggcaatgacaggtgcgtggctcggcctgtacagagggggtatagcatgggagtccgacctgcagtttaatgctcacccactgtgtatggtcattgggctcattttcttacaaggcaatgcccttttggtctaccgcgtatttcgaaatgaggccaaacgtacaacgaaggtcctccatggccttctgcatatttttgccttagtgatcgctctggtgggcttggtggctgtgttcgactatcacagaaaaaaggggtatgccgatttgtacagtctgcattcatggtgcggcattttggtattcgtgctgtattttgtgcagtggctggtgggatttagcttcttcttatttcctggcgcctcattttctctcagatctagatataggcctcagcatattttcttcggcgccacgatattccttttgagtgtaggcactgccctcctggggctaaaagaggcgcttctctttaacctgggaggaaagtacagtgcattcgaaccagagggcgtgctcgcaaatgtcctgggacttctactggcgtgcttcgggggcgcagtgctctacatccttacaagggccgattggaaacgcccgagccaggctgaagagcaggccctgtccatggacttcaaaaccttgacggagggcgatagtcccgggtcccagtag

SEQ ID NO: 113589 - DNA, 1143 bp, Artificial Sequence
  Description of Artificial Sequence: Synthetic coding sequence
atgggcagcggttgccgaatcgagtgtatcttcttttctgagtttcaccctacacttggacctaagatcacatatcaggtacccgaagacttcatcagccgtgaactgtttgacaccgtacaggtctacataattaccaagccggaactccagaataagctgatcacagtcactgccatggaaaaaaagttaatcggatgtcctgtgtgtattgaacacaaaaaatactcccggaacgctctactcttcaatttgggtttcgtgtgcgacgcacaagcaaagacctgtgccttggagccaatcgtgaagaagcttgcagggtatctgacgacgttggagctcgagtcttcatttgtgagcatggaggagagcaagcagaagctggtgcccattatgaccatccttcttgaggagcttaacgcgagcggccgctgtaccttgccaattgatgaatccaacacgatccatttgaaagtcatcgaacagcgaccggatccgcccgttgcccaagagtacgacgtgcctgtgttcactaaagataaggaagacttcttcaattctcagtgggatctgaccacacagcagatacttccttacattgacggattcagacacatccaaaagatttcagctgaagctgatgtcgaactgaacctggtgagaattgcgatacaaaatctcctctactacggagtggtaacactcgtgagtattcttcagtacagcaatgtttattgcccgacgccaaaggtgcaggacttggtggacgacaagtcactccaggaggcgtgcctcagctacgtcacaaaacagggccacaaacgggcctctcttagggatgtgttccagttgtactgctcactctctccgggcactactgtacgtgacctgattggcaggcacccccaacagctccaacatgtggacgagcggaagttaatccagttcggtctgatgaagaatttgattaggagactgcagaagtatcccgtgagagtcactagagaagagcagagccaccctgcaagactgtataccgggtgtcactcctacgacgaaatctgctgtaagacgggcatgtcctaccatgaactcgatgagcgccttgaaaatgatcctaatattattatctgctggaagtag

SEQ ID NO: 113590 - DNA, 669 bp, Artificial Sequence
  Description of Artificial Sequence: Synthetic coding sequence
atggctttgagcgccgaaaccgaatctcatatttatagggccttgcgaacagcgagcggggctgctgcccacctggtggccctaggctttaccatatttgtcgcggtcctggccaggcccgggagttctctcttctcctggcacccggtcctcatgagcttggccttctcctttctcatgaccgaggctctcttggtttttagcccggaatcgagtctgcttcacagcctaagtcgtaagggaagggcacgatgccattgggtattacaattgttggctttgttgtgcgctctactgggattagggctagtgatcctgcacaaagagcagttaggaaaagcacatctcgtcacaaggcatggccaagccggactgctcgccgtactgtgggcaggcctccagtgttccgggggtgttggtctcttgtaccctaagctgctgcctaggtggcccttggcgaaacttaaactgtaccatgccacctctggcttggtgggctatctgttgggtagcgcaagtcttctcctgggcatgtgttctctatggttcaccgcgtcagtgaccggcgcggcctggtacttggcagtcctgtgccccgtcctcacttccttggtcatcatgaatcaggtgagtaacgcctatctatacagaaagcggatccaaccttag

SEQ ID NO: 113591 - DNA, 669 bp, Artificial Sequence
  Description of Artificial Sequence: Synthetic coding sequence
atggcactatccgcagaaaccgaaagtcatatttatcgagctctgagaaccgcctcaggcgcagctgcacatttggtggctctcggttttactatttttgtagctgtgttagcaagaccagggtcttcactcttctcttggcaccccgtgcttatgtctttggcattttcattcctcatgacggaggccctgcttgtgttttcccctgaaagctccctgctccactcactctccaggaaaggtcgtgctagatgtcactgggtcctccagttactcgcactcctctgtgcacttctcggcctgggattggtgatcctgcacaaagagcagctcggcaaagcccatctagtcacacgccacggccaggccgggcttttggctgtgctttgggctggcctgcaatgcagcgggggggtaggcctcttgtaccctaaactgctgccgcggtggcccttagctaaactcaagctgtaccacgccacgagcggtttggtgggctacctcctgggttctgccagcttgctactgggcatgtgttccctgtggtttactgcctccgtaacaggcgccgcatggtacctggccgttctctgcccagtgttgactagccttgttatcatgaaccaggttagcaacgcctacctatatagaaagaggattcagccatag

SEQ ID NO: 113592 - DNA, 669 bp, Artificial Sequence
  Description of Artificial Sequence: Synthetic coding sequence
atggcactgagcgccgagacggaatctcatatataccgcgcactgcgaacggcatccggcgccgctgctcacttggtcgccctgggcttcactatttttgtggccgtcttagccaggcccggcagtagtctgtttagttggcaccccgtgctgatgagcctggccttctcctttctcatgacggaggccctgctcgtgttttcgcccgagtcctcccttctgcattctttgtctaggaaagggcgtgccagatgccactgggtgctgcaactcttagcgctgttgtgcgctttgctgggattgggtctggttatcctccacaaggaacagttaggcaaggcccatctcgtgacgcggcacggtcaggctggtctgttggcagtgctctgggctggcctccagtgtagtggtggggtgggactcctctatcctaagttgttgccacgatggccactcgccaaactgaaactttatcacgctactagtggcttggtcggctatctactgggaagcgccagcttactccttggcatgtgtagcctgtggtttaccgcttctgtcacaggggccgcctggtacttagcagtgttgtgcccagttctgacatcactggtcattatgaaccaggtgagtaatgcatacctgtatcgcaaacgcattcagccatag

SEQ ID NO: 113593 - DNA, 696 bp, Artificial Sequence
  Description of Artificial Sequence: Synthetic coding sequence
atgggcggcctgtggcgacccggttggagatgcgtgcctttttgtggctggcgttggattcacccggggagccctacacgcgccgcggaacgggttgagccctttctgagacctgagtggtccggcaccggaggggccgagaggggacttcgatggctcggcacatggaaaaggtgctccctccgagctaggcacccagctttacaaccccctcgacggcctaagtcctctaatcccttcacgcgagcgcaggaggaggagagaaggcggcagaataaaacaaccctgacttacgtggcggcagttgccgtcggcatgctgggagccagctatgcagccgtcccactctaccgcctctattgtcagaccacaggtctgggcggaagtgcagtggccgggcacgcatccgacaagatcgagaacatggtgcccgtcaaagaccgcatcatcaaaatatcttttaacgccgatgtgcatgcttctttgcagtggaatttcagacctcagcagactgaaatttacgtggttcccggggaaacagccctggccttttacagggctaaaaaccccaccgacaaacctgtgatcggcatttcaacctataacatcgtgcccttcgaagccggacaatattttaacaagattcaggcctctaagttgcacagagtatacgttctggagagctggcatttgtag

SEQ ID NO: 113594 - DNA, 510 bp, Artificial Sequence
  Description of Artificial Sequence: Synthetic coding sequence
atgctggcgactcgggttttttctctggttggaaaacgtgctataagcacttccgtctgcgtacgagcccacgagagcgttgtcaagagcgaagacttctccctcccagcgtatatggaccgccgagatcaccctctgccagaggttgcccacgtaaagcatctgagcgccagtcaaaaggccctgaaagaaaaagaaaaggcaagctggagctcgctgtccatggatgaaaaggtcgagctgtatagaataaagttcaaggagtccttcgccgagatgaaccggggatcaaacgaatggaaaacagtggtaggcggagcaatgttctttataggattcacggcactggtcattatgtggcagaaacactacgtatacggaccgctgccacagtcatttgataaggagtgggtcgccaaacaaacgaaacggatgcttgacatgaaagtcaatcccattcaggggttggcatctaagtgggattacgaaaagaacgagtggaaaaagtag

SEQ ID NO: 113595 - DNA, 516 bp, Artificial Sequence
  Description of Artificial Sequence: Synthetic coding sequence
atgctgccaagagctgcttggagtctggtgttgaggaaaggcgggggagggagaagaggaatgcattcatctgaaggtaccacacggggggggggtaaaatgtccccatacaccaattgttatgcgcaaagatattatcccatgcctgaggaacccttctgtacagagttaaatgccgaggaacaggcgctaaaggagaaagaaaaaggcagctggactcagctcactcatgccgaaaaggtggccctctaccggctgcagttcaacgaaaccttcgcagaaatgaatagaagatccaatgagtggaaaacagtaatgggatgcgtctttttttttatcggtttcgccgccctggtgatctggtggcaaagagtgtacgtgtttccgcctaagcctattacacttaccgatgaaagaaaagcacaacaactacagagaatgctcgatatgaaagtaaatcccgtccagggtctcgcctcacgctgggactatgagaagaaacagtggaaaaagtag

SEQ ID NO: 113596 - DNA, 390 bp, Artificial Sequence
  Description of Artificial Sequence: Synthetic coding sequence
atggcctcccgtctactgcgcggcgctgggacgttggcagcccaggctctccgcgcccgtggcccaagcggagctgcggccatgcgcagtatggcgagtggcggaggggttccgacagatgaggaacaagctacaggtctggagcgcgagatcatgttggcagccaaaaagggcctagatccgtataatgtgctcgcaccaaaaggagcaagcgggacacgggaggaccctaatttggttccatcgatctcaaataagcgtatcgtggggtgcatatgcgaggaggataacaccagtgttgtgtggttctggcttcacaagggtgaggcccagcgctgtccacgatgcggagcccactacaaactagttccccagcagcttgcacattag

SEQ ID NO: 113597 - DNA, 606 bp, Artificial Sequence
  Description of Artificial Sequence: Synthetic coding sequence
atggcccgcgattatgatcacttgttcaaactgttaatcattggtgacagtggggtaggtaaaagcagccttttacttaggttcgctgacaacactttctccggctcatacataacgaccataggcgtcgacttcaaaattcgaaccgttgaaatcaacggagagaaagtaaaactccagatctgggacacggccggtcaggaaaggttccggactataacatccacctattaccgaggcacccacggagtgattgtggtgtatgacgtcacttccgcagagtctttcgtcaatgtcaagcggtggctccatgagatcaatcagaactgtgacgatgtgtgtaggatcctcgtgggcaataaaaatgatgaccccgagcgcaaagtggttgagactgaggacgcatataaattcgcaggccaaatgggcattcaactgttcgaaacgagcgctaaagaaaacgtaaatgtggaagaaatgttcaactgcataaccgagctggtgctgagagcaaaaaaggacaatctcgccaaacagcagcagcagcagcagaacgacgtggtgaagttaactaagaacagtaaacgaaagaaaagatgctgttag

SEQ ID NO: 113598 - DNA, 261 bp, Artificial Sequence
  Description of Artificial Sequence: Synthetic coding sequence
atggctgaagacatggagaccaagattaaaaattataagacggccccctttgacagcaggtttccgaatcaaaatcagaccagaaattgttggcagaattatcttgactttcaccgatgtcagaaagctatgaccgctaaggggggcgatatctcagtctgcgagtggtaccagagggtgtatcaatcactctgccccacctcctgggtgacagactgggatgagcagcgagccgaaggaacatttcccggaaaaatttag

SEQ ID NO: 113599 - DNA, 312 bp, Artificial Sequence
  Description of Artificial Sequence: Synthetic coding sequence
atgcatcctcacccccaaattcctggcagagacctggccggattctcaaccatggcagaggacatggagaccaagatcaagaattataaaacagcaccattcgattcacgcttccccaaccaaaatcagacacgcaattgctggcagaactacctcgactttcatcgctgtcagaaggctatgacagccaaaggtggggatatctctgtctgcgagtggtatcagagagtctaccagtccttgtgtccaaccagttgggtcactgactgggacgagcagagggctgaagggacgtttcccggcaaaatctag

SEQ ID NO: 113600 - DNA, 228 bp, Artificial Sequence
  Description of Artificial Sequence: Synthetic coding sequence
atggcccctgaagtgttgccaaaacccagaatgagaggactgttggctcggcggttaagaaatcatatggccgtagctttcgtgttgtcacttggcgttgccgctttatataaattcagagtggccgatcagcgcaagaaggcctacgccgacttctataggaactacgacgttatgaaggactttgaagagatgagaaaggccggaatcttccagtccgtgaaatag

SEQ ID NO: 113601 - DNA, 228 bp, Artificial Sequence
  Description of Artificial Sequence: Synthetic coding sequence
atggcccccgaagtcttgcccaaacctcgcatgcgtggcctcttagctcgaagactccgaaaccatatggccgtggcttttgtactttcgcttggtgtggcggctctttataagttcagggtggccgatcaaaggaagaaagcctatgctgatttttaccggaattacgatgtcatgaaagacttcgaggaaatgagaaaagccggcatctttcaatccgtgaaatag

SEQ ID NO: 113602 - DNA, 228 bp, Artificial Sequence
  Description of Artificial Sequence: Synthetic coding sequence
atggcacctgaagtgctgccgaagcctagaatgcgggggcttttagcgcgcagactgagaaaccacatggctgttgcgtttgttctgtctctaggagtggccgcactgtataagtttcgagtggccgaccagaggaagaaggcctacgcagatttttatagaaattacgacgtgatgaaagatttcgaggagatgagaaaggcgggtatcttccagtctgtgaaatag

SEQ ID NO: 113603 - DNA, 228 bp, Artificial Sequence
  Description of Artificial Sequence: Synthetic coding sequence
atggcacctgaagtactgccaaagccccgtatgaggggactgctagcaaggcggcttagaaatcatatggcggtcgcattcgtgctgtcccttggcgtggcagccctttacaaatttcgggtcgcagaccagcgaaaaaaggcttacgcagatttctaccggaattacgatgtgatgaaagactttgaggaaatgaggaaggcgggcatcttccagtcggtcaagtag

SEQ ID NO: 113604 - DNA, 228 bp, Artificial Sequence
  Description of Artificial Sequence: Synthetic coding sequence
atggcccccgaagtattgccaaaacctcggatgcggggtctgctcgcgcgtagactcagaaaccatatggcagtggccttcgtactaagcttaggggtcgccgcactgtataagttccgcgtggccgatcaaaggaaaaaggcctatgcggacttctataggaattacgacgtgatgaaagactttgaggagatgcgaaaggccggcattttccagagcgtaaagtag

SEQ ID NO: 113605 - DNA, 228 bp, Artificial Sequence
  Description of Artificial Sequence: Synthetic coding sequence
atggctcccgaggtgctccccaagccgaggatgcgaggactccttgcgcggcggctaagaaatcacatggccgtggcctttgtacttagcttgggcgtagcagccctctacaagtttcgcgtagcagaccagagaaagaaggcatacgcggacttctataggaactatgatgtgatgaaagacttcgaagagatgcgtaaagctggcatcttccagagcgtgaaatag

SEQ ID NO: 113606 - DNA, 228 bp, Artificial Sequence
  Description of Artificial Sequence: Synthetic coding sequence
atggcacccgaggtgctaccaaagcctcgaatgagaggactgttggcacggcgactgagaaaccacatggcagtagccttcgtgttgtcgctgggggtggcggctctgtataagttcagagttgctgaccagcgaaagaaagcttacgccgacttctacagaaactacgatgtgatgaaggactttgaagaaatgagaaaggcaggtattttccagagtgttaagtag

SEQ ID NO: 113607 - DNA, 228 bp, Artificial Sequence
  Description of Artificial Sequence: Synthetic coding sequence
atggcccccgaggtcctgccgaagcctcgcatgcgaggactactggctagacgactacgaaaccacatggccgtggcattcgtcctgtccctaggcgtagccgcattgtacaaattccgagtcgccgatcagcggaaaaaagcctatgcggacttttataggaactatgacgtcatgaaggattttgaagagatgcgaaaggctggaatctttcaaagtgtaaaatag

SEQ ID NO: 113608 - DNA, 228 bp, Artificial Sequence
  Description of Artificial Sequence: Synthetic coding sequence
atggcacccgaggtcctgcccaagcccaggatgcgaggtctgcttgccaggagattacggaaccacatggccgtcgcctttgtgctatctctgggggtagccgctttgtataagtttagagtggctgaccaaagaaagaaagcatatgcggacttttatagaaactacgatgtcatgaaggactttgaggaaatgcgtaaggctgggatctttcaaagcgtcaaatag

SEQ ID NO: 113609 - DNA, 228 bp, Artificial Sequence
  Description of Artificial Sequence: Synthetic coding sequence
atggctcctgaagtgctacctaagccaagaatgcggggactgttagccagaagactgaggaatcatatggccgttgcctttgtgctctcacttggggtcgccgccctttacaaattccgggtggctgaccagagaaagaaggcatacgccgatttttatcgaaattatgatgtcatgaaggactttgaggaaatgagaaaggccggcatctttcaaagcgtgaaatag

SEQ ID NO: 113610 - DNA, 240 bp, Artificial Sequence
  Description of Artificial Sequence: Synthetic coding sequence
atgcaggcactgcgtgtgtcacaggccctgattaggtcattctcgtccacagctaggaataggttccagaacagagtaagggagaagcagaaacttttccaggaggataatgatatcccactgtacctcaagggaggtatcgtggataacattctctacagggtcactatgaccctgtgtctgggaggcacagtgtactcgctctactccctcggctgggccagcttcccgaggaactag

SEQ ID NO: 113611 - DNA, 330 bp, Artificial Sequence
  Description of Artificial Sequence: Synthetic coding sequence
tagtccttttgggtgcttagcctgcctgggccttctaggcagccaggccatcctcaggctaggctgcagggcgagtctcctccgaatccggccggtagttctagagtgagccaggctctgattagatcattctcatcaacagctcgaaatcggttccagaatcgagtgagagagaaacagaaactctttcaagaagacaacgacatccctttgtatttaaagggcggcatcgtggataatatcttgtatcgggtcacaatgaccttgtgtcttggcggaacagtttacagcctctacagcctgggatgggcttctttcccgcgaaattag

SEQ ID NO: 113612 - DNA, 2775 bp, Artificial Sequence
  Description of Artificial Sequence: Synthetic coding sequence
atgagtaggagtcgccagccaccactggtgacaggcatctcaccgaacgagggcattccctggacaaaagtcacaataagaggggagaacctcggcacaggcccaaccgatctgatcgggttaaccatttgcggccataactgcttgctgaccgcagagtggatgtccgctagcaagatcgtttgtagggtggggcaagctaaaaacgacaagggggacataattgtgaccaccaaatctggagggcgtggaaccagtactgtgtcattcaagcttttgaagcccgagaaaattggaattctggaccagtccgctgtctgggtggatgagatgaactactacgatatgaggacggatcggaataagggcatcccacctctgtcattaaggccggccaatcccttaggaattgagatagagaaatcaaaattttctcaaaaggacttagagatgctgtttcatggaatgtctgccgactttacatcggagaatttttccgctgcatggtacctgatcgagaaccacagcaacaccagcttcgaacagcttaaaatggccgttactaatctcaagcgccaagcgaataagaaaagcgagggaagccttgcttacgtgaagggcgggttgagcacatttttcgaagcacaagacgctctgtctgccattcaccagaaactggaagcagatggtacagaaaaggtagagggatctatgacacaaaagctcgaaaatgttctaaatagagcttccaacactgcagacacactattccaggaggtgctgggccgtaaagataaggctgactcgacacgcaatgctcttaatgtgctccagcgattcaagtttctgttcaatttgccgctgaatatagagcggaacatccaaaaaggagactacgatgtggtgatcaacgattatgaaaaagctaaatctctttttggcaaaaccgaggtgcaggtcttcaaaaagtattacgctgaggtcgagacccgaatcgaagctctgagggagctgctcctggacaagctgttagaaactcctagcaccctgcacgaccaaaagcgctacattagatacttgtccgatctgcatgcctctggtgaccctgcgtggcagtgcatcggcgctcagcataaatggattctgcagttaatgcacagttgcaaagaaggctacgtgaaggatctgaaagggaatcccggactccactcccctatgcttgacctggataacgataccagaccctctgttctcggtcatcttagccagactgccagtctaaaaagaggctcatcatttcagtccggtcgtgacgacacatggaggtacaaaactcctcatcgggtcgccttcgtagagaagctgaccaagttagtgttatcccaactgccaaatttctggaagctgtggatatcctacgtcaatggcagtcttttctcagagaccgccgaaaaatcgggccagattgaacggtccaagaacgtgaggcagcgccagaacgactttaaaaaaatgattcaagaggttatgcatagcctagtgaagctcacccgtggcgcgcttttgccacttagcattagagacggcgaagccaagcagtatggagggtgggaagtgaaatgtgaactgagcgggcagtggctggcccacgccatacaaacagtgcgcctcactcacgaatcactgaccgccctcgaaataccaaatgatttgctgcagaccatccaggatctcattctggacctccgggtccgttgtgtgatggccaccttgcagcacaccgctgaggagatcaagcgcttggccgagaaagaggactggatagtggataacgaaggtctgacctctctgccttgtcaattcgaacaatgcatcgtctgcagcctccagtcattaaaaggtgtcctcgagtgcaagccgggcgaagcgagcgtgttccagcaacctaaaacccaggaggaggtgtgtcagctttcaatcaatatcatgcaagtgttcatttattgtctcgagcaactgtcaaccaagccagacgccgatattgataccacccacctgtctgtggatgtctcttccccagatctgtttggctcaattcatgaagacttctctctgacctccgaacagagactgctcattgtgctctcgaactgctgttacttggagagacacacattcttgaacatcgctgagcattttgagaaacacaatttccaaggcatcgagaagatcacacaggtgagtatggcttcgctcaaagaactggatcagcgcctgttcgagaattatattgagctgaaggctgatcctatagtggggtctctggagccaggcatatatgcaggctatttcgattggaaggattgcttgccgcctactggtgtgcggaactatctgaaggaggcactcgttaatattatcgccgtgcatgctgaagtctttacaataagcaaggagctcgtgccacgagtgttatccaaggtcatagaggcggtctcagaggagctttccaggctgatgcagtgcgtgagttcttttagtaagaatggtgccctccaagctcgtcttgaaatttgtgccctccgagacactgtcgccgtctacctgactccggagagcaagtcttccttcaaacaggcactggaggcacttccacagctgagctcaggggccgacaaaaaactcctggaggagctcctgaataaatttaaatctagcatgcacctacagcttacatgtttccaggctgcctcatctaccatgatgaaaacttag

SEQ ID NO: 113613 - DNA, 348 bp, Artificial Sequence
  Description of Artificial Sequence: Synthetic coding sequence
atgcacacacaagacagtgaggtggtgcctgtcccggcatggccttttagtttggtggtgttctcctgtggcggctgctggtcggtcactgcaaagatgctgcgcaatttgctggcactccggcagattgggcaacgtacaatcagtactgcgtccagaaggcactttaagaacaaggtccctgagaagcaaaaactcttccaggaagacgatgaaatccccttgtacctcaagggaggagtggccgacgcacttctctatagagccacaatgatcttaactgtcggcggaactgcttacgctatctacgagctcgctgtcgcatcatttccaaaaaagcaggagtag

SEQ ID NO: 113614 - DNA, 348 bp, Artificial Sequence
  Description of Artificial Sequence: Synthetic coding sequence
atgcacacccaagattccgaagttgtacccgtgcccgcttggcctttcagcctggtggtgtttagttgtggaggatgttggtccgttacagctaagatgttgcgcaatctgcttgccctgcgccaaattggccagagaacaatctctactgcatctagacgacactttaaaaataaggtaccagagaaacagaaacttttccaagaagatgatgagatacctttatacttgaagggcggtgtggccgatgcacttttgtatcgcgcaaccatgatcctgactgttgggggaactgcatacgcaatttacgagcttgctgtggcaagcttcccaaagaaacaggaatag

SEQ ID NO: 113615 - DNA, 1734 bp, Artificial Sequence
  Description of Artificial Sequence: Synthetic coding sequence
atgtccaagcccgaactgaaggaggacaagatgctcgaggtgcatttcgtgggagacgacgatgttctgaatcacatcctcgacagggagggcggggctaagctgaagaaggaaagagcacagctgctggtcaatccaaagaaaataattaaaaaacccgaatacgatctggaggaggatgaccaagaggtgctgaaagaccagaactacgtggaaattatgggacgggatgtccaggagagtctgaagaatgggagtgccacagggggaggaaataaagtgtattcctttcagaaccgcaaacatagcgagaaaatggccaaattagcctcggaactcgcaaaaacaccacaaaagtcagtctcgttcagtctgaaaaatgaccccgaaattaccattaacgttccgcagagtagcaaaggacacagtgcaagtgacaaggtacagcctaagaataacgataaaagcgagtttctaagtacagcgccccgaagcctgcgaaaacgtctgatcgtgccaagaagccactctgactcggaatcggaatattcagctagcaattcagaagacgacgaaggggttgcccaggagcacgaagaagacaccaatgccgtgatatttagtcagaagatccaagcccaaaaccgggtggtgtctgcccctgtcggaaaggagacaccatcaaagagaatgaagcgagataaaacgtccgacttagtagaagaatacttcgaagctcacagttcctccaaagtgctgacaagcgatcgtaccctccaaaaattgaaacgtgcgaaacttgatcagcagacactgcggaatttattgtcaaaagtgagtccctctttctcagccgaactgaaacagctcaaccaacaatacgagaaactctttcacaagtggatgctccagctgcatttgggatttaatatagtgctatacggtctgggcagcaagcgcgatctgctcgaacgatttcgaactactatgcttcaggattctattcatgtcgtgatcaacgggttctttccgggaatcagcgtgaaatccgtgcttaacagcattactgaggaggtcttagatcacatgggaacgttccgttcaatcctcgatcagctcgattggatcgtcaataaattcaaggaggatagctcgcttgagctcttcctactcatccacaatttagatagtcagatgctccgtggggaaaaatctcagcagatcattgggcaactgtctagtttgcacaatatctatctaattgcctcaatcgaccatttaaacgctcccctaatgtgggaccacgcaaagcagagcttgttcaactggctatggtatgagactactacttactccccctacaccgaggaaacttcttacgagaacagtctacttgtcaagcagagcggatccctgcctctctcctctttgacccatgtgctgaggtctttaacccctaatgctcggggaatattccgcctgctgatcaaataccaattagataaccaggacaatccatcttatatagggctttcttttcaggacttttatcaacagtgtcgcgaggcattcctcgtaaattccgacctgacattaagggcacagcttactgagtttcgagaccataaactcattcggacaaaaaaaggtactgatggggttgaatacctcctgatccccgtagataacggcaccctgaccgattttctcgaaaaagaggaagaagaagcgtag

SEQ ID NO: 113616 - DNA, 345 bp, Artificial Sequence
  Description of Artificial Sequence: Synthetic coding sequence
atgtattataaattttctggatttacccaaaagctcgcaggcgcttgggcatctgaggcctactctccacagggcttgaaacctgtggtgagtacagaagccccaccaataatcttcgccacccccaccaagcttacgagtgatagtaccgtttacgattatgctggcaaaaacaaggtgcccgagctccaaaagtttttccagaaagccgacggcgtgcccgtgtatctcaaaagaggactccctgaccaaatgctctatcgcacgacaatggcattgacagtgggcggcaccatctattgtctcatcgccctgtacatggcctcgcagcctaagaacaaatag

SEQ ID NO: 113617 - DNA, 246 bp, Artificial Sequence
  Description of Artificial Sequence: Synthetic coding sequence
atgatgttccctcttgctaggaatgcccttagttccctcaagattcagtccattctccagtccatggcccgccacagccatgttaaacatagccctgactttcacgacaaatacggtaacgccgtcctagcaagcggcaccgccttttgtgttgcaacctgggtttttactgccactcagataggaattgaatggaacctgagcccggtggggcgggtcactcccaaggagtggaagcaccagtag

SEQ ID NO: 113618 - DNA, 246 bp, Artificial Sequence
  Description of Artificial Sequence: Synthetic coding sequence
atgatgtttcctctagcaaggaacgcgttgtcaagcctgaagatccagtctatcctgcagagtatggcccgacattcacacgtgaagcattctccagatttccacgataagtatgggaacgctgtgcttgcaagtggaacagctttctgcgttgcaacttgggtgtttactgccacacaaataggtatagagtggaatctgtctccggttggacgggtcacgcctaaggagtggaaacaccagtag

SEQ ID NO: 113619 - DNA, 246 bp, Artificial Sequence
  Description of Artificial Sequence: Synthetic coding sequence
atgatgttccccctggcacgcaatgccctttcgtcgctcaagatacagtctatcctgcaatccatggcgcggcactctcacgttaaacactctcctgatttccatgataaatacggtaacgctgtcctggcatcaggtacagcattctgcgtcgccacatgggtgtttaccgctactcagattggtatagaatggaacctgtctcctgtcgggcgagtaacacccaaggagtggaaacaccaatag

SEQ ID NO: 113620 - DNA, 99 bp, Artificial Sequence
  Description of Artificial Sequence: Synthetic coding sequence
atgatgtttccactcgcaaggaatgccctgtcctcgcttaagattcaatccattctccagagtatggctcgccactcacacgtcaaacattctccgtag

SEQ ID NO: 113621 - DNA, 243 bp, Artificial Sequence
  Description of Artificial Sequence: Synthetic coding sequence
atgttcccgctggcccggaatgccctcagctctctgaagattcagtcgatcctccagtccatggcccggcattcccatgtgaagcattcccccgattttcacgacaagtatggcaatgccgtgctcgcctccggtactgcattttgcgtggccacatgggtgtttacagcaacacagattggaatagaatggaacctctctccggtggggagggtaaccccaaaagagtggaaacaccagtag

SEQ ID NO: 113622 - DNA, 192 bp, Artificial Sequence
  Description of Artificial Sequence: Synthetic coding sequence
atgctcggacagtccatcaggcgcttcaccacctccgtcgtgaggcggagccactacgaggaaggccctggcaagaatctgccgttctctgtcgaaaacaaatggtccctgctcgctaagatgtgtctctattttggatccgctttcgctaccccgtttttggtggtgcggcaccagctgctcaagacgtag

SEQ ID NO: 113623 - DNA, 192 bp, Artificial Sequence
  Description of Artificial Sequence: Synthetic coding sequence
atgctgggccagagcatccggcggttcaccacctccgtggtccgccgcagccactatgaggaaggacccggcaagaacctccccttttccgtagagaataagtggtcgctccttgccaagatgtgtctgtacttcggttccgccttcgcgacacctttcctggtcgtccgacaccagctgctcaaaacctag

SEQ ID NO: 113624 - DNA, 978 bp, Artificial Sequence
  Description of Artificial Sequence: Synthetic coding sequence
atggccgccgctgcggccagcttgaggggggtcgttctgggccccaggggtgccgggctcccgggggcacgggctcgtggtctgctttgctccgctcggcccggccagttgccgctgcgcacgccccaggcggtggcactctcatctaaatctggtctcagtagaggcaggaaagtcatgctgtctgccctgggaatgctggccgctggcggagctggcctggccatggcccttcatagtgctgtgagcgcctcagacttggagctgcatccgcccagttatccttggtctcataggggactcctgtctagtctggaccatactagtatcaggagaggatttcaggtgtataaacaggtgtgcgccagctgtcattcaatggactttgttgcctaccggcacttggttggtgtctgctatactgaggatgaagccaaagagctggcagcagaagtcgaggtgcaggacgggcccaacgaagatggagagatgttcatgagacctgggaagctgtttgattacttcccaaagccttaccccaacagtgaagctgccagagcagccaacaacggagcactaccccccgacctctcatacattgtcagggcccgacatggaggcgaagattatgttttcagcctactcacaggatactgtgagccacctaccggagtctctctccgggaagggctttacttcaatccgtacttccccggtcaggccattgccatggcaccgccgatctataccgacgtccttgaatttgacgatggtactccagcgacgatgagtcaaatcgcgaaagatgtgtgcacttttttacggtgggcgtccgagcctgagcatgatcatcggaagcgcatgggcctgaaaatgctgatgatgatggccctgttagtgcctctggtatatactatcaagaggcataagtggtcagtgctgaagagcaggaagctggcttatagacctcccaagtag

SEQ ID NO: 113625 - DNA, 252 bp, Artificial Sequence
  Description of Artificial Sequence: Synthetic coding sequence
atggaaccgtttgtcgtgttggtgctgtgcctgtcatttatgttgctcttctctttgtggagacaatcatgccgccgaaggaagctgcccccaggccctacccctctccccatcattggcaacatgctccagatcgacgtgaaagacatatgtaaatcttttacaaacgtgagtctgccgtacgtgcctccggcgaactgcaagggctcccagaagagcatggtcttgtgttcaccatgtatcctggcttag

SEQ ID NO: 113626 - DNA, 219 bp, Artificial Sequence
  Description of Artificial Sequence: Synthetic coding sequence
atggagccgttcgtcgttctggtgctgtgcctttcttttatgttactgttttctctgtggcggcagtcttgtagaaggagaaagctcccccccggccccaccccattgcccattattggaaatatgcttcagatcgatgtgaaggatatttgcaaaagcttcactaacgtctcgcttccatatgtcccaccagcaaattgcaaaggggtgctgctgtag

SEQ ID NO: 113627 - DNA, 423 bp, Artificial Sequence
  Description of Artificial Sequence: Synthetic coding sequence
atggatctaatccctaatctggctgttgagacttggttacttctggcagtgtctctggtactgctttatttgtacggtacaagaacccacgggctgtttaaaagattaggaattccaggtccaacccccctgcctcttctgggcaatgtcctgagctacaggcaaggattgtggaaatttgataccgaatgctacaaaaagtatggcaagatgtggggaacctatgaaggtcaactgcccgtgctggccattaccgatccagatgtaatccgcacagtgctggtgaaagaatgctactctgtttttactaataggcgcatttgcgccaccaccagcactataaaaatgcagacccattcagtcactatgtggctcccaccagccgttctccagtctcaacacggagtttgtttatttttatag

SEQ ID NO: 113628 - DNA, 1563 bp, Artificial Sequence
  Description of Artificial Sequence: Synthetic coding sequence
atgccccagctgtccctgagctcactgggcctttggccaatggctgcctccccctggctgctcctgctgttggtcggcgcctcatggcttctagccagaatcttagcctggacctatacattttatgataactgctgccgactgaggtgtttccctcagccgcctaaacggaattggttccttggacatctcggcttggtcacaccaacggagcaaggaatgagagtcctgacccagcttgtcgccacctaccctcagggttttaaggtatggatgggacccatatttcctgtaatccgcttctgtcaccccaatatcatccggagtgttattaatgcaagcgctgcaatagtgcccaaagataaggtattctactccttcctgaagccttggctgggcgacggtctgctcctcagcgcaggtgaaaaatggagccgccaccggcggatgctgacacccgcatttcattttaatatcctgaagccctacatgaagatcttcaatgagagcgtgaacattatgcacgccaagtggcagctgctcgcctccgaaggtagtgctagacttgatatgtttgagcatataagcctgatgacactggacagtctccagaaatgcgtgttcagcttcgatagtcactgtcaagagaaacccagtgagtatattgctgcgattctggagctctccgcgcttgtaacgaagcgacaccagcagatcctgctgtacatcgatttcctgtactacctgactcctgacgggcagaggtttagaagagcatgcagactggtgcacgactttaccgacgccgtgattcaggagcgacggcggactcttccgtcgcaaggagtcgatgacttcctgcaggcaaaagccaaatcaaagaccttagattttatcgatgtgttgttactgagtaaagacgaggacgggaagaaattgtccgacgaggatattagagcagaagccgacacgtttatgtttgaaggacatgacaccacggcatcaggcttatcctgggtcctgtatcacctggccaaacacccggagtaccaagaacgctgcagacaggaggtacaggaactcctcaaggatcgcgagcctaaagagatcgaatgggacgatcttgcccagctgcccttcttaaccatgtgtatcaaagagtccttgcgtttgcacccaccagtccccgcagtgtcgaggtgctgcacacaagacattgtgctgcctgatggcagagttatcccaaagggcataatctgtctgattagtgtgttcgggactcatcacaacccagctgtgtggcccgaccccgaagtatatgatccctttaggtttgatcctaagaacatcaaagagaggtcaccactggcattcatcccgttctctgctggcccgcggaattgcatcggtcaggccttcgctatggccgagatgaaggtggtcctgggtctgacactgctccgatttagggtgcttcctgatcacacagaaccccggcgaaaaccagagctggtgctgcgcgccgaagggggactatggctgcgagtggaacccctgagttag

SEQ ID NO: 113629 - DNA, 1455 bp, Artificial Sequence
  Description of Artificial Sequence: Synthetic coding sequence
atgttattccctatcagtatgtctgcaaccgagttcttacttgcctctgtgatcttttgtctggtcttttgggtcatcagagcgtccaggcctcaggtgcctaagggactcaaaaacccgcctggcccgtggggctggccactgatcggccacatgcttacgctgggtaaaaatccacacctcgccctcagccggatgagccagcagtatggagacgtcctgcagatcaggatcggctccactccagttgtggtcctcagcgggcttgacaccatccgacaagctctggttagacagggggacgatttcaagggacgtccggatctgtacaccttcacccttatctccaacggccagtccatgtctttcagcccggattcaggtcctgtttgggcagccaggcggcgactggcgcagaacggccttaagtctttttctatcgccagcgatccagcctcttcaacaagctgttacttggaagagcatgtgagcaaagaggccgaagtgttgataagtaccctgcaggagctgatggccgggcccggacatttcaatccatacaggtatgtggtcgtgtccgtgaccaatgttatttgcgccatctgttttggacgacggtacgaccataatcaccaggaattactaagccttgtgaacctgaatgctttcaaagatctcaacgaaaaattctattccttcatgcaaaaaatggtcaaagagcattataagacatttgagaaaggccacatcagggacattactgacagcctcattgagcattgccaagaaaagcaactcgatgaaaatgctaacgttcaactgagtgacgagaaaatcattaatatcgtgctggacctctttggtgctggcttcgacaccgtcactaccgcaatatcctggagcttaatgtaccttgtgatgaacccgagggtgcagaggaagatccaggaagagctggataccgtcatcggcagaagtagaagacccagactctccgaccgttcgcatctaccctacatggaggcattcattctcgaaacgtttcgccacagcagcttcgtgccatttacaattccgcactctacaacacgagatactagtctcaagggcttctatattccgaagggacgatgtgtattcgtaaaccagtggcagataaaccatgaccagaagctctgggttaacccgagcgaattcctgccagaacggtttcttacacccgacggcgccattgataaagtgcttagtgaaaaagtaatcatctttggcatgggaaagagaaaatgcattggcgagacaatcgctcgatgggaggtattccttttcctcgcgatcctactgcagcgggttgagttttctgtgccactcggagtaaaagtggacatgacccccatctatggcctgacaatgaaacacgcttgctgcgagcattttcagatgcagctgcggagttag

SEQ ID NO: 113630 - DNA, 1539 bp, Artificial Sequence
  Description of Artificial Sequence: Synthetic coding sequence
atgttgttcccaatttcgatgtctgcaaccgagtttctgctggcttctgtcatattctgtctggtgttctgggtcataagggcaagcaggccccaggttccaaaaggcctgaaaaaccccccagggccttggggctggcccctcatcggacacatgttaactcttggtaaaaaccctcatctcgccctaagcagaatgagccagcagtacggcgatgttttacagatcaggataggctccaccccagtggtggtactctccggacttgacactatcaggcaggccctcgtgcgacagggcgacgatttcaaagggagaccagacttatatactttcaccctgattagtaatggccaatctatgtcattctcccctgactctggtcctgtatgggcagccaggcgaagactggctcagaatggtctgaagtcattcagtatcgcgtccgatcctgcctcctccacttcctgctatttagaggagcacgtaagcaaggaggccgaggtcctgattagcactctgcaggagctaatggccggacctggtcactttaatccttaccgatacgtcgtcgtcagcgttaccaatgtgatctgcgcaatatgcttcggacgccggtacgatcacaaccatcaagagttgttgtccctggtgaacctcaacaataacttcggtgaagtggtggggtccggcaacccagccgacttcattccaattctccgatacctgcccaatccaagtctgaatgccttcaaggatctcaacgaaaagttctattctttcatgcagaagatggtgaaggagcactataaaacatttgaaaaagggcatatcagagatataacggatagcctgatcgaacattgtcaggaaaagcagctggatgagaatgcgaacgtccagctgagcgacgagaagattattaatatcgtgttagacctctttggggccggtttcgatacagtgacaactgcgatttcatggtccctgatgtatctggtgatgaacccccgcgttcagcgtaaaatccaagaggaactggacacagttataggccgctcacgcaggccacgtctatcagaccgatcccacctaccctatatggaagctttcatactggagactttcagacacagctcgtttgtcccatttaccatcccccactcaacaacccgcgacacctccctgaagggcttttatatccctaaaggccgttgcgtgtttgtgaaccagtggcaaatcaatcacgaccagaagctctgggtaaatcctagcgaattcctgccagagaggttcctgacccctgatggcgccatcgacaaagttttgagcgagaaagttataatcttcgggatgggaaagcgcaagtgtattggagaaacaatagcccgatgggaagtcttcctcttcctggccatcctgctccagcgggttgagtttagcgtgcctctgggcgtcaaggtggatatgactcctatctacggacttactatgaaacacgcctgctgcgaacacttccaaatgcagctccgaagttag

SEQ ID NO: 113631 - DNA, 1539 bp, Artificial Sequence
  Description of Artificial Sequence: Synthetic coding sequence
atgctgttcccaatcagcatgtcagcaactgaatttctgttagcgtcggttatcttctgtcttgtgttctgggtgatacgagcgtcccggccacaagtccctaaaggcttgaagaacccgcccggcccctgggggtggcccctcataggccacatgctgactcttgggaagaatccccatctggcattaagtcgcatgagtcagcagtacggcgacgttcttcaaataaggataggttcgaccccagttgtggttctcagtgggttggatacaatacgccaggccttagtgcgacaaggagatgactttaaaggccggcccgacctgtatacatttactctgattagcaatgggcagtctatgtccttttcacccgacagcggacctgtatgggctgcccggagaaggttagctcaaaacggccttaagtcattttctattgcttccgatccagccagcagtacttcttgctatctggaagaacacgtgagcaaagaggccgaggtgttgattagcacactgcaggaactgatggccggtcctggccattttaacccatataggtacgtagtagtgagcgttacaaacgtgatttgtgcgatttgcttcgggagacggtacgaccataatcatcaggagttgttgagcttggtcaacttgaataacaacttcggggaagtggtgggctctggaaatcctgccgacttcatccctattctgagatacctgccaaacccatccctgaatgcctttaaagacctgaatgagaaattctattctttcatgcagaagatggtgaaggagcattataaaacctttgaaaagggccatattagggatattaccgattcactgattgaacactgccaggaaaaacagctcgacgagaacgccaatgtccagttaagtgatgagaaaattatcaatatcgttctagatttgttcggggcagggtttgacactgtcaccacagctatctcttggagcctgatgtacctggtcatgaacccccgcgtgcagagaaagatccaggaggagctcgacactgtcattgggcgctctagaaggccacgcctcagcgatagatctcacctgccgtatatggaagccttcattttggaaactttccggcacagctcgttcgtgccttttaccatccctcactcgaccacccgggacacatccttgaagggattttatattcccaaaggacgctgcgtatttgtgaaccagtggcagataaatcatgaccagaaattgtgggtgaacccgtccgagttcctgcccgagagatttctgacccccgatggcgccatagacaaggtactgtctgaaaaggttataatcttcggcatgggaaagcgcaagtgtataggggaaaccatagcccgttgggaggtcttccttttcctcgctatcctgctgcagcgcgtagagttcagcgtgccgctgggagtaaaggtggatatgacgcccatttacggcctgacaatgaaacacgcctgttgtgagcacttccagatgcaattgagatcctag

SEQ ID NO: 113632 - DNA, 1452 bp, Artificial Sequence
  Description of Artificial Sequence: Synthetic coding sequence
atgctgtttcccatctccatgagcgcgaccgaatttctcctggcatctgtgatcttctgtctggtgttctgggtcattagggcaagccggccacaagtgcccaaaggactgaagaaccctccagggccgtggggttggccactcattggccatatgctgactttaggtaaaaatcctcatctcgcactgtctagaatgtctcagcagtatggagatgttttacagatcaggatcggaagtacacccgtggtcgtgctttctggcctcgatacgattaggcaggccctggtgaggcagggggatgattttaaaggcaggccagatctatataccttcaccttgatttctaatgggcagtctatgtccttctcgcctgattcaggccccgtgtgggctgcacggcggcgcttggctcagaatggtcttaagagcttctcgattgcttcagacccagcctcgagcaccagttgctatctggaggaacatgtttctaaggaagcggaagtcctgatctccaccctgcaagagcttatggcaggcccagggcacttcaatccttacagatacgtggtggtcagtgtaaccaacgtcatatgcgccatatgtttcggcagaagatatgaccacaaccaccaggagctgctgtccctcgtgaatcttaataacaattttggggaagtggttggcagcggaaaccccgccgatttcattccaattctccgctacctccctaaccccagcttgaatgcttttaaagatctgaatgaaaagttttactcatttatgcaaaagatggtgaaagaacactataaaacgttcgagaaagggcacattcgggatatcaccgatagtctgatcgagcactgtcaggagaagcagctggatgagaacgctaacgtacagctctcagacgagaaaattataaacattgtgctggatctgtttggtgcaggattcgacacagtcacgacagcgatcagttggtcccttatgtacctggtgatgaatcccagggtccaacggaagatccaggaagaactggatacagtgataggacgctcccgcagaccgagactttccgacagaagtcatcttccttacatggaggcattcattcttgaaacctttaggcacagttctttcgtgccgttcacaataccccacagaaagctctgggtcaatcctagtgaatttctcccagagcgcttcttaactcctgacggcgccatcgacaaggttctatctgagaaagtcatcattttcggtatgggtaagcgtaagtgcatcggtgagaccattgcccgatgggaggtgttcctgtttttggccatcctactgcagcgcgtcgagttctcagtgccattgggcgtgaaggtggacatgacaccgatctatggccttacaatgaaacacgcatgctgcgagcactttcagatgcaactcagatcgtag

SEQ ID NO: 113633 - DNA, 1551 bp, Artificial Sequence
  Description of Artificial Sequence: Synthetic coding sequence
atggccttgtcccaatccgtccccttctcagccacggagctgctcctggcgagcgccatcttttgtctcgtattctgggttctcaaaggtctgcgcccacgagtgccaaaaggactgaagtctcctcctgagccttggggctggcctcttctaggacatgtgcttacattaggaaagaacccccacctcgcattatcccgcatgagccagaggtatggtgatgtgttacagatccggattgggtccactccagtgctggtgctttcccgcctcgacacaattcggcaagctcttgtgcgacagggcgacgactttaaaggcagaccagatctctacacttcaactctcattactgatgggcagtccctcacattttccacggactccggtccagtgtgggctgcccgccggaggctggcccaaaatgccctgaatactttcagcatcgcttccgaccctgcgtcttccagctcatgctacttagaggagcacgtcagcaaagaggctaaggctctgataagtcgcttgcaagagctaatggcgggcccaggacactttgatccatacaaccaggttgtggtgtccgtggcaaatgtgatcggagccatgtgttttgggcagcatttccctgagtcttccgacgaaatgttgtctctcgtaaaaaacactcacgaatttgtcgagacagccagttctgggaatccgctggatttcttccctattttgaggtaccttccaaaccctgccctgcagcgttttaaggcattcaaccagagatttctgtggttcctccagaaaacagtgcaggagcattaccaggacttcgacaagaatagtgttcgcgacattacaggggccctgtttaagcacagcaagaagggcccgagggcatccggcaacctcattccccaggaaaaaattgtcaatttagtgaacgacattttcggggctggcttcgacacggttaccacagctatatcctggtcattgatgtacttagtcacaaaaccagagatccagcgaaagattcagaaggagctggacaccgtgattggccgggaaaggcgcccacgcctctccgataggccacagttaccatatttagaagcgttcattctagagacctttaggcactccagcttccttccttttaccataccacactctaccacacgcgataccaccctcaacgggttttatatcccaaagaagtgctgtgtatttgttaaccaatggcaagtgaaccatgatccagagctgtgggaggatccaagcgaattccggccggagcgattcctgactgcggacggcaccgctattaataagcctttgtccgagaagatgatgttgtttggcatgggcaagcgcagatgcattggcgaggtgctggctaagtgggagattttcctcttcctggcgattctgctacagcaactggagttctcggtaccgccaggcgttaaagtggatttaacaccgatttatggtctgacgatgaagcacgctaggtgtgaacatgtgcaagcgcgcctgcgcttctctattaattag

SEQ ID NO: 113634 - DNA, 1512 bp, Artificial Sequence
  Description of Artificial Sequence: Synthetic coding sequence
atggcgttgcgtgcaaaagcggaggtctgtatggctgtgccatggttgtcactgcagcgggctcaggccctgggtacccgggctgcccgagtgccacgcacggttctcccgttcgaagcgatgccccgcaggcccggcaaccgctggcttagactgctgcaaatctggcgagagcagggctacgaagatttacatctagaggtgcatcaaactttccaggaactgggacccattttcaggtacgacctgggcggagctggcatggtctgcgtcatgctgccagaggacgtcgaaaaattgcagcaagttgatagcctgcacccacatagaatgagcctcgagccatgggtcgcctacagacagcacagggggcacaaatgtggcgtctttcttttgaacggcccggagtggaggtttaaccgtctgcgactgaacccagaggtgctttctcccaatgccgtccagcgattcctccctatggttgatgccgtagccagggatttctcccaggctctcaagaagaaagttctccagaacgcccgcgggtccctgactctggacgtgcagccatctatttttcattatactattgaggcctcaaatcttgcattatttggggagagactggggctggtgggacatagcccttcttccgcctctctgaattttctccacgccttggaagtgatgttcaagtctacagtccaattgatgtttatgccccgcagcctgtccaggtggacaagtccaaaagtgtggaaggagcacttcgaggcttgggactgtattttccagtatggtgataactgcattcagaagatttaccaggagctcgctttctcaaggcctcagcaatacacctctattgttgcagagttgctgcttaacgctgagcttagtcccgacgcgattaaagcgaactcaatggagctgacagcaggtagcgtggatactaccgtgttccctctcctcatgacactgtttgagttggccaggaatcccaatgtgcagcaggcactgcggcaagagtcattggcagctgccgcctcgatcagcgaacatccacagaaagccactaccgagttacccttattaagggcagcgctcaaagaaaccctgcggctgtatccggtcggattattcctggagagagtggcttcgagtgatctcgtgcttcaaaactaccatatccctgccggaacacttgtacgcgtgttcctttatagtctcggaaggaaccccgcgttgtttccacggccagaaaggtacaacccacagcgctggctggatatccgtgggtccgggcgaaatttttaccatgtgccattcgggtttggcatgagacaatgtttggggcggcgtctggctgaggccgaaatgctgctgctgctgcatcacgtcttgaagcacctgcaggtcgagaccttaactcaggaagacattaagatggtgtacagcttcatcttacgcccgtctatgttccccctgctgacatttcgtgcaattaactag

SEQ ID NO: 113635 - DNA, 1314 bp, Artificial Sequence
  Description of Artificial Sequence: Synthetic coding sequence
atggccctaagagcaaaagctgaggtctgtatggctgttccatggctttcccttcagcgcgcacaagcccttggcactcgcgcagccagggtccctcgtactgtcctgcctttcgaggccatgccgcgaagaccgggcaacaggtggcttcgcctgttacagatttggcgcgaacagggttatgaggacttgcacctcgaggtacaccagacgtttcaggaacttggccccattttccgctacgatctcggaggagcaggcatggtctgtgtgatgttgcctgaggatgtggagaagttgcagcaagtggattctctgcacccgcataggatgagtttggaaccatgggttgcctataggcagcaccgaggccacaagtgtggagtatttctgttaaacgggcctgagtggagatttaacagactgcgcctgaaccctgaggttctgtctcctaacgccgtgcaacggttcctgccaatggtggatgccgtcgctagagacttctctcaggccttgaaaaagaaggtgttgcagaatgcaagaggctctctgaccctggacgtgcagccatccatattccattacaccatcgaagcttccaacctcgcgcttttcggtgaacgccttggcttggttggccactcaccctcgagcgcgagcctcaattttctgcatgctttagaggtcatgttcaagagtaccgtacaactcatgtttatgcccagaagtctgtccaggtggacaagcccaaaggtttggaaggaacatttcgaagcttgggattgtatctttcaatatggtgataactgtatccagaagatttatcaggagttggcttttagccgccctcagcagtacacatccatcgttgcggaactcctgctgaacgctgaattgtcaccggacgccatcaaagccaattcaatggaactcacagccggaagcgtggataccacagtctttccactattgatgaccctgttcgaactggcaagaaaccctaatgtgcaacaagcccttaggcaggagagcttggccgccgcagcttctatttccgagcacccgcagaaggcgactacagagttgccactcctcagggcagccctgaaagagacactgaggctgtatccagtgggtctgttccttgagcgcgttgctagctccgaccttgttctccagaactaccacattcccgccggagttctgaaacatctgcaagtagaaactctcacacaggaggatatcaaaatggtttactccttcatccttagaccttccatgttcccgttgctcacattccgagctatcaactag

SEQ ID NO: 113636 - DNA, 1512 bp, Artificial Sequence
  Description of Artificial Sequence: Synthetic coding sequence
atggcactaagagccaaagctgaggtttgcgtggctgccccctggctgagcctccagcgcgctcgggccctcggcaccagggctgctagggcaccccgaactgtcttgcccttcgaggcgatgccacaacatccagggaatagatggctgcggttgcttcaaatttggagggagcagggctacgaacatcttcaccttgagatgcatcagacgttccaggaacttggcccaatcttcagatacaacttagggggtccccgcatggtgtgtgtgatgttgcctgaggacgtggagaaactgcagcaggttgacagcctacatccttgtagaatgatactggagccatgggttgcctaccgacaacatcggggccacaagtgtggggtgttcctgctgaatgggcctgaatggcgtttcaacagacttcgcttgaacccagacgtcctcagcccaaaggcagtccagcgcttcctccctatggtggatgccgtagcacgcgactttagccaggccctgaagaagaaggtactgcagaacgcaagaggctcactgacgctggatgtgcagccctcaatttttcattacaccatcgaagcatcaaacctggcgctctttggagagcgcctcggcctggtcgggcacagtccaagctccgcttctctgaactttctacacgccctcgaggtaatgttcaagagcactgtgcagttgatgttcatgcccagaagcctgtctcgatggattagtcccaaggtttggaaagaacattttgaagcttgggactgcattttccagtatggggacaactgtatccaaaaaatttatcaggaactggcctttaatcgcccacagcactacacagggattgtagctgagttattactgaaggcggagctgtcactcgaagccatcaaggcaaatagcatggaattaacggccgggagcgttgacactacagctttccctttactgatgacgctcttcgagctcgcacggaatcctgacgtccagcagatcctacgacaggaaagtcttgccgctgctgcctccattagcgaacaccctcagaaagctacaacagaattgcccctgctgagagcagctcttaaagagacactgagattgtatcctgttgggttattcctagagcgggttgttagctcagacctggtgctgcagaactatcacattcctgccggcaccttggtgcaggtgtttctgtatagcttggggcggaatgccgctttgttcccacggccggaaagatataacccacagagatggctcgatataaggggtagcggccggaactttcatcacgtcccgttcggatttggcatgcggcagtgtctgggacggaggttggcggaagcggagatgctgctgctgctccaccacgttctgaagcactttttagttgaaaccttgacgcaagaggacatcaagatggtgtatagcttcattctgcggcccggcacctctcccttgttgaccttcagggcaatcaactag

SEQ ID NO: 113637 - DNA, 1527 bp, Artificial Sequence
  Description of Artificial Sequence: Synthetic coding sequence
atgtgggagttggtggcactcctgctcctgacgctggcttatctgttctggcctaaacgcagatgtcctggggctaaataccccaaaagccttctgagcctcccccttgtgggaagcttgccgtttctgcctcgtcacggacacatgcataacaatttctttaagctccagaaaaaatatggtcctatctattcagtacgcatgggaacaaagactaccgttatcgtgggacaccatcagctggccaaagaagtgttaatcaagaaagggaaagactttagcggtcggccccaaatggccactttggacatcgcctccaataatcggaaaggtatagcctttgccgattctggggctcattggcagcttcaccgtcgacttgctatggcaaccttcgccttattcaaggacggagaccaaaagctggaaaagatcatctgtcaggaaatttctaccctgtgcgacatgctggctacacacaatggacaatcaattgatattagtttcccagtatttgtggccgtaacaaacgtcatcagccttatctgttttaacacaagttataagaatggcgatcccgaactaaatgtgatccagaattataatgagggtataattgataacctgagtaaggattcattagttgacttagtaccatggctgaaaatttttccaaacaagacacttgagaagcttaagagccatgtgaagatcaggaacgacctgttgaacaaaatcttagaaaactataaagaaaagtttcggagcgatagcatcacaaatatgctcgacacactgatgcaggccaagatgaattcagacaacggcaacgctggccccgatcaggactccgagctcctctctgataatcatattctgaccactataggcgacatcttcggggcaggcgtcgaaactactacctccgtcgtcaagtggacactggcatttctactccacaaccctcaggtcaagaaaaagctgtacgaagaaattgatcagaatgtgggattttcgcgaacccctaccatatcggatcgcaaccgattgctcttgcttgaggccaccatcagggaggtgctccggctgaggcctgtggcccccatgctcatcccgcacaaggccaatgtcgattcgtctatcggcgagttcgcagtcgacaaggggaccgaagtgattattaacctgtgggcactgcaccataacgagaaagaatggcatcagcccgatcagttcatgcctgagcggtttttgaaccccgcaggaacacagttgatatccccgtctgtctcttacctgccctttggtgctgggccaagatcctgtattggtgagatacttgccagacaagagctgttcctgatcatggcatggctcctgcaaagattcgacctcgaagtgcccgacgacggccagctcccatcactcgagggcatccccaaagtggttttcctgatagatagttttaaagtgaaaatcaaggtccgccaagcttggagggaagcgcaggcagaaggcagtacctag

SEQ ID NO: 113638 - DNA, 1512 bp, Artificial Sequence
  Description of Artificial Sequence: Synthetic coding sequence
atggtgctggagatgctcaaccctatacattataacatcacgtcaatcgtccctgaggcgatgccagccgctacaatgcccgtgctgctgctaacaggcctgttcctacttgtgtggaactacgaaggcacaagttctattcctgggcctggatattgtatgggaatcggccctttaataagtcatggtcggttcctgtggatgggtattggttctgcttgcaactattacaaccgagtctacggtgaatttatgcgggtgtggatctctggtgaggagactttgatcattagcaagtcctcctcaatgttccacatcatgaaacataatcactattcgtctaggttcggatcaaagctcgggctacagtgtattggcatgcacgaaaagggaatcattttcaacaacaacccagagctttggaaaacaacacggccgttttttatgaaagccctgtcaggacccgggctagttcgcatggtgacagtgtgcgcggagagtttgaagacacatctggaccgcctggaggaagttaccaatgagtccgggtacgtggacgtcttgactttactgcgacgggtgatgcttgatacctccaatactctgttcctgaggatccccttggacgagagtgccatcgtggtgaagattcagggctactttgatgcatggcaggcccttctgattaagcccgatattttttttaagatttcgtggctgtataaaaaatatgagaagtctgtgaaagacctcaaggatgctatcgaagtccttatcgccgagaaaaggaggagaatctccactgaagaaaaactcgaggagtgtatggattttgccactgaactcatcctggccgagaagagaggggacctgacacgtgaaaatgttaaccaatgtatccttgagatgctgatagcagctcccgacacaatgagcgtcagtctttttttcatgctgttcctgatcgctaagcacccaaacgtggaggaggccattatcaaagaaatccagaccgtcattggagagcgcgacatcaaaatcgacgatatccagaagctgaaagtcatggaaaattttatctatgagtctatgcggtatcagccagtcgtggacctggtaatgcgcaaggcactcgaagacgacgttattgacgggtacccagtgaaaaagggtactaatatcatcctgaacatcggccgaatgcaccgtctagaattttttcctaaaccaaacgaatttacactggagaactttgcaaagaatgttccttacaggtactttcagccatttggcttcggccccagaggctgtgccggaaaatatatcgccatggtcatgatgaaagccatactggtaaccctcttacgcagatttcacgttaaaaccctgcaggggcaatgcgtggagtccatccagaagattcacgatctcagtctacacccagatgagactaaaaacatgctggaaatgattttcacccctcggaattccgaccgctgcctcgaacattag

SEQ ID NO: 113639 - DNA, 1512 bp, Artificial Sequence
  Description of Artificial Sequence: Synthetic coding sequence
atggtgctcgaaatgctgaacccaattcattataacatcactagcatcgtcccagaagccatgcctgcagctaccatgcctgttctgctgcttaccggcctgttcctgctggtatggaactacgagggtacctctagcatacctggaccaggctactgcatggggattggaccactgatctcccatggtagattcctgtggatgggcataggctcggcttgtaactactacaatagggtctatggcgaattcatgcgcgtgtggatatccggtgaggaaaccttgatcatcagtaaaagctcgagcatgttccacatcatgaagcacaaccactactcgtctagattcggcagcaagctcggcctccagtgcatcggcatgcacgagaaagggatcatcttcaataataaccccgagctatggaaaacaacacgcccattttttatgaaggccctgtcgggccctggactcgtccgcatggtcaccgtctgcgctgaatcactaaagactcacctggataggctggaagaagtgacgaatgaatcagggtacgtcgacgttctgacactactccggcgcgtcatgctggataccagcaacaccctctttctgagaattcccctagatgaaagcgccattgtggtgaagatccagggctactttgacgcttggcaggcgctgctgattaaaccagacatattctttaaaatctcatggctttataagaagtatgaaaagtctgtgaaggatctgaaagacgcaatcgaagtgttgattgcagagaaaagaagaaggatcagcacagaggaaaagttggaggagtgtatggacttcgccaccgaactaattcttgcagagaagcggggcgaccttacacgggaaaacgtcaatcagtgcatcttggaaatgctcattgcagcccctgacactatgagtgtcagtctcttctttatgctgttcctgattgccaaacaccctaacgtggaagaagcaataattaaggaaatccagactgtgattggtgagcgcgatattaaaattgatgacattcagaagctgaaggttatggagaattttatttatgaatcaatgagatatcagcctgtcgtggacctggtgatgcgaaaagctctggaggatgacgtcattgatggctatccagtaaagaaaggtaccaacattatcctcaacatcggaagaatgcatcggctggagttctttcctaagcctaacgaatttacactggagaacttcgctaagaatgtcccctaccggtacttccagccttttggatttgggccacggggatgcgccgggaaatacatcgcaatggtgatgatgaaagccatccttgtgactcttctccgtcggttccatgtaaagacactgcagggccagtgcgtggagagcatccagaagatccacgatctgagcctgcaccccgacgagacaaaaaacatgttagagatgatctttacacctcgcaattcagacaggtgcctggagcattag

SEQ ID NO: 113640 - DNA, 1512 bp, Artificial Sequence
  Description of Artificial Sequence: Synthetic coding sequence
atggttctggagatgctcaatccaatacactataacatcacctctatcgtgccagaggccatgccggcagccaccatgccagttctcctactgacaggcctgttcctgctcgtgtggaactacgaaggaacatcctctatccctggccctggatattgtatgggtatcggtcccttaatctcccacggtagattcttgtggatgggcattggttcggcgtgtaattattacaacagagtatatggcgaatttatgcgggtctggattagcggggaggaaactctgattatcagcaaaagcagcagtatgtttcatatcatgaagcacaaccattatagctctcgattcggatctaaacttgggctgcagtgcataggcatgcatgaaaagggcattatattcaataacaaccccgaattgtggaaaactacaaggcccttttttatgaaggccctatcgggccccggactggtaaggatggtaactgtctgtgcagaatcactcaaaacacacctggatcggttggaggaagtgaccaacgagagcggttacgttgacgtcctcacattgctgaggagggtaatgctcgacacaagcaacaccctattcctgcggattcccctggacgaatccgccattgtcgtgaaaatccaggggtatttcgacgcctggcaagcactgctgattaagcccgatatattcttcaagatttcctggctctacaagaagtacgaaaaatctgtgaaagatttaaaagatgcaattgaggtgttgattgctgagaaacggcggcgtatatccaccgaggagaagttagaggaatgtatggactttgccactgagctaatcctggcggaaaaacggggagacctgacccgggagaacgtgaatcagtgcatcctcgagatgctgatcgctgcccctgacacgatgtcagtctccctgtttttcatgctctttctgatagcaaagcatcctaatgtcgaggaggctatcattaaagaaatacagaccgtaattggagagagagatatcaagattgatgacattcagaagttaaaagttatggaaaacttcatctacgagagcatgcgataccaacctgtcgtggacctggtgatgcgaaaggcattagaggatgatgtcatcgatggctatcccgtcaaaaaggggacaaatatcatcctgaacatagggcgcatgcaccgactcgagttctttccaaaacctaacgaatttaccctggagaatttcgcaaagaacgttccctaccgatatttccagccattcggatttggaccaagaggctgcgctggtaagtacattgctatggtcatgatgaaagccatccttgtgacccttctgcgcaggtttcatgtgaagacactgcaggggcagtgcgttgagagtatccagaagattcatgatttgtcgttgcatccagacgagactaagaacatgctggagatgattttcactccccgcaactccgatcgctgtctcgaacattag

SEQ ID NO: 113641 - DNA, 501 bp, Artificial Sequence
  Description of Artificial Sequence: Synthetic coding sequence
atggtcctggagatgttgaatcccattcattacaacattacctctatcgtacccgaagcgatgcctgccgccacgatgcccgtgcttttgctgaccgggctttttctactggtatggaactacgaggggacaagctctatcccagggcctggttactgtatgggaattgggccattgattagtcatggccgattcctgtggatgggtattgggtcagcatgtaactactataatagagtgtatggtgaattcatgagggtctggatttccggcgaggagactttgattatctccaagagtagtagcatgtttcatataatgaagcacaaccactactcctctcgctttgggtccaaattgggactccagtgtatcggtatgcacgaaaaaggcatcatttttaataacaacccagagttgtggaagacaactcggcctttcttcatgaaggcactcagtggaccaggactggtgcggatggtaaccgtgtgtgccgagtag

SEQ ID NO: 113642 - DNA, 657 bp, Artificial Sequence
  Description of Artificial Sequence: Synthetic coding sequence
atggttctggagatgctcaacccaattcattataacatcacaagtatcgtacccgaggccatgcccgcagcgaccatgcctgttttactcctgacgggcttgtttttgctcgtatggaattacgaaggtacctcatcaattccagggccaggttattgtatggggatagggccactgatttctcacggacggtttctttggatgggtattggctccgcctgcaattattataatagggtctacggtgaattcatgagggtgtggatctccggcgaggagaccctgatcatctccaagagctcctcgatgtttcacatcatgaagcacaatcactactcgagtagattcggctcgaaacttgggcttcaatgtattggtatgcatgagaaagggattatcttcaataataaccccgagctgtggaagacaacaagacccttttttatgaaagcgttgtccgggccgggtctggtccggatggttaccgtgtgtgccgagtcactaaagacacatctcgaccgtctggaagaggttaccaatgaaagcggatatgttgatgtgctgacgctcttgagaagagtcatgcttgacactagtaacacactgttcctgcgaattcctctggacggcacagagatcttcactctaacgtcttag

SEQ ID NO: 113643 - DNA, 1080 bp, Artificial Sequence
  Description of Artificial Sequence: Synthetic coding sequence
atggtcctcgagatgttgaaccccatccactacaacatcacttcaattgtgccagaggccatgcccgcagctactatgcctgtgctgctgctgacagggctcttcctgctcgtctggaattatgaaggcacaagtagcatccccgggccggggtattgcatgggcatagggcccctgatatcccatggcagattcctatggatgggaatcgggagcgcctgcaattattataatcgggtgtacggcgagttcatgcgagtatggatttccggggaggaaacacttataatctccaaaagttctagcatgttccacataatgaaacacaatcactatagctccaggtttggtagtaagctgggattgcagtgcattgggatgcacgagaaaggaattatttttaacaataacccagaactttggaaaacaaccaggccattcttcatgaaagctctgtccggtcctggacttgtccggatggtaacagtctgtgcggaaagcctgaagacacatttggatcggctggaggaagtcactaacgaaagcggatacgtagacgtgctgaccttgttacgtagggtgatgctcgacaccagcaacaccctcttccttcgtatccccttggacgaatctgctatcgttgtgaaaattcagggatacttcgatgcctggcaggcgctgctgatcaagccagacatcttttttaagatctcttggctgtataaaaagtacgaaaagagcgttaaggatctcaaggacgccatcgaagtgctgatcgccgaaaaaagaaggcgtatcagcacagaggaaaagttagaagaatgcatggattttgccaccgaactgattttggccgaaaaacgtggggacttgacccgggaaaacgtcaatcaatgcattctagaaatgctcatagctgcccctgatactatgagtgtgagtctcttctttatgctcttcctgattgccaagcaccccaatgttgaggaggccatcatcaaagagattcaaacagtcatcggcgagcgtgatattaaaatagacgacatccagaaactgaagaagcatgatgcaaaatag

SEQ ID NO: 113644 - DNA, 1059 bp, Artificial Sequence
  Description of Artificial Sequence: Synthetic coding sequence
atggtgctagagatgctcaatcccatccactataacataaccagtatcgtgccggaggctatgcccgctgccacaatgcccgttctcctgttgactggcctgttcctgctggtctggaactacgaagggacctcgagtatccctggccccggctactgcatggggataggaccactgatctcacacgggcggtttctctggatgggaatcggttccgcctgtaactattataatagggtgtacggcgagtttatgagagtgtggatctctggcgaagagactctaattatctctaagtcaagctctatgttccatattatgaagcataaccattattccagccggtttggtagcaagctggggctacaatgcataggcatgcatgagaagggcataatctttaacaataatcccgagctgtggaagacaacccgaccatttttcatgaaagccctgtctggcccgggcctggtgagaatggttacggtgtgtgcggagtcgttaaaaacccacctcgatcgtcttgaggaggtcactaatgaatccgggtatgttgacgtgctgaccctgctgcggagggtgatgctggataccagcaataccctgttcctaagaatacccctggatgagagcgccatcgtggtgaaaatccaaggttatttcgatgcatggcaggcgttgctgattaagcccgacatcttcttcaagattagttggctctataagaagtatgagaagtccgtgaaggatctaaaggacgcaattgaggtgctgatagccgaaaagcgtcgtcggatctctaccgaagagaaacttgaggaatgcatggacttcgcaacagagctgatactggcggaaaagcgcggtgatctcacacgcgaaaatgtgaaccagtgtattctagagatgctcatcgcggcccccgatactatgagcgtgagtttgttctttatgttgttcttgatcgccaaacaccccaacgtggaggaggccatcatcaaggaaatacagacggttataggggaaagggatattaagattgacgacatccagaagtag

SEQ ID NO: 113645 - DNA, 729 bp, Artificial Sequence
  Description of Artificial Sequence: Synthetic coding sequence
atggtgcttgagatgcttaatcccatacattataatattacctcgatagtgcctgaggcaatgcccgccgccactatgccagtgttactccttaccgggttgttcttactggtctggaattatgagggcacatccagcatccccggtccagggtattgtatgggaataggcccattgatttctcatggcagatttctttggatgggtattgggagcgcatgtaactattataacagggtctacggggagttcatgcgagtgtggatcagcggtgaagaaactctgataatttcaaagtcctccagtatgtttcacatcatgaagcataatcactactcttctaggtttggctcgaaactggggctgcagtgcatcggaatgcatgaaaaaggcatcatattcaacaataaccccgaattatggaaaaccacacggccattctttatgaaggcactgtcaggtccaggcctggtgaggatggtgaccgtgtgtgcagaaagcctgaagacacacctggaccgacttgaagaggtcaccaatgaaagcgggtatgtggatgtgctgactctcctgagaagagttatgctggacacctctaatactctgttcttacgaatccctctggatgagagtgccatagttgttaagatacagggttactttgacgcctggcaggcactcttgataaagcccgacattttctttaagatctcctggctgtacaaatag

SEQ ID NO: 113646 - DNA, 546 bp, Artificial Sequence
  Description of Artificial Sequence: Synthetic coding sequence
atggtgcttgagatgttaaatccaatccattataatatcacgagtatcgtgcctgaggccatgcccgcagccaccatgccagtgttgctcctgactggcctgtttctgctcgtatggaattacgagggtacgtcatcaatccctggaccggggtactgcatgggcatcggacccctgatttctcacgggcggttcctgtggatgggcattggctcagcctgcaactattataatagggtgtatggggagtttatgagggtgtggatctccggggaagagacgctgatcatttccaaaagctccagtatgtttcatattatgaaacacaatcattattcttcccgattcgggagcaaactggggcttcagtgcatcgggatgcatgaaaaggggatcatcttcaataataatcccgaactttggaagacaactagacccttctttatgaaggctctatcagggcccggactagtgcgtatggtcactgtgtgcgcggagtctttaaagacacatcttctcctgtttactccggcctccgtcaactag

SEQ ID NO: 113647 - DNA, 657 bp, Artificial Sequence
  Description of Artificial Sequence: Synthetic coding sequence
atggtcctggagatgctgaaccccattcattataacattacctccattgttcccgaggccatgcctgctgccaccatgccggtactgttactaacaggactgttcctgctggtctggaattacgagggtacctctagtattccgggacccggatattgcatgggaattgggccactcattagccatgggcggtttctctggatgggcatagggtcggcttgtaattattacaacagagtgtacggggagttcatgcgtgtttggatttcaggagaagagacattaatcatcagcaaatcaagctcaatgttccacatcatgaagcacaaccattatagtagccgatttggaagtaagctgggtcttcagtgcatcggcatgcatgagaagggcataatcttcaataataatcctgagttgtggaagacaacaagaccctttttcatgaaggctctgagtggcccaggattagtgcgcatggtaaccgtatgtgcagagtctctgaagacccacctggatcggttggaagaagtaaccaatgagagtgggtacgttgacgtcctgacactgttgagaagagttatgctggatacctccaacaccctctttctccgcattccacttgacggtaccgagatttttactctgacgtcttag

SEQ ID NO: 113648 - DNA, 1059 bp, Artificial Sequence
  Description of Artificial Sequence: Synthetic coding sequence
atggtcctggaaatgctcaaccctatccactacaacataacctccatcgtgcccgaagccatgcctgccgccacaatgcccgtcttactgctcacaggcctatttctgcttgtgtggaactatgaagggacatcaagtatacctggacccggatattgcatgggtatcggaccactgatctcacatggccgcttcctgtggatgggcataggttctgcttgcaattattacaaccgggtttacggggagttcatgagggtttggatttctggtgaggagacactgataattagtaagtcatcaagtatgtttcatattatgaagcacaaccactacagctctcggtttgggtcaaaactcggtcttcaatgcataggcatgcacgagaaaggtattatttttaataacaatccagaactctggaagaccacccgcccattcttcatgaaagccctgagcggccccggcctggtcaggatggtgactgtctgcgcagagtctctaaaaacccatctggataggctcgaagaagtgacgaacgaatcagggtacgtcgatgtgctgactctgctgaggcgggttatgttagacacatctaatacactgttcctcagaattccattagatgagagcgccattgtggttaagatccagggctattttgacgcctggcaggctctgttgataaagcccgacatcttcttcaagattagttggctttacaaaaagtacgaaaaatccgtgaaggatctgaaggacgctatcgaggttctgatcgctgagaaacgccggcgcatcagtaccgaggaaaaacttgaggagtgcatggacttcgctacagaactgatacttgcagagaaacggggcgacctcacgcgagaaaatgtgaaccagtgtatcttagagatgctaatcgccgcccctgataccatgagcgtgagcctgtttttcatgctttttttaatcgctaagcaccctaatgttgaggaagcaatcatcaaggagattcagacagtgatcggagaaagggacatcaaaatcgatgatattcaaaaatag

SEQ ID NO: 113649 - DNA, 852 bp, Artificial Sequence
  Description of Artificial Sequence: Synthetic coding sequence
atggtcttagaaatgttaaaccccatccattataacattacgtctattgtgccagaggccatgccagctgccacgatgccagtgctgctactgacaggccttttcctgctggtgtggaactacgaaggcacatcttcaatccccggacccggatattgcatgggcattgggccacttataagccacggacggtttctgtggatggggatcggcagcgcgtgtaactactacaatcgcgtttacggggagttcatgcgcgtttggatttccggggaagaaactcttattataagcaaatcgagttctatgttccacatcatgaaacataatcattacagcagtcggtttggcagtaagctgggacttcagtgcatcggaatgcatgagaagggcatcatctttaacaataatcccgagttatggaagactactcgcccttttttcatgaaagcactgagtgggccgggcctggtcaggatggtgactgtctgtgccgaatctctgaagacccacctggaccggttggaagaggtgaccaacgaatccggctacgtcgatgtgctgacactactgaggcgggtcatgttggatacaagtaacactttgtttctgcgcatccccctggacgagtctgcaattgtagtaaagatccagggatacttcgatgcatggcaagcactactaatcaagcccgatattttctttaagatctcatggctctataaaaaatacgagaaaagcgtaaaggatctgaaggatgcaatagaggtactgattgccgaaaaacgacggaggatctccactgaagagaaattagaagaatgcatggattttgccacggagctgatttag

SEQ ID NO: 113650 - DNA, 498 bp, Artificial Sequence
  Description of Artificial Sequence: Synthetic coding sequence
atggtgttggaaatgctgaaccctattcactacaacataaccagcatcgtaccagaggcgatgcctgccgcgactatgcctgtgctgcttctgaccggcttatttctgttggtttggaattacgagggaacttccagcatccccgggcccggctactgcatggggatcgggcccctcatttcgcacggccgttttctgtggatgggcatagggtccgcctgtaactattacaacagagtgtacggtgagtttatgagagtctggatatctggagaagaaacactgataatcagcaaaagttccagtatgttccatattatgaaacataatcactacagcagccgctttgggtccaagcttggcttgcagtgcatagggatgcatgaaaaaggtatcattttcaataataaccctgaactgtggaaaaccacgcggccattttttatgaaggcactttcagggccagggttggtgaggatggtgacagtctgtgcttag

SEQ ID NO: 113651 - DNA, 1512 bp, Artificial Sequence
  Description of Artificial Sequence: Synthetic coding sequence
atggtgctggaaatgctgaaccctattcactacaacatcaccagtatagtcccagaagctatgccagccgccactatgccagttctgctccttacaggtctctttcttttagtttggaactatgagggaacctccagtatccctgggccaggctattgcatgggcattgggcctcttatttcccacggtaggttcctctggatgggaattggttctgcctgtaattattacaaccgtgtatacggcgaattcatgcgagtttggatctcaggcgaggaaactctgattatatctaagtccagctcaatgttccacatcatgaagcacaaccattacagcagcaggttcggaagcaaactcggtctccagtgcatcggaatgcacgaaaaaggaattatttttaataacaacccagagctgtggaagaccacaaggcccttcttcatgaaggcccttagcggtccaggtctggtgcgcatggtaaccgtgtgcgccgagtccctgaagacgcatctcgatagactggaggaagtgacaaatgaaagtggatatgtagatgtgctgactctcctgaggcgggtgatgctcgacacttctaatactttgttcttacggatcccgctggacgagagcgctatcgtagtgaagattcaaggctatttcgatgcgtggcaagccctgttgatcaagccggatatatttttcaagattagctggctgtacaaaaagtacgaaaagagcgtgaaagatctgaaggatgccattgaagttctcatcgccgaaaagaggcggcggattagtaccgaagagaagctggaggaatgtatggacttcgccactgaactgattttggctgagaagcggggggatctgacaagggagaacgtgaatcaatgcatcctggagatgcttattgccgcgcccgataccatgagcgtcagtctcttcttcatgctattcttgatagcaaaacaccccaacgttgaggaagcgatcatcaaagagatacagacggtaatcggggaaagagatattaaaattgacgacatccagaaactgaaggtcatggaaaattttatttatgaatcaatgcgctaccagcccgttgtggatttagtgatgcggaaagccctcgaggatgatgtgattgatggttatccagtcaagaaaggcacgaacattatcttaaacataggaagaatgcacaggcttgagttctttcccaagccgaatgaatttaccctggagaattttgctaagaacgtgccataccgctactttcaaccctttggcttcgggccaaggggctgtgccggcaaatatatagcaatggtgatgatgaaggccatactagtgaccctcttgaggcgtttccacgtgaagacactgcaggggcaatgtgtagagtcaatccagaagatccacgatctatcccttcaccccgatgaaaccaagaacatgcttgaaatgatatttacgccaagaaatagcgatcgctgcctggaacactag

SEQ ID NO: 113652 - DNA, 519 bp, Artificial Sequence
  Description of Artificial Sequence: Synthetic coding sequence
atggtccttgagatgttaaatccaatacattacaacattacttctatcgtgccagaggccatgcctgccgcaaccatgccggttttgctcctcacagggctgttcctgctggtgtggaactacgaaggcacttccagcatacctggccccgggtattgcatggggatcggccctctcatcagtcacggtagatttctgtggatgggcattgggagcgcctgtaactattacaatcgtgtctatggcgagttcatgagagtgtggatatcaggcgaggaaaccctgataatatccaagagctcctcaatgttccacatcatgaagcataatcactactcgagccgtttcggctccaaactgggcctgcaatgcataggcatgcatgaaaaggggattatttttaataacaacccggagctgtggaaaaccactagaccattctttatgaaagctctctcaggaccagggttggtgagaatggtcacagtctgcgctgaatcactcaaaacacacttgtag

SEQ ID NO: 113653 - DNA, 735 bp, Artificial Sequence
  Description of Artificial Sequence: Synthetic coding sequence
atggtgcttgaaatgctgaatcccatacactacaacataaccagcattgtgccggaagcgatgccggcggccacaatgcctgtgctgctgctgaccggcctctttctgttagtgtggaactacgaggggacctcttctattccaggccctggatattgtatgggtattgggcctcttattagccacggtaggttcctgtggatggggataggttccgcctgtaattattataatcgcgtgtacggcgaatttatgagggtttggatatctggcgaagaaactctgattatttctaaatcctcaagcatgttccacattatgaagcacaaccattattctagcaggttcggctctaaactggggctgcaatgcattggtatgcacgagaaaggaattatctttaataataatcccgagctttggaaaacaacacgccccttcttcatgaaggagagcgccatcgtagtaaaaattcagggatattttgacgcctggcaggctcttcttatcaaaccagacattttttttaaaatctcctggctttacaagaagtacgaaaagtccgtgaaggacctgaaggacgcaatcgaagtgctgatagctgagaaaaggagaaggatatccacggaagagaagctcgaggagtgcatggattttgcgactgaactgatcttagctgagaagcgtggtgacttgaccagggagaatgtcaaccaatgtatcctcgaaatgtag

SEQ ID NO: 113654 - DNA, 1485 bp, Artificial Sequence
  Description of Artificial Sequence: Synthetic coding sequence
atgctggcctccgggctcctcctggtcacgctgctggcttgcctgacagtcatggttctgatgagcgtctggaggcagcgcaagtcccgaggcaaactgccgcccggacccacacccttacccttcattggcaattaccttcagctcaatactgagcagatgtacaatagtctgatgaagatatccgagcgctatggacccgtattcactatccacctgggccctcgacgcgttgtggtgctgtgcggccacgatgccgtgaaagaagcactcgtagatcaggctgaagaattcagcggcagaggtgaacaagcaaccttcgattggctgttcaaggggtacggcgtggctttcagtaatggcgaaagagcgaagcagctgagacggttctccatagcaactctgcggggattcggcgtgggaaagcgaggcatcgaggaacgcattcaggaggaagccggcttcctcattgacgcgctccgggggacccatggcgcaaacattgaccccacgttctttctgtcccgcactgtgtctaacgtgatttccagcatcgtcttcggcgatagattcgactacgaggacaaggaatttttaagcctcctgaggatgatgctggggtccttccagtttactgctactagtactggccagctgtatgagatgtttagctccgtcatgaagcatctgcccggtcctcagcagcaggctttcaaggaactgcaggggttagaggatttcatagccaaaaaggttgagcacaaccagcggacacttgatcccaacagccccagagactttatcgatagtttcctgatccggatgcaggaagaggaaaagaatccaaacactgagttctacctgaaaaacctggtcatgaccaccctcaatctcttttttgccggtaccgagaccgtctccacgacattgcggtatggattcctcctcttgatgaagcatcctgaggtggaagctaaagtgcacgaagagatagatcgggtcatcgggaaaaacagacagcctaagtttgaagaccgagctaagatgccgtacacagaggccgtgatccatgaaatacagcgattcggagatatgctcccaatggggttggctcatcgtgtgaacaaggatactaagtttcgcgattttttcctccccaaaggcactgaagtcttccctatgctcggctccgtgcttcgcgacccaaggttttttagcaatccccgagacttcaatccacagcacttccttgacaaaaaaggacaatttaagaagtctgatgcattcgtgcctttcagtattggtaagcggtactgtttcggagagggtttggcacgaatggaattatttctgttcttcactaccataatgcaaaacttccggttcaaatccccacaaagtcccaaggatattgatgtatctcccaagcacgtgggctttgctactattccccgtaattacactatgtcttttttaccgaggtag

SEQ ID NO: 113655 - DNA, 1485 bp, Artificial Sequence
  Description of Artificial Sequence: Synthetic coding sequence
atgttagcaagcggcatgctcttagtggcccttctcgtctgcctcacggttatggttcttatgagcgtgtggcagcagagaaagtccaagggaaagctgccaccagggccaacccctctgcccttcatcgggaattacctgcagctgaatacagaacagatgtataactccttgatgaagatctcggaacgctacgggcccgtgtttacgattcatttgggaccaagacgcgtggttgtgctatgtgggcatgacgctgttagggaagccctggtcgaccaggcagaagaattcagcgggcgtggcgagcaggccacattcgactgggtattcaagggctatggcgtagtattcagtaatggggagagagccaagcagctgagacggttttcaatcgccacgctgagggatttcggagtggggaagagagggatcgaagagcgcatacaggaagaagcaggattcctgatcgatgctctgcgaggcaccggcggggccaacatcgatcccaccttcttcttaagccgtacggtgagcaacgttatatccagtatcgtgtttggcgataggttcgactataaggacaaggaattcctttctcttttacgcatgatgctcgggatcttccagtttacttctacttcaaccggtcagctgtatgaaatgttctcttctgtgatgaagcacctgccagggccccaacagcaggcattccagctactgcaggggctggaagattttatcgctaaaaaagtggaacacaatcaacgaacccttgatccgaacagtccccgcgatttcatagacagctttttgataaggatgcaggaagaagagaaaaatccgaataccgagttttatctcaagaatctcgtcatgaccaccctgaatctgttcatcgggggtaccgaaactgtgtcgacgacactgcggtacggcttcctcctactcatgaagcaccctgaagtggaggcaaaggtgcatgaagagattgaccgagttattgggaagaatagacagcctaaatttgaagacagggcgaagatgccatacatggaggctgtaatacatgaaattcagcggtttggcgacgtaatccccatgtctctggcccgcagggtcaaaaaggacaccaagtttagagacttcttcctgcctaaggggactgaggttttcccaatgctgggctctgtgctccgagatccatcattctttagtaatccacaggatttcaatccccagcactttttgaacgagaagggacagttcaaaaaatctgacgcatttgtacctttttccattggaaagcgtaactgttttggcgaagggctcgcgcgtatggaactcttcctgttctttaccacagttatgcaaaattttcgtctgaagagttctcagtccccaaaagacattgatgtgagccccaagcatgttgggttcgccacgattcctagaaactatacgatgagttttcttccccgctag

SEQ ID NO: 113656 - DNA, 1332 bp, Artificial Sequence
  Description of Artificial Sequence: Synthetic coding sequence
atgttggctagcggtctgcttcttgtagccctgctggcttgcctgactgtcatggttttgatgagcgtgtggcaacagcgcaaatctagagggaagctccccccaggaccaacgccacttccattcataggtaactaccttcagctcaacactgagcacatatgtgactcaatcatgaaggtttctcagggcgtagccttctctaacggagaaagggctaagcaattactccggttcgctatagccacactgcgagactttggcgtcgggaaacggggcatcgaggagagaatccaggaggagtccggatttttgattgaggcaatccgaagcacccacggcgccaatatcgatcccacgttctttctctcacgaacagtatcaaatgtgatttccagtatcgtgttcggcgatcgctttgattacgaggataaggaattcctctcactgttatccatgatgcttgggatttttcagttcacgagtacttccaccggccagctgtacgagatgttcagtagcgtgatgaagcatttgcccggcccgcagcaacaagccttcaagctgttgcagggactggaagatttcatcgctaaaaaagtggaacataatcagaggactctcgatcctaacagtccacaggattttatagactcattccttattcatatgcaggaggaggaaaagaatcccaacactgaattctatctcaagaacctcatgatgtccaccttgaacctattcatcgcgggcacagagacggtcagcaccaccttgagatatggctttctgctcttaatgaagcaccccgaggtggaggctaaggtccacgaggagattgacagagttataggcaagaacaggcagcccaagtttgaggacaggacgaaaatgccttacatggaagctgttattcatgagattcagcgattcggtgacgtgattcccatgagtctcgcacggagagtcaaaaaggacacaaagtttcgcgacttttttttgcccaagggaactgaggtgtttccaatgctggggtcagtgctgcgcgatccaagcttttttagtaatccccaggactttaatccccaacattttctggatgacaaggggcagttcaagaagtccgatgcttttgtacccttttcaatcggcaagaggaattgctttggcgagggacttgctcggatggagctgttcctgttctttaccactgtgatgcaaaactttcgcctgaagagctcccaatcacctaaagacattgacgtgtcccctaaacatgtcgtgttcgctactatcccccgcaattacacaatgtctttccttcctcgctag

SEQ ID NO: 113657 - DNA, 1485 bp, Artificial Sequence
  Description of Artificial Sequence: Synthetic coding sequence
atgttggcttcagggctgttactggtcgctttacttgcctgtttgaccgtaatggttctgatgagtgtatggcagcagcgtaaaagccgcgggaaactgcctccaggacctaccccattgccattcattggaaactatctacagctgaacacggaacacatctgcgattcgattatgaagttcagtgaatgttacggcccagtattcactatccatctcgggccacggagggtggtagtgctctgcggtcatgatgcagttagggaagcgctggtggaccaggccgaagagttctcaggccgaggagaacaagccaccttcgactgggtgttcaagggttacggggtggcttttagtaacggggagagagcaaaacaacttttacggtttgcgatagccacattgcgcgatttcggagttggcaaaaggggcatagaggagcgcatccaggaggaaagcggctttttaatcgaagccatcaggagcacccacggcgcaaatattgatccgactttttttctgtcacgcactgtgtcaaacgtgatctctagcatcgtgtttggtgatcgatttgactacgaagacaaggaatttctctctctcctgagtatgatgctgggaatcttccagttcacctccacatcaaccggacagttgtacgagatgttttcctccgtgatgaaacatctacccggaccccagcagcaggcattcaagcttctgcaggggctggaagattttatcgcaaagaaagtcgagcacaatcaacgcaccctcgatcctaatagcccccaggattttatcgattccttcctgattcacatgcaggaagaagagaagaatcctaacaccgagttttacttgaaaaacctgatgatgtccaccctgaacctgttcattgccgggactgagaccgtctcgaccaccctccggtacggatttctgctcctcatgaagcatccggaggtcgaggcaaaggtccacgaggaaatagatcgagtgatcggcaagaacagacagcccaaattcgaggatcgcaccaagatgccttacatggaggccgtcatccatgagattcaaagatttggcgacgtaattcccatgtctctcgcgaggagggtgaaaaaggatactaagtttcgcgacttcttcctgcccaaaggaacagaggtgttccccatgctcgggagcgtgcttcgagacccatcatttttcagcaatccccaagacttcaaccctcaacattttttagatgataaaggtcaattcaagaaaagcgacgcttttgtgcctttttctataggcaagaggaactgcttcggggagggactggctcgaatggaattattcctctttttcaccacagtgatgcagaatttccgactcaaatccagccagagtccaaaggatatagacgtctcacctaaacacgtagtgttcgcgaccatcccccgcaactataccatgtcattcttgccacgttag

SEQ ID NO: 113658 - DNA, 1476 bp, Artificial Sequence
  Description of Artificial Sequence: Synthetic coding sequence
atggagctttctgtcctgttgttcctggcactgttaactgggctgctgctgctgctggtgcagcgtcaccccaatacacacgatcgccttcccccaggccccaggcctctgcctctattaggcaatctgctgcagatggatagacgcggtctcctcaagtcctttctccgctttcgggaaaagtacggggatgttttcacagtgcacctcggaccgagaccggttgtgatgctgtgtggtgtcgaagccatccgcgaggccctcgtggacaaggcggaggctttttccggaaggggcaagatagctatggtggacccattttttagaggatacggagtgatttttgccaatggcaacaggtggaaagttctaagaagattctctgtgacgactatgagggactttgggatggggaaacgaagtgtggaggaaagaattcaggaagaggcacagtgcctgatcgaggagctgcgaaagtctaaaggggctctgatggaccccacttttctgttccaatccatcactgccaacatcatctgttctatcgttttcgggaagcgatttcattaccaagaccaggaatttctgaagatgctcaatctgttctaccagactttcagtctgataagcagtgtcttcgggcagttattcgagctgtttagcggatttcttaaatatttcccaggggcccaccggcaagtgtacaagaatctgcaagagattaacgcctacattgggcactctgtggaaaagcacagagagaccttggacccatcggcccccaaggatctgattgatacctacctgctccacatggagaaggagaagtccaacgctcacagcgaattctcacatcagaatttaaaccttaacaccttgtctctgtttttcgcaggaactgagaccacatcaaccaccctcagatacgggttcctgcttatgctgaagtacccacacgttgccgaacgagtgtaccgtgaaatcgagcaggttattggtcctcacaggcccccggagctccacgatagggctaagatgccgtacacggaggccgttatctacgagatccagcgtttcagtgacctccttcccatgggcgtgccacacattgtgacccagcatacctctttcaggggctacattatccccaaagacacggaggtcttcctaattctttcgacagcccttcatgaccctcactacttcgagaagcctgacgcttttaatcctgatcatttccttgatgcaaacggggctctaaaaaaaacagaggcattcattcctttctctctcggaaaacggatttgtcttggagaagggatcgccagagcggagttatttctctttttcactacaatcttacaaaacttttctatggccagtcccgtagcgcccgaagacattgaccttacgcctcaagagtgcggcgttggaaagatcccccctacgtatcaaatccgcttcctgccacggtag

SEQ ID NO: 113659 - DNA, 876 bp, Artificial Sequence
  Description of Artificial Sequence: Synthetic coding sequence
atgcgctgcatgcttacgaatagccatccttggtgtgggtgcgactggcagtttagagaaaagtacggtgacgtgttcacggtgcacctgggcccccgaccagtagtgatgctctgcggcgtcgaggccatcagggaagctctggtggacaaagccgaagcatttagtgggcggggcaagatcgccatggtcgatccattcttcaggggttatggcgttatcttcgccaatggcaataggtggaaagtgctgcgtcggttcagcgtcacaacaatgagagatttcgggatgggtaaacgctcagtcgaggagagaatccaggaggaggcccagtgcctgattgaggagttgcgcaaaagcaaggagagggtataccgggaaatcgagcaggttatagggccccataggcctcccgaacttcacgatagggcaaaaatgccatatactgaagccgtgatttacgaaattcagcgttttagcgatctgctccctatgggcgtgccacacattgtcactcagcacacaagcttcagaggctacattattccaaaggataccgaggtcttcctcattctgtcgacagccctccatgatccccattatttcgagaaaccagacgccttcaacccagatcacttccttgacgccaatggtgcgctgaaaaagacagaggcattcataccctttagcctgggtaagcgtatatgtcttggggagggcattgccagggccgagctgttcttgttttttaccaccattctgcagaatttctccatggctagccccgtggcaccggaggatattgacctgaccccacaggagtgcggtgtgggaaagatccctcccacataccagatccggttcctgccgagatag

SEQ ID NO: 113660 - DNA, 1473 bp, Artificial Sequence
  Description of Artificial Sequence: Synthetic coding sequence
atggatcccttcgtggttctggtcctgtgtctttcttgcctgcttctgttgtcgatttggcgccagagctcaggacgaggcaaactgccccctggacccacgccactgcccgtgatcgggaacatcctccagatcgatatcaaggatgtctcaaagtcactgacgaacttatcaaaaatttacggtccagtgttcactttgtactttggtctggagcgtatggtggtccttcacggctacgaagtagtgaaggaggccctcattgatctcggcgaggaattctctggacggggccatttccccctggccgagagagcaaatagaggatttggcattgttttcagcaacggtaaacgttggaaggaaatcaggaggttttccctaatgacactaagaaatttcgggatgggaaaacgctccattgaagaccgcgtgcaggaggaagcacgctgcttagtggaggagctgcggaagaccaaggcttccccatgcgacccgacttttatcttgggatgtgcgccctgcaatgtaatctgctcaattatcttccaaaaacgtttcgactacaaagatcagcagttcctaaatttgatggaaaagttgaacgagaacatccggatcgttagcacaccctggattcaaatctgtaataattttccaacaattatcgattattttccaggcacacacaacaagttgctgaaaaatctcgctttcatggaatccgatatactggagaaggtgaaggaacatcaagagagtatggatattaacaacccccgcgatttcatagattgtttcttaataaaaatggagaaggaaaaacagaaccaacaatctgaattcaccattgagaacctagtgatcactgcggccgatctactaggagccggcactgagacaacttccaccacccttcggtacgccttgctactgcttctgaaacaccctgaagtgacagccaaagtacaggaagagatagagcgagttgtgggtcgcaacagatctccttgtatgcaggatagaggacatatgccctacacagacgccgtggtccatgaagtgcagaggtatatcgacctcatccccacctccctcccccatgcggtcacatgtgatgtgaaattcagaaattacttaattccaaaaggtacaacaatcttgacaagcctaacaagcgtcctgcacgataacaaagagttccctaaccccgagatgttcgatcctaggcatttcctggacgaaggcggaaacttcaagaagagcaactattttatgcccttcagcgcggggaagcgcatttgtgtcggggaagggctagcacgaatggagttattcctgttcttgactttcattctgcaaaatttcaacctgaagtcattaattgacccaaaagatcttgatacaaccccggtggtcaacggctttgcctctgtgccaccattttatcagctgtgctttattcctgtgtag

SEQ ID NO: 113661 - DNA, 1473 bp, Artificial Sequence
  Description of Artificial Sequence: Synthetic coding sequence
atggaaccctttgtagttctggttctgtgcctgagcttcatgctacttttcagcctttggcgacagagctgtcgacgcagaaagttacccccgggccccaccccgctgccgatcatcgggaacatgttacaaattgacgtgaaagacatctgtaagtcttttaccaatttctcaaaggtttatggccccgtctttactgtgtattttgggatgaacccgattgtggtatttcacggatacgaggcagtgaaggaggccctcattgacaacggtgaagagttttcgggacggggcaatagtcctataagccagagaattacaaaagggttgggtatcatcagttccaatgggaaacggtggaaggagattcgtagattcagcctgacaactctgcggaactttggcatgggcaagcgcagcattgaagacagagttcaggaggaagcacactgtctcgtcgaggaactgagaaaaacaaaggcaagcccatgtgatcctacatttatcctcggatgtgcgccatgcaacgtaatctgctcggtcgtgtttcagaaaaggttcgactataaggatcaaaattttctgacccttatgaaaagatttaatgagaattttcgaattctaaactccccttggatccaggtgtgtaacaactttccgctcctcattgactgttttcccggcacacataataaagtgctgaaaaacgtcgctctcacgcgctcctatataagagaaaaggtcaaggagcaccaagccagccttgacgtaaataaccccagagactttatcgattgtttcctgatcaaaatggaacaagagaaggacaatcaaaagagcgaatttaatatagagaaccttgtgggtaccgtggcagacctcttcgttgcaggaacagagactacttctacaactctacggtacgggctattgctgctcctcaaacatccggaggtcacagccaaagtacaggaagagatcgatcacgtcattgggcgacaccgctcaccttgcatgcaggacaggtcacacatgccatacactgacgccgtcgtgcacgagattcagcggtatagcgaccttgtgcccaccggcgtgcctcacgccgtgacaacggacaccaagttccggaattatcttattccgaagggcactacgattatggcccttcttactagcgtgctgcatgacgacaaggagttcccaaatcctaatatatttgatcctggccacttcttggataagaacggcaacttcaaaaaatcagattattttatgcctttctccgccgggaagcgaatttgcgctggtgaaggactcgctcgcatggaactatttctgtttcttacaaccatccttcagaatttcaacctgaagtcagtggacgatctcaagaacctgaataccacagccgttactaaaggtattgtttcccttccgccaagttaccagatctgcttcattcctgtgtag

SEQ ID NO: 113662 - DNA, 1374 bp, Artificial Sequence
  Description of Artificial Sequence: Synthetic coding sequence
atggagcgcagctttctcgaagaggccattccccagtatctgaaagaattgctgaaagatctggttggcgctcacatcagcgtctccgcccttgtcacaggggtgcgcggcatggaaaatagggctctgaagagtttcagtgccgaattaagtctcagcgcctggttaccttccgtcgctgctctgagttcccttgctgttaattcaccgagtttctgtccgttttttctaggcattattagcagtaatggaaaacggtggaaagaaatcagacgattctcactgacaaccctcaggaacttcgggatgggtaaacgcagtatagaagaccgggtgcaagaggaagcacactgcctcgtggaggagctgagaaaaaccaaagcctctccttgcgatccaactttcattttaggttgcgcaccctgtaacgtgatttgcagcgttgtgtttcagaaacggtttgactataaggaccaaaattttctgactttgatgaaaagattcaacgaaaattttcgaatcttgaattccccctggatacaggtctgcaacaattttcctctattaattgactgtttccccggaacccacaataaggtcctgaaaaatgtggcgctcacaagatcgtacattagagagaaagtaaaggaacatcaagcttccttagatgtaaataaccctcgcgacttcatcgattgtttcttaataaaaatggagcaggaaaaagataatcagaaatccgagttcaatatcgaaaatctggtaggcactgtggcagacctttttgtagccggcactgaaacaacatcaaccacacttcgctatggtctcttattgctgctcaagcaccctgaggtgaccgccaaagtgcaggaggagatagaccatgtgattggccgccaccgctcaccctgtatgcaggacagatcacacatgccgtatacggatgctgtcgtgcatgagatccagagatactcagacctggttccaaccggggtgcctcacgctgtgaccaccgataccaaatttcgcaactacctgattcccaagggtacgacaattatggccctgctgacttccgtcctacacgacgataaagaattccctaatcccaatatctttgatccaggacacttcctggataaaaatggcaatttcaagaagtccgactactttatgccctttagcgccggaaaacgcatatgcgccggcgaggggctcgccagaatggagcttttcctcttcctgacgacaattcttcaaaattttaacctcaagtctgtcgacgatctgaaaaatctgaacactacagcggtgacaaaaggcatcgtctctctgccgccgagctaccagatctgctttatcccagtatag

SEQ ID NO: 113663 - DNA, 1167 bp, Artificial Sequence
  Description of Artificial Sequence: Synthetic coding sequence
atgtttctccagcctatcgcaaagggaattataagttccaacggtaagcgctggaaagaaatcagacggttttctctcacgacgctgaggaacttcggaatgggaaaacgatccatcgaggatagggttcaggaggaggcccattgcctcgtggaggaacttcgcaaaaccaaagcctctccctgcgatcctacatttattctgggctgtgcgccctgtaacgtaatttgcagcgtggtcttccagaaaagatttgactacaaggaccagaatttcctgaccctgatgaaaaggttcaatgaaaacttcaggatacttaattctccctggattcaagtgtgcaataacttcccactcctaatcgactgtttccctggaactcacaataaagtactcaagaatgtagcgttaacacgatcctacattagggagaaggtcaaggagcaccaggcatccttggatgtgaataacccacgggacttcattgactgtttcctgattaagatggagcaggagaaggataaccagaaatccgaatttaacatcgagaacttggtgggcaccgtagccgacctgtttgttgccggcacagagaccaccagcacaaccctcagatacggcttactcctgttgttgaagcaccctgaagtgacggcaaaggtccaggaggagatcgaccatgttataggaagacaccgcagcccgtgtatgcaggaccggagccacatgccctacacagacgctgtggtccacgagatccaacgctattccgatttggtgcccaccggagtccctcatgccgtgacgacagatactaagtttcgtaactatcttattcccaagggaaccacaataatggctctgctgacaagcgtcctccacgatgataaggaattccccaatccaaatatttttgatcccggacactttctagataagaacgggaatttcaagaaatccgattattttatgcctttttccgctggaaagcggatctgcgccggagagggcctggcaagaatggagctgtttttattcttgactacaattctgcaaaatttcaatctgaaatctgtcgacgatctgaaaaatttaaatacaactgctgtgaccaaaggtatcgtatccctgcctccatcgtatcagatctgttttattcccgtgtag

SEQ ID NO: 113664 - DNA, 924 bp, Artificial Sequence
  Description of Artificial Sequence: Synthetic coding sequence
atggctgccaagtgttgttcaacgttctttctcggctgtgagttcagtcaatttttgcctctgtttctgcttggaataatttcgtcaaatggcaagcgctggaaggaaatccggcggttcagccttacgaccctgcggaatttcggaatgggcaagcgcagcatcgaggatagggttcaggaggaggcccactgtctggtggaagagctgagaaagaccaaggcatctccatgcgatcctactttcattctaggctgcgccccatgcaacgttatttgtagtgtggtcttccagaagagattcgactacaaagaccagaattttctgacgctgatgaagcggttcaacgagaatttcaggattctgaactccccctggatccaggtgtgcaacaactttccgctattgattgattgttttccgggaactcataataaagtgctgaagaacgtggctctgacgcgttcctacataagggagaaggttaaagaacatcaggcctcactggatgtcaataatccgcgagactttatcgattgttttcttattaagatggaacaggagaaagacaatcagaaatcagaatttaatatagagaatttagtgggtactgtcgctgacttgttcgtcgcaggtaccgaaacgacaagcacaactcttaggtatggcctcctcttattgctgaagcacccagaagtgaccgccaaggtccaagaagagatagatcatgtgatcggcagacaccgctcaccctgcatgcaggatcgcagccatatgccatataccgacgctgttgttcatgaaatccagcggtacagcgatttagtgcctaccggggttccacacgccgttacaacggacaccaaatttaggaactacttaatccccaagagttttgataacaaaatcatgttggccgcctag

SEQ ID NO: 113665 - DNA, 1473 bp, Artificial Sequence
  Description of Artificial Sequence: Synthetic coding sequence
atggactccctggttgtgttagtgctgtgtctgtcttgcctacttctcctcagtctgtggcgtcagtcgtcgggtcgcggtaaactgccccccggacccactccactgccagtcatcggcaacatcttgcagatcggcatcaaggacatttcaaaatccctgaccaatctctccaaagtgtacggccccgtttttacactgtatttcgggctcaagccaatcgttgtccttcacggctatgaagccgtgaaggaggccttaattgatttgggcgaagagttttccggccgcggtatattccctctcgctgagcgggccaaccgggggttcgggatcgtgtttagtaacgggaaaaaatggaaggaaatccgcagattcagtctgatgaccctccgaaactttggtatgggcaaaaggagcattgaagatagagtgcaggaggaggcaagatgtcttgtggaggaattgagaaagacgaaggcctcgccctgcgaccctacattcatcctggggtgcgctccatgcaacgtgatatgttctatcatttttcataaacggttcgactataaagatcaacaatttctcaatcttatggaaaaactcaatgaaaacattaaaatcctgagtagcccgtggatccagatttgcaataacttctctccaatcatcgactattttcccgggactcataacaagttgttaaagaatgtggcctttatgaaatcatacatactggaaaaagtcaaggagcaccaggaatcgatggacatgaacaacccgcaggacttcattgattgctttctgatgaagatggagaaggaaaaacataatcagcctagtgaattcaccattgaaagcctcgagaatacagctgtggacctcttcggggcggggaccgagaccacgagtacaaccttacgctacgccctgctactcctcctcaaacaccctgaagttacagcaaaagtgcaggaggaaatcgagagagtgattggaagaaacaggtccccatgtatgcaggatagatcccatatgccatacacggatgccgtcgttcatgaggtccagaggtatatcgatctcttgcctaccagcctgccacacgcggtcacctgcgatattaaatttagaaattacctgatccccaaggggactacaattttgatctccctgacaagcgtcctgcacgacaacaaagagttcccgaacccagagatgttcgaccctcaccacttcctagacgagggcggtaactttaagaagtcaaaatatttcatgccctttagcgctgggaaaaggatctgcgtgggggaggccctcgccggcatggaattgttcctctttttaacctctattctccagaatttcaacctgaagtcccttgtggatcctaagaacctggacactaccccagtggtaaatgggttcgcgtccgtgcctcctttttaccagctctgtttcatccctgtgtag

SEQ ID NO: 113666 - DNA, 1362 bp, Artificial Sequence
  Description of Artificial Sequence: Synthetic coding sequence
atggattccctggtggtgctggtcctctgtttgagctgtctgctcctcctgtcactctggcgacagagctcgggtcgtggcaagctgccacccggcccgactccactgcctgttatcggcaacatcttacagattggcatcaaagacatttctaaaagtctgaccaatctgagtaaggtctatgggccagtgttcactctttatttcggactgaaacccatcgtagtcctgcatggctacgaagcagtgaaagaggctttgatagatcttggggaagaattttcagggcggggtatctttcctctcgctgaaagggctaatcgtgggtttgggatcgtcttttccaacggaaagaagtggaaggagattaggcggttttccttaatgacgctgcggaattttggcatgggtaagcgaagtatcgaggaccgcgtacaggaagaggcccgttgtctggtggaagaactacgaaagaccaaagcttctccctgcgatcccaccttcattctggggtgtgccccctgtaatgtaatctgttccatcattttccacaaacgatttgattataaggatcaacagttcttaaacctgatggaaaagctcaacgagaacatcaagatcctttcgagcccatggattcaaatctgcaacaacttctcccctattattgactactttcccggtacccacaacaaactactgaaaaacgtcgcattcatgaagtcttacatactcgagaaggtcaaagagcaccaggagagcatggatatgaataacccccaggattttatagactgtttcttaatgaagatggagaaggaaaaacataaccagccaagtgagtttaccatcgaatccttggaaaatactgccgtggatctctttggcgctgggacagagactacttctaccacgctgcgctacgctcttctactgcttctaaaacacccggaagtgacggccaaagtgcaggaggagatagaacgggtgatagggcgcaaccgctccccttgtatgcaagacaggtcccatatgccatataccgatgccgtggtgcatgaagtgcagaggtacatagatctcttgcccacgagtctgccacacgcagtgacctgtgacattaagtttcggaattacctaatccccaaagggactaccatactgatcagccttacttcagtccttcacgacaacaaagagttcccaaaccctgaaatgtttgacccacaccactttttggacgaggggggtaattttaagaagagcaagtacttcatgcttgtgttgaagatgatacgtacagagaggacaaaacgaaagagagtgggcaagcttttctgggtgtcagtccgagtaacttag

SEQ ID NO: 113667 - DNA, 1341 bp, Artificial Sequence
  Description of Artificial Sequence: Synthetic coding sequence
atgggactcgaagcattggtgccgctcgccgtcatcgtggccatctttctgttactcgttgacctcatgcaccgcagacagcgctgggccgcacgctatcccccagggccactgcctcttcccggactgggcaacctactgcatgtagactttcagaacacaccttactgtttcgatcagctacgcaggaggttcggggacgtgttcagcctgcagctggcctggaccccggtggtggttctcaacggcttagccgctgtgcgtgaagcccttgtgacccatggggaagacacagcggaccgccctcccgttccaatcacccaaatcctgggatttggtcccaggagccaaggtagaccttttagaccgaatggtctgctagacaaggctgtgtcaaatgtaattgcatctctaacttgtggtagacgtttcgagtatgacgatcctcgattcctaagactgctggatctcgcccaggaaggattgaaagaagagtcaggcttcttgagggaagtgctcaacgcagtcccagtactgctacacatccccgctctggctgggaaggttctcagattccagaaggcatttctcactcagctggatgaactgttaacggaacatcgaatgacatgggatcctgcacagccacccagggaccttactgaagcctttttagcggaaatggagaaagccaaggggaaccccgagtccagcttcaacgacgaaaacctgtgtattgttgtcgccgacctcttttccgctggtatggtgacaacttccactaccctggcctggggcttacttttaatgatcctacaccctgacgtgcaaaggcgggtacaacaggaaatagacgatgtcattggccaggtacgtcgtccggagatgggcgaccaggctcatatgccgtacaccactgccgtgatccacgaagttcagaggttcggcgatatcgtgcctctcggtgttacgcacatgacaagtagagatatcgaggtccaaggctttagaataccaaaaggcacaaccctgatcaccaatctatcctctgtgttgaaggacgaggccgtgtgggagaagcccttccggtttcatccggagcatttcctcgacgctcagggccattttgtcaagcccgaagcttttctcccgttttccgcgggacgcagagcatgtctcggcgagcccctggcgcgcatggaactatttttgttttttacaagcctcctgcagcacttcagtttttccgtgccgacgggacagcccagaccctcacaccacggagtattcgcatttctggtcaccccttcaccctacgaactgtgtgcggtgccaagatag

SEQ ID NO: 113668 - DNA, 1494 bp, Artificial Sequence
  Description of Artificial Sequence: Synthetic coding sequence
atgggcctagaggccttagtgcctctggctgtgatcgttgcaatttttctcctgctggtagatttgatgcaccgaagacagcggtgggcagccaggtacccaccaggcccgcttccattaccggggcttggtaacctgcttcacgtagattttcaaaacactccctactgctttgatcagctgcgacgtaggtttggggacgtgttctctcttcagctagcgtggactccagtcgtggtgctaaatggcctagcggcggtgcgtgaggcattagttacacacggcgaagataccgctgatcgcccgcccgttccaatcacccagatcctgggttttggccccagatcacagggggtcttcctggcacggtacgggcccgcatggcgagagcagcgcaggttcagcgtgtccaccttacgaaatcttgggcttggcaagaagagtctggaacaatgggtcacggaagaggccgcttgcctgtgcgctgcctttgcaaatcattcagggcgtccctttagacccaacggtttactggataaggccgtatcaaatgtgattgcgtccttgacgtgtggtagacgcttcgaatatgacgaccctaggttcctgcggctactggacctcgctcaggaggggcttaaggaagaaagcggcttcctgcgcgaggtgctcaacgcagtccctgtgctcctccacatccccgctctcgccgggaaagtcttgaggtttcagaaggcttttctgacccagttggatgaactgttaactgaacatagaatgacatgggatcctgctcagccaccgcgggatttaacggaagcctttctggctgaaatggagaaggcgaagggtaaccctgaatcaagctttaacgatgaaaacctgtgtatcgtggtggccgacctattttccgccggtatggttaccacttccactaccctggcatggggcttacttctcatgatcctgcatcctgacgttcagcgacgcgtgcagcaggaaatagacgatgttattggacaggtgcggcgtcccgagatgggcgaccaagctcacatgccctatacaaccgccgtaattcacgaggtgcagcgttttggagatattgtccccctgggcgtgacccatatgacaagtcgggatatcgaagtccagggattccgtatccccaagggcacaaccctcattaccaacttaagcagtgtacttaaagacgaggctgtttgggaaaagccttttaggtttcatccggaacactttctggatgcccagggccacttcgtcaagcctgaggcatttctgccgttttccgccgggagacgagcctgcttgggggaaccattggcccgcatggagctcttcctgttctttacatctctcttgcagcatttctccttctcagttccaactggccaaccacgcccgagtcatcacggggttttcgctttcttggtaactccgtctccctacgagttgtgcgccgtccctaggtag

SEQ ID NO: 113669 - DNA, 1494 bp, Artificial Sequence
  Description of Artificial Sequence: Synthetic coding sequence
atgggattagaagcgctggtccccctcgccgtaattgtggccatctttctcctactggtggaccttatgcataggcggcagagatgggctgcccgttacccaccgggtcccctgcctctgccgggcctggggaatctacttcatgttgattttcagaacaccccatactgttttgaccagctgcggcgcaggttcggcgacgtctttagcctccagctggcgtggactcccgtggtcgtattgaacggattagccgccgtgcgagaagccctggtcacacatggcgaggacactgctgataggccccctgtgcctatcacccagattctgggattcggaccacgcgggcagggcgtgtttcttgcgagatacgggcccgcatggagggaacagcggagattcagcgtctctaccctacgtaacctcggacttggcaagaaatccttggagcagtgggtaacggaagaagccgcttgtttatgtgccgcctttgccaaccacagtggacgccccttccgacctaatggcctgttggacaaggcagttagtaatgttattgcctcactgacatgtggaaggagatttgagtacgatgacccaaggttccttcgcctattggatttggcccaggaaggactcaaggaagagagtgggttcctgagagaagtgcttaatgcagtaccagtgctgcttcatatcccggcgctcgctggcaaggttctgcggtttcagaaggcctttctcacgcagttggacgaattgttgaccgagcacagaatgacatgggatccagcacagccccctagagatctcaccgaagcctttctggccgagatggagaaagctaagggcaacccagagagctcattcaatgacgaaaatttgtgcattgtggtggcagatctgttcagtgccggtatggtgacaacaagtaccacattggcatggggcctcctgcttatgatcttacacccagatgtccagaggagggtccagcaggaaattgacgacgttattggccaagtacggcgcccggagatgggtgaccaggcacacatgccttacaccacagctgtcatccacgaggtgcagcgattcggagatatcgtgccactgggtgtgacgcatatgaccagtagggacattgaagtgcagggcttccgtattccaaaaggcacaacactgatcaccaacctttcttcagtactaaaagatgaggctgtgtgggaaaagccatttcggttccacccagagcacttcctcgacgctcaggggcacttcgtgaagcctgaggcgttcctccctttttctgcaggccgccgcgcttgtcttggggaaccactggcaaggatggaactgttcttgtttttcacatcccttttgcagcatttctcttttagcgtgcccaccggacagccccggccctctcaccatggtgtgttcgcattcctcgtgaccccgagcccctatgagctctgcgccgtcccacgatag

SEQ ID NO: 113670 - DNA, 1332 bp, Artificial Sequence
  Description of Artificial Sequence: Synthetic coding sequence
caggaagccctgactctgccgctgcagctgcgccggcgtttcggcgacgtcttttcactccagctggcttggacccctgtggtagtattaaatggtcttgcggcagtgcgcgaagcactggtgacacatggagaggacacagcagatcggcctcccgtcccaataacccagatcctgggctttggcccgcgcggacagggtgtctttttggcgcggtacggcccggcctggagagagcagaggagattcagtgttagcaccctccgtaatctagggctggggaagaaaagcctagaacagtgggtcactgaagaggccgcatgcctctgcgccgcgttcgcgaaccacgatgccccgttcgcgcccaccgtgtcatggacgaagcccaacgtgatcgcaagcctgacctgtggccggcggttcgaatatgacgaccccaggtttctccgtctgctggatttagcccaagaggggctgaaggaagagtccggctttctgagagaggtattgaacgccgtgcctgtattattacatatacctgccttggccggcaaagtcttgagatttcaaaaggccttcctgacccagttggacgagctgcttactgagcaccggatgacctgggatcctgcacagcccccaagggatctgacagaggctttcctggccgaaatggagaaggcgaagggtaacccagagtcaagcttcaacgatgagaacctgtgcatcgtggtcgccgacctgttcagcgccggaatggtgaccaccagcacaaccctcgcctgggggctattactcatgattttacatccagatgttcagagacgggtccagcaggagatcgacgacgtaatcggacaggttcggagaccggaaatgggggaccaggcccatatgccctacacaacggctgtgatacacgaggtccagcgcttcggagacatcgtccccctgggagtgacgcacatgaccagtagggatattgaagtgcagggttttcgcattccaaaagggaccaccctcattacaaatctgtccagtgtactgaaggacgaggccgtctgggagaagcccttcaggtttcaccccgagcactttcttgacgcacagggacatttcgtgaaacccgaagcttttctgcctttctctgctggccgtcgcgcttgccttggggagcctctggcccgcatggagcttttcctgtttttcactagtctactgcagcactttagcttctccgtacccaccgggcagccacgcccatcgcaccacggggtatttgctttcctcgtgaccccctccccatacgaactgtgtgcagtgcctcgctag

SEQ ID NO: 113671 - DNA, 1341 bp, Artificial Sequence
  Description of Artificial Sequence: Synthetic coding sequence
atgggcttagaggcgcttgttcccctcgctatgattgtggcgatatttcttctgctcgttgacctgatgcacaggaggcagcgctgggccgcccgttacccgcctggccccctcccactgccagggctcggaaacttgctgcatgtggacttccaaaacacaccttactgctttgatcaactcagaaggcgattcggtgatgtgttctcattgcagctagcgtggacaccagtcgtcgtcctaaatggtcttgccgctgtcagggaagccctcgtcacccacggggaggacactgctgaccgccctccggtgccaattacccagatcttaggattcgggcccagatcccagggcaggcctttccgcccgaacgggttactcgacaaagcggtgagtaacgtcatcgcttctcttacctgcggcagacgattcgaatatgacgatcctagattcctgaggctgttggatctggctcaagaggggttaaaggaagaaagcggctttctgagggaggttctgaacgctgtaccggtgctcctgcacatccccgccttagccggcaaagtacttagattccagaaggccttcttgactcagctggacgagctgctgacagagcaccgtatgacttgggatcctgcacaacctccacgcgaccttactgaagcatttctcgctgaaatggaaaaagctaagggcaatcctgaaagctcttttaatgacgaaaatctgtgtattgtggttgctgacctcttcagcgccggtatggttactacttcgacaacactcgcgtggggactcctgcttatgatcctccacccagatgttcaaaggagagtgcagcaagagatcgacgacgtcatcggtcaggtccggaggcctgagatgggggatcaggcgcacatgccctacacaaccgccgtaatccacgaagtccagcggttcggcgacatagtcccgttaggcgttacgcacatgactagcagggacatcgaggtgcaggggttcaggatccccaagggtacaactctgattactaacctgtcatcggtcttgaaggacgaagccgtgtgggaaaaacctttccgcttccatccagagcactttcttgatgcacagggtcatttcgtcaaacctgaagcatttctgcccttttccgcaggcaggcgcgcatgtctcggggaacccctagccaggatggagttgtttctgtttttcactagtttgcttcaacacttttctttttccgttcctacagggcaacctaggcctagtcatcacggggtgtttgcttttctcgtcacaccatcaccatacgaactgtgtgctgtcccacgatag

SEQ ID NO: 113672 - DNA, 1482 bp, Artificial Sequence
  Description of Artificial Sequence: Synthetic coding sequence
atgtccgccttgggtgtgaccgttgcactgctggtgtgggcggcattcctgctgttggtgtcgatgtggagacaggtgcattcctcttggaacctgccccccggaccttttcccctgccaatcatcggaaatttattccagcttgaactcaagaatattcctaagtcgttcacaagacttgcacagcggttcggacctgttttcacgctatatgtcggtagtcagagaatggtggtcatgcatggctacaaagctgtgaaggaagcactgttagattataaggatgagttcagcgggagaggagatcttcccgcatttcatgctcaccgcgacagaggaatcatatttaacaacggcccaacatggaaagatatccggcggttctcccttacaacgctgcgcaattacggtatgggcaaacaggggaatgagtcaaggattcagcgggaagcacactttctcctcgaagcgctgcggaaaacccagggccaacctttcgaccccaccttccttatcggatgcgcaccatgcaacgttattgctgacatcctcttccgtaaacacttcgattacaacgatgagaagttcttgaggctgatgtatctgtttaacgaaaacttccacttgttaagtaccccttggctgcagctatataacaattttccctcctttctccactacttaccaggatctcaccgtaaggtgatcaagaatgtagcagaagttaaagagtatgtatcggagagagtgaaagagcatcatcagtccctggaccccaactgtccaagggacttgacagactgtctccttgtcgaaatggagaaggagaagcattctgccgaacgcctctatacaatggacggcatcacagttacagttgccgacctatttttcgcaggcactgagacaacttcaacaacgttaaggtatggactactgatactgatgaagtacccggagattgaggaaaagctgcatgaggagatcgatagagtgataggaccttccagaattcctgcaatcaaggaccgccaggaaatgccttacatggacgctgtggtgcacgaaatacagcggttcataacactcgtcccaagtaatttgccgcacgaagcaaccagagacacgattttcagggggtatttaatcccaaagggcaccgtggtggtgcccacgttagattccgtcctgtatgacaaccaagagttcccagaccccgagaaatttaaaccggagcattttcttaacgagaatgggaaattcaaatatagcgactacttcaaaccatttagcacagggaagagggtgtgcgccggagagggactggccaggatggagctgttcttactgctgtgcgccatcctccagcactttaatctgaagccgttggtcgatccaaaggatatagatctctcccccatccatatcggttttggatgcataccacccagatataagctttgtgtgatccccagaagctag

SEQ ID NO: 113673 - DNA, 1482 bp, Artificial Sequence
  Description of Artificial Sequence: Synthetic coding sequence
atgtcagccttaggtgtgaccgtggccttgttagtgtgggcagcattcctgttgctcgtgtccatgtggaggcaggtgcatagctcttggaacttgccacctggaccttttccgctaccaatcattggtaacctctttcagctggagctgaaaaacatcccaaagagttttactaggttggctcagagattcgggcccgtctttactttatacgttggctctcagaggatggtcgtgatgcacggctacaaggctgttaaggaggccctcctggactataaagatgagttctccgggcgcggggatctccctgctttccatgctcaccgcgacagaggaataatctttaacaacggaccgacatggaaagacattcgaaggttcagcttgacgacgctgcggaactacggcatggggaagcagggcaacgagtctagaatccaaagagaagcccacttcctcctcgaggctctccgtaagacacaagggcagccgttcgaccctaccttcctcatcggttgcgccccttgtaacgttatcgcggacatacttttcaggaaacacttcgattacaatgatgaaaaattcctgaggctcatgtatctgttcaacgaaaattttcacctgctaagcacaccctggcttcagttgtataacaacttcccttcattcctgcactacctccctggatcgcatagaaaagtgatcaagaacgtagccgaggttaaggaatacgtgtccgagagggtcaaagagcaccatcagtcccttgatccaaactgtccccgggatttgaccgactgtctgctggtggagatggagaaggaaaagcatagcgccgagcggttgtatactatggatggaattactgtgacggttgctgacctgttcttcgccggtacggaaaccactagcacaactctcagatatgggttgcttatcctgatgaaataccccgaaatcgaggagaaattacacgaggagatcgatcgcgtgattgggccttccagaattccggctatcaaagatagacaggagatgccatatatggatgccgtggtccatgagatacagaggtttatcaccctcgttccctctaacttaccacacgaagcaacccgcgacacaatcttccggggatatctgattcccaaggggacggtagtcgtgcctactcttgattctgtgttgtacgataaccaggagttccccgacccagaaaagttcaagcccgagcactttctgaatgagaatgggaagttcaaatatagtgactactttaagccatttagtaccggaaaaagagtctgtgccggcgaaggtctggcacgcatggagctctttctgctcttgtgtgctatactgcagcatttcaatctgaagccattagtggacccaaaagatattgatctgagccctattcacattggatttggatgcattcccccccgctacaagctttgcgtgataccgcgctcctag

SEQ ID NO: 113674 - DNA, 261 bp, Artificial Sequence
  Description of Artificial Sequence: Synthetic coding sequence
atgagcgcgctcggcgtgaccgtggcccttcttgtgtgggcagcctttctcctgctggtgagcatgtggaggcaggttcattcgagctggaatctccctcccgggccattcccccttcctatcatcggcaatttgtttcagctggagttgaagaatatccccaagtcatttaccaggctggctcagcgattcggccctgtgttcaccctttacgtcggcagtcagaggatggtggttatgcatgggtataaagccgtttag

SEQ ID NO: 113675 - DNA, 1476 bp, Artificial Sequence
  Description of Artificial Sequence: Synthetic coding sequence
atggactccatttccacagcaatcctgcttctcttgctcgcccttgtatgtctgcttctgacattaagcagcagggataagggcaaactgccgcctggaccacgacccttatccattttaggaaacctgctgctgctctgtagccaagacatgctcactagcctcaccaaactaagtaaagaatacggatcaatgtacacagttcatctgggaccccgtagggttgtggtcctttcaggttatcaggctgtgaaagaggctctcgtcgaccagggtgaagagttctcgggaaggggagattatcccgctttttttaactttaccaagggaaatggaatcgccttctctagcggcgacaggtggaaggtccttagacagttctcgatacaaattctcaggaacttcgggatgggcaaacgtagcatcgaagagcggatactcgaggaaggatcttttctgttagccgaactgcggaagaccgaaggagagccttttgatcctactttcgtgctttccagatccgttagtaacattatttgttccgtcctatttggttcccgcttcgattacgacgacgagcgtcttctgaccatcatcagattgatcaacgacaattttcagatcatgagtagcccatggggcgaactgtacgacatctttccctccctactggactgggttcctggaccccatcagcggatcttccaaaatttcaaatgtcttcgcgacctcatagcccactcagtgcacgaccatcaagcctctttagatcctcggagtccgcgagacttcatccagtgcttcctcactaagatggccgaagagaaggaagacccactgtcacattttcacatggatacactgttaatgacgacacataaccttcttttcggcggcactaagactgtgtcaacaacactacatcatgccttcctggccttgatgaagtatccgaaagtgcaggcaagggtccaggaggagatcgatctggtggtcggccgagctcgtcttcccgcactgaaggatagagcggctatgccttacaccgatgccgtgattcacgaggtgcaacgatttgccgatatcattcccatgaacctcccacatagggttactagggataccgcattccgagggtttctcatcccaaagggcaccgatgttatcacgctgctgaatactgttcactacgatccatctcaattcttaacccctcaggagtttaatcctgagcattttctggacgctaatcagagcttcaagaaatctcctgcctttatgccattttccgccgggaggcggttgtgtttgggggaatccctggcccgaatggagttattcctgtaccttacggcaattctgcagtcattttcgcttcagcccctcggcgcccctgaggatattgacctgacacccctatcttcaggtctcggcaacctcccccgaccttttcagctttgcctgcggcctaggtag

SEQ ID NO: 113676 - DNA, 1509 bp, Artificial Sequence
  Description of Artificial Sequence: Synthetic coding sequence
atgctcgccgcaatgggttcactggccgccgccttatgggctgtggtacatcctcgtaccctcttgttaggaaccgtggcctttcttctcgctgctgacttcctgaagcgacgacgccccaaaaattaccctcctggcccctggcggctacccttcttgggtaacttcttcctcgtggacttcgaacagtcacacctggaggtacagctctttgtgaagaaatacggcaatctgttctccctcgaacttggggatatctcagcagtcctcatcacaggccttccactgataaaggaggcattaatacatatggatcagaactttggcaatagaccggtgactcctatgagagagcacatctttaagaagaatggattaattatgtcctctggacaggcctggaaagaacagcgtaggttcactctgaccgccctaaggaacttcggactgggcaagaagtctttggaagagagaattcaggaggaagcgcaacatttgacggaggctatcaaagaggagaacggtcaaccgttcgacccgcactttaagatcaataatgcagttagtaacattatctgctccattacattcggtgagaggttcgagtatcaagatagctggtttcagcaactgctcaaactgctagatgaggttacctacctggaagcaagcaagacatgtcaattatacaatgtgttcccatggatcatgaaatttcttcctggccctcatcagactctgttctccaactggaaaaagctcaagttgtttgtttcccatatgatcgataaacacagaaaggattggaatcctgccgaaacacgcgacttcatagatgcatacctgaaggaaatgtccaagcatactgggaaccccaccagttcctttcacgaggaaaaccttatttgttcaactctggacctgtttttcgccggaacagaaacgacttccacaactttgagatgggctctactctacatggccttgtatcccgagattcaggaaaaggtgcaagctgagatcgaccgtgtgattggccagggacagcagccctcaaccgccgcacgggagtctatgccctatacaaatgcggtaatccacgaggtccagagaatgggaaacataatcccactgaatgtgcctcgcgaggttacggttgacacaacattggctggctaccacctgcccaaaggcactatgatcctgacgaatttaacagctcttcaccgggatcctacagagtgggctacacccgatacatttaatcccgaccactttctggagaacggacagtttaaaaagcgcgaggctttcatgccgttcagtattggcaaacgggcatgcctgggggaacagctggctaggactgaactgttcatattttttacaagcctaatgcagaagttcacttttcggccccccaacaatgagaaactttctctaaagttcaggatgggcatcaccataagccccgtatcccacaggctgtgcgcagttccccaggtttag

SEQ ID NO: 113677 - DNA, 1506 bp, Artificial Sequence
  Description of Artificial Sequence: Synthetic coding sequence
atgtggaaactctggagagccgaggaaggggccgctgccctgggcggcgcattgttcctccttttgtttgccctcggtgttcgacagttactgaagcaaaggaggcctatggggttccctccaggccctcctgggttaccctttatcggaaacatttactccctggctgcaagttccgagctgccccatgtctacatgcggaagcagtcacaagtctacggagagatcttttccttggatctcggagggatcagcaccgtggtactgaacggatatgatgtggttaaagagtgtctggtccaccaatcagaaatcttcgctgatcgcccatgcctcccgctgttcatgaagatgaccaagatgggcggcctcttgaactctaggtacgggcgtggttgggtggaccaccggagactggccgtgaacagtttccggtacttcggctacggacagaaatccttcgagtccaagattctcgaggaaacaaaatttttcaatgacgccattgaaacatacaaaggccgacccttcgacttcaagcaactaatcacgaatgctgtgtctaacataacgaacttaatcatttttggtgaacgcttcacctatgaagacactgattttcaacacatgattgagttgttcagtgaaaacgttgagctcgcagcaagcgcttccgtgtttctgtacaatgcctttccttggatcggtattctcccgttcggaaagcatcaacagctctttcgtaatgcagccgtagtctacgattttctgtcacgactgattgagaaggcgtccgttaacagaaaaccccagttaccacagcattttgttgacgcctatttagacgagatggatcagggaaagaatgacccttcatcaacattttcaaaagagaatctgatattcagcgtgggggagctgatcattgctggaaccgaaacaacaactaatgttctaagatgggcaattctgtttatggcactgtacccgaacatccagggacaggtccaaaaggagatagatcttattatgggcccgaatggaaaaccctcctgggacgacaagtgcaagatgccttacacagaggcagtgctgcacgaggtcctgcggttctgtaatattgtgccccttggtatttttcacgccacaagtgaggacgcagtcgtacgcggctattcaattcccaaaggcactaccgtgattactaacctgtattctgtccatttcgatgagaagtactggagagatcctgaggttttccacccggagaggtttttggattcttccgggtactttgccaagaaagaggccctggtgccttttagcttgggtcgtaggcactgtctcggggagcacttggctagaatggagatgttccttttctttaccgccctcctgcagcggtttcacctgcacttccctcatgaactcgtgcctgacctcaagccccgcctcgggatgacactgcagcctcaaccctacttaatttgtgcggaacgccgctag

SEQ ID NO: 113678 - DNA, 1695 bp, Artificial Sequence
  Description of Artificial Sequence: Synthetic coding sequence
atggaggctaccggcacatgggccttgctgctggctctcgccctattgctcctcctgacattagccctctcaggtacccgggcccgcggccatctccctccgggacctacacccctgccactgctgggaaatctgttgcaactaagaccaggcgccttatatagcgggttgatgcggttgagtaagaagtatgggcctgtttttaccatctacctggggccctggaggccggtggttgtcctggtcggacaggaagcagtgcgtgaagcactggggggccaggctgaggagttttccggaagaggcactgtggccatgctcgagggtacttttgatgggcatggggttttcttctctaacggtgaaagatggcgccagctccgcaagttcacaatgttagctctccgtgacctgggaatgggcaaaagagagggcgaggagctgatccaggccgaagcccgatgcctggttgagacattccaaggcacggaagggaggccctttgacccctccctactgctggcgcaggctaccagcaatgtggtatgcagcctgctattcggcctaagattttcttacgaggacaaagagttccaagcggttgtgagagccgcaggaggtaccctgctgggtgtgagcagccagggaggccagacttacgaaatgtttagttggttcctaaggcccttgcctggtccacacaagcagctactacaccacgtcagtactctggctgcctttacagtgaggcaggttcagcaacatcagggcaacctcgacgccagcgggccagcgagggatctggtggacgcattcctgctgaagatggctcaggaggaacagaaccccggaactgaatttacaaacaaaaatatgctgatgacagtgatctacctccttttcgccggcaccatgaccgtcagcaccacagtaggctacacactcctgcttttgatgaaatacccccatgtacagaagtgggtgcgcgaagaattgaatagggagctgggggcagggcaagcacccagtctcggcgaccggacacggttaccctacacggatgcagtcctgcatgaggcccagaggcttctggctcttgtaccaatggggatcccccgcactctgatgcgaaccacaaggtttcgaggctatacgttgccgcagggcactgaggttttccccctcctgggaagtattctgcatgaccctaacatcttcaagcacccagaggaatttaatccggaccgttttctcgacgcggacgggcgcttccggaagcacgaggctttcctacctttctctctgggcaagcgggtctgcctgggcgaggggttggccaaagccgagttatttcttttcttcaccaccattctgcaagcattctcacttgagagcccttgtccacctgataccctgtcactcaaacctaccgttagtgggctgttcaacatcccccccgccagcactgtgggcatggaccgggtgaatgtgagcagggtatatacagcaggcagccacatttacaccccagccgtagtgttccggtctctgagccatggccctcacgcgcacctcactcatgccgcaaagatgcacaatcgaacccctatccataactacaagggtcacaaggctaccgccggcttggcgtttcatagacacaaatacagcccgagcgccattacttctacttag

SEQ ID NO: 113679 - DNA, 1515 bp, Artificial Sequence
  Description of Artificial Sequence: Synthetic coding sequence
atggaagccactggaacgtgggccttactcctagcactcgccctactcctcttgctcacgttagccctcagcggcacccgcgcacgcgggcacttgccacctggccctaccccccttccattactcgggaacctcttacaactgcggccaggagctctgtatagtgggctcatgcgcctgtctaagaagtacgggcccgttttcacgatatacctcggcccttggcgtccagtggtggttcttgtaggccaggaagccgttcgggaggccttaggtggccaggctgaagaattttccggacgaggcacagtggcgatgctcgagggtaccttcgatggccacggggttttctttagcaacggcgaaagatggcgtcaactgaggaaattcactatgttggctctgcgggacctgggcatgggaaagcgcgagggagaggaattgattcaagccgaggcacggtgcttggtcgaaactttccagggtaccgaaggtcgcccttttgatccatcacttctgctggcacaggccacaagcaatgtggtgtgctcccttcttttcggtctgcgcttctcctacgaagacaaggaatttcaagcggtcgtgcgggcagcaggtggaactttactcggggtctcctctcaaggcggacagacatacgaaatgttctcctggtttttgcggcctctgcctggaccccacaagcagcttctccaccatgtgtctaccctggctgcctttacagtgagacaggttcagcagcaccaaggaaatttagacgccagtggaccagcgcgggatctagtagatgcttttctgctgaaaatggcccaagaagaacaaaatcctgggaccgaatttacaaataaaaatatgctaatgaccgtaatttatctgctattcgccggaacgatgacagtaagcacaacggtggggtatacactcctcctcttaatgaaatacccccatgtgcaaaagtgggtgcgcgaggaattaaacagagagctaggtgccgggcaggcccccagcttgggggacagaactcgcctcccatacaccgatgcagttttgcatgaagcccaacggctgttggcccttgtgcctatggggataccacgcacccttatgaggactacacgttttagaggatacacccttccgcagggaacagaagtcttcccgctgttggggtcaatcctgcacgacccaaatatcttcaagcatcctgaggaatttaacccagatagattcctcgacgctgatggtcgctttcgcaaacacgaagcatttttgcctttttctttgggaaagcgtgtgtgcctgggcgagggccttgccaaagccgaactgttcttattttttacaaccatactgcaggcattctcactggaaagcccctgtcctcccgacaccctgtctttgaagcccactgtcagcgggttatttaatatccctccagctttccagctgcaagtcagaccaacggatctgcatagtaccacacaaacaagatag

SEQ ID NO: 113680 - DNA, 690 bp, Artificial Sequence
  Description of Artificial Sequence: Synthetic coding sequence
atggccatggaggaacagaaccccggcactgaatttaccaataagaatatgctcatgacagttatctacctgctgtttgccgggacaatgacagtctccactacggtcggctacaccctcctgctacttatgaagtacccacacgtccagaaatgggtaagggaagaacttaatagagaactgggagccggccaagcaccatctttgggggaccgaacacgattgccttatacagatgctgtgcttcatgaggctcaaaggcttttagcattggtcccaatgggcatcccaagaaccctcatgcgcactacacggtttaggggctacacactgccgcagggaaccgaagtatttccactgcttggtagcatcctccatgacccaaacatcttcaagcatccagaggaatttaatcctgataggtttcttgatgcggatggaagatttagaaagcacgaagcttttcttccattctcacttggcaagcgagtttgccttggagaagggttggccaaggctgaactgttcctattcttcactactatcctgcaggcgttttctcttgagtccccttgccctcccgatacactctcactgaaacccactgtctcagggttattcaacataccaccagccttccagctacaggtaagacctaccgacttgcactctaccacccaaacccgctag

SEQ ID NO: 113681 - DNA, 1635 bp, Artificial Sequence
  Description of Artificial Sequence: Synthetic coding sequence
atgtcgagccctggtccatcacagcctcccgcggaggatcctccgtggccagctcgcctgctcagagcccctctcggtttgctgagattagacccttcgggtggggcgttactgctttgtggccttgttgccttgctgggctggtcatggctaagacggcgcagagcccgagggataccacctggtcccaccccttggccgctagtgggaaatttcgggcatgtgctgttgcccccctttcttagacgaaggagctggctgagttctcgcaccagggccgcaggtatcgacccctccgtcatagggccgcaagtactactggcccacctggcgcgggtctatggctctattttcagcttcttcatcggccattacctggtagtggtgctgagtgacttccactctgtacgcgaggccctcgtgcagcaggccgaggtcttctctgacaggccgcgcgtgcccctgatctccatcgtgaccaaggagaaaggagtggtgtttgcgcactacgggccggtctggcgacagcagcggaagttcagccactccaccctccggcatttcgggttagggaaattgagcctggagcctaaaatcattgaggagttcaaatacgtgaaagccgagatgcagaagcacggagaggaccctttctgcccgttttcaatcattagcaacgctgttagtaacatcatttgctcgctctgttttggccagcgcttcgattacacaaacagtgaatttaagaagatgttaggcttcatgtctcggggcctggaaatatgtcttaactcccaagtcctgctagtcaatatctgtccatggctctattacctgccctttggccccttcaaggagttgagacagattgaaaaggacatcaccagtttcctgaagaaaattatcaaggatcatcaagaatcacttgatcgggagaaccctcaagatttcattgacatgtacctcttgcacatggaagaggaacgtaaaaacaactcaaactctagcttcgacgaggaatacttattctacattatcggcgatcttttcattgccggtacggacactacaaccaactctctgttgtggtgtctgctttatatgtccctcaaccccgatgtgcaggagaaggtgcatgaggagatcgaacgcgtaatcggagccaacagagccccttcactcacagacaaggcccaaatgccctataccgaagcaactatcatggaggtccagaggctgaccgtcgtggtgccacttgccatcccacatatgacctcagagaacacagtgcttcagggttacaccattcccaaaggaactctcatacttccgaatttatggagcgtgcacagggatccggccatctgggaaaagccagaggatttttaccccaacaggtttctcgatgatcagggccagttaatcaaaaaagaaacttttattccattcgggatcggtaagagagtctgtatgggtgaacagctcgccaagatggaacttttcctgatgttcgtgagcctgatgcaatcttttgcctttgccctgccggaggactctaagaagcccttactcacaggccggttcggactaacattagcccctcatccatttaacatcaccatctctaggaggtag

SEQ ID NO: 113682 - DNA, 1506 bp, Artificial Sequence
  Description of Artificial Sequence: Synthetic coding sequence
atgagttcccccgggccttctcagccacctgcagaggacccaccatggcctgcacgattgcttcgcgccccactggtggggaactttggccacgttctgctaccgcccttcctccgtcgcaggtcttggctgagtagcaggactcgcgctgccggtatagacccatccgtgatcgggccccaagtcctactggcccacctagcccgggtgtatggatcaatattctcgttttttattggacattacttagtggtggtcttaagcgacttccatagtgtccgcgaggcgctggtgcagcaggcagaggtgtttagcgacaggccccgcgtccctctgatatcgattgttaccaaagaaaaaggcgtcgtattcgcccactacggtcccgtctggagacagcagcgaaagttcagtcatagcacgctcagacatttcggtctcggaaagctcagtttagagcctaagattatcgaggagtttaagtatgtaaaagccgagatgcaaaaacatggcgaagacccgttctgcccattcagtatcatttccaacgccgtttccaacataatatgcagtctgtgctttgggcaaaggttcgactatactaacagtgaattcaagaagatgttgggattcatgagccgcggcctggaaatatgccttaactcccaggtgctgctggtaaatatctgtccttggctctactacctgccctttggcccgtttaaggaacttaggcagatcgaaaaggatattaccagtttccttaagaagatcattaaggatcaccaagaatctctggaccgcgagaatcctcaggacttcattgacatgtacctgctgcatatggaggaggagcgcaaaaacaatagtaatagcagctttgatgaggaataccttttctatattataggagatttattcatcgccggcactgatacaaccactaattctctcctctggtgtctcttgtacatgagtctgaatcctgacgtgcaggaaaaggttcacgaagagattgaacgtgtgataggcgccaaccgtgcaccatcccttactgacaaagcccaaatgccttatacagaggccaccatcatggaggtacaacgactgacagtagttgtgcccctggctatcccccacatgacaagtgagaataccgtactgcagggctataccatcccaaagggaaccctgatcctccccaacttatggtctgttcaccgagatcctgccatctgggagaagcctgaggatttttatcccaatcggttcctggacgatcaggggcagttgattaagaaagagaccttcattcctttcggaatagggaagcgggtgtgcatgggtgaacagttagcaaagatggaactcttcctcatgttcgtatccctaatgcagtctttcgcctttgcgctccctgaggattcaaagaagccattgctgaccggtcgctttggcctcactctggctcctcaccctttcaatatcacaattagccgtcggtag

SEQ ID NO: 113683 - DNA, 1398 bp, Artificial Sequence
  Description of Artificial Sequence: Synthetic coding sequence
atgctattgctgggactgttactactcctgcctcttctcgcaggtgcacgcctgttatggaactggtggaaacttagaagcttgcacctgccacccctcgcccctggatttcttcacctgctccaaccagatctgcctatttatctcctgggactgacgcagaagtttggacccatttatcgcctccacctcggtctacaggacaagctggtttcaaggaattacccagatctttcactgggcgattacagtctcctgtggaaggcccataaaaaactgacaaggtcggcactcctgcttggcattcgagattccatggagccggtggttgaacagcttacccaggaattctgcgagagaatgagagcgcagccaggcactccggttgccattgaagaggagttttcgctgctcacctgcagcataatctgctacctcacctttggcgataaaataaaagatgacaatttaatgcctgcgtactacaagtgcatccaggaggtgctgaagacctggtctcactggtccatccaaatagtggacgtgatcccctttctacggttttttccaaacccggggctgaggcggcttaagcaggccattgagaagcgagatcacattgttgaaatgcagctcaggcagcataaagaaagccttgtggctggccaatggagagatatgatggactacatgttgcagggtgtggcacagccatcaatggaggagggctcgggtcaactgctcgaagggcacgtacacatggccgccgttgatctgctcatcggcgggaccgagaccaccgcaaataccctcagttgggcagtcgtattcttattgcaccacccggagatccagcaacgattgcaggaggagctcgaccacgaactgggcccaggcgccagctcctccagggttccctacaaagaccgtgccaggctgcccctacttaacgctactatcgctgaggtactgcgattgcgccccgtcgtgcccctcgcattgccccataggaccacacgaccctcatctatcagcgggtatgacatccccgagggaacagtgatcatccctaatctgcagggggctcacctggatgaaactgtatgggagagacctcatgaattttggcccgataggtttcttgagcccggcaaaaactccagggccttagcttttggatgtggggcgagggtatgcctgggggagccccttgcccgtctcgagttatttgtagtgcttacgagacttctgcaggctttcacgctgctgccaagtggcgatgcgctccctagcttacaacctctacctcattgctccgtcatactgaagatgcaaccattccaggtgagactgcagccgcgcggcatgggcgctcactcccctggccagtcacaatag

SEQ ID NO: 113684 - DNA, 1488 bp, Artificial Sequence
  Description of Artificial Sequence: Synthetic coding sequence
atgctgcttttggggctgttgctcctgctacctttgcttgccggcgcgagactcttgtggaactggtggaagctgcgatccctacacctccctccacttgcccctggattcctgcacttgctccagcctgacttaccaatatacctgctgggcctgactcaaaaatttggacccatctaccgtctccacctcggactgcaagacgtggtcgtcttaaatagtaaacgtacgattgaggaggctatggtaaagaaatgggccgactttgctggtcggccagagccacttacatataaattagtgtctagaaactatccagatttaagcctgggcgactactccttactgtggaaggctcacaagaaattgacacgcagcgcactgctgcttgggatccgagattcaatggaacctgtggtggaacagctgacgcaggaattttgcgagcgtatgagagcgcagcctggcacaccagtcgccattgaggaagagttctcgctccttacctgtagcatcatttgctatttgacctttggagacaagataaaggatgataaccttatgcccgcctactataaatgcattcaggaggtgcttaagacatggtcccactggagtattcaaattgtcgacgttataccctttcttaggttctttcccaatcccggcttgcggcggctgaaacaggctatagagaaaagggaccacatcgtcgagatgcagctcaggcaacataaggagtctctggtagccggccagtggcgagatatgatggattatatgttgcagggagtggcacagccttctatggaagaagggagcggccagttactggagggacacgtccacatggctgctgttgacctactgattggtggaaccgagaccacagccaatactctgtcatgggccgtggtctttctccttcaccaccctgaaatacagcaacggctacaagaagagctggatcacgagctcggacctggtgccagctcaagtcgggttccatataaagaccgggccaggctgcctttactgaacgccaccatcgcggaagttctgagactcagacccgtggttccactggcactgccgcaccgaaccaccagacctagctctatcagcggctacgacatacccgagggcaccgtcattataccaaacctgcagggagctcacctcgacgaaaccgtgtgggaaaggccccacgagttttggcctgacaggttcctcgagccagggaaaaatagcagggcattggcatttggttgcggcgcgcgcgtgtgcctgggagaaccgctagctcgcctggagctgtttgtcgtccttacacgcctgctgcaggcattcacattactgccgagtggcgatgccctcccaagcctgcagcctttacctcattgcagtgtgatcctgaaaatgcaaccctttcaggtacgccttcagcccagggggatgggagcccacagtccagggcagtctcaatag

SEQ ID NO: 113685 - DNA, 1488 bp, Artificial Sequence
  Description of Artificial Sequence: Synthetic coding sequence
atgcttttattgggactcctcttactactgccactcctagctggtgctaggctgttgtggaattggtggaaacttcggagtttgcacctgcctccactcgcacctggttttctccatttgctccagcctgacctgcctatctatctgctcggactcacgcagaagtttggccctatctatcgcttacatttaggcttgcaagacgtggtcgtgcttaattctaagaggaccatcgaagaagccatggtgaaaaaatgggctgacttcgcgggtaggccagagccactgacctacaagctggtatcacggaactaccccgatctgtccttgggcgattatagtctgctttggaaggcccataagaaattgaccagaagtgctctgctgctaggcatccgtgacagcatggagcctgtggtcgagcagctcacacaggagttctgcgagcgcatgcgcgcacagccaggcaccccagtggctattgaagaggagttctctcttctgacttgctccattatctgctacctgacgttcggagacaaaatcaaggatgataacctgatgcctgcttactacaagtgcattcaagaggtactgaagacctggagccactggagcattcagattgtggacgtgataccattcttacgctttttcccaaaccccggcctcagacggctgaaacaggccatagagaagcgcgatcacattgtggagatgcagcttcgtcaacataaagagagcctagttgccggtcagtggagagacatgatggactacatgctgcaaggcgtcgcccagccttctatggaggagggcagtggacaactacttgaagggcacgtgcacatggcagctgtggatctgctcatcggcgggactgaaaccactgcgaacacactgagctgggccgttgttttcctgcttcaccaccccgagatccagcagaggttacaggaggagctagatcacgagctgggtcccggagcctcctccagtagggtaccgtataaggacagagctcggcttcctctactgaacgcaaccatagctgaagttcttaggctccgacccgtcgtgcccctggcccttcctcataggaccactagacccagtagcatatccggctacgacatccctgagggcacagtcataatcccaaatctccagggagcccatctcgacgagaccgtttgggaaaggccacacgagttttggcccgatagatttctggaacctggcaagaattctcgcgctctggcattcggatgtggggcgcgtgtctgcttgggggagccattggcacgcctggagctttttgtggtgttgactaggctcttgcaggcttttactctgcttccttcgggcgacgcgctgccaagcttacaacctctcccccactgttccgttatacttaaaatgcagcctttccaagtccggctccaaccccgaggaatgggggcccacagccctggtcagagccagtag

SEQ ID NO: 113686 - DNA, 1398 bp, Artificial Sequence
  Description of Artificial Sequence: Synthetic coding sequence
atgctcctcctaggcctcttgctcctcctgccactactggctggtgcgcgactgctttggaactggtggaaattgaggagccttcaccttccacctttggctcctggtttcctacacctccttcagcctgacctccctatatatctgctcggactaacccagaagtttggccccatttataggctgcacctgggactgcaggataagctcgtgtcacggaattaccccgatctgtctttaggagactacagcctgctttggaaggcccacaaaaagcttactcgcagcgccttactcctggggattcgagactccatggagcccgtagtcgaacaactcacacaggagttctgcgagagaatgcgtgcccagcccggaactcccgtggcaatcgaagaggaattttccctcttgacctgcagcatcatatgttacctgacatttggcgataaaattaaagatgacaacctgatgcctgcctactataagtgtattcaggaggtccttaaaacttggtcccactggagcatacaaatcgtggacgtgatcccattcttgagattcttccccaacccagggttgagaaggttgaaacaggcgatcgagaagagagatcatatagtggaaatgcagctgcgacagcacaaggaatcattagtagctggccaatggagagatatgatggattacatgctgcaaggagtggctcagccatcaatggaagaggggagtggtcagctcctggaaggacatgtccacatggctgctgttgatctactaataggcggcactgagaccacagccaacaccctcagctgggccgtggtgttcttactgcatcatcctgagattcagcagagactccaggaggagcttgatcatgaactgggtcccggggcgtcatcttccagggtgccttataaagatagagccaggctcccactgcttaatgccacaatcgctgaggttctccgcctgagacctgtcgttcctttagcgctcccacatcggaccactcgcccgagttctatttccgggtacgacatccctgagggcaccgtcattattcccaatctgcaaggagcgcacctcgacgagactgtgtgggagcgtccccacgaattctggccagaccggtttcttgaacctggcaaaaactctagggctctggcgttcgggtgtggggctagggtttgcctgggggaacctctggcaaggctggaactgtttgtggtgctgaccaggctgctgcaagcattcacactgctcccttccggggacgctcttccttcactgcagccccttccccactgttctgtcattcttaaaatgcagcctttccaggttcgcctacagcccagagggatgggagcgcatagccccggacagtcccagtag

SEQ ID NO: 113687 - DNA, 1398 bp, Artificial Sequence
  Description of Artificial Sequence: Synthetic coding sequence
atgctgctcctcgggcttctactgctgctgcctttgctcgcaggggctaggctcctgtggaactggtggaaactgcgtagtctgcatcttccccccctggccccagggtttctgcacctgctgcaaccagacttaccgatctacctgttgggcctgactcaaaagtttggcccaatttacagactgcacctgggtctgcaggataaactagtctccaggaactaccctgatctttccttgggggactactccttactatggaaagcccacaaaaagttaacacgctctgccctgttgttgggtattcgtgacagtatggagcccgtggtggagcagttgacccaggagttttgcgagcgcatgcgagctcagcctggaaccccagtggcaatagaagaggagttttcattgctgacctgctccatcatctgctacctcactttcggcgacaaaatcaaagacgataatctgatgccagcctactacaagtgtattcaggaggtgctcaaaacctggtcacactggtctatccagattgtcgacgttatcccattcttacgattctttccgaatcccggactccggaggcttaaacaagccatcgagaaacgggatcatatagttgagatgcagctgcggcagcacaaggaaagtcttgtagccggccagtggagagatatgatggactacatgctgcagggcgtggctcagccatcaatggaagaggggagcggccagctgctcgagggacacgtgcatatggccgccgtggacctgctgatcggcggaacggaaaccaccgccaatactctgagctgggcggtcgtttttctcctccaccaccccgagattcagcagagattacaggaagagctggaccacgaattgggcccaggagcctcatccagtagagtcccatataaagatagggcccgactccctctattgaacgcaactatagctgaagttcttagactccgtcccgtcgtccctttggcccttccacatcgtaccacccgtccctcgtccatcagcggctacgatatcccagagggcacagtgatcatacccaacctgcaaggcgctcaccttgacgagacagtctgggagagaccccatgagttttggccggaccgttttctggagccaggcaaaaacagtcgcgccctggcattcggttgcggtgcccgcgtttgtcttggcgaacccttggcccgcttggaattgttcgttgtgttaacacgcttgctccaggccttcacactcctcccaagcggcgatgccttacccagccttcagcccctgccccactgttccgttatacttaaaatgcagcccttccaggtccggttacagccccgaggtatgggggcacattcccctggccaatcccagtag

SEQ ID NO: 113688 - DNA, 1485 bp, Artificial Sequence
  Description of Artificial Sequence: Synthetic coding sequence
atgctcctgctgggtcttcttctgctgcccctattggcgggcgcccggctcctttggaattggtggaagctgaggtcactgcacctaccaccccttgccccagggtttctgcaccttctgcagccagatctgcctatctacctcctgggcctgactcagaagttcggacctatctaccgcctgcatctggggctgcaggacgtggttgtgctgaactccaagagaaccattgaggaggcaatggtcaagaaatgggctgactttgcagggagacctgagccactcacctataagttggtgtcgaaaaactaccccgatctcagcctgggggattattccttgctttggaaagcgcacaagaaactaactaggtcggcactgctgctgggaatccgcgattccatggagcccgtagtggaacagctgactcaggaattctgtgagcgcatgagagcgcaacctggtactccagtagccattgaggaggaattctctctcttgacttgtagtatcatctgttacctgactttcggggacaaaattaaagatgataacctgatgcccgcgtattataaatgcattcaggaggtgctcaagacttggtctcactggtctatccagattgtcgatgttatacccttcttgcggttctttccgaaccctggattaagacgccttaagcaggctatcgaaaaaagagaccatatcgtcgagatgcagcttagacagcataaagagagtctggtcgcaggccagtggcgtgacatgatggactacatgcttcagggggtagctcagccttccatggaggaaggctcaggacagcttcttgagggacatgtgcacatggcggccgtggacttgttaattggcggaaccgagaccacggccaacaccctgtcctgggcagttgtcttcttactacaccaccccgaaatccaacagaggctccaagaggaattggaccatgagcttggcccgggggcttcaagctccagagtgccctataaggatcgagcccgcctcccattgctcaatgctacgattgcagaggttttgcgcctgcggccagtagtgccccttgccctgccccatagaaccacccgtccttcctccatctccgggtacgatattccagaggggacggtcattatacccaatctccagggtgctcacctggacgaaaccgtatgggaacgcccccatgagttctggccagatcgttttcttgagccaggcaagaatagccgggccctcgcatttggctgcggggctagagtatgtctcggggaacctctggctcggctggagctgttcgtggtgctgacgcgactcctgcaggcgttcactctgctgccctccggggacgccctaccttcgctgcaacctcttccacactgctccgtgatcctgaagatgcaaccattccaggttagattgcagcccaggggcatgggggcgcacagtcccggacagaaccaatag

SEQ ID NO: 113689 - DNA, 1485 bp, Artificial Sequence
  Description of Artificial Sequence: Synthetic coding sequence
atgctcctcttgggcctgctgctgcttcctctgctagctggcgcccggctcctttggaattggtggaaacttcgcagtctccacctccctccccttgcgcccgggtttcttcacctgctgcagccagatctgcctatatatcttctcggcctgacacaaaaatttggccctatataccgccttcacctcgggctccaagatgttgtggtcctcaactcaaagaggaccatcgaagaggcgatggtcaagaagtgggctgatttcgccgggcgacccgagcccctgacatataagctggtaagcaaaaattacccagatctcagtcttggagattattcacttttgtggaaagcccacaagaaactgactaggtctgctctcctcttaggaatcagagacagtatggaacctgtagtagagcagctaacgcaggagttctgcgagagaatgcgcgctcagccaggaaccccagtggcgatcgaggaggagttctctcttctgacctgtagcataatctgttacctgaccttcggagataaaatcaaggatgacaacctgatgcctgcatactataaatgcatccaagaggtgctgaaaacgtggtcccactggtctatacagatagtagacgtgatcccgttcttgcggttctttcccaacccaggcctacgtaggcttaaacaggcgattgaaaagagggaccacatagtggaaatgcagctgcgccagcataaggagagtttagtcgctggtcagtggagggacatgatggactacatgctgcaaggagtggctcaaccgtccatggaggaaggatctggccagctccttgaaggacatgttcacatggctgctgtggatctgctgattggtgggaccgaaaccacagccaataccctatcttgggcggtggtgttccttttgcaccaccctgagatccaacagcgacttcaggaagagctggatcatgagttaggtccgggcgcatcctcatcccgggtgccatataaggacagggcacgcctccccctgttaaatgctactattgcggaagttctcagacttaggcccgtagtgccccttgcactcccacatcggactaccagaccttcaagtatttccggttacgacatccccgaaggaactgtgattataccaaacctgcagggggcgcacctggacgagaccgtttgggaacgcccgcacgaattctggcccgatagatttctggaaccaggcaagaatagcagggcccttgcctttgggtgcggagcgcgcgtgtgccttggtgagccactcgctaggctggagttatttgtggtactgacacggctactccaggcctttaccctgctcccatctggagatgctctgccatcccttcagcctctgcctcactgctctgttatcttaaagatgcaaccgtttcaggtgagactgcaaccgagaggtatgggtgcacatagccctggccagaatcaatag

SEQ ID NO: 113690 - DNA, 1488 bp, Artificial Sequence
  Description of Artificial Sequence: Synthetic coding sequence
atgctgctcctgggacttcttctccttctgccactcttagccggggcccgcctgctctggaactggtggaaactcagatctctacacctgccaccacttgcaccaggctttctccatctcctgcaacctgatctccctatttacctgctggggctgacccagaaatttggtcccatttatagactccaccttgggctacaagacgtggtggtgctcaatagtaaacgaacaatcgaggaagcgatggtgaagaaatgggccgactttgctggccgcccagagccactgacgtacaagctagtcagccggaactaccccgatttatctttaggtgattattctctgttatggaaggcccacaagaaattaactcgctccgcccttctcctgggcattagggattccatggagcccgtcgtggagcaattgacccaggagttctgcgagagaatgcgtgcccagccggggacccccgtggccattgaggaagaattctcgctcctgacctgcagcataatatgttacctcacttttggcgataagataaaagatgacaatctcatgcctgcttactataaatgtatccaagaagtgctgaagacgtggagtcattggtccattcagattgtggatgtaatccctttcctgaggttcttcccaaaccccggactgcgccgactgaaacaagctattgagaagagggaccacattgtggaaatgcagcttagacaacataaggagtccctggttgccggacaatggcgtgacatgatggactacatgctgcaaggggtcgcccagccttccatggaagaggggtccggccagctcctcgagggccacgtgcatatggctgctgtggacctcctgattggggggactgaaacaacggcgaataccctgtcttgggctgttgttttcctcctgcaccatcccgagatccagcagaggctgcaggaagagttggaccatgaactaggaccaggagcctcttccagcagagtcccctataaagatagggcccgactccctttactaaacgccaccattgctgaagtactcagactccgcccagtagtcccactggccctgccacaccggactactaggccaagctctatctccggctacgacatacctgaagggaccgtgataattcctaatcttcagggggcacatctggacgagactgtgtgggaaagaccccacgaattttggccggatagattcctggagcccggcaagaattcccgggccctggctttcggatgtggagcaagagtctgcctgggggaaccactggcccgcctggagctgttcgtcgtcctgacgaggctgctccaggcttttacattgttaccaagcggggatgccctgcccagtctccagccgctgccccactgctctgtgatcctgaaaatgcaacccttccaagtccgcctccagccccgtggcatgggcgcacattcccctggacaatcacagtag

SEQ ID NO: 113691 - DNA, 1395 bp, Artificial Sequence
  Description of Artificial Sequence: Synthetic coding sequence
atgctcttactcggcctcttactcttgcccctcctagccggcgcgcgcctgctttggaattggtggaaactgcggtccttgcacctccctcctctggctcccggctttctgcacttgttgcagccagacctgcctatatatctgctcggactgacacagaaatttggtccaatctaccgcctgcacttggggctgcaggataagctggtgagcaagaattatcctgacttgtcattaggggattattccctgctgtggaaggcccataaaaagcttactcggtccgcgctcctgttgggaatcagggacagtatggaacctgtcgtcgagcaactcacccaggaattctgcgaacgcatgcgagcacagcccgggacccccgtggccattgaagaggaattctcattacttacatgcagcatcatttgctatctgacttttggcgataaaatcaaggatgacaacctcatgccagcatactacaagtgcatccaggaggtgctgaagacatggtctcattggtcaatacagatagtggacgtgatccctttcctccggttcttccccaatccggggctcagaaggctgaaacaggccatagagaagagggaccacatcgtggagatgcaattgaggcaacacaaggaaagtctagttgccggccagtggcgggatatgatggattatatgctacagggagttgcccagccgagtatggaagagggatccggccagctgcttgagggccacgtccatatggccgcggtggacctgctaattgggggaactgagacgactgctaacaccttatcctgggccgtggtgttcctgttacaccaccccgagatccagcaacgcctacaggaggagctggaccacgaactcgggcccggagcatcttcgtcgcgagttccctacaaagacagagcccgcctccccctgcttaacgctaccatagcagaagtgctgaggctgagaccagtggtccccttggctctacctcaccgaacaacccgaccctcaagcatctcgggctacgatatccccgaaggcaccgtaatcatccccaacctgcaaggagctcatttggacgagacagtatgggagcgcccacacgagttctggcccgaccgcttcctcgagccgggaaagaactctagagctctagcgtttggttgtggtgcccgtgtgtgcctcggcgagcccctcgcaaggctggaactatttgtggtgcttactcgactgttacaggcatttaccttactcccctccggcgatgcactgcctagcctccagcccctgccacattgctcggttatccttaaaatgcagccctttcaggttaggctccagccccgcgggatgggcgcacacagccccggacaaaaccagtag

SEQ ID NO: 113692 - DNA, 1398 bp, Artificial Sequence
  Description of Artificial Sequence: Synthetic coding sequence
atgctgctgttggggctgctcctattgctgcctttactcgccggagcaaggctgctctggaactggtggaaactgcgcagcctgcatctgccgcccttagccccgggttttctccacctattacaacccgatctgcccatttacctgcttggactgacgcagaaatttgggcccatctatcgcctgcacctcgggcttcaggacaagctggtttcacgaaattaccccgatctttccctgggggattacagtctactttggaaggcgcacaagaaattaacaaggtccgccctcctcctcgggattcgggacagtatggagccagtagtggaacaactgacgcaggagttttgcgaaagaatgagggctcagcctggtacaccagtggctattgaggaagagttttctttgctcacgtgttcaattatatgctacttgacctttggtgacaagattaaagatgataacctaatgccagcctactacaagtgtatccaagaggtcctaaagacatggtcgcactggagtatccagatcgtggatgtcatcccttttctgcgctttttccctaaccccggcctgcgccgtcttaaacaagcaatcgaaaaacgcgatcatatcgtggaaatgcaactgagacagcataaagaatctcttgtcgcgggacagtggagggatatgatggattacatgctccagggtgttgcccagcccagcatggaggagggctccggacagcttctagaaggtcacgttcacatggctgcagtggatctgttgatcggagggaccgagacaacagcaaacactttatcgtgggccgtagtctttctcctccatcaccctgaaatccaacagcgcctgcaggaggagctggaccacgagcttgggccgggagcttcatccagcagggtaccttataaggaccgcgctcgtcttccgctactgaacgcaaccatagccgaggtgttgcgactgcggcccgtggtgccccttgccttacctcatcggacgacacggcccagcagtattagcgggtacgacatccccgaggggaccgtgattataccaaatctgcaaggggcacacctggatgaaacggtgtgggagcggcctcatgagttttggccagatcgattcttagagcctgggaagaattcccgggctctggctttcggctgtggtgccagggtgtgcttgggtgagccgctggcccgtctggagttgtttgtagttcttacaagactccttcaggcctttaccctcctccccagcggagacgctctccccagtctgcagccccttccacattgtagtgtgattctcaaaatgcaaccattccaggtgcgacttcagcctagaggcatgggcgcccactcacctggacaaagtcagtag

SEQ ID NO: 113693 - DNA, 1395 bp, Artificial Sequence
  Description of Artificial Sequence: Synthetic coding sequence
atgttactgctcggacttctgctgctccctctgctagccggagcgcggctgctttggaattggtggaagctgcggtccctgcatcttccaccattggccccaggctttctgcatctactccagcccgacctgcctatctatttgttaggtcttacccagaagttcgggccaatatatcgcctgcacctggggctgcaggacaaactagtatctaaaaattaccctgatttatctctcggtgactactctttgctgtggaaggcccataagaaattgaccagatctgccctgctgttgggtatacgggactccatggaacctgtagtcgaacaacttacacaggagttttgcgagcgcatgcgcgcgcagccaggaacccccgtagccatcgaagaggaattttccctgctgacatgtagcataatatgttacctgacattcggtgataaaattaaagacgataatcttatgcccgcgtactacaaatgcatccaggaggtgctgaaaacttggtcccattggtcaatccagatcgtggacgttatcccctttctgcgattctttcctaaccctggcctgaggcggctgaaacaggcgatagagaagcgggaccacatcgtcgagatgcagctcaggcagcacaaggagtctttggtcgcaggacagtggcgcgacatgatggattatatgcttcaaggcgttgctcagccctccatggaagaaggatccgggcagctgttggaagggcatgtgcatatggccgcagtcgaccttctaattggggggactgagaccaccgcaaacacgctgtcgtgggcggtggtatttcttctccaccaccctgagattcaacaacggctgcaggaggaactcgatcatgaattgggccctggtgcttcttcttcccgtgtcccttataaagacagagctcgactaccactgctcaatgctaccatcgccgaggtattgcggctgcgccccgtcgtccccctcgccctgcctcatcggacaacacgtcctagctctataagcggttatgatattccagaagggaccgtcataattcccaacctccaaggggctcatctcgacgaaaccgtttgggaaagaccccacgaattttggccagaccgcttcctggagccaggaaaaaatagccgggccctcgcctttggatgcggtgcacgcgtatgtctcggagagcctctcgcccgcttggagctgtttgtggtcctcactcgtttattacaggcctttaccctcctaccttcaggagatgcgcttccctcccttcagcctctccctcattgctccgtcatcctcaagatgcaacccttccaggtgcgcctccaaccgcgcggcatgggagctcacagtccgggccagaaccagtag

SEQ ID NO: 113694 - DNA, 1488 bp, Artificial Sequence
  Description of Artificial Sequence: Synthetic coding sequence
atgctactgcttggcttgctgctgctgctgcctctcctcgctggggctagattgctctggaattggtggaagctgaggagccttcacttgctgccactggcacctggcttcttgcacctgttacagcctgaccttcctatatatctactgggcttaacccagaagttcggcccaatctacaggctgcacttaggcctgcaagatgtggtggtattaaactccaaacgaaccatcgaggaggcgatggtcaaaaagtgggccgattttgctggtagaccagagccactgacctacaaactggtgagcaaaaactatccagacttgtcattaggggactattctctcctatggaaagcacataagaaactgacaaggagcgcattactgctgggaatccgcgattcaatggagcccgttgttgagcagcttacgcaggaattttgtgagcgaatgcgggcacagccagggaccccggtagccatcgaggaggaattcagtctactgacctgttcaatcatctgctacctgacgtttggcgataagatcaaggacgacaatctgatgcccgcctattataagtgtatacaggaggtgctaaaaacatggagccactggtcaatccaaattgtggatgtgatcccgtttctgcgtttttttcccaacccggggctgaggcgattgaaacaggcaatcgagaagcgcgaccatattgtggagatgcagctgaggcagcacaaagagagtctggtagccgggcagtggagagacatgatggattacatgttgcaaggagtggcgcagccaagtatggaggaaggctcaggacagctgctcgagggacacgtgcacatggctgccgtggacctgctgataggaggcaccgagactaccgccaataccctcagttgggctgtcgtgttcctactgcaccatccagagatccagcagcggcttcaggaggaactggatcacgaacttggtccaggcgccagtagtagtcgggtgccatacaaggacagagcacgtttacccctgttaaacgccactattgccgaagtactgagattgaggcctgttgtcccccttgctcttccccaccgcaccaccaggccttcctccatcagcgggtatgatatcccagaagggaccgtcattatccctaacctgcaaggagcccacctggacgagactgtgtgggagcgcccccacgagttctggcccgacaggttcctggagccgggtaagaactctcgggctctggccttcggttgtggggccagagtttgtctaggggaacctctcgctaggctggagctgtttgtggtactgacccggctgctgcaggcctttacgttgcttccttctggcgatgccctcccgtccctccagcctctgcctcactgttcagtgatccttaagatgcagccctttcaagtgaggttacaacctcggggcatgggggcccattctccaggacagaaccaatag

SEQ ID NO: 113695 - DNA, 1488 bp, Artificial Sequence
  Description of Artificial Sequence: Synthetic coding sequence
atgcttctattaggtctgttgttacttcttccccttttggccggagcacgactcctctggaattggtggaagctgagaagcctgcacctgcctccactggcccccggcttcctgcacctgctgcaaccggatctgccaatctacctgcttggactcacccaaaagtttggcccgatctatcgtctgcatttgggactgcaagatgtagtggtgctgaactccaaaagaacaatagaggaggcaatggtgaaaaagtgggctgatttcgcagggaggccggaacctcttacatataagcttgtctctaagaactaccccgacctgagcctaggcgattattcgctgctctggaaggcacacaagaaacttactcgtagcgcactgctcctcgggataagggattccatggagcccgtcgtggaacaactcacccaggaattttgcgagcgcatgcgggcacagcctggaacacccgtagcaatagaggaagagttctctctccttacatgctcaattatttgttacttgacattcggcgataaaatcaaagacgataatctgatgccagcgtattataaatgtatccaggaggtcctcaaaacctggtcgcactggtccattcaaatagtggatgtcatcccattcctgcgcttcttcccaaatccgggactcagacgacttaaacaggcgattgaaaaaagagatcatattgtggagatgcaactgagacagcacaaggagtccctcgtggccgggcagtggagggatatgatggattacatgcttcagggagttgcccagccatctatggaagagggttcaggtcaattgctggaaggccacgtgcacatggcagccgttgatctgctgatcggtgggacggagaccacggccaacaccctgagttgggccgttgtgttccttttacaccacccagaaattcaacagcggcttcaggaggagctcgaccacgagttagggccgggagcaagttccagcagagttccgtataaagatagggcgcgactcccattactcaacgccaccatcgcggaggttctgagactgcgaccggtggtgccactggctctcccccacaggaccaccaggccctcaagtatctcaggctacgacatcccagaggggaccgttatcatcccaaacctgcaaggcgcccacctcgatgagacagtgtgggagcgacctcacgagttctggcctgacagatttctggagccaggcaagaacagcagggccttggccttcggctgtggtgcccgggtttgtctgggcgagcccctggctagactggagctgtttgtggtgctgacgaggttattacaagccttcactcttttaccctcaggtgatgctctgccgtctctccagcccctgcctcattgttcagtaatcctgaaaatgcagccattccaggtgcgcttacagccgaggggaatgggcgcccatagccccggacaaaaccagtag

SEQ ID NO: 113696 - DNA, 1398 bp, Artificial Sequence
  Description of Artificial Sequence: Synthetic coding sequence
atgctgctgcttggcctactattgctgttgccgctgctggctggcgcccgcctactttggaactggtggaaattgaggagcttacacctcttacctcttgcccctggatttttgcacctcctccagcctgacctccctatctatctcctaggactgacacaaaagttcgggcctatatatcggctgcatttgggtctacaagacaagcttgtaagcaagaattatcccgacttgagcctcggggattactctctgctgtggaaggcccacaaaaagctcacccggagtgccttactgctgggcatccgggactctatggaacctgtggttgaacagctgactcaggagttttgcgaacgaatgagggcacagccaggaacaccggtggcgatcgaggaagagttttccctgctgacctgcagtattatctgctacctgacatttggagataaaataaaagacgataatctgatgcctgcttactataagtgcattcaagaggtgctcaagacgtggtcccattggagcattcaaatcgttgacgtaatcccctttctgcgcttctttcctaatccaggtctccggcggctgaagcaagcaattgagaagagggatcacatagtggagatgcagctgcgacagcataaggaatctctggtagcgggtcagtggcgagatatgatggactatatgcttcaaggcgtggcgcagcctagcatggaggaaggctccggacagctcctggagggacacgtacatatggccgctgtagacttgttgatcggcgggacagagaccacagccaatacccttagctgggcagtggtgtttctgttacaccacccagagatccagcagagattacaagaggagctcgatcatgagctgggtccaggcgcatcctctagccgggtcccgtacaaggatcgcgcccgcctcccgcttcttaacgccaccatagctgaggtgctccgcctgcgcccggtggtccctctggccctgcctcacagaaccactaggccgtcgtcaattagcggatacgacattcctgagggtacggttattattcccaatctccagggtgctcacctcgacgagacagtttgggagcgaccacatgaattctggcccgataggtttttggagcctggcaaaaactcgagggctctcgcttttggctgcggagcgcgcgtatgtctgggagaacccctggccagactcgagctcttcgttgtccttaccagactgctgcaggctttcacactgctgccctcgggcgatgccctgccttccctgcagcccctaccccattgctccgttatcctcaaaatgcaaccttttcaggtaagactgcagcccaggggcatgggagctcactcacccgggcagaaccagtag

SEQ ID NO: 113697 - DNA, 1704 bp, Artificial Sequence
  Description of Artificial Sequence: Synthetic coding sequence
atgcacggtagattaaaagtgaaaaccagcgaggagcaggccgaggctaagaggctggaaagagaacagaagctgaaactgtaccagagcgctacacaggctgtgttccagaaaagacaggccggagagctcgatgagtccgttctggaactcaccagccaaatactgggggccaatcccgatttcgcaactttgtggaactgcaggagagaagtgttacaacagctggaaactcagaaatccccagaggagctggcagccctggtgaaagcagagctgggcttcttggaatcttgtcttcgggtcaatccaaaaagctatgggacttggcaccacaggtgctggcttttgggcagattgcctgagccgaactggactcgagaactggagctctgcgctcgctttctggaggtggacgagaggaattttcactgttgggattaccgccggttcgttgccacgcaggccgcagtgcccccggcggaggagctggcttttacagacagcctcataactcgcaacttttccaattactcttcttggcactatcggtcatgtctgcttccacaactccacccccaaccagattccggaccacagggacggctgcccgaggatgtgctgttgaaagaacttgagctggtccagaatgccttttttacagacccgaatgatcagagcgcctggttttaccacagatggctgctgggaagggccgaccctcaggacgcactgcgctgtctccacgtctcccgcgatgaggcttgtctgacggtgtctttcagtcggcccctgctggtcgggtctaggatggaaattctattgctgatggtcgatgatagtcctctaatcgtggaatggagaacgcccgacggtcgaaatcgaccatcccatgtgtggctgtgcgatctcccagccgcatccctgaatgaccagttaccccagcacacttttcgcgtaatctggactgctggggacgttcagaaggagtgtgtgcttctaaaaggcagacaagagggatggtgtagggattccacaacagatgagcagctctttaggtgcgaattgtccgtcgaaaaaagtactgtccttcagagtgaattagaaagctgcaaagagctgcaggaactcgaaccagagaataaatggtgtctgttaaccatcatacttctcatgcgcgctctggatccgcttttgtatgagaaggagaccctccaatattttcagactctgaaagccgtcgacccaatgagagcaacctaccttgatgacctccgttccaaatttttactggagaactccgtgctaaaaatggagtacgcagaggtgagggtgctgcacctggcacacaaggatctgaccgtactgtgtcacttagaacagctcctactagtcacacaccttgatctgtcccacaacaggctgagaaccctgccgccggccctcgccgcgcttaggtgtttagaagtcttacaggcgtctgataatgcaattgagtctctcgatggtgtgaccaatctcccaagacttcaggagctgctgctatgtaacaatcgcttgcagcaacctgccgttctgcagccgctggcctcatgtccccgcttggttctcctcaatcttcaaggaaaccccttgtgtcaggccgttggaattttggagcaactggctgagctgctccccagcgtctcttccgtgctgacatag

SEQ ID NO: 113698 - DNA, 1347 bp, Artificial Sequence
  Description of Artificial Sequence: Synthetic coding sequence
atgtcatcccctatttccaaatcccggtcccttgcagcctttctgcagcagcttagatcacccagacagcctcccagacttgtcacctccactgcctatacaagtccacaacctcgagaggtgcctgtgtgtccacttacggccgggggcgaaacacagaacgccgccgccctccccgggcctacttcttggcccctcctgggatcattattgcaaatcctttggaaaggtgggttgaaaaaacagcatgatactctcgtggaataccataagaagtacggcaagatttttaggatgaagctgggctcatttgaaagcgtgcacctgggctccccttgtttgctcgaagccctctacaggacagagtcagcatatccccagcgcctagagatcaaaccttggaaagcataccgtgactacagaaaggagggctatgggttgctcattctcgagggagaggattggcagcgggttaggagcgccttccagaagaaattgatgaagccaggagaggtgatgaagttagataataagattaacgaagtcctcgctgactttatgggccgcatagatgagctttgtgacgagaggggacacgtcgaagatctgtacagcgaactgaacaagtggtcttttgagtcaatttgtttagtgctttatgaaaaaaggttcgggctgctccagaagaatgctggggacgaggccgttaattttattatggccatcaaaacaatgatgagtaccttcggcagaatgatggtgacacccgtggagctacacaagtccctgaacacgaaggtgtggcaggatcacacattagcatgggacactatattcaagtcagtgaaagcgtgcatcgacaataggctcgaaaagtattcccagcagccctcggctgattttctatgcgacatttaccaccagaaccgactctcaaaaaaagaactctacgccgcagtgaccgagctgcagttagctgcagtcgaaactactgctaactccctcatgtggattctttacaacctcagtaggaatcctcaagtacagcaaaagctgctgaaggaaatacagagtgtgcttcctgagaaccaggtgcctagggccgaggacctgagaaacatgccttatctcaaggcctgtcttaaggagtcaatgagattaactccttctgtcccattcaccacccgtacactggacaaggcaactgttttaggagagtacgctctcccgaagggcattgttcgcaaatatgatatccaggcaacggataatgagccggtagagatgctgcattcggggacattagttcccagccgagaactgcccattgccttttgccagcgctag

SEQ ID NO: 113699 - DNA, 1371 bp, Artificial Sequence
  Description of Artificial Sequence: Synthetic coding sequence
atggataaactgaacaagatcaccgtgcccgcctcgcagaaactcagacagcttcagaagatggtccacgatatcaagaacaatgaaggggggattatgaataagatcaaaaagctgaaagtcaaggcaccccccagcgtgccccggcgggactatgccagcgagtcacccgcagacgaagaagagcagtggtctgacgatttcgattccgactatgagaatcctgacgaacactcggacagtgaaatgtacgtaatgcccgccgaagagaacgccgacgactcgtacgagcctccccctgtggagcaggaaacacggccggtgcatccagcccttccttttgcgaggggggaatatattgacaaccggtcctcacagcgccactcgcccccattctcaaaaactctgccttccaaaccgtcgtggccctctgaaaaggcacggctgacctcgaccctccccgccttgactgctcttcagaagccacaggtcccccccaaacctaagggcctgttggaggacgaagccgactacgtggtgcccgtcgaggacaatgatgagaattacatccatccaacagagtcttcttctcccccacccgagaaggcgccaatggtgaatcgtagtacaaaacctaatagcagcacccccgcaagtcctcccggaacggccagtggtagaaattccggcgcctgggagacaaagtcgccccctcccgctgcacccagtcccctcccacgtgcgggaaagaaacctactacacccctgaagacaacgcctgttgcgagccagcagaacgcctccagcgtctgtgaagagaaacctattccagctgagcggcaccgaggctcatctcacaggcaagaggccgtgcagagtcctgtctttcctccggcgcagaagcagatccatcagaagcccattcctttacctcggttcactgagggcggcaacccgacagtggacgggcccttaccgtctttttcatcaaatagcaccattagcgagcaggaagcaggggtcctgtgcaaaccatggtatgcgggggcctgtgatcgaaagagcgccgaagaggctcttcaccgatctaataaagacggttccttcttgattcgcaagtcttccggacatgattcgaagcagccttatacgctggtggtatttttcaacaaaagagtgtataacatccctgtaaggttcatcgaagctacaaaacagtatgccttgggcagaaagaaaaacggcgaagagtacttcggtagtgtcgctgagatcatccgtaaccatcagcactcgcccctggtccttatcgactctcagaacaacactaaggattccacccgactcaagtacgcagtgaaggtcagctag

SEQ ID NO: 113700 - DNA, 1287 bp, Artificial Sequence
  Description of Artificial Sequence: Synthetic coding sequence
atgaaacgcaggaagtacggttttatctacaagacccatcttttcgggagacccactgtcagagtgatgggagctgacaacgtgcgcagaatacttctgggcgaacatcgattggtgagtgtgcactggcccgcttcagtacggaccatcctcggatccggatgtttgtctaatctacacgacagctcgcacaaacaacggaagaaggtgatcatgcgtgcattcagccgggaggcgttagagtgttacgttccggtgattactgaggaagtgggatccagcctcgagcagtggctgagctgtggcgaaagggggctgcttgtctacccagaggtgaagcgcctcatgtttcgcatagcaatgcgaatactgctggggtgcgaaccacagctcgcaggtgatggagacagtgagcagcaacttgttgaagctttcgaagagatgacgcgcaatttgttttccctgcctatcgacgttcctttcagtggactgtaccgtgggatgaaagcgcgaaacctgatacacgcccgaatcgaacagaatatacgggcaaagatttgcggattgagggcctcggaggccgggcaagggtgcaaggacgccttgcagttgctgatcgagcattcttgggaaagaggagagaggctggatatgcaggccctgaagcagtcgtctacagagctgctttttggcggtcatgagactaccgcctctgccgctacctctctgattacatacctggggttgtaccctcatgttcttcagaaagttagagaagagctgaaaagcaagggactgctgtgtaagtcaaaccaagacaataagctagacatggaaattcttgagcagcttaagtatatcggatgcgtgattaaggaaacactgcgcctcaaccctcccgtcccaggcggcttcagagtggccctgaaaacattcgagctgaacgggtaccagatccccaagggatggaatgtgatctatagcatctgtgatactcacgacgtggcagagattttcacgaataaggaggaatttaatcccgaccgtttcatgttaccacacccggaggatgcaagccggtttagttttatcccttttggcggtgggttacgctcttgcgttggaaaggaatttgcgaaaatactcctgaaaatcttcactgtagagttggctcgccattgcgactggcagttacttaacggaccgccgactatgaagactagtcccaccgtctaccccgttgacaacctccccgcaagattcacccacttccacggagagatttag

SEQ ID NO: 113701 - DNA, 1287 bp, Artificial Sequence
  Description of Artificial Sequence: Synthetic coding sequence
atgaaacggcggaagtatggcttcatctacaaaacccatctgtttggtagacccacagttcgcgtgatgggcgccgataatgttcgcaggattttgctcggagagcaccgtcttgtgtctgtccactggcctgctagtgtccgaactattctcggatcaggctgcttatccaatcttcatgactcaagtcataagcagagaaaaaaagtaataatgcgtgccttctcccgggaggccctggagtgttatgtcccagtgatcactgaggaggtggggagctcattagaacagtggctctcatgcggggaaaggggtttgcttgtgtatcccgaggtcaaacgtctcatgttccggattgccatgcgcatcttactaggctgtgagccacagctggcaggcgatggcgatagtgagcaacaactggttgaagcgtttgaggagatgaccagaaaccttttcagcctgcccatagacgtgcccttctccggcctgtacagaggcatgaaggcaaggaaccttattcatgcgcgcatcgagcaaaacatacgtgcaaagatttgcggcctgagagcatcagaggccgggcagggatgtaaggacgccctgcagttactaatcgagcactcatgggaaaggggtgagaggctggacatgcaggcattgaagcagagctcaactgagctgctattcgggggccatgagactaccgcctcggccgcaacttctctgatcacctaccttggattgtacccgcatgtgctgcaaaaggtgcgggaagaactaaagtctaagggactgctatgcaagtcaaaccaggacaacaaattggatatggaaatactagagcagttgaagtatattgggtgcgtcatcaaggagactctccgcctcaatccccccgtaccaggggggtttagagtcgctctaaaaactttcgaactcaatggatatcaaatacccaaaggatggaacgtgatttactccatctgtgacacccatgacgttgcagagattttcaccaacaaagaggagttcaaccctgacaggttcatgctaccacatcctgaggatgcctcacgattttcttttattccattcggtggggggctgaggtcatgcgttggaaaggaatttgcgaagattctgctgaaaattttcactgttgaacttgccaggcactgtgactggcaactactcaatgggccacccactatgaaaacatcccctacagtctaccccgttgacaatctgccagcccgtttcacccacttccatggtgagatctag

SEQ ID NO: 113702 - DNA, 1569 bp, Artificial Sequence
  Description of Artificial Sequence: Synthetic coding sequence
atgtttccttggggactgagctgcctaagcgtgctgggagcagctggaacagccctgctttgtgctggcctgctcctctccctggctcaacacttgtggaccctgagatggatgctgtcaagggaccgtgctagtacattaccactacccaagggaagcatggggtggccttttttcggggaaaccctgcattggctggtccagggttctaggttccactcaagcaggcgcgagcggtatgggactgtattcaaaactcacctcctgggaagacctgtgatccgagtatccggcgccgagaacgtaaggacaatcctgctgggagagcatcgccttgttcgttcgcagtggccacaaagcgctcatattctgttaggatcccataccctattgggagcagtcggtgaaccccataggcgcaggaggaaagtccttgctagggtgttctcccgggccgctttggagcgatatgtacccaggttgcagggcgcccttagacacgaggtccgcagttggtgcgcagctggcggtccggtgagcgtgtatgacgcctcaaaagcactcacgttcagaatggctgcgcgaatcctcctggggttaaggctcgatgaagcacagtgtgccaccctcgcgagaacatttgagcagctagttgaaaatctcttttccttgccacttgacgtgcccttctctggtctgaggaaaggcatccgtgccagagaccaactgcacaggcatctggaaggggccatatccgaaaagctgcacgaagacaaagcagctgagccaggagatgcgctcgacctcattattcacagcgcccgcgaactgggtcatgagccttctatgcaggagctgaaggaatctgcagtggagctgctgtttgctgccttctttaccacagcttctgcatctacctctctggtgctgctgttattgcagcaccccgctgccattgccaaaatccgcgaagaactggtggcccaggggctgggacgagcttgcggctgcgctccaggcgctgccgggggctcagagggcccacctccagactgcggatgcgaaccagatctgtcgctagctgcgctcggccgcctgcgatacgttgactgtgttgtcaaagaagtgctgcgtctcctgccgccagtttccggaggctatcgcaccgctcttagaacatttgaactcgacggataccaaatccccaagggctggtcagtaatgtactcaatacgtgatacccatgaaaccgcagccgtgtaccggtcccccccagagggctttgaccccgagaggtttggcgccgcccgcgaggactcaagaggtgctagttctcgatttcattatatccccttcggtggaggagcccgctcctgcttaggtcaagaactggcgcaagccgtccttcaacttctcgcggtcgaacttgttaggactgcccggtgggagctggcaacacccgcattcccggccatgcagaccgtgccaatagtgcaccccgtcgacggcctgcgattgttcttccacccgctgacaccttcagttgctggaaacggcctatgtttgtag

SEQ ID NO: 113703 - DNA, 1596 bp, Artificial Sequence
  Description of Artificial Sequence: Synthetic coding sequence
atggctgctcttggttgtgctaggctgaggtgggctctgcgaggggctggccggggcctctgccctcacggtgccagagctaaggccgccatcccagccgctctgccatccgacaaagctaccggggctccgggggctggccccggagtgagaaggcggcagaggtcccttgaagagataccacggctcggacagctgaggttcttcttccagctgttcgtccaggggtacgcactgcaactgcatcagctgcaggtcctctataaggcaaagtacgggcccatgtggatgtcatatctgggccctcagatgcatgtgaacctggcatctgctcccttgcttgaacaagtgatgagacaggaaggaaagtatccggtcaggaatgacatggagctgtggaaggaacacagagaccagcacgacctgacttatggccccttcacaacagaaggccaccattggtatcaactccgtcaggccctgaatcagaggctcctgaaacctgctgaggctgcgctgtatactgatgccttcaacgaggtgatagatgatttcatgacacgcctcgatcaactgcgcgcggaaagcgctagcggaaaccaggtttcggatatggcccaactcttttattatttcgccctcgaggcaatctgctacattctgttcgagaaacgcatcgggtgtctccagaggtccatacctgaagacacagtgaccttcgtcaggtctatcggcctgatgtttcagaactcactctatgctactttcctgccaaaatggacaaggccggtgttaccgttctggaaaagatatctggatggttggaacgctatttttagctttggcaagaagctgatcgacgaaaagctggaggacatggaggcacagctgcaggccgccggcccggacggaatccaggtgagcggttaccttcactttctgttggcatccggacagctcagcccgagagaagcaatggggagtttgccagagcttctcatggccggcgtggatacaacctcaaatacactgacctgggccttgtatcacctgtctaaagatcctgagattcaggaagcactacatgaagaagttgtgggtgtcgttcccgcgggccaagtcccacagcacaaggactttgctcatatgcctttgctgaaagctgttctgaaagaaactctgagattgtatcccgttgtcccaacaaattccaggattattgaaaaagagattgaggtcgatggatttctctttcctaagaacactcagttcgtgttttgccattatgttgtgagtcgcgaccctactgcgtttagcgagccagagagctttcagccacaccgttggctccgcaatagtcaacctgcaaccccacggatacagcatccgtttgggagcgttcctttcggctatggtgtgcgcgcttgcctgggccgtcgtattgccgagctagagatgcagttgctgctcgctaggctcattcagaagtataaggtggtgctggcccctgagactggagaactgaagagtgtggctaggattgttctggtgccaaacaagaaggtcgggcttcagttcctgcagcgacagtgttag

SEQ ID NO: 113704 - DNA, 1572 bp, Artificial Sequence
  Description of Artificial Sequence: Synthetic coding sequence
atgagcttccataaggaagatggcgtaaacagtctgtgccagaaggcactacacatcgtgacagaactatgctttgcaggacaggtggaatgggagaaatgttcaggcatttttccccgggaccgaggatctcagggcgggtcaagcaccgatatctctgtctcactactggctgttgtagtgtccttttgcggcttggcactgctggtggtgagcctgttcgtgttctggaaactctgttggccctgttggaaaagcaagcctgtcacctctaatattacgactctgcctcagtctatttcaagtgcgccaacagaggtctttgagacggaagagaagaaagagataaaggagaacgagaagcccgcggtcaaagcaatcgagcccgcaatcaaaatatcccacacctctcctgatatccctgcagaagtgcaaaccgcactgaaagagcacctcattaagcacgctcgggtacagcgccagattaccgaaccgacatcatcaaccagacactcatccttccgacgccacttacctagacagatgcaagtatcatccgtggatttcagtatggggacagaaccagtgctgcagagaggggaaacgaccacctcaattggtcgcatcaagcccgagctatataaacagaaatcggttgattctgaaggcaatcaaaacgaagacgtcaaaatttgcggcaaactaaattttaccctccaatatgattatgaaaacgaactgctagtggtgaagattattaaggctctagacttgcctgctaaggacttcactggaacgtctgacccatatgtgaaaatgtacctgctgcccgaccgcaaaaagaagtttcagactagagtgcataggaagactttaaaccctctcttcgacgagacattccaattccccgtagcttatgaccagttatccaatcgtaagctgcatttcagcgtgtacgacttcgacagattttctagacacgatatgattggagaggtcatcttggacaacctgtttgaagtctcagacttaagtagggaggccaccgtgtggaaagatattcattgcgctactactgaaagcatcgacttgggcgaaataatgttctcactgtgttatctcccgaccgcaggaagaatgactctgacagtgattaaatgcaggaatctgaaagccatggacattactgggagctctgatccctatgtgaaagtgtccttaatgtgtgaaggcaggagactgaagaagcgtaagacaactacaaaaaagaacaccctgaaccctgtctataatgaggctatcatattcgacatccctccagaaaacgttgatcaggtgagcctgagcatcgcagtcatggactatgacagagtgggacacaatgaggtcataggggtgtgccggacagggttggatgctgaaggcctgggacgggaccactggaatgaaatgttagcgtaccaccgaaagccaatcacacattggcacccactgctagagctgccaggacgagcgaccagcttcgattcccaaggttcgtgcccctctcccaaaccgccttcaaccccatag

SEQ ID NO: 113705 - DNA, 1512 bp, Artificial Sequence
  Description of Artificial Sequence: Synthetic coding sequence
atggccttgatccctgacctagcaatggagacttggttgttattggccgtgtcgttggtactgctctatctgtacgggacacatagccatgggctttttaagaaacttggcatcccaggcccaaccccccttccattcctaggcaacattctgagctatcataagggtttctgtatgttcgacatggaatgccacaaaaaatatggaaaagtgtggggcttttacgacgggcaacaacccgtccttgcaattacagacccagacatgataaagactgtgcttgtgaaggaatgctatagcgtgttcaccaaccggcgaccctttggccctgtgggctttatgaagtcagcgatatcaatcgctgaagacgaggagtggaaaagactgcgttcactgctttcgcctacattcacctccggaaagttaaaggaaatggttccaattattgcccagtacggagacgtactggttagaaatttgagacgggaagcggagactggaaaacctgtgacgttaaaagatgtgttcggagcatattccatggatgttataaccagcacgagcttcggagtgaacatagacagtctcaataatccacaagacccctttgtggagaataccaagaagctgcttaggttcgattttctcgacccattttttctctccattaccgtcttcccttttctgatcccaatcttggaggtgctgaatatctgtgtcttcccaagagaggtgacaaacttcctgcgtaagtcggtaaaacggatgaaggaatccaggttggaagacacccaaaaacatcgtgtggacttcttgcaactcatgattgacagccagaactcaaaggagacagagtcccataaagccctgtcagatctagagctagttgctcaaagcattatcttcattttcgcagggtacgagacaacatcctcagtgctctcttttattatgtatgaactagcgacccatcctgatgtgcagcagaaactccaggaagagatagacgctgtgctgcctaacaaagcaccccctacatacgatactgtgctacagatggagtatctagatatggtcgttaacgagaccctgcggctgttccccatcgcaatgaggctggagcgagtatgcaaaaaggacgtcgagattaacggcatgtttatcccaaagggggtagtagtgatgatacctagctacgccctgcatcgggaccctaaatactggacagaaccagagaagtttctacctgaacgattttctaagaagaacaaagacaacattgacccttatatttacaccccgtttggatcaggcccccggaattgtattggaatgcgctttgcacttatgaatatgaaacttgccctgattcgggtcctccagaacttttctttcaagccttgtaaagagactcagattcctcttaagttgagtctgggcggcctgctgcagcctgagaaacccgtagtgcttaaagtagagagccgtgatggaaccgtgtcaggcgcctag

SEQ ID NO: 113706 - DNA, 1062 bp, Artificial Sequence
  Description of Artificial Sequence: Synthetic coding sequence
atggctctcattccagatctggcgatggaaacctggctcttgctcgctgtttctctggtcttattatacttggtctttggggcatactcaatggatgtgatcacatcaacttcatttggcgtgaatatcgacagtctgaacaatccacaggatccattcgtggaaaataccaaaaaactgctaagattcgatttccttgacccttttttcctctccattactgtattcccgttcttgattccaatcctcgaagtgttgaatatatgcgttttccccagagaggttactaattttctgcgtaagagcgtgaaacgcatgaaagagtcacggctcgaggacacacagaagcaccgggtcgacttccttcaattgatgatagacagtcagaacagtaaggaaactgaaagccacaaggccttatccgatcttgagttagtcgcccagagtattattttcatttttgctggatacgagaccactagttctgtcctctcctttattatgtatgagctggcgacccatcctgacgtccagcagaagttacaagaggagattgatgcagtcttgcctaacaaagctccccctacctacgataccgtcctgcagatggaatatctggacatggtggtaaacgaaaccctgagactgttcccgatagccatgagacttgaacgcgtgtgcaaaaaggacgttgaaatcaatggcatgttcatcccgaaaggagttgtagttatgatcccgtcatatgcactgcaccgggacccaaaatattggaccgagccagaaaagtttctgcctgaaaggtttagcaaaaaaaataaagacaacattgatccttatatatacacaccattcggcagcggacccaggaattgcattggcatgaggttcgcccttatgaacatgaagctggcactcatcagggtgctgcagaatttctctttcaagccctgcaaagagactcaaatcccacttaaattatctctgggaggtctgctccaaccagaaaaaccagtggtgctgaaagtcgagtctcgcgacggtacggtctccggagcttag

SEQ ID NO: 113707 - DNA, 240 bp, Artificial Sequence
  Description of Artificial Sequence: Synthetic coding sequence
atggttcctattatcgcccagtatggcgacgtattagtccgaaacctccggcgagaggctgagacgggtaaacctgtcacgctaaaagacgtattcggtgcttattccatggatgttattacatccacctcttttggggtaaatattgatagcctgaataatccccaggaccccttcgtggagaatacaaaaaagttactaaggtttgacttcctggaccctttcttcctttcaatctag

SEQ ID NO: 113708 - DNA, 1068 bp, Artificial Sequence
  Description of Artificial Sequence: Synthetic coding sequence
atggcaaagctaattgcgctgactcttctgggcatggggcttgcgctctttagaaatcatcagtcttcttaccagacccgcctgaatgcactgagagaagtccaacctgtggaactgccaaactgcaatctcgtgaaaggaatcgagaccggaagcgaagatctcgaaatcctccctaacggactcgcatttatcagctccggtttgaaatatcctggaattaagagttttaacccaaatagccctggcaagattctgctcatggatcttaacgaagaggatccgacagtcctggaactcgggatcaccggttcaaagttcgacgtgagctccttcaatcctcacggaattagtactttcaccgacgaagataatgccatgtatctcctagtggtcaaccatccagatgcgaagtcgacagtggagttattcaagttccaggaggaggaaaagtctctcctccatcttaagactatacggcacaagctccttcctaaccttaacgacattgtggccgtcggacctgagcatttctatggaaccaacgatcactacttcctggatccttacctgcagagttgggaaatgtacctgggccttgcgtggtcctatgtggtttattattcaccgtccgaagtccgggttgtagccgaaggcttcgacttcgccaacggaattaatatcagtccagatggaaaatatgtctacatagcggagctactcgcccataaaattcacgtgtatgaaaagcacgccaattggaccctgacccccctcaaatcgctggattttaacacccttgtggataatatctccgtggaccccgaaaccggagatctatgggtggggtgccatcccaacgggatgaagatattcttctacgactcggagaatcctccagctagtgaagtgctgcgtatccagaacattttaacagaagaaccaaaggtcacacaggtgtacgctgaaaacggcacagtcctgcagggatcaacagttgcaagtgtttataagggcaagctgctgatcggaaccgtttttcacaaagccttgtattgtgagctctag

SEQ ID NO: 113709 - DNA, 1263 bp, Artificial Sequence
  Description of Artificial Sequence: Synthetic coding sequence
atggacctgattccaaacttcgcaatggagacatgggtgctcgtcgccacgtctctcgtcctgctctatatctatgggacgcactcccataagctatttaagaagcttggcatcccgggaccaacccccctgccgtttttaggtactatcttgttctatctgcgggggctgtggaatttcgacagagagtgcaatgaaaaatacggcgaaatgtggggcctgtacgaaggccagcagccaatgctcgtcattatggaccctgacatgataaagacagtcctggtgaaggaatgctactccgtctttaccaaccagatgcctcttggccccatgggcttccttaagagcgcactctctttcgccgaagacgaggagtggaaaaggattcgcacactcctgtcacccgcatttacctctgtgaagtttaaagagatggttccaatcatctctcaatgtggtgatatgctcgtgaggtctctgagacaggaggcggagaatagtaagtccatcaatctgaaagacttttttggcgcatataccatggatgttattacgggaactctgtttggtgtcaacctggatagccttaacaatccgcaggacccatttctaaaaaatatgaaaaaattgctcaaactcgattttctagaccctttcctgctgctgatctcactgttccctttcctcactcctgtgttcgaggccctcaatattggtctgtttcctaaagatgtaactcattttctgaagaattccattgaacgaatgaaagaatccagactgaaggacaaacagaaacacagagtggatttctttcagcagatgattgacagccagaactccaaagaaaccaaatctcataaggccctgtctgacctggaattggttgcacagagcatcattatcatttttgctgcttacgatactacttccacaacattgcctttcatcatgtatgagctggccacccacccggatgtgcagcaaaagctgcaagaggagattgatgcagtgctccccaataaggcccccgttacttatgatgcattggtgcagatggaatatttagatatggtggtgaatgaaaccttaagattgtttccagtagtgagtcgagtaactcgagtttgtaaaaaggatatagagattaatggcgtgtttataccgaaaggcctcgccgttatggtaccaatttacgctctccatcacgaccctaagtattggacagaaccagaaaagttctgtccggagcgctcgcactag

SEQ ID NO: 113710 - DNA, 843 bp, Artificial Sequence
  Description of Artificial Sequence: Synthetic coding sequence
atgaatctggaaaccgggaacgggccccaccatttcccaatgtggcgttacgtgggagagaaaccggaggccggaagtagggagcaacaagtacatcaactggaacgtttcctttggggtctgcaccacggatgcaaccattggcacataatttggagcgaactcggcttcagccagcaaagcacgagatccctgagcgagaaatacgaagaggcctttaaaatcgggttcttcggatctctgttcacgctaaatatccagtccctagctgtgctgccaagacctgaatgtatggtcaggagtggcttaaccgagacatcaacatcatgggtgagagtaattctactgccacagccacctgaagagctgggcttgcagcacagggtggacttttttcaacaaatgattgattcacagaactcaaaagaaacaaagagccacaaggcgttgtcagacttggagctggttgcccagtctataattatcatattcgcagcttacgacactacatccaccactcttccattcatcatgtacgagctcgccacacatcccgacgtgcaacagaaactgcaggaggagattgacgcagtgctacccaataaggcccccgtgacatacgacgcccttgtccagatggaatacctggacatggtcgtcaatgaaacactcagactcttccccgtggtgagcagagtcaccagagtttgcaaaaaagacatagaaatcaacggagtctttatacccaagggcctggccgttatggttccgatctacgcattgcaccacgaccctaagtattggacagaacccgaaaagttctgtccagaacggagtcactag

SEQ ID NO: 113711 - DNA, 1512 bp, Artificial Sequence
  Description of Artificial Sequence: Synthetic coding sequence
atggacctcattcccaactttgctatggaaacctgggtcttagtagccacctcgctggtgttgctctatatctacggcacacactctcacaaactgttcaagaagctcggaattccaggtcctacccccttgccttttctaggcacaattctgttttacttgagggggttatggaactttgaccgggaatgtaacgaaaaatatggagagatgtgggggctgtacgagggacaacagcctatgctagtgataatggaccccgatatgatcaagacggtcctcgtcaaggaatgttactcagtctttaccaatcagatgccactgggtcctatgggttttctcaagtcagctctctcatttgccgaggacgaagagtggaaaaggattaggacactactctctccagcctttacgtctgttaagtttaaagaaatggtgccaattatctcccaatgtggagatatgctagtgcgctctttgagacaggaagccgagaacagcaaatctatcaacctcaaggactttttcggggcatacactatggacgtcatcacagggaccttgtttggggtgaacctcgactccctgaacaaccctcaggacccatttctgaagaacatgaaaaaactgctgaagctggatttcctggatcctttcctcctactgatttccctgttcccttttttaactccagtgtttgaggccctgaacataggcttattcccaaaggacgtaactcactttcttaagaacagtatcgaaaggatgaaggagtcacgactgaaggacaaacagaagcatcgcgtcgattttttccagcagatgatcgactctcaaaacagtaaggaaacaaaatcccataaggctctgagcgacttagagctcgtggctcagagcataatcatcattttcgctgcctacgacaccacatcaaccaccctcccgtttatcatgtacgagctcgccacccaccccgatgtacaacagaaactccaagaagagatcgatgctgtgctgccgaataaggcccccgtaacttacgacgcgttggttcagatggaatacttggatatggttgtaaacgagacattgagactctttcctgttgtttctcgggtgacgagggtctgtaaaaaagacatcgaaattaacggcgtcttcattcctaagggcctagcagtcatggtacctatttacgctctccaccacgatcccaaatactggaccgaacctgaaaaattctgtcccgagcgcttcagtaaaaaaaataaagactcgattgacctctatagatacatcccatttggtgctggccccagaaactgtattggtatgaggtttgcgctcaccaacattaagctggctgttattagggcactgcagaactttagcttcaagccttgcaaagaaacacagatccccttgaagctggataacctccctatccttcagcctgagaaacctatcgtcctgaaggtacacctgagagatggtattacgagtggcccatag

SEQ ID NO: 113712 - DNA, 381 bp, Artificial Sequence
  Description of Artificial Sequence: Synthetic coding sequence
atggacctgatccctaatttcgctatggagacatgggtcctggttgctacctcactagtgctcctgtatatatacggaacacattcgcataaattgtttaaaaaactcggaatccccggccctacgcccctgccttttcttggtacgattttgttctatttgaggggcctgtggaactttgatagagaatgtaatgagaagtttttgtggggacttcaccatggctgtaaccactggcatatcatatggagtgaacttggcttcagccagcaaagcacccgtagcctgagcgaaaagtatgaagaagcgttcaagattggctttttcggctcgctctttacactgaatattaccctgtccattagctatccatctttttag

SEQ ID NO: 113713 - DNA, 225 bp, Artificial Sequence
  Description of Artificial Sequence: Synthetic coding sequence
atggatcttatccccaattttgcgatggaaacctgggttctcgtggccacttctctggtgctcctgtatatctatggtacacattcacacaagctcttcaagaagctgggtatccctggacccacgcccctgcccttcctgggaactatcctgttttatcttagaggactgtggaatttcgatcgcgaatgcaatgagaaatatggagagatgtggggtccctag

SEQ ID NO: 113714 - DNA, 435 bp, Artificial Sequence
  Description of Artificial Sequence: Synthetic coding sequence
atgccaaaagtaaagcggagcaggaaggccccacctgatggctgggagttgattgagcccaccctggatgagcttgaccagaaaatgcgtgaggctgagacggaacctcatgagggcaaacgcaaggtggagagcttatggcctatatttaggatccaccaccagaaaaccagatatatcttcgacttgttttacaagcgcaaagcaatctcgcgggaactttacgagtattgtatcaaggagggctacgcggacaagaacctgattgccaagtggaagaagcagggatatgagaacctttgttgtttgcgctgcattcagacccgggacaccaacttcggcactaactgcatctgtcgtgtcccgaagtccaagctggaagttggcagaattattgagtgtactcactgtggctgccgtggatgttctggctag

SEQ ID NO: 113715 - DNA, 120 bp, Artificial Sequence
  Description of Artificial Sequence: Synthetic coding sequence
atggatctcatccctaacttggcggtggagacatggctattacttgccgtcagccttgtcctgctgtatctgatgagagtgcctaagtcagccaagagtcctttaaccaagcaaacttag

SEQ ID NO: 113716 - DNA, 1479 bp, Artificial Sequence
  Description of Artificial Sequence: Synthetic coding sequence
atgcagttgctcatgctggaacttctgctgctctttatagtttacggtacccgcactcacggtctgtttaagagattagggattcctgggcccacacctctgccactactgggcaacgtactgtcctaccgacaaggtctgtggaagtttgacactgaatgctataagaagtatggaaagatgtggggtacctatgaagggcaacttccggtgctagctattacagaccctgacgtcattcgcacagtccttgttaaagaatgctattctgtgttcacaaatcgtagaagtctcgggcctgttggcttcatgaagtctgcaatttcccttgccgaggacgaggaatggaagaggataaggtcattgctgtcgccaacattcacgagcggaaaacttaaggagatgttccccatcatcgcccagtacggggatgtgctggttagaaacctgcggagagaagccgagaaggggaagcctgtcacccttaaagatattttcggggcttactcgatggacgtgattactgggacttctttcggcgtaaacattgattctctgaataacccacaggacccattcgtggaatccacaaaaaagtttctgaagtttgggttcctggacccccttttccttagtatcatactgtttcctttcctgactccagtgttcgaggcgctgaatgtgtctttattcccaaaagacacaataaattttctgagcaaatccgtgaataggatgaagaagagtcgactgaatgataagcagaagcaccgcctcgatttcttgcagctgatgatcgattctcagaattccaaagaaactgagtctcacaaggcactgagcgacctcgaactcgccgcacagtcgatcatttttatctttgccggatacgaaacaactagttcagtgctttcgtttactctttatgagctggctactcacccagacgtgcaacagaagctgcaaaaggaaatcgacgcggtgctgccaaacaaagctccacctacatacgacgctgtggtgcagatggaatacctcgatatggttgtgaacgaaacactccgtctgtttcctgttgccatacggctggaacggacctgtaaaaaggatgtagagattaacggggtttttattccaaagggatctatggtcgtgatcccaacctacgcccttcatcacgacccgaagtactggacagaacctgaggaatttcgacctgagcggtttagcaagaagaaggattctattgatccttatatctatacacccttcgggacagggccgcggaactgtatcgggatgaggttcgccctgatgaatatgaagctggctctgattcgcgtgctgcagaatttctcctttaagccttgtaaagagacgcagattcccctgaagttggacacccagggcctgctgcagcccgagaagccaattgtgctgaaagtcgatagtagagacggaacactgtcaggcgagtag

SEQ ID NO: 113717 - DNA, 1602 bp, Artificial Sequence
  Description of Artificial Sequence: Synthetic coding sequence
atggacctaatcccgaatttggccgtggaaacatggcttctcctggccgtctctctgatactcctgtatctgtatgggacacgaacacatggcttgttcaaaaagctgggcataccagggcccacaccccttccatttctcgggaatgcccttagcttccgaaagggttattggacctttgacatggagtgttataaaaaatatcggaaggtttgggggatctacgattgccagcagcccatgctggccataactgaccccgacatgatcaagaccgtactggtgaaggaatgctattccgtattcacgaataggcggcctttcggcccagttggttttatgaagaatgctataagtatcgctgaggatgaagagtggaaaaggatccggtctttactgtcacccacctttacgagtggcaaacttaaggaaatggtgcccataattgcacagtacggcgacgtcctggtgagaaacctgcgacgtgaggccgaaacagggaaacccgtcaccctgaagcacgtttttggggcctactccatggatgtgattacatccactagttttggcgtttcaatcgactcattgaataacccacaggatccctttgtggagaatacaaagaaactcctgcgattcaatcctctcgacccctttgtgttgtccatcaaagtgttcccctttttaacgcccatcctggaagcccttaatatcacagtgtttcccagaaaggtgatcagtttcttgactaaaagtgttaagcagattaaagagggaagactcaaggagactcagaagcatagagtggacttcctgcaactcatgatagattcgcagaactctaaagatagcgaaacacacaaagctctttctgacttggagctgatggcacagtccatcatctttattttcgcaggctacgaaacaactagtagtgtactgagcttcattatctacgaactggctactcatcccgacgtgcagcagaaagtgcagaaggagatcgatactgtattgcccaacaaggcacctcccacatacgatacggtgctccaactggaatatctggacatggtggtaaatgaaactctgaggctgtttcctgtggccatgcgtctggaaagggtatgcaagaaagacgtggaaataaacggcatgtttatccctaagggagtggtcgtaatgatcccttcctacgtcttgcaccatgatcccaagtactggcgtgaacccgagaagttcctccccgagagattttctaagaagaacaaagacaatatcgacccttatatctacaccccttttgggtccggcccgaggaactgtatcgggatgaggttcgccctggtgaacatgaaattagccctcgtccgcgtgctccagaatttcagtttcaaaccatgtaaggagacccagattcccctgaaactgcgctttggcggtctgctcctcacggagaagcctattgtactgaaggctgaaagccgcgacgagacgttcgtggatatggagccaatccacatggactttctgcggtcgctggcctttcagggtccccacctttgttttttttgggaactgctctgtcctacaataagatag

SEQ ID NO: 113718 - DNA, 1512 bp, Artificial Sequence
  Description of Artificial Sequence: Synthetic coding sequence
atggacctaatccccaacctcgcagtcgagacgtggttactgctggccgtatcgctaatcctgctatatttgtacggaacacggacgcatggattgttcaaaaagcttggcattccaggccctactcccctgccatttctcgggaatgctctctcctttaggaagggctattggacctttgatatggagtgttacaaaaagtatcggaaggtgtggggaatttatgattgccaacagcccatgctggcgatcactgaccctgacatgattaaaaccgtgctggtgaaggagtgttacagcgtgttcaccaaccggcgaccatttggaccagtcggcttcatgaagaatgccatcagcattgccgaggacgaagagtggaagagaattcggagccttctcagccccacatttacatcaggcaaactgaaggagatggttcctattattgcccagtacggtgatgtgctggtccgcaatttgagaagggaagcagaaaccgggaagcccgttacattgaagcatgtcttcggtgcgtattcgatggatgtcatcacttccactagcttcggagtttctatcgattccttaaacaatccacaagatcctttcgtcgaaaacaccaagaaactgctccggttcaatcccctggatcctttcgtccttagtattaaagtgttcccatttctcacccctatcttggaggcgctcaatatcaccgttttccctaggaaagttatcagctttctaacgaaatcagttaaacagatcaaggagggccggctcaaggagactcagaagcacagggtggactttcttcagttaatgattgattctcagaactccaaggactccgagactcacaaggccttaagcgacctggagctgatggcccaatctataatctttattttcgcagggtacgagactacttcatctgtgctgagttttattatctacgaattggcaactcatcccgacgtgcagcaaaaggtacagaaagaaattgataccgtgctgccaaataaggctcctcccacttatgatacagtgcttcagttggaatatttagatatggttgtgaacgagactttgagactcttccctgtggccatgaggctcgaaagggtgtgcaaaaaagacgtggagatcaatggaatgttcatacccaagggcgtcgtggtgatgatcccatcatatgtgctgcaccacgaccccaagtattggagggaaccggagaagtttctgcccgaaagattttctaaaaaaaataaagacaacattgatccctatatttacactccctttggttccggtcctagaaattgcattggcatgcgattcgcgctagtgaatatgaaactggctttggtgagggtgctccagaattttagctttaagccctgcaaagagacacagataccgcttaagctgcgctttggaggtctgctcctgacagaaaaacccatagtcctgaaggcggagagtcgcgacgagacagtgtctggggcctag

SEQ ID NO: 113719 - DNA, 1410 bp, Artificial Sequence
  Description of Artificial Sequence: Synthetic coding sequence
atggagctgatctcccccaccgttatcattatcctggggtgcctggcactgttcttgttactccaacgaaaaaacttgcgccggccaccctgcatcaagggctggataccctggatcggggttggttttgagtttgggaaagcccccttggagttcatcgagaaggcccggataaagtatgggccaatattcacagtgttcgctatggggaaccggatgaccttcgtgaccgaagaagaaggtattaatgtgttccttaaaagcaagaaggtggatttcgagctggctgttcaaaatattgtctacaggaccgcttctatccctaaaaacgtcttcctggcactccatgagaagctctacatcatgttgaagggcaaaatgggcacggtcaacctccatcaattcaccggacagttaacggaggaattacacgagcagctagagaacctgggcactcatgggactatggatctcaataacctggtgcggcatctcctgtacccagtaaccgtcaatatgctcttcaacaaatctcttttctccactaacaagaagaagatcaaggagtttcatcaatactttcaggtttacgacgaggattttgagtatggcagccagctacccgaatgcctgctgcgtaattggtctaagtccaaaaagtggtttcttgagctgttcgaaaagaacattcctgacattaaagcttgcaagagtgccaaggataacagcatgacactcctacaggctacccttgatatcgtcgagacagaaaccagcaaagagaactcccccaattacggcctactgcttctgtgggcatctctgtccaacgccgtgcctgtggccttctggactcttgcatacgtgctgtctcatccagatattcataaagccataatggaaggcatttcctccgttttcgggaaagccggcaaagataaaatcaaggtgtccgaggatgacttggagaatctcctccttatcaaatggtgcgtgctcgaaactatcagactgaaagctccgggagttattacacgtaaggtcgtcaaacctgtcgagatcttgaattacataatacctagcggagacctcctgatgctttcacccttttggctacatcgtaaccccaaatacttccctgaacctgagttatttaagccagagaggtggaagaaggctaatcttgaaaagcattcctttctggactgctttatggcatttggaagtggaaagttccagtgtcccgcgcgctggtttgccctgctggaggtccagatgtgcatcatattaattctgtacaagtacgactgttcactgctggatccgctccctaaacagagctacctacacttagtcggcgtgcctcagcccgaaggacagtgcagaatagaatataaacagcgcatttag

SEQ ID NO: 113720 - DNA, 1560 bp, Artificial Sequence
  Description of Artificial Sequence: Synthetic coding sequence
atgtccgttagtgtgctttccccatctcgcctgcttggggacgtgagtgggatcctgcaagcagcttcactgttgattctgctgctcctgctgatcaaggccgtgcagttgtatttgcatcgccagtggcttctaaaagccctccaacaattcccatgcccaccatcccattggctttttggacacattcaagagctccagcaagaccaagagctgcagcgcattcagaagtgggtggagactttccccagtgcatgccctcactggttatggggtggaaaggttcgagttcaactttatgatcccgattatatgaaggtgatactaggaagatcagatcctaagtctcacggcagctaccgctttcttgccccctggatcggctacggtctgctacttcttaatgggcagacgtggttccagcaccgcagaatgctgacgccagctttccattacgatattctgaaaccatatgtgggtctgatggcggattctgtgagggtgatgctcgacaagtgggaagaactattgggacaggatagccccctcgaagtatttcagcatgtgagcctgatgactctggacacgatcatgaaatgcgccttctcacatcagggcagtatccaggtcgacaggaattctcagagctacattcaggcaatcagcgacctcaacaacctagtctttagccgggttagaaatgcattccatcagaatgacacgatatattctctgaccagcgctggcaggtggactcatcgagcatgccagctagcccaccaacataccgatcaggtaatccagctgagaaaagctcagctgcagaaagagggggagctcgaaaagatcaaaaggaaacgacacctggactttctagatatcctccttttagcaaagatggaaaatggtagtatcctgtctgataaagaccttcgtgccgaggtggacactttcatgtttgaaggacatgacaccactgcctccgggatttcctggattctttacgctttggctacgcaccccaaacaccaggaacgttgtcgagaggaaatacactctctgttgggcgacggagcgtcaataacatggaaccaccttgaccagatgccatatacaacaatgtgcatcaaggaggctcttcgtctgtaccctcctgtgccgggcatcggtcgggaactttcaacgccagtcacatttcccgatggacgaagcttgcctaaaggcatcatggtgctccttagcatctacggcctccaccataatccaaaggtttggccaaatcctgaggtgttcgatccatttcgttttgcgccagggagcgcccaacattcacatgcttttctgcctttctccggcggatcacggaactgcattggaaagcagttcgctatgaacgaactgaaggttgctaccgctctcaccctcttacgattcgagttattgcccgaccccactagaatcccaatcccaatcgcccggttagtcctgaaatcaaaaaatggcatccacctgaggttgcgccgcctgcccaacccatgcgaggacaaggaccaactgtag

SEQ ID NO: 113721 - DNA, 1563 bp, Artificial Sequence
  Description of Artificial Sequence: Synthetic coding sequence
atgagcgttagcgttctctctccatccagattgctcggagacgtgtccggaatcctgcaggcggcttctctactaatacttcttttgttacttattaaggcagttcagctctacctgcaccgacagtggttgctgaaggcattgcagcaattcccatgtcctccctctcactggctcttcggacacatccaagagctgcagcaggaccaggagctgcagaggattcaaaaatgggttgagacatttccatctgcgtgtccacattggctttggggaggcaaagtgagggtccagctgtacgatcccgactatatgaaagtgatactggggaggtcggatcctaagtcacacggaagctaccgattcctggctccctggatcggctatggtctccttcttctaaacggccagacttggtttcagcatcgccgtatgcttacccctgcctttcactatgatatcctgaaaccttacgttggcctgatggcggacagcgtaagagtcatgctcgacaagtgggaagagttgttaggtcaagactccccactggaagtcttccagcatgtcagcctgatgactctagatactatcatgaaatgcgcattttcccaccagggttccattcaggtcgatcggaactcccaatcttacatccaagcaatatccgacctcaacaatcttgtgttttcaagagtccgcaacgcattccaccagaacgataccatttactcgctgacgagtgctgggagatggactcacagggcatgtcagttggctcaccaacatactggcgatcaggtgatccaactgagaaaagcgcagctgcagaaggagggagagctcgagaaaatcaaaaggaagaggcacctggattttttggacattctgctcctggctaaaatggagaacggcagcattctcagcgacaaggacctgagggccgaggtcgacacctttatgttcgagggccatgatacgactgctagtggcatttcttggattctgtatgctttggcaactcaccccaaacaccaggagcgttgccgtgaggagatccattcactgcttggtgacggtgcaagtatcacctggaaccacctggatcagatgccgtataccacaatgtgcatcaaggaagcattgcgtctgtatccacccgtccccggcatcggcagggaactcagcactcccgttacattccccgacggcaggtctctgcccaagggcatcatggtgttactgagtatctacggcttgcatcacaatcccaaggtgtggcctaatcccgaagtgttcgatccatttcgattcgcaccagggagcgcacaacacagccatgccttcctgcccttctcaggcggaagccggaactgcatcggcaagcagtttgccatgaacgagctgaaggtggctacagcccttacactcctaagattcgaactcctgcctgaccctactcggattccaatcccaatagcccggctcgtgctcaaatccaagaatggcatacacctgcgcttgagacgactgccaaacccctgtgaggacaaagaccagctctag

SEQ ID NO: 113722 - DNA, 1368 bp, Artificial Sequence
  Description of Artificial Sequence: Synthetic coding sequence
atgtccgtgtccgtgctctcgccttcaagattgctaggcgacgtgtctggaattctccaggccgccagcctcctcattctgctgctgctgctcataaaagccgtccaactctacctgcacagacagtggcttttgaaggccctgcaacaattcccctgtcctcccagccattggctgttcggacacatccaagaacttcagcaagaccaggagttacagagaatccagaagtgggtggagacctttcctagtgcttgtccccattggctttggggcggcaaagtgcgagtccagctgtacgatccagactatatgaaggttatactgggccggtcagatcccaagtcacacggaagctatcggttcctggccccatggatcgggtacggtttgctgttgctaaacggccagacatggttccagcacagacggatgttgacccccgcttttcactatgatattctcaagccatacgtgggcctgatggctgacagtgtgagggttatgcttgacaagtgggaggagctcctgggacaggactcccccctggaagtattccagcacgtgtctttaatgaccctggacaccattatgaagtgtgcctttagccatcaggggtccattcaagtggacaggaattcgcagtcatatatccaagcaataagcgacttgaacaatctggtgtttagccgcgtgaggaacgcattccatcaaaacgatactatttactccctcacgtcggccggacgatggactcacagggcgtgtcaactggcacaccagcacaccgatcaggtgatccagctgagaaaagctcaacttcagaaggagggggaattagaaaaaataaaacgcaagcgtcatctcgattttttagatatactcttgcttgctaagatggagaacgggagcatcttaagtgacaaagatctgcgtgctgaggtggacacttttatgttcgaggggcacgacactaccgcctcaggcatatcgtggattctgtacgcactggccacacatcccaagcaccaagagagatgtagggaagagatacattcattgctaggcgatggggctagtatcacctggaaccacttagaccagatgccctacactaccatgtgtattaaggaggctctgaggctctacccacctgttcccggtatcggacgggagttgagcacgcccgtcactttcccagacgggcgatcccttcccaaaggaatcatggtcctgctatctatatacggactgcaccataacccaaaggtctggccgaaccctgaggtctttgacccctttagattcgcacctgggtctgcccagcattcacatgcatttttgccttttagtgggggatcacggtag

SEQ ID NO: 113723 - DNA, 474 bp, Artificial Sequence
  Description of Artificial Sequence: Synthetic coding sequence
atgaaagtgatcctgggacggtcagatccaaagtctcacgggagctataggtttctcgctccttggatcggatacggcctcctactgctgaacggacagacttggtttcaacacagacgaatgctcactcccgcctttcattacgatattttgaagccttatgtcgggttgatggccgatagcgtcagagtcatgttggacaagtgggaggaactcctgggtcaggatagccccctggaggtgtttcagcatgtttccctgatgacgctggatacaatcatgaagtgtgccttcagccaccagggatccattcaggtggatcgaccctccgatcccacggaggaggggtctacaactgaagggggcggggcgggtgaagaccaggaggaggaggcttttggcttcagcggatacccgcctctgggccaaaacggggaatgggagcacctcgtccggcaggggccgccttgttag

SEQ ID NO: 113724 - DNA, 1575 bp, Artificial Sequence
  Description of Artificial Sequence: Synthetic coding sequence
atgcctcagctgtccctatcctggcttggccttggacctgtggccgcctccccttggctgctgctcctgctggttggagggagctggctgctggcccgagtcctggcatggacatatacattctatgacaattgccgtcgccttcaatgtttcccccagccgccaaagcagaactggttctgggggcaccaaggacttgtgacccctacggaggaggggatgaaaacgctgacacagttggtgaccacttaccctcaggggtttaaactctggctgggcccaacattcccactccttatcctctgccatcccgatattattcgaccaatcactagcgcgtcagccgctgtcgcccccaaggacatgattttctatgggtttcttaagccatggctaggggacggattgttgctgagtggcggagataaatggtcccgacatagacgaatgctcactcccgccttccacttcaatatcctgaagccctacatgaagatctttaacaagagcgttaacattatgcacgataaatggcagaggctcgcatcagaagggtcagccagattggacatgttcgagcacattagccttatgacgctcgacagcttgcaaaaatgcgttttttcattcgaatcaaattgccaggagaaacccagcgaatatatcgctgcaatcctggagttgtccgcgttcgttgagaagcggaaccagcagattctactgcataccgacttcctgtactacctgacacccgacggacagcggtttcggcgcgcctgccacctagtgcatgacttcaccgatgctgtcatccaagagaggaggtgcaccctccccactcagggcatcgatgattttctgaagaacaaggctaaatcaaagacgctggatttcatcgacgtgctcctgttgagcaaagatgaggatgggaaggaattgtcagatgaggatatccgtgctgaggctgacacatttatgtttgagggacacgacacaactgcttctggattgtcatgggtgctctatcacctagcaaaacaccccgaatatcaggagcagtgccggcaggaggtccaggagctccttaaagatagagagccgattgagattgagtgggatgacctggcccagctgccattccttactatgtgtatcaaggaaagcctgcgcctgcatccaccagtccccgtgatttctaggtgttgcactcaggattttgtgttgccagacggtagggtaattccaaaaggtatcgtatgcctaattaacattattggtatacactacaaccccacagtctggcccgatccagaggtatacgaccccttcaggttcgaccaagagaacatcaaagaaaggagtcccctggccttcattcctttctctgccggccctagaaactgcattggccaggccttcgccatggcagagatgaaagtggtgctggcactcaccctgctgcattttaggatcctgcccacgcacacggaaccgagacgaaagccagagctaatactgcgggccgaggggggactctggttgcgcgttgaaccactcggagccaactcccagtag

SEQ ID NO: 113725 - DNA, 1365 bp, Artificial Sequence
  Description of Artificial Sequence: Synthetic coding sequence
atgccacaactcagcttatcttggcttgggctgggacccgtcgctgcctcgccgtggttgctgctactcctggttggggggtcctggctactggcacgcgtgctggcgtggacttatacattttacgacaactgcaggaggctgcagtgcttcccacagcctcctaagcaaaactggttctgggggcaccagggtctagtcactccgaccgaagaaggaatgaaaactctcacacaattggtcacaacatatcctcagggattcaagctgtggcttggcccaacatttccactcctcattctgtgtcacccagacattatcaggccgatcacaagcgcatcagcagctgtagccccaaaggatatgatcttctacgggtttctaaaaccctggctgggcgatggtcttctgctgtcgggtggagataagtggagcaggcaccgacggatgctgacaccagcctttcacttcaatattctgaagccctatatgaagatatttaataagtcggtgaacatcatgcacgacaagtggcagcgccttgcaagtgaaggatcggcccggttagacatgttcgagcatatcagcctcatgacgttagactctctgcagaagtgcgtgttctcgttcgaatccaattgtcaggaaaagccctcagagtatatcgcggctatcctcgagctttctgcgttcgtggaaaagaggaaccagcagatcctgctgcacaccgattttctttattacctgacgcccgatggacagaggttcagaagagcctgccatctcgtgcacgattttaccgatgcggtgatccaggagcggaggtgcacgctccccacgcaaggcatcgacgattttctgaagaataaagctaaaagcaaaacgctggattttattgacgtgctactgttgtcaaaggatgaggatggcaaggaattgtctgatgaagatattcgcgccgaagccgatacgttcatgttcgagggccacgatacaacagcaagcggtctaagctgggttttgtaccatctggcaaaacaccccgagtatcaagagcagtgccgccaggaggtgcaagaactcctaaaagatcgcgagccaatcgaaatagaatgggacgaccttgcacagcttccatttctgactatgtgtatcaaggagagcctgcgccttcacccccctgtaccagtcatctcacgttgctgcacccaggactttgtcttacctgacggtagagttattccaaaaggtctccgacctttgccgtttcggccaagagaacatcagggcgaggtgacatccggcttctattccctgctgggtcgcgcacagaaactgcacagggcgggtgtccgacacggctag

SEQ ID NO: 113726 - DNA, 1575 bp, Artificial Sequence
  Description of Artificial Sequence: Synthetic coding sequence
atgccgcaactttcactttcgtggctcgggctcggccctgtagccgccagtccctggttactcctgctcctggttgggggctcatggcttctggcccgggttcttgcgtggacctacacattctatgataattgtcgcagactgcagtgctttccgcagcctcccaaacagaattggttctggggacaccaggggttagtgacacccacagaggaaggcatgaaaacactaactcaacttgtaaccacctacccacaaggattcaagctttggttgggccccacattccctctgttgatactttgtcatcccgacataatccgtcccattacctctgcctcagctgccgtcgcacccaaagacatgattttctacgggtttcttaagccctggctaggcgacggtcttttactctccggcggagataagtggtcaagacacaggcgcatgctcacaccagccttccactttaatattctgaagccctacatgaagatcttcaacaagtccgttaacattatgcacgataagtggcaacggttggcttctgaggggtccgcccgactggacatgttcgagcacatctcccttatgaccctcgacagcctccagaaatgtgtcttctcattcgagtccaactgccaagagaaaccctcagagtacatcgctgcaatcctggagctatcagcatttgtagagaaaagaaatcaacagattctgctacataccgattttctgtactacttgacccccgatggtcagagattcagacgcgcatgtcacctcgtgcatgatttcacagatgccgtaatacaggagcgtcggtgtactctaccgactcagggtattgatgatttcctgaaaaataaagccaagtccaagactctggatttcattgatgtgttgttgctctctaaggatgaagacggaaaggagctgtcagacgaagacattagagcagaggccgacacgttcatgtttgaaggacacgatactaccgcatcaggcttgtcgtgggtgttgtatcacttggccaaacaccccgaataccaagaacagtgcaggcaagaggtccaggaattactcaaggatcgggaaccaatcgagattgagtgggacgacttggcacagctgccctttctaacgatgtgtattaaagaaagccttcggctacacccgcccgtgccggtgatttctagatgctgcacacaggacttcgtgctgcctgacggccgagtgattcccaagggcatcgtctgtcttattaatatcatcggaatacattacaaccccacagtctggcccgatcctgaagtttacgaccctttcaggttcgaccaagagaatatcaaagagagaagcccgctcgcattcatcccattctctgctggtcctaggaattgcattgggcaggcttttgccatggccgaaatgaaagtagtcctggctctgacactcctccactttcggattcttcctacccataccgaacccagaagaaaaccggaactaatccttcgcgcggaagggggcctgtggctcagagtggaaccactgggagcaaattcccagtag

SEQ ID NO: 113727 - DNA, 1575 bp, Artificial Sequence
  Description of Artificial Sequence: Synthetic coding sequence
atgagcctcctctccctgccctggttgggattgcggccagtcgctaccagtccgtggctgctcctcctcctggtggtggggtcctggctgctggcacggatcctcgcctggacatacgccttctacaataattgtcgtagacttcaatgtttcccccagccgcctaagaggaattggttttgggggcatctcggcttgattaccccaacagaggaagggctcaagaactccacacagatgtctgccacatacagtcaaggttttactatctggctgggacccattataccgttcatcgtactgtgccaccccgacaccatcagaagcattactaatgcttcagcagctatagcccctaaagacaacttgttcatccggttcttgaaaccctggttgggagagggcatcctgctgtcgggaggagacaagtggagtagacataggcggatgctgaccccagccttccactttaatattctgaagagttatataaccatattcaacaagtcagcgaacatcatgctggacaaatggcagcaccttgcttcagagggcagctcctgcctcgatatgttcgagcacataagcctaatgacgttggactccctgcagaagtgtatcttcagctttgactcgcactgccaggaacggcccagcgaatacatcgccactatcctcgagttatccgctctggtggagaaacgaagccagcatattctgcagcacatggactttctttactacctgagccatgatgggcgtaggtttcaccgtgcctgccggctggtgcatgacttcactgatgcagtcatacgcgaaaggcggcgcaccctgccaacgcaaggaattgacgacttctttaaagataaggccaaatcaaagacccttgattttattgatgttcttctgctctccaaggatgaggatggaaaggcactgtccgatgaggacatccgggctgaggcagacactttcatgtttggcggacatgatactactgcttccggcttgagctgggttttatataacttagctagacacccggaatatcaggagcgctgcaggcaggaggttcaagagttgctgaaagatagggatcccaaagagattgaatgggacgaccttgcccaactcccattcctcaccatgtgcgtaaaggagagcctccggttgcatcctcctgcacctttcataagtaggtgctgcacacaggatatcgtgttgccagacggccgcgtgatcccaaagggaatcacttgtttaattgacattatcggcgttcaccacaatccgacagtgtggcctgacccagaagtgtatgacccatttagatttgatcctgagaattctaaaggtcgttcccctctggcattcatacctttttcggcaggcccccggaactgtattggtcaagccttcgccatggcagaaatgaaggtggtgctagcgctgatgttactccatttccgatttcttcccgaccataccgagccaaggcgcaaactggagctgatcatgagagctgagggcggcctgtggctacgagtcgagccgctaaacgtcagtctccaatag

SEQ ID NO: 113728 - DNA, 1575 bp, Artificial Sequence
  Description of Artificial Sequence: Synthetic coding sequence
atgtcccttttatcgctcccctggctgggactgcgacccgtagcgacgagcccttggttactactgctgctggtagtggggtcatggcttttggctaggatcttagcctggacttacgccttttacaacaattgtagaaggctgcaatgtttcccacagccccccaagaggaactggttctggggccatctcggactaattaccccaaccgaagagggtctcaaaaacagcacacagatgtccgctacctattcgcaaggatttactatttggttaggcccaatcattccgttcatcgtgctgtgccacccagacactatacggtccattacgaacgccagtgcggctatcgcgcccaaagataacttattcatcaggttcttgaaaccatggctcggcgaaggaattctactgtctgggggagacaaatggtccagacatcggcgtatgctcaccccggcattccatttcaatatactaaagagctacatcaccatattcaacaagtcagcaaatattatgctggacaagtggcagcatcttgcctcggagggatcttcatgcctggatatgtttgaacatatctcactcatgacactagactctttacagaaatgtatattctcctttgacagtcattgtcaagaacgcccttctgagtacatagcaaccattttggaactgtcggctctcgtcgagaagaggtcgcagcacattttacagcacatggatttcctctattatctgagtcacgatggccgcaggtttcaccgcgcttgccggctggtacatgacttcaccgacgcagtgatacgagaacgccgtcgcacactaccaacccaggggatcgacgacttctttaaagataaggcaaaatctaaaacacttgacttcatcgatgttctgctcctgtctaaggatgaagatggcaaagctttgagtgatgaggacatcagagccgaggccgatactttcatgttcggaggccacgacaccacagcatctggcctgtcctgggtgctgtacaacctggcgaggcatcccgagtaccaggaaagatgtcgccaagaagtgcaagagctgttgaaggatagggacccaaaggagattgaatgggacgacctggcgcagttgccatttttgaccatgtgcgtcaaggaatccctccggcttcacccccctgcaccattcatctcaaggtgctgcacccaagacatagtgcttccggacggccgcgtcatccctaaaggaattacctgcctcattgacattattggcgtgcaccacaatcctacagtttggcctgaccccgaggtgtacgaccctttcaggtttgatcccgagaattccaagggaaggagccccctggcgttcatcccattctccgccggtccccgaaattgtatcggtcaagcttttgcaatggccgagatgaaagtggtgcttgcacttatgctgctgcactttcgatttcttcctgaccacaccgagccacgtcgcaagctggaactcataatgcgggccgaggggggcctctggctgagggtcgagcccttaaacgtgagcctgcagtag

SEQ ID NO: 113729 - DNA, 1596 bp, Artificial Sequence
  Description of Artificial Sequence: Synthetic coding sequence
atgttgcccattaccgatcgccttcttcatttactggggttggagaagaccgctttcagaatctatgccgtcagcactctgcttctttttttgctgttctttttgttccgcctgctcctgcgctttctgcggctatgtcgctctttctatatcacgtgtcgaaggttaagatgtttccctcaaccccccagaagaaactggcttctgggccacctgggaatgtacttgccaaacgaggccggtttacaggatgagaagaaagtgctcgataatatgcatcatgttctgttggtctggatgggaccagtgctgcccctgttggtgcttgtccaccccgattatattaagcctctactgggcgcatccgccgcaattgcaccgaaggatgatctgttttatggcttcctaaagccttggttgggggacgggctcctgttgtcaaaaggggacaagtggagcagacatagacgcttgttgacccctgctttccactttgatatactgaagccgtacatgaagatctttaaccaatcggccgatatcatgcacgccaagtggcggcacctggccgagggcagcgccgttagtctggatatgtttgaacacatttcactgatgactctggattctctgcaaaaatgcgttttcagctacaattcgaactgtcaagagaagatgtcagactacatctcagccatcatagagctgagcgcactgagtgttaggcgacaataccgattacaccactatctggacttcatttattacagaagcgcagacgggagaaggtttcgacaagcttgtgatatggttcaccattttacgacagaagttatccaggagcgcaggagggctcttcgccaacagggtgctgaggcctggctgaaggcaaaacaagggaagactcttgattttatagatgtactccttcttgcccgcgatgaagatggaaaagagctctcagacgaggatattagagccgaggcagatacattcatgttcgagggtcacgacactacaagcagcggtataagctggatgctcttcaatctagctaagtatcccgaatatcaggagaaatgccgcgaggagatccaggaggtgatgaagggacgcgaactggaagaactggagtgggatgacctgactcagctccctttcacaacgatgtgtatcaaggaatccctgcggcaataccccccagtgactctggtgtctcggcaatgtaccgaggacatcaaactccccgacggccggatcatccctaaagggattatctgtttggtatctatctatggaacacaccataaccctaccgtttggcccgacagtaaagtgtacaacccgtaccgctttgacccagacaacccgcaacagagatcccctctcgcctacgtccccttttcagcaggccccaggaactgcatcggtcaatcatttgccatggctgaacttcgagtggtagtcgcattgactcttctcagatttcggctttctgtcgataggaccagaaaggtcagaagaaaaccagagcttattttacggaccgaaaatggtctctggttgaaggtggagccgcttccacctagagcctag

SEQ ID NO: 113730 - DNA, 1782 bp, Artificial Sequence
  Description of Artificial Sequence: Synthetic coding sequence
atggccccatcaggtctcaaggctgtggtgggcgagaagatcctatctggagtaatccgatctgtcaaaaaagatggtgaatggaaagtgctgattatggatcaccctagcatgcgaattctgtctagttgttgcaagatgtccgacatcctggcagagggaattactatcgtggaagacatcaataagagacgcgagcctatacctagcctcgaagccatttatctcctcagtcccaccgaaaaatctgttcaagccttaatcaaagactttcagggaactcctacgttcacctataaggctgcacacattttcttcacagatacttgtccagaaccactcttttccgaattgggccgaagccgcttagccaaagtggtgaaaactctcaaagaaattcatctggctttcctgccatacgaagctcaggttttcagcctggacgctccgcattctacgtataatctctactgcccattccgcgccgaagagaggactcgccagctggaagtcctcgctcagcaaatagcaactctgtgtgccactttgcaggagtaccccgccattagatatcgaaaggggcccgaggacaccgctcaattggcccatgcagttcttgccaaattgaacgcgtttaaagccgacaccccctctctaggagaggggcccgagaagacaaggtctcagctcctcataatggacagggcagctgacccagtgtctcctctgctgcacgaactgacctttcaggccatggcgtatgaccttctggatattgagcaggacacctaccgttatgagaccaccggccttagcgaagcgcgggagaaggctgtacttctggatgaagatgatgatctctgggtcgaactgaggcatatgcacattgcggatgtcagcaaaaaagtgaccgagctgctgaggaccttttgcgaatccaaacggctgacaactgacaaggccaacataaaagacttgagtcagatactgaaaaagatgccacagtatcagaaggaattaaacaagtactccacacatctgcacttggcagatgattgcatgaagcacttcaagggctccgtcgagaaactgtgtagcgtcgagcaagacctggcgatgggttcggacgctgagggtgagaaaattaaggattccatgaaattgatcgtgcccgtgctgcttgatgctgcggtgcccgcctacgataaaattagagtgcttctgctgtacatcctcctgaggaacggggtgagcgaggagaacctagcaaagctgatccaacacgcaaacgttcaagcccatagtagtctgattagaaacttggagcagttagggggcacagtcactaaccctggcggttcaggcactagctccagactggagccccgcgagaggatggagccaacctaccagttatcccgctggacacctgtaattaaggacgttatggaggatgccgtcgaggaccggttggaccgaaatctgtggccatttgttagcgatcctgcgcccaccgctagttctcaggcagccgttagcgcgcgatttggacactggcacaagaacaaagcaggcattgaagccagggccgggccccggttaatagtgtatgtgatgggcggggtggcgatgtccgagatgcgcgctgcctacgaggttaccagagccaccgagggaaaatgggaggtgctcatcggatctagtcacattttgacacctaccagattcctggacgacctgaaggcccttgacaaaaaactggaagacatcgccctgccctag

SEQ ID NO: 113731 - DNA, 1344 bp, Artificial Sequence
  Description of Artificial Sequence: Synthetic coding sequence
atgcgcgtgctcacccaacttgtcgcaacctaccctcagggcttcaaggtctggatgggaccaatcttccccgtgattaggttctgccatcctaatataattaggagtgttataaacgccagtgctgcgatcgtgcccaaggataaggtgttttattcctttctgaaaccttggttaggcgacgggttattgctgtctgcaggtgaaaagtggagccggcacagaagaatgctcaccccagcattccacttcaatattctcaagccttacatgaaaattttcaacgagtcagtgaatatcatgcacgctaaatggcagctgctcgctagtgagggtagtgcccgcctcgacatgttcgagcatatttccctcatgaccctcgatagtctgcagaaatgtgtgttttcattcgattcacactgccaggaaaaaccttccgaatatatagctgccatactggagctgtcggcattggtcaccaaaaggcaccagcaaattcttctgtacatcgatttcctgtactatctcaccccagacggccagcgtttccgcagggcgtgcagactagtgcacgattttacagacgccgttattcaggagcggcggcgcacattacccagtcaaggagtggatgactttcttcaagcaaaggctaaatccaaaacgctagactttatcgacgtgctgctactgtcaaaggacgaggatggaaagaaactgtcggatgaggacatccgcgccgaagccgatacttttatgttcgaggggcacgacacaactgcttcaggtctgtcgtgggtgctctatcacctggccaagcatcctgaataccaagaacgttgccgtcaggaggtgcaagagctgcttaaggatagagagcccaaggagattgaatgggacgatcttgctcagctgcctttcctcacgatgtgcatcaaagagagccttcggctgcacccgccggtgcctgctgtgagtagatgttgtacacaggacatcgttctgcctgacggcagggttattccaaaaggaatcatctgcctgatcagcgtcttcggaacccaccacaaccccgccgtctggcccgatccagaggtctacgatccattccgttttgacccgaaaaacatcaaggagcgtagtccactggcgttcatacccttctctgcggggccgcggaattgcatcgggcaggctttcgctatggccgagatgaaagtcgttctgggcctgacactgctccggttccgcgtgcttcctgaccacaccgagccaaggagaaagccggaactggtattgagggcagaaggtggcctgtggctcagggtagaaccactatcttag

SEQ ID NO: 113732 - DNA, 999 bp, Artificial Sequence
  Description of Artificial Sequence: Synthetic coding sequence
atgccgtctatcaccacggccgccgccagcggtgtcagccgcagcccgggaaaccgcaccggaagctgggtgacgtgggcctggaaacctagcgagtatatcaccgccatcatggagctctccgctctggtcgtcaaacggaacaaccagtttttccggtacaaggactttttgtatttcctcaccccctgtggtaggcgattccacagggcctgccgactggttcacgatttcacagacgccgttattcaggaacgcagaagaaccctcacgtcacagggagttgacgacttcctgcaagctaaagctaaatccaagacactggattttattgacgtgctgctgttgtctgaggacaaaaacgggaaagaattgtctgacgaggacattcgcgcagaagcggacacattcatgttcggagggcacgacactaccgccagtggtttgtcctgggtgctgtacaacttagctagacatcccgagtatcaggaacgctgccggcaagaagtccaagagttgttaaaagatcgggaaccaaaggaaattgaatgggacgatttagcccagcttccttttcttaccatgtgcctgaaggaatctttgcggctgcatccaccaatacccacatttgctcggggatgcactcaggacgttgtgctgcccgactctagagtgatacctaaaggaaatgtatgcaatatcaatatttttgcaattcaccacaatcccagcgtctggcccgatcccgaagtctatgatcctttcagatttgatcccgaaaacgcccagaaaagaagtccgatggcttttatccccttttctgccggcccccgtaactgcattggacagaaatttgctatggccgagatgaaagtagttcttgccctgactctcctgcgcttcagaattctgcccgatcatcgggaacctagacggacgccagagattgttctgagagccgaggatggcctctggttgcgagttgagcctctggggtag

SEQ ID NO: 113733 - DNA, 1560 bp, Artificial Sequence
  Description of Artificial Sequence: Synthetic coding sequence
atgagcctgctgtccctatcctggctgggcttgcgcccagtggccgcctccccttggcttctcttgctcgttgtcggggctagctggttgctagccagaattctcgcctggacctatgcattttaccacaatggtcggaggcttagatgctttcctcaacccaggaaacagaattggttcctcggacatctggggttggtaactcccacagaagaaggcttacgcgttctgactcagctggttgcaacttacccccagggtttcgtcaggtggctaggccctattaccccaattatcaacttgtgccatccagatatagtgagatcagtgatcaacactagtgacgccatcaccgacaaggacatagtcttttacaaaaccctgaaaccatggcttggggacggtttgctgcttagcgtgggcgataaatggaggcatcacagacggctgacgcctgccttccactttaacatccttaagccttatattaagatcttttccaagtccgcaaatatcatgcacgccaagtggcagaggcttgcgatggagggatcgacctgccttgacgttttcgaacatatctccctaatgactctggatagcttgcagaagtgtattttcagtttcgatagcaactgtcaggaaaagccctccgagtacatcacagctatcatggagctgagcgcgctggtagtgaagcgcaacaaccaattcttcagatacaaagattttctttactttctgacgccctgcggaaggcgcttccatagggcgtgccggctggtacacgactttaccgacgctgtcattcaagagcggaggcggactttgaccagccaaggcgtggatgatttcttacaggcaaaagccaagagcaagactctcgactttattgacgtgcttctgctgtccgaggacaaaaacggtaaggagcttagcgatgaggacatcagggcggaagctgatacatttatgttcggaggacatgatacgacagctagcggactgagctgggtcttgtataaccttgccagacatcccgaatatcaagaacggtgtcgtcaggaagttcaggaactgctgaaggaccgcgaacccaaggagatcgaatgggatgacctggcgcaactgcccttcctcacaatgtgcctcaaagaatctctcagactccacccacccataccaacctttgctcgcggatgtactcaggacgttgtcttgcctgattcccgggtgattccaaaggggaacgtctgtaacatcaacattttcgcgatccaccacaaccccagcgtctggcctgacccggaagtctatgacccttttcggttcgaccccgagaacgcccagaaacggtcgcctatggcttttatacctttttcagcaggcccccgcaattgtatcggacagaagttcgccatggctgaaatgaaagtcgtcctagcccttaccctgctgcgcttccgtatattgcccgaccaccgcgaaccaaggcggactccggagatagttctccgagctgaggatggactttggctccgggtagagccactggggtag

SEQ ID NO: 113734 - DNA, 804 bp, Artificial Sequence
  Description of Artificial Sequence: Synthetic coding sequence
acaccggcatttcactttaacatcttgaagccctatattaagatcttctcaaagtcagcaaatattatgcatgccaaatggcagagactcgctatggaagggtcaacctgcctggatgtgtttgagcatatcagcctaatgaccttagactctctgcagaaatgtatattcagctttgactctaactgtcaagaaaaaccctctgagtacattactgctataatggagctttccgcattggtcgttaaacggaataaccagttcttccggtataaagacttcctgtacttcttaactccatgcggtcgaagattccaccgcgcctgccggcttgttcatgattttaccgatgctgtcattcaagagcgcaggcgcaccttaacgtcccagggcgtggatgatttcctgcaggccaaggccaaatcaaaaactcttgactttatcgatgtgctcctgctcagcgaagataagaatggcaaagaattgtctgacgaggatattagagctgaggctgacacgtttatgttcgggggtcacgacaccaccgcatccgggctctcttgggttttgtacaaccttgcccggcatccagagtatcaggagcggtgcaggcaggaagtccaggaactgctcaaagatcgcgagccgaaggaaatcgaatgggacgatctggcacagctgccttttcttacaatgtgcctaaaagagtccctccggcttcaccctcccatccctacctttgcgagaggatgcacacaggacgtggtcctgcctgactcccgggtaattcctaagggcctctag

SEQ ID NO: 113735 - DNA, 1512 bp, Artificial Sequence
  Description of Artificial Sequence: Synthetic coding sequence
atggctgggctgtggctgggactggtgtggcagaaactgctgctttggggggctgccagtgcactgtccttggcgggggcttccctggtgctgtcacttctgcagagggtggcctcttacgcactgctgatgaaacccgatggacgagagttttttcagcagatcattgaatataccgaggagtatcggcacatgcccctgctgaagctctgggtgggtcccgtgcctatggtggccctgtataacgctgaaaacgttgaggttatccttacttcttctaagcagatcgataaaagtagtatgtataagttcctggaaccctggctgggcctggggctgctgacttctaccggcaacaaatggcgatcaaggcgcaaaatgttgacacctactttccatttcacaatcctcgaggacttccttgatatcatgaacgagcaggctaatattctcgttaaaaagctagaaaagcatataaaccaagaagcattcaattgttttttctatattaccctgtgtgctttggacatcatctgcgaaacagctatggggaaaaacattggcgctcagtcaaatgacgactcagagtacgtgcgggcagtttacaggatgtccgagatgatatttaggaggataaagatgccttggctctggctagacctgtggtatctgatgtttaaagagggctgggagcataagaaaagcttacaaatcctgcacacctttacaaactcagtcatagcagaaagagctaacgagatgaacgccaatgaggattgccgtggagacggccgcggtagcgcgccttccaagaataagcgacgagcattcctggacttactactaagcgtcactgacgatgagggcaacagattaagccacgaggacatcagagaagaggtcgatactttcatgttcgagggccatgatacgaccgcggccgccataaattggtctttgtacctcctgggttccaatccagaggtgcaaaaaaaagttgaccacgaactggatgacgtattcgggaagagtgatcgtcccgctacagtagaagacctcaaaaagctgcgctatctcgagtgtgttataaaagaaaccctgaggctgtttccctccgttcctctgtttgctcgctcagtgtcggaagattgcgaggtagccgggtacagagtcttgaaggggaccgaggcggtaatcattccatacgcactgcacagagacccaagatattttcctaatccagaagaattccagccagaacgttttttccccgagaatgcccaaggaagacacccctacgcatacgtgccgttttccgccggccccagaaactgtatagggcagaagtttgccgtcatggaggagaaaaccatactgtcctgcattcttcgccatttttggatagaaagtaatcagaagcgcgaggagttgggtctggaaggtcagttaatcctccgcccgtctaatggcatctggattaagctgaagcgacgcaacgctgacgagagatag

SEQ ID NO: 113736 - DNA, 1578 bp, Artificial Sequence
  Description of Artificial Sequence: Synthetic coding sequence
atggcagggttgtggctgggcctcgtttggcaaaagctcctcctgtggggggcagccagtgccctcagcttggctggtgcctctctagttctgagcctcctgcagcgcgtggccagttatgctagaaaatggcagcagatgcgaccgatccccactgttgcccgcgcttaccctttagtgggccatgcactgctgatgaaacctgacgggcgtgaattcttccaacagatcatcgaatacactgaagagtatcgccacatgcccctgctgaagctgtgggttggcccggtgcctatggtggccctgtataatgccgagaacgtcgaggtgatactgacctcatctaagcaaatcgataagagcagcatgtacaagttcctggagccttggctgggacttggtcttttaacctctaccggcaataagtggaggtctcgacggaaaatgttgactccaacctttcacttcactattctggaagatttcctcgacattatgaacgaacaggctaatatactcgtaaagaaactggagaaacacattaaccaagaagcatttaactgtttcttctacataacgctgtgtgcattggatattatttgtgagacggccatggggaaaaacatcggcgcccagtctaatgacgacagcgagtacgtgcgggcagtgtatcggatgtctgaaatgatcttccggaggattaaaatgccgtggctgtggctcgacctctggtacctgatgttcaaagaggggtgggagcacaaaaaatccctgcaaatcctgcacaccttcaccaattcagtaatcgccgagcgcgctaacgaaatgaacgccaatgaagactgtagaggcgatggacgcggcagtgccccaagcaaaaacaagaggagagccttcttggacctccttcttagcgttacagatgacgaagggaataggctttcccacgaagatataagagaagaagttgatacttttatgttcgaagggcacgacaccactgctgccgctattaactggtctctttacctccttggctctaaccccgaagtacagaaaaaggttgatcacgagctggacgacgtgtttgggaagtctgaccggccagctaccgtggaagatttgaagaagctacggtacctggagtgcgtgatcaaagagacgctgcgcttgtttcccagcgtaccactcttcgccagatcagtaagcgaagactgtgaggtggcgggctacagggtgctcaagggaacagaggctgtgattatcccatacgctcttcacagagaccctcgctatttcccgaacccagaggagtttcagccagagcgatttttccccgaaaacgctcagggccgccatccctacgcctacgtaccattcagcgccggtccacgaaactgcatcggccaaaaattcgcagtgatggaggagaagacgattctgagctgtattctccggcacttttggatcgagagcaaccagaaacgggaggaactcgggctcgaggggcagttaattctgcgccccagtaatggaatttggatcaaattgaaacgcaggaatgccgatgaacggtag

SEQ ID NO: 113737 - DNA, 1503 bp, Artificial Sequence
  Description of Artificial Sequence: Synthetic coding sequence
atgtctcctggactgttactgttggggtctgcagtgcttctggctttcgggctctgttgcacttttgtgcacagagcccgaagtcggtacgaacacatccctggcccacccaggccatcgttcctccttggtcacctgccatgcttttggaagaaagacgaggtcggggggcgagtcctccaggacgtctttttggactgggcaaagaagtacgggccagtggttagggtcaacgtttttcacaaaacatctgttatagtgaccagccccgagagtgtaaagaagtttttgatgtccacgaagtacaacaaagattccaagatgtaccgggctttgcagactgtgttcggggagcgcctgtttggacaaggcctagtgagcgagtgcaattatgaaaggtggcacaaacagcgccgcgttatcgacctggctttcagcagaagtagcctggtgtcgctcatggaaaccttcaacgaaaaggcagagcagctggtggaaatcctggaggctaaagccgatggacagacccccgtatccatgcaggacatgctgacgtatacagccatggacatcttagccaaagctgctttcggaatggaaacttcgatgttgctaggcgctcagaagcccctgtcccaagccgttaagctcatgctagagggcattactgccagccggaatacactggcgaagttcttaccagggaagagaaaacagctgcgggaggtcagggagtcaatccgttttctgcgacaggtcggacgcgattgggtgcagaggcgccgcgaggctctgaagagaggcgaagaagtccccgcggacatcttaacccaaatccttaaggccgaagaaggcgctcaggacgacgagggattgttggacaattttgtgacctttttcatcgccggtcacgaaacaagcgccaaccaccttgcgtttaccgtcatggagctgtcacgacagcctgaaatcgtcgctaggctccaggctgaagtggatgaggtgatcggatccaagagatacttggattttgaagacctgggccggctccagtacttgtctcaagtactgaaggaatctctgcgactgtatcctcctgcctggggcacattcagactgctggaggaagagactctcattgacggcgttagagttcctgggaacacccctttgctcttctccacttacgtcatgggacgcatggatacatattttgaagatcccctgacattcaatcccgacaggttcggacccggcgcccctaaaccacgcttcacctactttccattctcattaggtcatcgctcttgcattggccagcagtttgctcagatggaagtgaaagtggttatggcaaaactgctgcagcggctggaatttaggctcgtcccgggtcagaggttcgggctgcaggagcaagctaccctgaagccacttgaccccgtcttgtgcacactgcggccgcgaggatggcagcctgctccccctcctccgccatgttag

SEQ ID NO: 113738 - DNA, 1212 bp, Artificial Sequence
  Description of Artificial Sequence: Synthetic coding sequence
atgagtaccaagtacaataaggattccaagatgtacagagccctccagaccgtcttcggggaaaggctgttcgggcaaggcctggtcagcgaatgtaactatgagagatggcacaagcaacgacgggtcattgatctggcattctccagaagctccctcgtgagtctgatggaaactttcaacgagaaggccgaacagctggtcgagatcctggaggcgaaggcggacggacaaacccctgtgagcatgcaagacatgctcacatatactgccatggacatcctcgctaaagcagcattcggtatggagaccagcatgcttttgggcgctcagaagcccctgtctcaggcggtgaagctaatgctcgaaggaatcacagcatcccgcaacacgctagccaaattcttgccaggtaaacgaaaacagttgagggaggtgcgggagtccattcggttcctgcggcaggtcggtcgcgactgggttcagcgtagacgcgaagcgctgaaacgcggagaggaggttcccgcagatatcctaacgcagatcctaaaggcggaagagggcgcgcaggacgatgaaggcctcttggacaattttgtgaccttctttattgctggccacgaaacttccgcgaatcacttagcctttaccgtaatggaactcagccgtcagcctgagattgtggcaaggctgcaagctgaggtggacgaagtaatcggtagcaagcggtacctcgactttgaagacctaggccgtctgcagtatttgtcccaggtattgaaggaatcactgcggctgtacccgccagcatgggggacatttcgcttgctcgaggaggaaactctgattgatggcgtgagagtgcctgggaacacaccgttgctgttctctacgtatgtaatgggtcggatggatacgtacttcgaagatccattgactttcaatccagacagatttgggccgggggctcctaagccccgcttcacctactttccgttcagtctgggccaccggtcatgtattggacagcagttcgcccagatggaggttaaagtggtcatggcaaagctgctacagagacttgaattcaggctggttcccggtcagcgattcgggctacaagagcaggcaactctgaaaccccttgaccctgttctctgcaccctgcggccaaggggttggcaacccgcaccaccccctccgccctgttag

SEQ ID NO: 113739 - DNA, 1530 bp, Artificial Sequence
  Description of Artificial Sequence: Synthetic coding sequence
atggccgctgccgcaggaatgttacttctgggattgttgcaggcaggaggctctgtgttgggtcaggcaatggaaaaggttacaggtgggaacctgctgtccatgttactgatcgcctgcgccttcactctctccctggtttacttaatccgccttgcggctggtcacctggtacagctgccagcaggagtcaaaagccccccttacatcttctcacccatacccttcctggggcacgcgatcgcttttgggaagtctccaatcgaattcctggagaatgcctatgaaaaatacggacctgttttctctttcaccatggtaggcaaaaccttcacgtatttgctgggcagcgatgcggccgccttgctttttaatagcaagaatgaagatctgaacgccgaagacgtatacagtcggctgaccaccccagtcttcggtaagggagtggcttatgatgtgcccaatcccgttttcttagaacagaaaaagatgttgaaatcgggtttgaatatagcacactttaaacagcacgtctctatcatcgaaaaagagaccaaggaatatttcgaatcatggggggagagcggagagaagaacgttttcgaggcactttctgaactaatcatactgactgccagccattgtctgcatggcaaagaaatcaggtcccagctgaacgaaaaggtagctcaactctatgcagacttggatgggggcttctcccacgctgcttggctgctgcctgggtggctgccactgccctctttccgccgaagagacagggcccatagagagattaaagacatcttttacaaagcgatccaaaaaaggcgtcaatctcaggaaaagatagatgacatactgcagaccttgctggacgccacatacaaggatggccgcccccttactgacgacgaagtcgccggtatgctgattggactcctccttgccggacagcacacttccagtactaccagcgcctggatgggcttctttctggccagagacaagacactccagaagaagtgttacctcgaacaaaaaacagtgtgcggcgagaatcttcctcccctgacgtacgaccagctcaaagacctgaatcttctggaccggtgcatcaaggaaaccctacgcctccggccacccattatgatcatgatgcggatggccagaactcctcagaccgtggcgggatacaccatcccccccggacatcaggtatgcgtaagtcctaccgtgaatcagaggctgaaggacagctgggtcgagagactcgatttcaatccagatagatatttgcaggataatcctgctagtggcgagaaatttgcttacgtcccctttggagccggaaggcaccggtgtatcggagaaaattttgcctacgtccagataaaaacgatttggagtacaatgctcagactgtacgagttcgatttgatcgatgggtatttccctacggtgaattataccacaatgatccacactccagaaaaccctgttattcgttataagagacggtccaaatag

SEQ ID NO: 113740 - DNA, 1215 bp, Artificial Sequence
  Description of Artificial Sequence: Synthetic coding sequence
atggtaggcaagacatttacgtatctgctcgggtcggacgcagccgctctgctcttcaatagtaagaacgaggatcttaatgccgaggacgtttactcacgtctcaccacccctgtctttggcaagggcgttgcatacgacgtccctaatcccgtgttcttagaacagaagaagatgctgaaaagtggcctcaatatagcacacttcaagcaacatgtgtccatcatcgaaaaagaaacaaaggaatatttcgaatcttggggtgagtcaggagaaaagaacgtgttcgaggccctaagcgaactgatcattctcacagcctcacattgccttcacggaaaagagattaggagccagctcaatgagaaggttgcgcaactttatgctgacctagatggaggattttctcacgccgcttggctgttacccggatggctgccgctgccaagtttcagacgtagagaccgcgcccaccgagagatcaaggacatcttttacaaagctatccagaagcgaagacagtcccaggaaaaaatagacgatatactgcagacccttctggatgctacttataaggacggacgcccactgacagacgatgaggtagctggtatgctgatcggcctgctgctggctgggcagcatacttcctctacaacctctgcctggatgggattttttctggcgagggataagaccctgcagaagaaatgctacttggaacagaagaccgtgtgtggcgagaatctcccccccctgacctacgaccagttaaaggaccttaatttgctggacaggtgcatcaaagaaacgctacgcctccgacccccaatcatgataatgatgcgcatggcgcgcaccccccagaccgtcgccgggtacactatccccccgggtcatcaggtgtgcgtttctccgactgtgaatcagaggctgaaggacagctgggtcgagaggttggacttcaacccagacaggtatttacaggacaatccagccagtggcgaaaagttcgcatatgtgccgttcggggccggaaggcaccggtgcatcggcgaaaactttgcgtatgtccaaattaaaaccatttggagcactatgctccggctatacgagtttgaccttatcgacggctactttccaactgtgaactacactacgatgattcacacgcctgagaacccagtaattcggtataaacggcgtagtaagtag

SEQ ID NO: 113741 - DNA, 1350 bp, Artificial Sequence
  Description of Artificial Sequence: Synthetic coding sequence
atgaaacatgaaaaatctccaccttacattttctcccccatccctttcctggggcacgcgatagccttcggaaagtcacctatcgagtttcttgagaacgcatacgagaagtacggaccagtgttcagttttacgatggttggcaagactttcacctatctattaggaagtgacgccgccgcattactgttcaactccaagaacgaagacctgaatgcggaagatgtgtattcccggctgaccacgcccgtcttcggcaagggtgtcgcttacgatgtgcctaaccccgtcttcctggaacagaagaaaatgcttaaatccggtcttaatattgcccactttaaacagcacgtctctataatcgaaaaagagaccaaagaatattttgagtcttggggggagagcggggaaaagaacgtctttgaggccctatccgagctgatcattctgaccgcctcacactgcttacatgggaaagaaatccggtcacagctgaatgagaaggtggcccagctatatgccgaccttgacgggggattttctcatgctgcttggctcctgcctgggtggctgcccttacccagctttaggcgcagagacagggctcacagggagatcaaagatatcttttacaaggccatccagaagaggcgacagtctcaggaaaagatcgatgatatcttgcagaccttacttgatgccacatacaaggacggccggccgctcacggatgacgaagtggcgggtatgctgatcggactcctgctcgccgggcaacatacctcgtcaacaacatccgcctggatggggttcttccttgcgcgggacaagaccctgcagaagaagtgctacctggagcagaaaacagtttgcggcgagaacctgcccccccttacttacgaccaactcaaagatctcaatcttctcgaccggtgtatcaaggaaactctgcgcctgagacctcctattatgattatgatgcgaatggcgagaacacctcagacagtggcgggctataccatcccgcctggtcatcaggtatgcgtgagcccgacagtgaaccaacgactaaaggactcttgggtggaacgcctggactttaaccccgaccggtatctacaggacaatccggccagtggcgaaaaattcgcctacgtcccctttggcgccggacggcataggtgcattggcgaaaatttcgcctatgttcagataaagacaatttggtcaactatgctgagactatatgagttcgacttaattgacgggtatttccctaccgtcaattacactaccatgatccatactcctgaaaatcctgtgattaggtataagaggaggagcaagtag

SEQ ID NO: 113742 - DNA, 1515 bp, Artificial Sequence
  Description of Artificial Sequence: Synthetic coding sequence
atgatgactacatcattaatctggggcattgctatcgcggcatgttgctgcctttggcttatactcgggatacgcaggaggcagacaggtgagccacctctggaaaacggactgattccttacctcggatgcgcactccaatttggggccaacccgctggagttcctgagggctaaccaaaggaagcacggccacgtatttacttgtaaattgatggggaaatacgtgcattttataaccaacccactttcttaccacaaggtactttgtcacggcaagtactttgactggaagaaattccacttcgcaacttcagcaaaggcattcgggcaccgatccatagatccaatggacggcaacacaacagagaatataaacgatacctttatcaaaacgctccagggacacgcattgaatagcctcactgagtctatgatggaaaacctgcagaggatcatgcggccgcccgtatccagtaatagtaagacagccgcatgggtcacggaaggcatgtacagcttttgttacagggtgatgtttgaggcaggctatttgacaatcttcggaagggacttgacacgtagggacacgcagaaagcccacattctcaacaacctcgacaactttaaacagtttgacaaagtcttccccgcactcgtggccggactgcctattcacatgttcagaaccgcacataatgcgcgcgaaaaacttgcagaatctttaaggcacgagaaccttcagaaaagggagtccatctctgaactgatttctctgcggatgtttcttaacgatactctaagcactttcgatgaccttgagaaagcgaaaacacacctagtggtcctctgggcctcccaggccaatacaattccggcaaccttctggagcctgtttcaaatgatacggaatcctgaggcaatgaaggctgccactgaagaagtaaagcggacactggaaaacgccggtcagaaggtgtctctcgaaggaaatcccatctgcctgagtcaggcagagctcaacgatctccctgtcctcgattccatcatcaaggaatctctacgactcagctccgcatcactgaacatcaggacagccaaggaagatttcactctgcacttagaggacggttcatataacatacgtaaggatgacatcatcgccctgtacccccaacttatgcacttagatcctgaaatctatccggacccactgacctttaagtacgaccggtatcttgacgagaacgggaaaaccaagactactttttactgcaatggattgaaactcaaatactactacatgccatttggctctggggccacgatttgtcccggccggctcttcgcgattcatgaaattaagcagttcttgattctgatgctcagttatttcgagctggagctgatcgaagggcaggcgaagtgccccccattggaccagagccgtgcaggcctgggcattctacctcccctcaacgacatagaatttaaatacaagttcaaacacttgtag

SEQ ID NO: 113743 - DNA, 1521 bp, Artificial Sequence
  Description of Artificial Sequence: Synthetic coding sequence
atggcaggcgaagtgagtgcggctactggtagattctccctcgagcgcctgggcctgcctggcctcgctctggctgcggcattattgctattggctctttgtctcctggtccgccggactagacgaccaggcgagcctcctcttataaagggctggctgccatacctgggcgtggttctcaatctgcgaaaagatccgttaaggtttatgaagacattacagaaacagcacggcgatacattcactgtgcttttagggggcaaatacatcacctttattttggacccattccagtaccagctcgtaattaagaaccataagcagctctccttcagagttttcagtaacaagttacttgaaaaagcattttctatctcacagttacaaaaaaatcacgacatgaatgatgaactgcatttgtgttaccagttcctgcagggcaagtccctggacatcctgcttgagtccatgatgcagaatctgaaacaggtcttcgagccccagttactcaaaactacttcttgggatactgcagagttgtatcccttttgcagctccatcattttcgaaatcacattcaccacaatctacggaaaggtgattgtctgtgacaacaataagtttatttcagaactccgggacgatttcctgaagtttgacgataagttcgcctacctagtgagcaacattcccatagaactgcttggcaatgtcaaaagtataagggagaagattatcaaatgcttttccagcgaaaagctggctaagatgcagggatggagcgaggtctttcagagtcgccaggatgtccttgagaagtattatgtgcacgaggatctggaaatcggggcccatcacctgggcttcttatgggcgtcagtcgccaataccatcccaaccatgttttgggctatgtattatctgttgcggcaccccgaggcaatggccgccgtgcgggatgaaatcgataggctgctacaatcaaccgggcaaaagaaggggtctgggtttcctatccatctgacacgggaacaattggatagtctgatctgtcttgaaagcagcatcttcgaggcgctgcgcttgtctagctatagtacaactattaggtttgtcgaagaggacttgacacttagctcagagactggtgattactgtgtccggaaaggggacttggttgcgatcttccctcccgtattacacggcgatcctgagattttcgaggcaccggaagagtttcgctacgataggtttatagaggatggaaagaaaaagaccacattttttaagcgcgggaaaaaacttaagtgttatttaatgccgttcgggacaggcacttcgaaatgtccaggtcggttcttcgcacttatggagatcaaacaattgcttgtgatcttgctgacttacttcgacctcgagatcatcgacgataagcctattggactgaattatagtcggttgctgttcggcatccagtaccccgactctgatgtgctctttcggtataaggtgaagtcctag

SEQ ID NO: 113744 - DNA, 1506 bp, Artificial Sequence
  Description of Artificial Sequence: Synthetic coding sequence
atggtcctctggggcccggtgctcggcgcgttattagtggtgattgcagggtatctctgcctgccgggcatgctgcgccagagaagaccttgggaaccgcccctcgataaggggacagtcccatggctggggcatgctatggcattcagaaaaaacatgtttgaatttctaaagcgtatgcgtaccaagcacggtgacgtcttcaccgtgcagctggggggtcagtattttacttttgtgatggaccccctctctttcgggtcaattttaaaagacacccagcggaagttagactttgggcagtacgccaagaagctcgttctcaaggtctttggatataggtccgttcagggggaccatgaaatgattcactctgccagcaccaagcacttgagaggcgatggcctcaaagatctcaacgaaacaatgctggattcactaagcttcgttatgctaactagtaaggggtggagccttgatgccagctgttggcatgaggattccctcttccgattctgttattatatactgtttaccgcaggttatttgagcctctttgggtacactaaggataaggaacaagatctgttacaggcgggagagttgttcatggagtttcgtaagttcgatctgctatttccaaggttcgtttactccttactgtggcccagggaatggctcgaagttggaagactgcagcgtctatttcataagatgctgagtgtgagccactctcaggagaaagagggtatctccaattggctcggtaacatgctgcagttcttgcgggaacagggagtgccatctgcaatgcaagacaaattcaacttcatgatgttgtgggcctctcagggaaacactggtccaacctcattctgggcacttctctacttgctgaagcaccctgaagccataagagccgtgcgcgaggaggcgacccaggtgctcggcgaggccagacttgagactaaacagtcattcgctttcaagctgggcgccctgcagcatactcccgttctcgacagtgttgtcgaggaaacactgaggttgagagccgcacccacattgctgagactcgtacatgaagactatactctgaaaatgagcagcggacaagagtatctgttccgccacggtgacatcttggcactcttcccgtacctgtctgttcacatggaccccgatatccaccccgaacccactgtatttaagtatgaccgtttccttaatccaaacggcagccgcaaggtggatttctttaagaccggcaagaaaatccatcattataccatgccatggggctctggagtgtccatctgccccggtcgtttcttcgcactgtccgaggtgaaactctttattctcctcatggtgacgcactttgatctggaactggtggaccccgacactcctctgccccacgtggatccccagagatggggctttggcaccatgcagccatcacacgacgtcaggtttcgatatcgacttcatccaaccgaatag

SEQ ID NO: 113745 - DNA, 573 bp, Artificial Sequence
  Description of Artificial Sequence: Synthetic coding sequence
atggaaaaggtcccaggagagatggagatcgagcggagggaaaggtccgaagagctgtctgaagccgagagaaaggctgtgcaggcgatgtgggccaggctttatgctaattgtgaagatgtgggtgttgccattctggtgaggttcttcgttaattttcctagtgctaaacagtatttttctcaattcaagcatatggaggatccactggagatggagcggagcccccaactgcggaagcacgcttgcagagtcatgggagcacttaacacagtggttgagaatctgcatgacccagacaaggtcagtagcgtcctggccctcgtcggaaaggctcacgccttgaaacataaggttgagcccgtttactttaagattctcagtggggtcatattagaggtcgttgcagaggagttcgctagcgactttccgccggagacccagagagcgtgggccaagcttcggggactgatttattctcacgtgacggctgcctacaaggaggtgggctgggtgcaacaggtccctaatgctacaactccgccggcaaccttgcccagttctggcccctag

SEQ ID NO: 113746 - DNA, 1194 bp, Artificial Sequence
  Description of Artificial Sequence: Synthetic coding sequence
atggaagaagatgacagttacgtccctagtgacctgaccgccgaggagaggcaggagcttgaaaacatccggcgacggaaacaagagctgcttgctgacatccagaggcttaaggatgaaattgctgaggtcgctaatgagatcgagaacctggggagtacagaagagcgtaagaacatgcaacgaaacaagcaggtcgctatgggtagaaagaaatttaatatggaccccaaaaaagggattcagttcctgattgagaatgatctgctgaagaatacatgtgaggatatagcgcagttcctgtacaaaggggaaggactgaataaaacagccatcggtgactacctgggagagcgcgacgagtttaacatccaggttctacatgctttcgtcgagcttcacgagttcactgacttgaacctggtgcaagccctccgccagttcttatggtccttccgccttccaggagaggctcaaaaaatagacagaatgatggaggcgttcgcgcagcgctactgtcagtgtaacaacggggtcttccagtccactgatacctgttacgttctgtctttcgccatcatcatgcttaatacttcgctccacaatcccaacgtaaaagataagcctaccgtggaacggtttattgcgatgaacaggggaattaacgacggcggagacctgcccgaagaattgttgaggaatctctacgagtcaatcaagaatgaaccgtttaaaatcccggaagatgacggcaacgaccttactcatacgttctttaatcccgatagagaggggtggctccttaaattgggaggacgagtcaaaacctggaaaagacgctggttcatcttgacggataattgtttatattatttcgaatacacaaccgacaaggagccccggggcattatcccactggaaaatctcagtatacgcgaggtcgaagattccaaaaagccaaattgttttgaactgtacattccagataataaagatcaggtcattaaggcttgtaaaaccgaggccgacggccgggtcgtggaggggaatcatactgtgtaccgaatcagcgctccgacgccagaagagaaggaagaatggataaagtgtattaaggccgctatctccagagatcctttttatgagatgctggcggcaagaaagaaaaaagttagcagcactaaacgtcattag

SEQ ID NO: 113747 - DNA, 1197 bp, Artificial Sequence
  Description of Artificial Sequence: Synthetic coding sequence
atggaggaagatgacagctacgtgccctccgatctgactgcggaagagcgacaagaattggaaaacatccgacgccgaaagcaggagctgctggctgacattcagcgccttaaggatgagatcgcggaggtcgcaaatgagatagaaaatctggggtcaacagaggaaaggaagaatatgcaacgaaacaagcaggtcgccatgggcagaaaaaaattcaatatggatccaaagaaaggcatccagttcctgattgagaacgatttgctgaagaacacttgcgaggacatcgcccagttcctgtacaagggggagggtctcaacaagacagcaattggggactatttaggggagagggacgagtttaacattcaggtgctccacgcatttgtggaactacacgagtttacagaccttaacctggtgcaggctctgcggcaattcctgtggtctttccggttgcctggtgaagcacagaaaattgaccgtatgatggaggcctttgcacagcgatactgccagtgtaataatggagtcttccagtctaccgacacttgctacgttctcagcttcgctatcattatgttgaatacatctctgcacaatccaaatgtaaaggacaagccaaccgtggagagattcatagcgatgaacaggggtatcaacgacggcggagacctccccgaggagctgttgcggaacctgtatgagtcaatcaaaaacgagccatttaagattcctgaagatgatggcaacgacctaactcacaccttctttaatcccgacagggaagggtggctactcaaactcgggggcggcagagtcaaaacctggaagagaagatggtttatcttaaccgataactgcctgtattactttgagtatacgacagacaaggaacctcgaggcatcatccctctggagaatttatccattcgggaagtcgaagattcaaaaaagcccaactgctttgagctctacatcccagataataaagatcaggtgataaaggcctgtaagaccgaggctgacggtcgggtagtcgaaggtaaccataccgtgtaccgaatcagcgctcccactcctgaggaaaaggaggaatggataaagtgcatcaaggccgccattagtcgggaccccttttatgagatgctggcggctagaaagaagaaggtttccagcacaaagcgccattag

SEQ ID NO: 113748 - DNA, 657 bp, Artificial Sequence
  Description of Artificial Sequence: Synthetic coding sequence
atgatggaagcctttgcacagaggtactgtcagtgtaacaacggcgttttccagagcactgacacatgctacgtgctgagtttcgctatcataatgctcaacacctcattgcacaatcctaacgtaaaggataagcctactgtcgagagattcatcgcgatgaaccgcggcattaatgatggcggcgacttgcctgaggagctcttacggaacctgtacgagtcaatcaaaaacgagccttttaagatccccgaggacgacggcaatgaccttacccacacgtttttcaatccagatagagaaggctggttgttgaaactggctggagggagagtgaaaacatggaagcggcggtggtttatcctgacggacaactgtctctactacttcgaatacactacagataaggagcccagaggcattatcccgctagagaaccttagcatccgcgaggtagaagattctaagaaacctaactgttttgagttatatatccccgacaacaaggaccaggtaattaaggcctgtaaaaccgaagctgacgggagggtcgtggagggcaatcatacagtataccggatctctgcgccaacccctgaggagaaggaggaatggatcaaatgtattaaattccaggtaagccccggggagccttag

SEQ ID NO: 113749 - DNA, 1197 bp, Artificial Sequence
  Description of Artificial Sequence: Synthetic coding sequence
atggaggaagatgactcatatgttccaagtgacctcaccgccgaagagaggcaggagttggaaaacattcgccgcaggaagcaagagttgctcgccgacatacagcgtctcaaagacgaaatcgctgaagtggcgaatgagattgaaaatctgggctctacagaagagcggaaaaacatgcaaaggaacaaacaggtggcaatgggccggaagaagttcaatatggatccaaagaaaggaatccagtttcttattgaaaacgatctactaaaaaatacttgtgaggacattgcacagttcctctataaaggcgagggcctgaacaagacagcaatcggcgattaccttggagaaagagatgagttcaatattcaagtattgcacgcattcgtcgaactccacgaattcaccgatctcaacctcgtccaggccctcagacaatttctctggagttttaggctgcccggcgaggctcagaaaatcgatcgcatgatggaagcttttgctcaacggtattgccaatgcaacaatggggtgttccagagcacagacacctgctacgtgctatcttttgccatcattatgctgaacacctctttgcacaaccctaacgtaaaggataaaccaaccgtcgagcgctttatcgccatgaataggggaattaatgacgggggagatctgcctgaggagcttcttcggaacctgtatgagtcaattaaaaatgagccttttaaaatcccagaagacgatgggaacgatcttacccatacgttttttaaccccgaccgagaggggtggttgctgaaactgggcgggggcagggtaaagacttggaagcggcggtggttcatactgaccgataattgtctttactactttgaatatactacagataaggagccccggggcatcattcctttggagaacctcagtatccgtgaggtggaagactccaagaagcctaattgcttcgagctctatattccagataataaggaccaagttataaaagcttgtaagactgaagccgacggccgggtggtggagggaaatcatacagtgtaccgtattagcgcaccaacccctgaggagaaagaggaatggatcaagtgcataaaagcggcgatttctcgggacccattttatgagatgctggcagccagaaagaaaaaggtcagctccacgaagcgacactag

SEQ ID NO: 113750 - DNA, 1020 bp, Artificial Sequence
  Description of Artificial Sequence: Synthetic coding sequence
atgcaacgaaataagcaagtcgcgatgggccggaagaaatttaatatggacccaaaaaaagggatccagttcctgatcgaaaatgacttgctgaagaacacatgtgaggacattgctcagttcttgtacaaaggcgaggggttgaacaagacagcgattggggactacctgggagaacgggacgagtttaacatccaggttctgcatgccttcgtcgaattgcacgagttcactgacctgaatctggtgcaggcactccggcagttcctttggtccttccgcctgcctggcgaggcccagaagatcgatagaatgatggaagcctttgcccaaaggtattgccagtgtaataatggcgtttttcagtccacggatacgtgttacgtgctgtcgtttgccatcatcatgttgaatacttctttgcacaaccccaacgtcaaggacaagccaacagtggagcggttcatcgctatgaacaggggaataaatgatggcggggaccttcctgaagagctactgcgcaacctctatgagtcaatcaaaaacgagccctttaagattcccgaagacgatggtaacgatctgacacataccttctttaatccggaccgtgaaggctggctcttgaagctgggaggaggccgcgttaagacctggaagaggaggtggttcatattgacggacaattgtctgtactacttcgaatatactacggacaaggaacccaggggtatcatccctttggaaaacttatctattagggaagtagaggactcaaagaagccaaactgtttcgagctgtatatccctgataataaggatcaggtcatcaaggcttgcaagaccgaggccgacgggagggtcgtcgagggtaaccataccgtgtatcggataagtgctccaacaccagaggagaaagaggaatggatcaagtgtataaaggccgccatcagtcgggatccgttttacgagatgctcgctgcccgcaaaaagaaagtgagtagcaccaaacggcactag

SEQ ID NO: 113751 - DNA, 1020 bp, Artificial Sequence
  Description of Artificial Sequence: Synthetic coding sequence
atgcagaggaataaacaagtagctatgggtcgcaagaagtttaacatggacccaaaaaagggcatccagttcctgatcgaaaacgacctgctgaagaatacatgtgaagacatagcccagtttctgtataaaggggaaggcctaaataaaactgctataggggactatctcggagaaagggacgagtttaacatacaggtgctgcatgcttttgtggagctgcatgagttcacagatcttaatttggtgcaagctctgcgtcaattcctttggtcattccgattgcctggtgaagcgcagaaaatcgatagaatgatggaggctttcgcccagcgctattgccagtgcaacaatggagtctttcagtccacagatacttgctacgttttgagctttgccattatcatgctgaacacttctttgcataacccaaatgtcaaggataagccgaccgtggagagattcatcgcgatgaatcgcggcattaacgatggaggggacctgcccgaagaattactgcgaaatctttacgagagcatcaagaatgagccctttaaaatcccggaagacgacggtaacgatctaactcatactttttttaatcctgatcgggaaggctggctactcaaactcggtggagggcgtgttaaaacctggaagcgcagatggtttatcctgacagataactgcctgtactattttgagtacactaccgacaaagaacccagggggattattccactagaaaatctttccatcagggaagtggaagactctaagaaaccaaattgttttgaactttatataccagataataaagaccaggttatcaaagcttgtaagaccgaggcagatgggcgcgttgtggagggaaatcacactgtttatcggatctctgcccccaccccagaagagaaggaagaatggattaagtgcattaaagccgccattagtagagatcctttctatgagatgctggccgccaggaaaaagaaggtttccagcacaaagcgacattag

SEQ ID NO: 113752 - DNA, 1080 bp, Artificial Sequence
  Description of Artificial Sequence: Synthetic coding sequence
atgtcattacagcggctgctgcagcattcctccaatggaaaccttgccgatttttgcgcggggccagcttacagttcttatagcacactgacagggagcctcaccatggatgataacaggcgcatccagatgctcgcagacacagtggccacactaccaagaggccgtaagcaacttgctctgactcgcagctcatccctgagtgacttctcgtggagccagcgcaaactggtgactgtggaaaagcaggacaacgaaacattcgggtttgagatacagagttacagaccccaaaaccagaacgcttgcagctcagagatgttcacactcatctgtaagatccaggaagatagccctgctcattgtgccggactgcaggccggagacgttcttgctaatatcaacggggtctcaaccgaaggtttcacatacaagcaagtggtggatcttattcgcagtagcggcaatttactcacaattgagacattgaatggcacgatgatacttaaaaggacggaactggaagcaaagttgcaggtgttgaaacagaccctgaagcagaagtgggtggaataccgctccctccagcttcaggagcaccggctactgcacggcgacgccgccaactgcccaagcttagagaacatggacctagacgagttatccttgtttggccctttgcctggacctggcccagctttagtcgataggaaccgcctgtccagcgagagcagttgcaagtcttggttaagctctatgaccatggattcagaggacggatatcaaacctgcgttagcgaagactcaagtagaggcgccttctctcgtcaaacaagcaccgatgacgagtgctttatccccaaggaaggcgatgattttctgcgccgaagcagcagcaggcggaaccggagcattagtaacacgagttcagggtcaatgagccccctgtgggaagggaacctgagttcaatgttcggcaccctgccgagaaaatctcgaaaggggtccgtgagaaagcaattgttaaagtttattcccggcctccaccgcgcggtggaggaggaggaatcccgattctag

SEQ ID NO: 113753 - DNA, 762 bp, Artificial Sequence
  Description of Artificial Sequence: Synthetic coding sequence
atgttcaccctgatctgcaagattcaggaagatagtcctgcacattgtgccggactccaagcgggagatgtattggctaatatcaatggggtcagcaccgaagggtttacatacaagcaagtggttgatttgattcgcagcagcgggaacttgctgaccatcgaaactttaaacggcacgatgatactaaagcgcaccgaattggaagcaaagttacaggtactgaaacagacccttaagcagaagtgggtggagtacagatcactccagctacaggagcatcggctgttacatggcgacgcagcgaactgccctagtctggaaaacatggatctcgatgaattgtctctctttggtcctctgcccgggccgggtcccgccttggtagatagaaatcgcttgtctagcgagtcctcctgcaagtcatggctctccagcatgactatggatagcgaggacggttatcagacctgcgtgagcgaagactcaagccggggtgcctttagcagacagacttccactgatgatgagtgttttattccaaaggagggggacgactttctaagacgctcgtcaagtcgtcggaatcggtctattagcaatactagtagtggaagcatgagccccctgtgggaaggaaacctgagttctatgttcggcacccttccacgaaaaagccgtaagggatccgtgaggaagcagctcctgaaatttataccgggcttacatcgggctgtggaggaggaggagagccgattttag

SEQ ID NO: 113754 - DNA, 1203 bp, Artificial Sequence
  Description of Artificial Sequence: Synthetic coding sequence
atggaagacggggtttatgagccaccagacctgacccccgaggagcgtatggaactggaaaatataaggcggcggaaacaggaactcctggtcgagatccagcgtttacgcgaggaactgtctgaagccatgtccgaggtggagggcctggaggctaacgaggggagtaagacactccagcgcaataggaagatggcgatgggccggaagaagtttaacatggaccctaaaaagggtatccagtttctggtggagaatgaactgttgcagaacaccccggaggagattgcccgattcctatataaaggcgaggggctgaacaaaacagcgattggtgactatctcggcgagcgcgaggagttgaatttggcggttctgcacgcttttgtcgatctacacgagttcaccgatctgaatctggtccaggctttgcgacaatttctgtggtcctttcggctccccggggaagctcagaaaatcgaccgaatgatggaagccttcgctcagcgctattgcctgtgtaatccaggcgtgttccagtcaaccgacacatgctacgtcttatcctttgctgtgataatgttaaatacctctctgcacaaccctaacgtacgggacaaaccaggcctggagcgtttcgttgcgatgaatcgaggcattaatgaaggaggggacctgccagaagagttgctgagaaatctgtatgactccattagaaatgagcccttcaaaatacctgaggacgatgggaacgatctgactcacaccttcttcaatccagaccgggagggctggctcttaaagcttgctggtggccgcgtcaagacatggaagcggcggtggttcatcttaacagacaactgcctttactatttcgaatacactaccgacaaagaaccgagaggtattatccctctcgagaatctgtcaattagggaggtggatgaccctagaaaaccaaattgcttcgagttatacattccaaataataaggggcagctgattaaggcctgcaaaaccgaggcggacgggagagtggtggagggaaatcacatggtgtatcgtatctccgctcctacacaggaggagaaagacgaatggattaagtccatccaggccgccgtgtccgttgacccattttacgagatgttagctgcgaggaaaaagagaattagcgtcaagaagaagcaagagcagccttag

SEQ ID NO: 113755 - DNA, 1200 bp, Artificial Sequence
  Description of Artificial Sequence: Synthetic coding sequence
atggaggatggcgtatatgaacctcctgatcttacccccgaagaaagaatggagctggaaaatattaggaggcgtaaacaggaactcctggtggagatccagcgcctgagagaggaactgagtgaagcaatgagtgaggtcgaaggccttgaggctaacgaagggtccaagaccctgcagagaaaccggaagatggccatggggagaaagaaatttaacatggacccgaaaaagggcatacagtttctcgttgagaacgagttgttgcagaacacacccgaagagattgcacggttcctgtacaaaggggaggggctgaacaaaacggctattggtgattatttaggcgagcgagaggagcttaatctggcagtcctccatgcttttgtagacctccacgagtttaccgatttgaatttggtccaggcgctacgccagtttctgtggtcattccggttgcctggggaggcgcagaagattgatagaatgatggaggcattcgcacagcgctactgcctctgtaaccccggcgtctttcaaagtactgatacttgttatgtcctaagttttgcggtgattatgctgaacaccagcttacacaatcctaacgtgcgagacaagcctggcctggaaaggtttgtggcgatgaatcggggaataaacgagggtggcgatctccccgaagaactgctgcgtaatctctatgactccattcggaacgaaccctttaaaatcccagaagacgatgggaatgacttgacccacacattcttcaatccagaccgagaaggctggttactaaagctgggagggagagtgaagacctggaaaagaagatggttcatcctcacggataattgcctttactatttcgagtatacaaccgataaggagccacggggcatcatccccctcgaaaacctgagtatccgcgaagtggatgaccctcgtaagcctaattgcttcgagctgtacatccctaacaataaggggcagctgattaaagcatgcaaaactgaagcagatggtagagtcgtggagggtaaccatatggtctatcgaatctctgctcctacccaagaagagaaagatgagtggattaagtccattcaggctgcagtgagcgtggaccccttttatgagatgctggccgcaagaaaaaaacgtatcagcgtcaaaaagaaacaggagcagccatag

SEQ ID NO: 113756 - DNA, 1200 bp, Artificial Sequence
  Description of Artificial Sequence: Synthetic coding sequence
atggacgaggatggtgggggagaagggggaggcgtgcccgaggacttgagtcttgaggaacgcgaggagctgctcgacatcaggcggcgaaaaaaggagctcattgacgatatcgaacgactgaagtacgagattgctgaggtcatgacggagattgacaacttgacttctgtggaagagtccaagacaacacaacggaataagcaaatcgctatgggtaggaagaagtttaacatggatcctaaaaagggaattcagtttttaattgagaacgacttactacaaagttctcccgaagacgtcgcacagttcttgtataaaggagaaggtctgaataaaactgtgattggcgattacttgggtgagagggacgaatttaacatcaaggtacttcaggcttttgtcgagctgcacgaatttgccgatctgaaccttgttcaggcacttcgacagtttctttggagttttcgtctgcctggagaagcccaaaagatcgacagaatgatggaggcttttgcgagcaggtactgtctttgcaaccctggcgtatttcagagcacggacacttgctatgttctttcatttgctatcattatgctcaacactagcttgcacaatcacaatgtacgcgataaacctacagccgaaagatttatagccatgaaccgaggcataaacgagggtggggatttgcccgaagagctgctgcggaacctgtatgagagcatcaagaacgagccttttaagatacccgaggacgatggcaacgacttgacgcacacatttttcaatccggaccgggaagggtggctgttgaaattaggtgggcgcgtgaagacgtggaagagacgctggtttattctgaccgataattgtttgtactacttcgaatacaccacagacaaggagccccgcggaattatcccactggagaacctgtcgattagagaggtcgaggatccgagaaagcctaactgttttgaactgtataatcccagtcataaaggccaagtgattaaagcgtgtaaaaccgaggctgacggacgggtcgttgagggaaatcatgttgtctaccgcatctcagctccatcaccagaagagaaggaagaatggatgaagtccatcaaggcaagtatttcaagggatcctttctacgatatgctggctacaagaaaaagacggatcgctaacaaaaagtag

SEQ ID NO: 113757 - DNA, 945 bp, Artificial Sequence
  Description of Artificial Sequence: Synthetic coding sequence
atggcactgcctcagttacagacagccatgctggccgccttcctatgggaccccagggacgttgtgctgaccgcccagccaggggccgaacagtgcgccgaatccagtcaacacatccggattctgcagccccaattcaggcttattaggttgcggttctggaaactctacatccagcgaagagtacaggcttggcagttcctgtggagttttaggctccccggggaagcccaaaagatagatagaatgatggaggccttcgcctctagatactgcctgtgcaacccgggagtgttccagagcactgacacttgttacgtgttgtccttcgctattatcatgttgaataccagcctgcataaccacaatgtccgcgataagccaaccgctgagcgctttattgctatgaataggggaatcaacgagggaggagaccttcccgaggaactgcttagaaatctgtacgagtcaattaaaaatgagcctttcaagattcccgaggacgacggaaatgaccttactcacacattcttcaaccccgacagggagggttggttgttgaagctgggtggccgcgtgaagacatggaagagacgctggttcatcctgaccgacaactgcttgtactactttgagtatactactgacaaggaaccgcgcggtattatccccctcgaaaacctgtccataagggaagtggaagatcctcggaaacctaattgcttcgaactgtacaaccccagtcataaaggccaagtcataaaggcctgtaaaaccgaggcagatggcagagtcgtcgagggcaatcatgtggtatacagaatcagcgctcccagccctgaggaaaaagaagaatggatgaaatctattaaggcctccatctctagggatcctttctatgatatgctcgctaccagaaagcggaggatagctaacaagaaatag

SEQ ID NO: 113758 - DNA, 1185 bp, Artificial Sequence
  Description of Artificial Sequence: Synthetic coding sequence
atggacctctgtcatcccgaacccgcagagctgtctagtggtgagacggaagagctgcaacgcatcaaatggcaccgaaaacagttactggaggatatccagaaactcaaggatgagattgcagatgtgttcgcacagattgattgcttcgagtcagccgaggagtctagaatggcacagaaagagaaggaactatgtatcggccggaaaaaattcaacatggatccggcgaaaggcatccagtacttcatcgaacacaagctgctaactcccgacgtgcaggatatcgcgaggtttctctacaagggagaaggccttaacaagaccgccatcgggacctacttgggcgaacgggatccaataaacctccaggtgcttcaggccttcgtagattgtcacgagtttgcgaatcttaatctggtccaggccctgcggcagtttctctggtctttcagattacctggagaagctcagaaaatcgaccgtatgatggaagcgttcgccactcgctattgcctgtgcaaccccggagtttttcagtccactgacacatgctatgtgctgagcttctcaatcatcatgctgaatacctcgctgcataatcccaatgtgcgggatcggccgccctttgagcgttttgtcagcatgaataggggtataaataacgggtccgacttgccggaggaccaactgcggaatctcttcgatagcataaaatcggaaccattttctataccagaagacgacgggaatgacctgacacatacgttttttaatcctgacagagaaggctggctgctgaagctagggggccgcgtaaagacttggaagcgcaggtggttcatcctgaccgacaactgcctgtactatttcgaattcacgacagacaaggagccccgtggcataatcccgttggaaaacctgagcgtgcaaaaggtagacgatccaaagaagccattctgcctggagctgtacaatccctcatgcagagggcagaagattaaagcttgcaaaacagacggggacggaagagttgtcgagggcaaacatgaatcctatcgcatttctgcaacttccgccgaagaacgagaccagtggattgagtcaatcagggcaagcattacccgcgtgccattttacgatctggtaagcaccagaaagaaaaagattgcctcaaagcagtag

SEQ ID NO: 113759 - DNA, 474 bp, Artificial Sequence
  Description of Artificial Sequence: Synthetic coding sequence
atggacttgtgtcatcccgaacccgccgaactgagcagtggtgagaccgaagagctgcaacggatcaaatggcatcgcaaacagttactggaggacatccaaaagttgaaggatgagatcgccgatgtgttcgcgcagatcgactgtttcgagagcgcggaagagagtcggatggcgcagaaggaaaaggagctatgcatcgggcgtaaaaaatttaatatggatccagccaagggcatccagtattttatagaacataagttactgacacccgacgtgcaagacattgctcgcttcctatataagggggagggacttaacaagactgccattggcacttatctgggcgaaagggatccaatcaacctgcaggtgctgcaggcatttgtcgactgtcacgaatttgccaatttgaatttggttcaagcactgaggttcagggagggcgcatccgaccttggctttggcggctag

SEQ ID NO: 113760 - DNA, 876 bp, Artificial Sequence
  Description of Artificial Sequence: Synthetic coding sequence
gatcgatctacagggcacctcttccccaggggcgtcggcatggacctgtgccaccctgagcctgccgagctgagtagcggtgaaactgaagaactgcaaagaatcaagtggcacagaaagcaactcctggaagacatccagaaactcaaggacgaaatcgccgatgtgttcgcgcagatagactgcttcgagagtgctgaggaatctcgaatggctcagaaggagaaggagctatgtatcggcagaaagaaatttaacatggacccagccaaagggatccaatatttcattgagcacaagctgctgacgcctgacgtgcaagacatagcccggttcctgtataagggcgaaggcttgaataaaacagctatcgggacataccttggtgagagagacccgataaatctgcaggtgctacaggcctttgtggattgccatgagttcgctaatctgaacctcgtgcaggccttgcgtcagtttctgtggagctttagactgccaggcgaggctcagaaaatcgaccgaatgatggaagcttttgctacccgctactgtctatgcaatcccggcgtgtttcaatctacggatacctgttatgtcctgtctttcagcattattatgttgaacaccagtctgcacaatccaaatgtgagagaccggcccccattcgaacggttcgtctctatgaataggggcataaataacgggtccgacctgccagaggaccagctgagagtcacatgggaatgctcccagcgtagatcccgtgaaaggacatttcagaaagaagaggttgcaagaacagaggcctgcccggactgggagcgccggggtgtgcaatgtggacgggagccactgcgccagcaccaggagtag

SEQ ID NO: 113761 - DNA, 444 bp, Artificial Sequence
  Description of Artificial Sequence: Synthetic coding sequence
tgaacccatacatctggtagtctgagcagccgcgacagtcaggcaggcgacagcgcaagccgcgcgggggggcgcgtgaagacatggaaacgccgctggttcattctgaccgacaactgcctatattattttgaatttaccaccgacaaggaaccccggggaatcatccccctggagaatctgagcgtgcaaaaggttgatgacccgaaaaagcccttttgtcttgagctctataacccttcctgcagaggtcagaaaattaaggcttgcaaaacagacggcgatgggagagtggtggaagggaaacatgagagctatagaatcagcgccacctccgccgaagagagagatcagtggatcgagtcaatacgagcctctatcacacgcgtgccgttctacgatctcgtttctacacggaaaaaaaagattgctagcaaacaatag

SEQ ID NO: 113762 - DNA, 354 bp, Artificial Sequence
  Description of Artificial Sequence: Synthetic coding sequence
atggacctgtgccacccagagcccgccgagctaagctcaggggagaccgaagaactgcagcgcattaagtggcacaggaagcagctgctggaggatatccagaaactgaaggacgaaatagcagatgtattcgcacagatcgattgcttcgagagtgcagaggaaagcagaatggcccagaaggaaaaggaactgtgtatcggccgcaagaaatttaacatggatcccgcgaaaggcattcagtatttcatcgaacacaaactgctaactccagacgttcaagacattgcaagattcctgtataagggggaaggactgaataaaacggctattggcacttatttaggcgagtag

SEQ ID NO: 113763 - DNA, 777 bp, Artificial Sequence
  Description of Artificial Sequence: Synthetic coding sequence
atggttttatgcgtgcagggtccacggcccctgctagcggtagaacgtactgggcagagaccactgtgggcccccagcctagaattgcccaagcctgttatgcagcccctgcccgccggcgcattcctcgaggaagttgccgaaggaacccctgctcaaaccgaaagcgagcctaaagtactagatcccgaggaggacctgctctgcatcgccaaaacattctcctatttacgcgagtccgggtggtactgggggagtattactgcaagcgaagccaggcaacatttgcaaaagatgccggaaggaacctttctggtcagggatagtacacaccctagttatctgtttaccctgagcgttaagaccacgagaggacctaccaatgtaaggatcgaatacgcagatagttcctttagacttgactccaactgtctctctcgaccgagaattttagcatttccagatgtcgtctcgctcgttcaacattatgtcgcttcctgtacagccgatacacggtcggactcccccgatccggcacctactcccgccttgccaatgccaaaggaggatgctccaagtgatcctgcattgccagccccacccccagcaacggcagtgcacctgaagctcgtgcagccatttgtgagacggtcttccgccagaagcctccagcatctgtgccgactcgttatcaaccgtctagtcgccgatgtagactgtctccccctgcctcggagaatggcggattatctgagacagtatccttttcagctctag

SEQ ID NO: 113764 - DNA, 828 bp, Artificial Sequence
  Description of Artificial Sequence: Synthetic coding sequence
atgtatcttgagcatacctctcactgtcctcaccacgacgatgatactgcaatggacacacctttgccccggccaagacccctactggccgtagaacgtactggccagagacccctttgggccccaagccttgagcttccaaaaccggtgatgcaacccctccccgcgggagccttcctcgaagaagtggccgaaggtacccctgcacagactgagagcgaaccaaaagttctcgatcccgaggaagatctactatgtatcgcaaagacgttttcctatcttagagaatccgggtggtattggggttccatcacggcgtcagaagcccgccaacacctccagaaaatgcctgagggcacgttcctggtaagggactcaacgcatccaagctacctcttcactttaagcgtgaagaccacaagaggccccaccaacgtgagaatcgagtacgccgattcatcattccgtctagattccaactgcctgtccaggccgcggattctagccttccctgacgtggtgtcattagtccagcactacgtggcttcctgcaccgcagacaccaggtccgactccccagaccctgccccaacccctgctctgcccatgcccaaggaagacgccccgagcgatccagccctgcctgcaccgcccccagccaccgcagtgcatcttaagttagtgcagccatttgtgcgcaggtctagcgctcgctctctgcagcatctgtgccgtctcgtcatcaatcgacttgtggccgatgtcgactgcctccccctgccaaggaggatggcagactacttacggcagtaccctttccagctgtag

SEQ ID NO: 113765 - DNA, 1269 bp, Artificial Sequence
  Description of Artificial Sequence: Synthetic coding sequence
atgcccgcgggtaggcgcgggcctgccgctcaaagcgcgcgtagacccccaccactgctgcctttattattgcttttatgtgtattgggggccccgcgtgcagggtcaggggctcatacagctgtgatcagtccgcaggatccgacgttactgattgggagcagcctgctggccacatgcagcgtgcacggcgatcctccaggcgccacagctgaaggactctactggactctgaacgggaggcggctgccacccgaactgagcagagtgctgaatgcttccacactggccctggccctagcaaacctcaatggctcccgacagcgaagtggcgacaacttggtttgtcacgctagagatggaagtatcctcgccggatcctgtctctacgtcgggctgccccccgagaaacccgttaatatatcctgttggagtaaaaacatgaaagatctaacttgtcggtggacaccgggagctcatggcgagacgttccttcacaccaactattctctgaagtacaagttgcgttggtatgggcaagacaatacctgtgaggaataccataccgtcggaccccatagttgccatatccctaaagacctcgctctgtttactccctatgagatatgggtggaggcgacgaatcgtttaggctccgcaagatctgacgtactaactctggatattctggacgtagttaccacagatccccccccggatgtgcacgtgagccgagtgggaggcctggaggatcagctgagcgtccgttgggtcagtccgcccgccctgaaggactttctgttccaggccaaataccaaattagataccgcgtcgaagactccgtggactggaaggttgtcgacgacgtctctaatcagaccagctgtaggcttgccgggttgaaacccggcaccgtgtacttcgtgcaggtgcgttgcaatccgttcgggatctatgggagtaaaaaagcaggcatatggagcgagtggtcacacccaacggccgcgtctaccccccgctctgagcgcccagggcccggagggggggcatgtgaaccaagaggtggcgagccaagctctggaccagtgcggagagagctgaaacagttcttgggatggcttaagaagcacgcttactgttccaacctgtccttcaggctgtacgaccagtggcgggcatggatgcagaagtctcacaagaccagaaaccaggatgagggaattctgcctagtgggcggagagggaccgctcgaggccctgctagatag

SEQ ID NO: 113766 - DNA, 702 bp, Artificial Sequence
  Description of Artificial Sequence: Synthetic coding sequence
atgggacggctggtcctcctgtggggggccgccgtctttctgctggggggatggatggccctggggcagggtggagctgcagagggcgtgcagattcagattatctacttcaatctggaaacagtacaggtgacctggaacgcctccaagtattccaggactaatcttacatttcattatcgtttcaacggcgatgaggcctatgaccagtgcacgaattatctcttgcaggaaggccacaccagcgggtgtttgctggatgcagaacaacgggatgacattctgtatttttccatccgcaatggtactcacccagtctttacagcttctagatggatggtctattacctgaaaccatcatccccgaagcacgtccgcttctcctggcaccaggatgcagtgaccgtgacttgttcagatttaagctatggcgacctgctctacgaggttcagtatcgatccccatttgataccgagtggcagacacaaagtcgttcggtgacccaggcgggagtgcagtggtgcgacctgtgcctgctgcagccctcccccccccgattcaagagatttagttgcctgtcgctaccgtccagctgggattaccgccacccccccccacgtctggccaatttctgcattattagcagagatggcgtaagcccctgctggcctgggtggtctcgtacgtgcgatctgcggtag

SEQ ID NO: 113767 - DNA, 771 bp, Artificial Sequence
  Description of Artificial Sequence: Synthetic coding sequence
atgggaaggttggtgttgttgtggggggccgcagtgtttctcctcggcgggtggatggcattagggcaagggggagccgccgagggcgtgcagattcagataatttatttcaatctagaaacagtccaagtaacctggaatgcaagcaagtattccagaacaaatctcacctttcactatcgttttaacggcgacgaagcgtacgatcaatgcactaactatctcttgcaggaaggccacacatccgggtgcttactggatgccgagcagagagacgatattttgtacttttcaatccgaaatggcactcaccccgtgttcacagcatccaggtggatggtttactatctgaaacccagctcgccaaaacacgtccgattctcctggcatcaggacgccgtaacggtgacatgttccgatctcagctacggcgatctgctttatgaagtgcaatacaggagtcctttcgatacggagtggcagtccaagcaggagaacacctgtaacgtaactattgaggggctggatgcagagaagtgttatagcttttgggtgcgcgttaaagctatggaggatgtctacggaccggatacatatcctagcgattggtcagaagtgacttgttggcagcgcggggagatcagagacgcatgtgccgagactcccactccacctaaacccaagctcagtaagttcatcttgatttccagcctggctatactgttgatggtttcactcctgctgctctccctctggaagttatggaggtag

SEQ ID NO: 113768 - DNA, 768 bp, Artificial Sequence
  Description of Artificial Sequence: Synthetic coding sequence
atggggcggctggtcctgttgtggggcgctgccgttttcttgctggggggatggatggccttgggccagggcggggcagccgaaggggtccaaatacagattatctacttcaaccttgagactgtgcaggtcacctggaacgctagtaagtattcacgcaccaatctgacttttcactatcggtttaatggggacgaagcctacgatcagtgcactaattatctcctgcaggaagggcacacatcaggctgtctgctggacgccgagcagagggatgacatactgtatttctcaattcgcaacggaacccatcccgtgttcacagcatctcggtggatggtgtactacctgaagccttccagccccaagcacgttcgtttcagctggcaccaggacgccgtgaccgttacatgctcagatttatcttacggcgatttgctctatgaagttcagtaccgcagtcccttcgatacagagtggcaaagcaagcaggagaacacatgcaacgtgaccatcgaaggactggacgccgaaaaatgctacagtttctgggtgcgcgtcaaggcgatggaggatgtctatggacccgacacataccctagtgattggagcgaagtgacatgctggcagcgcggggagattagggacgcctgcgcggaaaccccaactcctcccaaacctaagctcagtaaattcatactcattagcagtctggccatcctgctgatggttagcctgctgctcctaagcctctggaagctgtggtag

SEQ ID NO: 113769 - DNA, 411 bp, Artificial Sequence
  Description of Artificial Sequence: Synthetic coding sequence
atgagaacacctggcccactgcctgtcctgctgttgcttctcgccggcgccccagcagctcgaccaacacctcccacctgttactctcgcatgcgcgctttgagtcaggagatcacccgggactttaatctactccaagtatcagaaccctctgagccatgtgtgcgatacttgccaagattgtatttggatattcataattactgtgttttggacaagctgcgagatttcgtggccagtcccccatgctggaaggtggcgcaggtggacagcctgaaagacaaggcacgaaaactgtacacaattatgaattccttctgtcgacgggacctagttttcctcctcgatgactgcaacgcccttgaatatccgatccctgtaaccaccgtgctgccggataggcagaggtag

SEQ ID NO: 113770 - DNA, 3762 bp, Artificial Sequence
  Description of Artificial Sequence: Synthetic coding sequence
atggccgcacaggtcacccttgaggatgccttatctaatgtggatctgctggaggagttgccacttcccgatcagcagccttgtattgagccaccaccgtccagcctcctatatcagcccaatttcaacacaaacttcgaggaccgaaatgctttcgtcactggcatcgcccgatacatcgagcaggcaaccgttcactcatctatgaacgaaatgctggaggaaggacaggagtacgcagtgatgctgtatacgtggcgctcttgcagtcgcgcaatccctcaggtgaaatgtaacgagcagcccaacagagtcgagatctacgagaagacggtcgaagtgctggagcccgaggtgactaagttgatgaattttatgtacttccagcggaatgccatagaacggttctgcggcgaggtgagacggctgtgtcacgccgaacggaggaaagatttcgtttcagaagcttatctcatcacactgggaaagttcatcaatatgttcgctgtcttggacgagctcaaaaatatgaagtgcagtgtgaaaaacgatcactccgcatataagagggccgcccagtttttgcggaagatggccgatccccagtctatacaggaatctcagaacctgtccatgtttctagcaaatcacaacaagatcacgcagtctcttcaacaacaactggaggtaatctctgggtacgaggaactcttggctgacatcgtgaacctttgtgtggactactacgagaacaggatgtatctcacaccttcagaaaagcatatgttgctgaaggtcatgggttttggactgtacctcatggatggaagcgtgtcaaatatctacaagctcgatgctaaaaaaagaatcaatcttagtaagattgataaatacttcaagcaactgcaggtcgtgccgctgttcggggatatgcagattgaactggcaagatatattaagacctctgctcactatgaggaaaataagagcagatggacatgcaccagctccgggtcaagccctcagtacaacatctgcgagcagatgatccagatacgcgaggaccatatgagatttataagtgaattggcccggtactccaactcggaagtcgtgaccggtagcgggaggcaggaggcccagaagacagacgccgagtatagaaaattgttcgatctcgccctgcaagggctgcaacttctttcccagtggagcgcccatgtgatggaagtttactcctggaaactcgtccacccaacagataaatactccaataaggactgtcccgacagcgctgaagagtacgagcgagccacgagatataactatacaagtgaagagaaattcgctctagtggaggtgatcgccatgatcaaaggcctacaggtgcttatgggaagaatggaatccgttttcaaccatgcaattaggcacacagtttatgccgcgctgcaggacttttcgcaagtcacactccgtgaaccactccggcaggccattaagaagaaaaagaatgtgattcagagtgtcctccaggcaatacgcaaaacagtgtgcgactgggaaacaggccacgaaccgtttaacgatcccgcgttgcgaggcgagaaggatcctaagagcggcttcgacatcaaggtgccccgcagagccgttgggccatcttcaacacagctctatatggtgcgcaccatgctggaaagcctgatcgccgataaatctggttccaaaaagaccctacgaagttccctggagggccccactatcctggacatagaaaagtttcatagggaatcattcttctacacgcacctgatcaactttagtgaaactctgcaacagtgttgtgacctgtcacaattgtggttcagggagtttttcctggaactgaccatgggtagacgaatccagtttcccatcgagatgagcatgccgtggattctcaccgatcatatattagagaccaaagaagcctctatgatggagtacgtgctgtactctctagacctgtataacgactccgcgcactacgcacttacccggttcaataagcagttcctttacgatgagatcgaggctgaagtgaatctctgttttgaccagtttgtgtataaattagccgaccagatctttgcttactacaaagtcatggctggatcgctgttgctcgacaagcgtctcaggagcgagtgcaagaaccaaggagctacaatacacctcccaccttccaatcgatacgagacgttgctgaagcagagacatgtccagcttcttggacgctctattgatctgaacagacttatcacccaacgcgttagcgcagctatgtacaagagcctggaactggccataggtcgcttcgaatctgaagatctcacgtctatcgtggaacttgatggtctactggagatcaaccgcatgacccacaagctgttgtctaggtatctcaccctcgacggctttgacgctatgttcagggaagcaaatcataatgtgtcggcaccatatggtcgcatcaccttacatgtcttttgggagctgaattacgacttcttacccaactattgctacaacggatccaccaacaggttcgtgcgcactgtgctcccattctcccaggagtttcagcgagataaacagccgaacgctcaaccacagtacctgcatggctcgaaagcccttaacctcgcctactcatctatttatgggagttacaggaactttgtcggcccaccacacttccaggtaatctgcagactattgggatatcaaggtatagctgtcgtgatggaggaattgctgaaagtggtgaagtctctcctccaagggactatactgcaatacgtgaagacgctcatggaggtcatgccaaagatttgtagactacccagacatgagtacggctcccccggaatcctcgagttctttcatcaccagctcaaggacatagtggagtatgccgagttaaagactgtgtgctttcagaacctgcgtgaagtcggtaatgctatactcttttgtctgctaatcgagcaaagcctgtctttggaggaggtttgcgatctgctgcacgcggccccgtttcagaatatcctgcctagggtgcacgtaaaggagggagagcgactagacgctaaaatgaagcgactggaatccaagtacgccccattacatctcgtaccgctcattgagcgcctgggaaccccacaacaaatcgccatcgctagagaaggcgatttattaactaaggagcgcctgtgttgcggcctgagtatgtttgaggtgattctaacaaggattcggagtttcctggatgatcccatctggcgaggacctcttccttcaaacggtgtgatgcatgtggatgaatgcgtagaattccacagattgtggagtgctatgcaattcgtgtactgcatccctgtgggcacgcacgagttcacagtcgaacaatgttttggcgacggccttcattgggcagggtgtatgataattgtcctgctcgggcaacagcgccgcttcgccgtactggacttctgctatcaccttttgaaggtccagaagcacgacgggaaggacgaaattattaagaatgtcccgcttaaaaaaatggttgagcgaatcagaaagttccagatcttgaacgatgaaatcattacaatcctggataagtatctgaagagcggagacggagagggaacccctgtggaacacgttaggtgtttccagccgccaatccaccagtctctggcgtcatcttag

SEQ ID NO: 113771 - DNA, 3768 bp, Artificial Sequence
  Description of Artificial Sequence: Synthetic coding sequence
atgggccctaagcacgtgctgcggcagcctggaccctcggagaggcaccatccagaagttcctgcgtggacgcctagggcggggcccccttgttggctgtgcagacagaggtggggctggaccctgcaccccccgggcagagggtgtccagctctgctgctgtcagaacctcggatggccgcccaagtgaccttggaagacgccttgtccaatgtggacctgcttgaggagctccctctgcccgatcagcagccatgtattgagccccctccctcaagcttactgtaccagaacgagatgcttgaggaggggcaagaatatgcggtgatgctgtacacttggcgtagctgcagccgagcaataccacaggtgaagtgtaacgaacagcccaaccgagtggagatctacgagaaaacagtagaggtcctggaaccggaggttacaaagcttatgaactttatgtattttcagaggaacgccattgagaggttttgcggcgaggtaagacgtctctgtcacgcggaaaggagaaaggactttgtatctgaggcctacctcatcactctaggaaaatttatcaatatgtttgccgtcctggacgaattgaagaacatgaaatgtagcgtgaagaatgaccactctgcttataaacgcgccgcccagttcttaaggaaaatggccgacccacagagcatacaggaatcgcagaacctcagtatgttccttgctaaccacaataagataacccaatctcttcagcagcagcttgaagtgatttcaggttacgaagagctgctggccgatatagtaaacctgtgcgtcgactattacgagaatcgcatgtacctcaccccgagtgaaaaacatatgctgctaaaagtcatggggttcggcttgtatctaatggacgggagtgtctcgaatatctacaagctggacgccaaaaagcggataaacctgtcaaaaatagataagtacttcaagcagctccaggtggttcctttgttcggggacatgcaaattgaactggctcggtacatcaagacttcagctcactacgaggagaataagagtaggtggacctgcacgtccagcggctcctctcctcagtataatatctgtgaacagatgattcagatccgagaggatcacatgaggtttataagcgaactggcccggtattcaaactccgaagtggtcaccggaagcggccggcaggaagctcagaagactgatgccgaataccgcaagctctttgatctcgcattgcagggccttcagctcctgagccagtggtccgcacacgtaatggaggtttacagctggaaactggtgcaccctacagataaatatagtaataaggattgccccgattctgctgaggagtacgagcgcgcaacgagatacaactatacctctgaggagaaattcgcgctggtcgaagtcattgcgatgatcaagggattgcaggttcttatggggaggatggaatcagtatttaatcacgcaatcaggcataccgtgtacgctgctctgcaggatttttcccaggtgacactgagagagcctctgagacaggccatcaaaaagaaaaagaacgtcattcagtctgtgttgcaggccatccgtaagactgtgtgcgactgggagaccgggcacgagccctttaacgaccccgcgttaagaggcgaaaaggatccaaagagtggttttgacattaaagttccaaggcgcgcggtgggaccctcctccacccagttatacatggtaaggactatgttggaaagtctcatcgccgacaagagtggaagtaaaaaaaccctcagaagctccttggagggacctacaattctagacatcgaaaagttccacagagaatccttcttctatacccatctaatcaatttttccgagacgctgcaacagtgctgcgatttatctcaactttggttcagagagttctttctggaactgaccatggggcggaggatccagtttccaatcgagatgtcgatgccttggattctgacggatcatatcttagagacaaaggaagccagtatgatggaatacgtgttatactccctggatctgtacaatgactccgcacactatgcacttacccgatttaacaaacagtttctgtacgacgaaattgaagctgaggtaaacctgtgctttgatcagttcgtgtacaaattggcagaccaaatatttgcgtactacaaggtgatggctgggagccttttactggacaaacgactcagaagcgaatgtaaaaaccagggagcgacaattcatttgcctccctcaaacaggtatgaaactctgctgaagcaacgtcatgtccaactgctaggtaggtctatcgatttaaacagattgattacccagcgtgtgtcagccgcgatgtataagtccttggagctggccattggtcggttcgaatcagaagacctgaccagcatcgtggagctggatggactattggaaattaatcgaatgactcacaaacttcttagccgctatcttaccctggatgggttcgatgccatgttcagagaagctaatcataatgtttcagccccctatgggcggatcaccctgcatgtattttgggagctcaactacgattttctgcctaattactgctacaacggctctaccaataggtttgtgagaaccgtcctccctttttcacaggagttccagagggataagcaaccgaacgcccagccacagtatttgcacgggagcaaagctcttaatctcgcatattcttccatctacggaagctatagaaactttgtggggccgcctcactttcaggtcatttgtaggctgctgggctatcagggaatcgccgtggttatggaggaactcctgaaagtcgtaaaatctctgcttcaaggcactattctgcaatacgtaaagacactgatggaggtcatgcccaagatctgtcggctgcctcgccatgagtatgggtctccaggcatcttggagttcttccatcaccagctcaaggacatcgtggaatatgccgagcttaagacagtctgtttccagaatttacatgccgctccatttcagaatatcttgcctcgggtgcatgtgaaggagggagaacgcctcgatgcaaaaatgaaaaggcttgaatcaaagtacgctcccctgcacctagtgccgttgattgaaagacttgggactccacaacagatcgccattgctcgagagggagacctgctgaccaaagagagactgtgctgtggactgtctatgttcgaagtgatactgaccagaatccgatcctttctggacgatcccatttggcgcggtccgctgccttcgaatggtgtgatgcacgtcgacgaatgcgtcgagtttcatagactgtggtccgccatgcagtttgtctactgtattcccgttggcacacatgaatttactgttgagcagtgctttggtgatggtttgcactgggcagggtgtatgatcattgttctcttgggacagcagcgacgattcgccgtactggacttctgttaccatcttctgaaggttcagaagcacgacggtaaagatgagattattaagaatgtgcccctaaaaaaaatggtggagcgaattaggaagttccagatcctgaacgacgaaattatcaccatcctggataaatacctgaagagtggggatggggaagggacccccgtggaacacgtgcgctgttttcagcctcccatacaccaatctctggcttcttcttag

SEQ ID NO: 113772 - DNA, 2469 bp, Artificial Sequence
  Description of Artificial Sequence: Synthetic coding sequence
atggcggagtcgcttggatcagccgaactgcttcggcaacttaaaagcctcggaatggagcgcctcctccacgccgtgaatacttttttacgtcaaagttgcacttacttaccattattgaccttcgggggtaagacatcatttgtgagcctggacgtgtacgggactgaagctaactgttccgcaacctcttgtagcttccccaaggctgccgccacatggccgcggagacaggcccccggccccctgggggaactagtgcggggccccccggaccagggggtcgctgaacagagtttctcgcatggactgttcgaatttggcatcactaacgttccctgtatatttagtccgccacagatgtttccatggataatccagctctatatggtgaggacgatgctggaatccctcatagcagacaagagcggctcaaagaagactcttagatccagtctcgaaggtcccactatcctcgacatcgagaagttccatcgcgagtcttttttctacactcatttgataaatttcagtgaaactctgcagcagtgttgtgatctgtctcaactttggttccgcgagttctttctcgaactcactatgggacggcgaatccagtttcctattgagatgagcatgccgtggatcctgactgatcacatattggagactaaggaggcaagtatgatggaatacgtgctttattctctcgatctctacaatgatagcgcgcattacgctctaacccgattcaacaagcaattcttgtatgacgagatagaggcagaggtcaatctgtgctttgaccagttcgtgtacaagcttgccgaccagatcttcgcgtattacaaggtcatggctggctctctactccttgacaagcgtctcaggtcagagtgcaaaaatcagggggccacaatccatctccctccatccaataggtacgaaaccctattgaaacagcggcacgtccagctactgggtagatccattgacttgaatagactgattacccaaagggtcagcgcagccatgtataaaagtctggagctagcaatcgggcgtttcgaatccgaagatttaaccagtattgttgagctagacggactgctggagattaatcgcatgacccacaaactgcttagccgctacctgacactggacggattcgacgccatgtttcgcgaggccaaccacaacgtgagtgctccttacggtcgaatcactttgcacgtgttctgggaattgaattacgactttctgccaaactactgctataatggttccactaacaggttcgtgaggactgtgttgccattttcccaggaatttcagagggataagcaaccaaacgctcagccacagtatctgcatggaagtaaggctctgaacctcgcgtactcatctatctacggaagctaccggaactttgtcgggcccccacactttcaggtgatatgccgactgttaggctatcaggggatcgccgtggtcatggaggaactcctaaaagtggtcaagagcctgttacaaggcactatacttcagtatgtcaagaccctcatggaggtcatgcccaagatttgtcggttgccaagacacgagtatgggagtcccggcatcctggaattctttcatcaccagctcaaagacattgttgaatacgccgaactcaagacagtgtgtttccagaatcttagagaggtcgggaatgccatcctattttgtctgcttatagagcagtccctgagcctggaagaagtgtgcgatctgctgcacgccgctcctttccagaacattctccccagagtgcacgtcaaagagggcgaacggctggatgccaaaatgaagagactcgaaagtaagtacgccccactccatctggtgccactgattgaacgtcttggtactcctcaacagattgcaattgcccgggagggagatctactgaccaaggagcgtctctgctgtgggttatccatgtttgaagtgattctgactaggattcgctcctttttggatgacccaatatggcggggacctctgcctagtaatggcgttatgcatgtggatgagtgcgttgagttccatcgactctggagcgcaatgcagttcgtttactgcattcccgtaggaacacacgaatttacagttgagcaatgctttggagatggtctacattgggccggctgtatgatcatcgtcttgctaggtcagcaaagaagattcgctgttttggacttttgttatcacctgctgaaagtgcagaagcacgacggtaaggatgaaatcattaagaacgtgccgctgaagaaaatggtggagcggattcggaagttccaaatcctaaacgatgaaatcatcaccatactggacaagtatctcaaaagcggagacggtgagggcactccagttgaacatgtgcggtgcttccagccccccattcaccagagtctggcctcaagctag

SEQ ID NO: 113773 - DNA, 3762 bp, Artificial Sequence
  Description of Artificial Sequence: Synthetic coding sequence
atggccgcccaggtaactctagaggatgctctgtcaaacgtggatttgcttgaggaattgcccctccctgaccagcagccgtgcatcgagcccccaccttctagcctcctgtatcagcctaacttcaatactaactttgaggatcgcaacgcttttgtaacagggattgcccggtatatcgagcaggctacagtgcacagttctatgaatgaaatgttagaagagggccaggaatacgctgttatgctctacacctggcggtcctgttctagggcaatcccccaggtgaaatgcaacgaacagcctaaccgcgtggagatctatgagaaaaccgtcgaggtgctggaacccgaggtgacgaagctgatgaactttatgtattttcagagaaacgcaattgagagattttgtggagaagttaggaggctgtgtcatgcggagaggcgcaaggatttcgtgtcagaggcctaccttattaccttaggaaagttcataaatatgtttgcggtgctggatgaactgaagaatatgaaatgctccgtaaagaatgaccactccgcgtacaagcgggcggcccagtttctgaggaaaatggccgatcctcagtccattcaggagtcgcagaacttaagcatgttcctggcaaaccacaacaaaataacccagtcactccagcagcagctcgaggtgatcagtgggtatgaggagctcctggccgacatcgtgaacctgtgcgtggactactacgaaaacagaatgtatctgacaccctccgaaaaacatatgcttctgaaggtgatgggctttggcctgtatctgatggatggctcagttagcaacatttataaacttgacgccaaaaaaaggataaacctgagtaagattgataaatactttaaacagctccaggtcgtaccgctgttcggtgatatgcagatcgagcttgcaagatacataaagacatcagcacactacgaggagaacaagagcagatggacttgcacatcctctggcagcagtcctcaatacaatatctgtgagcaaatgattcagataagagaagaccatatgagatttataagcgagctcgccagatatagcaacagtgaagttgtcaccggaagtgggaggcaggaggcccagaaaacggacgcagagtacaggaaattatttgacctggctctgcaagggttgcagctgctgtctcagtggtctgctcacgttatggaggtctatagctggaagcttgtccatccaaccgataaatactcgaacaaagactgcccagatagcgccgaggagtacgagcgcgccacacggtataactacactagcgaggaaaaatttgctctggtggaggtgatagctatgataaaaggactgcaggtcttaatgggccgcatggagagcgtttttaatcacgccatcaggcacacagtctacgccgcattgcaagatttttctcaggtgaccttgcgcgaacctctgcgacaagctattaagaagaagaagaatgtcatacagtcagtgctgcaagcaatcagaaaaactgtctgtgactgggagaccggacatgaaccatttaacgacccggccctacggggcgagaaggatccgaagagcggatttgacattaaagtgccgcgccgcgccgtgggaccttccagcacacagctctacatggttcgcacaatgctggaatcccttattgccgacaagtccggctctaaaaagacccttagaagctcgctcgaaggccccaccattcttgatatcgagaagtttcaccgggaaagtttcttttatacacatctaatcaatttcagcgagactctccagcaatgctgcgacttaagccagctgtggttcagggaattttttctggagctgaccatgggcagacgcatccaatttccaattgagatgtcgatgccctggatccttacagaccatatcctcgaaactaaggaagctagtatgatggagtatgttctttactcactggatctttacaacgactcagctcattatgccctgacccgattcaacaaacagtttttgtatgacgagatagaggccgaggtgaatttatgtttcgatcaatttgtctacaaactagcagaccagatcttcgcttactacaaggtgatggccggatccctgctcctggacaagcgcttaagatccgagtgcaaaaatcagggcgccacaatccatttacccccatcgaaccggtacgaaacgctcctgaagcaacgtcacgtgcagctcttaggtagaagcattgatctcaatagactgatcacacaacgggtgtctgcagcaatgtacaaatctctggaactggctattggaagatttgagagcgaagacctgacgtccatcgttgagttagacggattgctggaaattaaccgcatgacccataagcttttaagtcgctatctaaccctcgacggctttgacgccatgtttagagaggccaaccataacgtgtctgcgccctacgggagaataacactccatgttttttgggagctgaactatgattttctccccaattattgttataatggaagtacgaatagattcgtgaggactgtgttaccattttctcaggagtttcagcgcgacaaacagccgaacgctcagccgcagtatctgcacggctcaaaggccttgaatctggcttacagcagtatctacggctcatataggaactttgtcggcccaccccattttcaggttatctgccgattactaggataccaaggaatcgcggtagtcatggaggagctgctcaaagttgtcaagagtcttctgcaaggaaccatattgcagtacgtgaaaactctgatggaagtcatgccaaaaatttgtagactgcctcgccatgagtacggaagcccaggcatcctagaattctttcaccatcagttgaaagatattgtggaatatgctgaactcaaaacggtctgctttcaaaatctccgggaagtgggaaatgcgatcctattctgcctattgatagaacaatccctctctctggaggaggtgtgtgacctgctacatgctgccccctttcaaaacatccttcctagagtgcacgtcaaggagggcgagagactggacgccaaaatgaagcggttggagtcaaaatacgccccccttcacctcgtgcccctcattgagcgcttgggcactcctcagcagatcgctatcgctcgggaaggagatctactgaccaaagaaaggctttgttgtgggctgtctatgttcgaagtgattctgactcgcatcaggtcatttctggacgaccccatctggcgtggccccctgcctagtaacggtgtcatgcacgtcgacgagtgtgtggagtttcatcgactgtggtctgctatgcagttcgtctactgcatcccggttggtactcatgagttcaccgtggaacagtgcttcggagatggcctgcactgggccggatgcatgattatcgtgcttctgggtcaacaacgtcgattcgccgttctggacttctgctaccacctgctaaaagtccaaaaacacgatgggaaagatgagattattaaaaacgtgcctctcaaaaaaatggtggagagaattcgcaaatttcaaatcctcaacgatgagataatcactatcctcgacaagtatctcaaaagtggcgacggcgaaggaacccctgtggaacatgtacggtgtttccaacctccgatccaccagtcccttgcgagttcatag

SEQ ID NO: 113774 - DNA, 486 bp, Artificial Sequence
  Description of Artificial Sequence: Synthetic coding sequence
atggccgctcaagttactttggaagacgcactgagcaatgtggacctgctggaagagctgcccctaccagatcaacagccttgcattgagcccccgcccagtagcctcctataccagccaaactttaacaccaactttgaagatcggaatgctttcgtcaccggaatcgctaggtatatcgaacaggctacagtgcactcgtctatgaatgaaatgctggaggagggccaggagtacgctgtgatgctctacacgtggagatcttgctcccgggctatcccccaggtgaaatgcaacgagcagcccaatcgcgtggaaatctacgaaaaaaccgttgaggtgctggagcctgaggtcaccaagctgatgaattttatgtatttccagaggaatgcgatagagaggttctgtggggaggtgcgtagactctgtcacgcagagcgccggaaagattttgtaagcgaggcctacctcattaccttgtag

SEQ ID NO: 113775 - DNA, 456 bp, Artificial Sequence
  Description of Artificial Sequence: Synthetic coding sequence
atggccgctcaggtcaccctcgaagacgcattatccaacgtcgatctactggaggagctcccgttgcctgatcagcaaccttgtatcgagcccccaccttcttcactgctgtatcagcccaacttcaatactaactttgaggataggaacgcgttcgttacggggatcgcacgttatatcgagcaggccactgtccacagctcaatgaatgaaatgctggaagaggggcaggaatacgccgtgatgctctatacgtggcgctcctgttctcgagccatcccccaggttaagtgtaacgagcagccaaatcgcgtcgagatctatgagaagaccgtggaggtactggagcctgaggttacaaaactgatgaactttatgtacttccaaaggaacgcaatagaaaggttctgtggcgaggtcagacgattgtgccatgcagagagaagaaaggattag

SEQ ID NO: 113776 - DNA, 3837 bp, Artificial Sequence
  Description of Artificial Sequence: Synthetic coding sequence
atgaccacccacgtcacgctcgaggatgccctctctaacgtggacctgctcgaagaactgcctctgcctgaccagcaaccttgtattgagcctccgccaagttctattatgtatcaggctaatttcgatacgaatttcgaggataggaatgcattcgttaccggaatcgctcggtacatcgagcaggcaacagtgcacagcagcatgaacgagatgctggaagagggccatgagtacgccgtgatgctgtacacttggaggtcttgttcccgcgccatccctagagtgaaatgcaatgaacaaccaaaccgggtggagatatatgagaaaacggtggaggtactggaacccgaagttaccaaactgatgaagttcatgtatttccagagaaaagctattgagagattctgttcagaggtaaagcgcttgtgtcatgctgagaggaggaaagattttgtgtcagaagcgtacctgctgacactcgggaaatttatcaatatgtttgccgtcctggacgaactgaaaaatatgaagtgttctgtgaagaatgatcatagcgcctacaaacgggctgctcaatttcttcgcaagatggctgacccacagagcatccaggagagtcagaacctgagtatgtttttggccaaccacaatcggatcacgcagtgtctgcatcagcagctcgaagtaataccggggtacgaggagctgcttgctgacatcgtaaacatctgtgtggactattatgagaacaagatgtatctgaccccctctgagaagcacatgctgttgaaggtgatgggctttggcttatatctgatggacggcaacgtctcgaacatatataagttggacgccaagaaacgaattaacctatcaaagatcgataagttcttcaagcagttgcaggtggtgccactgtttggcgacatgcaaatcgagcttgcacgctatataaaaactagcgcacactatgaagagaacaaatctaaatggacctgtacccaatctagtatctccccccagtacaatatctgcgagcaaatggtccagatccgagacgatcacatccgctttatttccgaactcgctcgctactcaaacagtgaagtagtgactggcagcggcctggactctcagaagtctgacgaggagtatcgagagctcttcgaccttgctctccgtggccttcagttgctatcaaagtggagcgcccacgtgatggaggtatattcgtggaagttggtccacccaactgacaaattttgcaacaaagactgcccaggcacggctgaagagtacgaaagggctacccggtacaattacacttctgaagagaagtttgccttcgtggaagtgattgctatgatcaagggactgcaggtgcttatggggagaatggaatcagtctttaaccaggccatccgcaataccatttacgcggccctgcaggacttcgctcaagtgaccctgcgcgagcccctcagacaggccgtgcggaaaaagaagaatgtgttgatttccgttcttcaggctataagaaaaaccatttgcgactgggaaggcggccgcgaacctccgaacgacccctgtttgcgcggcgagaaggacccgaaggggggttttgatattaaagtgcccaggcgcgctgtaggcccttcgagtacccaggcctgtcaatggtcgccacgggccttgttccatcccaccggggggactcaggggagaagaggatgccggagcttgctttacatggtgaggacgatgcttgagtcattaatcgccgacaagagtggcagcaaaaagactctgcggtcttcccttgatggaccaattgtcctggcaatcgaagatttccacaagcagtctttcttttttacccacctgcttaatatctccgaggccctgcagcagtgttgtgacttgtctcagctatggtttcgcgagttctttctggagctaacaatgggccgtcgtatacaatttccgatcgagatgtccatgccatggattctcacggaccacattctcgagacaaaggagcccagtatgatggaatacgtgttataccctttggacctgtacaacgattcagcttactacgccttaacaaagttcaagaagcaattcctttacgatgagatcgaggcagaggtgaacctatgttttgatcagtttgtctacaagctggccgatcagatttttgcatactataaggcaatggcaggatccgtgctgctggataagcgcttcagagctgaatgtaaaaattacggggtcatcatcccgtacccaccatctaaccgctacgaaacgctgctaaaacagagacatgtacagttgttgggccgtagtattgatttaaacaggctgataacacaacgaatatcagcagcaatgtacaagtccctggatcaggccatatctcgctttgaatcagaagatctcacgagcatcgttgaacttgagtggctgctagagataaatagattgacccaccgccttctgtgcaagcatatgacacttgattcattcgacgccatgttcagggaagctaaccataatgtgtctgcaccatacggcagaatcactttgcacgtgttttgggaactgaactttgactttctcccaaattactgctataatggttctaccaacagattcgtgcggaccgccattcctttcactcaggaaccccagagagataagccagcaaatgtgcaaccttactatttgtacgggtccaaacctctgaacattgcgtattcacacatctacagttcttatagaaatttcgtgggtcctccccatttcaaaacaatctgccggttgctgggttaccagggcatcgcagtggtgatggaggagctgctgaaaatcgtcaagtccctcctgcaaggcactatcctgcagtatgttaagacactgatcgaggttatgcccaagatttgtcgtcttcccaggcatgagtacgggtctcctgggatcctagaatttttccatcatcagctgaaagacatcatcgagtatgcagagttgaaaaccgatgtgtttcaatcactgagagaagtggggaacgccatcctgttctgtctactcattgagcaagccctcagccaagaggaagtttgtgatctgttacacgccgccccctttcagaacatattgccacgggtgtacatcaaggaaggagagcggcttgaggtgcgcatgaagcgcctggaggccaagtatgcccccctgcacttggttccgttaattgagagactcggcacaccacaacagattgccattgcaagagagggggatcttctcactaaggagcgactttgctgcggtttgagcatgttcgaggtgatcctgacccggattcgcagctatctgcaggaccctatttggcgcggtccccctccaacaaatggtgtcatgcatgtggatgaatgtgtcgaatttcaccggctgtggtctgcaatgcagttcgtctattgcataccggtgggaacgaacgagttcacagcggaacagtgctttggggatggcttgaattgggctggttgctcaatcatcgtacttctcggacagcagcgccgcttcgatctgttcgatttctgctatcacttgctcaaggtccagcgccaagacggaaaggatgagataatcaagaatgtgccactgaaaaaaatggcggacaggattaggaagtaccagatactgaacaacgaggtcttcgctatcctaaacaagtatatgaagtccgtggaaactgactctagtacagtggagcacgtgcggtgtttccaaccgcccatacatcagtctctcgccaccacatgctag

SEQ ID NO: 113777 - DNA, 3762 bp, Artificial Sequence
  Description of Artificial Sequence: Synthetic coding sequence
atgaccacccatgtcacactggaggatgcgctgtcaaatgtcgatctgctggaagagctccccctccccgaccagcagccatgtattgaaccgccgccatcatcaatcatgtaccaggccaattttgacacaaacttcgaggacagaaatgcattcgtgacagggatagcgcgctatattgagcaggccacagtccatagttctatgaacgagatgttagaggagggccacgagtatgcagtgatgctgtacacatggagatcatgttcccgggctatccctaaggtgaagtgtaacgagcagccaaatcgagttgaaatctatgaaaagaccgtggaagtgttggaaccggaggtgaccaagctgatgaagtttatgtactttcagaggaaagctatcgagcggttttgctcagaagttaagagactgtgccacgctgagcgtagaaaggacttcgtgtcggaggcatatctgctcactttgggcaagttcatcaatatgttcgccgtactggacgaactgaaaaacatgaagtgttcagtcaagaatgaccattccgcatacaaaagagccgcacagtttctccgcaagatggcggacccccaaagtattcaggagagccaaaacctttctatgtttctggcgaaccacaacagaattacccagtgcttgcaccagcagcttgaagtgatacccggttacgaggagctcctggcggatatagtcaacatctgcgtcgactactatgaaaataaaatgtacttgaccccttcagaaaagcacatgctgttaaaggtgatgggctttggcctgtatttgatggatggaaatgtctccaacatttacaagcttgacgcaaagaaaaggattaacctgtcgaagatcgacaaatttttcaagcagttacaggtagtgcccttatttggtgacatgcagatcgaactcgctcgctacatcaagacctctgcccattacgaggagaataagagtaagtggacctgtactcagtcttcgatctccccacaatacaacatctgcgagcagatggtgcagattcgtgacgaccatatcaggttcatttccgaactcgccaggtatagcaactccgaagtggtgactggatccgggctggactcccaaaagagcgacgaagaatacagagagctttttgatctagctcttcgcggattgcaactgctcagcaaatggtctgcacatgtgatggaagtatattcctggaagctcgtccatcctactgacaagttctgcaataaagattgccctgggactgccgaggaatatgagcgggccacccgctacaattacacgagcgaggagaagtttgctttcgttgaggtgattgccatgatcaaaggcctgcaggtgctaatgggaagaatggagtcagtattcaaccaagcaattcgtaataccatttacgcggctcttcaggatttcgctcaagtgacgctccgggaacctctgaggcaagctgtgaggaagaagaagaatgtgttgattagtgtgcttcaggctattaggaaaacaatctgcgactgggagggcggcagggagccccctaatgacccttgtctgaggggggaaaaagatccaaagggcgggttcgacatcaaggtcccccggcgtgcggtcggcccaagctctacacagctgtacatggtaaggaccatgctcgagagcctcatcgctgacaagtcaggctctaagaaaaccctgcgcagcagtttggatggacccatcgtgctggccatcgaagattttcataagcagtcatttttttttacacatttgctgaatatttcggaggccctccagcaatgctgtgacctctctcagctgtggttccgggaatttttcttagaattaactatgggccggcggattcaattccccatcgaaatgtccatgccgtggatcctcactgaccatatcttagagaccaaagagccatctatgatggaatacgtgctctatccactggacctgtacaacgatagcgcgtattatgctctaaccaaattcaaaaagcagttcctctatgacgagatcgaagctgaagtaaacttatgttttgatcagtttgtgtacaagctggccgatcagattttcgcctactacaaggccatggcaggtagcgtgctgttagataagaggtttagggcagagtgtaagaattacggagtgattataccataccccccttccaacaggtacgagaccctgttaaagcagaggcacgtgcagctccttggtcgatccatagacctcaaccgactgatcacacagcgtatttccgcagccatgtataaatccctcgaccaagccattagtcgcttcgagtccgaagacctgacatcgatcgtggagctggagtggctgctcgaaatcaaccgcctgactcaccggttgttatgcaagcacatgactctggatagcttcgacgccatgtttcgggaggcaaatcataatgtatccgccccctacggtcgcataacactgcacgtcttttgggagctcaacttcgactttttgccaaattattgttataatggttcaacaaaccggtttgttcgcaccgccataccatttactcaggaaccccaaagagataagcctgccaatgtccagccctattatctttacggctcaaagccccttaatattgcttactctcacatctacagtagctatcggaactttgtcgggccgccccactttaaaactatctgtcgcttgctgggctatcagggaatcgcagtcgtgatggaggagcttctgaagattgtgaaatctctactccagggcaccattctgcagtacgtaaagactcttatcgaggtaatgcctaagatatgtaggctgccaaggcatgagtacgggtccccaggaatcctggaatttttccaccaccagctcaaggacattattgagtacgcggagctaaagactgacgttttccaaagccttcgcgaagtgggaaatgccatcctgttttgccttctgatagaacaggcactttcccaagaggaagtgtgtgatctgttgcacgctgcaccttttcagaacattttgcccagggtgtatattaaagagggggagaggcttgaggtgcggatgaaacggctggaagcaaagtacgctccacttcatttagtaccactgatagaacgccttggaacgcctcagcagattgctatagcacgagagggagacctgttgaccaaagaacgcctttgttgtggcctttctatgtttgaggttatccttactaggatacgctcctatctgcaagaccccatctggaggggaccaccacctacgaacggggtaatgcacgtcgatgagtgtgtggagtttcatagactgtggagcgccatgcagttcgtgtactgcataccggttggaaccaatgagtttaccgctgaacagtgttttggtgatgggctgaactgggctggttgttccatcattgttttgctgggtcaacaacggaggttcgacttgtttgatttttgttatcatttacttaaagtgcagagacaggatggcaaagatgaaatcatcaagaatgtgccactgaagaagatggcagaccggattcggaagtatcagatcctcaataatgaagtcttcgccattcttaacaagtacatgaaatccgttgagactgactcatctactgtcgaacacgtgagatgttttcagcctccaatacaccagtctctggctaccacctgctag

SEQ ID NO: 113778 - DNA, 3762 bp, Artificial Sequence
  Description of Artificial Sequence: Synthetic coding sequence
atgaccacacatgtcactctagaggacgccttgtccaatgttgacttgctagaagagctgccgctccctgatcagcagccctgcattgaaccacccccgtccagtattatgtatcaggcaaattttgacaccaatttcgaggatagaaatgccttcgtaacaggcatcgcgcggtacatagagcaagccactgtacactcctcgatgaacgagatgcttgaggaagggcacgagtatgcagttatgctctacacgtggcgatcctgttccagggctatccccaaggttaagtgtaatgaacaacccaatcgtgttgaaatctatgaaaagacagtcgaggtactcgaaccagaggtgaccaaactgatgaagtttatgtattttcagcggaaggccatcgaaaggttctgcagtgaagtcaagcgcctgtgtcatgcggaacggcggaaggattttgtgagcgaagcctatctgttgacacttggaaagttcattaacatgttcgctgtactggatgaactcaaaaatatgaagtgctcagttaaaaacgaccatagcgcatacaagcgggcggcacagttcctccgcaagatggccgaccctcaatctatccaagagagtcagaatcttagcatgttcttagctaaccacaacaggatcactcagtgtctacatcagcagctggaagtaattccagggtatgaggagctcctggccgatatcgtgaacatttgtgtggactactacgaaaacaaaatgtacctgactccgtcagagaagcatatgctgcttaaggtgatgggctttggcttgtatctgatggatggcaacgtctccaacatctacaagctggatgcaaaaaagcggatcaacctgtcaaagatagataagttcttcaagcagctgcaagtcgttcccttgtttggagacatgcaaatcgaactcgcccggtacataaagacgagcgcacattacgaagaaaacaagagtaagtggacctgcacccaaagcagtatatctccccaatacaacatctgcgaacaaatggtgcagatccgagacgaccacatacgctttatctccgagttggccagatactccaacagcgaggtggtgacgggcagcggtctggactctcaaaagtccgatgaggagtacagagaactttttgacttggccctgagaggcctgcaactgctgagcaagtggagcgctcacgtgatggaggtttactcatggaaactggtgcacccgaccgataaattctgcaacaaagactgtcctggcacagcagaagagtacgagcgggcgacacgatacaattatacctcggaagagaagttcgcttttgtcgaggtgatcgcgatgatcaagggactacaggtcttaatggggcggatggaatctgtatttaaccaggcgattcggaacacaatctatgcggccctgcaagattttgcacaggttaccctgcgggaacctctcaggcaggccgtacgcaagaagaagaatgtactaatctcagtgctgcaggctatccgcaagactatctgcgattgggaaggcggtcgtgaaccaccgaacgatccctgtctgaggggcgaaaaagaccctaaaggggggttcgacattaaggtccctaggagggcggttggacctagctctacacagctgtatatggttaggactatgctggagtctttgatcgcggataagtctggatccaagaagactctccggagctcactcgacggtccaattgtgctggccattgaagattttcacaaacagtccttcttctttacacatttgctgaatatatcagaagccctccagcagtgttgcgatctgagccagctttggttccgcgaattttttttggagctcaccatgggaagacggatacaatttcctattgaaatgagtatgccttggatcctaacggatcacatcctggagacaaaggagccttcaatgatggagtatgtgctctatccactggacctttacaatgattcagcatactacgctctgactaagtttaagaaacagtttctttacgacgagatcgaggcagaagtgaatctgtgcttcgaccaatttgtgtataagctggcagaccagatattcgcctactacaaggcgatggccggaagcgtactacttgataagcgctttcgcgcagagtgcaagaactacggcgtaattattccctaccctccatccaatagatacgagacactgctgaaacagaggcatgtgcagctcctgggccgtagcattgacctcaatcggctgatcacccagcgaataagcgcagctatgtacaagtctctcgaccaggcaattagccgatttgagagcgaggacctcacaagcatcgtagagttggagtggttgctggagataaaccgacttacccacaggctgctctgcaagcacatgacactcgattcattcgatgccatgttcagagaggccaatcacaatgtaagcgcaccttacggaaggataacactccacgtattttgggagctgaattttgactttctgcccaactactgttataatgggagcacaaatagattcgtgcgcaccgccatccccttcacccaggaaccacagcgagataagccagccaacgtacaaccctattacctgtatggtagtaagcctctgaacatagcctattctcacatttatagctcttaccgcaacttcgtgggccctcctcattttaaaaccatttgccgactactgggctaccaaggcattgcggtcgtgatggaggagttgctgaagatcgtgaaatctctgctgcagggcaccattttgcagtacgtgaagaccctgattgaagtgatgcctaagatctgtagactgccaaggcatgagtacggcagccccggaatccttgagttcttccatcatcagctcaaagatatcattgagtacgccgagttgaaaacagacgtattccagtctcttcgagaggtcggcaatgcaattctgttctgcttacttatcgaacaggctctgagccaagaggaggtgtgcgatctcttgcatgccgcccccttccaaaacatcctcccgagagtgtacatcaaagagggtgagcgcctggaggtgaggatgaagaggctggaggccaaatacgctcctttacatttggtaccgctgattgaaagattaggtacaccacagcagatagcaatcgcaagggagggggatctgttgacaaaggagagactgtgctgcggtctgagtatgttcgaggtgatccttacaaggatccgcagctatctccaggaccccatttggcgcggccccccaccaacaaatggagtgatgcacgttgatgagtgcgtggagtttcatcgactgtggagcgctatgcagttcgtgtactgtatccctgttgggacaaacgaatttacagctgagcagtgcttcggagatggacttaactgggccggctgctccatcattgtgctgctgggtcagcagagacggtttgatttgtttgacttctgctatcatctgctgaaagtacagcgccaggatggaaaagatgaaattatcaaaaacgtacctctcaagaagatggctgacaggattcgtaaataccagatcctgaacaatgaggtcttcgcgatactcaacaagtatatgaaaagcgttgagaccgacagcagcaccgtggaacatgtgagatgcttccaaccccctatccaccagagcctcgctacaacttgttag

SEQ ID NO: 113779 - DNA, 2859 bp, Artificial Sequence
  Description of Artificial Sequence: Synthetic coding sequence
gagaaacggcgccgctggacctgcacccagagtagcatttctccccagtacaatatttgcgagcagatggtgcagatccgagacgatcacatccgatttataagcgagcttgcccggtactctaactctgaagtcgtaaccggatccggattggattcacagaagtctgacgaagagtacagagagctcttcgatcttgcgctgcgcgggttgcagctgctgtcaaagtggtcagctcatgtgatggaagtgtactcctggaagcttgtacacccaactgataaattttgtaacaaggactgtcccggtacggccgaggagtacgagagggccactcgctacaattatacttccgaggaaaaattcgcatttgtggaggtaatcgctatgattaagggccttcaggtactcatgggaaggatggagagcgtgttcaaccaggctatccggaataccatctacgccgcgcttcaggatttcgcccaagtcactctgcgagaaccgttaaggcaagcagtccggaaaaaaaagaatgtccttattagtgtgctgcaggcaataagaaagaccatttgcgattgggagggcggacgagagcctccaaatgatccatgcctgcgcggggaaaaggatccaaagggcggatttgatatcaaggtgccaaggcgtgccgtagggccatcttccacacaggcctgccaatggagtccacgcgctctgtttcaccctacggggggaacacagggccgcaggggctgccgaagccttctgtacatggtaaggacaatgctggagtcactcattgccgataagtctgggagtaagaagacgctgaggagctcactggatggacccatagttctggccattgaagactttcacaagcagagtttctttttcacccatctacttaatatcagtgaggccctccaacagtgttgtgacttgtcccagctgtggtttcgggagttctttttagagctcacgatgggccgacggatccagtttcccattgagatgagcatgccctggatactcaccgaccacatactcgagactaaagaaccatcaatgatggagtatgtcttatacccactcgacctatacaacgactcggcctattatgcactcacaaagttcaagaaacagtttctttacgatgaaatcgaggccgaagtgaacctgtgttttgatcagtttgtgtataagctcgcagaccaaatctttgcctattataaagctatggccggtagtgtgttgctggataagcgatttagagctgagtgtaagaattatggcgtcattattccgtaccccccttccaatcggtacgagacactcctcaagcagagacacgtgcagctgttgggcaggtccattgatcttaatcgcttaatcactcagcgtattagcgcagccatgtataagagtctcgaccaagctatatccagattcgagagcgaggatctgacatcgattgttgaactggagtggttgctggagatcaaccgcttgacgcacaggttgctgtgcaagcacatgacgcttgactcttttgacgccatgttccgggaagccaatcacaacgttagcgctccctacgggagaatcactctccacgtgttctgggagcttaactttgattttctccccaattattgctataatggaagcacgaacagattcgtacggactgccataccattcactcaagaaccgcagagggataaacctgcaaacgtgcagccctactatttgtatgggagtaagcctcttaacatcgcctactctcatatttactcaagctaccggaactttgttgggccaccgcatttcaagactatctgcaggctgctgggctaccagggaatcgccgtagtgatggaggagctcctcaaaatcgtcaagtcactcctgcagggcacaatcttgcagtatgtcaagacacttatcgaggttatgcctaaaatatgccggttacctcgccatgagtacggatcacccggaatcctggaattcttccatcaccagctgaaggacattattgaatatgctgaactaaagaccgatgtgttccaaagcttgcgggaggtcggaaatgcaatcttgttttgcttattaatcgagcaggctctatctcaagaggaagtgtgcgacttgctccacgcagctccattccaaaatattctgccacgcgtgtatattaaggagggtgagagactggaggtgcggatgaagagactcgaagccaagtacgctcccctccatctggtgccgctgattgagagactcggcactccacagcagattgctattgccagggaaggggacctgttgaccaaggaaagactgtgctgtggcctgtccatgtttgaggtaatccttacgcgcatacgctcctatctccaggaccccatatggagaggacctccacctacaaacggggtcatgcacgtagatgagtgtgtcgagttccacaggctgtggtctgccatgcagtttgtgtactgtattcctgtggggacaaacgaatttacagccgagcagtgcttcggggatggcctcaactgggccggatgctccatcatcgtccttctggggcaacaacgtagattcgatctgtttgatttttgctaccatcttctgaaggttcaacgccaggacggaaaagatgagattataaagaatgtgcccctcaaaaagatggcagacaggatacgaaagtatcagattctgaataacgaggtcttcgcaatcttgaacaaatacatgaagtctgttgaaacagactcttctaccgttgagcacgtacggtgcttccagcccccgatccaccaatctctcgctacgacttgctag

SEQ ID NO: 113780 - DNA, 651 bp, Artificial Sequence
  Description of Artificial Sequence: Synthetic coding sequence
atggcaggtagtgtcctcctggataagcgatttcgggccgagtgcaagaactacggagtgattattccctatccaccatctaacaggtacgaaaccctgctcaagcagagacatgtgcagctgcttggcaggtcaattgatctcaacaggctgatcacccagcggattagtgccgccatgtacaagtctcttgaccaggccattagccgatttgaatcagaagacctgacatccatagtcgagctcgaatggttactcgagatcaaccgattgacccataggctgttgtgcaaacacatgacgctcgactcctttgatgccatgttccgggaagctaatcacaatgtgtctgcgccgtacggccgcatcaccctacacgtattttgggaattgaactttgactttctgccaaactattgttacaacggatctaccaaccgctttgtaagaaccgcttctttccatccccgcacaacaactcgacagacatgtcagaggcctgcactgctccctctgtggatccaggccagccagcattgcctacagccccatctacagctgctccaagaattcaggggcgctacaagtttccaggactatgcagacagctgggtgatccgtgcgagtctctggagttggcgaaattgctag

SEQ ID NO: 113781 - DNA, 3537 bp, Artificial Sequence
  Description of Artificial Sequence: Synthetic coding sequence
atgaccacccacgtgaccctggaagatgcgctaagcaacgttgatctgctggaggagctaccattgccgaacgagcagcctaaccgagtggaaatttacgagaaaacagtagaagtgctcgaacccgaggtgaccaagcttatgaaatttatgtattttcaacgaaaagcgattgaaaggttctgtagcgaagttaagcgtttatgtcacgcggaacggagaaaggatttcgtgagcgaggcatatctgctgacgctaggcaaattcataaatatgttcgcggttctggacgagctgaagaatatgaagtgttcagttaaaaatgatcactccgcatataagcgcgccgcccaatttctgcgcaagatggccgatccgcagagcattcaagagtctcaaaacttgagcatgtttctggcaaaccacaatcgcattacgcagtgcctccatcagcagctagaagtcatcccagggtacgaggagctgcttgcagacatcgttaacatttgcgtggactattacgaaaacaaaatgtacctgaccccctccgaaaaacatatgttgctgaaggttatgggctttggtctgtatttaatggacgggaacgtgtcaaatatttacaagctggatgctaaaaaacggattaaccttagcaaaatcgataagttttttaagcagctgcaggtcgtgccactctttggcgacatgcagatcgagttagctcggtatattaaaacgtctgcacattacgaggagaataagagcaagtggacgtgcacacagtcatccatttcaccgcaatataacatatgcgaacaaatggtccagatccgcgacgatcacattaggtttatctcagagctcgccagatattcgaactcagaggtggtgacaggatccggacttgatagtcagaaatcggacgaagagtaccgtgaactgttcgatctcgcccttagaggattgcagctgttgagcaagtggtcagcccatgtgatggaggtctactcctggaaactagttcaccccacagacaagttctgtaataaggactgcccaggaactgctgaagagtacgagagagctacacgctacaactacacatccgaagagaagtttgcttttgtagaggttattgccatgatcaaggggctccaggtgctcatgggtaggatggaatcggtgtttaaccaagcgatacgcaatacgatttatgccgccctgcaagatttcgcccaagttacactccgcgaaccgttgaggcaggccgtccggaaaaaaaaaaacgtgctgatctccgtgctccaagccattcggaaaacaatttgtgattgggagggtggtagagaacctccaaacgacccctgtctcagaggagagaaggacccaaaaggaggattcgacataaaggttccccgccgggctgtgggccccagctctacccagctgtatatggttagaactatgctggagtcccttatcgcagacaaatcggggtccaagaaaactctccgcagtagtctggatggacccatagtcctcgcaattgaggactttcacaaacagtcattcttcttcacccatctgctcaatatcagcgaagctctgcagcagtgctgtgacctcagccagttgtggtttcgcgaattcttcctcgaactgaccatgggacgcagaatacaatttcccatagagatgagtatgccatggatcctgactgaccacattctggaaactaaagaaccctcaatgatggagtacgtcttatacccacttgacctttacaacgatagtgcatattacgcactgacaaaattcaaaaaacaatttctgtacgatgagattgaggcggaggtaaacctgtgttttgaccagttcgtatataagctggctgaccagattttcgcatactacaaagcaatggcagggagtgtgctgctggacaagagatttagagccgaatgcaaaaactatggagtgattattccgtatccaccaagtaatcggtacgagacccttctcaagcagaggcacgtgcagctgctggggcggtcgatcgacctgaatcggcttatcacgcagcgcatctccgctgcaatgtataaatcgctcgatcaagctatcagcagattcgaaagcgaagacttgacaagtatagtcgaactggaatggctgctggaaatcaaccgcttgacccacaggctgttgtgtaagcacatgacccttgacagttttgatgccatgttccgagaagctaatcacaacgtttccgctccctatggcagaattaccctacacgtcttttgggaactaaacttcgactttctccctaactactgttacaatggtagcactaatagatttgtgcggaccgctatccctttcacccaggaaccccagagagacaaacccgcaaatgtgcagccatactatctgtatggctccaagcccttgaacattgcttattctcatatctacagctcatatcgcaacttcgtcgggcccccccactttaagacaatctgtcgcctcttgggctaccagggtattgccgtggtcatggaggaattacttaagattgtaaaatcactgctgcaggggactatacttcaatatgtgaaaacactgatcgaagtgatgcctaagatttgtcgtcttccaagacacgaatatgggagcccagggattcttgaatttttccatcatcagttgaaagacattattgagtatgctgaactgaagacagatgtgtttcagtctttaagagaagtgggcaacgcaatccttttttgcctcctgatcgaacaagctctctcccaggaggaagtttgtgatcttctgcatgcagcccccttccagaacattcttccaagagtgtacattaaggaaggagagagattggaggtgcgcatgaagagactggaagccaaatatgcccctctccatctggtccctctgatcgaacgcctcggcaccccacagcagatcgccattgcacgggagggagatctgctgactaaagagcggctgtgctgcggcctgtccatgttcgaggtgattctcacccgcatacggtcctaccttcaggatccaatctggaggggtccgcctcctacgaacggcgtgatgcatgtggacgagtgcgtggaattccatcgcctgtggtcagccatgcaattcgtctactgcatccctgtggggacaaacgagttcactgccgaacagtgctttggggatggtctgaactgggctggctgctcaatcatagttctgctaggacaacagcggcgctttgacctgtttgacttctgctaccaccttctgaaggttcagcgccaggacgggaaggatgaaattataaagaatgtgcccttgaaaaagatggccgatcgcatcagaaagtaccagattcttaacaatgaggtgtttgccattttaaacaagtacatgaagtctgtcgagaccgattcctctacagttgaacacgtgaggtgcttccagccacctattcaccagtcactggcgacaacatgctag

SEQ ID NO: 113782 - DNA, 4617 bp, Artificial Sequence
  Description of Artificial Sequence: Synthetic coding sequence
atggaaccccgcatggaaagttgcctggcccaggttctgcaaaaagacgtgggcaaaaggctccaggtaggccaggaactaatagattacttctccgataagcagaaatccgcagaccttgagcacgaccagactatgctcgacaagcttgttgatggcttagctacgtcatgggtcaacagctcgaattacaaagtggtgctgttgggtatggacatcctgagtgcactggtgaccaggctccaggacaggttcaaggcccagatcgggacagtgctgccctcactgatcgacaggctgggggatgcaaaggattccgtcagggagcaagaccagacgcttttacttaaaataatggatcaagctgccaacccgcagtatgtatgggatagaatgctggggggatttaagcataagaattttaggactcgggaaggcatctgtctttgtctgatagcaaccctgaatgccagcggcgcacagaccctaactctctctaagattgtccctcatatatgcaatctgctcggagatcccaatagccaggtccgcgatgccgccatcaacagtctggtggagatctatagacacgtgggagaacgtgttcgggctgacctgtcaaaaaagggactcccccagtcgcgtctgaacgtgatattcacaaagtttgatgaggttcagaagtccggaaacatgattcagagtgctaacgacaagaatttcgatgatgaggattcagtggatgggaataggccgagcagcgcatcatccacctctagtaaagccccaccttcttctcgcaggaacgtgggcatgggtacaactcgacggctcggcagctccaccctggggagcaagagtagcgccgccaaggagggcgcaggagcggtggacgaggaagactttataaaggccttcgacgacgtccccgtagtacaaatttatagctcacgagacttggaagaaagtattaacaagattcgggaaatcctaagcgacgataaacacgattgggagcagcgagtaaatgcactcaagaaaattaggtcccttctgctggcgggagccgccgaatatgacaatttcttccagcacctcaggctcctcgacggagccttcaaactcagcgctaaggatttgaggtcccaggtcgtccgggaggcctgcattacactgggccacctgtcctcagtgctcggaaacaaatttgatcacggcgccgaagcgattatgccaacaatatttaacttgatccccaatagcgctaaaataatggccacatccggggtggtggccgtacgcctgattattcgtcatacacatataccaaggctgattcctgtcatcactagcaattgcacgtcaaagtctgtcgcagtgagacgccgatgctttgagttcctcgacctgctgcttcaggagtggcagacacacagcttagagcgccatatcagtgtcctggcggaaaccatcaagaagggtattcacgacgcagattctgaagcaagaatcgaggccagaaagtgctactggggttttcacagccatttttctagagaagccgagcacttgtaccacacgttggaatcttcgtaccaaaaggcattacaaagccatttaaaaaattcagattccatcgtgtcattgccgcaatctgacaggtctagctctagcagtcaggaatctttaaacaggcccctctctgcaaaacggtcacccacaggatcaacgacttcacgggcttccaccgtgagtacgaaatcagtctctacaacggggagtctgcagaggagcaggtccgatatagatgtgaacgctgccgctagtgccaaatccaaggtatcttcaagctcaggaacaacccccttctcttctgcggcagctctgcctcccggctcttatgcttctctcggacgcatcagaaccaggagacagtctagcggctcagccactaacgtggccagtactccggacaatcgtggacggtctcgcgcaaaagtggtgtcgcagagtcagcgaagtagaagtgccaatcccgcaggagccggttccagaagttcctcaccggggaagctgctcggttcagggtatggggggctgacaggcgggtccagccggggtcctccagtgacaccttcctctgagaaacggtccaaaattccccggtcacaaggatgtagccgggagacatccccaaaccggatcggtctggcaagaagctccaggatcccaaggcccagcatgagccagggttgttcaagggacacgtcgcgcgagtccagcagggatacaagccctgcccgtggattcccccccctggatagattcggtcttgggcaacccggtcggatccccggaagcgtgaacgccatgcgcgtgctttccacctctactgacctggaggcggctgtggcagatgcattgaaaaagccagtcaggcggagatacgagccatacgggatgtattctgatgacgacgccaatagtgatgcctcctcagtgtgctcggagcgcagctacggatcacggaatgggggtattccacactacctacggcagactgaggatgtcgctgaggttctaaatcactgtgctagttcgaactggtcggaacgtaaagaagggcttcttggcctgcagaacctgctgaaatctcagagaacactttcaagggtcgagttaaagcgactttgcgagatttttactcgcatgttcgcagacccacactctaagagggtctttagtatgtttctcgaaacccttgtcgacttcattattatacataaggatgaccttcaggattggttgttcgttcttctcacccagctcctaaagaaaatgggggctgatctgcttggcagcgtgcaggcgaaggttcagaaggcattagacgtcacccgtgactcattcccgttcgaccagcagtttaacatattgatgcgcttcatcgtagaccagactcagacgcctaacctgaaggtgaaagtggccatcctcaagtacatcgaatcacttgctagacagatggatcccacagattttgtcaattccagcgagaccagactggccgtctccaggattatcacgtggacaacggaacctaagagttctgacgtccggaaggcggcccagattgtgctcatttccctgttcgaattaaacacaccagaattcacaatgctgcttggggcattgcctaaaacctttcaggatggcgctactaagttgttacacaatcacctgaagaatagtagtaatacatcagtgggatcgccatcaaatacaatcggaaggacaccatctagacatacttcaagccgcacatcccctcttacttccccaactaattgtagtcacggtgggcttagcccatccagactctggggttggtcggcggacggtctcgccaagcatcccccgcccttctcccagcccaacagcatccctactgcaccatcccacaaagccttgcgacgctcctatagccctagtatgctagattacgatacagagaacctcaatagtgaggaaatatacagcagtctgcgtggcgtaactgaggctatcgagaaattcagttttcgcagtcaggaagatctgaatgaacctattaagcgggacggcaaaaaagagtgcgatattgtttctagggacggtggcgctgcctcccctgcgacagaaggccgcggagggtcagaggtcgaggggggaagaacggctctggacaacaaaacctcactgttaaacacacaacccccccgggcttttcctggacctagagcacgggactacaatccctacccatacagcgacgccattaatacgtacgacaaaaccgcccttaaagaagctgtctttgatgacgatatggagcagctccgggatgtgcccattgaccactccgacttggtggcagacttgcttaaggagctgtctaaccataacgaaagagtagaagagcggaagggggccctgttggaactgctgaaaattactcgcgaagatagtctcggcgtgtgggaggagcacttcaaaaccatcctcctcctactgctggaaacacttggcgataaggatcactccattagagctctggcactgcgagtgctgcgcgagatccttcgcaatcagcctgcccggtttaagaactatgcggaacttaccattatgaagactttagaggcgcataaagatagccacaaagaggtggtgcgggctgccgaagaagctgccagcaccctggcaagttccattcaccccgaacagtgtatcaaggtgctgtgtcccataatccagaccgcagactaccccatcaatctcgccgctatcaagatgcagacaaaagttgtcgagaggatcgccaaagaatcccttttgcagctcctggtcgacattatccctggccttctccagggttatgataacaccgagtcctccgtgagaaaagcttctgttttttgtctggtcgctatttactctgtcatcggtgaggatctgaaaccacacctggcacaattaaccggctccaagatgaagctgctgaacctctacataaaacgagcgcagaccacaaactcaaatagcagttcttcctcggacgtctccacacacagttag

SEQ ID NO: 113783 - DNA, 4437 bp, Artificial Sequence
  Description of Artificial Sequence: Synthetic coding sequence
atggaaccgcggatggaaagctgtctcgcacaagttctccagaaggatgtgggcaagaggcttcaggttggacaggaactaatcgattatttctccgacaagcaaaagtcagccgatctggaacatgatcaaaccatgctggataaattggtggacggtctggctacctcttgggttaactcatcaaactacaaagtggtactgctgggtatggatatcctctcagccttggtcacccgtttacaggatcgatttaaagcccaaattggcacagtgcttcccagccttattgacagactgggggacgctaaagacagtgtacgtgagcaagatcagactctgctactcaaaattatggaccaggccgctaacccgcagtatgtatgggaccgtatgctcggcggattcaaacacaagaactttaggaccagagagggaatttgcttgtgcctaatagcgacactgaacgcctccggtgctcagacactcacgctgtcaaagatcgtgcctcatatatgtaatctcttgggcgatcccaactcccaggtgcgggacgcagccatcaactctctcgtcgagatctaccgacacgtgggcgaacgggtgagagccgacctgtctaaaaaaggattgcctcaatcccggcttaatgtcatcttcactaaattcgacgaggtgcaaaaatccgggaatatgatccagtcagccaatgataagaatttcgacgatgaggacagtgtggacggcaatcggccctcatcagcaagttctactagtagtaaagcgcctccttcatctcgccgtaacgttggcatgggaaccacaaggaggctgggttcatccactttaggaagcaagagttctgcagcaaaggaaggcgcgggtgccgtggacgaggaagacttcataaaggcatttgacgatgttcccgtggttcaaatatatagtagtcgggatctggaagagtctattaataagattcgcgaaatcttgagtgatgataagcatgactgggaacagcgggttaacgcacttaagaagatccggagcctgcttcttgcaggagccgccgagtatgacaatttcttccaacatttacggctactggacggcgccttcaagctgagtgcgaaagacctaagatcgcaggtcgtgcgagaagcttgtattacactgggccatttatcttctgtcctggggaataagtttgaccacggggccgaggcgattatgcccacaatctttaatctaattcctaactctgccaagattatggctacgagtggtgtggtggctgttcgtcttatcatccgccatacccatattccgaggctcatcccagtgattacaagcaattgcaccagcaaaagtgtggcagtgaggagaaggtgctttgagtttcttgacctcctgcttcaagagtggcagacacactctctggaaagacatatttcagtgctggcagaaacgatcaagaaaggcatccacgatgccgacagtgaagccaggattgaggcccggaagtgctactgggggtttcattcacacttttccagagaggcagagcatctctatcacaccctggaaagttcctatcagaaggctctccaatcacacctaaagaactctgattccattgtgagcctcccgcagagcgatagatcatctagcagtagtcaagagagccttaatcggcctttgtccgccaaaagaagtccaaccgggtctactactagccgggcaagtacagtatctacgaagtcagtgtctactactgggagcttgcagaggagtcgctctgatattgacgtcaacgccgccgccagcgcaaagagcaaagtttctagtagctcaggaacgaccccattctcttcagcggccgcactccccccgggttcttacgctagtctggacggcacgactaccaaagctgaaggcaggatcagaacaaggcgtcaatcgtccggttctgcaaccaacgtggcgtccaccccagacaatcgggggagatctagagccaaggtggtgagtcagtcccagaggagccgctcggcaaatccggcaggcgctggctctaggtcttccagcccaggtaaactgctggggagcgggtacggcggcctgaccggcggaagtagccgggggcccccagtcacaccctccagtgaaaagaggtccaaaattcccaggagccaaggctgcagcagagagaccagccccaatcgaattggcttagatcggttcggcttgggccaacccggaagaattccagggagcgttaacgctatgcgcgtgctgtctacgtcaacagacttggaagccgcggtggccgacgcgcttttactgggagatagccggagtaagaagaaaccagtgcgtaggaggtacgagccctatggcatgtactcagacgatgatgccaatagtgatgcctctagcgtttgttctgaaaggagttacggttcccggaacggggggattccgcactacttgcgacagaccgaggatgtggcggaggtgctaaatcactgcgcatcttctaactggagcgagcgcaaggagggacttttgggtctgcagaacctcctcaagtcacaacggacgctctccagggtggaactaaaacgtctctgcgagatatttactagaatgtttgccgatcctcacagcaaggtcttttctatgtttctggagacactggtcgattttataatcattcataaggatgacctgcaagattggctctttgtgctgctgacccagttgctcaagaaaatgggagcagatctcctcgggagtgtgcaggccaaggtgcaaaaggccttggacgttactagggactcatttcccttcgatcagcagtttaatatactaatgagatttatcgtcgatcagacacagacacccaatctcaaagtgaaggtcgccattctgaaatatattgaatctcttgcccgtcaaatggaccccacagacttcgtgaactcctccgaaacccggctggctgtgagcaggatcatcacctggaccactgaaccaaaatcctctgatgtgaggaaagccgcccagattgtgctgatctctctgttcgagttgaacacacctgaattcaccatgctgctgggcgccctgccaaaaaccttccaggacggcgcgacgaaactgttgcacaaccacctgaaaaattcaagcaatacttcagtgggttccccctccaacactattggcagaacacctagccgacacacatcttcaaggacctccccattgacatcccctacgaattgttcccatggaggcctctcaccgtcaatgttagactacgacacagaaaatctgaactcagaggaaatttactcctctctgaggggggtgaccgaggccatcgagaagtttagctttcgctctcaggaggatctcaatgagcctattaaaagagatggcaagaaggaatgcgatatcgtttcccgggacggcggagcggctagccctgcaaccgagggtaggggcggaagcgaggtggagggtggccggacagccctggacaacaaaacaagcttactgaacactcagccacctagggcattccccggaccaagggctcgcgattacaacccttatccctattccgacgccatcaacacgtacgacaagaccgcacttaaggaagctgtgttcgatgatgacatggaacaactgcgtgatgttccaattgaccacagcgatctggttgctgacctgcttaaagaacttagcaatcataacgagagggtggaggagcgtaagggggccctccttgaactgcttaagattacaagggaggacagcttaggagtctgggaagagcacttcaagaccattcttttgctgctactcgaaaccttgggtgataaggatcactcaattcgtgctctcgccctccgggtgctccgtgagattttgaggaaccagcccgcccgcttcaaaaattacgccgagctcacaatcatgaaaacgctcgaagctcacaaggactcacacaaagaggtggttagggccgccgaggaagcagccagcacgctggcctcatctatccatccggaacagtgcataaaggtcctctgtccgatcatccagaccgcagattatcctattaacctcgccgccataaagatgcaaactaaagtcgtggaaagaattgccaaggaaagtctcctccaactgctggttgacattatcccgggcttacttcagggctacgataatactgaatcaagtgtgcggaaggcttccgttttctgtcttgtggccatctatagcgtcatcggggaggacctgaaacctcacctcgcacagctgaccggttccaaaatgaagctcttgaatctatacattaagagggcgcagaccaccaactccaacagctcctcctcgtccgacgtgtccacccattcatag

SEQ ID NO: 113784 - DNA, 4416 bp, Artificial Sequence
  Description of Artificial Sequence: Synthetic coding sequence
atggagccccgaatggaatcttgtctcgcccaagttctccagaaagatgtgggaaaaagactgcaagttggccaggaactgatcgactatttttcagataaacaaaaaagcgctgatcttgagcacgatcagacaatgctggataaactcgtcgatgggctggctacatcctgggtcaactccagcaattacaaggtagtgttgttgggcatggatattttgagtgctttggtgacacggcttcaggaccggtttaaagctcagatcgggacagtgctgcccagtctgattgaccgccttggcgacgccaaggatagcgttagggagcaggatcaaactctacttttgaagattatggaccaggccgccaaccctcagtatgtgtgggaccggatgctaggcggatttaaacacaagaactttaggacccgggaggggatttgtctgtgcctgattgccacgctgaacgcatccggggcgcaaacactaacactctccaaaatcgtgccgcatatttgcaacttacttggggatccgaatagtcaggtgcgcgacgctgctataaattccctggtggaaatttatcgccacgttggagagcgtgtgagggccgatctatctaagaagggactcccccagagccgactgaacgtcatttttaccaagtttgacgaggtccagaaaagtggtaacatgatacagtcagccaacgataagaactttgacgatgaggacagcgtagatggaaaccggcccagctccgccagcagcacttccagcaaagccccccccagctccagacgcaacgtgggaatggggactactagacgcttgggatcctcaacactggggtccaagtcatctgcagctaaggaaggcgctggcgccgtggatgaggaagactttataaaggcttttgatgacgtgcctgttgtgcagatttacagctctcgcgacctggaagagtctataaataagattcgggagatcctttccgatgacaaacatgactgggaacagagagtgaacgccttgaagaaaatccgcagcctcttgctggctggggcagctgagtatgataatttctttcaacatctcagactcctggacggggcattcaaactgtcagctaaggacctaaggagtcaggtggtgcgggaagcctgtattacattagggcatctatcttcagtgctgggaaataagtttgaccacggcgccgaggcaatcatgcctaccatttttaatctgatcccaaactctgcaaaaattatggcaacctctggtgttgtggccgtgcggctgattattcgccacacgcacatccccaggttgatccccgtgatcacatccaattgcacaagtaaatccgtcgcagtcagaaggcggtgcttcgaattcctggatctgctcttgcaggagtggcagacccactcactggagcgccatatatcagtgcttgccgagactattaagaagggaattcacgatgccgactccgaggctcggatagaagctcgcaaatgttattgggggttccacagccatttctctagagaagcagagcacttatatcacaccttggaaagcagctatcagaaggccttgcagtcccacctgaagaatagcgactctatagtgtctctgccccagtctgatcggtcttcctcttcctcccaagaaagcctaaatcgcccgctctccgccaagagaagtcctacaggtagtacaactagcagagcatcgactgtgtcaactaaatcagtctcgacaacagggagcctgcagagaagccgatccgatatcgacgtgaatgccgctgcaagcgccaaatccaaagtaagtagttcctctggaactacgcccttctcctcagccgctgcactgccacctggctcatatgcgtccctgggcagaatccggacacggagacaatcaagcggatctgccacaaacgtggcatccaccccggacaatagaggcaggagtagggccaaagtggtaagccagagccagcgcagcagatcggcgaatccagccggggccgggagtagatccagctcccccggcaagctgctgggcagtggctacggcggactcactggcggcagctcacgggggcccccggtcacccccagctcggagaagcggagtaaaattccaagaagccaaggatgtagcagggaaactagcccgaaccgtattgggctcgataggttcgggctaggtcagcccgggagaattccaggctccgtgaacgccatgagggtcttatccaccagtacggacttggaggctgctgtggcggatgccctccttctgggtgactcaagatccaagaagaagcccgttcgaagaaggtatgaaccctatgggatgtactcagatgatgatgctaactctgatgcaagctccgtgtgctcagaaagatcctatgggtctcggaatgggggcatcccccactatctgcgccagaccgaagatgtagcagaggttctgaatcactgtgcgagctcaaactggtcagaaagaaaggagggactgctgggcctgcagaatctgctcaagagccagcgcacgttgtctcgagtggagctgaagagactttgtgagatctttaccaggatgttcgcagacccacattctaagctagtgttttctatgttccttgagacgctcgtggattttattatcatccacaaggacgatctgcaggactggctctttgtgttgctgacccagctgctgaaaaagatgggtgccgatctccttgggagtgtgcaggccaaggtgcagaaggccttggatgttaccagagactccttcccctttgaccaacagtttaatattctgatgaggttcattgtggatcagacccagactcctaacctcaaagtgaaagtggccattttgaaatatattgagagtctggctcgccagatggaccctacggattttgtaaatagttctgaaacgaggctagcagtgagtcgcataatcacctggacaaccgagccaaaatccagtgacgtgcgtaaggccgctcagatcgttcttatatccctgttcgagctgaataccccggagtttacaatgcttctgggcgcgttgcccaagacctttcaagatggagctactaagctgctccataatcatcttaagaacagctccaatacctccgtagggtcccctagcaatacgataggccgtaccccatcgcgccatacttctagccgaaccagtccccttaccagccccaccaactgctcacacgggggtctttcaccttctatgttagactatgatactgagaatcttaacagcgaggagatatacagctcgctgagaggggtcacagaagccatcgaaaaattctcctttagatcccaggaggacctcaatgagcccataaagagggatggcaagaaagagtgcgatatagtctcgcgcgacggaggagctgcaagccctgccacggaggggaggggcgggtcagaagtggagggcggcagaactgctctcgataacaagacctctctcttgaacacccagccccctcgcgcatttcctgggccacgagcccgggactacaacccctacccctacagcgacgcgatcaacacatacgacaagactgccctcaaagaagctgtctttgacgacgacatggagcaacttagggacgtgccaatcgaccactccgacctggtggccgaccttctgaaggaactcagtaatcataatgaaagagtggaggagcgtaagggtgcactgttggagttgcttaaaattacacgagaggactcattgggtgtctgggaagaacatttcaagacaatactattactgctcctcgagaccctaggagataaggaccactccattagggccctcgcccttagggtgctgagagaaatcctaagaaatcagcccgccagattcaagaattatgctgaacttaccattatgaaaacccttgaagcccacaaggattcccataaagaggtcgtaagagcggctgaggaggctgcttccacattggcctcatctattcacccagagcagtgcattaaagttctgtgtccgataatacagacagccgattaccccattaacctggctgctataaaaatgcaaacgaaggtggttgaacgaattgcaaaggagagcctgttgcagctgctcgtagatatcattccaggcctgttgcaggggtatgacaataccgagtccagcgtcaggaaagcctcagtcttctgcctcgtagctatttattctgtcatcggcgaagacctgaagccgcatctggcccagctcaccggaagcaagatgaagctcctgaatctctacatcaagagggcccagacaaccaatagcaactccagcagctcaagcgatgtctcgactcacagctag

SEQ ID NO: 113785 - DNA, 2115 bp, Artificial Sequence
  Description of Artificial Sequence: Synthetic coding sequence
taaacgaagttcgacgaagtccagaaatctggtaacatgattcaaagcgctaacgataaaaactttgacgacgaagatagcgtcgacggtaataggccttcatccgcaagttcaaccagttccaaggctcccccctctagccggaggaacgtggggatgggaacaacacgcagattgggttcatccactctcgggtctaagtcatctgccgccaaagagggcgccggagccgtggatgaagaggactttatcaaggcattcgacgatgttcctgtggtgcagatttattctagcagagacctggaagagagcattaataaaatccgcgagatcctcagtgacgataaacatgactgggagcagagggtaaatgcactgaaaaaaatcagatcccttctgctagccggcgccgccgagtacgataacttttttcagcatttaaggctcctggacggtgcattcaaactgagcgccaaggatctgcgatctcaagtggttcgcgaagcctgtatcactctgggtcatctctccagcgttctcgggaataaattcgaccacggggctgaggcaattatgcctaccatctttaatctgatcccgaactccgccaaaattatggcaacctcaggcgtggtggctgtgcggttgatcattaggcacacacacatcccgcgactgattcccgtgatcacatccaactgcacatccaagtctgtggccgtgcgccgtaggtgttttgaattcttggaccttctgctgcaggaatggcagacacacagcctggaaaggcacatatccgtgctggcggaaaccataaaaaagggcatccacgatgctgacagcgaagctagaatcgaagcacgaaaatgttactgggggtttcactcccatttctccagagaggccgagcatctataccacacgttagaatcatcctatcagaaagctttgcagtctcatttaaaaaactctgacagcatcgttagccttccacaaagcgacaggagctcaagttcttcccaagagtcgttgaacaggccactatctgccaagcggtctcccactggatcgacgacttcccgtgccagtactgtgtctaccaaatcagtctcgaccaccggcagcctgcagcgcagtcgtagtgacatcgacgtaaatgccgccgcgtccgctaagtcgaaagtctccagctcttccgggaccacaccgttcagtagcgccgctgccctgccacccggatcctatgcatccctggggcggataagaacccggcgacaaagcagcgggagcgctaccaacgtggctagtacaccagataacagaggcaggtctagagcaaaggtagtcagccagtctcaacgcagcaggtctgccaacccggccggggcaggctcaaggtcgtcctcgcccgggaagctgctcggaagcggatacggcggactcaccggagggagctcccgagggcctccggtgaccccaagcagcgaaaaacgctcaaaaatcccacgaagccagggctgctcccgcgagacgtcgccaaaccggatcgggctggaccgcttcggtctgggtcaaccgggcaggatccccggatccgtaaatgctatgcgagtgcttagcacatctactgacctagaagccgccgtggcggacgccctgttgctgggagattcccgttccaagaagaaacctgttcgaagacgttatgagccgtacggcatgtactccgatgacgatgcaaattccgatgcgtcctctgtgtgtagtgaacggtcttacggatcccgtaacggtgggatccctcattatctgagacagactgaggacgtggccgaggtccttaatcattgtgcgtcctcgaattggagcgagcgtaaagagggacttctcggcttgcagaacctgttaaaaagccaacgaacactttcacgcgtcgaattaaaaagactgtgcgagatattcaccagaatgtttgctgatccccactccaaaatcgctgattctgaggctgagtgtgaggataaagagggtaacctgttcccctccgaagtatcttgcaccgtctcgttccagtacgtgttcggagatagctgcggtttttacaataattcgtag

SEQ ID NO: 113786 - DNA, 4485 bp, Artificial Sequence
  Description of Artificial Sequence: Synthetic coding sequence
atggaacccaggatggaatcttgccttgcacaggtgctgcagaaagatgtggggaagaggcttcaggtgggacaagagttgatcgactacttcagcgacaaacaaaagagtgccgacctcgaacacgaccagaccatgttggacaagctggtcgacggattggctactagctgggtaaactcctccaattataaagtggtactgctcggaatggatattctgagcgctttagttaccaggttacaagatagattcaaggcccaaatcggaactgtgctgccaagccttattgacaggctgggagacgccaaggattctgtcagggagcaggatcagactctcttgttaaagattatggaccaagccgccaacccccagtatgtctgggaccgtatgttaggcggattcaaacacaaaaatttcagaactagggagggcatctgcctctgtttgatagctacgcttaatgcgtccggggctcaaacgttgacactcagcaagatcgttccccacatttgcaacctactcggtgatcctaacagtcaagtgcgcgacgccgcaattaactctctcgttgagatctaccgtcacgttggcgaacgggtgagagccgatctcagtaagaagggcctgccgcagtcacgccttaatgtaatcttcaccaagttcgacgaggtacaaaagagtggtaatatgattcaaagcgctaacgacaagaattttgacgatgaagactctgttgacggaaatcgaccctcctcggcttcttctaccagttccaaggccccaccgtctagccgacgtaatgtcggaatggggactacacgcaggctgggcagttccacgctcggctccaaatcctcagccgctaaagaaggtgctggtgcggtggatgaggaggattttatcaaagcgttcgacgacgtgcctgtggtccaaatctattcatcaagggatctcgaggagagtattaataaaatccgcgagatactgtccgacgacaagcacgactgggaacaacgggtgaatgctctgaaaaagatcagatctctgctgctcgcaggggctgcagaatatgataactttttccaacatctccgcctcctggatggcgccttcaagcttagcgccaaggatctgcgatcacaggtcgttagggaggcctgtattacactcgggcacctgtcttcagtgctgggcaacaagttcgaccatggggccgaggccatcatgcctacgatttttaacctgattccaaattccgctaagattatggcaactagcggcgtagtggccgtgcgcctcatcatccgccacacccatattcccagacttatacctgtgatcacaagcaactgtacaagcaagagtgtcgcggtaagaaggaggtgtttcgaattcctggacttactgctgcaagaatggcagacccattcactggaacgccacattagcgtcctggctgagacaattaagaagggcattcatgatgcagacagcgaagcgcgaatagaagctcgcaaatgctattggggattccactcccatttttctcgggaggccgaacatctctatcataccctcgaatccagctatcagaaggctttgcagagccacctaaagaacagtgactccatcgtgtcactgccccagagcgaccgaagctcgtctagttcccaggagtcactaaatcggccactgtcagcaaaacggtccccgacaggctctactaccagcagggcctccacagtatccaccaagtctgtctccacgactggctccctgcagcggtctaggagcgatatagacgtgaacgctgccgcaagtgccaagtctaaagtgtcctcttcatctggtacaactcctttctcctctgcagccgccttaccacctgggagttatgcctccctaggtagaattagaacgcgtagacaaagtagcggttctgcgacgaatgtggcctctactccagataatcgggggcggtctagggctaaggttgtcagccagtcacaacggtcacgatccgccaacccggccggagcgggaagtcgatcctctagccctggcaaattactgggcagcgggtacggtgggttgaccggtgggtcctcacgcgggcctccggttacaccgtcaagcgagaaaagatcaaagatacctagatcgcaggggtgtagtagggagaccagcccaaatcgtatcggcctggataggttcggcttgggccagcccggacgtatccccggatccgtgaacgcgatgagagtgctcagcacttcaacagacctggaggcagcagttgcagatgccttagttcgaggcacctctacaggtaaaaaaaagccagttaggcgtcgctacgagccttacgggatgtacagcgacgatgatgcaaattctgacgccagctccgtgtgttccgagcgctcctacggatcacgcaacggcggcatccctcactatcttcgccagaccgaggacgttgcagaagtgcttaatcattgtgcatcatccaattggagcgagcgtaaagaagggctcctcggtttacagaacctactgaagtctcagaggacactctcacgcgtcgaacttaaacgactgtgcgaaatttttacaaggatgtttgcagatccccattctaagattgccgattcagaggcggagtgcgaagataaagagggtaatctgttcccctccgaggtgtcttgtacccgcgttttttccatgtttttggaaactttggttgacttcatcattatccacaaggacgacctccaagactggttgtttgtgctgctgacccaactgctcaagaagatgggcgccgacctgttaggttcagtgcaggctaaagttcagaaggccctcgacgtgaccagagatagttttcctttcgaccaacagttcaacattctcatgcgtttcatagttgaccaaacccagacccctaacctgaaggtgaaggtggccattcttaagtacatagagagtctggcccgccagatggatccaacagattttgtaaacagctcagagacccgactcgccgtcagcagaatcatcacgtggaccaccgaacccaaaagctcagacgtacgcaaagctgcacagattgtgctgatcagcctgtttgagttaaatacgccggaattcaccatgttgctgggcgctctgccaaaaacatttcaggacggagctacaaaactgctgcacaatcacctcaagaacagcagtaatacttctgtaggcagcccaagcaataccattgggcgtacccccagtaggcacacgtctagccgaacctccccattgacctcgcctaccaattgctcacacggcggcctctccccgtccatgctcgactatgatacagaaaatctgaactctgaagagatttattcatccctgagaggggtgacagaagcaattgagaagttcagttttaggagccaggaagatctcaatgagcctataaagagggacggcaagaaggagtgtgacattgtttcccgagatggtggcgctgcttcccccgccactgagggcaggggaggatcagaagtggaggggggcagaaccgccctcgataataagacaagtcttctgaacacccagccccctcgggcctttcctgggccccgcgcccgcgactacaacccctatccatacagtgacgccatcaacacatacgacaaaactgcccttaaggaggccgtgtttgacgatgacatggaacagcttagggatgtgcctattgaccacagcgacctcgtagcggacttactgaaagagctgagcaatcataacgagagagtggaagagagaaaaggcgccttgttggagttgctgaaaattactcgggaggattcactgggagtttgggaagagcatttcaagacaatcttgcttcttctcctggagacactgggagataaagaccattcaataagggcgctcgccttacgggtcctgagggagatattgcgcaatcagccagcacgtttcaagaattatgcagagctgacaatcatgaagactttagaggcacacaaagactctcacaaggaggtcgtccgcgccgcagaggaggctgcaagcaccttggcatcatccatccacccagagcagtgtattaaagtactgtgtcctatcatacagacagcggattatcctatcaatttggcagctatcaaaatgcaaacgaaggtcgtggaaagaattgcaaaggaatctctcctccaactgttggtggatattatcccaggcttgcttcaggggtatgataatacagaatcaagtgtgcggaaagcatcagtgttctgtctggtggctatctatagcgtgatcggtgaggacctgaagccacacctcgctcagcttaccggtagcaaaatgaaattgctaaacctgtatattaaacgagctcagacgacaaactctaacagctcgagtagctccgatgtcagtactcatagctag

SEQ ID NO: 113787 - DNA, 4434 bp, Artificial Sequence
  Description of Artificial Sequence: Synthetic coding sequence
atggagccccgcatggagtcttgtctggcacaggtgctgcagaaggacgttggaaagcggcttcaggtgggccaggaactgatcgactactttagtgataagcagaagtccgccgacctggaacacgatcaaaccatgctggacaagctcgtggatgggctagctacaagctgggttaactcttccaactacaaagtcgtactgctcggaatggacatactgtctgccttagtcacgcggctccaggataggtttaaagcccaaatcggaacagtcctgcccagcctgattgatagactgggagacgctaaggacagtgttagggaacaggatcaaacgttgctgctgaagataatggatcaggccgcaaatccccagtacgtatgggacaggatgctgggtggattcaagcacaagaatttccggacacgggaagggatctgtttgtgtttgatcgccactctgaatgcgtctggagcacagaccctgactctgtctaagatcgtgccccatatctgtaacttactgggcgatccaaactctcaggtgcgggatgcagccattaattctctcgtggaaatctaccgccacgtaggggaaagagttagagccgacctctcgaagaaaggtctgcctcagtctaggctgaacgtcattttcaccaaatttgacgaggtgcaaaaatcgggcaatatgatccagagcgcaaacgataaaaacttcgacgacgaagattccgtggacggaaaccgacctagctcggcttctagtaccagctcaaaagcacctccatccagtaggcgcaatgtcgggatgggcacaacaaggagactgggcagctctacactaggcagcaagtctagcgcggcaaaggagggtgccggggctgtcgacgaagaggatttcatcaaggcctttgatgacgttcccgttgtccagatttactcatctagagatctggaagagtcaatcaataaaattcgtgagatattgtccgatgataagcatgactgggagcagagagtgaatgcactgaaaaaaatcagaagcttgcttttggccggggccgccgagtacgacaattttttccagcacctgaggctattagatggggcatttaagttgtccgcgaaagacctgagatcccaggttgtacgggaggcttgcatcactctcggccacctgtcttctgtgctgggcaataaatttgaccatggggccgaagcgatcatgcccacaatcttcaatctgattccaaacagcgcaaaaattatggcaacttccggggttgtagccgtgcggctgatcatccggcacacacacattcccagacttattcccgtgatcacaagcaactgtacttcaaagtccgtggctgtgcgcaggagatgctttgaattcttggacctcctgctccaggaatggcagactcatagcctggagcgccacatcagtgtattggctgagacgataaagaagggaatacacgacgccgactctgaggcccgcatcgaggcgcgcaagtgctattggggtttccatagccatttcagtcgagaggccgagcacttgtaccacacgctcgagtcgtcttaccagaaggccctgcagtctcatctaaagaatagcgactctatcgtttctctgccccagagcgacaggagcagtagttcgtctcaggaatcattgaacagacctctgtccgcaaaacggtcacccacaggatcaacaacgagcagggcaagcaccgttagtacaaagtccgtttctactactggcagtttgcagaggtcaagatccgatatcgatgttaatgccgccgcaagcgcaaagtcaaaggtctcctccagttcagggaccacccccttttcttccgccgctgcactgcctcccggttcttacgcgagcttagagtccagacatatgagggaggatatggaatacatagggctggacagtggccgcattcgtacacgtcgccagtcatccggatcagccaccaatgtggcctcgacacccgataaccgtggccgcagccgggccaaggttgttagccagtctcaaccgggatcccggagctcatctccgggcaagctgctgggctctgggtacggtggtctgacaggtgggtcatcccggggcccaccagtgaccccctccagcgagaaacgatccaaaatccccagatctcagggttgctcaagagagacctcccccaatcggattggcttggaccgattcggcctcggacagcctgggcgtattcccgggtctgtgaacgcgatgcgtgtgctgagcacaagcacagacctggaggccgctgtcgccgacgctctcctgttaggagactcccgcagtaaaaagccagtgcggcgccgctatgaaccctatgggatgtattccgacgatgacgctaattccgacgccagctccgtgtgtagcgagagaagctacggtagtcgaaatggtggcataccccattatcttcgccagactgaagacgtggctgaggtcctcaaccactgcgcttcaagtaactggtccgaaagaaaggaaggtctgctaggtttacagaacctgctgaaaagccagcgcacactaagcagagttgaactgaagcgattgtgcgaaatctttactcggatgttcgctgatcctcatagtaagagagtcttcagtatgtttctggagactcttgtcgatttcatcataattcacaaagacgacctgcaggattggctgtttgtgctgctcactcagttgctcaagaagatgggagcggacctcctcggatcagtgcaggctaaggttcagaaggctctggatgtgaccagagacagcttcccatttgaccaacagtttaatatcctgatgcggttcatcgttgaccagacccagactcccaatcttaaggtgaaggtggcgatacttaaatatatcgaatcactggctcgtcaaatggaccccacagacttcgtaaatagctccgaaacgagattggcagtttccagaatcatcacatggactaccgaacctaaatcctccgacgtcagaaaggccgcccagatcgttcttatctcactttttgagttgaacacacccgagttcaccatgctactaggggctctccccaaaaccttccaggatggcgcgacgaaactgctccacaatcacctcaagaattcttccaatacgtctgtgggttcacccagcaacacaatcggtagaacaccctccaggcacacatcatcacgcacgtctccgctcactagccccactaactgctcacacggaggcttgtctccatccatgttggattacgacactgaaaacctaaacagcgaggagatctacagctcattgaggggtgtcaccgaagctatagaaaagtttagctttcgtagccaggaggacctgaatgagcctatcaagcgcgatgggaagaaggagtgcgatattgtaagccgtgatggcggagcagcaagtcctgccaccgaagggaggggcggtagcgaagtggaaggtggcaggactgccttagacaacaaaacgtcactgcttaacacccagccaccccgcgcctttccgggccctagagcaagggactataacccctacccctattctgacgcaatcaatacatacgataaaacagctctgaaagaagcagtcttcgatgacgacatggagcagctgcgcgacgtgccaatagatcacagcgatctggtggctgacctcttgaaggagctgagtaaccacaacgagcgcgttgaggaacgaaaaggagcccttctcgaattgcttaaaattacacgagaagactctctgggagtttgggaagagcatttcaagaccatcctcctactcctgctggagactctgggagacaaggaccactctatcagagcgctggccctgagagtactgagagaaatcctcaggaaccagcctgcccgcttcaagaactacgccgaactgaccatcatgaaaactctggaagctcacaaagacagccataaggaggtggtgagggccgccgaagaggcagcgagtacacttgcaagtagcattcatccagagcagtgcattaaagtactctgccccataatacagaccgccgattatccaattaatcttgccgcgattaaaatgcagaccaaagtggtcgaacgaattgccaaggagtctctgcttcagctgctggtggatatcatccccggacttctacaaggatacgacaatacagagagtagcgtacgtaaggcctccgtattttgtctggttgccatctactcagtaataggtgaggatctgaagccccacttagcccagctcactgggagtaaaatgaaactgctgaacctttacatcaaacgcgcgcagaccaccaactccaactcgagcagtagctctgatgtatccactcactcctag

SEQ ID NO: 113788 - DNA, 3768 bp, Artificial Sequence
  Description of Artificial Sequence: Synthetic coding sequence
atgcttcagaattgttctgacaagaactttgatgatgaggattcagtggacggaaaccgtccatcttccgctagctctacctctagcaaggcccccccctcaagtcggcggaacgtcgggatgggcacgaccaggaggctgggctcttctaccttgggctccaaatcatcagcagctaaggagggagcaggcgcagtcgacgaggaggacttcatcaaggcttttgacgatgtgcccgtggtacagatctactcttcccgtgacctggaggaatctatcaacaagatccgcgagattctttccgacgataaacacgattgggaacagcgcgtaaacgcactgaagaagatcaggagtctgctactggcaggcgcagccgagtatgataactttttccagcacctgcggttactggatggagcattcaaactaagtgccaaggaccttagaagccaggtagttcgtgaggcgtgtatcactctcgggcatctctccagcgtgcttggaaacaagtttgatcatggggccgaggcaataatgcctacaatcttcaacctgatccctaatagtgctaagatcatggctacatcgggcgtggtggctgtccggctaatcatcagacacactcacataccgagacttattccagtcataacctcaaactgcacatcaaagtctgtggctgttagacgacgttgctttgagttccttgacttgctcctccaggaatggcagacccacagcctggagcgccatattagtgtgcttgccgaaaccatcaagaaaggtattcatgatgccgactccgaagctagaattgaagcgcgaaaatgttactggggatttcattcccatttttcacgtgaggctgagcatctgtaccacactctcgagtcttcttaccagaaagctctccaaagtcatctgaagaattccgacagcatcgtctctctgccgcagtccgacaggagtagcagttcatcacaagaatctctaaatagacctttatcggcaaagcgctcacctacaggcagcacgacaagccgggcatccactgtcagtacaaagagtgtcagcaccaccggcagccttcagcggagcaggagtgacatcgacgtgaacgccgccgcctcagctaagtcaaaggtgtcttctagcagtggaacgactccattctcaagcgctgccgccctgccacctggatcatatgccagtcttggcagaatccgaactaggcgccagagtagcgggagcgcgactaacgtagcaagcacacctgacaatcgcggccgcagtagagcgaaagtggtctctcagagtcagcgatcacggtctgccaatccagctggagctggctccaggagctcatctcccgggaaattacttgggtctgggtacggcggcctgaccggtgggtcttccaggggcccacccgtaactccctcttctgagaagaggtccaagatcccccgctcgcaaggttgttccagggaaacatcccctaatcgaataggcctcgacagattcggcttgggacagccaggccgcattccaggctccgtcaacgctatgagagtgcttagcacatcaaccgaccttgaggccgccgtggctgatgccctgaagaagccggtgagaaggcgctatgagccgtatggcatgtattcagacgacgacgccaacagcgacgcaagtagcgtgtgcagcgagcgtagttacgggtcgcgaaacgggggaatcccacattacttgcggcaaacagaggacgtggccgaggtgctaaaccactgcgcctcctctaactggagtgagagaaaggaaggccttctggggctgcagaacctgctgaagagccagcggaccctttctagggtggaactaaagcgcctgtgcgaaatttttacccgcatgtttgccgatccccattcaaaaatcgctgactctgaggcggaatgcgaggataaggaggggaacctgtttccaagcgaagtgagttgtacacgagtgttctccatgttcctcgagaccctcgtggacttcatcattatccacaaagatgaccttcaggactggctgtttgtactgttaacacagttattaaaaaagatgggcgctgacctcctcggcagcgtgcaggccaaagtgcaaaaagcccttgacgtgaccagggacagttttcctttcgaccagcaattcaacatcctcatgagattcattgtggaccaaacacagactcccaatctgaaagtcaaggtggctattctgaaatatatagaatctctggcaagacagatggaccctacggactttgtgaactcgtcagagacaagactcgccgtgtcgaggattattacatggacgaccgagcctaagagcagcgacgtgaggaaagccgcccagattgtactgatcagtctgttcgaattaaatacacccgagtttaccatgttattgggggcgctgccaaagacttttcaagatggcgcaactaagctgctgcacaatcaccttaagaactccagcaacacttctgttgggtcaccttccaatactataggccgtaccccgtccaggcacacgtcttccaggacgagtcccctgacatcccccaccaattgttcgcacggcgggctgagtccttctatgctcgactacgacaccgaaaacctaaactccgaggagatatactcctcgctacgcggcgtcacagaggcaattgagaaattcagctttagatctcaggaggacctcaacgaacctatcaagcgggatggcaagaaggagtgtgacatcgtgtcgcgagatggaggagcagcttcccccgcgacggaaggaaggggaggaagcgaggtggaaggaggccggacagccctggataacaagacaagcctgctcaacactcaaccccctcgggcgttcccaggccctagagctagagattacaatccttatccctacagcgacgctattaatacttatgataaaacagcactaaaggaggctgttttcgatgacgatatggaacagctgcgggatgtgcctattgaccactctgacttagtggccgatctcttaaaggagctgagcaatcacaacgaaagggtcgaagagagaaaaggcgccctcctcgagctgctgaagattactagggaagattcattgggcgtctgggaagagcactttaagaccatcctgctcctgttacttgaaacactaggagataaagatcattccatcagagccctggctttacgcgtgcttcgagagattctacggaaccaaccagcgagattcaagaactacgcggagttgaccattatgaaaaccctcgaggcccacaaggactcccacaaggaggtggtccgagcggctgaggaggcagcaagcaccctggcctcgagcattcaccccgagcagtgtattaaagtgctttgtcctatcatacaaaccgcggactacccaatcaatctggcggccattaaaatgcaaactaaggtggtggagcggatcgctaaggaaagccttttacagctgctcgtcgacataatccccgggctgctgcagggatatgataatactgagagtagcgtgaggaaggccagtgtgttctgtttggtggctatatattccgttattggcgaagacctgaagcctcatctggcccagcttacagggtccaaaatgaaactgctaaatctctacatcaagcgagcccagaccaccaactcgaacagcagtagcagcagtgacgtttccactcactcatag

SEQ ID NO: 113789 - DNA, 3738 bp, Artificial Sequence
  Description of Artificial Sequence: Synthetic coding sequence
atgacaacagggaaagacaagaactttgatgacgaagatagcgttgacggaaacaggccttcatctgctagctcaacgtccagcaaggcccccccatcctccaggcgaaatgttggaatggggactaccaggagactcggctcctctacattagggtcaaaaagcagtgcagccaaagaaggcgccggtgccgtcgatgaagaggactttatcaaagccttcgacgatgttcctgttgtccagatctactcctcgagagatctggaagaatcaataaataagattcgagagatattgtcggatgacaagcacgattgggaacaacgggtgaacgctctaaaaaagattcgcagcctgctcttagcaggggccgcggaatatgacaacttctttcagcacctgagactgctggatggcgcctttaagctgtcagccaaggatctacgctctcaggtggtgagggaagcttgtataacgctgggccatcttagctccgtcctgggcaacaagttcgatcatggcgccgaagccataatgccaactattttcaatttgattccaaattctgctaaaatcatggccacgtcaggagttgtggctgtgcggttgatcattaggcacacacacatccccaggctcatccctgtgataacctccaattgtacatcaaagagtgtggcggtcagaaggcgctgttttgagtttctggacctgctcctgcaggaatggcagacccattccctagagagacatatctccgtgttggccgagactatcaagaagggtattcacgatgccgactccgaagcccggatcgaggctaggaagtgctactggggatttcactcacactttagcagggaagccgagcatctctaccatacattagagtcaagctatcagaaggccctccagagtcacttgaagaatagcgattctatcgtctcattgccccagtccgaccgctcatcttcatcctcacaagagtcgctcaacaggcctctgagcgcaaaaaggtcccctactggtagtacaaccagccgggcctccacagtttcaacaaagtctgtcagcaccacaggttccctccagaggagcaggagtgatatcgatgtcaatgcagccgcaagcgccaaaagcaaggtcagcagtagcagcggcacaacccccttcagttccgccgcagcattgccacctggatcctacgcgtctctcgacggaacgacaaccaaggccgagggccgaataaggacacgccgccaatcttccggatccgccactaacgtggcctcgacacccgataacagaggaagatcacgcgctaaggtggtgtcccagtcccaaagatcaagatctgctaaccccgcaggcgccggttcacgctcctccagcccgggcaagctcctgggttctgggtatggtggcctcaccgggggaagtagcagaggaccgccagtgacgccaagcagcgaaaagagatccaagattcctagaagccagggttgttcgcgggagacttcacccaatcggatcggcttagatcgattcggcctgggccagcctggtagaatccccgggtcagtaaatgcgatgagggttctttctacttcaaccgatctggaggctgctgtggcggacgcattgttactaggtgacagcaggagtaagaaacccgtgaggcgaaggtacgaaccttatggcatgtatagtgacgacgatgccaatagtgacgcctcatcggtgtgtagcgagcgctcttacggaagcagaaatgggggaattccccactatctaagacagaccgaagacgtggctgaggtgctcaaccactgtgcctcctctaattggagcgaacgcaaggaaggtcttctgggtctacagaacctgctgaagtcgcaacgcacgctctctagagtggaactaaaaagactctgtgaaatcttcacacggatgtttgccgacccccattcgaaagtgtttagcatgtttcttgagaccctggtagatttcataatcattcacaaggacgatctccaagattggttgtttgtgttgctgacacagctgctaaaaaaaatgggagccgatcttcttggctccgtgcaagcgaaagtccagaaagccctggatgtgacaagggactccttcccattcgatcagcagtttaatatactcatgagatttatcgtggatcagacccaaacgcctaatctgaaggtgaaggttgcgattcttaagtatattgaaagcctggccagacaaatggatcctaccgatttcgtaaatagttcagagacaaggctggctgtaagccgcattataacttggaccaccgaaccaaagtcctctgacgtgcgtaaggcggcccagatcgtacttatttcattatttgaattgaatacccccgagtttaccatgctgctgggagcattgcctaaaaccttccaagatggtgccactaagctgttacataatcatctgaagaatagcagtaacacatctgtgggctctccgtccaacactataggtcgcaccccaagccgtcacacctcatctcggacatcacctctgacctccccaaccaactgttcacacggcgggctttctcctagcatgctggattatgataccgaaaacctgaactccgaggagatttactcctccctgagaggagtgaccgaggctattgagaaattttcgtttcgttctcaggaggacctaaatgagcccatcaagagagacgggaaaaaggagtgtgacattgtatcacgagacggtggggccgcttcccccgccaccgaagggagaggcggctccgaagttgagggcggacggacggcactggataacaaaaccagtctgctcaacacacagcctccccgtgcctttccagggcccagggcgcgagattataacccatatccttatagcgatgcgatcaatacatatgataagacagctctgaaggaggcagtgttcgacgatgacatggaacaattgcgcgatgttcctatcgatcatagtgacttggtcgcagatctccttaaggagctgagcaaccacaacgaacgggtggaggagagaaagggggctttgttggagctcctgaagatcaccagggaagattcgcttggggtttgggaagaacacttcaagacaattctgctgcttctcttagagacattgggtgataaggatcacagtatcagggcactggccctgcgggtacttagagaaattctgcggaaccagccagcgcgcttcaagaattatgctgagcttacgatcatgaaaactctcgaggcgcacaaggactctcacaaggaagtagtcagagcggccgaggaggcagcttctacattggcaagctccattcaccccgagcaatgtattaaggtcctatgcccaattattcagaccgccgattaccctattaatcttgctgccattaaaatgcagaccaaggtagtggaaagaattgccaaagagagtttactgcaactcctggtggatattataccgggattactgcagggttacgacaacaccgagtcatcggtccgaaaggcttccgtattttgtctggtcgctatctactccgtgattggagaggacctgaagcctcacctggcacagctaactggctccaagatgaagcttctgaatctctatataaagagggcccagacgaccaatagcaacagctcaagctcatcagatgttagcacacatagctag

SEQ ID NO: 113790 - DNA, 2988 bp, Artificial Sequence
  Description of Artificial Sequence: Synthetic coding sequence
atgggactgcggaaccattttcctggtgaagccgagacactctataactccctggaacccagctaccagaagagtttgcagacatatctaaaaagctctggcagtgttgcaagtctcccacagtctgacaggtcatccagtagttctcaagagtcacttaacaggccattctcttcaaaatggtcgacggcaaacccgagtaccgtagccggccgagtgagcgccggcagttctaaagcctcttctctccctggctccttacaaagatcaaggtcagacatcgacgtgaatgccgccgccggagccaaggcccatcatgccgccggacagtctgtgagatcaggtaggctcggcgccggcgcattaaacgcagggtcctatgcctctctggaggacacctcggacaaactggatggcaccgccagcgaggatgggcgtgttcgcgccaagctgtcagccccactggcgggaatggggaatgcaaaagccgactcaagaggccgctcaagaaccaagatggtgtcccagagccagcccggatctcgctccggctccccgggcagggtgctgacaactactgccttgtccaccgtaagtagtggagtgcagagggtgctggtcaattcggcgtccgcccagaaaagaagtaagatcccaagatcgcagggatgtagtcgggaggcctccccctcaagactgagcgtggcacgatcctcacgtatccctagaccctctgtgagtcagggctgttctcgcgaagcgagtagagagagtagtcgtgacactagccctgtgcgctccttccaacccctcggtccaggctacggaatctcgcaatcttcccgactgtcttcgagcgtgagtgctatgagagtgcttaacacaggcagtgacgtcgaagaagcagtcgctgacgctttgaaaaaacccgccagaaggcgctatgaaagttatggcatgcattcagacgatgatgccaactctgacgctagttccgcctgcagtgagaggtcatattcttccagaaacggcagcatccccacttatatgcggcagaccgaagatgtggcggaagttctgaatagatgtgctagcagtaattggtccgaaagaaaagagggactcctgggtctccagaatctgctgaaaaatcagagaacactatctcgggtggagctgaagaggctgtgtgaaatcttcacgaggatgtttgcagatccccatggcaagcgggtgttttcaatgtttctggaaacactggtagacttcattcaggtgcacaaggacgacttgcaggactggttgtttgtgctcctcacccagttacttaaaaaaatgggcgccgaccttctggggtccgtccaggcaaaggtgcagaaagccctggatgttacacgcgagagctttccaaacgacctccaatttaacattctcatgcgattcacagtagaccagacccagaccccttccctgaaagtcaaggtggcaattctcaagtacattgagactttagccaaacagatggaccccggtgatttcattaacagttccgagacacgccttgcagtttcccgagtgatcacatggaccaccgagccaaaaagttcagatgttaggaaggccgctcagtctgtgctcatcagtctgtttgaattaaacacacccgaattcaccatgctgttaggtgcccttcccaaaacctttcaggatggagcaacgaagttattgcacaatcatctccgaaatacaggtaatggcacccagtccagcatgggctcgccactgactcgcccaaccccgcgttcaccagcgaactggtccagccccctgacgtctcccaccaacacctcgcagaacactctaagtccgagtgccttcgattatgacactgagaatatgaattctgaggacatttattcttccttaaggggtgtcacagaggctatccaaaatttttcttttaggagtcaagaagatatgaacgagcccctgaagagagacagtaaaaaggatgatggcgactctatgtgcggagggccaggcatgtcggatcctcgggccggaggcgacgcaactgacagcagccaaacggcccttgacaacaaagcctccctgctgcattcaatgccaacccacagctctccgcgaagtcgggactacaacccatataactactctgattcaattagtcccttcaataaatcagcgctcaaagaggccatgttcgacgatgatgcagaccagtttccagatgatctgtccctggaccacagtgaccttgtggctgaactcctaaaagagctgagtaaccacaacgagagagtcgaagagcggaaaattgccctgtatgagctgatgaagctgacccaagaggagtcctttagcgtctgggatgagcattttaaaactatcctcctgctgctccttgaaaccctgggtgataaggagcctactatcagagcactcgcactgaaggtcctgcgcgagatactgaggcatcaaccagcgcgatttaaaaactatgccgagcttaccgttatgaaaactctggaggcacacaaggatcctcacaaagaagtagtccgcagtgcagaagaggccgccagtgtgctggccaccagcatctcacctgagcagtgcattaaagtactgtgccctattatacagacagctgattatcccattaacctggcggctatcaagatgcagaccaaggttatagaaagagtgtctaaagagacactgaatctcctcttgcctgagataatgcctggtctgattcagggctatgataacagcgaaagttccgtgcggaaggcatgtgtgttctgcctggtcgccgtgcacgctgttattggtgacgaattaaagcctcacttatcacagttaacgggttccaaaatgaagttgctcaacctgtacattaaaagagcacaaacaggcagcggaggcgccgaccccactacggacgtgagcgggcaatcttag

SEQ ID NO: 113791 - DNA, 1296 bp, Artificial Sequence
  Description of Artificial Sequence: Synthetic coding sequence
atgaggagattgatttgtaagcgtatctgcgactataagtccttcgacgatgaggaaagtgtagatgggaaccggccatcaagtgcagccagcgccttcaaggttcccgccccaaagacatctgggaacccagccaattcagctagaaaaccggggagcgccggcgggcctaaggtgggaggggccagtaaagagggtggcgctggcgctgtggatgaggacgactttattaaagccttcaccgatgtcccctccatccagatctactcttctagagagctggaggagaccctgaacaagatccgcgaaatcctgtcagacgataagcacgactgggaccagcgggctaatgcactaaagaagattcggtccttgctggtcgccggagccgctcagtatgactgttttttccagcacctgagactgctggacggcgctctgaagctgagtgccaaggacctcagatcccaggttgttcgagaggcatgtataactgtggctcatttaagcaccgtactgggcaataagttcgatcacggagccgaagccattgttccaaccctctttaatctcgtgcccaactctgccaaagtgatggccacctctgggtgtgccgctattagattcatcatccgtcatactcacgtgcctagactgataccgcttatcacttcgaactgcacaagtaagtccgtgccagttagaaggcgatcattcgagtttctagatctgctgttacaggagtggcagacgcacagccttgagaggcatgccgctgttctcgtagaaacgattaagaagggtatccatgacgcggacgccgaggctagggtggaagcaaggaagacttatatgggcctgagaaatcatttcccgggcgaggccgaaacactttataattctctggaaccatcttaccagaagtctttgcaaacatacctgaagtcttccgggtcagtggcatcgctgccccaatcagaccggtcttcaagtagcagccaagagagtcttaacagacctttctcatcaaaatggtctacagccaaccctagtaccgtcgctggccgtgtgagcgcggggagttctaaagcctcttcgctgccgggatcccttcagcgctcaaggtccgatattgatgtaaacgccgccgccggggccaaagcccaccacgccgccggacagtccgttcgatccggtagactgggggcaggcgcgctgaacgcagggagctatgcgagtttagagtgcgaagcgttttggcgcagcggcagaactgccaagctctacagtgtttag

SEQ ID NO: 113792 - DNA, 4518 bp, Artificial Sequence
  Description of Artificial Sequence: Synthetic coding sequence
atggagccacgctcaatggaatatttttgcgcccaagttcagcagaaagatgttggcggtcgtcttcaggttggccaggaactgctcctctacctgggtgccccaggcgctatcagcgacttggaggaagatttgggccgactggggaaaaccgtggatgcacttaccggctgggtgggctcctcgaattaccgtgtctcactgatggggcttgagatccttagcgccttcgtggatcgcctgagcacacggttcaaatcctacgtggccatggtgatcgtcgccctcattgaccgaatgggtgacgccaaagataaagtaagagacgaggcccagacactgattttgaaattgatggatcaagtggcacccccaatgtatatctgggaacaactcgcgtcaggcttcaaacataagaatttccgttctagggagggtgtctgtctttgtctgattgagactttaaacatctttggagcccagccactggtgatttccaagctaatcccccacctgtgcatcctgttcggggacagcaatagtcaggtccgggatgctgctattctcgccattgttgagatataccgccatgtcggcgagaaagtacgcatggacctatacaagcggggaatcccccccgccaggctagagatgattttcgccaagtttgatgaggtgcagagctcaggtggtatgatcctaagcgtttgcaaggacaagtctttcgatgatgaagaatcggtcgacggcaaccggcctagctcagccgcttcagccttcaaggtccccgcacctaagacgagcgggaaccccgccaacagcgccaggaaacctggtagcgcaggagggccaaaggtggggggggcctcaaaggagggcggggcgggagctgtggatgaggatgattttattaaggccttcactgacgtcccatctattcagatctactcctccagggaactcgaagaaaccttgaacaaaatccgagaaatattaagtgacgacaagcacgactgggaccagagagctaacgctctgaaaaaaatccggagtctgctagtggctggtgctgcacaatatgactgctttttccagcatttacggctactcgacggagctctgaagctgtcggctaaggatctgaggagtcaggttgtcagagaagcctgcattaccgtggcccacctgtctactgtgcttggcaataagttcgatcacggcgccgaggctatcgttcccactctttttaacttagtcccaaattctgctaaagtaatggccacgtctgggtgtgcagcaatccgattcatcatacggcacacacacgtaccacgcttaatcccactgattacatcgaattgtaccagcaagtcagtgccggtgcggcggaggagcttcgagtttctcgatctgctgctgcaagagtggcagactcactccttggaaagacatgccgctgtcctggtggagacgatcaagaaaggaattcacgatgctgatgcagaagctcgcgttgaagccagaaagacatacatgggcctgcggaaccactttcctggcgaggcggaaacactatacaacagcctcgaaccgagctatcagaagtcacttcagacttacctgaagagcagcggttcagttgccagcttacctcagtctgataggagttcaagttcctcacaggaatccctcaacaggcccttctcttctaagtggagtaccgctaacccttctaccgtggcggggcgagtatccgcaggctccagcaaggcgagttcactcccagggagtctgcagagaagtaggagcgacattgacgtgaacgctgccgccggcgccaaagcccaccacgcagcaggccaatctgtgaggagcggacgcctgggcgctggggcacttaatgctggcagttatgcatccttggaggatacctcagacaagctggacggaactgcgagcgaagacggcagggtaagggcaaaattatctgcccctctggcaggcatgggaaatgcaaaagcagattcacgcggacgcagccgaacaaaaatggtttcacaaagccagcctggttcacggtcaggatcaccgggccgagttcttactacaaccgccctgagtacagtttcgtccggtgtacaacgagtcctggtgaatagcgctagtgcacagaaacggtctaagatccccagaagccaaggttgctccagagaggcctcacccagccggttgtccgtggctagaagcagccgtatacccagaccttcagtgtctcagggttgctcacgcgaagcatctcgtgagagttctcgagataccagccctgtgcgttcttttcagccacttggacctggatacggtattagccaatcgtcacgactttcttcaagtgtgagcgccatgcgggttctgaataccggttcagatgtcgaagaagccgtggcagacgctctaaagaaaccagctagaaggcggtacgaatcctatggaatgcactctgacgacgacgccaactccgacgcaagctccgcttgctctgagagatcatacagctctcgcaacggaagcatccctacatacatgagacagaccgaggatgtggctgaggtgctgaaccgctgcgcatccagcaactggagcgagcgtaaggagggcctactgggcctccagaatctgctcaaaaatcaaagaacactctctcgggtggagctcaagcgcctgtgcgaaatcttcactcgaatgttcgccgatccgcatggcaaggtcttcagcatgttcttggagacattggttgacttcatccaggtccataaggacgatttacaagattggctgtttgtgctgctgacccagctcctgaaaaaaatgggagcggatttgttaggcagcgtgcaggctaaagtgcagaaggccctcgatgtgacaagggagtcctttccaaacgacctgcagttcaatatactcatgaggtttacggtcgatcaaacacagacaccgtccctgaaagtcaaggtggctattttaaagtacatcgaaaccttggctaagcaaatggaccctggcgatttcatcaattctagcgaaacgagactggctgtgagccgcgtgatcacctggacgaccgagcccaaatccagcgacgtgcgcaaggctgctcagtcagttctgatctctctgttcgaacttaacacccctgagtttaccatgttgttgggggccctcccaaaaacgtttcaggatggagcgaccaagttgctacacaatcacctgcgaaataccggcaatgggactcagtcttccatgggcagccccttgacccgcccgaccccgaggagccccgccaattggtcgagcccactgacgtcccccacgaacacatcccagaatactttgagcccgagcgccttcgattacgatacagaaaacatgaactctgaagatatatactcaagcctgcgcggggtcacagaagccatccagaattttagcttccgttcccaggaggacatgaatgaaccactgaaacgcgactctaaaaaagatgatggggactctatgtgcgggggcccaggcatgtcggacccacgggcaggaggcgacgccacagacagcagccagaccgccctcgacaataaagcttctctcctgcattccatgcctactcattctagccctcggagccgggattataatccgtacaattactccgattctattagtcctttcaacaagtcagccttaaaagaagcaatgtttgacgacgacgccgatcagttccctgatgatctgtcactggaccacagcgacttggtggccgaattgctgaaggagttgagcaaccacaatgagagagtggaagaacgcaagattgctttgtatgaactgatgaagttgacacaggaagagtctttttccgtttgggatgaacactttaagacaatactcctgttacttctcgagacattgggcgataaagaacctaccattagagccctggctcttaaggtattgcgtgaaatactgaggcaccagcccgcccgcttcaagaactatgccgagctgactgtgatgaagactctcgaggcccacaaagacccacacaaagaggtggtgcgatccgccgaggaggctgcctcagtgcttgcaacgagtattagccccgagcaatgcattaaagttctttgccctataatccaaactgctgattacccaatcaacctggcagctatcaagatgcagaccaaggtgatcgaaagagtctctaaagaaacgttgaatttattgctgccagagatcatgcctggcctcatacaagggtacgacaattccgagagctctgtgagaaaggcctgcgtattctgccttgttgccgtgcacgccgtgatcggagacgaactgaagccacacctgtctcaactcaccggatccaaaatgaagcttctgaacctatacattaaacgggcccagacagggtccggaggcgccgatccgaccacagacgttagcggacagtcctag

SEQ ID NO: 113793 - DNA, 4542 bp, Artificial Sequence
  Description of Artificial Sequence: Synthetic coding sequence
atggaacccaggtctatggaatatttttgcgcccaggtacagcagaaagatgtgggtggacgcttgcaagtgggccaggaacttctgctgtacctgggggctccaggtgccatctccgaccttgaagaagaccttggaagacttggcaagactgttgacgctctcaccggttgggtagggtctagcaattatagagtgtccctgatgggcctggagatactgagtgccttcgtcgaccggttatcaacccgatttaagagctacgtggctatggtgatcgtggctctgatcgatcggatgggcgacgccaaagataaggtcagagacgaagcccaaaccctgatcctgaaactaatggaccaggttgccccccccatgtatatctgggagcagctggccagcggctttaaacataaaaacttcaggagtcgggagggcgtatgtttatgtctgatagagacgctaaatatcttcggggcgcaaccactcgttatctctaaattaataccccatctgtgcattttattcggggactcgaactcccaggtgcgggacgccgccattcttgcaatcgttgaaatttatcgccatgtgggcgagaaagtacgaatggatctctacaagagaggcattccacccgccagactggagatgatctttgccaagtttgatgaggtccagtcctcaggcggaatgatcctgtctgtctgtaaagataagtcctttgatgatgaagagtccgttgatggaaaccggccatcttctgctgccagtgcttttaaggtgccagcacccaagacctctggcaaccccgccaatagcgcaagaaaacccgggagtgccggcggtcctaaagtgggcggagctagcaaagaaggaggcgctggcgctgtggatgaagacgactttatcaaggcattcaccgatgtgcctagcatacagatttactcttcccgcgaactggaggagaccctgaataaaatccgtgagatcctgtccgatgacaaacatgactgggaccagagggcgaatgctctgaagaagattaggtctctgcttgtggctggggccgcccagtacgattgtttttttcagcacctccggcttctggatggagctctgaaattgtctgctaaagatctgcgctcgcaggtggttagagaagcatgtatcaccgtagcacacttaagtacagttctggggaacaagtttgaccacggggcagaagctattgtgccgacactctttaacctagtgcctaacagcgccaaagtgatggctacatctggatgcgctgccattcggttcatcatccgccacacacatgtgccccggctgatccccctgatcaccagtaattgcaccagcaagagtgtccccgtgcgacggcggagtttcgaattccttgaccttctcctccaggagtggcaaactcactccctggagaggcacgcggctgttctggttgaaaccataaagaaggggatccatgacgccgacgctgaggcccgtgtggaggcccggaaaacatatatggggctaaggaatcacttcccgggagaagccgagacactttataatagtcttgaaccttcttatcagaagagccttcagacctatctcaagagtagcggttctgttgcttcgcttcctcagtccgacagatctagcagtagctcccaggagagtctcaataggccctttagctcaaaatggtccacggctaacccctctactgtggctggacgcgtgtccgctggctcatccaaggcaagctctctgcctgggtctctgcaacggtccaggtctgacatcgatgtgaatgccgctgccggcgcaaaggcacaccacgcggccggacagtccgtgaggtccgggagattaggtgcgggcgctctgaacgctgggagctatgcctccctggaggataccagtgacaaacttgatggcactgcaagcgaagacgggcgtgtgcgagctaaactatcagcccccctcgctgggatgggaaatgctaaagcagattctcgcggtaggtccagaacaaaaatggtgtcccagagccagcccggcagccggtccggaagcccggggcgtgtgctcacaactaccgccctgtcaacggtctcgtctggagttcagcgtgtccttgtgaattcagctagcgcacaaaaaagatctaaaatacctaggagtcagggctgctcccgagaagcgtctcctagcagattgagcgtagcacggtcaagcagaattccacgcccaagcgtaagtcaaggttgcagtcgggaggcctccagagagtcctctagggatacgtctccagtcagatcttttcaaccacttggacctggctatggcatttcacagtcaagccgtttatccagctccgttagcgccatgagagtgctgaacaccggtagcgacgtcgaggaagctgtggccgatgcattgctgctgggagacatacgcacgaaaaagaagccagcgcgccggaggtatgagtcatacgggatgcactcagacgacgacgcaaattcagacgcttcgtccgcctgttcagaaaggtcctactcaagccgcaatggaagcatccccacatatatgcgccagaccgaggatgtagccgaagtcttaaaccgttgtgcgagctctaattggagcgagagaaaggagggcctcctggggttgcagaacctgttgaagaatcagcgcacattgtctagggtggagctaaagcgcctctgtgagattttcacccggatgttcgcagatcctcacggcaaagtgttctctatgtttctggagaccctggtagattttattcaagtgcacaaggacgacttgcaggattggcttttcgtcttgctgacccagctgctcaaaaaaatgggagcggatctgctcggttccgtgcaggcaaaagttcaaaaagcattggacgtgacgagggagtcatttccaaatgacctgcaattcaatatcctgatgaggttcaccgtagatcagactcagacaccctctctgaaagtgaaagttgctattttaaagtatatcgaaacattggcaaagcagatggatcccggtgacttcatcaatagctcggaaaccagattagccgtatcacgggttattacttggacaacggagcctaaaagtagcgacgtgcgcaaagcagcccagtccgttctaatctcactgttcgaactcaatactccggaattcactatgctgctgggcgccctgcccaaaacattccaagacggcgccacaaaattgctccataaccatttgagaaacactggcaacggaacccagagctcaatgggaagccctctcacacggccaacgcccagaagccccgctaactggtccagccccctgacaagccccaccaacacctctcagaacaccctttcacccagcgcctttgattacgacacggagaacatgaactccgaagacatctactccagcttgaggggtgtgacggaagctattcagaacttttcattccgctcccaagaagatatgaacgaacctctgaaacgggactccaagaaggacgacggcgacagcatgtgcgggggccccgggatgagtgatcctagggccggcggtgacgcgactgattcatcgcagacagccctggacaacaaagcatctctcttacattctatgccaactcatagctccccccggagccgggactataatccttataattatagtgattccataagcccttttaataagtcggctctaaaggaggctatgttcgacgacgacgcagatcagtttccagatgacctcagtctggatcattcggatcttgttgctgaactactgaaagaactctcgaatcacaatgaacgcgtggaagagcggaaaatcgccctctacgagctcatgaagctcacccaggaagagagcttttctgtttgggatgaacactttaagactattctgctgttgctgctggagacgctcggcgacaaggagcctaccattagggctctcgcattaaaggttttacgggagatcttgaggcaccagccagccaggttcaaaaactatgcggaacttacagttatgaagaccctggaagcgcacaaagatccccacaaggaagtggtcagatccgctgaggaggccgcctcggtactggccactagtatatcaccagagcagtgtataaaagtgctctgtcccataattcaaaccgctgattacccaatcaacttggctgcaatcaaaatgcagaccaaggttatagaacgggtcagtaaggagacactgaatctcctgctccctgagataatgcctggtctgattcaagggtacgataattccgagtcatcagtcagaaaggcctgtgtgttctgtctggtcgcagtgcatgctgtgattggggacgagcttaaacctcatttatcgcaactgactgggtctaaaatgaagctactcaacctgtatatcaagcgggcccagaccggttctggtggcgccgaccctacgaccgacgtttccgggcagtcatag

SEQ ID NO: 113794 - DNA, 4545 bp, Artificial Sequence
  Description of Artificial Sequence: Synthetic coding sequence
atggagccaaggtctatggaatacttttgcgctcaggttcaacaaaaagacgtggggggacgacttcaagtgggccaagagctgcttctttatttgggtgcccctggcgctatttcggatctcgaagaagacctgggacggctggggaaaaccgtggacgctctgaccgggtgggtcggcagctcgaattacagagtgagcctgatgggattggagattctttcagcgtttgttgatagattaagtacacgtttcaaaagctacgtggccatggtgatcgtcgccttaatcgacagaatgggagatgcaaaggataaggtgagagatgaagctcagacactgattctcaaactaatggaccaggtggctccccccatgtacatctgggagcagttggcaagcggttttaagcacaaaaacttcagaagccgggaaggtgtatgtctttgcctgatcgaaaccttaaacatttttggcgcgcaacctcttgtgatcagtaaactcattccccacctctgtatcctctttggggattcaaacagccaggtacgcgacgcggctatattggccattgtcgagatttaccgccacgtgggggagaaagttagaatggatttatacaagcgcggtatcccgcccgcgcggttggaaatgatttttgccaagtttgatgaggtgcagtcaagtggtggtatgatcctgtccgtatgtaaggacaagtcatttgacgacgaagagagtgtcgacggaaataggcctagcagtgccgcctcggcattcaaggtccccgcgcccaagacctctggcaaccccgccaattctgctcggaaaccagggagtgccggcgggcccaaggtcggggcaggagcaagcaaggagggcggggccggggccgtagatgaggacgatttcatcaaggcatttaccgacgttccctctattcaaatctattcctcccgagagcttgaagagacactgaataaaatacgcgagattctgagcgacgacaagcacgattgggatcaacgcgccaatgccttaaagaaaatccggagcctcctggtggccggggctgcccaatacgattgcttctttcagcatttgagacttttagacggcgctctcaagctctccgctaaagatctgcgctcgcaggtcgtgagagaggcctgcatcactgtcgcacacctttcaaccgtgttaggcaacaagtttgaccatggtgccgaggcgattgtccctactcttttcaatctcgttcccaattctgccaaggttatggctaccagtggctgtgccgccattcggtttatcattaggcacacccatgtccccagactaattcctcttatcacatccaattgtacatctaagagtgtgcccgttcgaagacgatccttcgagtttcttgacttgctcctgcaggagtggcaaacccactcgctagagaggcatgcagcggtactggtggagacaatcaaaaaggggattcacgacgctgacgccgaagcccgtgtcgaggctagaaaaacatacatgggactgcgcaatcacttcccaggtgaagcagagaccctctacaactccttagaaccatcttatcagaaaagtctgcaaacatacctgaagagttccgggtctgtggcgtccttgccacagtcagatagaagcagttctagtagccaggaatcccttaaccggcccttctctagtaaatggtccacagccaacccaagtacggtagctgggcgcgttagcgcggggagtagtaaagcgtccagcttgccaggctcgctgcaacggagtcggtccgacattgatgtgaatgcagctgctggggcaaaagcccaccacgcagcaggacaatctgttcgaagtggccgcctcggggctggtgcacttaatgctggctcttatgcgtcactggaagatacctctgacaaattggatggcacagcctccgaagacggccgggtccgtgcaaagctttctgcccctctggcgggaatgggtaatgctaaggcggacagtcgcggccgtagtaggacgaagatggtgagccagagtcagccagggagtcggtctggttcaccaggaagagtgctcactacaacagcgctgagcacagtgagtagtggggtgcagagagttctcgttaacagcgcgtcagcgcagaaacggtctaagatcccccgctcccagggctgtagcagggaggcctcacctagtcgtcttagcgtggctagatccagtaggatcccaagaccaagtgtcagccaagggtgtagtcgcgaggcctctcgcgagtcatctcgagatacctctcccgtgcgaagcttccagccgcttggtcccggttacggcatcagccaaagctcacgcttgtcgagtagcgtcagcgcgatgcgggttctgaacaccgggtcagatgtggaggaggccgtggccgacgcactgctcctgggggacatcaggaccaaaaaaaagccggcccgcagaaggtacgaatcctacggaatgcactccgacgatgacgccaattcagacgcctctagcgcatgcagcgagaggtcttattcaagcagaaacggcagcatccctacatatatgaggcaaacagaagacgtggctgaggtgctgaataggtgcgcctccagtaactggtcagagcgaaaggaaggcctgctcgggctgcagaatttattgaagaatcaacggactctcagtagagttgaacttaaacgcctgtgcgagatcttcactcgcatgtttgccgacccacatggcaaagtcttcagcatgtttttggagactctagtcgacttcatacaagtccataaagatgacctgcaggactggctgtttgttcttctgacccaactcctgaagaagatgggcgctgacctcctaggctccgtacaggccaaagtccagaaggccttggacgtcaccagagagtctttccctaatgatctccaattcaatatcttaatgcgcttcacggtagatcagacacagactccgtctctaaaagttaaggtagcaatactcaagtacatagagactctggcaaaacagatggaccctggagattttatcaattcctccgagacgcggctcgcggtctcccgggtgataacttggaccacggagcccaagagcagcgatgtgcgcaaagccgcccagagcgtcctcatttccctgtttgaactcaacacccccgagtttactatgctgctcggggcactccccaagaccttccaggatggtgctactaagctactgcataatcacctgcggaatactggaaatgggacccaaagtagtatggggagtcccctcacccggccaacacccagatctcctgccaattggtcatcccctctgacatccccaaccaacaccagtcagaacactctaagccccagcgcatttgattatgacactgaaaacatgaattctgaggacatatattcctcattgcggggggtcaccgaagccattcagaatttcagctttaggtcgcaagaagatatgaacgagcctttaaagagggacagcaagaaggacgacggggatagcatgtgtgggggccctgggatgagcgaccccagagccgggggggatgccacggattcaagccagactgccttggataacaaggcatcactgctgcatagcatgccgacccatagttctccccgctctcgcgactataatccctataactactccgactccatctcaccctttaacaaaagcgccttgaaagaagctatgtttgatgacgacgcggatcaatttccagacgatctgtctttagatcattcggacctggtagccgagctgctgaaggagctgtccaatcacaatgaacgggtcgaagaaagaaagattgcgctttacgagctgatgaaactcacacaggaagagtcattctctgtttgggacgaacattttaagaccattctgctcctgctgctcgaaaccttgggcgacaaggagcccaccattcgtgccttggctctgaaggtcctgagagaaattctgcggcatcagcccgccaggtttaaaaactatgccgaattgaccgtgatgaaaacactcgaggcccacaaggatccccacaaggaggtagtccgctcggccgaggaagcagccagcgtcttggccacttctataagccccgagcagtgcatcaaagtgctctgcccgatcattcaaaccgctgattaccctataaaccttgccgcaataaaaatgcagacgaaggtgatcgaacgcgtaagtaaagagactcttaacctgttgctgcccgagattatgcctgggttgatccaggggtatgataacagcgaaagctccgtgcggaaagcttgtgtcttttgcctcgtagcagtgcatgctgtgataggggacgaactgaaacctcatctttcgcaactgactggctcaaaaatgaaattgctcaacttgtacatcaagagagcccagacaggttcgggtggcgctgaccccaccaccgatgtatccggccagagctag

SEQ ID NO: 113795 - DNA, 3882 bp, Artificial Sequence
  Description of Artificial Sequence: Synthetic coding sequence
atggcgatgggggacgacaagagttttgacgacgaggaatctgtggatggtaacaggcccagttcagccgccagcgccttcaaagtacctgcccctaaaacttcaggaaatcccgctaatagtgcacggaagccagggtctgcgggagggcctaaggtgggaggagcaagtaaggagggaggtgcaggcgcagtggacgaagacgattttataaaagccttcacggatgtaccaagtatacagatatactcttctcgggagctggaagaaaccctgaataagatcagagagatcctttccgatgataagcatgattgggatcagcgcgcaaatgcgctgaagaagatccgtagccttttggtcgccggagcagcccagtacgactgtttcttccagcacctgcgactgcttgatggagccttgaagctttccgcgaaggacctgcgtagccaggttgtccgcgaagcttgtattactgtcgctcatttgtccaccgttctagggaacaaatttgaccacggtgctgaggcaattgttccaaccctgttcaacctcgtgcctaactccgccaaggttatggccacatcgggatgtgccgctattaggtttattatcagacacacccacgtcccacgcctcatacccctgatcacaagcaactgtaccagtaagtccgtacctgtgcggcggcgcagctttgaattcttggatctcttgctgcaggaatggcaaactcactccctggagcggcacgcggccgtgctggtcgaaacaatcaaaaagggaatacatgatgcagacgccgaagccagggtagaggctcgaaagacatatatgggtttaagaaaccactttcctggtgaagccgagactctgtataactccctggagcctagctaccagaagagcctgcagacatatctaaagagcagcggttctgtggctagcctgccccaatccgatagatctagtagctcatctcaagaatccctgaatagacccttcagctccaagtggagcacagccaatccgtcaaccgtggctgggagagtctcagcggggtcttcaaaggcgtcctccctgccgggcagcctccagcggagcaggtccgatatcgatgtgaacgctgctgccggtgccaaagcacatcatgccgcaggacagtccgtgaggagtggtcgactcggagctggagcattgaacgctgggtcatacgccagtctggaggatacaagcgataaattggacgggaccgcctctgaagatggcagggtccgcgccaaattatcagctcctctggctggcatggggaatgctaaggctgatagtcggggcaggtcacggacaaaaatggtcagtcagtcgcaaccagggtctcgctctggttccccaggcagggttctgaccacaacagccctctccaccgtcagttcgggcgtgcagagagtgcttgtcaattctgctagcgcccagaagcgttccaagataccacggtcacaggggtgcagtagagaggcctcacctagcaggctttctgtagcgcgcagctcccgtatcccccgaccttcagtgtcccagggatgcagcagggaggcatccagagaaagttccagagatacatctcctgtgcggtccttccagccccttgcttcacgacaccactctaggtctaccggggccctctacgctcctgaggtgtatggcgcttccgggcccggatatggaatctcacagagctccagattgagctcaagtgtgtctgccatgcgtgtgctgaacacgggttcagatgtggaagaagccgtcgccgacgcactaaagaaacccgcgaggcgtaggtatgaatcctatgggatgcactccgacgatgacgccaactctgacgcctcctccgcctgctcagaaagaagttactctagccggaacggcagtatccccacatacatgcgccagaccgaagacgtcgctgaggtgctgaatcgatgtgcgtcctcgaactggtccgaaagaaaggaaggcttactgggtctacaaaacttactaaaaaatcaacgtaccctgagtcgcgtcgagcttaagcggctctgcgaaattttcactcggatgttcgcagacccccacggaaaggtcttcagcatgttcttagagacactggtggattttattcaggtacacaaggatgatcttcaagattggcttttcgtgctgctgacccagctgctgaaaaaaatgggcgcggatctgctgggcagcgttcaagctaaggttcagaaggctctcgacgtgacacgcgagtctttcccaaatgatttacagttcaacatcctgatgcgcttcaccgtagaccagacccagactccatccctcaaggttaaggtcgctattctcaaatacattgagaccctagctaagcagatggatccaggtgattttatcaacagtagtgagacaaggctggcagtgtcgcgagttattacttggacaactgagccaaagtcttccgatgttcggaaagctgctcaatccgttttgattagcctctttgaactgaacactccagaatttaccatgcttctgggggcactgcccaagaccttccaggatggagcaacaaagctgctgcataatcatctgcgtaatacaggtaacggcacccaaagtagtatgggaagcccacttactcgtcccacacctaggtccccagctaactggtcttcccctctgacttcgcctaccaacactagccagaataccctctccccaagcgcattcgattacgacactgagaacatgaactcagaggacatttattcctctttacggggtgtcaccgaggcgattcagaactttagctttcgctcccaggaagatatgaatgagccactgaaaagagattctaagaaggacgatggcgactccatgtgcgggggccccggtatgtcagatccgcgagctggtggcgatgccaccgattccagccagacggctctcgataacaaggcttcactcctgcattcaatgccgacgcactctagtccacgaagccgggattataacccatataactactcagactccatttcccccttcaacaaaagtgcactcaaggaagctatgtttgatgacgatgccgaccagtttcctgacgatttatccctggatcactcggacttggtggcagaactcctgaaggaattgtctaatcacaacgaaagggtagaggagcgcaagatcgcactatacgagctgatgaaactgacgcaggaagagagtttttcagtgtgggacgaacactttaaaactatcctgctcctgctgctggagaccttaggcgataaagaaccaaccatacgagccctggcattaaaggtcctgcgtgaaatcctgcgacaccagcccgctcgtttcaagaattacgccgagcttacggtcatgaaaacactagaggcccacaaggacccacataaggaagtcgtgcgatcagctgaagaagcagcttccgttctagctacgtccatctcacccgaacagtgtatcaaggtcctgtgccctatcatccagactgctgattatccaatcaatcttgcagctattaaaatgcagactaaagtaattgagcgcgtttctaaagaaacacttaatctccttttaccggagataatgcctggactcattcaggggtatgacaactccgagtcttccgtgaggaaggcatgtgtgttctgtctggtggccgtccatgcggtgatcggtgacgaattgaagcctcatctgagccaattaactggttctaaaatgaaacttctaaatctctacatcaagagggctcagaccggctcaggtggggccgatcccaccactgatgtttccggccaatcttag

SEQ ID NO: 113796 - DNA, 3192 bp, Artificial Sequence
  Description of Artificial Sequence: Synthetic coding sequence
atgcgcaggctgatatgtaaaaggatttgtgactataaatcttttgatgatgaagagagtgttgacggcaataggccatctagcgccgcgtccgcattcaaagtcccagcccccaagaccagtggtaatccagctaactctgctcggaaaccaggctctgctggcggtcccaaagtgggagaactgctctccatcatgatatactcgtcgagggaactagaggagacactcaataaaattagggaaattctgtctgatgataaacatgattgggaccagcgagcaaatgcgctaaagaagattagaagtttgctggttgccggtgcggcccagtatgattgcttctttcaacatctgcggttgctggatggagccctcaaactgtcagccaaagatctacgctctcaggtggtgcgcgaagcgtgtatcaccgtggcccaccttagcactgttttggggaataaatttgatcatggggctgaagcaatcgtacccaccttatttaacttagtgccaaatagtgcaaaagtaatggccacatctggctgtgcagcaatacgcttcataatcagacacacacacgtccccagactgatccccctgattacatcaaactgtacctctaaaagcgtgcccgtacgcaggcgatcattcgagttccttgacctcttgttacaggagtggcagacccattcactcgagcgccatgccgccgtgttagtcgagaccatcaagaaaggaattcatgacgcggacgccgaagcacgagtggaggctcgtaagacctatatgggtctgaggaaccactttcccggggaggccgagaccctatacaatagtttagagccttcctaccagaaatcccttcagacttacctcaaaagctccggaagtgtcgcctcactcccgcagtcggaccgctcttcttccagctcccaggaatcgctcaaccgtcctttcagctcaaaatggtccacggctaacccgtccacggtggcaggtcgtgtgagcgccggaagttctaaagcctcaagcctgcccgggtcactccagagaagccggagcgatattgacgtcaatgcagccgccggggcaaaagcccaccatgccgccggccagagtgtcagaagcggccgccttggggccggggcactcaacgcaggctcatatgcatctcttgaggacacatcggataagctggacgacctgttctcagacaacgggcgggttagggccaaactgtcagcgcccctcgccggcatggggaatgccaaagcagacagccgaggaagatcgagaaccaaaatggtgtcccagtcccagagatcatcttcccctgataagaatgagggatcacagagtgctaacaccatcggcgcaggctcccgttctggcagcccaggcagagtgctcaccacaactgccttgtctacagttagttctggagtgcagcgtgtactggtgaatagcgcctcagcacagaagcggtctaagatacccaggtcacagggatgcagtagggaggcctcaccctcgagactctccgtggctcgctcgagtcgcatccccagaccctccgttagccagggctgcagtcgcgaggcttccagggaaagtagcagagatacctcaccagtacggagctttcagcccctgggaccgggatatggaatcagtcagtccagccgcttatcctcttcagtcagtgcaatgagggtactgaacaccgggtccgatgttgaagaggccgtcgccgatgctttggttcttttcgattttaaaactaagaagaagcctgctaggcgccgatacgagagctacggcatgcactcagatgacgatgccaactccgacgcctccagtgcttgctcagaacggtcctatagttctcgtaatggaagcattcccacctacatgcgacaaacggaagacgtcgccgaggtgctgaaccggtgcgcttcatccaactggagcgagcgcaaagaaggacttctgggcttacagaacctcctcaagaatcagcgcaccctgtctcgcgtcgagttaaagcgcctgtgcgagatttttacaagaatgtttgcagaccctcatggaaaggtgtttagcatgtttctagaaacacttgtggacttcattcaggtgcacaaggatgatcttcaggattggctattcgtgctactgacacagctgctcaagaagatgggagctgacctgctgggcagcgtccaggctaaggtacagaaagctcttgacgtcactcgcgagtcgtttccaaatgatctgcagtttaacatactcatgcggtttacggtcgaccaaacccagacgccctccctgaaggtaaaggtagccatcctaaaatatatagaaacactcgcgaaacagatggatcccggggattttatcaactcttctgaaactagattggctgttagccgagtgattacttggacaaccgaacccaaatcatcggatgttagaaaggccgctcaatccgtgctcattagtcttttcgaattaaatacacctgagtttactatgttactgggcgcccttccaaagacctttcaagatggcgctaccaagctgcttcacaatcatctgcggaatacagggaacgggacgcaatccagtatgggcagtccgctgacaaggccaacaccgagaagccctgccaactggtcttcccctctgacttcccccaccaacacttcccagaacaccctctcgcctagtgccttcgactacgacaccgagaacatgaattccgaagacatttattcatcactccgtggggtcaccgaggccatccagaacttttctttcagaagtcaggaggatatgaatgagccgttgaagagagacagtaagaaggacgacggagacagtatgtgtggaggtcctggcatgagtgatccgagggctggcggagacgctacagactcatcccagacggccttggacaacaaagcaagtctcctgcattcaatgcctacacattcaagcccccggagtagagattacaacccctataattattcagactctatatccccgtttaataaatctgctctgaaagaggccatgttcgatgacgacgcagatcaatttcctgacgacctcagcctggatcattctgacctggtggccgagctcctgaaggagctttcgaatcataatgaacgggtgtag

SEQ ID NO: 113797 - DNA, 1680 bp, Artificial Sequence
  Description of Artificial Sequence: Synthetic coding sequence
atgccccctccaagcccggacagtgaaaatggattttatcctggactgccaagttcaatgaacccggcattcttccccagcttcagccccgtctcccctcatggttgtaccggtttaagtgtgcctacttcgggcggcgggggaggcggtttcggaggccccttcagcgcgaccgccgtgccccctcccccacctcccgctatgaatattccccaacaacagcctccacctcccgctgccccccaacagccacagtctagaaggagtccagttagccctcagcttcagcagcagcaccaagcagccgcagcagcatttctgcagcagaggaactcctacaaccatcatcaacccttgctgaagcaatctccatggagtaaccaccagtccagcggatggggcaccggcagcatgagttggggagccatgcacggacgggatcacagaagaacaggcaacatgggtatccccggaacaatgaaccagatttcgcctctgaagaaacccttttctggtaacgtgattgctcctcccaaatttacccgctccacgccgtctctgacaccaaagagttggatagaagacaatgtattccgaaccgataataactccaatactcttttgcccttacaggacaggtctcgcatgtatgactctctaaatatgcacagcctggagaattccctaattgacatcatgcgggcagagcatgaccccttaaaggggagacttagctatcctcacccaggcaccgacaatcttcttatgctcaacggaagatctagcctcttccctatcgatgacggactactagacgatggtcattctgatcaggtgggagtgctcaactctcctacttgctactctgctcatcaaaacggcgagcgtatcgagcgattctccaggaaggtgtttgtggggggactgcctcctgacatagatgaggatgaaattacagcttcttttcggcgctttggcccattagtggtggattggcctcataaggccgagtccaaatcatatttcccccctaagggctacgctttcctgctgtttcaggaagagtcttctgtgcaagccctcattgatgcctgtatcgaggaggacggaaagctgtacttatgcgtatcttccccaaccataaaggacaagccagtccagatccgcccatggaacctcagcgatagcgattttgttatggatggctctcaaccattagatccccgtaaaaccatttttgtcggcggtgtcccgaggcccctgagagccgttgaactggccatgattatggacaggctgtatggcggagtgtgttacgccggtatcgataccgatcccgaactgaaataccctaagggcgcaggaagggtggcttttagcaaccaacagagctacatcgccgccatctccgctcgatttgtccagctgcagcacggcgatatcgacaagcgagtggaagtaaagccttacgttctcgacgaccagatgtgtgatgagtgccagggcgctcggtgcggtgggaagtttgctccattcttctgcgccaatgtaacctgcctgcaatattactgtgagttttgttgggctaacatccattccagagcaggcagagagtttcataagcctctcgtcaaggaaggggcagatcgaccgcgccagattcacttccgatggaattag

SEQ ID NO: 113798 - DNA, 1731 bp, Artificial Sequence
  Description of Artificial Sequence: Synthetic coding sequence
atgcccccaccgtcccccgactctgagaacggcttttatccgggactcccaagtagtatgaatcccgctttcttcccctccttctctccagtgtcgccacacggctgcactggcctgagcgtgccaccaccacccgcaatgaacattccacagcaacagccaccacccccagctgcacctcaacaaccacaaagcaggcgctctccggtgtcaccacagctccagcagcagcaccaggctgccgctgctgcatttctacaacagcgcaactcctacaaccaccaccagccactacttaaacagagcccttggtcaaaccaccagtccagcgggtggggcacgggatcaatgtcttggggagctatgcacgggagggatcaccgtcgaaccggtaatatgggtataccaggaacaatgaaccagatctcaccattgaagaaaccattcagcggcaacgtgattgcccctcctaagttcacccgcagcacaccgagcctcacccctaagagttggatcgaggataatgtcttccgaactgacaacaacagtaacacactgctcccactccaggtccggtcctccttgcagctgccggcctggggctccgattcccttcaggatagttggtgtacggcagccggcactagccgcatagatcaagacagatcccggatgtacgatagcctgaatatgcacagcctggagaactccctcattgatataatgagggccgagcacgatccgctcaagggaagactgtcctatccccatcccggcactgacaacctcctgatgctgaacgcacgctcctacggtagaaggcgggggaggtcttcactgttcccgatcgacgatggactgctggacgacggacatagtgaccaggtgggtgtccttaattctcctacttgttatagtgctcaccagaacggtgaacggatcgagcggttttcccggaaagttttcgtcgggggcctgccaccagatatagacgaggacgagatcactgcgagtttccggaggttcggtcctctcgttgtggactggccccataaagcagaatcgaaatcctactttccgcccaagggatatgcctttctgcttttccaggaggaatcgagtgtgcaggcccttattgacgcttgcatcgaggaggatgggaagctgtacctctgcgtcagttctcctaccattaaggacaagcccgtgcaaatccgcccctggaacctgagtgatagcgattttgtgatggacggttcacagcctctggatccacgcaaaactatctttgtgggaggggtgccccgccctctgcgggccgttgagctagccatgattatggatcggttgtacggcggtgtctgttacgccggtatcgacacagaccctgagcttaagtatcctaagggtgccgggagagtcgctttttctaaccagcagtcatacatcgccgcaatatctgctagattcgttcagctgcagcacggtgacatcgacaaacgcgttgaggttaaaccgtacgtgctcgacgatcagatgtgtgacgagtgtcagggcgctagatgcggcggcaagttcgcaccctttttttgcgcaaatgtaacatgtctgcagtactattgtgaattctgttgggccaacatccattcccgcgccgggcgggagttccataaacccctggtgaaggagggggcagaccgcccgcgccagatacattttagatggaactag

SEQ ID NO: 113799 - DNA, 1704 bp, Artificial Sequence
  Description of Artificial Sequence: Synthetic coding sequence
atgccgcccccttctccagattccgaaaatggcttttaccctggcctgccttccagcatgaatcctgcattctttccatccttctctcctgtctccccacacggatgtacaggcctgagcgtccctacttccggggggggagggggcggttttggtggtccgttctctgcaacggctgtgcctcctcctccccctcctgccatgaatattccccagcagcagccaccgcccccggcagccccacaacagcctcagagcaggagatcacccgtctccccacaactccagcagcaacatcaggccgccgcagccgccttcctgcaacaacggaacagttataaccatcaccaacctctcctaaaacagtctccctggagtaatcaccagtcctcggggtggggcacaggatcaatgtcctggggagcaatgcatggccgcgaccatagaagaaccggaaatatggggataccaggaacaatgaaccagatctcgccattgaagaaaccattttcaggaaatgtgatagcaccaccaaagtttacgcggtccacccccagccttacaccaaaatcgtggattgaagacaacgtattcagaacagacaacaactccaatactctgttgccactccaagatcggagcaggatgtatgacagtctgaacatgcactccttggaaaattctttgatcgacattatgagagctgagcatgacccactgaagggacgcctgtcataccctcatcctgggacagataacctgctgatgctgaatgcccgaagctatggccgcaggagaggacgcagtagcctgttccccatcgacgacgggcttttagacgatggacacagcgatcaggtgggagtattgaattctcccacgtgctactccgcacaccagaacggcgaacggatcgaacgcttctcccggaaagtgttcgtcggaggtctgccgcccgacattgatgaagacgagatcactgcctctttcagacggttcggtccactagtggtcgactggcctcacaaggcggaatctaaaagctatttcccccccaaggggtacgcctttctgctgtttcaggaagagtcctccgtccaggctctgatcgatgcctgtatagaagaagatggcaaactgtacctgtgcgtatcatccccgaccatcaaggacaaaccagttcaaatcaggccttggaacctgagtgactcagactttgttatggacggctctcagcccctggatccacggaagaccatttttgtcggcggcgtgcctagaccgctgcgggcagtggagttggccatgataatggatcgtctgtatggaggagtgtgctacgcaggcattgacacggatcccgagctgaagtatcccaagggggccggcagagtggctttctcaaaccagcaatcttatatcgctgccatcagcgctagatttgtacaactgcagcatggcgatatcgacaagagggtggaggtcaagccgtatgttcttgacgatcagatgtgtgacgagtgccaaggcgccagatgcggtggcaagttcgctccttttttttgcgccaacgtaacctgcctgcaatattattgtgagttctgttgggccaatatacattccagggccggccgggaattccataagcctttagtcaaagagggtgcagatcgccccagacagatacattttcggtggaactag

SEQ ID NO: 113800 - DNA, 1689 bp, Artificial Sequence
  Description of Artificial Sequence: Synthetic coding sequence
atgcccccaccatcccccgactccgagaatggattctacccaggactgccttctagcatgaatcccgctttttttccatcgtttagtccagtgagcccccacgggtgcacaggtctctccgtgcccacctccggagggggaggtggcgggttcggcggcccttttagcgctactgcagttcctcccccgccaccaccagccatgaatattcctcagcaacagcctcctccacccgccgcaccacagcagcctcaaagccgtcgttccccggtgtcccctcagctgcaacagcaacatcaagccgccgcagctgctttcctgcaacaaagaaactcatataatcaccaccagcccctgcttaagcagtctccatggagcaaccaccagagctcagggtgggggacagggtcaatgagctggggcgcaatgcacggccgggatcacaggcgaacaggcaacatgggcattcccgggaccatgaatcagatctccccactcaagaagcccttctctggaaacgtcatagcacccccaaaattcaccagatccacccctagtctgacaccgaagtcttggatagaagacaacgtttttcgaaccgacaataatagcaacactctgctaccgctccaggtccgcatggaccgctcccggatgtatgattctctcaacatgcactcgctggagaattcactgatcgacatcatgcgcgcagagcacgatcccctgaaaggccgactgagttacccacatcccggtacggacaacctgctgatgctgaatggccggtcttcactatttcccatagacgacggcctgctggacgacgggcactccgatcaagtcggcgtactaaatagccctacttgctactctgcccaccaaaatggagaacgaatcgagcgattctccagaaaggtgtttgttgggggcctgccaccagatatagatgaagacgagattacggcatcgttccgtaggtttggcccactggtggtggactggcctcataaggcagagtccaaaagttacttcccccccaagggatacgctttcctcctattccaagaggagtctagcgtccaggccctgatcgatgcatgtattgaggaggatggaaagctgtacctctgtgtcagcagccccactataaaagataaaccggtacagatcagaccatggaacctctcggattccgatttcgtgatggacggaagccagcccttagatcccagaaagaccatctttgtgggcggggtcccccgaccactgcgggccgtagagctggctatgatcatggatagattgtatggcggagtgtgttacgccggaattgatacagaccccgaattaaaatacccaaagggcgctggaagggtggccttttcaaaccaacagagctacatcgctgctatcagtgctcgatttgtgcagttgcagcacggggatatcgataaacgtgtggaagtcaaaccctacgtgctggacgatcaaatgtgtgatgagtgccagggcgctaggtgcggcggcaagtttgctcccttcttttgcgcaaacgtcacctgtctgcagtattattgtgaattttgctgggccaatatccactcacgggctgggcgggagttccataagccactcgtaaaggaaggcgctgatcgtccccgacagatacatttccggtggaactag

SEQ ID NO: 113801 - DNA, 3024 bp, Artificial Sequence
  Description of Artificial Sequence: Synthetic coding sequence
atgcgtgactttggattcggagtgctgcagaccgcccctcttagaagttcttccccagggccactattctgtggcgaagcctacggtccatacgccgtgggctctgtcaacccactaccgtctgcaaccccatttggaccactcagcccacccccattacctgtgacgggtttcctcgaagccgcatcacctttctccgtacccctcgggggcggtgcaggctcccctgctgcagcagcctcgagcagtagcccctttctggcacaccagcaaaccatgcaggacgagctattattgggcttgacccagcagccagcaagaccgttgagcggggccgccgcaaccgaaaagctgcctgaccaccatccaggaggaggcacgatcgcaggggtgacccatttgctgccctctcaggattttaaacctagtctgcaccaccccagctccagctcagccagctcatgctgttgctgtaggacgtcaagccctcaggacttcagcaagagacaacagcagcaactgtcttcccaaaaacggaaggagtttagccctccacacctgccacacccccccgacagtaaaccacctccccctccgccaccactgcactgccctggccggttctcccctcccccgccaccggccggcccgctgctgcagccggcacagctggcccagcgccagcagcagcagcctcctcaacaattcagcctgcttcaccagcagcacctatccccgcaggactttgcccctagacagagacccgcagacctaccgcctctcccacagctgccacccagtccccccgccgctccccgccgcagacatggcggggccggttcccctcgcaaaacccccgccgccggagaggggagtgctgcagagtctccaaacgcaggcctggcatcgtcgacccctgttaaccccgcccctggttccatggaaagccctaaccaccctctactgaattcaccctccaaccttttaccagggggcgcgctcggtgccggcgctttctcctccctgcagagcccggacttgcctcaccccggaggcggtggcggcggcggcggcggaggccctccaggggggggcgggggtggaggttctgcgagccctccacctctgccgggtttcgggaccccctggtctgtgcagacagcaagcccccccccgcaaccccagcaacctccccctacacagccacagcaacagcctccaccacctcagcagcccccacaaccccaacctcagccccctggaagtagcgcaaccactcctggggggggcagcggaggcagtctgtccgcaatgcctccgccatcccctgacagcgagaacggattctatcctggcttgcctagcagtatgaatcctgcttttttccccagcttcagtcctgtgtccccccatggttgtaccggcctgagcgtcccgacttctggcggtggaggcgggggattcgggggccctttttctgccaccgctgtgccaccccctccacctcctgcgatgaatatcccacaacagcagccccccccgcccgccgcaccgcagcaaccacagtcaagacgatcacctgtgtccccacagctgcagcagcagcaccaggctgcagcagcagcgttcttgcagcagagaaacagctacaaccaccaccagcccttgctgaagcagagtccctggtcaaaccatcagtcatctgggtggggcaccggaagtatgtcttggggagccatgcacggccgcgaccacaggcggacaggcaatatggggattccgggtactatgaatcagattagccctttaaagaaacccttctcagggaatgtgattgctccacccaagttcactcggtctactccgagcctgacgcccaaaagctggattgaggacaatgttttcagaactgataataacagtaatacattgctccccctgcaggtgcgaatggaccggagtcggatgtacgactccctaaatatgcattcgctggagaattctctgatcgacataatgcgagcagaacacgacccgctgaaaggacgccttagctatccgcaccccggtacagacaatctgctgatgctgaatgcgagaagctacggaagaagaaggggtcgctcctctttatttccaattgatgacggattgctggacgacggacattcagaccaggtgggagtgctcaattcaccgacctgttactctgcacatcagaatggagagagaatcgaacggttctcacgcaaagttttcgtgggcgggctcccgcctgacattgacgaggatgaaatcacagcttcttttcggaggttcggacctctggtagtcgactggcctcataaggctgaatcaaaaagttactttcccccaaaaggctacgcctttcttctttttcaggaggagtcttcggtgcaggcactgatcgacgcctgcatcgaggaagacggaaaactgtacctgtgtgtgagtagtccaaccattaaagacaagccagtccagattagaccgtggaacctaagtgatagcgatttcgtcatggacggatcacagccactggacccccgcaagactatctttgtgggaggggtgcctcgcccactgcgcgccgtcgagctggcgatgatcatggacagactgtatggaggagtctgctatgcgggaatcgacacagacccagaactgaaataccccaaaggtgcaggtcgcgtggcattttcgaatcagcaaagttatatcgcagctatctccgcgaggttcgtccagctccaacatggggacattgacaaaagagtggaggtgaagccctatgtgttggatgaccagatgtgtgacgagtgccaaggtgctcgctgcggtgggaaatttgccccatttttctgtgctaacgttacatgcctgcagtactactgtgagttctgttgggccaacatacatagtcgggccgggcgtgagtttcacaagcctctggtaaaagagggagcagatcggcctagacagatacatttcagatggaactag

SEQ ID NO: 113802 - DNA, 1770 bp, Artificial Sequence
  Description of Artificial Sequence: Synthetic coding sequence
atgccacctccttctccagattctgaaaatggtttctaccccggtctcccatctagcatgaatcccgctttctttcccagcttcagtcctgtctctcctcatggctgcactggcctttccgtgccaacttctgggggaggcgggggaggattcgggggaccttttagtgctaccgccgtgccaccccccccccccccagccatgaatatcccacaacaacagccacctcctcctgccgcgccccagcagcctcagtcacgccggtctccagtatccccccaactgcagcagcagcatcaggcagccgccgccgcatttcttcagcagagaaatagttacaatcaccaccagcctctgttgaagcagagcccatggtcgaaccatcagtccagcggctggggcaccggatctatgagttggggagctatgcatgggcgagatcatagacggacagggaatatggggattccaggaacaatgaaccagattagtcccctcaaaaagcccttctccggaaatgtaatagcaccgcctaaattcacaagaagtaccccgtctcttactcccaaaagttggatagaggataatgtttttagaactgataacaattctaacacactgttacctctgcaggtaagaagctcactccagctcccggcatgggggtctgacagcctccaagatagctggtgtaccgccgctggcacctcccggatcgatcaggaccgttcacgaatgtatgattccctgaacatgcattcgttagagaattctctcatcgacataatgcgggccgagcatgacccgctaaaaggtcgccttagctacccgcaccctggtaccgacaatttactgatgctcaatggacggagttccctttttcctatagacgacggtctgcttgatgatggacactccgatcaggttggcgtcctcaacagtcccacgtgttactccgcccatcagaacggagaacgaatcgagcgtttcagccgtaaggtcttcgttgggggattgcctcctgatattgacgaggacgagattacagccagctttcgtcgcttcgggccactggtagtggattggccccacaaggcagagagcaaaagctattttccgccaaaaggctacgcgttcctgctgttccaagaggagagcagcgtccaggccctgattgatgcttgcattgaggaggatggtaaactatacctgtgcgtttctagtccaactattaaggacaagcctgtccagattaggccctggaacttgagtgacagcgatttcgtaatggacggctctcagccactggacccacgaaagacaatcttcgtgggcggcgtccctcgaccactgcgcgccgtcgagctggccatgatcatggataggctctacgggggcgtgtgctacgcgggtattgacacagacccagaactcaaataccccaagggcgcaggacgcgtggcattctctaaccagcaatcttacattgcagctatctcagcccggtttgtccagctgcagcatggagacattgataaaagggttgaggtgaagccctatgtgctggatgaccagatgtgtgatgaatgtcaaggggcccgatgtggaggcaagtttgctccgtttttctgtgccaatgtgacatgtctgcaatattattgtgagttttgttgggccaatatccattccagggccggacgtgagttccataaaccactagtgaaggagggcgctgatcgaccccgacagatccattttcggtggaactag

SEQ ID NO: 113803 - DNA, 3105 bp, Artificial Sequence
  Description of Artificial Sequence: Synthetic coding sequence
atgcgagatttcgggtttggcgtgctacaaacagcacccttgaggtcttcctcacccggcccgctcttctgcggggaggcctatgggccttacgctgtgggtagcgtcaaccccctccccagcgctacgcccttcggacctctttcccccccccctctgcctgtgaccggcttcctggaggctgcatccccgttttcagtgcccttaggtggcggggcgggctcacctgctgctgctgcatcctcttcctctccgttcctggcgcaccagcagaccatgcaagatgagttgcttctaggcctgacgcaacagccagcaagaccgttatcaggagccgccgccaccgaaaagctacctgaccatcatccggggggagggaccattgctggcgtgacccacctgcttccatcccaggatttcaaacccagcctccatcatccatccagttcatcggcatcatcatgttgttgctgtaggacctccagtccccaggacttttccaagaggcaacagcagcagctgtcatctcagaaacgcaaagaattttcaccgccccatttgcctcaccctccagactccaagcctccacctcccccccctccgctccattgtccaggacggtttagcccaccaccacctccagctggtcctctgctgcagcccgctcagctagcacagcgccaacagcagcaaccacctcaacaatttagcctcttacatcaacagcacctgtctccacaggattttgcgcccaggcagaggcccgctgaccttccgcctctcccacagttgcccccctcacctcctgccgccccacgtcgaaggcacggtggggccggaagccctagaaaaactccagccgccggcgagggttcagcggccgaatcacccaacgccgggttagctagttccactcccgtgaatccagccccgggatccatggaatcccccaatcacccccttcttaatagtccctcgaacctgctccctgggggggctctcggcgcaggagcctttagctccctgcagtccccagaccttcctcaccctggcgggggtggagggggcggtgggggaggaccgccaggaggagggggtggaggtggaagcgcaagtccccccccgctccctggctttggcacgccctggagcgtacagacagctagtcctcctccccagccacagcaaccacctcctacccaacctcaacagcaaccccctcctccgcagcagccaccacagccccagccgcagcccccaggctccagcgccaccacaccaggaggcggcagcgggggatctctttcagcaatgccccctcccagtcccgactccgagaacggcttttatcctggattgccgtcctccatgaatcctgccttttttccatctttcagccccgtgtcgccccacgggtgtacagggctcagcgtgccaactagcgggggcggaggtggagggttcggaggcccattctctgccaccgcggtgccaccgccgccgcccccagctatgaacattccgcagcagcagcctccacctccggccgctccacagcagccacaatcccgacggtccccggtatctccccagttacagcagcagcatcaagcagccgcggcagcatttctgcagcagagaaactcctataaccaccatcagcctctgttaaagcaatctccctggagtaatcaccagtcaagcggttgggggactgggtctatgtcttggggagcaatgcatggcagggaccatcggagaaccggcaacatggggatcccgggcacaatgaaccaaatctctcccttaaagaaacccttctccggaaatgtcattgcgcctccaaaatttacccgaagcacgccctccctgacaccaaaaagttggatcgaagacaacgtctttcgcacggataataacagcaacactctgttaccgctacaggtgcggtctagcctgcagctgcctgcctggggatccgactcactgcaggactcgtggtgtacagccgcaggaacatcaaggatcgatcaggatcgcagtagaatgtacgattcgctgaatatgcattcactagaaaattccctaatagatattatgcgggcagagcacgacccactgaagggtagattgagttatccccaccctggtacagacaacctattaatgctcaacgctcgcagctatggaagacggcggggcaggtcatcccttttccccatcgacgacggtctcttagacgacggacactccgatcaggtgggagtcctgaactcacctacatgctactctgcccaccagaatggagaaagaattgagagatttagccggaaagtttttgtgggcggactgccaccagacatcgacgaagacgaaatcacagcatcttttagacgttttggacccctggtcgtcgactggcctcacaaggctgagtccaaaagttacttcccacccaagggttatgccttcctcctctttcaggaggaatccagcgtacaggcgcttatcgacgcctgcattgaggaagatggaaaactgtatctgtgcgtgtcttcccccacaattaaggacaaacccgtacaaatcaggccctggaatctgagcgacagtgacttcgttatggacggctctcagcccttggatccgagaaagactatattcgtgggcggcgtgccccggcctctcagagccgtagaacttgctatgatcatggaccgactgtacggtggggtctgctacgcgggcatcgatactgatccagagcttaaatatccaaagggcgcgggcagagtggcattctctaatcagcaatcctacatcgcggcgataagtgctcgcttcgtacagttacagcatggcgacattgataaacgcgtcgaggtgaagccatatgtgctcgatgaccaaatgtgtgacgagtgccagggggctcgatgtgggggcaaattcgccccttttttttgtgcaaatgtgacctgcctccagtactattgcgagttttgttgggcgaacatacattccagagctggacgtgaattccataaaccactggttaaagaaggagcggataggcctcgccagatccactttcggtggaattag

SEQ ID NO: 113804 - DNA, 3081 bp, Artificial Sequence
  Description of Artificial Sequence: Synthetic coding sequence
atgcgcgatttcgggtttggagtccttcaaacggcgcctctgcgcagcagttccccgggccctttattttgtggggaggcctatggtccctacgctgtcggatccgtgaacccgctcccgagcgctactccattcgggcccctctcacctccccctcttccggtgaccggattcctcgaagcagcttcgcccttctccgtccccttggggggcggagctgggtctccagcggcagctgccagctccagttccccatttctcgcacaccagcagactatgcaagacgagcttttgctcggactgacccagcagcccgcccggccactaagcggagccgcagccactgagaagttacctgaccaccatcccggaggggggaccatcgccggagtaacacacttactgccaagccaagacttcaaaccgagcttgcaccaccctagcagttcatcagcctcatcctgttgctgctgccgcacatcttcccctcaagatttttccaaacgacagcagcagcaactttctagccagaagagaaaggagttttcacctccccacctaccccatccccccgactccaaaccaccccctcctcccccaccacttcattgccccggtagatttagcccccccccccctccagccggcccactgctacaacccgcccagttggcacagcggcagcagcaacagcctcctcagcagttcagtctgctgcatcaacaacacttgtctccacaggatttcgcacctcgtcaacgcccagcagaccttcccccactcccccagcttccccctagtcccccagcagccccaagacggagacacggcggcgccggttctccacgtaaaacacccgccgcgggggagggaagcgctgctgaatctcccaatgccggtctcgcttcctccacgcccgtcaatcctgcaccgggttccatggaatcccctaaccaccctcttcttaactcaccctctaatctgctccctggaggtgccctaggcgcgggggcattttcctctctgcagtcccctgatctgccccaccctggtggcggggggggcgggggaggtggcggcccccctgggggaggaggcggcggcggatcagcgtcaccaccccccctgccgggctttggaacgccctggtccgttcagacggcctccccgcccccacagccacagcaacccccacccacccaaccccagcagcagccacctcccccccagcagcctccccagccccagccgcagccccccggcagcagcgcaacaacccccggtgggggctcaggtggatccctatccgccatgcctccaccatcacctgatagcgagaatggcttttacccgggcctgccctcttcaatgaaccctgcattcttcccctcattttcacctgtaagcccccatggctgcaccgggctgtccgtgcctacatcaggaggtggcggtggggggtttggcgggccattctctgcaacagctgttccccctccccctccccctgccatgaatatccctcagcagcagccacctcctcctgccgccccacaacagccacagtcgcggaggtctcccgtaagtcctcagctgcaacagcagcaccaggcggctgctgccgcgtttctgcagcagcgcaactcttataatcatcaccagccacttttgaagcagtcaccctggtctaatcatcagagttctggatgggggacaggctcaatgagctggggggctatgcatggcagggatcaccgcaggaccggcaatatgggaatccctggcacaatgaaccagataagcccactcaagaaaccattttcaggcaacgtcatcgcacccccaaaattcacacggagcaccccttccctcacccccaagagctggatcgaagacaacgtgtttcgaacagataataattcaaacactctgctacctctccaggtgcggagctccctgcaactgcctgcttggggatcagatagcctgcaggactcttggtgtacagccgccggaacttctcgcatcgatcaggacagaagtagaatgtacgactctctgaacatgcactctctggagaacagccttatcgatattatgcgcgccgagcatgatccactcaaagggaggctcagctatcctcaccctgggactgataacctgttgatgttgaacggacggagttctttgtttcctatcgatgatggtttgctggatgacgggcattctgaccaggtgggtgtgctcaactcacctacctgctatagcgcccaccagaatggggaacgaatcgaacgattttcgcgtaaggtattcgttgggggactgcctccagatatagatgaggatgaaattaccgcatccttccggcgcttcggccctctcgttgtcgattggccccataaagccgagtccaaaagctatttccccccgaaggggtacgctttcctgctctttcaggaggagtcctccgtccaggcccttatcgatgcctgtatagaagaggatggaaagctgtacctgtgtgtgtcgagccccaccatcaaagataaacccgtacagattaggccctggaacctgtctgatagcgacttcgtcatggatggatctcagccccttgacccgaggaaaactatctttgtcggcggagtcccacgtcccctgcgagcggtcgagttagccatgatcatggaccggttgtatggtggtgtatgctatgctggcatcgacacagaccctgagttgaagtaccccaaaggcgccggacgggtggccttctctaaccagcagagttatatcgctgccatttcagccagattcgtccagcttcagcacggggatatagacaaacgcgtggaagtaaagccctacgttttagatgatcaaatgtgcgatgaatgtcaaggggcacgatgtggaggcaaatttgccccctttttctgtgccaatgtgacatgcttacaatattactgcgaattctgctgggccaacatccatagtcgcgccggaagagagtttcacaaaccattagtgaaggaaggtgcagatcgtccacgacagatccattttcgttggaattag

SEQ ID NO: 113805 - DNA, 2097 bp, Artificial Sequence
  Description of Artificial Sequence: Synthetic coding sequence
atgcaggatgacctgctgatggacaaaagcaagacccaaccccagccccagcagcaacagcgccagcagcaacaaccccagccagaatcaagcgtcagtgaagctccctccacccccttgtcctcagagactccgaagccagaggagaattctgccgtacctgctctttctccagccgccgccccgcccgcgcctaacgggccagacaagatgcaaatggaatcccctctcttgccaggcctctcattccaccagccaccccaacagcctcctcctccgcaggagcctgcagccccaggcgcctctctctccccttctttcggaagtacatggtccacgggaaccacaaacgccgtcgaggactctttttttcagggcattacccccgtgaacggtaccatgctgttccagaactttccacatcacgtcaaccctgtttttggggggaccttttctccccagatcggcctggcccagactcagcaccatcagcagccacccccaccagcccccgcgcctcagccagctcagccagcccagccaccccaggcacaaccgccccagcaaaggaggtcccctgcttcacccagccaggctccatatgcccaaaggtccgctgctgcggcctatggccaccaacccattatgactagtaaaccgtcaagttcgtcagcagtcgccgctgcagccgccgcagccgctgccagctctgcatcgtcatcctggaacactcaccaatcagtgaacgcagcttggtcagcccctagtaacccttggggcggactgcaagcaggaagagaccccaggagggctgtgggcgtgggagtgggtgtgggagtcggagtgccttcccctctgaatccgatctcacctcttaagaagcccttcagctcgaacgtcatcgctcctccgaagtttccacgggcagcccctttaacatcaaaatcctggatggaggacaatgccttcagaacagataacgggaataacttactcccatttcaggaccggtctcgaccgtacgatacctttaatctccacagcctggaaaactctctcatggacatgatccggacagaccacgagcccttaaaaggtaaacactaccccccatccggccccccaatgtcctttgcagatattatgtggcgtaatcatttcgccggtcgcatgggaattaattttcatcaccccggcacggacaacataatggccctcaacaatgcgttccttgatgactcccacggcgatcaggccctgagctccggtcttagctccccaaccaggtgccagaatggggagagagtcgaacgatatagccggaaggtgtttgtcggggggctcccccctgacatcgatgaagacgaaataaccgcttccttccgccgctttggccccttagtagtggattggcctcacaaggccgagagtaaaagttattttcctcccaagggatacgcatttctcctgtttcaagaggagtcatcggtgcaggcactgatcgatgcatgccttgaagaagacggaaaactgtatctgtgcgtaagctctcccacaatcaaggacaagcccgtgcaaatacgaccctggaacctgtccgacagtgactttgtaatggacgggtctcaaccattagatccccggaaaactatctttgtcggcggggtgccacgcccgcttagagctgtcgagttagcgatgatcatggaccggttatacgggggcgtgtgttacgccggcattgacactgatcctgagctgaagtacccgaagggggccggacgtgttgccttttccaaccagcagagctatattgcagccatctccgcaaggtttgtccaattgcagcataacgatattgacaaaagagttgaagtaaagccatacgtgttggacgatcaaatgtgcgacgagtgtcagggaacgaggtgcgggggtaaattcgctccgtttttctgcgcaaacgtgacgtgtctgcaatattactgcgaatactgttgggccagcatccacagtagggccgggagggagttccataagccgctggttaaggaaggaggtgaccgcccccgccacgttccatttcggtggtcctag

SEQ ID NO: 113806 - DNA, 2055 bp, Artificial Sequence
  Description of Artificial Sequence: Synthetic coding sequence
atgcaggacgacctgctgatggataagagtaaaacccaaccacagccacagcagcaacagcgacagcagcagcagccccaacccgagtccagcgtgtcagaggcaccatctacccccctgtcttccgagacccctaagccagaagagaattcagcagttcctgcgctgtcccccgcggctgcaccccctgcacccaacggacctgacaagatgcagatggagtctccattgttacccggcctgagttttcatcagcccccccagcagccacctcctccacaagaaccagccgcacctggcgcatcactctccccttcctttgggagcacttggagtactggcaccacaaacgcagtagaggactcattttttcaggggattacccctgtgaacggcacaatgctgtttcagaacttcccccatcacgtcaaccccgtctttggtggtactttctcccctcagataggactcgcacaaactcagcatcatcagcaaccgcccccgccagcaccagccccacaacctgcgcaaccagcccagccgccccaggcccagcctcctcagcagcgaagaagccctgcttcccccagccaggctccttacgcccagaggtctgccgcggcagcctatggccaccagccaatcatgactagcaaaccatcttcttccagcgcagtggccgctgcagcggccgccgctgccgcaagttctgctagttcaagttggaacacccatcagagtgtgaatgccgcgtggagtgctccgtccaacccttgggggggtctccaagccgggagggacccacgccgcgcagtgggggtgggggtcggtgtcggagtgggagtaccaagcccattgaatccgatctccccattaaagaagcctttctcctccaatgtgattgcaccccctaagtttcccagagctgccccattaacaagtaaatcctggatggaagacaatgcctttcggacagacaatgggaataatttactcccttttcaggacagatcacgcccatatgacactttcaatctgcattcactggagaatagtctgatggatatgattaggacagaccatgaaccgctaaagggacggatgggtattaactttcaccaccctggaaccgacaacatcatggccctcaacagcagatcctcactcttcccgttcgaggatgccttcttagatgatagccatggcgatcaggccttgtccagcgggctgagtagtcctacccggtgtcagaacggcgagcgagttgagcgctactcacgtaaggtattcgtgggtgggctgcccccggacatcgatgaggatgagatcacggcctcatttcgtcggttcggacctttagtggtggattggcctcacaaggctgagagcaagtcctatttccccccaaaggggtacgctttcctcctctttcaggaggagagctcagtgcaggcgctgatagacgcttgcctggaggaggatggaaagctttatctctgtgttagcagtccgaccattaaggataagccagtacagattagaccctggaacttatcggattccgactttgtgatggatggtagccaacccttggaccccaggaaaacaatcttcgttggcggagtccctcgcccactgagggcagtcgagctcgccatgatcatggacagactgtatgggggcgtgtgctacgccggaattgacacagaccctgagcttaaataccctaagggtgcagggagagttgcctttagcaaccagcagtcctacattgcagcaatttccgctcgattcgtgcagctgcagcacaatgacattgataagagagtcgaagtcaaaccctatgttctagacgaccagatgtgcgatgagtgtcagggaactaggtgcggcggcaagtttgcaccttttttctgtgcaaacgtgacttgcctgcagtattattgcgaatattgctgggcatctatccactcgcgtgccgggcgggagtttcacaagcccttagtcaaagaagggggggatcgacctcggcacgtaccctttagatggagctag

SEQ ID NO: 113807 - DNA, 2055 bp, Artificial Sequence
  Description of Artificial Sequence: Synthetic coding sequence
atgcaagacgatctcctgatggacaaaagcaagacacagccccagccgcagcagcagcaacgtcagcagcagcagccccagcccgaatcatcggtgagcgaagcgccgtctacaccattaagtagcgagaccccaaagcctgaggagaatagcgctgtaccagccttgagcccagccgctgctccaccagctccaaatggtcccgacaaaatgcagatggaatcgccactcttgccaggcctctcgttccaccagccaccacagcagccgcctcctcctcaggaacccgctgcacccggagcctcactcagtccaagctttggatcaacctggagcacaggcacaacgaatgcagttgaagattcctttttccagggaatcactcctgtgaatggaacaatgttgttccaaaatttcccacatcacgtgaacccagtgttcggaggaacattttccccacagataggcctggcccagacccagcaccaccagcaaccccccccccccgccccagcaccccagcctgcccagccagcacagcctcctcaagcccagcccccacagcagcgccgtagccccgcctctcccagccaggccccatacgcccagcggagcgcagcggccgcctacgggcaccagcctattatgaccagcaagccttcttcctcttctgctgtcgctgcggcagcagccgctgccgctgccagctctgccagttcatcttggaacactcaccagagtgtgaatgcggcatggagcgctcctagtaacccctggggcgggttacaggctgggcgtgacccacggcgagctgtcggagtcggagtaggggtaggagtcggggtgccgagcccccttaacccgatttccccgctcaagaaaccattttcttctaacgtgattgcaccgccgaaattccctcgcgctgcacccctgacttcaaagagttggatggaagataacgccttccggacagacaatgggaataacttgcttccattccaggataggagcaggccatacgatacttttaacttgcactccttagagaattccttgatggatatgattcggactgatcacgagccactgaagggacggatgggcattaatttccaccacccaggcacagataacatcatggcgctgaactcaaggtctagcttattcccctttgaggatgctttcctggacgattctcatggagaccaggccttgtcttcaggactctcttcccctacccgctgccagaacggggagcgggtcgagcgctacagtagaaaagtttttgtaggcggtctgccacctgatatcgacgaagacgagattactgcgtcgttcaggcgatttggacccctggttgttgattggcctcacaaggctgagagcaaatcctactttcctccgaagggttatgctttcttgctgttccaggaagagagctccgtgcaggcactcatagacgcctgcctggaggaggacggaaaactttacctgtgtgttagtagcccaactatcaaggataaaccagtgcagattcggccgtggaatctgtccgattctgacttcgtcatggacggttcacaacccttggaccccaggaagacgatattcgtggggggagtccccagacctttgagggccgtagaattggctatgataatggacaggctttacggtggtgtctgttacgctggcatcgacactgatcccgaactgaagtatcctaaaggggccggacgagtagcattttctaatcaacagtcctacattgccgctatttctgctcgcttcgtgcagcttcagcacaatgatatcgataagagggtggaggtgaagccctacgtactggacgatcagatgtgtgatgagtgccaggggaccaggtgcggaggcaagttcgctcccttcttctgcgctaacgtcacatgcctacagtactactgtgagtattgttgggcttcaatacatagcagagccgggcgtgagttccacaagcctctggttaaggagggaggagataggcctcgacacgtcccttttagatggagttag

SEQ ID NO: 113808 - DNA, 2190 bp, Artificial Sequence
  Description of Artificial Sequence: Synthetic coding sequence
atgggagactatggcttcggggtgctggtccaaagcaatacaggcaataagtccgctttcccggtgagattccacccacacctgcagccacctcatcaccaccagaatgctacccccagcccagcagcctttattaacaataacacagctgccaacggcagcagtgctggcagtgcctggctgttcccggctcctgcgactcacaatatccaggacgaaatcctgggttccgagaaggccaagagtcagcagcaagaacagcaggatcctctggaaaaacagcaactctccccttcccccggtcaggaggctggaatcctgccagagactgagaaagccaagagtgaggagaaccagggcgacaatagttcagagaatggaaatggcaaggaaaagatccgaattgaatctcccgtcctcaccggattcgattaccaggaggcaaccggcctaggcaccagcacacaacctctcacctccagtgcttcttcccttaccggtttttccaactggtcagcagctattgccccaagttcatctaccattatcaatgaggacgcgagctttttccatcagggcggggttccagcagccagcgccaacaacggcgccctgttgttccaaaactttcctcatcatgtgagtccggggttcggaggatctttctcaccacagatcgggcctctgagtcagcatcatccccatcatccccactttcagcaccaccattctcagcaccagcagcagcgcagatctcctgcttcgcctcacccaccaccttttacacacaggaatgccgcctttaatcagctacctcatcttgccaataacctgaacaagccaccctctccctggtccagttatcagagtccatcccccacccccagctcctcttggagtcccggaggtggcgggtacgggggctggggaggttctcaaggaagagaccatcggagaggcctgaatggcggtatcacaccccttaacagtatctcaccactgaaaaagaactttgccagtaatcatattcagctgcagaagtatgctagaccctctagcgcctttgctcctaagagttggatggaggatagcctaaaccgggccgataacattttcccattcccagacaggcctagaacgtttgatatgcactccctagagtcgtcactgatcgacatcatgcgggccgagaatgataccatcaaaggacggctgaattatagctatccagggagcgattcttctcttttaattaacgctaggacgtatggaaggcggagagggcagagttcactttttccgatggaggacgggttcctggacgatggaagaggcgaccagcctctgcatagtggcttggggtcaccacattgcttcagccatcagaacggagaaagagtggagcggtactccagaaaggtgttcgtgggcggattgcccccagatatcgacgaagatgaaatcaccgccagttttaggcgcttcggtccgcttattgtggactggcctcataaggctgagtctaaaagctactttccaccaaaaggatatgcctttcttttgtttcaggatgagagtagcgttcaggccctgatcgatgcatgcattgaggaggacgggaagctgtatctgtgcgtgagctctcccacgatcaaggacaaaccagtgcaaatccgaccatggaacttgagcgacagtgatttcgtgatggacggttctcagcctctggatccacggaagactatcttcgtcggcggtgtccctaggccacttcgggctgtggagctagcaatgatcatggaccgcctgtacgggggcgtttgctatgctgggattgatacggatccagagctgaaatatcctaagggcgccggccgagtcgctttcagcaaccagcagagctatattgcagcgatttctgccagatttgtgcagctgcagcatggggaaattgataagagagtggaggtgaagccctacgtgttggatgatcagctgtgcgacgagtgtcagggtgcccgatgtggcggcaaatttgcccctttcttttgtgctaacgttacttgcctgcagtactactgcgagtattgttgggctgccatccatagtagggccggccgtgagtttcataaacctcttgtcaaggagggaggggaccggccacgccatatatccttccgctggaattag

SEQ ID NO: 113809 - DNA, 2139 bp, Artificial Sequence
  Description of Artificial Sequence: Synthetic coding sequence
atgggcgattatggttttggggttctcgtgcagagcaacacgggtaataagagtgcatttcctgtgcgcttccatccgcacctacagcctccgcatcatcatcagaatgcaactccaagtcctgccgcgtttataaacaacaatacagcagccaatggcagcagtgccgggtctgcatggctgttccctgccccagcaacgcataacatccaagatgaaatccttggcagtgagaaggccaagtctcagcagcaggagcagcaggatccacttgaaaagcagcaactcagcccctcgcctggtcaggaagctggcatcttgccggagacagagaaagcaaaatcagaagagaaccaaggagataatagctctgaaaatgggaacggaaaagagaaaattcggatcgagtctcctgtcctgactgggtttgattaccaagaggccactgggctcggcaccagcacgcagcccctcacctccagcgcctcttccttgactgggttcagcaactggtctgccgccatagcaccatcttcatcaactataattaacgaagatgccagctttttccatcagggcggcgttccggccgctagcgcaaacaatggggctctcctgtttcagaacttcccccaccatgtgtcaccaggcttcggagggagcttctcaccccagatcggtcctctgtcccagcaccacccccatcatccacactttcagcaccatcatagccagcaccagcaacagcggaggtcacccgccagtccacaccctccccctttcacacatagaaatgccgccttcaaccagctcccccacctggccaacaatctcaataagccaccctcaccctggtcatcctaccagtcccctagccctacaccatcatcgtcttggagccccggcggtggcggttatggcggctggggcggttctcaggggcgagatcaccggcggggtctcaacggcgggataacacctttgaattccatatcgcctttgaagaagaattttgccagtaatcacatccaactccaaaaatacgctcgtccaagctctgcattcgcccccaaatcctggatggaagactccttgaatcgagccgataacattttcccattcccagacaggccaaggacatttgacatgcactctttggaatcgtccctcatcgacattatgagggctgaaaatgacactattaaagcacgtacttacggacggcgcagaggacagtcaagcctgtttcctatggaggatggtttcttagacgatggaagaggtgaccagccactgcactcaggcctgggatccccccactgtttttctcatcagaacggcgaaagggtggaaaggtactccaggaaagtgttcgtaggtggacttccccccgacatcgacgaggacgaaatcaccgcatcattcagacgcttcggccctctcatcgtagattggccacacaaagctgaatctaaatcatactttccccccaaggggtatgcgttcctgctattccaagatgagtctagtgtacaggcccttatcgacgcctgtatcgaagaagacggcaaactgtatctctgcgttagttcccctaccatcaaagacaaacctgtgcagattcggccttggaacctgtccgacagcgacttcgttatggatgggagtcagccactggacccccggaagactatcttcgtggggggcgtgcccaggcccttacgggccgtggagctagcgatgataatggaccgtctgtacggcggcgtgtgctacgccgggatcgataccgatcccgagctaaaatatcctaaaggggcaggaagggtggccttctccaaccaacagagctacatcgcggctatcagcgcccgattcgtccaattgcagcacggcgagattgacaagagggtggaggtgaagccatacgtattggacgaccagctgtgcgacgaatgtcagggggctcgctgtggaggcaagtttgccccctttttttgtgcaaacgtcacctgcctgcaatactactgcgaatattgttgggctgctatccacagcagagcaggcagagaatttcacaagcccttggtgaaagaggggggcgacagaccacgccacatctcatttaggtggaattag

SEQ ID NO: 113810 - DNA, 2049 bp, Artificial Sequence
  Description of Artificial Sequence: Synthetic coding sequence
atgagtacgccagctgtcccccaagaccttcagctcccaccctcacagcgcgcgcagtctgccttcaaagaacagcgacgtcaaaaactcaaagaacacttactgaggcggaagaccctgttcgcctacaagcaggagaacgagatgcttagcagcagagatcaacgagtcgtaacttctgaagaccaagttcaggagggcacaaaagttttgaaactgaagactaagatggccgacaaggagaatatgaaacgacctgcagagagtaagaacaatacagtggttggcaagcattgcattcctcttaagccatccaatgagctgacaaattccacagtggtgatagatacacataagcctaaggatagtaatcagacccctcaccttctgctaacagaggacgacccccaaagccagcacatgactttgagccaggctttccatctgaagaacaactccaagaagaaacagatgactacagagaagcaaaagcaagacgctaacatgcccaaaaagccagtcctgggaagctaccgcggccaaatcgtgcaatccaagatcaactcctttagaaaaccccttcaggtaaaggacgagtcctcagctgcgacaaagaagcttagcgctactattcctaaagccacaaagccacagcctgtcaacacgagctcggtgacagtcaagagtaacaggtcctctaacatgacagctactactaagttcgttagcactacaagtcagaacactcagctcgtgcgccctccgatcagatctcatcactccaacacacgcgacactgtaaagcagggaatcagccgaacttcagccaacgttaccattcggaaggggcctcacgaaaaggagctacttcagtctaagacggctctgtcctctgtgaaaaccagtagtagtcaaggaatcattcgcaacaaaaccttaagccgctcgattgcttctgaggttatcgcgaggccggcctccctgagcaatgataagctaatggagaagagtgagcccgtggatcagaggaggcacactgcgggaaaagcaatagtggatagcaggagcgcgcagcctaaagaaacatcagaagaacgtaaggccagactttctgagtggaaagcaggcaagggacgcgttttgaagcgcccgccaaatagcgtggtcacccagcacgagcccgcaggtcaaaacgagaaaccagtgggaagcttttggaccactatggcggaagaagatgaacagcggttgttcaccgaaaaagtaaataacacattctccgaatgcctcaacctgattaacgaggggtgccctaaggaggacattctggtcaccctcaacgaccttataaagaacattcccgatgcgaagaagctagtgaagtactggatctgtctggccctgattgaacccattacttcgcctattgagaacatcatagcaatctacgagaaggccatcctggccggagctcaacccatagaggagatgcgccacacaattgtcgacatcctgaccatgaaaagccaggaaaaggctaatctaggtgaaaacatggaaaaaagctgtgcgtccaaggaggaggtgaaggaagttagtatagaggataccggcgttgatgttgatccagaaaaattggagatggagtcgaagctccacagaaatctgctttttcaggattgcgagaaggagcaagataataaaaccaaggacccaacccacgatgtgaaaacgccaaacactgagacaaggacctcctgcctgatcaaatataacgtgagcaccacaccatatctccagagtgttaaaaaaaaggtccagtttgatggaaccaattcagccttcaaagagctcaagttcttgacacccgttcgcaggtctcgccgtctgcaggaaaagacttccaagctcccagatatgctgaaggatcactacccttgcgtgtcaagcctcgagcagttaacggagctgggaagggagactgacgcattcgtgtgcagacccaatgctgctctctgcagggtttattacgaagccgacaccacttag

SEQ ID NO: 113811 - DNA, 1485 bp, Artificial Sequence
  Description of Artificial Sequence: Synthetic coding sequence
atgagcactccagcagtacctcaggatctgcagctccccccctctcagagggcacagtcagcctttaaagaacagaggcggcagaagttgaaagagcaccttcttcgcagaaagaccttgttcgcatacaaacaggagaacgagatgctgtcctctcgagaccaaagagtggtgacatctgaagatcaggttcaggagggaacaaaggtactgaagctcaagacaaagatggcagataaggaaaatatgaagagacctgctgagtccaagaataacacagtagtcggtaaacactgcattcctctaaagccatctaacgaattgaccaactccaccgtagtgatcgatactcacaaacctaaagacagtaatcagaccccccatctgttactaactgaggatgaccctcagtcacagcatatgacactgtcacaagctttccatctgaagaataattccaaaaaaaaacagatgacaactgagaagcaaaaacaggatgccaatatgcccaagaagccagtgcttggctcataccgggggcagatagtccaatctaagatcaactcgttcaggaagcccttgcaggttaaagacgaatctagcgcggccactaaaaagttgtcagcaactatccctaaggcgaccaagcctcagcctgtgaacaccagctctgttacagtgaagtcaaacagatccagtaatatgactgctacaaccaaatttgtgtccactacttctcagaacacccaactggttcgaccaccgatccgcagtcatcattctaatacacgcgacaccgtcaaacagggcatctcccgcactagcgcaaacgttacaattagaaagggcccccatgaaaaggagctgctccagtccaagacagccctatcctctgtaaaaacttcttcttcccagggaattatccgaaacaaaacactgtctcggagcattgcgagcgaggtgatcgcgagacccgcctcattgagcaatgacaaattgatggaaaagagcgagcctgtggaccagaggcggcatacggcaggaaaagccatcgtggactcccgcagcgcccagcccaaagaaaccagcgaagaacggaaggcgagattgtctgagtggaaggctgggaagggtagagtgcttaaaaggcccccaaatagcgtggtgacccagcatgaacctgctggccaaaacgagaaacccgtcggctccttctggacgactatggctgaggaggatgagcagcgcctttttaccgagaaagtgaataacaccttctctgagtgcctgaacctgatcaatgaagggtgcccaaaggaggacattttggtgaccctgaatgacctaattaagaatattcctgacgcaaagaaactggtcaaatactggatatgccttgctctcatagaacctataacatctcccatagagaatatcattgccatctacgagaaggccattcttgccggagcccaggtgagatag

SEQ ID NO: 113812 - DNA, 2052 bp, Artificial Sequence
  Description of Artificial Sequence: Synthetic coding sequence
atgtctacaccggccgttccccaggatcttcaactccctccttctcagagggctcaatcagcttttaaagagcagaggcggcagaagctcaaggaacacttgctgagaagaaaaaccctgtttgcgtataaacaggagaacgagatgctttctagtagccgtgatcagagggttgtgaccagtgaggaccaggtccaggaaggcactaaagtgctaaaattgaagaccaaaatggcagacaaagagaacatgaagcgccccgcggaaagcaaaaataacactgtcgtcggaaagcactgcattcctttgaagccctctaatgagcttaccaattccaccgtggtgattgatacacacaaacccaaagactcaaatcagacaccccaccttctgctcactgaagatgacccacagtcacagcatatgaccctgagccaagcatttcatctgaagaataacagcaagaaaaaacagatgactactgaaaaacagaagcaggatgctaacatgcccaaaaagcccgtgctgggttcttatcgtggacaaattgtgcaaagcaagattaatagcttccggaaacctctgcaggtgaaagacgaatcatccgctgccaccaagaaactcagtgccacaatccctaaagccacgaaaccacagccagttaacacatcttctgtgaccgtgaagtccaatcgatcatcaaacatgaccgccaccacaaaattcgtgagcacaacatctcagaacacccagctggtgcggcctcccatcagaagccaccattccaatacccgtgatacagtgaaacagggcatctcacgcacctcggccaacgtgactatccgtaagggaccccatgagaaggagcttttacagtccaagaccgccctttccagcgtgaaaaccagcagcagccagggcattattcggaataagactctgtctcgatccatcgccagcgaagttattgcgagaccagcttctttgagcaacgacaagttgatggagaagtctgaaccggtagatcagagacggcataccgccgggaaggctatcgtcgatagcagatccgcccagcccaaggagactagtgaggaaaggaaggcaaggctctccgaatggaaggccggaaagggaagggtcttaaaaagaccgcctaacagcgtggtgacacagcatgagcccgcaggacagaatgaaaagcctgttggctctttctggactaccatggcagaggaggacgaacaacgtctcttcacagagaaggtgaataacacatttagcgaatgcttgaaccttatcaacgagggatgtcctaaggaagacattctcgtgaccctgaacgatcttatcaagaatattcccgatgccaaaaaactcgtgaagtattggatttgcctggcgttgattgagcctatcacttcaccaattgagaacattatcgcaatttatgagaaggccattctcgcaggtgcccagcccatagaggaaatgagacacaccatcgttgatatccttacaatgaaatcgcaagaaaaagctaacctgggagaaaacatggaaaagtcgtgcgcatctaaagaggaagttaaagaagtcagcatcgaagacacaggggtggatgtcgatcctgagaagttagaaatggagtctaaattgcatcgcaacctgttgttccaggactgcgagaaagaacaggataacaaaacgaaagaccccactcacgatgttaaaacaccaaacaccgaaacaaggacatcttgcctaatcaaatataatgttagcaccacaccctacctgcagtcagttaaaaaaaaagtgcagtttgacggcaccaactccgcctttaaggagcttaagtttctgacccctgtgcgccgctctcgccggctgcaggaaaagaccagtaagctccctgacatgttgaaggaccactacccttgcgtgtcatcattagaacagctgaccgagctgggtcgcgagacagatgccttcgtctgtagacctaacgccgccctgtgtcgggtgtattacgaagcggataccacctag

SEQ ID NO: 113813 - DNA, 1488 bp, Artificial Sequence
  Description of Artificial Sequence: Synthetic coding sequence
atgtcaactccagcagtcccgcaagacctacagctcccgccctcacagcgggctcagtccgccttcaaagagcagagaagacagaagctgaaggagcatctgcttagacgtaaaaccctgttcgcatataagcaggaaaacgaaatgctgtcctctagtcgggatcaacgggttgtcacctctgaggatcaggttcaggaaggcactaaggtgctcaagctaaagacaaaaatggcagataaggaaaatatgaagcgtcccgccgaatcaaaaaacaatacagtggtaggcaaacactgtatcccgctgaagccttcgaatgaactgaccaacagtaccgttgtgattgatactcacaaaccaaaggattcaaatcagaccccccacctgcttcttaccgaagatgaccctcagtctcagcatatgactctgtcacaagcctttcatttgaaaaacaattcgaagaaaaaacagatgaccacagagaagcaaaaacaggatgccaacatgccaaagaagcctgtgctggggagttaccgaggtcagatcgtccagtcaaagatcaatagcttcagaaagcccctgcaggtcaaagatgagagttccgctgctaccaagaaactgtctgctacgattcctaaggctactaagccgcaacctgtgaacactagctcagtgaccgtgaaatcaaaccggtcatccaatatgaccgcaaccacaaaattcgtgagtactacttctcagaacacacagcttgtgcgccctcccatccgttcccatcactccaacacccgggacaccgtgaagcaaggtatctcacgcacaagtgccaatgtcactatacgcaagggccctcacgaaaaggaactccttcagagtaagaccgccctctccagtgttaagaccagttccagccaagggattattcgtaacaagacgcttagtcggtcaattgcatccgaagttatcgcacggccggccagccttagcaatgataagctgatggagaagtccgagccagtggatcagcgtcgacatacagctggtaaagctatcgtggactcccgttccgcccagcccaaagaaacgagcgaagagcgcaaagccagactgtctgaatggaaggctggaaaggggcgtgtgctaaagagacccccaaactccgtggtgacccaacacgagcctgcaggacagaatgaaaagcctgtcgggtccttttggactacaatggctgaggaagatgaacagagactgtttacggaaaaagtaaacaataccttttcggagtgcctgaatctaattaatgagggctgtccaaaagaagatatcctcgtcacactcaacgatctgatcaaaaacatccctgacgcaaaaaagctggtgaaatactggatctgcctagcactgatcgagcccatcaccagcccaatcgaaaatatcatcgccatttatgaaaaggccatcctggcaggcgcgcagcacatatag

SEQ ID NO: 113814 - DNA, 5919 bp, Artificial Sequence
  Description of Artificial Sequence: Synthetic coding sequence
atgggagatgattccgagtggctgaagctgcccgttgaccaaaaatgcgagcataaattatggaaggcaaggctaagcggatacgaggaagccttgaaaattttccaaaagattaaagacgagaagtcaccagaatggagtaaatttctgggcctcatcaagaagtttgtaacggattcaaacgcagtcgtgcagctgaagggcctcgaggctgccctcgtttacgtcgaaaatgcccatgttgcgggaaagactaccggcgaagtggtctctggtgtcgtgagtaaggtttttaatcagcctaaagccaaagcaaaagagttgggcatcgagatctgtctcatgtatatcgagattgaaaagggcgaagctgttcaggaggaattgctgaagggactcgacaacaaaaaccccaagattattgtggcctgcattgagacactccgaaaagccctttctgaattcggtagtaagattatcctgcttaaaccaataataaaggtgctcccaaagttgttcgagtcacgcgagaaggccgtaagagacgaggccaaattaatcgctgtggagatctatcgttggattcgcgacgccctccgcccacccctccaaaatattaattcggtccagctcaaggaactcgaggaagagtgggtcaaacttcccaccagcgctcccagacctaccaggtttctcagaagtcagcaagaactggaggcgaagctggagcagcagcaatccgctggtggcgacgccgaaggcgggggggatgacggtgacgaggtgccacagatcgatgcctatgagttgcttgaagcggtggagatcttaagtaaacttccgaaggacttctacgataagatcgaagccaagaaatggcaagaacgtaaggaagcccttgaatctgtcgaggtcctcattaagaatccaaagttggaagccggtgattatgccgacttagtgaaggcactaaagaaagtggtgggaaaggatacaaatgtgatgttggtcgccttggctgctaagtgcttgacgggtcttgcagtgggactgcgtaaaaagttcggccaatacgccggccatgtcgtgccaaccattcttgagaagttcaaagaaaaaaaacctcaggtcgtccaggcgctccaggaggccattgacgctattttcctcacaacgacacttcagaatatatctgaggacgtcctggcagtgatggacaacaagaaccccactatcaagcagcagacctctttattcattgctagatcattccggcactgtacagcaagtaccctgcctaaaagccttctaaagcccttttgcgctgccctcctgaaacatatcaacgattccgcgccagaagtgcgggatgcggcctttgaggcgttggggacagcgctcaaggtcgtaggggagaaggcagtgaatccattccttgcagacgtagataagctgaaactggataaaatcaaggagtgctccgaaaaggtcgagctcatccatggtaagaaggccggcctggcagcagataagaaagaattcaaaccccttcccggcagaaccgctgcatctggagcagctggggataaggacaccaaggacattagtgctccaaaacccggtcctctcaagaaggcccctgccgccaaggcaggcgggcccccaaaaaaaggtaagcctgccgccccagggggtgctggaaacacaggaactaagaacaagaagggcctagagaccaaggagatcgtggagccagagctttccatcgaggtctgtgaggagaaggcatccgcggttcttcctccaacttgtattcagctgttggactctagcaattggaaggagagactggcttgtatggaggagttccaaaaggccgtggagctcatggatcgcacagagatgccatgccaggccctggtgcggatgctggccaagaagccaggatggaaggagacaaatttccaggtaatgcaaatgaagctgcacattgtggctttgattgcccagaagggcaacttcagcaaaacctccgcgcaggtggttctcgacgggctagtggataagatcggcgacgtcaagtgtggaaacaatgcaaaggaagccatgactgctatcgccgaagcatgtatgcttccatggaccgccgagcaggtggtctccatggctttttcgcagaagaacccaaaaaaccaatcagagactcttaactggctttccaatgccattaaagagttcggctttagcgggctgaatgtcaaggcctttataagtaacgtaaagacagcactggccgccactaatccggctgtcagaaccgccgctatcactctcctcggggtgatgtatctttacgtgggcccatctcttcgcatgttttttgaagacgaaaagcctgccctgctcagtcagattgatgccgagtttgagaagatgcaagggcagtcccctcctgctcccactcgaggtatttccaagcactctacgtccggcacggacgaaggcgaggatggagacgagcccgatgacgggtctaatgatgtggtcgatctgctcccacgcaccgaaatcagtgataagatcactagcgaacttgtcagtaaaattggggacaagaactggaaaatcaggaaggaagggctggacgaagtcgccggtatcatcaacgatgccaaattcatccagccaaacatcggagagctcccaactgcgctgaaaggacggctcaacgatagtaacaagatccttgtgcagcagacactgaacatactccagcagctggctgttgcgatgggacccaacattaagcagcacgtaaagaatctcggaattcctataattactgtcctgggtgactcaaaaaataatgttcgggctgctgccctggctacagtgaacgcttgggcggaacagacagggatgaaggaatggctcgagggcgaagacctttcagaggaattaaagaaagagaatccatttctccggcaggagctgctggggtggcttgctgaaaagctccccacactcagaagtacacccactgatctgatcttgtgcgtgccacatctttacagctgtctagaggataggaacggagacgtgcggaagaaggcccaggatgcgctgcctttcttcatgatgcatctcggatacgagaaaatggccaaagccacaggcaaactgaaaccaacgtcgaaagatcaggtcctggccatgctggagaaggccaaggtgaacatgccggctaagccagcccccccgacaaaggctaccagcaagcccatgggcggaagtgcccccgcgaagttccagcctgctagtgccccagcagaggattgtattagctcttcaacagaaccaaagcctgaccctaaaaaggcaaaagcccccggactgagcagcaaagcgaagtccgcgcagggtaagaaaatgccatcaaaaaccagcctgaaggaggatgaagataaaagcggtcccatttttatagtcgtccccaacgggaaagaacagcgaatgaaagatgaaaaaggacttaaagtgttgaaatggaactttacaactccacgcgacgagtatatcgagcagctgaaaacccagatgtcaagctgcgtggccaagtggctccaagacgagatgttccatagcgatttccagcaccacaacaaggccctcgctgtgatggtggatcacctcgagtcggaaaaggaaggagtcatcggctgcttggatcttatactaaagtggctgactctgcggtttttcgatacgaatacctcagtgctgatgaaagcactggaatatctgaagctcttattcacgctgttgtcagaagaggagtatcaccttaccgaaaatgaggccagtagctttataccttatctggtcgttaaggtgggtgagccaaaagacgtgatcaggaaggatgtaagggccattctaaatcggatgtgcttggtttacccagcatctaaaatgttcccttttataatggaggggaccaagagtaagaactccaagcagcgggccgagtgtctcgaggagctcggctgcctcgttgagtcatatggcatgaatgtatgtcagccaacaccaggaaaggctctgaaagagattgccgtccatatcggcgatcgagacaatgcagttcgcaacgccgcactgaataccatagtgactgtatataacgtccacggcgatcaggtgttcaagctcattggaaacttaagcgagaaagatatgagcatgctcgaggaacggatcaaacggagcgctaagaggccatctgctgctccaatcaaacaggtggaggaaaagccacagcgggcgcaaaatataagctccaacgccaacatgctgcggaaaggtccggccgaggatatgtcctcaaaacttaaccaggcaagatccatgtcaggccatccagaagcggcacagatggtgagacgcgagtttcagctggatctggatgagatcgaaaatgacaatggcacagtgagatgtgaaatgcccgagctggtacaacacaaactggacgatatctttgagccagtgttaatcccggagcccaagattcgggcagtatcccctcacttcgatgatatgcacagtaataccgccagtacaatcaattttattattagtcaggtggccagtggcgacatcaacacaagcattcaggctctgacgcagcttttccagatcgagtcgttggcacgggaagcatctacgggagtgctcaaagacctcatgcatggtctgatcacactcatgctggactcccggatcgaggatctggaggaggggcagcaggtgattcgtagtgtcaatctgctagttgttaaggtgcttgagaagtctgaccagactaatattttgagcgccctgcttgtgcttctgcaggactccctgctggcaacagctagctcccccaagttcagcgagttggtgatgaagtgcctctggagaatggtcagactccttccagacacaattaattccattaacttagatcggatactgttggacatacacatctttatgaaagtgtttcctaaggagaagctgaagcagtgtaaaagcgagttcccgattagaactttgaagacccttctccatacgctctgtaagctgaagggtcctaagattctcgaccacttgactatgattgacaacaagaatgagtctgagctggaggcccacttgtgccggatgatgaagcacagcatggaccagactggatctaaaagcgacaaggagacagaaaagggcgcatcaagaatcgatgaaaaaagctctaaagcgaaggtgaatgatttcctcgcagaaatcttcaaaaagattggctctaaggagaacaccaaggaggggttagccgaactgtatgaatacaaaaaaaaatatagcgacgctgatattgagcctttcctgaaaaactcttcccagttttttcagtcctacgtggaaagagggctccgtgttatcgagatggaacgggaaggaaaggggcggatctccacctctaccgggatttcccctcaaatggaggttacctgcgtgcccactcctacctctacagtgtcgagcataggcaacaccaacggggaagaggtgggccccagtgtctatctcgagagactcaaaattctgaggcaacgttgtggcctggataatacgaagcaggatgatagaccaccactcacaagcctgctgagcaaacccgccgtgccaaccgttgctagtagcactgatatgctacacagcaagctctctcaactgagggagtcccgcgaacagcaccagcactcagacttggatagtaatcagactcattcatctggcactgtcacttcctcaagctctaccgcgaacatcgacgacctgaagaaacggctggagcgcatcaagtccagcaggaagtag

SEQ ID NO: 113815 - DNA, 5919 bp, Artificial Sequence
  Description of Artificial Sequence: Synthetic coding sequence
atgggggacgactccgaatggcttaagctcccggtcgatcagaagtgcgaacataagttgtggaaagctcgactgagcgggtacgaggaggctctgaaaatctttcaaaaaattaaagacgagaaatctccagagtggagcaaattccttggcttaatcaaaaagtttgtcacggatagcaatgccgtggttcagttgaaaggcctcgaagcggccctggtttacgtggaaaacgcgcacgtggcggggaaaacgacgggcgaggtcgtgagcggcgtagtctctaaggtgtttaatcagcctaaggctaaggctaaagagctgggtattgaaatatgcttaatgtacatagaaatagaaaagggtgaagctgtgcaggaggagctgctgaagggtctcgacaataaaaatcctaaaatcatcgttgcctgcattgaaaccctgcggaaagccctttcagaatttggaagcaagattatccttttgaagcccataatcaaggtgctgcctaagctgtttgaaagcagagagaaagccgtgcgcgatgaagccaagctcattgccgtggagatttacaggtggataagagacgcccttcgcccccctctgcagaatattaactccgtccagctcaaggaattagaggaagagtgggtgaagctgcctacttcagctccaagacccacacgcttcctcagatcccagcaggaactcgaggcaaagctggaacagcagcagagcgccggtggcgacgccgaaggcggaggagacgacggcgatgaagtcccacagatagacgcttatgagctcttagaagccgtggagatcctgtctaagctgccgaaggacttctatgataaaatcgaagccaaaaaatggcaagagcgcaaggaagcactagaatcagtggaggtcttaatcaagaatcctaagttggaggccggggattacgctgacctcgtcaaagcactgaagaaggtggtgggtaaagacaccaacgtaatgttggtggctcttgcggctaagtgcctgaccgggttggccgtgggactccgcaagaagttcgggcaatatgctggccatgtggtgccaactatactcgaaaagttcaaggaaaaaaagccgcaggtagtgcaggccctgcaagaggctattgatgctatttttctgaccaccacactgcagaatatcagcgaagatgtcctggctgtgatggataacaagaatcccacaattaagcaacagactagtttgttcattgcaaggtcctttagacactgcaccgcatccaccctgcccaaaagtttattgaagccattttgcgcggcgctgctcaagcacatcaacgatagcgcaccagaggtgcgggacgctgctttcgaagctctcggcacagccctcaaagtcgtcggagagaaagccgttaatcccttcctggccgacgtcgacaagttaaaactggataaaattaaagaatgttctgagaaagtggaactcattcatgggaagaaggctgggctggccgccgacaagaaggagtttaagcccctgcccggacgaactgcggcctctggagccgctggtgacaaggacaccaaagatatctccgctcccaagcctggccccctcaaaaaagctcctgccgccaaagccggcggcccacccaaaaagggcaagccagcagcgcctggcggcgcaggtaatacaggaactaagaataaaaaagggttggaaaccaaagaaatagtggaacccgagctctctatagaggtctgtgaggagaaggccagtgccgtactgcccccaacttgtattcagctcctggattcgagtaactggaaggagcggttagcgtgtatggaagagttccagaaagccgtggagctcatggatagaactgaaatgccctgccaagccctggtacgtatgctcgcaaagaagccaggttggaaggagacaaattttcaggtgatgcaaatgaagctacacattgttgccctgattgcgcaaaagggtaactttagtaaaacctccgctcaagttgtcctggatggacttgtggacaagattggagacgtgaaatgtggcaacaacgcaaaggaagcaatgaccgctatagctgaggcctgtatgttgccatggactgccgagcaggtcgtctcaatggcgttcagccaaaagaatcccaagaatcagtccgaaactttaaattggctcagcaacgccatcaaagaattcggatttagcggattgaacgttaaagcattcataagcaacgtgaaaacggcgcttgcggcaaccaatcctgctgtacggaccgccgccatcacactgctcggggtgatgtacctgtacgtgggcccgtccttaagaatgttcttcgaagatgaaaagcctgccttattgtctcagatcgacgcagagttcgagaagatgcagggccagtctcctccagccccaacccgaggaatctccaaacactccacttccggaactgacgaaggcgaggacggcgatgagccagacgacggaagcaatgacgtggtggatttgttgcctcgcacagagatctcagacaagatcacttccgagttggttagcaagatcggagataaaaactggaaaatacgaaaggaaggcctcgacgaggtggcaggcatcatcaatgacgccaagtttatccagcccaatattggcgaacttccaacagccttaaaggggcggcttaacgactcaaacaaaatactggtgcaacagaccctgaacattttgcagcagcttgccgtggcaatgggtccaaacatcaaacagcacgtgaaaaacctcggaattcccatcataacggtcctgggcgacagtaagaacaacgtgcgagccgccgccctggccaccgtgaacgcctgggctgagcagacgggaatgaaggaatggctagaaggggaggatctgtccgaggagttgaagaaggaaaatcccttcctcagacaggaactgctaggatggctggccgaaaagcttccgactctgaggagtacccctaccgacctgatcctatgtgttccacatttgtactcctgtctggaagatcgcaacggcgatgtgcgcaaaaaggcccaagatgcgctcccgtttttcatgatgcaccttggatatgagaagatggcgaaggcaactggaaaactgaagcccacctccaaagatcaggtgctggctatgttagagaaggcaaaggtgaacatgcccgctaaaccagccccgcccactaaagccaccagtaaaccaatggggggcagcgcccccgctaagttccagcccgcgtccgccccggcagaagactgtatcagtagcagcaccgaacccaagccggaccccaaaaaggcgaaggcacctggcttatcgagcaaggccaagtctgcgcagggcaaaaaaatgccgagtaagactagtctgaaagaggacgaggacaagagcggacctatattcattgttgtgccaaatgggaaggagcagcggatgaaagatgagaaggggctgaaagtgctgaagtggaacttcaccactcccagggatgaatacatcgagcagctgaaaacccagatgtcttcgtgtgtagccaagtggttgcaggacgaaatgtttcactctgacttccagcatcataataaggccctggctgtcatggtggaccatcttgaatcagaaaaggagggcgtgatcggatgtttggatcttatcctgaagtggctgacactccggttttttgatacaaacacttctgtactcatgaaagccctggagtatctcaagctcctgtttactctactgtcagaggaggagtaccacttgaccgagaacgaggctagctcgtttattccgtatctcgtggttaaggtgggcgaacctaaagatgttatcaggaaagacgtgcgggccatccttaaccgtatgtgtttggtgtatcccgctagcaagatgttcccctttattatggaaggcaccaaatcaaagaattcaaagcagcgggccgagtgtctggaggagcttgggtgtctggtcgaatcttacggcatgaacgtgtgtcagcccacacctgggaaggccttgaaggagatcgcagtccatattggagaccgcgataacgccgtccgaaatgcggccctgaatacgatcgtgacagtctacaacgtacacggagaccaggtgtttaaattgatcgggaatctatccgagaaggatatgagtatgctcgaagaaagaataaagcggagcgccaagcgaccttctgccgcacccatcaaacaagtagaggagaagccacagcgcgcacagaacatttcctcgaacgcgaacatgctgcgaaaggggcccgctgaagatatgtcatccaaactgaaccaggcgcggtccatgtcaggtcaccctgaagctgctcagatggtacgacgggaattccaactcgacctggacgagatcgaaaatgataacggaaccgtccggtgtgagatgcccgaactggtgcaacacaaactggacgacatcttcgagccagtgttgatcccagaacccaagatccgggcggtgagccctcattttgacgatatgcactcaaacacggcatccactataaacttcattatcagtcaggtcgccagcggagatattaatacatccatccaggcgctgacccaattattccagatcgagagtctggcacgggaagccagtacgggggtcctcaaagatctcatgcacggtttaattacactcatgctagactcccgaattgaggatctggaagagggacagcaggtcattcggtctgtcaatcttcttgttgtcaaggtacttgagaagagtgatcagaccaatattctgagcgcattgttggtgcttctccaggattcacttcttgctaccgccagcagcccaaagttctctgaactggtgatgaagtgtctgtggcgaatggttagactgctgccagacactataaactctattaacttagatcggatcctcttggacatccacattttcatgaaagtcttcccgaaagagaagcttaaacaatgcaaatcagagttccctatccgcaccttgaagaccctgctgcacacactatgtaaattaaaaggacccaaaatcctggaccatctaactatgatagacaataaaaacgaatccgagttagaggcccatctctgcaggatgatgaagcactcgatggatcaaaccgggagcaaaagcgacaaggaaaccgaaaaaggtgcatccagaatcgatgagaaaagctcgaaagccaaggtgaacgattttctggccgagatcttcaaaaagattggatccaaggaaaatacaaaggaggggctagcagaactgtacgaatataaaaaaaaatactctgacgctgacatcgaacccttcctcaagaattcttctcagtttttccaatcctatgtcgaacgggggctaagagtcatcgaaatggaaagggagggaaaggggcgcatctcaactagtacgggtatcagtccacagatggaggttacctgcgtcccaactcctacctctacagtgtcaagtataggaaacaccaatggggaagaggtgggcccaagcgtgtacttggaacggctgaaaattctgcgccagcggtgtggcctggataacacaaaacaggacgataggcctccgcttacttcactgctgtctaaaccggcagtaccaacggtcgcaagttccactgacatgttgcactcaaaacttagtcagctgagggaatctcgcgaacagcatcagcactcagacttggatagcaatcaaactcattctagcggcacggtgacctcttcgtcctcaacggccaatattgacgaccttaagaagcggttggagcgtatcaagagtagccgcaaatag

SEQ ID NO: 113816 - DNA, 906 bp, Artificial Sequence
  Description of Artificial Sequence: Synthetic coding sequence
atgggcgatgactccgagtggctgaaactgcccgtcgatcagaaatgtgagcacaagctgtggaaggctcgcctctccggctatgaggaagccctcaaaatctttcaaaaaataaaagacgaaaaatccccagagtggtctaaattcctgggactaattaagaagttcgtgaccgacagtaatgcagtagttcagcttaagggtctggaggcagctctcgtgtatgtggaaaatgcacacgtggccgggaagacaaccggagaggtggtgtcaggggtcgtgagcaaggttttcaaccagccaaaagcaaaagctaaagagctagggatcgaaatctgcctgatgtacatcgaaattgaaaagggcgaagcagttcaagaagaactactcaaggggctggataacaaaaaccctaaaattattgtggcttgcatagaaactctgcgaaaggccctgtcagaattcggttctaagatcatcctccttaaacctatcattaaggttctgcccaaattatttgagtcccgggaaaaggctgtcagagacgaggcaaagctgatcgctgtagagatctataggtggatccgtgatgcactgcgtcctccattgcagaatatcaactcagttcagctaaaagaactcgaggaagaatgggtgaaactaccaacctctgcacctcgcccaactcgtttcctccgctcccagcaggaactggaagccaagttggaacaacaacagtcggccgggggggacgcagagggcggcggcgatgatggtgacgaggttccgcagatcgacgcatacgaactcctagaagcagtggagatcctttctaagcccaagacatttatgaccaagctgcggcaaaagaatggaaagcgcgagaagcgcccttggtcactctag

SEQ ID NO: 113817 - DNA, 6120 bp, Artificial Sequence
  Description of Artificial Sequence: Synthetic coding sequence
atgggcgacgacagcgagtggctcaaactgccagtagaccagaaatgcgagcacaaactgtggaaagctaggctatcaggctacgaggaggccttgaaaatctttcagaagattaaggatgaaaaatccccagagtggtccaaatttctaggactaatcaagaaatttgtcacagatagtaatgcggtggtccagctaaagggcctggaggcagcactcgtatacgttgaaaacgcgcatgttgccgggaagacaaccggcgaagttgtgagcggtgttgtgtctaaggtattcaatcaacccaaggctaaggctaaagagctgggaattgaaatctgtctaatgtatattgagatcgagaagggagaagctgtgcaggaggaattgctcaaaggtctggataacaaaaatcctaagattatcgttgcatgcattgagactctgagaaaggccctaagcgaatttggatccaagattattctgctaaagcctataatcaaagtactccctaagctgttcgagtcacgggagaaagctgttcgggatgaggctaaactaatagctgtggaaatctatcgctggattagggacgccctgcgacctcctttgcagaatattaactccgtacaactgaaggaactggaggaggaatgggtcaagctgcccaccagtgctccccgccctacccgttttctgcgctctcaacaggagctggaggcaaagctagagcagcagcagagcgctggcggggatgctgagggaggtggggacgatggagatgaagttcctcagatcgacgcatatgagttacttgaagccgtggagatccttagcaaattacccaaggatttttatgataaaatcgaggccaaaaaatggcaagaacgcaaagaagccctagaaagtgtcgaggttctgattaagaatcccaagctggaggcaggagactacgccgatcttgtgaaggcactgaagaaagtggtgggcaaggacactaacgttatgttggtggcactggcggcaaagtgtctcactggactggctgtgggactgcgcaagaaattcggccagtatgcgggtcacgttgtcccaaccattttagagaaattcaaggaaaaaaagccgcaggtggtacaagcactacaggaggctatcgacgcaatttttctgacaaccacacttcagaacatttctgaggatgtgcttgctgtgatggataacaagaatcccactattaagcaacagacgagcttgtttatagcaaggagttttcggcactgcactgcttcaaccctgcccaagagtcttctcaaaccattctgtgcagcccttctgaagcacattaatgattccgcgccagaggtgagggatgccgcctttgaggctcttgggaccgcccttaaggttgttggtgagaaagcagttaatccttttctggcagatgtagacaaactaaaactcgataagatcaaagaatgctccgagaaagtggaattgatccatggcaagaaagccggcctggcagccgataagaaggagttcaagcccttgcccgggcggaccgccgcgtccggggcagctggagacaaggacacgaaagacatttctgctcccaagcccggcccccttaaaaaagccccggccgcaaaagctgggggtcctccaaaaaagggcaaaccagccgccccaggtggggcaggtaatacaggcaccaaaaataagaaagggttagagaccaaggagatagtggagccagagttgtccattgaggtgtgcgaggagaaggcgtcagctgttctccctcctacttgtattcagctgttggattcttctaattggaaagagcgtctggcctgcatggaagagttccagaaagcggtggagttaatggatcgcaccgagatgccatgccaggctcttgtgcgaatgctggccaagaagcccgggtggaaggaaaccaactttcaggtcatgcagatgaaactgcacattgtggccttaatcgctcagaaagggaacttcagcaaaacatccgctcaggtcgtgcttgacgggttggtggataaaatcggggatgtgaaatgcgggaataatgctaaggaggctatgactgccattgccgaggcatgcatgctgccatggacagctgagcaggtggtgtccatggccttcagccagaagaaccccaagaaccaatcagagacacttaactggttaagcaatgcaatcaaagagttcggcttcagcggcctgaacgtgaaagcatttataagtaatgttaagacagctctggcggctaccaatcccgctgttcgtaccgccgccatcacactgcttggagtaatgtacctctatgtcggtccaagcctgcgcatgttcttcgaggatgaaaaacccgcactgttgagccagatcgatgccgagttcgaaaaaatgcagggtcaaagcccccccgctccaacgcgcgggatttctaagcacagtacgtcgggtaccgacgaaggagaggacggcgatgagcccgatgacggctccaacgacgtggttgaccttttacctagaacggaaatcagcgataagatcaccagtgaactcgttagcaagattggcgacaagaattggaaaattagaaaggaggggctggacgaggtcgccggaattattaatgatgctaagttcatccagccaaatattggcgagttgcctactgcccttaagggccggcttaatgatagtaataagattctggtccaacagaccctgaatatcttacagcagctggcggtggcgatgggcccgaatataaaacagcacgttaagaacctcggaatacctattattaccgtgctcggcgactctaagaataacgtccgcgcggcagccctagccacagtgaacgcctgggcagaacagactggcatgaaagagtggttagagggggaagacttgtcagaggaactcaagaaagaaaatccgttccttcggcaggagctcctcgggtggttggcggaaaagctgcccactcttcgctcaacacctaccgacctgatcctctgcgtcccacacctgtatagctgcctcgaagataggaatggcgatgtgcgaaaaaaagctcaggacgccctccccttttttatgatgcacttgggttacgagaaaatggcaaaagccaccggcaaacttaaacccacaagcaaggaccaggtcctggctatgctggaaaaggccaaagtgaacatgcccgctaagccagcgcctccaaccaaggcaacgtccaaacccatgggaggcagtgctcccgcaaagttccagccagcatcagcacctgcagaagattgcattagctcctctactgaaccaaagcctgatccaaagaaggccaaagcaccagggctctcgtccaaggctaagagcgcccagggaaaaaagatgcccagcaaaacttcattgaaggaagacgaggacaagtcagggcccatctttatcgtcgtgccaaacggcaaagaacagcgcatgaaggacgagaagggattaaaagtgctgaaatggaactttacaactccgcgggatgagtatattgagcagttaaagactcaaatgtccagctgtgtggccaagtggcttcaggacgaaatgttccacagcgactttcagcatcacaacaaggccttggccgtcatggttgatcatctggaatctgagaaagaaggcgtgatcgggtgtttagatcttatcctgaagtggttaaccctgcgcttttttgatacaaatacttccgtgctgatgaaggccctggagtacttgaagctcctctttactctgctcagcgaggaagagtatcatctgaccgaaaacgaggccagtagtttcataccatatctagtggtgaaggtaggcgagccaaaggacgtgatccggaaagacgtccgagccatcctaaaccgaatgtgtctagtgtatccagcctctaagatgttcccgtttatcatggaaggaaccaaaagtaaaaactctaagcagagggctgagtgtttggaggagctaggttgcctggtggaatcttatggaatgaacgtctgtcagccaacacctggcaaggcgctgaaagaaattgccgtccacatcggcgatagagataatgccgtgcgtaatgcagctttaaataccatcgtgacagtatacaacgttcatggggatcaggtcttcaagttaattgggaatctctccgagaaggatatgtctatgctggaggagaggatcaagcgctctgccaaacgcccgtccgcggctcctattaagcaggtagaggaaaaaccacagcgggctcagaatattagcagcaacgctaacatgctacgaaagggccctgccgaggatatgtcctccaagctgaatcaggcacggtccatgtccgggcatccagaggctgcgcagatggtccgaagagagtttcagctagatctggatgaaatcgaaaacgacaacggcactgtgaggtgcgaaatgcctgagctggtgcagcacaagttagacgacatctttgagcccgtgttgattcccgagccgaagatccgcgcagttagtcctcacttcgacgacatgcattccaacaccgccagtaccataaactttattattagtcaggttgcttcaggcgatatcaatacctccatccaagcccttacacaaattgatgaggtgctcaggcaggaagataaggctgaggccatgtcaggccatatcgaccagttcctgatagcgactttcatgcagctcagactcatctacaatacgcacatggctgacgaaaaattagagaaagatgagatcatcaaactttacagctgtattatcgggaatatgatatccttgttccaaattgagagcctggcaagggaggcctcaacaggagtgctgaaggatctgatgcatggactgatcactctgatgcttgactctcgtatcgaggacttggaagagggtcaacaggtgatcaggtcagtcaatttactcgtggtgaaagtgttagaaaaatctgaccagacaaatatcttgagcgctctattagttctgctccaagactcacttctggcaactgcctcaagcccgaaattctccgagctggtcatgaagtgcctctggcggatggtcagactgcttccggacaccatcaacagtattaacctcgacagaatcctgctggacatccatatatttatgaaggtgttccctaaggaaaagcttaaacagtgcaaaagtgagttccccatacgtacactgaagaccttgctgcacacactttgcaagttaaaaggccctaagagctgtatgtgcctgccacagattctggaccaccttacgatgatcgataacaaaaatgagagcgagcttgaggcccacctgtgtcggatgatgaaacactcgatggaccagacaggctcaaaaagcgacaaagagaccgagaagggggccagcaggatcgacgagaagtcctctaaggcaaaagtgaacgacttcctggcagagattttcaagaaaataggttccaaagagaacacaaaagaaggactggcagagctctatgagtacaagaagaaatactccgacgctgacattgaaccgtttctaaaaaattcctcccagttctttcaaagttatgtagaaaggggcctccgagtgatagaaatggagagggaagggaaaggaagaataagcacttcaacagggatatccccacagatggaggttacttgtgtacccacacccacaagtactgtttcttccatcggaaatactaacggcgaagaggtgggcccaagtgtttatcttgagcgcctgaagatcttgcggcagagatgcggactcgacaataccaaacaagatgacaggccacccttgacgagcttgctgtccaaacctgccgtccctactgtggcgagttctaccgatatgttgcacagtaagctttctcagctcagagagagccgggagcagcaccaacactcggacctggattccaatcagacccactcatccggtaccgtgacgagttcttcttctacagccaatattgacgacctgaagaagcggctcgaaaggatcaagtccagccgcaagtag

SEQ ID NO: 113818 - DNA, 456 bp, Artificial Sequence
  Description of Artificial Sequence: Synthetic coding sequence
atgggcgacgactccgagtggctgaaacttccagttgaccagaagtgtgaacataaactttggaaggcaagactctcaggctatgaagaggcacttaaaatctttcagaaaattaaagatgagaagtctcctgagtggtcgaaattcttaggcctcattaagaagttcgtgaccgacagtaacgcagtggtccagctgaagggactcgaggccgcgctcgtgtatgtcgagaacgcccacgtggcaggaaaaactacgggtgaggtggtctccggagtcgtcagtaaggtgtttaaccaacctaaggctaaggctaaagagctgggaatcgaaatctgcctgatgtatattgagattgagaaaggcgaggcggttcaggaggagctgttgaaaggactggataataagaacccaaagatcattgtggcatgtatcgagacactcagaaaagcctag

SEQ ID NO: 113819 - DNA, 6099 bp, Artificial Sequence
  Description of Artificial Sequence: Synthetic coding sequence
atgggagatgattcagagtggctcaagttaccagttgatcagaaatgcgagcacaaattgtggaaggcccgattgtctgggtatgaagaagcactcaaaatcttccagaagattaaagatgaaaagtcccccgagtggtcaaaatttctgggattaataaagaagtttgtgactgatagcaacgcagtggtgcagctgaagggtctcgaagccgccttggtctacgtggagaacgcgcatgttgctggaaaaaccacgggggaggtggtcagtggagttgtttcaaaggtgtttaatcagcctaaggctaaggcgaaagagctaggcattgaaatctgccttatgtatattgagattgagaaaggcgaggctgtccaggaagagctgctcaagggactggataacaagaatcctaaaataattgtggcttgcattgagacgctgcgcaaggccctgtcggaatttggttcaaaaatcatcttactgaaaccaattataaaggtactaccaaaactgttcgagtctagggaaaaggcagtgagggacgaggctaaactgatcgcggtcgaaatttacaggtggatcagggatgctctccggccgccacttcagaatatcaacagtgtccaacttaaggagctggaagaagagtgggtcaagctgcccaccagtgccccccgccccacccgttttctgagatcacagcaagagttggaagcaaaattggaacaacaacaaagcgcgggcggagacgcggagggaggaggcgacgatggagatgaggtgccacaaatcgatgcgtacgaacttttggaggcagtagagatcctgtcaaagctgcccaaggatttctatgacaagatcgaagcaaagaagtggcaagagcgcaaggaagccctggaatcagtcgaagtgctaattaagaaccctaagcttgaggcaggtgattatgccgacctggtgaaggcgctcaaaaaagttgtgggcaaagatactaacgtcatgctcgtagctttagccgctaaatgcctgacaggactggccgtgggactcagaaagaagttcggacagtacgcaggccacgtggtgccaaccattctcgagaagtttaaagagaagaaaccccaggttgtccaagctctgcaagaggctatagatgccatatttctcacgactaccttgcagaacatctcggaggacgttttagccgtgatggacaataagaatcctactatcaaacagcagacatccttattcattgcacgctcatttcgacactgcaccgcgagtacattgcccaagtcactgctcaaacccttttgcgctgctcttctgaaacatattaacgattccgcaccagaagtcagagacgcagcgtttgaagccctgggtaccgctcttaaggtggtgggagagaaagccgtcaatcctttcctcgccgacgttgacaaactgaagcttgacaagattaaggagtgctctgagaaggtggaactgatacacggaaagaaggcggggctagccgccgacaagaaagaatttaagcctctgcctggccgcaccgccgcatcaggcgccgccggcgacaaagacaccaaagatatcagtgccccgaagcctggccccttgaagaaagctccagcagccaaagcaggcggtccccctaagaagggtaaacccgcggcaccaggtggcgctggcaataccggcacgaagaacaaaaaggggttggagaccaaagagatcgtcgagccagaactttccatcgaggtttgcgaggagaaggccagcgccgtgctgcctcctacctgcattcagcttctagattctagcaattggaaagagcgcctggcttgcatggaggagttccagaaggccgttgagttaatggatagaaccgaaatgccctgtcaggccttagttaggatgctcgcgaaaaagccggggtggaaagaaaccaacttccaggtcatgcagatgaagctgcatatcgtcgcactcatagcgcaaaaaggcaactttagcaagacgtccgctcaggtggtgctcgatgggcttgttgataaaattggcgatgtcaagtgtggaaataacgccaaggaagcgatgactgctattgctgaagcatgtatgctgccatggactgcagaacaggtggtgagcatggcattcagccaaaaaaatcctaagaaccaatccgagactctgaattggctctccaacgcgataaaggagttcgggttttcgggcctgaacgtgaaggccttcatttcgaatgtgaagaccgcactggccgccaccaaccctgctgtgcgaaccgccgcaataacactgttgggtgtgatgtacctgtatgtcggaccctcattaaggatgttcttcgaggatgaaaaacccgctctgctgagccagatagatgccgagttcgagaagatgcaaggacagagtcccccagccccaacacgaggcatttctaaacacagcaccagcggaacagacgagggggaggacggagatgagccggatgatggaagcaacgacgtggtagatctgctgcccaggacagaaatctctgataaaataacctccgagttagtgtccaagatcggggacaaaaactggaaaatccgcaaagagggcctggatgaagtggctggcattataaacgatgcaaaattcatccagcccaatataggcgaactaccaacagccttaaaggggagattgaatgatagcaacaaaatcttggtgcagcagacactgaatatactgcagcagctggcagtagcaatgggcccaaatatcaaacagcatgttaaaaatcttggcatccctattataacagtgttgggggattccaagaacaacgtgagagcagctgcactcgctaccgttaacgcatgggctgagcagactggcatgaaggaatggctggagggagaagacctctccgaggagcttaagaaggagaatcctttcctgaggcaagaacttctgggatggcttgccgagaaactcccaacactcaggtctaccccaaccgatctcatactgtgtgttccccatctctattcgtgtctggaagaccgcaatggggacgtgagaaaaaaagcacaggatgccctgcccttctttatgatgcacctcgggtacgagaaaatggccaaagcaacaggtaaactaaaacctactagcaaagaccaggtgctcgcaatgcttgagaaagccaaggtcaacatgcccgctaaacccgccccccctacaaaggccacatccaaacccatggggggcagcgcaccagcaaaattccaacctgcatccgcccccgcggaagattgtatcagttcttctacagagcccaagcctgatcccaagaaggcgaaggcacctggactttccagcaaggccaagtcggctcaaggcaagaagatgccaagcaaaacctcactgaaagaagatgaggacaagtcgggacccatctttatagtggtgcctaacggcaaagagcaacgtatgaaggacgagaagggtcttaaggtcttgaagtggaacttcactacaccacgggatgagtacattgagcagttaaagactcagatgagctcctgtgtcgcaaagtggctacaggatgagatgttccacagcgactttcaacaccataacaaggcccttgcggtaatggtggaccacctagagtctgagaaggaaggagtaataggctgccttgacctcatcctgaagtggctcacacttcggttcttcgacactaacacatctgttctgatgaaggctctcgaatatctgaagctgctgttcactctactttctgaggaagagtaccatttaacagagaacgaagccagctcttttataccttatctggtggttaaggtgggggagccaaaggacgtgatccgaaaggatgttcgcgcaattctgaatagaatgtgcctagtgtaccctgcttcaaaaatgtttccatttatcatggaagggacgaaatccaaaaactcaaagcaaagagccgaatgcttagaggagctcgggtgtctcgtggagagctacggcatgaacgtatgccagcccacccctggaaaggccctcaaagagatcgccgtgcatattggcgaccgcgataacgcggttcgaaatgcagctctgaataccattgtgaccgtatataatgtgcatggtgatcaggtgtttaagcttatagggaatttgtccgagaaagatatgagtatgctcgaggagcgtattaagcggtcagccaagcgaccctctgccgcaccaatcaaacaggtagaggagaagccacagcgagcccaaaacatttcatcgaacgccaacatgttacggaaaggacctgccgaggacatgtcctctaagctgaaccaagccagaagtatgtcaggccaccctgaggcagcccagatggttcgacgcgaattccagctcgatctggacgagattgagaacgataacggaaccgtgaggtgtgaaatgccagagctcgtccagcataagctggacgatatctttgaacctgttttaatccccgaaccaaaaatacgagcagtgtcgccgcattttgacgacatgcattcaaatactgcctctaccatcaacttcattatcagccaagtggcgtcaggggatattaatacctctattcaagctctgactcagattgacgaggttttgcgccaggaggataaagcagaggccatgtctgggcatattgaccaatttcttattgcaacattcatgcagctgcgcctaatttacaacacccatatggcggacgagaaacttgaaaaagatgaaatcattaaattgtacagttgcattatcgggaacatgatcagcctttttcagattgagagcctggcccgggaggcatcaactggcgtgcttaaggatttgatgcatgggctcatcaccctgatgctcgactcccggatagaagacctggaagagggtcaacaggttatcaggagcgtgaacctgctcgtggttaaggtgctagaaaaaagtgatcagacgaatattctgagcgcgctgctggtcctgttgcaagactccctcctggccactgcctcaagtcctaaattcagcgagttagtgatgaaatgtctttggagaatggttaggctgttgcctgacaccattaactcaataaacttagaccggattctcctcgacattcacattttcatgaaagtgttccctaaagaaaaactgaagcagtgcaagagcgagtttcccatcaggacactgaagacactgctccacactctgtgcaaattgaaaggaccaaagattttggatcatctcactatgattgataacaaaaatgaatccgagctggaagcccacctgtgcagaatgatgaagcacagcatggaccagaccggctcaaaatccgacaaggaaaccgagaaaggggcaagccgcattgatgagaagtcctcgaaagctaaagtaaacgatttcttagctgagatttttaaaaagatcggaagtaaggaaaacacgaaagaaggtctcgccgagctctacgagtacaaaaaaaagtattctgacgcagatatcgagccgttcctcaaaaattcgtcccagttctttcagtcttacgtggagagagggcttcgtgttattgagatggagagagaaggcaaaggcagaatctctaccagcaccggtattagtccccaaatggaggttacgtgcgtgcccacccccactagtactgtgtcttcgatcgggaacacgaatggtgaagaagtcggccccagcgtgtatctcgaaagacttaaaatcctgcgccagcgctgcggattagacaatacaaagcaggatgataggccccctctcacgagtctgctttcaaagcccgcagtcccgacagtggcctctagcactgacatgcttcactctaagttgtcacagctgcgagagagtcgagagcagcaccaacatagcgatcttgacagcaatcagacccactcttcgggaactgtgacctcaagttccagtaccgctaatatcgatgatctcaaaaagcggctggaacgtattaagtcttctaggaagtag

SEQ ID NO: 113820 - DNA, 1020 bp, Artificial Sequence
  Description of Artificial Sequence: Synthetic coding sequence
atgaaagactctttagtgctgctgggtcgggtgcctgctcaccctgactcgagatgttggtttctagcatggaaccctgccggaacactgctagcatcctgcggtggggaccggcgcatccggatctggggtacggaaggagatagttggatttgcaaaagcgtgttgtctgaggggcaccagcgcacagttcggaaggtcgcttggagcccgtgtggtaattacttggcatctgcttcctttgacgccacaacctgtatctggaagaagaatcaggatgactttgagtgcgtcactacgctggaggggcatgagaatgaggtgaaatcagttgcgtgggctccaagtggcaatctcctcgctacctgcagcagagataagtctgtatgggtctgggaagtggacgaggaagacgaatacgagtgcgtttccgtgctaaactctcatacacaggatgtgaaacacgtagtttggcacccctcacaggaactgctcgccagtgcctcctacgatgataccgtcaagctatacagagaggaggaagacgattgggtgtgttgtgctacgctcgaaggtcacgagagcaccgtatggtcactagcctttgatcccagtggtcagagactcgcatcctgcagtgatgaccggaccgtccgtatctggcggcagtacctgccaggcaacgagcagggtgtggcttgttccggaagcgacccttcttggaagtgcatctgcacactttccggctttcacagtagaacaatatacgatattgcctggtgccaattgactggagctctggcgactgcatgtggcgacgatgccattcgtgtgttccaggaggaccccaatagcgaccctcagcaacccacgttctccttgacagcgcacctccatcaggcacactctcaagacgtcaactgtgttgcctggaatcccaaagaaccgggtctactggccagctgtagcgacgatggtgaagtggccttttggaagtaccagcggccagaaggcttgtag

SEQ ID NO: 113821 - DNA, 1380 bp, Artificial Sequence
  Description of Artificial Sequence: Synthetic coding sequence
atggctgccagcggtgcggtggaaccagggccacctggcgccgctgtggccccctctccagcccccgcgccccccccagcccctgatcatctctttagacccattagtgccgaagacgaagagcagcagcctactgagatcgaatctctctgtatgaactgctattgtaatggaatgaccaggctcctactgacaaagattccattttttcgcgagataatcgtgagcagcttcagttgcgaacactgcgggtggaacaacactgaaattcagtctgctggacgcattcaggaccagggtgtccgctacacactgagcgtccgtgccctcgaagacatgaatagggaagtcgtgaagacggactctgctgctactagaattcctgagctggacttcgagattcccgccttctctcagaagggcgccctcacaacggtggagggcctgatcacacgagcaatctccggtctcgaacaggaccagcccgcacgcagagcaaacaaagacgcaactgccgaacgcatcgatgagttcattgtgaagctgaaggaactcaagcaggtcgcttctcctttcaccctcatcatcgatgacccctcaggcaacagtttcgtagagaacccccatgcccctcagaaggacgatgcactggtcatcacacactacaatagaacaagacagcaggaggaaatgctgggtctgcaagaggaggcccccgccgaaaagcctgaggaggaggacctcagaaacgaggttctccaattttctacaaattgtccggagtgcaacgccccagcacaaactaatatgaaactggtccagattcctcattttaaggaggtcatcattatggctacaaattgcgagaactgcggccacaggaccaacgaagtaaaatcaggcggggccgttgaaccattggggaccagaataaccctgcacatcacagacgctagcgatatgaccagggacctattgaagagtgagacgtgcagcgtcgagatccctgagcttgagttcgaattgggaatggccgtgctgggcggcaagtttacaacgctcgaaggactgctgaaggatatacgagagcttgtcaccaaaaacccgttcacgttgggggatagttccaatccggggcaaactgagcgactgcaggaattcagccagaaaatggaccagatcattgaggggaatatgaaggctcattttatcatggatgaccccgccgggaactcttatttacagaacgtgtacgctccagaagatgaccctgagatgaaagtcgagaggtacaagcgtaccttcgaccaaaacgaggagctcgggctgaacgatatgaagacggaaggctacgaagccggcctggccccccagagatag

SEQ ID NO: 113822 - DNA, 585 bp, Artificial Sequence
  Description of Artificial Sequence: Synthetic coding sequence
atgtgggttaaattgctgagtattgtggccgagttctgtttcagcccgtttctggtcacagatgaagaaacagcatcagatgctctggaacgcaattccctgtcttctcaagacccccagcagcctacctctacagtgtccgttacggaggattccagtacttccgagattgacaaagaggagaaggagcagaccacccaagatccggatctgactacagaggccaaccctcaatacctgggcctagctcgtaagaagagtggaatcctcttactcaccctcgtgtcctttctgattttcattctgtttatcatagtgcaactgttcatcatgaagctccgaaaggcccacgtgatttggaagaaagaaaatgaagtctccgaacatacccttgagtcttatagatcgaggtcaaacaacgaagaaacttcctccgaggaaaaaaacggccagtcgtctcatcccatgaggtgcatgaattacattaccaagctctattctgaggccaagactaagaggaaagaaaacgtgcagcattctaaacttgaagagaaacatatccaagtccccgaatctatcgtgtag

SEQ ID NO: 113823 - DNA, 525 bp, Artificial Sequence
  Description of Artificial Sequence: Synthetic coding sequence
atggcctgtctgggctttcagagacataaagcacagttaaacttggccacacgcacctggccctgtacacttttgtttttcctattatttattccagtgttttgcaaagccatgcacgtggctcagcccgctgtcgtattagcctcctctcgaggcatcgcatccttcgtctgtgaatatgcctctccaggcaaagccaccgaggtgagagtcaccgtccttagacaggcagacagtcaggtaactgaagtctgtgctgcaacttacatgatgggtaacgagctcactttcctggatgattccatctgcactgggacctcttcaggaaaccaagtgaatcttacaatccaaggtttgcgtgctatggacacgggactctatatctgcaaggttgaactgatgtaccctcctccctactacctgggtataggaaatggaactcagatttatgtgatagctaaggagaagaaaccaagctacaacagaggcttgtgtgagaatgcacctaatcgggcccgcatgtag

SEQ ID NO: 113824 - DNA, 672 bp, Artificial Sequence
  Description of Artificial Sequence: Synthetic coding sequence
atggcttgtctaggcttccagcggcataaggcacagcttaatttagcaaccaggacctggccctgtaccctgcttttcttcctcctattcattcctgttttttgtaaagcaatgcatgtcgcccagcctgccgtggtcctcgccagctctcggggcatcgctagtttcgtctgcgaatacgcttcacccggtaaagccacggaagtgagagtgactgtattgcgccaggccgactcacaggttaccgaagtgtgtgcagcgacatacatgatggggaacgaactgacgtttctcgatgactctatttgtacaggaacctcttccggcaatcaagttaaccttaccatccagggactgcgcgccatggataccggcctgtacatctgcaaagtcgagctgatgtatcccccaccttactacctgggaattggcaacggcacacaaatctacgtgattgacccagagccatgtcccgacagtgattttcttctgtggattctcgctgccgtaagctctggcctctttttttattcgttcctcttaaccgcagtcagcttaagcaagatgctaaaaaaacgttcgcctctgactacgggtgtgtacgtgaagatgccccccacggagcccgaatgtgagaagcagttccagccctatttcatcccgattaattag

SEQ ID NO: 113825 - DNA, 414 bp, Artificial Sequence
  Description of Artificial Sequence: Synthetic coding sequence
atgcacgtagcccagcctgccgtggtgctcgcctcttcccgtggaatcgctagttttgtctgcgaatatgccagtcccggcaaagcaaccgaggtaagagtcaccgtattgaggcaagctgatagtcaagtaaccgaggtctgcgctgcaacctatatgatgggaaacgagctgacattcctggacgattccatatgcaccggtacctcctccggcaaccaagttaacctcactattcagggcctgagggctatggatactggtctctatatttgtaaagtggagttgatgtatcctccgccgtactacttaggcatcgggaacggcacgcagatttacgtcatcgccaaagaaaaaaaaccctcatataatagagggttatgtgaaaacgccccaaatcgcgcacggatgtag

SEQ ID NO: 113826 - DNA, 171 bp, Artificial Sequence
  Description of Artificial Sequence: Synthetic coding sequence
atggcatgcctggggttccagaggcataaagctcagctgaatctggcaaccaggacttggccgtgtactctgctgttttttcttctctttatcccagtgttctgcaaggtaccgccgacagaaccagaatgcgagaaacagttccaaccttacttcattcccattaattag

SEQ ID NO: 113827 - DNA, 660 bp, Artificial Sequence
  Description of Artificial Sequence: Synthetic coding sequence
atggcctctgcaggtgacacccaggccggaccgcgggatgctgctgaccagaatttcgattatatgtttaagctgctgctcattgggaacagttccgtcgggaaaacttccttccttttcaggtacgccgacgactccttcacccccgcctttgtgtccacggttggaatcgattttaaggttaaaacagtttaccgccacgacaagagaataaagttacagatttgggacaccgccgggcaggagcgctatcggactatcaccaccgcctattatagaggtgcaatgggcttcctgctcatgtacgatattgcaaatcaggaaagcttcgccgctgtgcaggattgggccacccagattaagacatatagttgggataatgctcaggtcatcctcgtggggaacaagtgtgacctggaggacgagcgggttgtgcctgctgaggacggccggcggctggcagacgacctgggttttgagttcttcgaagctagcgccaaagagaacattaacgttaagcaagtatttgaaagactagtggatgtgatttgtgagaagatgaacgagtcgctggagccaagttcctcatccggtagcaatgggaagggccccgctgtcggggatgcccctgctcctcaaccatcttcatgcagctgctag

SEQ ID NO: 113828 - DNA, 1566 bp, Artificial Sequence
  Description of Artificial Sequence: Synthetic coding sequence
atgctgcctcgcagacctctggcctggccagcttggctgctgcgcggtgctccgggtgccgctggcagctggggccggcccgtgggccccctcgcccgtaggggctgctgcagcgcccctgggacgccggaggtgccactcacaagagagcggtatcctgtacgacgacttcccttcagcactgtcagcaaacaagacctcgccgcttttgaaaggatcgtgcccggtggagtcgttaccgaccccgaagccctgcaggcccctaatgtggactggcttaggactttacgcgggtgttccaaggttcttctccgacctcgaaccagcgaagaggtctcccacatcctccggcattgccatgaaaggaacctggcggtgaaccctcaggggggcaacactggcatggtcggaggaagcgtaccagtgtttgatgaaatcatactctctacggcacgcatgaatagggttctgtcttttcattctgtgagtggtattcttgtttgtcaggccgggtgtgttttggaggagctctcgaggtacgtagaggagcgggacttcattatgccccttgatctcggggcaaaaggcagctgtcacatcggtggcaatgtggctacaaatgccggcgggctccgatttctgcgttatggttctctccacgggactgtgctgggactagaggtggtgctggccgacggcacagtgctggactgtctgacgtcgctccggaaggataacaccgggtacgaccttaagcagctcttcattggctctgagggaacattaggaatcatcactacagtttcaatcctgtgccctccaaaacctcgcgccgtgaatgttgcttttctaggatgcccaggtttcgccgaggtgttacagacattcagtacatgtaagggtatgctaggcgagattctttctgccttcgagttcatggacgcagtctgtatgcagcttgtaggcaggcacctccacctggcgtcccctgtgcaggaaagcccattctacgtgctgattgaaacctcaggcagtaatgcaggccacgatgccgaaaaattaggacactttcttgagcacgcacttggaagtggcctggtgactgacggaacaatggctacagatcagaggaaggtaaagatgttgtgggctcttcgagagcggattactgaggcgctgagtagggatggatatgtttataaatatgacctctcactgcctgtggagcggctgtatgacattgtcacagatctgcgtgcgcgcctgggacctcacgccaagcacgtggtgggatatggtcacttaggagatggaaatttacatctaaacgttacagcagaagccttctctccttctttgctcgccgcactcgagccacatgtctacgaatggacagccgggcagcaggggagcgtctctgctgaacatggcgttggtttccgcaagcgggatgtgctaggatattccaaacccccaggtgccctccagctgatgcagcagttaaaggcccttctggaccctaaggggattttaaatccatataaaacattgcccagccaggcttag

SEQ ID NO: 113829 - DNA, 960 bp, Artificial Sequence
  Description of Artificial Sequence: Synthetic coding sequence
atgctgccacgcaggccgctggcttggcccgcttggttgttgcggggagcgccaggagctgcaggaagctggggtcgtccggtgggccccctagcccgccgcggttgctgtagcgcccccgggactccggaagtaccccttacccgggaacgatacccagtgaggcgtctgccattttcaactgtgtctaaacaagacttggctgcttttgaaaggattgtcccaggcggtgtagtgaccgaccctgaggccttgcaggctcccaatgttgattggctgaggaccttgcggggctgctccaaggtcctgctccgccctagaaccagtgaagaagtatctcacatcctgcgccactgccacgagcgcaacctcgctgtcaatcctcagggagggaatacaggcatggtcggcgggagcgtccccgttttcgacgagattattctgagtaccgcacgtatgaatagggttctcagcttccattctgtatctggcatcctcgtgtgtcaggcggggtgcgtcctggaggagctttctaggtatgtcgaggagagggatttcattatgcccctggatttgggcgcaaagggtagttgccatatcgggggcaatgtagcaacgaatgccggcggccttaggttcctgcgatacggaagtcttcatgggaccgtcctcggcctagaagttgtgctagccgacggaactgtcttggattgcctcactagtcttaggaaagataatactgggtacgacttgaaacaactgttcatcggttcagaaggtaccctgggcattattacaacagtttccatactctgtccacctaaaccccgggccgtgaatgtagctttcttagttacttgcgtgcctcctgcctgcggaccaggcagtccaagacctgcccgcctgcctcaccccgctcttagaactcccggggtgtgcccgcagcccctgcgcctctag

SEQ ID NO: 113830 - DNA, 1164 bp, Artificial Sequence
  Description of Artificial Sequence: Synthetic coding sequence
atggtggggggctcagtgcctgtgtttgacgagattatcttatcaaccgcaagaatgaatcgggtccttagctttcatagcgtgtcgggcatcttagtctgtcaagcgggatgcgtgttggaggaattgagtcgctacgttgaggagcgcgacttcatcatgccgttagatctaggtgctaaagggagctgccatataggcgggaacgttgcaactaatgctggcggcctgcggttcctgaggtatggtagcctgcacggcaccgtcctagggcttgaggtggtgctggcagacggaacggtgctggactgcctgactagcctgaggaaagataatactgggtatgaccttaagcagttattcatcggtagcgagggaactctgggcatcattacaacggtgtcaatcttgtgtccccctaagccccgggccgtcaatgtagcctttctggggtgccctggatttgcagaagtgctgcagactttcagcacatgtaagggcatgctaggggagatcttaagcgcttttgagtttatggacgccgtttgcatgcagttagtgggccgccacctacacttagcctcccctgttcaggagagtcccttttacgttctgatcgaaacgtccgggagcaatgctggtcacgatgccgaaaagctgggccattttttggagcatgccctgggaagcggcctcgttacggacggcaccatggccacagaccagcggaaagtgaagatgttgtgggccctgagggaacgaatcaccgaggctctttctagagatggttacgtttataagtacgatctcagtctgccggtcgagcgcctgtacgacatcgtgaccgatctgcgcgcccgtctaggcccccatgcaaagcacgtcgtcggttacggacacttaggtgacgggaacttgcatcttaatgtgacggccgaggccttttctccttcccttctggcggcccttgaaccacatgtctatgagtggacggccggacagcagggctccgtgtcggcagaacacggcgtaggctttcgaaagcgtgatgttcttggatatagcaagcccccaggcgctttacagctaatgcagcagctgaaggctttgcttgacccgaagggtatcctgaatccctacaagacattaccgtctcaggcatag

SEQ ID NO: 113831 - DNA, 978 bp, Artificial Sequence
  Description of Artificial Sequence: Synthetic coding sequence
atgctgccgagacggcccctggcttggcccgcttggttgctcaggggggccccaggggctgccggctcatggggtaggcctgtcggcccacttgcccgccgtggctgctgttcagccccgggaacccccgaggtgccacttacacgcgaacggtatcccgtgagaaggctacccttttcgaccgtttcaaagcaggatctcgctgccttcgagagaatcgtgcctggaggcgttgtgaccgaccctgaggcactccaggcccctaatgtagactggctgaggacattacggggctgctcaaaagtcttgctgcgaccaagaacaagcgaggaagtatcccatatcttaaggcactgccatgaaagaaacctggccgtgaacccccagggcggtaacactggtatggtgggcggctcggttcctgtgttcgatgaaatcatcctcagcacagctcgcatgaacagagtgctgtccttccactccgtctctggcattctcgtatgccaggcagggtgtgtcttggaagaactgtctaggtacgtagaggaacgggactttattatgccacttgatttaggagccaaagggagctgccacattgggggcaacgtggcaacaaacgcaggtgggctccggttcctgcggtacggatcgttgcacgggaccgtcttgggacttgaggtggtgctggcagatggcactgtcctggactgcctgacatctctccgcaaagacaacaccggctatgatctgaaacagctgttcattggatccgaaggcacactcggaatcataaccaccgtgagcatcctctgtcctcccaagcccagagccgtgaacgttgccttcctggtgacttgtgtgccccctgcctgtggcccaggttcacctcggccagcgaggctgccccatcctgcactgcgcacaccaggtcttagacaagagtccctggcttcttcctgccatgcgcatgtgtag

SEQ ID NO: 113832 - DNA, 426 bp, Artificial Sequence
  Description of Artificial Sequence: Synthetic coding sequence
atgctgtgggccctgagagaaagaattactgaagcactgtctagagatggatatgtctacaagtacgatcttagcctgcccgtagagagactctacgatatcgtgactgacctcagagcccggctggggccacatgctaagcacgtggtaggatacgggcacctaggcgacgggaacctccacctgaacgtgaccgccgaggctttttctccttcccttttggccgcgcttgagccccacgtctatgagtggaccgctgggcagcaaggttctgtttcagccgagcacggggtaggttttcgcaaacgagacgtacttggctactcaaagcctcccggcgctctgcagcttatgcagcagcttaaagctcttctagatccgaagggcatcctcaatccctacaagactctgccttctcaggcttag

SEQ ID NO: 113833 - DNA, 609 bp, Artificial Sequence
  Description of Artificial Sequence: Synthetic coding sequence
atgtcattccccccattatggcctacccgtcacgtgcctgcgtcgcaccctacctgcccgctcctccctgggccatgctgttgtccacattgcttgtgtgatagtgctccaccttcccttccttgtccaaccctggtccagggggctagtagacctatattaatattgcgagcctttccgggcccttgtcactcggtgccttgccacgacttgaaactgcaggtgggggcgtctccctttcgacatggatgtccaccctccgtcaggtgtccttcacgccttattgctggcgtacccggctgttctgtgctgtcctggtccctgggtcacagtctgtccggtatcgattcccgcgtgggggcaactccaggtctgggccacagcctgtcctgggtgagggccccaccagggcttgggcactccttatccggtgtaggcgccacacccggcctcggtcatttgctgagcggggttggcgcttctcccggggaagatactgagcatgctgccgcactcaccccatgcggtgtcccccccgtgcccggatgtcggagccactctcagcccctgagccatctcgttagcagctctaggtgttgtggaccctag

SEQ ID NO: 113834 - DNA, 849 bp, Artificial Sequence
  Description of Artificial Sequence: Synthetic coding sequence
atggcccttagctgctcttcctggtgtaggtctcctcagtggaagttcgaagcctctaaaagccatgctaaccaccgacctatctgcctatcccccagaatctggccggggtctgcctccgcgaccagcactgtatgttcatcaagtgagtcctttctgcccaggggtccgcctgctgtatcccttttgcttcatggaccgcctactgtatcctttccacccccctggcccacgcaccatgtcttgcccagtcctgtggcccaccctccctgcccttgtctgccgcctgacatgccgcttgagctgcctggaccctgttgttgtccacactgtttgtgtgacagcgccccaccttctctgccatgtcccacacttgtccaaggcgcctctagaccgattctgatcctcagggcgttcccaggtccctgtcacagcgtgccatgtcatgatctaaaactgcaggttggagcatctccctttagacatggttgtccaccttccgtgcgctgcccctcccggctgatcgcaggcgtacctgggtgctcagtcctgagctggtctttgggacactccctgagtggaattgacagcagggtgggcgcaacacccgggcttggccatagcctgtcatgggtgagagccccacccggattgggacattcacttagcggcgtcggagccacaccaggcctgggccatctgctgtccggcgtaggagcatcaccgggagaggatacagagcatgcggcggccctgactccgtgtggtgtcccacctgtgccgggctgtcgaagtcattcccagcccctgtcccatctggtctcatcatcaaggtgctgtggcccctag

SEQ ID NO: 113835 - DNA, 1245 bp, Artificial Sequence
  Description of Artificial Sequence: Synthetic coding sequence
atgggtggcctgagcgcaagaccaaccgccggacgaacagatcccgccggcacatgttggggtcaagatcctggatcaaagatggcaaccgtgatccctggacccctctccttaggggaagatttctatcgcgaggccatagagcattgtcgctcctataacgcacgcctgtgtgctgaaaggtcattgcggttgccattcttggacagccagacaggcgtggcccagaacaactgctacatttggatggaaaagacacacagaggcccgggactcgcccctggtcagatttacacataccccgctagatgctggcggaagaagcgaaggctgaatatactggaggatccacgactccgaccctgtgaatataaaatcgattgcgaggcccccttgaaaaaagagggaggcctgcctgaaggtcctgttctagaagccttactatgcgcagagactggcgagaagaagatcgagttgaaggaggaagaaacaatcatggactgccagaaacagcagctattagaattccctcacgacctcgaagtggaagacctggaggacgatatacccagacgtaaaaatagagctaaggggaaagcctacggcatcggtggcctgcgcaaacgacaagacacggccagtctggaagatagagacaagccatacgtatgtgatatatgtggaaagcgctacaaaaatcggccaggcctatcttaccactacacccatacccacctcgccgaggaggaaggcgaagaaaatgctgagaggcacgcattaccctttcatcgtaagaacaaccacaaacagttctacaaggaactggcatgggtcccggaagctcagaggaagcatactgcaaagaaggctccagacgggaccgttataccaaatggatactgcgatttttgcctgggcggttctaaaaagacagggtgccccgaggacttgatctcttgtgcagactgcggacgatcagggcaccccagctgtctgcagttcactgtgaatatgacagccgccgtgcgcacctaccgctggcagtgtattgagtgcaagtcttgttcattatgcggtacatcagagaacgacgatcaattgctcttctgcgacgattgtgaccggggttatcatatgtactgcctgagcccacccatggccgagcctcctgagggtagctggtcatgccacctgtgtttaaggcatcttaaggagaaggcttcagcttatattacactgacctag

SEQ ID NO: 113836 - DNA, 1074 bp, Artificial Sequence
  Description of Artificial Sequence: Synthetic coding sequence
atggccacagtaatccataaccccctcaaggctctgggggaccagttctacaaagaggctattgagcattgtagatcttacaatagcaggctctgtgctgaacgcagtgtccgcttgcctttcctcgactcccaaacaggagttgctcagaataactgctatatatggatggaaaaacgtcatagaggcccagggctggctcctggccaactttatacctatcctgccaggtgctggcggaagaaaaggcgattgcaccctccagaagatcccaagcttcgtctcctagagattaagcccgaggttgagcttccactgaagaaagacgggttcacatccgagagtacaacccttgaggcactcctgcgtggggaaggcgtcgagaagaaggtagatgcccgcgaggaagagtcaatccaggagattcagcgtgttctcgagaacgatgagaatgttgaagaggggaatgaggaggaggacctcgaggaggacatcccaaagcgaaagaaccgcacccgcggtagagccaggggctcagccggggggagaaggcgccacgatgctgcctcgcaggaggaccacgacaaaccttacgtatgtgacatttgcggcaaacggtacaagaatcgccccgggctatcataccactacgcacatacccatctggctagcgaggagggcgacgaagctcaagaccaggagaccagaagcccgccaaatcatagaaacgagaaccaccggcctcaaaaagggccagacggtactgtcataccaaacaattactgtgacttttgcttgggaggctcgaatatgaataagaagtctggccggcctgaggagctcgtgagctgcgctgactgcggaagatccgcccacctggggggcgaggggcggaaggagaaagaggccgccgccgccgcccgcacaaccgaagacctgtttgggagtaccagcgaatccgacacctccacgttccacgggttcgacgaggatgacttggaagagccaaggagctgtcgtggccgcaggtcaggtagaggtagtcccactgcggacaaaaagggttcttgttag

SEQ ID NO: 113837 - DNA, 999 bp, Artificial Sequence
  Description of Artificial Sequence: Synthetic coding sequence
atggagaaaacacacagggggccagggcttgcccccggccagatctacacgtacccagctagatgttggcggaaaaagcggcggctgaacattctggaagatccaaggctacgtccttgcgagtataaaattgactgtgaggctccactgaagaaagaaggtggccttcccgaggggccagtgcttgaggctttgctatgtgccgagaccggagaaaagaagattgaactgaaggaggaggaaaccattatggattgccaaaagcaacaactccttgagttcccgcatgacctggaagttgaggatctcgaggatgatatcccccgccggaagaaccgcgcaaaggggaaagcatacggcatcgggggactgcggaaaagacaggatacggcgagtctggaagacagagacaagccttatgtttgtgacatctgtgggaagcgatacaaaaaccgtcctgggctgagctaccactatactcacactcacctggcagaggaagagggcgaggaaaacgctgaacggcatgctttgcccttccatcgcaaaaacaaccacaaacagttttataaggagctggcctgggtccctgaagcccagaggaaacacacagccaaaaaggcccctgacggcacagtgatccccaatggttattgcgacttctgtttaggcggctccaaaaaaacagggtgccctgaggatcttatatcttgtgcagactgcggaagatctggccacccctcttgtctgcaattcaccgttaacatgaccgccgcagtgcggacctacagatggcaatgcatagaatgtaagtcgtgcagtctgtgcggaacaagcgaaaacgacgatcagcttttattctgcgatgattgtgatcgtgggtaccacatgtattgtttaagtccacctatggctgaaccgccagagggatcgtggagctgccacctctgtctgaggcacctgaaagaaaaagcctctgcctacattactctgacctag

SEQ ID NO: 113838 - DNA, 1143 bp, Artificial Sequence
  Description of Artificial Sequence: Synthetic coding sequence
atggggggactgtcagcccggcctacagcaggcagaactgacccagcgggaacatgctggggccaggaccccggctcaaagatggcgacagtgatccccggacccctgagtctgggtgaagacttttaccgtgaagccatcgaacactgccgatcttacaatgccagattatgcgccgagcgctctcttcggctgcctttcctggactcccagacgggcgtggcccagaataattgctacatttggatggaaaagactcaccgcggacctggactcgcaccaggccagatttacacttaccccgccagatgctggcgaaagaaaaggaggttgaacatactggaggatccgaggctcaggccttgtgagtataagatagactgcgaagcacccttaaaaaaggaaggagggctccctgagggtccagtgctggaagctctgctttgcgccgaaacgggtgaaaaaaaaattgagttaaaggaagaagagaccatcatggattgccaaaagcaacagctgttggagtttccacatgatctagaggtggaggacctggaggatgatatacctagacgcaaaaatcgggctaagggcaaggcctatggaattggggggctgaggaagcggcaggatacagctagcctggaagaccgagataagccctatgtgtgtgacaagttctataaggagctggcttgggtgcccgaggcgcagagaaagcacaccgcaaagaaggcacccgatgggacagtgattccaaatggatactgcgatttttgtctcggaggctcaaagaaaactggctgcccagaagacttaatctcctgcgctgattgtggccggtctggtcatccctcctgcctccagttcacagtgaacatgaccgccgccgtgagaacctaccggtggcaatgcatagaatgcaagagctgcagcctctgcgggaccagtgagaacgacggcgctagttgggcaggccttactcctcaggaccagctccttttctgcgacgattgcgatcggggctaccacatgtattgccttagtccaccaatggcagagcctccggagggctcatggtcctgccatctgtgcctaagacatttaaaggaaaaagcgtctgcgtacatcactctcacctag

SEQ ID NO: 113839 - DNA, 612 bp, Artificial Sequence
  Description of Artificial Sequence: Synthetic coding sequence
atggccacagccatacaaaatccacttaaaagcttaggggaggatttctaccgcgaagccattgagcactgtcgctcctataatgctaggctctgcgcagagagaagcttgcggctgccttttctggactctcagactggggtagcccagaataattgctatatttggatggagaagacccatagggggcctggtctggcacccggtcaaatctacacataccccgcacgctgctggcgtaagaaacgacggctgaatatactggaggacccaagactccggccatgtgaatacaaaatcgattgcgaggcaccattgaagaaggaagggggtctgccggagggacccgtcctggaggccctcctctgcgccgagaccggcgagaagaaaattgagttgaaggaagaggagaccattatggactgccagaaacaacagctcctggagttcccacatgatttggaggtcgaggacctcgaagacgacatccccaggagaaagaaccgagccaaagggaaggcatatgggatcggaggccttcgcaagagacaggacacagcttccctggaagatcgcgacaagccgtacgtgtgcgactctgaaagtttttag

SEQ ID NO: 113840 - DNA, 1245 bp, Artificial Sequence
  Description of Artificial Sequence: Synthetic coding sequence
atgggcggcctcagcgcccgtcctaccgccggacggaccgaccctgcgggcacttgttgggggcaggatcctggcagcaagatggcaactgtgataccaggtccgcttagcctgggggaagacttttatcgcgaagcgattgagcattgtcgctcctacaacgcccgactctgcgccgagagatcgcttcggctcccctttctcgacagccagactggtgtcgcacagaataactgttacatctggatggagaagactcacaggggcccagggctagctcctggacagatctatacctatcccgcccgctgttggcggaaaaagcgtagactcaacatcctcgaagaccctcgcctgcggccttgcgaatataagattgactgcgaggcaccactaaaaaaggaaggtggtttacccgaagggcctgtgttggaggccctgttatgtgccgagacaggagagaagaagatcgagctgaaagaggaggaaaccatcatggactgccagaagcaacagctcctagaatttccccatgatctggaggtggaggatctggaagacgatattcccaggagaaaaaatagagcgaagggtaaagcttatggcatcggaggccttagaaagaggcaagacaccgctagcctcgaggatcgagataaaccttatgtctgcgacatttgcggtaagcgctacaagaacaggcccggcctgagttaccactacactcatacccacctggcggaggaagaaggcgaggagaatgcagagaggcatgctttaccattccacagaaaaaacaatcataagcagttctataaagagcttgcttgggtgcctgaggctcaacgaaagcacacagccaagaaagcacccgatggcactgtcattccaaatggatactgcgacttttgtttaggaggctccaaaaagactggatgccctgaggaccttatctcttgcgctgattgcggtcgatcaggccacccgtcctgtctgcagtttaccgtgaacatgacagccgcggtccgtacttatcgatggcaatgtatagaatgcaaaagttgtagcctttgtggcacaagcgaaaatgatgaccagctgctgttctgcgacgactgcgatcgtgggtatcacatgtattgtctttctccccctatggccgagccacctgagggctcctggtcgtgccatctatgtctgagacacctgaaggaaaaagcatcagcttacatcactttgacgtag

SEQ ID NO: 113841 - DNA, 1167 bp, Artificial Sequence
  Description of Artificial Sequence: Synthetic coding sequence
atggccacagccatccagaatcccttaaaatccctgggagaagatttctatcgagaggccatagaacattgtcgatcctacaacgctcggttgtgtgccgagcgctcactgagactgccttttctggattctcagaccggcgtcgcacaaaataattgttacatttggatggaaaaaacccatcgagggcccgggttggcaccaggtcagatatatacctatcctgcccggtgctggaggaagaaaagacggctcaacattctggaagacccccgtttgaggccatgcgagtataagatcgactgtgaggcccctctcaagaaagagggagggctgcctgaaggaccggtactcgaggctctgttgtgtgcagaaactggggagaagaagatcgaactaaaagaggaagagacaattatggactgtcagaaacagcaacttctggagttcccccacgacttggaagtagaggatcttgaggacgacatacctcggagaaagaatagagctaaggggaaagcttacgggataggagggctgcgtaagagacaggacacggcgtccctcgaggatagagataagccttatgtgtgcgatatttgtggaaaacgctataaaaaccgccccggactaagctaccattacactcatacgcatcttgccgaggaggagggcgaggagaatgccgagagacacgccctgcccttccatcggaagaataatcacaagcaattctataaggaacttgcttgggtgcccgaggcgcagaggaaacacaccgccaagaaggcccccgacgggacagtgattccgaatgggtattgtgacttttgcctgggcgggtccaaaaagaccggctgccccgaggacctgatcagttgtgccgattgcggacgttctggccatcctagctgtttgcagttcacagtgaacatgaccgcagccgtgcggacttaccggtggcagtgtatcgaatgcaaatcttgctcactttgtggaacctctgagaacgacgaccaactgcttttttgtgacgactgtgatagaggctatcatatgtactgcctgtccccacctatggctgagccccctgaaggctcatggagctgccacctgtgcttgaggcacctgaaagaaaaggcttcggcttacatcactctgacatag

SEQ ID NO: 113842 - DNA, 1176 bp, Artificial Sequence
  Description of Artificial Sequence: Synthetic coding sequence
atggcagcagtcgtcgagaatgtggtgaaattactgggagagcaatattataaagatgccatggaacagtgtcataactacaatgcccggctgtgcgctgagagaagcgtccggttgcctttcctcgactcccagacgggcgtggcacagagcaactgttacatctggatggaaaagaggcataggggccccggactagcctcagggcagctttatagttatcctgctcggcgctggcggaagaagagacgagcccacccacctgaggaccctcgtttaagtttcccaagtataaagcctgacactgaccagacactgaaaaaggaggggcttatttcccaggatggaagctctctcgaggcactcctgcgaactgatcccctggagaaaaggggggctccagacccacgcgtggatgacgattctctcggtgaatttccagtgaccaatagccgtgctaggaagcggatccttgaacccgacgatttcctggacgatctcgatgacgaggactatgaggaagacacccctaaacgccgcgggaagggcaaaagcaagggtaagggtgtgggctctgctcgcaagaaactggacgccagtatcttggaggatcgggataagccttacgcatgtgacatctgcggcaagcgctacaagaatagacctgggttgtcataccactacgctcactcacacctcgccgaggaggagggggaagataaggaggatagccagccgcctactcccgtgagccagcggagtgaggaacagaaaagcaaaaaagggcctgacggattggccctgccaaataactattgtgacttctgtcttggcgattctaaaattaacaaaaagaccggacagcctgaggagctggtgtcttgttccgattgcggaagatctgggcacccttcttgcctacaattcacacctgtgatgatggctgccgttaaaacgtacagatggcagtgtattgagtgcaaatgctgtaatatttgtgggacaagcgaaaacgatgatcagctcctcttctgtgatgactgcgataggggttatcatatgtattgtctgaccccctctatgagcgagcctcctgagggctcctggagctgccatttatgccttgacctccttaaagagaaagcaagtatttatcaaaatcaaaattcatcctag

SEQ ID NO: 113843 - DNA, 1134 bp, Artificial Sequence
  Description of Artificial Sequence: Synthetic coding sequence
tctagtatcatccaaaatagactgaagaagctgggcgatcaattttacaaggaggccattgagcactgtaggagctataattcgcgactgtgtgccgagagatccgtgcggctgcccttcttggactctcaaacgggcgtcgcccagaataattgctacatctggatggagaaaagacatagaggcccagggctcgccccaggacaactttacacctaccccgctaggtgttggcgaaagaagaggagactccacccccccgaagatccaaaattacgcttgctcgaaatcaaaccggaagtcgagctcccacttaagaaggacggtttcacatctgaaagcactaccttagaggctcttctccgcggagagggggtggagaagaaagtggatgccagagaagaagagtcgattcaggagattcaaagggtcctcgagaacgacgaaaacgtggaagagggcaacgaagaggaagacttggaggaggacatcccgaagaggaagaataggacccgaggtagggcccggggatcagccggaggccggcgcagacacgacgctgcgtcgcaggaagatcacgacaagccctatgtatgcgacatctgcgggaaaagatacaagaataggccagggttgtcctatcactatgcccacacccacttggcatctgaagagggagacgaggcccaagaccaggagacacgctccccccctaatcacagaaacgaaaatcataggccccaaaagggccctgacgggactgtgatccccaacaactattgcgacttctgcttgggggggtcaaacatgaacaagaaaagtggcaggcccgaagaactggtgagttgtgctgattgcggaaggagcggccaccccacatgcctgcagtttactctgaacatgacggaggcggtgaaaacatacaaatggcagtgcatcgagtgcaagagctgtattctgtgtggaacctccgagaatgacgatcagcttctgttctgtgacgactgcgaccgcggctatcacatgtattgtttaaaccctccggttgccgagcccccagagggttcctggtcatgtcacctgtgttgggaactgctgaaagaaaaggcctccgcattcggttgccaggcatag

SEQ ID NO: 113844 - DNA, 1074 bp, Artificial Sequence
  Description of Artificial Sequence: Synthetic coding sequence
atggccactgtgattcataaccccctcaaagccctcggggatcaattttataaggaggctatcgaacattgccgatcttacaactcacgcctgtgcgctgaacgatccgtcaggctgccctttctggattctcagactggcgtcgctcaaaataattgttatatttggatggagaaaaggcacagaggcccgggactcgcacccggtcaactgtatacctatcccgcaagatgttggaggaaaaagcgtcgactgcaccctccagaggatccaaaacttcgtctcctggagatcaaaccagaggtggaacttcctttaaagaaagacggattcacttccgaaagcaccaccctggaggcgctgcttagaggggaaggcgttgagaaaaaggtggacgcccgggaagaggagtctatccaagagatccagagagtactggagaatgacgaaaacgtggaggagggtaatgaggaagaagacctggaggaggatatccccaaacgtaagaataggacccgaggacgggcccgaggcagcgccggagggcggcgacgccacgacgcagcatcccaggaagaccacgataagccgtacgtttgcgacatctgtggtaagcggtacaaaaatcggcctgggctcagctatcattatgcccacactcacctggcgtccgaggagggggacgaagcacaagaccaggagaccaggtctccacctaatcacaggaatgagaaccatagaccacagaaaggcccagatggcactgtcattcccaacaattattgcgatttctgcctgggagggtccaatatgaacaagaagagtgggcgccctgaggaattggtgagttgtgctgactgcggccgcagcgctcatctgggtggagaaggacgcaaagagaaagaagctgcagctgctgccagaactactgaagatctctttggatccacatccgagtccgatactagcactttccatggattcgacgaggacgaccttgaggagccgcggagctgtcgtggcaggcgctctgggcgtggctctccaacagcagataagaaaggcagttgttag

SEQ ID NO: 113845 - DNA, 1137 bp, Artificial Sequence
  Description of Artificial Sequence: Synthetic coding sequence
atggctacagtaattcataatcccctgaaggcccttggcgatcagttctataaggaggccatcgaacactgtcgctcctataacagcagactatgcgctgagcgaagcgtgcgcctccctttcctggactctcagacaggcgtcgcacaaaataattgttacatttggatggaaaaacgccatcgaggcccaggtctggcccctggtcagctctacacataccccgctaggtgctggagaaagaagcgacgattacacccccctgaggatcctaaactgcgtctcctggaaatcaaaccagaagtggaactcccactgaagaaagatggctttacctctgagtcaaccactttagaagccctgctgcgaggggagggggtagaaaaaaaagtcgacgccagagaagaggaatctattcaggagattcagagagtactggagaatgacgagaatgttgaagaaggcaatgaagaggaagacctcgaggaagacataccaaagagaaaaaatcgaacccgaggaagggcaagggggagtgctggcgggcgccgcaggcatgatgcggcatcccaagaggatcatgataagccttatgtctgcgacatttgtgggaagagatacaaaaacaggcctgggctgtcctaccattacgcccatacccatctggcctccgaggagggcgatgaagcccaggatcaggaaacgcgtagccccccaaaccacagaaatgagaaccataggcctcagaagggtcctgacggcaccgttatccccaacaactactgcgatttttgcctgggcgggtcaaacatgaataaaaagtcaggacgacctgaagaattggtcagctgtgcagactgtggacgatctggacaccccacttgtctccagttcacactgaatatgaccgaggcggtgaagacctataagtggcagtgtattgagtgcaagtcgtgtatcctttgtggcacctctgagaacgatgaccaacttctcttctgtgacgattgcgatcgggggtaccacatgtactgtcttaaccccccagtggctgaaccacctgaggggagctggtcctgccacttgtgctgggagctgctgaaagagaaggcgagtgcattcggctgccaggcctag

SEQ ID NO: 113846 - DNA, 4110 bp, Artificial Sequence
  Description of Artificial Sequence: Synthetic coding sequence
atgagtccatgcggaaggaagatgggcgaagggcgccagcaacgtcgcgccccagtgggtaaactgctgttgctaccggggaggagggacaccccacacggacgttcaggtagcagcggtgcgcgcacccagcgaagtttgttgtggcttctcgtgcatgtctggctgtgggcggcctcggggtcatctgcccagctgttcaatctcactctttcggtggatgagggcctgccacccgatacactagtgggggacattcgcgctggccttccagccgcccagcagcaagagggatcaggcttctttctttctgaagattcagatgacagtccacttctggacgatttccatgtgcaccctgacaccggaataatccggaccgcgaggcgccttgatcgcgaacggcgggatcactattctttcgttgcggccactcttttgggtgcggtggtacaggttgaaattcgggtgaacgatgtcaatgatcatagccctcggttcccgctggatagtctgcagctcgacgtgagcgaactctccccccctggaacagcgttccgactgcccgtggcacatgatccggacgccgggctcttctcaacccaaggttacaccctggttcaaccatctgatctgccaaaggacccggctgggccctttttccagttgcggtatcgaacccccggcccgctcccgtctccactactgcccgggtcctcgagtccactggagcctttagacctggtgttgctgaggcggctggatcgtgaggaggccgctgcccacagacttcagattgaggcttgggacggcggcagaccgcggcgcacgggcttgcttagcgtcgaacttagggtgctggatgagaacgacaatcctcctgttttcgagcaggatgagtacagagctgccgtgagggaagacgcgcagcccggggccgaggtttgtcgtgtcagagccacagaccgggacttgggacccaacgggttcgtgagatattctgtgagagcaaggcaagtgcctggcgccggtagtggcggcggagcccttggagatgccgcgtattttgcggttgaagaacttagcggcgtggtacgtgtatggagacccctggacagggaagcgcaggcctggcatcagctggtggtcgaggcccgggatgggggtgccgaacccgaagtggcgacagtgagggtgtctatagctgtactggacgttaacgacaaccgacctgctatccacgtcctcttcctgacagaaggtggggtggcaagagtgtccgagggagcacgaccaggcgactacgttgctcgggtgagtgtgtcggatgctgacggagattgggagaaagaggacgaggctaccggggagctgggcgtgggcctcggagatggctcaattagcctcagcctggagggcggggaaggtgacttcgccctactccccggcggtccacccggagtctttttcctgtgtgtggagggtccccttgaccgggagtctagagacttgtatgagttattgcttgtggccacagacgccggttccccccccttgtccaccgaagagacgcttctgctccgagtggcggatcttaatgaccagccccccttatttagccaacagcattacaaggccagcgtgtccgaagctgcagccccagggacggtcgtcatgtgggtctccgcttcggatgccgatgaggccggtagtgatcacgcttggcttagatacaccgtggttcagctctccgcaccatgtaacctgggctccctgcagtctaaaatggtgcatacagcggaatgtggaccatcgttcgcgatcgatagtgagtccggagccattagcaccattcgcacgcttgatcgggaggtacaggaagccgttgagcttaaagtagttgctcaagatctgggggagcctcctctctctgccacatgcctggtctcaatcacagtcgatgacgtcaacgataatgaacctatcttttggcgacaagtctacaatgctaccatcgctgaacacgccccggttggtcattgcttcctccaagtgacagcttccgacgcagatagtggcctctacggctttatcgagtattctctgtacgatggattcctgtcttacgaagccccacaggctttccggatcgacccacacgatggacagatctgcgtgtcccaggatatcgaccgagagcgcgatccagccacctatgatctgttggtggaggcaaaagatggtgggggacttagtgcccaggctttcgtgcgcgtcgatctggaggatgtgaacgataaccatcccgtttttaacccttccacttatgtgacctctattagcgatgagacccaacccggtacagaaattattaatgtcctggccaccgaccaggactctgggatttacggcactgtcgcctacgagctcattcctgggaacgttagttccctctttaccatcgatagcactacaggaatcatctatctgacgttgccactttcccatcttgagtcaaccacactcagcttgatggtgtctgcccaagatggaggcggcctcacagccgtgatcaatgccgacgttacaatccatatatttcagactactctggccccagctgagttcgaacgccctaagtacacgttcctcgtttatgaagacgtgccagaggatagccccataggcactgtgaaagcgcgcgaaccactaaattcctctgaacccattttctatcgaatcagcagtggcgatctggggggaaagttttcaatccaccccaggctaggtacaatccggaccaggaagccactggatcacgaaactcaacctgtcgttgtattaacagtgcaagcacagctcgggagcgcgcccgcctgctcctctactgaggtaaatatcacagtaatggacgtgaatgataaccatcccgcattcctccgaactagcgatgagatccgcattagtcagaccaccccacctggtacagcactgtatctggcacgggccgaggaccgcgactctggacgaaacggcctgatacgctacagtatcgcctccccacagcctggggtatttgctatagacagagcgcttggggtgctgttcctgaacgggtctctgggcgccggcgagcagcgcgaactaaccctgacacttcgcgcggaagatcaaggcgtacaccctcaagcagcactcctggttctaacggtcgttatcgagaagcgcgagcactctccgtcctggactttcgagcaccttgtttatcaggtagaggtctccgaatccctgagccccatgacacaaatgctgcaaacccaggcccacccactgggcccccagagagccgcaagccccctgagatactctctagaaccatccgtcgactctgcaatgtttggtattcgcccttataccgggtggatctaccttcggaggcagtttgactacgagtccacgcagacctataacttcagggtgttcgcatggatcccggaggacgggttcctgcagaatgtctcgacaaccgtcattgtgcgggtgtgggatgaaaatgacaacagcccaaccttcttacacgatgtgctgtttctgaaggtcgaggagagtccggtgccgcagggggtaatcggcaaaataaccgccatcgacatggatagtggcaagaatggacagctactgtacttcctgctgagtgacggaaaatttttcaagatgaaccctaacaccggggaactgatcaactgggttgcactagatagggaacaccggggccaccatgaaatgactgtgctcgtaaccgatagggggtctcctccacgcaacgccacaatggccgtgtatgtgtcagtgacagacataaatgacaatcgccctttcttcccccagtgcctcccggggaaggaactacacgtcaaagtgttggaggggcagcccgtgaacatgctggtgaccaccgtattcgctaaagatccagatgaaggcaataatgccgaagtgacgtacagcgtttcgtcagcgaggcctatgcccctgaagggaaaaacagcatttggtaaacaaagctgcaagaaacagacaaataagcaaactaacaaaattttaacttag

SEQ ID NO: 113847 - DNA, 8751 bp, Artificial Sequence
  Description of Artificial Sequence: Synthetic coding sequence
atgcgtctagacgagatcaccaaatctgagaacgaggacggtgagaagaagatgtttacgcagcaattcgaatctacagatgcttgcgtttacgaggtgtacgtgaaaatcaattccatcgtgaaaagccagagtcagtgcgggcttaagcggggatccccagaaactgagctctggggggctatagttttccgtagtcaagaggagaacgccaagccagttaaggagactgaagttactgcaagcgatgccgacagtggcttatacggattcatagagtatagcctgtacgacgggtttctctcgtatgaagcaccacaggcatttaggatcgacccgcatgacggacaaatttgcgtgagccaggacatagatagagagcgggatcctgcaacatatgacctcctggtggaggctaaggatggggacgaacagcggatgacgcacctggcacttgtgaagggagggctaagtgcccaggccttcgtgcgggttgacctcgaggatgtgaacgacaaccatcccgtcttcaacccttcaacatatgtcacctcaatatctgatgagacgcagccaggtacggaaattattaacgtcctcgccactgatcaggactccggaatttatggaaccgtggcttatgaactgattccggggaatgtgtcatctttgttcacgatcgattctacaacaggcttgtattcacctgaggttgagatcctgtcagccgtaaacttctctgcagataaggaggttatgaacagcttggagatgttccttcctcttcttcgacacttcaagaaggttgagagagacgaagaagcagccgagaagaaattcgaggcgagccgcgggtggtttatgcgatttaaaggtcgacgccacctgcactacctgaaggtgcaggacgaggctgctagcgctgatggcgaggccgcggcccggtacgttgccaacctcgctaagatcctgggggaaggcattatatacctgacattaccattgtcacatctggaaagcaccactctttctctgatggtttccgctcaagacggggggggccttactgcagttattaatgcggacgttaccatacacatttttcagactacactggctcccgcagagttcgagcgaccaaaatatacgttcttagtttatgaagacgtgcctgaggacagtccaattggcacagtcaaagcacgagagcctctgaattcatcagaacccattttctaccgcatttcctctggcgacttgggcggtaaattctcaatacatccccggctgggtaccatacgtactcggaaacctttggaccatgaaactcagccagtggtggtgctcactgttcaggcgcaacttggctcagccccagcctgctcatccactgaggtgaatatcaccgtcatggacgtcaatgataaccaccccgcctttctacggaccagtgacgagatccgcatttcccagaccactccccctggaactgccctctaccttgctagggccgaagatagagactcaggccgcaatggacttatcagatattccatagctagcccccagccgggcgtgtttgccattgaccgtgccttgggcgttctgtttcttaacggtagtttgggtgcaggcgagcagcgcgagctgacgctgaccctgagagccgaggatcagggggtccacccccaagctgccctgctcgtgctgacggtagtgattgagaagagggagcactctccaagctggacctttgagcacttggtatatcaagtcgaggtgtctgaatccttatcccctatgacacagatgttgcagacacaggcacaccccttaggcccccaacgggctgcaagtcctctcaggtactctctggagcctagcgtggatagcgctatgtttggcatcaggccttatacgggatggatatacctcagacgacagtttgactatgagtcgacccagacctacaacttccgggttttcgcgtggattcctgaagacgggttccttcagaatgtctctacgaccgtgatcgtccgcgtctgggacgaaaacgacaattctcctactttcctgcatgatgtactctttctgaaggtggaagagagtccagtgccccagggcgttatcggcaaaattacagccatagatatggactctggcaaaaacgggcagctactgtacttcctccttagtgacggtaagtttttcaaaatgaaccctaacacaggtccagcaggtaccatctatgttattacttgggccgatggcgcggcagcttttagcgggacggattttgccttcagttcggatgaactgcaagcatttgtgcttaaatctttgttctgcgaactcggagaaggagagctgattaattgggtggccctcgaccgcgagcatcgcggccatcacgagatgactgtccttgttacagaccgagggtctccaccacgtaatgccacaatggccgtttatgtctctgttacagatatcaatgacaatcggcccttcttcccacagtgtctcccaggtaaagaacttcacgtgaaggtgcttgaaggacagcccgtcaacatgttagtgacgacggtatttgctaaggacccagatgaaggaaacaacgccgaggtaacatatagcgtatcatcagaggactccagcgaccatttcaaaatcgatgccaataatggcgaaattcgaaccacgacaatcctctcatacgattatcgccctagttatcgcatgtcagtcatcgctaccgaccagggggtgccccctcttcagggccaggccgttgtgaacatccaggttatacctctgtccaaaggcagggccataatgtcgcagaacatcagacatctgatcattccggagaatttgaagcccaccaaaatcatgagcctgataaagtccagcgaccacctacagcaacactataatggtaaactccatttttccattgtcgctgacgacaaggatggtcacttcgagattgattcatctactggggatctgttcctcagtaaagaattagactacgagaccacatcccactatctctttagagttatcacaaccgatcatagcaagaatctctcactctcctcaaccgtcttcctgtcaattgacgtcgaggatcagaacgaccactcgccaagcttccaggacgaactcatcgtgatatctgtcgaagagaatgtgcccatagggaccctggtctacgtctttaatgccaaggatgacgatggctcttttctcaattcgcgtatacagtattatatcgagtcacacaatcccggaacaaatcctttccttatccacccttctttcggtactcttgtcacagtgagcaggcttgatcgcgaaagtatcccaactgtgatactcaccgttactgctagtgaccaggctgtcaatgtgactgaccgccggctgcggtctctgaccgcacagatcgtgattctcgacgttaacgatcataatcccaccttcatctcttttcctaatgctcacgtgaaggaggacgtgacagttgggtctctcgttcaccacatcaccgctcatgatcccgacgaagggcgaaatggcaaggtgacatactccatactgagtgggaacgaaaatatgaccttcatgttggatgaatcaagcggactcttgacaaccacatgtcccctcgattatgaaatgaagacccaacatattctaaccgtgctcgccctggatgacgggactccagctttgtctagctctcaaaccttgacagtaacagtcctagacgtgaatgacgaggcccctgtgttcaaacagcacctgtacgaagccagtgtgaaagaaaaccaaaaccccggcgaattcgtgactcgcgtagaggctctagaccgggattctggagtcaactccaaattgcagttcgaaatcatgcctggcgccagttttgagctcttcgaaattaacagcgatactggcgaagtcgtcaccaccaccattcttgacagggagatccaggaggtatttacccttcgcgtcctggtgcgtgacggcgggttcccttctcttagctccaccacaaccattctctgtaccgtggaggatgagaatgaccacgcgcccgaattcatcgtaagttcttacgacattgaggtgttagagaaccaggagccagaggtagtttacacagtcctggcgtctgatatggatgcaggcaacaatcgcgccgtggagtatcacatcatcgatggcaataccgatgagtgtttcactataaatgaaatgtctggcgagctgagtacgaccagagccctggatagagagcagatctccaatttcacactggtcattttgtgttcggatctgggcgatccacctcgcagttcagtgattcacctacaggtgagagtcttggatgccaacgaccattctccatcttttccaaccctgtattatcagtcttccgtgcgggaggatgccgaggtgggcactgtggtgttagttctttcagctgttgacaaggatgagggactgaatggccagacagagtatttcctgacagacgaagcatcgggcgcatttaccatagacccaatgagcggaacacttaagacgtcaaacacgctcgatagagaggcccggtcccagcataccttctcagcagtggcaagggactgctctattcagggctctaggtctaccaccgtcattatcaaagtgtatgtgaccgatgtcaacgacaacgaccccgtgcttgagcagaacccattcgatgtttttctgtcccccgagtcacccaccaatcagaccacagtgattgtgcgcgccgacgatttggatttagggccgaacggtaccgtggtattttcattcgcagaaactcaaagtatgttttctatcgacaaatacaccggcgagattcagttccagcagaatcctagctctgaatacttccccatatggttacagcttaaggtgacagaccaggggatcccagcgcgaaccactaccggcttgctcgtcatccacatggaaggcgaggacgttaagatctccttctctcaccacctttacaaagggctggttaccgagaactgcgaagctggcacgtccatcgtgactgtgaaggcctttgctcctgacagcattcaggattcaatgaaatactcgatattcagtggcaatgaggacggtgtcctttctctgtgctcaaaaagcggccagttgaccgtaaaggaacctaagtttctggatttcgaggtgcggaatgaggtgcagctgattgtgctcgcggagagtagtggacatcgcgcttattgcaaagtcgcagtactgatccaggacgagaatgacaacagtccctgcttcgagcagtccatatatcaggcaagcgtatcagaatcgcagctatacaatgcacatgtaattcaggtcttcgctacggaccttgactcgggattaaacggccttattgaatactctatcctgtcgggcaatcaggaagaagcattccaaatagatgcactgtcgggggtcattactacaaaggctatcctcgattacgagttgacatcaagttacagcctcatagtgcaagctactgataagggtatgcccagactgtccaacaccacggtcatcaaggtccaggtgaccgatattaatgataacgccccagccttcctgccatcagaagccgttgagatcacagaagacagcttgcccggcgtgatcgtcacccacgtttccgtccacgatgtggatctaaactccgcttttatcttctccttcgccaaggagagcaaccctgggactaagtttgcaatagaccagaacactggggtcgtcgtgcttgtgaaaaccctcgactttgaggagatgaccgagtacgaactgttgattcaaatctccgattccgtgcattatacagagggtgctctggtggtgcgtgtcctcgatgtcaacgacaaccctcctgtgttctcacaagatttctaccaagtcaccgtgccggagtctatacccgtgggctattcggtgcttactcttagtgcaaccgacctggaatccaacgagaatatctcttatcgcatcctgagttcttcaaaagaattctctattgaccctaagaatggcacaatcttcacaatatctcccgtcctgctgctcgacactatcagcaccacccagttccttgttgaggcaagtgacgggggaaacccagatctccgggcattgacactagttgaaattgggatcgaggatatgaacaactacgctccagagttcaccgtgaagagttataacctgagcctgtccgaggacgccctggtgggtagcactctggtcacattctccaacattgatcatgactggacccgcgaaaatacctatgtagagtactcgataatctccggaaatagccagaataacttccacgtggaaacgaaattctttcatagcgagtatccatacaagcaggtgggatatctcgttctcctgcactccctggacagggaagcctctgcgagccacgagctcgtgattcttgcatccgactccggctgtccacctctatcctctactgctgtcatttccatccaagttctagatgtgaacgataatcctccaaatttctcctctctctcatatcacactcatgtgaaggaaagtacgcccctaggatcacacatcactgttgtgtcagctaatgacagagacaccggcagccacgcagaaatcatctataacatcatctcagggaatgagaaggggcatttctaccttgaggagaacaccggggttctgtacctcatcaaaccacttgattacgagaaaatgaccaaattcacactgacagtccaggcatccgacgctgaaaagaaacacttcagtttcgccgtggtgttcgtaagtgtgctcgacgataacgaccacgctccgcagtttatgttctcatcattctcttgcatcgtgccagagaatctaccaatctcgtctacaatctgttccatcaacgcactggatttcgacgccggcccatacggcgaactgacctacagcatagtgagcccctgtttcctcacccacgggatgagctacgaccatgatctcttcctcatagaccctctgactggcgatatccatgccaaacagatcttggactacgaaaacgggaacaagtattgcctgaccgttcaggctaaagacaaaggagacgccacggcgtctctggtggtctgggttgacatcgagggcattgacgaatttgagcctatattcacacaggaccaatacttcttcaccctacccgagaagaataaggataggcaacttattggaagagtcgaagcctccgacgcggatgctgggattgatggcgtgatcctgtactccctcggaacctcctctcccttcttttcagtaaataagaccaatggaaacatctatcttatcagggcactacctctgatcaaaagtcagttaaacaaggaagacaccctggagatgaagattatagcacatagccccaagtccgactcaaagtttgccagctgtaccgtattcgttaatgtgtcctttagttcagaggggacccctttagcagtcttcgccagctccttctctataagcctagtggtatcctttttagtcttcttgatcctcatttgcatcctgatcgtgatgattctgcgccacaagcaaaaagacactatcaacaattacgaagagaagaaaacaagttcactcgatgcagacctaagagtaactcgagacgccagcgtgcttaaggccttccagaagaccgacgattgttcaaacgaagttgtcccagtggatgccaccccggagtggctgagcctgatctctataatggagaaggacatcgtgaacctgtacagacattctaattccagcgggcactgtagcgtggaaggggaaacggctgaggacaaggaaatccagagaattaatgagcacccctacaggaagtgcagtgactccgccttatcggaccacgagagcagagtacctgacagcgggatccctcgggatagcgatcagctgagttgtcttagcggcgaaaccgacgttatggtcacagccgaaaccgcagaggcctcacagaccttcggcgaaggggaccagggagagggctgttccacgacctgcgctcaaaataatgtgctgccccaaactgtccagaagcgcgaagctaaggagtctatcctagctgatgtgagaaaggagtcagtgtttattagcggtgatcaagaagtacgatgcgcagctctttccacgcagaccaccagtgatcatgacggcaaagacaactatcattggaactacctactgtcatgggagccaaagttccagcccctagcatcggtgtttaatgacatcgctaagcttaaagacgaacacctgcacatgccggggattcccaaggaaaagaagtcgttcgtgttcccccccccactgattactgctgtggcccagcccggtatcaaagcagtccctccccgcatgcctgcggtgaatctgggacaagtgcctcctaagcatcccaggtcccctatcccctaccatctggggtctctccctgagggtatgacacccaattttagccccagtctgagtctgctgacaatgcagcctccagctctgagccctctgttacgagaaggagagctgctgggtacccacataagcggcacttgtcatgagctgaaagcagaggacgaagtccagatttag

SEQ ID NO: 113848 - DNA, 2130 bp, Artificial Sequence
  Description of Artificial Sequence: Synthetic coding sequence
atgtcaccttgtggccggaagatgggcgaaggacggcagcagcgcagggcccctgtggggaagttgctgcttcttcctgggaggagagataccccccacggccgttcaggatcgtcaggcgctcgcacccagcgctccttgctgtggctgctggtgcacgtgtggctctgggcagccagcggtagctcagcccagttgtttaatctgacgctgtctgtggacgaagggcttcctcctgacacactggtcggggacatcagggccggcctgcccgctgcacaacagcaggagggaagtggcttcttcctgtctgaagacagtgacgactcacctttgctggacgacttccacgttcaccccgataccgggattatcagaactgcccgtagactggatcgcgagcgccgggatcactactctttcgtcgctgcaactctgctgggcgccgtggtacaggtggagatcagggtgaacgacgtcaatgatcattccccccgattcccgttagattctctccagcttgacgtctcggagctgtcccctccaggaactgcattccgactgccggtggcccacgatccagatgcaggcttgtttagcacacagggctacacgctcgttcagccgagtgacctacctaaggaccccgccggtccgttctttcagctgcggtatagaaccccaggaccccttccctctccacttctcccggggtcctcctcaccattagagccgttggatttggttttgctgcgccgcctagatcgggaggaagcggccgcccacagactgcagattgaggcctgggacggtggaagaccaaggagaaccggactgcttagcgtcgaacttagggtgctggatgagaatgataacccacccgtgttcgaacaggatgagtaccgggccgctgtgagagaggacgcccagccgggagctgaggtgtgcagggtccgagctactgaccgtgacctagggccaaacgggtttgtccgatattctgtcagagcccgccaggttcctggggctggctccggagggggggccctgggggatgcagcctacttcgctgttgaagaactgtccggagtggttagagtatggcgccctctggatagagaggctcaggcctggcatcagctcgtggtcgaagcgagggatggcggggctgagcctgaggtggctacagtgagggttagtatcgctgtgttagatgtgaatgacaacaggcctgcgattcacgtgcttttcctgaccgagggtggcgttgcgagagtgtccgaaggagccaggcctggtgattatgtcgcgcgagtctcagtttcagacgcagacggcgattgggagaaggaagatgaagccaccggagaactcggcgtgggcctcggggacggctcgatctcactttcactggagggaggggagggggactttgctttgttaccaggcgggccaccaggagtgttttttctgtgtgtcgaaggacctttggaccgagaatcccgagatctgtatgagcttctgctcgtggcaacagacgctggcagtcctccattgagcaccgaggaaaccttgttgctacgggtcgccgatctgaacgaccagccccccttgttttcacaacagcattataaggcaagcgtgtcagaggctgcggcccccggcaccgtagtcatgtgggtgtctgcctccgacgcagatgaggccggcagcgaccatgcatggctccggtatactgtggtgcagctgagcgctccatgtaatctaggttccctgcagtcaaagatggtccatactgcggagtgtggaccgtccttcgcaattgacagtgagagcggggcgatctccaccataaggaccttagatcgagaggttcaggaagctgtcgagctcaaagtggtggctcaggatctgggggagccacccttgtccgctacgtgtcttgtttccataaccgtggacgatgtgaacgataatgagcccatcttttggcggcaagtctataatgcgacaattgctgaacatgctcccgtaggccattgcttcctgcagctcatctctgctcaggtggcctttgtcaaaatcaagcagaaacagaaagagatacaagagaaacagaacctcgcatag

SEQ ID NO: 113849 - DNA, 2109 bp, Artificial Sequence
  Description of Artificial Sequence: Synthetic coding sequence
atgggggaagggagacagcagaggagggctcccgtaggcaagcttctcctgctgcccggaaggagagataccccccatggcaggagtggctcctccggtgctcgtacccagaggtccttactatggctgttagtacatgtttggctttgggctgcgtctggttcaagcgcccagctattcaacctgactcttagtgtcgacgaggggctcccgccagatacacttgtgggggacattcgcgccgggttgccagccgcccagcagcaggaagggtctgggttttttctctcagaagacagtgacgactccccactgctcgacgatttccacgtgcatccagatactggaatcatcaggacggcaaggcgcttggaccgggaaagacgcgaccattactcctttgtggcagccacactgctcggtgccgtggtgcaagtggaaataagagttaacgacgttaacgaccactctcccagatttccgctggacagtctacagcttgatgtctccgagttatccccccctgggaccgctttcaggctgccagtggcccatgaccccgacgcgggattgttcagcacccaggggtatacattggtgcaaccttctgatctgcctaaggaccccgccgggcccttttttcagctgaggtaccgcacacccgggccactgcccagcccgttactacctgggagttcttccccacttgaacctctggacctcgtgctgctcagacgcctagacagggaagaggctgctgcccatcgcctgcagatcgaggcctgggatgggggccggccccgacgcaccgggttgcttagcgttgaacttagggtgttagatgagaacgataaccctcctgtgtttgaacaggacgagtatagggccgcagttcgggaagacgcccagccaggggccgaggtttgccgcgtccgggcgacggaccgcgacttaggccctaatggcttcgtgaggtatagcgtcagggccaggcaggtcccaggagccgggtccggcgggggggctctgggcgatgccgcttactttgctgtcgaggagctgagcggggttgtgcgcgtctggcgccccttggatcgcgaagcccaggcctggcatcagctggtggtcgaggcccgcgatgggggggctgagccagaggtggcaaccgtgcgcgtcagcattgccgtgttggatgtgaatgacaacagaccagctattcacgtcctgtttctgacagagggaggcgtagctagggttagcgaaggtgcgcgccctggggattacgttgcccgtgtctcggtgagtgacgccgatggtgattgggagaaggaggacgaagctaccggcgaacttggggtggggctcggtgatggcagcatcagcctgtccctggagggcggagaaggagactttgccctcctgccgggcggcccccctggcgtcttctttctgtgtgtcgaagggcccttggacagagagtctagggatctgtacgagctgcttttggtggcaacagacgccggcagtccccccctaagtaccgaagagactctactacttagggtcgcggacctgaacgatcagccccccctgttctcacagcagcattataaagccagtgtttccgaagcagcagcccccggaaccgtggtaatgtgggtgtctgcttctgacgccgatgaagccggctccgaccacgcatggctgcgatacaccgtcgttcagctcagtgctccatgtaatctaggtagcctgcaatcaaaaatggtgcataccgcagaatgcgggccgtcgtttgccattgacagtgaatccggcgccatttctaccataaggacactggacagagaagtgcaagaggccgtcgaactcaaagtggttgcacaagacttgggtgaaccacccctttcggccacatgtctggtaagtataactgtcgatgatgtgaacgataatgagcccattttctggcggcaggtgtacaacgccacaattgccgaacacgccccagtggggcattgtttcctgcagctgatcagcgcacaggttgcatttgtgaagatcaaacagaaacagaaggaaatccaagaaaaacagaacctggcgtag

SEQ ID NO: 113850 - DNA, 4101 bp, Artificial Sequence
  Description of Artificial Sequence: Synthetic coding sequence
atgagcccctgtggtcgtaaaatgggagagggcaggcaacaaagaagagcgccagtcggtaagctgcttctcctacccgggcgacgcgacaccccgcatggccgcagtgggagctccggcgcaaggactcaacgttctcttctctggttattggtgcatgtgtggctgtgggcagcttccggttccagtgctcagcttttcaatctaaccctgagtgtggacgagggtctccctccggacacacttgtgggcgacattcgcgctgggctccctgctgcccaacagcaggaaggcagcgggttcttcctgtctgaggattcggatgactccccactcctggacgatttccacgtgcaccccgacacaggcattatccgaactgcacgtaggttagaccgggagcgtcgcgatcactattcgttcgtggctgcaacactgttaggcgcggtcgttcaggtagagataagagtgaatgatgtcaacgatcatagccctaggttcccactcgactcacttcagctcgatgtttctgaactcagtccacccgggactgctttccgtctgcccgtcgcacatgatcccgatgccggattgttttcaacccagggctataccctggtgcagccaagcgacctccccaaagatcctgccggaccattttttcagttgcggtaccgtacacccggccctctcccgagtcccttgcttccgggatcttccagcccactcgaacccttagacttggttctgctcagaagactagacagagaagaggcagcggctcatcggctacaaatcgaagcttgggacgggggcaggccccgcaggacgggactgctgtctgtggaactcagggtgctcgacgagaacgacaaccccccagttttcgaacaagacgaatacagggccgctgttagggaagacgctcagccaggcgcagaggtctgcagggtgagagctacggaccgggacctcggacccaacggattcgtccgctactcggttcgggccagacaggtgccgggagcgggatccggcggaggcgctctgggagacgctgcctattttgcggtggaggagctgtcaggggtggtgcgggtctggcgcccgctggacagagaagcgcaggcctggcatcaactggtcgtggaggcacgcgacggaggtgctgagccggaggtggccactgtgcgcgtgagcattgccgtcctagatgtcaatgacaaccgccctgcaatccatgtattatttctcacagaaggcggggtggcccgggtctccgagggggcgcgacccggggattacgtagctcgggtgtccgtctctgatgccgacggcgactgggagaaggaagacgaggccaccggtgaactaggtgtgggtttaggcgacggctcaatttctctcagccttgaggggggagagggggacttcgccctgctccctggtgggcctcctggcgttttttttctttgcgtcgaagggccgctggatcgggagagcagggatctgtacgagctgctgctggtcgctacggacgcagggtcacctccactctccaccgaggaaacacttctcctgcgggtggctgacctcaacgaccagccacctctgttctcccagcagcattataaggcctctgtaagcgaagctgccgcgcccggcaccgttgtcatgtgggtctctgcctccgatgctgacgaagccgggagcgaccacgcatggctgagatacaccgtggttcagctgagtgcaccctgcaatctgggtagcctgcagagcaaaatggtgcataccgccgaatgtggccctagtttcgcaattgacagcgaatctggcgcaatctccacaattcggacactggatcgcgaggtgcaagaagccgtagaattaaaggttgtcgctcaggatctgggagaacctccattgtcagccacttgtcttgtttcaatcaccgttgacgatgttaatgacaatgagcccatattctggcgtcaggtttataatgccactatcgcagagcacgcccctgtcggtcactgttttctgcaggtcactgcctcggatgctgattctggactgtacgggtttatcgagtactccttgtatgatgggttcctgtcctatgaggcacctcaggccttcaggattgacccccatgacggtcagatctgcgtgtcacaagatatcgacagagaaagagatcccgcaacctacgacctcctagtagaagctaaggacgggggggggctgtctgctcaggcgttcgttcgtgtggatctggaggatgtaaacgacaatcatcccgtcttcaatcccagcacatatgtcacatccatctcggacgagacacagcccggcaccgagataattaatgtgctcgctacggatcaggacagtggtatatatggaaccgtggcatatgagctgattccgggcaatgtgtcaagtctgttcacaattgacagtacaaccggcatcatttacctcacactgcccttaagccaccttgagagcacaaccctttccctcatggtgagcgcccaggacggcgggggtctgactgccgtgatcaatgccgatgtgaccatccacattttccagacaacgctggcccccgccgagttcgaacgccccaaatataccttcttagtgtacgaggatgtgcctgaggatagtccaattgggacagtgaaagctcgggagcccctaaactccagcgaacccattttctaccgaatctcatcaggcgatctcggaggtaagttcagtattcaccctaggcttggaacaatccggacccggaaaccactggatcacgagacgcaacctgtcgtggtgttaaccgttcaagcacaactcgggtcagcccctgcttgctccagcactgaggtaaacataacggttatggacgtgaatgacaaccaccccgcctttcttagaacctcagacgaaattaggatctcccagactacaccaccggggaccgctctgtacctggcacgagcagaggaccgggactctggccgaaacggactgatcagatacagtattgcttctccgcagccaggggtcttcgccatagaccgcgccctgggggtgctctttctaaatggcagtctgggagctggcgagcaaagagaactgaccctcaccctgagggccgaagatcagggtgtgcacccccaggctgcgttgttggtgcttactgttgtgattgaaaaaagagaacacagcccatcatggactttcgaacatttggtatatcaggtcgaggtcagtgagtccttgtccccaatgactcagatgctccagacacaggctcaccctctgggaccacagagggctgcctcaccattgaggtattcgcttgagccttctgtggatagcgccatgtttggcatcaggccctacaccgggtggatttatcttagaagacaatttgactatgaatccacccagacatacaactttagagtgtttgcttggatccccgaggacggattcttgcagaacgtctcgaccacagtgattgtaagagtctgggatgaaaatgataattcacccacattcctccacgatgtgttgttccttaaggtagaagaaagccctgtccctcagggcgttattggtaagatcactgcaatagacatggactcgggcaaaaacgggcagctgctctattttctcctgtccgacggaaagttctttaaaatgaaccctaatactggggagttgattaattgggtggcactggacagggaacacagggggcatcatgagatgaccgtgttggtcaccgataggggtagtccccctcgtaacgctaccatggctgtgtatgtgtccgtgacggacataaacgataataggcccttctttccccagtgtctaccaggaaaggagctgcacgtgaaggttttagaggggcaaccagtgaacatgcttgtgacaaccgtgttcgcaaaggatccagatgaaggcaacaatgccgaggtcacctacagtgtgagtagcgcacgaccgatgccactgaaaggcaagaccgctttcgggaaacagagctgcaagaagcaaacgaacaaacagactaaaagctag

SEQ ID NO: 113851 - DNA, 462 bp, Artificial Sequence
  Description of Artificial Sequence: Synthetic coding sequence
atgctcgaaaaactcatgggagctgattcactccagctgtttagatcaagatataccctcggcaaaatatactttatcggctttcagaggtcaatactgctgtcaaagagtgaaaactctttaaactccattgcaaaagaaacagaggaaggcagagaaacagtcacccgcaaggagggctggaagcgtcgccatgaggatggatacttggaaatggcccagcgacacctccagcgaagcttgtgcccgtgggtgtcctacctgccccaaccatacgcagagctggaagaggtcagttcacatgtggggaaggtcttcatggcaagaaactatgaattcttagcatatgaggcaagcaaagacagacgtcagccgctggagcgcatgtggacctgtaattataaccagcagaaagatcagagttgcaaccacaaggagattacttcaacgaaggccgaatag

SEQ ID NO: 113852 - DNA, 249 bp, Artificial Sequence
  Description of Artificial Sequence: Synthetic coding sequence
atggctcagcggcatctccagcgatcactatgtccatgggtatcttacctcccacagccttatgcagagctcgaagaggtgtccagccatgttggcaaggtgtttatggctcgcaactacgagtttctagcgtacgaggctagcaaggataggcggcaaccactggagcgaatgtggacatgtaattacaaccagcagaaagaccagtcctgcaatcataaagagattactagcacaaaagcagagtag

SEQ ID NO: 113853 - DNA, 378 bp, Artificial Sequence
  Description of Artificial Sequence: Synthetic coding sequence
atgcggacagccatttggaagtggcacaggggtatctacagagatcattatgtgctcggaagtttgacttttcttagtcccatgcagcgcgccgggactagcaatcagtggaacatggggaaagtgatgaccttggattctggtgacgaggttactttccataaaacatggccaacagagacgggctccccttatcgcctcgaggaggtatccagtcatgtggggaaggtcttcatggccaggaattacgaattcctcgcatatgaagccagcaaggaccggcgccagcccctggagcgaatgtggacttgtaactataaccagcagaaggaccaatcatgcaaccacaaggagatcacttccaccaaggctgaatag

SEQ ID NO: 113854 - DNA, 1725 bp, Artificial Sequence
  Description of Artificial Sequence: Synthetic coding sequence
atggagctgaaggcggaagaggaggaagttggcggagttcagccagtcagcatacaggcctttgccagttcatccacactgcatggcttggctcacatattctcttacgaaaggttgagtcttaagcgggccctgtgggcgttgtgttttctgggatcactcgctgtgctgttatgtgtctgtaccgagagagtgcagtactactttcactaccaccacgtcactaagttagatgaggtcgctgccagccagctgaccttccctgctgtgactttatgtaacttaaatgagttcaggttctctcaagtaagcaagaacgatctgtatcatgctggggagcttttagcactgctcaacaacaggtatgagatccccgacacgcaaatggccgacgagaaacagttggagattctccaggacaaagccaacttccgctccttcaagccaaagccattcaatatgcgcgaattttatgacagagccgggcatgacatacgggatatgttactctcatgtcactttcgtggtgaagtttgcagtgcggaggactttaaagttgttttcactaggtacggtaaatgctatacctttaatagtggtagagacgggcgcccaagactgaagactatgaagggaggaaccgggaacggtctcgaaattatgctcgacatccagcaggacgagtatcttccagtttggggcgaaaccgatgagacaagttttgaagcaggcataaaagtacagattcactcccaagatgaaccaccatttattgaccagctgggtttcggggtcgcccctgggttccagacatttgtggcttgtcaggagcagaggctcatttatctgccccccccttggggtacatgcaaggcggtcacaatggactcggatctcgactttttcgattcctattcgataaccgcatgcaggatcgactgtgaaacacgctacctggtggaaaattgcaattgccgtatggtacatatgccaggggatgctccttactgtacacctgaacagtataaagagtgcgccgatccagctctggactttctggtcgagaaggaccaggaatactgtgtatgcgagatgccttgtaacctgaccagatatggaaaggagctgtctatggtaaagatccccagcaaagcatctgcaaagtatcttgctaagaagttcaacaaatcagagcagtacattggcgagaacattctggtgctcgatatcttctttgaagtgctcaactacgaaactatcgagcaaaagaaggcttacgagatagctggcctcctcggcgagttactcatgaccccagtccccttttcttgtcacggccacggtgtggctccttaccatcccaaggctgggtgcagcctgttgagccatgaaggaccccctccccaacggccattccccaaaccctgctgcttaggcgacatcggaggccagatgggcttgttcattggtgcatccattcttaccgttttagagctttttgactacgcgtatgaggttatcaagcacaaactctgtcgcaggggaaagtgtcagaaggaagcaaagagatcatcagctgataagggggttgccctgagtctcgacgacgttaagcgtcacaacccttgcgaatccttgcgaggccatccagcagggatgacctacgccgctaacattctgccacaccaccccgctaggggaacatttgaggatttcacttgttag

SEQ ID NO: 113855 - DNA, 594 bp, Artificial Sequence
  Description of Artificial Sequence: Synthetic coding sequence
atgcgagtggtcgtgattggcgcaggagtgatcggcctgtcaacggccctttgtatccacgaacgatatcactctgtgttgcagccgttggacattaaggtgtatgccgaccgctttactccgctaaccacgacagacgttgctgccgggctgtggcaaccgtacttaagtgacccgaacaaccctcaggaagcagactggtcacaacaaacatttgattacttgctgtcccacgtccactctccaaatgctgagaatctgggtctttttctcattagtggatataacttgttccacgaggccatcccggaccctagttggaaggataccgtgctcggcttccggaagttgacgcctcgcgagctcgatatgttccctgattatggatatgggtggttccacacttctctgatcctcgagggaaagaattacctgcagtggctgactgagcgcctgacagaacggggcgtgaaattcttccagagaaaggtggagagttttgaagaagtcgcgcgggagggcgccgacgtcattgttaactgtactggggtttgggccggagctttgcaacgcgatccactcctgcagccatag

SEQ ID NO: 113856 - DNA, 2400 bp, Artificial Sequence
  Description of Artificial Sequence: Synthetic coding sequence
atgaagccatcgccagcgggaactgcaaaggagctggagccgcctgcaccagcccggggagaacagcgcacagctgaacccgaaggcagatggagagaaaaaggcgaggcggacactgagagacagcgtacacgggaacggcaagaggccacattggccggcctcgccgagctggaatacctgaggcagcgccaggagctgctcgttcggggtgcactacgcggcgctggcggggcaggggcagcggcaccgagagcaggtgaattgttgggtgaagcagcccaacgcagccggcttgaggaaaagttcctagaggagaacatcctgctgctccggaagcagctgaattgcctgcggagacgggacgctgggctgcttaatcagctacaagaactggacaagcagatttccgacttgaggctcgatgtcgagaaaactagtgaagagcacctggagaccgattcaagaccgagcagcgggttttacgagttgagtgacggagcctcagggtccttgagcaactcatccaacagcgtgttctcagaatgcctgagtagctgtcacagtagtacatgtttttgtagccccttggaggcgaccctatcactgagtgacggctgcccaaaatctgctgacgtgaatcccaagtaccagtgtgacttagtctctaagaacggaaatgacgtgtaccgctatccatctccccttcacgccgttgccgtgcagagcccgatgtttctcctgtgcctgaccggcaacccactgagagaggaagacagactgggcaaccatgcctctgatatttgcggaggaagcgagctggacgccgtgaagacagattcatctctaccctcaccgagttcattgtggtctgccagccatccttctagtagcaaaaagatggacggatatattttgagtttagtgcaaaaaaaaactcaccctgtgcgcaccaataaaccacgaacaagtgtcaacgctgacccaaccaaaggacttctgcgtaatggatcggtatgcgtacgcgcaccaggaggagtatcccagggtaacagcgtaaatctgaagaactccaagcaggcctgcctgccctcagggggaatccccagcttgaataatggtactttttcaccccctaaacaatggtcaaaggagagcaaagccgagcaagctgagtcaaagcgagtgcccctccctgaaggctgtccaagcggagctgcctccgacttgcagagtaaacatctgcctaagacagccaagccggcctctcaagaacacgcgagatgctctgcaatcggaacaggtgagagtccaaaggagagtgcgcaactttccggcgcctctccaaaagaatctccgagcagaggtcctgctccaccccaggagaacaaggtcgtccagcccctgaagaaaatgtctcagaaaaactcccttcagggggtgccacccgctacacccccactactttccaccgccttcccagtggaggaacgccccgccctggatttcaaaagcgagggatcttcgcaatcccttgaggaggcacacctagttaaagcccaatttatccccggacaacagccaagcgtccgactccatcgaggccaccgtaacatgggcgtagtcaagaacagcagtcttaagcaccgaggacctgctctgcagggtctggagaacggtctgccgactgtgagagagaaaacccgggccgggtcaaaaaagtgtaggtttccggatgacctggacacaaacaagaagctgaaaaaagcgtcttcaaagggaagaaaatccggaggaggacccgaggctggcgtcccgggcaggccggctggaggcggacaccgggccggttctagggcacatggtcacggtcgggaagctgtggtggctaaaccaaagcacaaacggacagattaccggaggtggaagtctagcgcggaaatatcttatgaagaagctctgcgtcgagctcgccgcgggagacgggagaacgtcgggttgtaccccgcccccgttcccctgccgtatgccagtccttatgcatacgtggcatcagactccgaatactcggcagagtgcgaaagtctgttccacagcaccgtggttgatacgagtgaagatgaacaatcaaattatacgacaaactgtttcggggattccgaatcctcagtgtccgaaggagagttcgtaggcgagagtactaccacttccgacagtgaggagagcggaggcctgatatggagccagtttgtccagacactgcctattcagacagtgacagcgcctgatttacataaccatcctgccaagacgtttgtcaaaatcaaagccagccacaacctgaagaaaaagatcttgcgatttcgatccggatcactcaagcttatgactactgtctag

SEQ ID NO: 113857 - DNA, 2511 bp, Artificial Sequence
  Description of Artificial Sequence: Synthetic coding sequence
atgaaaccctcccctgcggggactgcaaaggaacttgaaccccctgcaccagcgcggggtgaacaaaggacagccgagcccgagggccgttggagggagaagggtgaggccgatacagaacggcagcgtacacgggaaaggcaggaggctacgctggctggactggccgagctagaataccttagacaacggcaagagctgctcgtgagaggcgccttgcggggcgccggtggcgcaggtgctgccgctccgcgtgcaggcgagctcctaggcgaggcggctcagcgatctcgactagaagaaaagtttctcgaagagaatatactactcctgcgtaaacagttaaattgtctacgacgcagggacgccgggctgctgaatcaactgcaagagttagataaacaaatcagcgacttacgcctcgatgtcgaaaagacgtccgaagagcacctggagactgattctcggccatcttctgggttctatgagctgagcgacggcgcaagcggaagtctgtccaacagctccaattccgtcttttctgaatgcctttcctcctgccactcttcaacgtgcttctgctcgcctttggaagctaccttgtccctgtcagatgggtgcccgaagagcgccgatctgattggcctcttggagtacaaggagggacactgcgaggatcaggcctcaggagcagtgtgccgatcgctgtccacaccccagttcaactctctggacgtgatagctgatgtgaatcccaaataccagtgcgatttggtaagtaagaatgggaacgacgtgtatcgctatcctagcccgcttcacgcagttgcggttcagtcacctatgttccttctttgcctgactggaaaccctctgcgtgaggaggatcgcctcggtaatcacgcgtctgatatatgtgggggttcagagctcgatgcagtgaagaccgattccagccttccatccccatccagtctctggtctgctagtcaccctagcagctctaagaagatggatgggtatattctgtccctggtgcaaaaaaaaacgcaccctgtgcgtaccaacaagcctcgaaccagcgtgaacgctgatcctacaaaaggcctgttacgaaacggctccgtttgtgttcgagcgccaggaggggtgtcgcagggtaacagcgtgaatcttaagaattcgaagcaggcctgtttgccgtcagggggaattccttctctgaacaacggcacattctctccacctaaacaatggagcaaagaatcaaaagcagaacaggccgagtctaagagggtaccactgccggaggggtgcccaagcggcgctgcttccgacctgcaatctaaacacctgccaaagacagccaaaccagctagccaggagcacgccagatgttctgccataggaactggggagtctcctaaggagtcggcccagctcagcggggcgagccctaaggaaagtccatctcgtggaccagcacccccccaggagaataaagtcgttcagccgctgaagaaaatgtcccaaaaaaatagcttgcagggcgtgccacccgccacacctccgctgctgtccaccgcttttccagtcgaagaaagacccgccctcgatttcaaaagtgaggggagcagtcagtcgctggaggaagcccaccttgttaaagctcagtttatccctggccagcagcccagcgtgagactgcatagagggcaccgcaacatgggtgtcgtaaagaacagttcattaaagcaccgaggccccgccttgcaggggctcgaaaacggcttacccactgttagagagaaaacaagggccggttctaaaaaatgtcgatttccagatgatctcgataccaacaaaaaattgaagaaggctagcagcaagggcaggaagtctggaggtgggcctgaggccggggtgccgggaagacccgccgggggaggccatcgggcgggaagccgcgcccatggacacggccgggaagccgtagtggctaaacctaagcacaaacgaacggactacagacggtggaagagttcagcagagataagttatgaagaggcccttcgccgagctcgccgagggcggcgcgagaatgtcgggctctatccagccccggtgccgctcccatatgctagtccctacgcctacgtggccagcgactcggaatactccgcggagtgcgagtcattgtttcactccaccgtcgtcgatacctctgaggacgaacaaagcaactacaccacaaactgttttggagatagcgagagttcggtctctgagggagagttcgtgggagagagcacaaccactagcgatagtgaagagagcggtgggttgatatggtcgcagtttgtgcagacactgcccatccagaccgttaccgctcccgacctgcacaaccaccctgcgaagacgttcgtgaaaattaaggcttcacataacttgaagaagaaaatcttgagatttaggtctggttcgcttaaactcatgactactgtctag

SEQ ID NO: 113858 - DNA, 2325 bp, Artificial Sequence
  Description of Artificial Sequence: Synthetic coding sequence
atgtggaccccagggggacccccagggtctgcaggctgggacagacggagactgggggcccgcctgcgggcggcatttgccggtttacaggagctccagggacttcgcgccacccagcaggaacgggtcaggggggccctcgctctgcagcctccaccagctccagctgcaccttgcggcccccacggtctgcatgggcccgaacagcaactcgaggccgctctcgccgccctccaagaacagttgtcccgactgcgtcagcaggacattggattgaaaacccaccttgatcagctcgacctgcagatcagcaaattgcaactggacgtgggcactgcaagcggagaagccctggattctgacagccgcccttccagcggattttatgagatgagcgatggcggctcctgtagcctcagcaccagttgtgctagcgtgtgcagcgaccatatcagcccgagccttggtagtttgctgcccgtcgcacaggcgcacaaggctcggcccagtatgggggattggaggccccgaagtgtagatgaaacaactgtgccagcttggcgtccacaggcaacagaggaaggagcgcgaccgcccggttcagtcgaagacgccggccaaccgtggggcaccttttggccccgtcccgtgtcaacaggtgacttggatcgggcgctgccagccgatactggacttcagaaagcgtccgccgacgcagaactgctgggacttctatgtcaaggagtggatatcccactccacgtgccagatccgaaatatcgccaggatctggtgagtcagggggggagagaggtctacccttacccttcgccactccatgctgtcgctctgcagagccccctgttcgtcctcacgaaagagacaccacagcgcggggggccgagctttcccagagagtccccacgggggccggccggcctaaacaccatacaaacggggcccgtgctcgaagcaggccccgcccgcgctagagcctatattgatcgcctcctgcacctgtggggtcgagagactccagctaagggctccgaaggggagcaaggtcccctgagacacgcggcctctccatccccacaacgacaaggcggatggtcaaccgacggcggcggcagattactggtctttgctccaggtagggaggatgagggagggccagcgcagtctcgaggtgctggtagagggggccctcagcagcaaggctatatgccattagagggaccacaacagtcaggctcactcccagaggaaggttcaaagcccagcaacagctgcgtgctcagggaaaccatggttcaggcgagcccctcttccaaggcccagcaaaccccttccgcccaggactacggtcgcggaaacatcatttctccatcgcgaatgctagacaaaagtccctcgccagcctccgggcattttgcacacccttcgttcgctgcatctctgaagatgggcccacccaagagcaaagctgaaaaaataaagaggtctcctatggataaggttctgcgatttgccagacagccgcttctcctgctggacaggcctgagggcgctcatgctgcgcctcagccttcactggagtgggatcccgcccattggcccaccggccggggcggtttacaaagacgccccgccctagcatgggaggcccccggacggtcttgctccgaaagcactttatatccaatgccagtcctggtcccgcttgctgtagctccacaagaatcccacagaaccagcgcccaggctttgttccccttcgaggcttccttactcacatccgtggccagacgaaagcatagacgatggcaatctacagtggaaattagcgctagagctcggctcgcctcctgtcccgaatcaaatctgggcccccctcgccctgtggcgaggagggcaggggggcccctggcgaggggccggcccagtctggtgcgccaggatgcttacacaagaagcgattctgaaccaagtaagcactccgccgagtgtgacccccgctttcccagtgtcataccggagactagtgaaggagaatccagcgaccatacgaccaaccgtttcggggaccgtgagtccagttcttctgacgaagaaggcggcgctcaatctcgggattgtgacctggccctgggatacgttgccgccgggcatgccgaactggcctggacacaggaagctcccgtgtcctctggaccattactctcaccggtgcccaagctctgccgaataaaggctagtaaggctttgaagaagaaaatccgccggttccaacccacggccctcaaggtcatgactatggtgtag

SEQ ID NO: 113859 - DNA, 843 bp, Artificial Sequence
  Description of Artificial Sequence: Synthetic coding sequence
atgtggacacctggaggccctcctggtagtgccggttgggatcggcgtcgccttggggccagactgcgggccgcgtttgccgggcttcaagagctgcagggtctgcgggcaacgcagcaggaacgcgttagaggcgcgctggctttgcagcccccaccagcgcctgccgcaccctgcggaccccacggactccatggtcccgagcagcagctagaagcggccttggctgcccttcaggagcagctgtcacgcctgcggcagcaagacatagggctcaagacacacctcgaccagctggatctgcagatctctaaactgcagttggatgtggggactgcaagcggtgaagcgttggacagcgattcccgcccttcaagcggattttatgagatgtctgacggcggctcctgctccctctccacttcctgtgcaagcgtgtgttcagaccatatatctccgtcattgggctctttgcttcccgtggcacaggcacacaaagccaggccctctatgggcgactggcgcccgcggtcagtcgacgaaacaacagtgccggcgtggcgccctcaagctacggaggagggagctcggcctccggggagcgttgaagacgccggccagccttgggggacattctggccacgcccagtgtccactgaactctgtaatgcccctggtgaactggatatgcatgcaccaccagccggctgtacgagcagctcactaaccggggtcggctcaggtttaaggggaaagtgcgggctttgcggttgccagttgccattctgctccgtgaacacaagctcgaagaccaagtcgtccggtatatcccgccagcagtag

SEQ ID NO: 113860 - DNA, 1890 bp, Artificial Sequence
  Description of Artificial Sequence: Synthetic coding sequence
atgattagggcttttagctttccagtgagtcccgaacgcggcagactacgaggttggctggagggaagtttagccgggttgtgcgagctgcattggctgcgggagagacaggagtaccgcgtacaacaggcactgagactagcccagcccgggatgggcggcgccgaggccgaggacgaagaagacgcagacgaggacgaggatgcagcggctgcccgaagggcagcggccgcccttgaagagcagctggaagcactgcccgggctggtgtgggatcttggccaacaactcggagatctctcattagagtccggcggcctcgaacaggagtccgggcggtcctcaggcttttacgaggatcctagctccacagggggtccagacagtcctccttccacgttttgcggtgactccggctttagcggatcctccagttacggcagactaggtccttctgaaccacgaggaatatatgcttccgagcgacctaaatccttaggagacgcatccccatcggcccctgaggtggtgggtgctagagcggccgtccctcgcagttttagcgcaccttacccaacagcaggcggcagcgcaggccctgaagcatgctcgtccgctgagcgccgtgcccgtgccggtccgttccttacaccgagccctctccacgccgtagccatgcggtctccgcgaccttgtggccgacccccaaccgattccccggacgcaggaggtgccgggcgaccacttgatgggtacatctcggccttgctgagaaggcggcgccgccgaggcgctggccagccccgcacaagtcctgggggagcagacggcggacctagaagacagaattcggtccgacaacggccacctgacgcttctcctagcccaggctctgctaggcccgcccgtgagcctagcctggagcgggtcggggggcatcctacaagccctgccgcactaagtcgtgcgtgggccagttcctgggagagtgaagccgctcccgaacccgctgcccctccagccgctccaagcccacctgacagtccagccgaggggcggctcgtcaaagctcaatacattccaggagcccaggccgctactaggggtctacctggtcgcgccgcccggaggaagcccccaccactcacaagaggtagatctgtcgagcagtcccctccacgggaacgtcctagagcagctgggcgcagaggcagaatggctgaggcttctgggcgccgtggcagccctagggcacgtaaggccagtcggagccagtctgagacatccttgctgggtagggcgtctgcagtaccatcgggccctccaaagtatcctacggcggaaagagaagaacctcggcctcctaggccccgacggggccctgccccaactctggccgcccaggctgccggttcatgtcgaaggtggcgttccacggcagagatagatgccgccgatggtcgacgggtgagaccgcgggcccccgccgccagggtacctgggcccgggccctccccatcagccccacagcgacggttgctctacggttgcgccgggtctgattccgaatgttcagcaggtcggctgggccctctcggccggcgagggccagctggtggagttgggggagggtacggcgaaagcgagagttccgcttccgagggagagtctccagcatttagtagtgcaagcagcgacagtgacggatcgggcgggcttgtctggccacaacaactggtggccgctactgctgcatcaggaggcggggcgggagccggggcccccgctggacctgccaaggtgtttgtgaagattaaagcatcccatgccctaaagaaaaagatccttaggttcagatcgggcagtctgaaggtgatgactacagtgtag

SEQ ID NO: 113861 - DNA, 2025 bp, Artificial Sequence
  Description of Artificial Sequence: Synthetic coding sequence
atgaattctggcgctatgcgtattcacagcaaaggtcattttcaagggggcatacaagtcaaaaatgagaagaatcgccctagtctgaaatctctcaagaccgacaatagaccagagaagagcaagtgtaagccactgtggggtaaggtattctacctggatctgccatctgttaccatctccgaaaagctgcagaaggacatcaaagacctggggggaagggtggaagagtttctatcaaaagacatctcatatttgatcagcaataaaaaggaggctaaattcgcacagacattagggaggatttcccccgtacccagcccagagtccgcctataccgccgaaaccacctcaccccacccttcacacgacggctctagttttaagtcccccgatactgtctgtctttcccggggtaagctgttggtggaaaaggcgattaaagatcacgactttatcccatctaacagcatcttaagcaacgccttgtcatggggcgtgaagatccttcatatagatgatattagatactatatagaacagaaaaaaaaggaactttatttgctcaagaagtcaagcacgagcgtacgggatggcgggaagcgggtggggtcaggagcccaaaaaacacggacaggtcgcttgaaaaagccgttcgttaaggtcgaagatatgagccagctctacagacctttctacctccagctgacgaatatgccgttcatcaactactctattcagaagccatgtagtccgttcgacgtggacaagcctagctccatgcagaaacagacacaagttaagctcaggatccagactgatggagataaatatgggggaacttctatccaactgcagctgaaggaaaagaagaagaaaggctattgtgaatgttgtctacaaaagtacgaggatctcgagacacatctcttgtctgaacaacaccgtaacttcgctcaatctaatcagtaccaggtggtggacgatattgtctccaaattggtcttcgactttgttgagtacgaaaaggacacccccaagaaaaaacggatcaaatattccgttggaagtttgtcacctgtgagcgcaagtgtcctcaagaagacagagcagaaggaaaaggtggagctgcagcacatttcccagaaagactgtcaggaagatgacacaacagtgaaagagcaaaactttctctacaaagaaacacaggaaacagagaagaaactgctcttcatcagcgagcccataccgcatccatcaaatgaactgcgcggcctgaacgagaagatgagcaataaatgctccatgctgagcaccgctgaagacgacatcaggcagaatttcacccagctcccattgcacaagaacaagcaagaatgcatcctggatatctcagaacacacgctttcagagaacgatctggaggagttgcgtgtggaccactacaagtgcaatatccaggccagtgttcatgtatccgatttttccactgataactctggcagccagccaaagcagaagtcagataccgtgctgtttccagccaaggacctcaaggagaaggacttgcattccatttttacacatgattcaggactgattactatcaacagctctcaggagcacctcacagttcaagccaaagccccttttcacacaccccccgaggagcctaatgagtgcgattttaagaacatggattcccttcctagcgggaaaatacaccgcaaggtcaagatcatcctcgggcgcaatcgaaaggagaaccttgaacccaacgccgagttcgacaagagaactgaattcattactcaggaagaaaataggatttgcagtagtcccgtgcagagcctgctcgacttgtttcaaactagcgaggagaaaagcgagttcctggggttcaccagttacacagaaaagtctggcatctgcaatgttctcgacatctgggaggaggaaaattctgacaatctccttacagctttcttctctagcccttctaccagtacatttaccggtttttag

SEQ ID NO: 113862 - DNA, 654 bp, Artificial Sequence
  Description of Artificial Sequence: Synthetic coding sequence
atgaacagcggtgcgatgcgaatccattcaaaaggccacttccaaggcggcatacaagtgaaaaacgaaaaaaatcggccgagcctgaagagcttgaagacagacaaccgtcctgaaaaaagcaaatgtaaacctctgtggggcaaggtcttctaccttgacctcccaagcgtaacaataagcgaaaagctgcaaaaggacattaaagacttgggtggaagagtggaggagtttctgtctaaggacatctcgtacctgatctcaaacaagaaggaagccaaattcgctcagaccctggggcggatttcccccgtgccgtcacccgagtccgcttacacggctgaaacgacaagcccacatccttctcacgacgggtccagcttcaagagtcctgataccgtttgtctttcaagggggaaactcctggtggaaaaagccataaaggaccacgattttattccctccaactccatcctgagcaatgcgctcagctggggcgttaaaatcctgcacatcgacgacataaggtattatattgagcagaagaagaaggagttgtacctgctgaagaaatcttctacgtccgtgagggatggtggcaaacgagttggctctggcgcacagaaaacgcgcaaggcgttacaatcgatttag

SEQ ID NO: 113863 - DNA, 1848 bp, Artificial Sequence
  Description of Artificial Sequence: Synthetic coding sequence
atgtctgagcctggaaagggagacgactgcctggaattggaatccagcatggccgaaagccgcctgcgtgcgccagatctcggcgtgtccaggtgccttgggaaatgtcagaagaactccccaggcgcccggaaacatccattttccggcaagagcttttacctggatttgcctgccggtaagaacttgcagtttttaacaggggccatccagcagctgggtggcgtcatcgaagggtttctctccaaggaggtgtcctacatcgtgagctcacgccgagaggttaaggctgaatcttccggcaagtcgcacaggggatgcccatcaccgtctcctagcgaggtgagagtggagacatccgcgatggtggacccaaagggatcacacccaaggcctagtaggaagcccgtcgactcagtccctctgagcagaggcaaagagcttttgcagaaggcgattagaaatcaggggtcgattagtgggggaggctcaggcggtagcagcagtctactcactaatgctcggtcatggggcgtgcgtatcttgcacgttgatgaaatgatgatgcacgtacagcagctcagcctggccagcctgtgcgtaaagaagcaacaaccaaagaagccagaaggaacgtgccccgctgctgagtccagaacccgtaaggtggcccggctcaaagctcccttcctgaagatcgaggatgagtcaaggaaattcagaccctttcaccatcaatttaagagcttcccagaaattagctttctgggtccaaaggatgcaagtccctttgaagccccaactacactcggttccatgcaccatacgcgcgagtcaaaggacggggagccttcaccacgctccgctgcccatactatgcctcggaggaaaaaaggatactgcgagtgctgccaggaggcctttgaagaactgcacgtgcatctccagtccgcacagcacaggtccttcgctcttgaggcccacttgtacgcagaagtcgaccggatcattgcccagctgtcacactcatttgctgatattcctttccaggccggtctccctcgctggtctggttcaccggcgtccgattgcgatcctttgtgcccagagactttacatccacaccagcctagccatcccagggccgcctccccccgtatccggaaagaagattcttgtcaggcctccgtcacgcaaggccgcgctgcaggacagcagagatggacagaatcattggacggcgtgatggggccacccgcttcacacacctgcgtgtccgccactactctgctcccagcactccccaaaggcagcagggagcagggttgtctctgcccctgtccagccagttttacccaatcccatctggtaacgtcactggctttactcccaggagaatggtccccagccgaagatatgccgctgcacccctcccaggagaattcattcgctcctgcagacatccccgttaaggggcccctcctctttccagaagcccgcccctggctaatgtctgcaagatgctgggttcgtcctttcccattcgtcacctggggctgtctgattccacacgataccactcctctccatgaggaggtttcaccttgcccgtgtctgcgactggggtatctgtatctgcttctgacacagagtctgtggtgtcgtgtgcgggtcccctcactcagtactgccggccctattccacgcacgtctcatccatgcaccctagccttccccagctatctaaacgaccacgacctgggacacttatgtcaggcaaagccacaggggtggaatacccctcaaccgttcctgcactgcggatttttggcagtagacagcggctag

SEQ ID NO: 113864 - DNA, 1296 bp, Artificial Sequence
  Description of Artificial Sequence: Synthetic coding sequence
atgtctgaaccagggaagggagatgactgtctggagctcgaatcttccatggccgaatcccgcttgcgggccccggacctgggagtctcgcgatgcctcgggaagtgccagaagaattccccgggggcacgcaagcaccccttcagcggaaagagtttctacctggatctgcccgccggtaaaaacttacagtttctcacaggcgccatccagcagttaggcggcgtcatcgagggatttttgagtaaggaagtctcttatattgtttcatctcgccgggaggtgaaggcggagtcttcaggtaaatcacaccgcggttgtccatctccctctcctagtgaggtcagggtggagacgagcgctatggtcgaccccaaagggagccatcctaggccatccagaaagcccgttgattctgtgcctctttctcggggcaaagaattgttacagaaggctatcaggaaccaagggagtatttctggtggtggctcaggtggatcatcaagtctgctcaccaatgcacgcagttggggagtgaggatcctgcatgtggacgaaatgatgatgcacgtccagcaattgtcactggcctctctgtgcgttaagaaacagcagccaaaaaaacccgaagggacctgcccggcagcagagtcccgaaccaggaaagttgcccgcctcaaagctccgttcctgaagatcgaagacgagagccgcaaattccgtccttttcaccaccaattcaaaagtttccctgagatttcattcttaggccctaaggacgcctcacctttcgaagcccccacaacattgggcagcatgcatcatactagggaaagtaaagatggcgagccctccccacgttccgcagctcacacaatgccacggaggaaaaagggctactgcgagtgctgtcaggaggcattcgaggaactgcatgttcaccttcagtccgcgcaacatcgctcctttgccctcgaggcgcacttgtacgcagaggtcgaccgaattatcgcccagctgtcccactctttcgctgatatcccttttcaggccggactgccacgctggagtggcagccctgcttccgattgcgaccccctgtgcccagagaccctgcatcctcatcagccaagccatccacgagccgcctcaccacgcattcgaaaagaagacagctgccaagccagtgtgacccagggcagagcagcaggacaacaaagatggaccgagagtttagatggcgtaatgggccctccggcctcgcacacctgtcacagaccttgtcgtcttccctag

SEQ ID NO: 113865 - DNA, 474 bp, Artificial Sequence
  Description of Artificial Sequence: Synthetic coding sequence
atgtctgagcccgggaagggtgacgactgcttagaactggaatcgtcaatggctgagagcagattgcgggctccagatcttggcgtgtcccggtgtttgggtaagtgccagaagaattcccctggcgcccgcaaacacccctttagcggcaagtccttttatctggacctccccgctggtaagaaccttcagtttcttaccggcgccatccagcagttgggaggagttatcgagggcttcctgtctaaagaagtttcttacatagtgtcttcacggagagaggtgaaggctgaaagctcagggaagagtcacagagggtgcccatcaccatcccctagtgaggtgcgtgtggagactagcgctatggtggaccccaagggcagtcatccccgcccctcaagaaaacctgttgattcggtgcccctctcccgcggtaaagaactccttcagaaagccatccgcaatcagaaatag

SEQ ID NO: 113866 - DNA, 570 bp, Artificial Sequence
  Description of Artificial Sequence: Synthetic coding sequence
atggtgggaggcgggcagccttgtggcccaaatatgtctgaagtcagctgcaaaaaaagagacgactacttagaatggccagaatatttcatggccgtggccttcttgtccgcgcagcgctctaaggacccaaattcccaagtcggggcctgcattgtaaattctgagaacaagatcgtcgggatcggatacaacgggatgcctaacgggtgctccgatgatgtcctcccctggaggcgaaccgccgaaaacaagctcgataccaagtatccatatgtctgccatgcagagttgaatgccatcatgaacaaaaattccactgatgttaagggatgtagtatgtatgtggctctgtttccatgtaatgaatgtgcaaaactcatcatccaggccggaataaaggaggtaatctttatgtcagataagtatcatgacagcgacgaggcaacagccgcgaggcttctcttcaacatggctggagtcacttttcggaagttcatccctaagtgttctaaaatcgtgattgattttgactccatcaacagccgccccagccagaaattgcaatag

SEQ ID NO: 113867 - DNA, 537 bp, Artificial Sequence
  Description of Artificial Sequence: Synthetic coding sequence
atgagtgaagtgagctgtaagaagagagacgactacttggagtggccggagtacttcatggccgtagccttcttgtcagcacagaggtcgaaggatcctaactcacaggtgggtgcttgcatcgttaacagcgagaataaaatcgtgggaatcggctataatggcatgccgaacgggtgctcagatgacgttctgccgtggcggcgcactgccgagaacaagctggatactaagtacccctacgtgtgtcatgccgagttaaatgcaatcatgaacaaaaatagcacagacgtcaagggatgttctatgtacgtggcactgttcccttgcaacgagtgtgccaaattgatcatccaggccggaatcaaggaagtcatttttatgtccgacaagtatcacgattctgatgaggcaacagccgcccggctgctatttaacatggccggagtcactttccgcaaatttatacccaaatgtagtaaaatcgtaattgatttcgatagtatcaattcccggccaagccagaaacttcagtag

SEQ ID NO: 113868 - DNA, 510 bp, Artificial Sequence
  Description of Artificial Sequence: Synthetic coding sequence
atgtcggaggtctcctgcaagaaaagagacgactacctcgagtggccggagtattttatggccgttgctttcctcagcgcacagagatcaaaggaccctaactcccaagttggcgcctgtattgtcaactccgaaaacaaaattgtgggaatcgggtacaatggaatgcctaacggctgcagtgatgatgtgctcccctggcgaagaacagctgagaacaaactggacactaagtacccatacgtctgccacgccgagctcaacgccataatgaataagaatagcaccgacgttaaagggtgctccatgtacgttgctctttttccttgtaacgagtgcgccaagttaattattcaagcaggcatcaaagaagtgatattcatgtccgataagtaccacgactcggatgaggcgaccgccgcccgcctcttgtttaacatggccggcgtgacgtttaggaagtttataccaaagtgtagcaaaatcgtgatcgattttgattctatctag

SEQ ID NO: 113869 - DNA, 222 bp, Artificial Sequence
  Description of Artificial Sequence: Synthetic coding sequence
atgtcggaagtgtcatgtaaaaaacgagacgattacctggagtggccagagtactttatggctgtggccttcctgtctgcccaaaggtcaaaagatccaaatagccaggtgggagcctgtatcgtcaattcggaaaacaagatcgtgggcatcggctacaacggaatgcccaacggatgtagcgatgatgtgctgccatggaggagaacggctgaaaattag

SEQ ID NO: 113870 - DNA, 180 bp, Artificial Sequence
  Description of Artificial Sequence: Synthetic coding sequence
atgtccgaagtctcatgtaaaaaacgcgacgactatctggagtggccggagtacttcatggctgtcgcttttctgtccgcacagcggagcaaagatcctaattcccaagttggcgcctgtattgtgaactcagaaaacaagatagtaggaattggctataacggcatgcctaacggatag

SEQ ID NO: 113871 - DNA, 72 bp, Artificial Sequence
  Description of Artificial Sequence: Synthetic coding sequence
atgtcggaggtaagctgcaagaaaagggacgattatctcgagtggcccgaatacttcatggccgtcgcctag

SEQ ID NO: 113872 - DNA, 363 bp, Artificial Sequence
  Description of Artificial Sequence: Synthetic coding sequence
atgtcagaggtgtcgtgcaagaagagagacgactaccttgaatggccggagtacttcatggctgtggccttccttagtgcccaacgtagcaaggacccaaatagtcaggtcggggcctgcatcgtaaattccgagaacaagattgtagggataggctacaacggcatgcccaacggatgctccgatgatgtattgccatggagaagaacagccgaaaataagctggacactaaatacccgtacgtttgtcacgccgagctaaacgctataatgaataaaaattctacagatgtgaagggatgctccatgtatgtcgctctgtttccctgtaatgagtgtgcgaagctcatcatacaggcttag

SEQ ID NO: 113873 - DNA, 537 bp, Artificial Sequence
  Description of Artificial Sequence: Synthetic coding sequence
atgagcgaagtctcttgcaaaaagagggacgactatctggagtggcccgagtacttcatggcagttgcttttctgtccgcccaaagatcgaaggatccaaattcgcaggttggggcgtgtatcgtgaattctgagaacaaaatcgtgggtatcggatacaatggtatgcccaatggctgtagcgatgatgttttaccgtggagacggacagccgaaaataagctggacaccaaatatccttacgtttgccatgcagaactaaacgctattatgaacaagaactccacagatgtgaaggggtgtagcatgtacgtcgcgcttttcccttgcaacgagtgtgctaagctaatcatccaggctggcataaaggaagtcatcttcatgtctgataagtaccacgactccgatgaagccaccgccgctaggcttttgttcaatatggccggcgtcacgtttagaaagtttatccctaaatgctccaagattgtgatcgatttcgactctattaatagccggccatcgcagaagctgcaatag

SEQ ID NO: 113874 - DNA, 360 bp, Artificial Sequence
  Description of Artificial Sequence: Synthetic coding sequence
atgtccgaggtcagttgcaagaaacgtgacgattacttggagtggcctgaatattttatggccgttgcctttcttagcgcacagcggtctaaggaccccaactctcaggtcggagcatgtatcgtaaacagtgaaaataaaatcgttggaattggatacaatggcatgccgaacggttgttctgacgacgtgctgccctggcgtaggaccgccgagaacaagttagacaccaaatatccatacgtatgtcacgcagagctgaacgccattatgaacaaaaactccactgacgtgaaaggatgctccatgtatgttgctctctttccctgcaacgaatgcgctaagctgattatccaatag

SEQ ID NO: 113875 - DNA, 297 bp, Artificial Sequence
  Description of Artificial Sequence: Synthetic coding sequence
atgtcagaagtcagttgtaagaaaagggacgactacctagagtggcctgaatacttcatggccgtcgctttcctgagtgctcaaagaagcaaggatccaaatagccaagtcggagcgtgtatcgtaaacagcgagaataaaatcgttgggattggatacaacggcatgcctaacgggtgtagtgacgacgtgctgccctggcggcgtaccgccgaaaacaaactcgacactaaatatccttacgtgtgccatgccgagcttaatgctattatgaataaaaacagcacagacgtttag

SEQ ID NO: 113876 - DNA, 780 bp, Artificial Sequence
  Description of Artificial Sequence: Synthetic coding sequence
atgaataagctgaaatcttcacagaaagacaaggtccgccaattcatgatctttactcagtcaagtgagaagaccgccgtttcgtgcttgtctcagaacgattggaaactcgatgtggcaacagacaatttctttcagaaccccgagctttatatcagggaatcagtgaagggctcactggatagaaaaaagttagagcagctgtacaaccggtacaaggacccacaggatgaaaataaaattgggattgatggaatccagcagttttgtgatgacctggcgctcgatcccgcctctatcagcgtgctgataattgcatggaagttcagagctgccacacagtgtgagttcagcaaacaagagttcatggacggaatgactgaactgggatgcgacagcatagaaaaactaaaagcgcagataccgaagatggagcaggagctgaaggaacccgggagatttaaagatttctatcaattcacattcaattttgctaagaatcctggccagaaggggctggatctcgagatggccatcgcttactggaacctggtcttgaacggacgattcaaatttctagacttgtggaacaagttcctgcttgaacaccataagagatcaatcccgaaggatacatggaacctgctcctcgatttctccactatgatcgccgacgacatgtcgaactacgatgaagaaggggcgtggcctgtgttgatcgatgattttgtggagttcgcccggccacagatcgctggaaccaagagtaccaccgtgtag

SEQ ID NO: 113877 - DNA, 660 bp, Artificial Sequence
  Description of Artificial Sequence: Synthetic coding sequence
atgaacaaactaaagtcctcgcagaaagataaggtccggcagttcatgatttttacacagtccagtgagaagaccgctgtcagctgtctgtcccagaatgactggaagctagacgtggcgacggacaacttcttccagaacccggagctctatataagagagtccgtcaagggcagtctcgatcgcaagaagctggagcaactgtataatcgctacaaagacccacaggacgagaataaaattggaatcgacgggatgaccgagctgggttgcgactctatagaaaagttaaaagcccagatacctaagatggagcaggagttgaaagagcccggtaggtttaaagacttttaccagttcacgtttaactttgccaaaaaccccggacaaaagggtctggatctggagatggccatagcctactggaatttggtgttaaatggaagattcaagtttctcgatctgtggaataagtttctcttggagcatcataagcggtcgatcccgaaggacacctggaacctgttgctagatttctcgacaatgatagcggacgatatgagcaactacgatgaagagggggcctggcccgttctgattgatgattttgtcgagttcgcaaggccccagattgcaggaaccaagtctaccactgtgtag

SEQ ID NO: 113878 - DNA, 387 bp, Artificial Sequence
  Description of Artificial Sequence: Synthetic coding sequence
atgatctttactcagagcagcgagaaaacggccgtttcgtgcttgagccagaacgattggaagcttgacgtcgcgaccgataattttttccagaatcctgagctgtatattcgcgagtcagtaaaggggtcactcgaccgtaagaagcttgagcagctctacaaccgctataaagacccccaggacgaaaacaagatcggtattgacgggatacagcagttctgtgacgacctcgctctggacccggcgtccattagcgtgctcattatcgcgtggaagtttcgcgccgctactcagtgcgagttttcaaagcaagagttcatggacggaatgactgagctgggctgcgacagcattgagaagctgaaggcacagattcctaagtag

SEQ ID NO: 113879 - DNA, 879 bp, Artificial Sequence
  Description of Artificial Sequence: Synthetic coding sequence
atgcactcggatgccgccgccgtcaatttccagcttaactctcatttgagcaccctcgcgaatattcataagatttaccacaccctgaacaaactgaatctgacagaggatattgggcaggatgatcatcagaccggatcacttaggtcctgcagcagtagtgactgtttcaacaaggtgatgcctccccgaaagaaaagaaggccagctagtggggacgacctgtctgctaagaaatcgaggcacgactctatgtataggaagtacgattccacgcggatcaagactgaagaagaggccttcagctccaagaggtgtctggagtggttttatgagtatgctggtactgatgacgtagttgggcccgaaggaatggagaaattttgcgaagacattggagtggaacctgaaaatgtggtgatgttagtgttagcctggaagttggacgctcagaacatgggctactttaccctccaagaatggctgaagggaatgacatccctgcagtgcgacaccaccgagaagcttagaaatacactcgactacctcagaagctttctcaacgattcaacaaactttaaactcatctaccggtacgccttcgatttcgctcgggagaaggaccagcgatcgctagatataaatacggcaaaatgcatgctcggtttgctgctggggaaaatctggcctttattccctgtcttccatcagtttctggaacaatcaaagtacaaggtcatcaacaaggatcagtggtgcaacgtactcgagttcagtcgcactattaatttggacttgagtaactacgatgaggatggggcatggcccgtgctcctcgatgagtttgtagagtggtacaaagacaagcaaatgagttag

SEQ ID NO: 113880 - DNA, 699 bp, Artificial Sequence
  Description of Artificial Sequence: Synthetic coding sequence
atgcccccacggaagaagaggcgccccgcttctggtgacgatctgtcagcaaaaaaaagccgacacgactccatgtaccgtaagtacgattcaactcgaatcaagacagaggaagaggccttttctagcaagcgctgcctcgagtggttttatgaatatgcagggacagacgatgtggttggtcccgaaggcatggaaaaattttgcgaggatatcggagtggagcctgaaaacgtggtgatgctggtgctggcttggaaactggatgcacagaatatgggttacttcaccctgcaagagtggctcaagggtatgaccagtctgcagtgcgacactaccgagaagctaagaaatacgcttgactacctcagatctttcctgaacgatagtacaaacttcaaactcatttatagatacgccttcgactttgcaagggaaaaagatcagaggagcttggacatcaatacagcgaagtgcatgttaggcctgttacttggcaaaatatggccactgtttcccgtcttccaccaatttctcgagcagtccaaatataaagtgatcaataaagatcaatggtgcaatgttctggagttcagccgtaccatcaatctggacttgtccaactacgacgaagatggagcatggcctgtccttctagacgagtttgttgaatggtataaagacaagcagatgagctag

SEQ ID NO: 113881 - DNA, 774 bp, Artificial Sequence
  Description of Artificial Sequence: Synthetic coding sequence
atgcattccgatgctgctgctgtgaacttccaactgaacagtcatcttagcacactggccaatattcacaagatttatcacaccctcaacaaactgaacctgaccgaggatataggtcaagacgatcatcaaacggggagtcttaggtcctgcagctcttctgattgtttcaataaagtcatgccgccaagaaagaagcgtcgacctgccagcggggacgacctgtcagctaaaaagtcaagacacgattctatgtaccggaagtatgattcgacgcggattaaaaccgaagaggaggctttctccagtaaacggtgcctcgaatggttctacgagtacgcaggaacagatgacgtggtgggacccgaggggatggagaagttctgcgaggacatcggtgtcgagcctgagaacgtggtgatgctggtccttgcatggaaacttgacgctcagaacatgggatattttacactgcaagaatggctcaaagggatgacatccttacagtgcgacaccactgagaagctaaggaataccctcgattacctccgtagttttttgaacgactcaacgaactttaaactgatctacaggtatgcctttgacttcgccaggcagagcaagtacaaggtaattaataaagatcaatggtgtaacgtgctggaattttcaaggactattaatctcgacttatctaattacgacgaagatggagcatggcctgtgctgctagatgagtttgtagagtggtacaaagacaaacaaatgagctag

SEQ ID NO: 113882 - DNA, 1011 bp, Artificial Sequence
  Description of Artificial Sequence: Synthetic coding sequence
atggaagtggaggccgcactgggctgcagcggtcaaggtcgcggctgtggtggcgtcgcacctgccggccgcggcagggagagagcctccgagcgaggcactagagtacgcatctccaagggtctttctggcgctgggggatcagtgcgtaaagccgatttccagctgaatagccacttgtcaaccttggccaatattcacaaaatctaccacacactgaataagctgaaccttacagaagacattggccaagatgatcatcagaccggctccctgaggtcctgttcaagcagcgactgtttcaataaggtcatgccgcccagaaaaaagcggaggccggcctccggggatgatctgagcgctaaaaagtcacgacacgattccatgtacaggaagtacgactccacacgaattaagaccgaagaggaggcattctcttctaaaaggtgcctggagtggttctatgaatatgcggggactgacgatgtagtcggtccagagggtatggaaaagttctgcgaagatattggggtggaacctgaaaatgtggtgatgctagtgttagcgtggaagcttgacgctcagaacatgggctactttaccttgcaagagtggctcaagggcatgacatctctgcagtgcgatacgaccgagaagcttcgtaataccctggactatttacggagctttctgaatgatagcactaatttcaagctgatctaccgctacgcgtttgacttcgcacgggaaaaggatcaaaggtcactcgatataaacaccgctaagtgcatgctgggattactcctggggaaaatttggcccctcttccctgtgtttcaccagttcctggagcaatctaaatacaaagtgatcaataaagatcaatggtgtaatgtcctggaattcagtcgaactataaatctggacctctccaactatgacgaagacggcgcttggccagtgctcctcgacgagtttgtggagtggtataaagataagcagatgtcatag

SEQ ID NO: 113883 - DNA, 1854 bp, Artificial Sequence
  Description of Artificial Sequence: Synthetic coding sequence
atggctgccgtggccgcaggcggcctggttggcaagggtcgggatattagtctcgctgcacttcagcggcatgatccttatattaacagaatcgtagatgtcgcaagtcaggtagctctctatacattcggccaccgagcaaatgaatgggaaaagacggacgtggagggtaccctgttcgtctacaccagaagcgcgagtcccaaacatggcttcaccataatgaacaggctctccatggaaaatcgcaccgagcctatcaccaaggatttggattttcagttgcaggacccatttctgctctatcggaatgcacgattatctatatacgggatttggttctatgataaagaagagtgccagcggatcgccgaacttatgaagaacttaactcagtacgaacaacttaaagcccatcaggggaccggggcgggaattagccccgttatcctgaattccggggaggggaaggaggtggatatcctgaggatgttaatcaaagcaaaggacgagtatacaaaatgtaaaacctgctcagaacccaagaagataacttcttcctctgcaatatacgataatccaaatctcatcaaacccatccccgttaagccctccgaaaaccaacagcaaagaatcccccaaccgaatcagaccctggatcctgagcctcagcacctttctttgactgcactgtttggaaaacaggataaggccacatgtcaggaaaccgtcgaacccccccagactctacatcagcaacagcaacagcagcagcagcaacaagagaagctgcccattcgccaaggtgttgtgcgatctctgtcctatgaggagcccaggcggcattccccacctattgagaaacaactctgccccgcgatccagaagctgatggtgcgaagcgccgaccttcaccctctgtccgaactgcctgaaaaccggccatgcgagaacgggtctacccatagcgctggagagttttttacgggccccgtgcagcctgggagccctcacaacattggaacctcccgtggggttcaaaatgctagccggacccagaacctatttgagaagctccagagcacacccggcgccgccaacaaatgtgacccctccaccccagcccccgcctcttcagcggcactgaatcgctcgcgcgcacctacctccgtaactcccgtcgctccaggcaaggggctagctcagcccccacaagcatacttcaatggttcgctaccgccacaaacagttggccaccaggctcacggcagagaacagtcgactttaccaaggcaaacgctaccaatctctggttcccagactgggtccagtggagtgatcagccctcaagagctgcttaaaaaactacaaattgtgcagcaggaacaacagttgcacgcctcgaaccgacctgcattagctgccaaattcccagtcctcgcacagagctccggaactggaaaaccattagagtcctggatcaataaaaccccaaatactgagcagcagaccccgctgtttcaggtcatttcacctcagcgcattcccgccaccgcggctccatccctgctgatgtcgcctatggtgtttgcccaacctacttccgtccctcccaaggagagagaaagtggactgttgcccgtcgggggccaggagcctcctgcagcggccactagtttattactgccgatccagtcacccgagccaagcgttattacttctagtccactcacaaagctccagctgcaggaagccttgctgtatctgatccagaatgacgataacttccttaacataatttacgaagcgtacctttttagcatgacgcaggccgcaatgaagaagactatgtag

SEQ ID NO: 113884 - DNA, 1548 bp, Artificial Sequence
  Description of Artificial Sequence: Synthetic coding sequence
atgcagatcaaagtgtcaatctacggcatatggttttacgataaagaggaatgccaacgcattgctgagctgatgaagaacttaacgcagtacgagcaactgaaagcccaccaggggaccggggccggtattagccctgtcattctgaatagcggggagggtaaagaagtggacattcttcggatgttaataaaagctaaagacgagtatactaagtgtaagacatgctcagagccaaaaaaaatcacatcgagttccgcaatttatgataatcctaacctgattaagccgattcctgtcaagccatcagagaaccagcaacagagaataccgcagcccaatcagaccctggaccccgagccccagcacctgtcactaactgctctgttcgggaagcaggacaaagcaacttgccaagaaaccgtggagcctccccagactcttcaccagcagcaacagcaacaacagcagcagcaagaaaagctgcccattagacagggggtggtgaggagcctctcgtacgaggagccccggagacatagccctccgatagagaaacagctgtgcccagccatccagaagctgatggtcagatccgctgacctacaccctctgtccgagctgcctgagaatcgcccttgtgagaacggtagtacacacagcgctggtgagttctttacaggccctgtccagcctggaagccctcacaacatcggcactagccgtggagttcagaacgcaagtcggacgcaaaacctttttgaaaagctccagtccacacctggcgccgcgaataaatgcgatcccagcacccccgctccagcgtcatccgctgctcttaaccgtagcagggcccccacttctgtaacaccagttgctcccggcaagggactagctcaaccgccccaggcatattttaacggctccctgcctccacagacagtcggccaccaggctcacggacgagaacagagcacattaccacggcagactttaccaatctctggctcacagaccggcagctccggcgttatttctccacaagagctgctgaagaagttgcaaattgttcagcaggagcagcagctgcacgcctcaaataggcccgcgctagccgctaagtttcccgtgcttgcccagtcgagcggcaccggaaagccgctcgagtcatggattaataagactcctaacacggagcagcaaacccctctgttccaggtgatcagcccacagcgtattcccgccaccgccgcaccatctttactcatgagtccaatggtgtttgcacaaccgacctctgtgcctccaaaggagagagaatcagggctcctcccagtgggcgggcaggagcccccagctgcagctacttcgctgctgttgcccatccagtcccccgagccctctgtgataacgtccagcccactgacaaagctacagctgcaggaggccctgctgtatctaattcaaaacgacgacaactttctcaacataatctacgaggcttatctgttctctatgactcaagccgcaatgaaaaagactatgtag

SEQ ID NO: 113885 - DNA, 1263 bp, Artificial Sequence
  Description of Artificial Sequence: Synthetic coding sequence
atggaaaccaagagggtggaaatcccaggctccgttttagacgatttctgttctcggttcatattacacattccctccgaagaaagagacaacgccatccgcgtgtgttttcagatcgaactggcacattggttctacctcgatttctacatgcagaatacacctgggcttcctcaatgtgggatcagagattttgccaaagccgtattttcccattgccctttcctcctcccccagggggaagacgtcgaaaaggtgctcgatgagtggaaagaatacaagatgggagtacctacatatggcgctataattctcgacgagacgttggaaaatgtacttttggttcagggttatcttgctaaatcaggttggggattccccaagggaaaagtaaacaaggaagaagcacctcatgattgcgcggcgagggaggttttcgaagaaacgggtttcgacatcaaggactatatatgcaaggatgattacattgaactcagaattaacgaccagttggcaagactatatatcattcccggcattcctaaagacactaagtttaacccaaagaccagacgggaaatccgcaacattgagtggttctccatcgaaaaactgccatgccacagaaacgatatgactcctaagtctaagcttgggctagctcctaacaaattcttcatggccattccctttatacgccccctacgcgactggctgagtaggaggttcggcgactcgtcagactccgataatggattctctagcaccggtagcactcccgctaagccgaccgtggagaagctgagcaggactaagttccgacattcccagcagctcttccccgatggatcacccggcgaccagtgggtaaaacaccgccagccattacaacagaaaccatataacaaccactcagagatgtccgacctccttaaagggaagaatcagtctatgcgggggaatggacgcaagcaataccaggactcgccaaaccagaagaagcgaaccaacggcctgcaaccagccaaacagcagaatagtttaatgaagtgtgaaaagaagctgcatccacgtaaacttcaggacaactttgagacggacgcagtgtacgatctcccctcaagttcagaagatcagctgctagagcatgccgaagggcagcccgtggcttgcaacggccactgtaagttcccattctcctccagggctttcctgtcgttcaaatttgatcataacgctatcatgaagatcctcgatctatag

SEQ ID NO: 113886 - DNA, 1158 bp, Artificial Sequence
  Description of Artificial Sequence: Synthetic coding sequence
atggagactaagagagtggagatcccagggtcagtcctggatgacttttgcagccgctttatcttacacatacctagcgaagagagggataacgcaatccgcgtttgttttcagatcgaattagcacactggttctatctggacttctatatgcagaacacccctgggctccctcaatgtggcatcagggatttcgccaaagcagtgttctcacactgcccttttctgctaccccagggcgaggacgttgagaaggtgcttgacgagtggaaagagtacaaaatgggggtaccaacgtacggcgccataatcctggacgaaacactagagaacgtcctgctggttcaaggatatttggcaaagtccggatggggtttcccgaagggaaaagtcaacaaggaggaggccccccatgactgcgctgcgcgagaagtgtttgaggagaccgggttcgatataaaagattatatctgcaaggacgattatatcgaactcaggataaacgatcagcttgcccgactttatatcattcccgggatccccaaggataccaaattcaaccctaaaacccggagagaaattcggaacatagagtggttctcaatagaaaagttaccttgccatagaaatgacatgacccccaaatccaaattgggactcgcaccaaataaatttttcatggccatcccatttattcgccccctccgggattggctcagtagacgcttcggggattcctcagactctgataacgggttctcatctaccggcagcacccccgcgaagccaaccgtagagaagctctcgcgtactaagttccgacattctcaacagcttttcccagacgggagtccaggggaccaatgggtgaaacaccgccaacctttgcaacagaaaccatataacaaccatagcgagatgtctgacctgctgaaaggcaagaaatgtgaaaagaaactccacccaaggaaactccaggataatttcgagacggacgccgtctatgatctgccaagcagcagtgaggaccagttgctcgagcatgccgagggccaaccggttgcatgtaatgggcactgcaagtttccattttcctcccgtgcatttctcagtttcaaattcgatcataacgcgattatgaaaatcctggatttgtag

SEQ ID NO: 113887 - DNA, 630 bp, Artificial Sequence
  Description of Artificial Sequence: Synthetic coding sequence
atgactcctaagtcgaaattgggcctggctcccaataaattttttatggctattccttttatcaggccattgcgggattggttatccaggcgctttggagatagctccgacagtgataacggtttttcaagcacagggtcgacccctgccaagccaactgtagaaaagctgtcgagaaccaagttccggcattcacagcagctgttcccagacggaagtcccggagatcaatgggtaaagcacagacagcccctccagcagaagccgtataacaaccatagtgaaatgtcagacctcttgaagggtaagaaccaaagcatgaggggcaacgggaggaagcaataccaggactccccaaaccaaaagaagcgtactaatgggctccaacccgccaaacagcaaaactcgctgatgaaatgcgaaaagaaattacatccacggaaacttcaggataatttcgaaacggatgcagtttacgacttgcctagttcgagcgaagaccaactcctcgaacatgcagagggacaacctgtcgcgtgtaatggccattgcaagtttccgttcagttcaagagcgtttctgagtttcaaatttgatcacaatgctattatgaagattctcgatctttag

SEQ ID NO: 113888 - DNA, 1341 bp, Artificial Sequence
  Description of Artificial Sequence: Synthetic coding sequence
atgactgagcttgggatggtcgtgctcggtatcgacactacccacctttggatgctccccctcactccaggatcttggaatagcatgcgcagccggcacaagtggaactggcctcagggctcttggggacttgggggcccaccccggtccacggcatttcttgagtgctgcaccagcttcctccctaacgatttgggattcaccgacagttacagtcagaaagccttttgtggaatttatagcaaggacgggcagatctttatgtcggcctgccaggaccagactatccgcctctacgactgtcggtatggacgcttcaggaaattcaaaagcattaaagcccgggacgtgggttggtctgtgctggatgtcgccttcacccccgacggcaaccacttcctttactcttcttggagtgactatattcatatctgcaatatatatggagaaggcgatacacacaccgccctcgacttgcgccccgatgaacggaggtttgctgttttcagtattgccgtgtcctcggacggaagggaggtgctgggcggggctaacgatgggtgcctttatgtgttcgatcgtgagcaaaacaggagaacccttcagattgagtcccacgaagatgacgtgaatgccgtagccttcgccgacattagcagtcagattttattctccggcggggatgacgccatctgcaaggtctgggatcgtcggacaatgcgcgaggacgaccctaagccggttggggccctggcggggcaccaggatggtatcacgttcattgactctaagggggatgcaagatatcttatcagtaatagtaaggatcagacaatcaagttgtgggacattcggaggttcagctcccgagagggaatggaggccagccgtcaggctgcaacacagcagaactgggactaccgctggcagcaagtgcccaagaaggcctggcggaaactaaaactccccggagattcgtctctgatgacttacagaggccacggagtgttgcacactttgatccgctgcaggtttagcccaatccattccacagggcagcagttcatctactcaggatgtagtaccggtaaagtagtcgtgtatgatttgctcagcggtcacatcgtgaaaaaattaactaaccacaaagcttgcgtgcgagacgtttcgtggcacccttttgaagagaagatcgtgagcagctcttgggacggaaacctgcggctgtggcagtatcggcaggccgaatacttccaggacgatatgcccgaaagcgaggagtgtgcgagtgcccctgctcccgtcccgcagtcctcaaccccctttagttcgccccaatag

SEQ ID NO: 113889 - DNA, 1563 bp, Artificial Sequence
  Description of Artificial Sequence: Synthetic coding sequence
atgggttctagaaacagtagtagtgcgggctctggatccggcgacccttcggagggattaccccggcgtggggctggacttcggaggtctgaggaagaggaagaggaggatgaagatgtcgacctagcccaggcactgctggactcagaggaggaaaatgaccgcgcatgggacggtaggctgggtgaccgctacaacccccccgtggatgctacacctgacaccagagagctggaattcaatgagatcaagacacaggtggagctggctacaggtcagctcggactgagacgcgcagcacagaagcatagctttccccgtatgctgcatcagcgggaacgcggcctgtgccacaggggaagtttctcattaggagaacaatctcgagtcatcagccacttcctccctaatgatctcgggttcacggactcatatagtcaaaaggccttctgcggaatctattctaaagatggccagatttttatgtccgcctgtcaggaccagaccattaggttgtacgattgccggtatggaagatttcggaaattcaaatctatcaaggctagagatgtcggatggtctgtcttggatgtggcgtttactcctgacgggaatcactttctttactcgtcttggtcggactacattcacatctgtaatatttacggcgagggcgacacccacactgctctggacctgaggcccgacgagcggcggtttgcagttttcagcatagcagttagctcagatggtcgtgaagtccttggaggagctaatgacggatgcctgtatgtcttcgacagagagcagaataggagaacgctccaaatcgaaagtcatgaagatgatgtcaacgccgtggcttttgccgacatttctagtcagatactgttttcaggtggcgatgatgctatttgcaaagtatgggatagaaggactatgcgggaggacgatccaaaacctgtgggcgccttggccgggcatcaggatggaattacgtttatcgatagcaagggcgacgcccggtacttaatctccaattccaaggatcagactatcaagctgtgggacattaggaggttttcgtctcgggagggcatggaagcgagtagacaagctgccactcagcaaaattgggattatagatggcagcaggtgcctaagaaggcctggcgcaagctcaaacttcccggtgacagcagcttgatgacttaccgaggacacggggtcctgcacactttgattaggtgcaggttttcacccatccactctacggggcagcagttcatttacagcggatgtagtaccggaaaggtggtcgtgtatgatctcctgtccggacatattgtgaagaagctgactaatcacaaagcgtgcgtacgtgacgtttcctggcaccctttcgaggagaagattgtgtcatcatcgtgggatggaaatttaagactgtggcaatatcggcaagccgagtactttcaggatgatatgcctgagtccgaggagtgtgctagcgccccagctcccgtgccacagagttccacacctttttctagcccacagtag

SEQ ID NO: 113890 - DNA, 1641 bp, Artificial Sequence
  Description of Artificial Sequence: Synthetic coding sequence
atgggcagccgtaattcttccagcgccgggagtggatccggcgaccccagcgagggcctgcctcgaagaggcgccggtctgcgccggtccgaggaggaagaagaggaggatgaagacgttgacctggcccaggtgttggcatacctacttagaaggggacaggtgcgactcgtccagggcggtggagctgcaaatctccagtttatccaagcactgctggactccgaagaggaaaatgatagggcctgggatggtcgcctaggggacagatacaatcctcctgtggacgctacgcctgatacccgggagctggaatttaatgaaattaagacccaggtggaacttgcaacagggcagctaggacttcggcgggcggcccagaaacatagttttcctcgtatgctgcaccaacgtgagcgtgggctgtgtcataggggatccttttctttaggagagcagtctagagtgatttcacacttcctgcccaacgacctgggtttcaccgacagctattcccagaaagcattttgtggaatatatagcaaggacggtcagatatttatgtcagcatgtcaagaccagacgatccggctgtacgactgtcgatatggacgcttcagaaagtttaagtctatcaaggcccgagatgttgggtggagtgttctcgacgtggcctttacgccggatggaaaccatttcctgtacagcagttggtccgactacattcatatctgcaatatttacggtgaaggggatacccataccgccttagacctgcggcccgatgagcgccgctttgccgtgtttagcatcgccgtgagtagcgacggaagggaggtattgggtggggccaacgatggatgcttatatgtgtttgatcgggagcagaaccggcgcacactgcaaattgaaagccatgaggacgacgtcaacgccgttgccttcgcagatatcagtagtcagatattgttctcgggcggcgatgatgctatatgtaaagtgtgggaccggaggacaatgcgtgaagacgatccaaagccggtaggtgcactggctgggcaccaggatggcatcacatttatcgactctaaaggcgatgcacggtatctgattagcaattcaaaagatcagacaattaaactgtgggacattagacgattcagtagccgagaaggcatggaggctagccggcaggctgccacacaacagaactgggactatagatggcagcaggttcctaagaaggcgtggcgcaagttgaaactcccaggcgattcaagtctgatgacctaccgaggccacggtgttcttcatactctgatccgatgccgatttagccccattcatagcacaggccagcagtttatttactccgggtgcagcaccggcaaagtagtggtgtatgatctgttatccggtcacattgtgaagaaattaaccaaccacaaagcctgtgtgcgggatgtgagctggcacccctttgaggagaagattgtctctagtagctgggacggcaatcttaggttgtggcagtatcgacaagcggagtacttccaggacgacatgccagagtccgaagaatgtgcatcggcccctgccccagttccacaatcctcgactcctttttcatctccccagtag

SEQ ID NO: 113891 - DNA, 369 bp, Artificial Sequence
  Description of Artificial Sequence: Synthetic coding sequence
atggggagccgcaactcctcatccgcaggatctgggtccggggacccaagcgaagggctgccccggagaggcgcgggtcttcgcagaagcgaggaggaggaagaagaagatgaagatgtcgatttagcccaggtgttggcatacctcctgagaaggggacaagttcgtctcgtgcagggcgggggggcggccaatctccagtttattcaggccctgctggactcagaggaagaaaatgacagggcatgggatgggcgcttgggcgaccgctacaaccctcccgtggacgcaacccccgataccagagagctcgagtttaacgaaattaagacacaggtcgaactggctacaggtcaactcggcctctag

SEQ ID NO: 113892 - DNA, 222 bp, Artificial Sequence
  Description of Artificial Sequence: Synthetic coding sequence
atgggctctaggaatagttcttcagccggttctggctccggcgaccctagcgaagggctgcctagacgcggcgccggcctccgcaggagcgaggaggaagaggaggaggatgaagatgttgacttagcccaggtgctggcatacctccttcgtagaggacaggtgagactggtgcagggcggcggggccgctaacttgcagttcatccaggcactactctag

SEQ ID NO: 113893 - DNA, 282 bp, Artificial Sequence
  Description of Artificial Sequence: Synthetic coding sequence
atgggatcccggaactccagctctgctggtagcgggagtggcgatccaagcgagggacttccccgcaggggggcagggctccggagaagcgaggaggaggaggaggaggacgaagatgttgacctggctcaagtgctggcctatctgctgcggcgaggtcaagtaaggctagtacaggggggtggcgcggcaaacctgcaatttattcaggcgctgctggattcggaggaggagaacgatcgggcctgggatggtagactgggcgaccggtacaacccctag

SEQ ID NO: 113894 - DNA, 327 bp, Artificial Sequence
  Description of Artificial Sequence: Synthetic coding sequence
atgggtagtcggaactcctcttccgccgggagcggcagcggtgacccctctgaaggtctcccacggcgcggtgctgggcttcggcggagcgaagaagaagaagaagaagacgaggacgtggatttagcccaggtgttggcttatctcctacggcgcggtcaggtgaggctggtgcagggcggcggagccgccaacttgcagtttattcaggcattgcttgatagcgaagaggaaaatgatagagcctgggatggtcgactgggggataggtataacccccccgttgacgcaacccccgacacccgagaattggagttcaatgaatag

SEQ ID NO: 113895 - DNA, 1641 bp, Artificial Sequence
  Description of Artificial Sequence: Synthetic coding sequence
atgggcagtaggaattcttcaagcgccggctcaggtagcggtgatccctctgaggggttgccacggagaggggcgggactccgtcggtctgaagaggaggaggaagaggacgaagatgttgatttggcccaggtcctggcttaccttctgaggcgtggccaggtgcggctggtccagggcggtggtgctgcaaatctgcagtttatccaagcactgctagattcagaggaagagaacgacagagcatgggatgggcgcctcggcgaccggtataaccctccagttgacgctacgcctgacacaagagagcttgagttcaatgagatcaagacccaggttgagcttgctacgggccagctgggcctcaggagagccgcccaaaagcactcattccctcgcatgctccaccagagagaaagaggactctgccaccgcggaagtttctccctcggcgaacaatccagagtgatctctcacttcctccccaacgacctggggttcacggatagttactcacagaaggctttctgtggtatatacagtaaagacgggcaaatattcatgtccgcctgccaagatcagaccattcgcctttacgactgtcgctatggccgtttccgcaaatttaagtcaattaaggcgcgcgacgtcgggtggtcagtcttggacgttgcgtttactcccgatggaaatcactttctctactcgagctggtccgactacattcatatttgcaatatatacggggagggggatacgcacacggctcttgacctcaggcctgatgagcggcggtttgccgtgttctcgatagcggtgagttctgatgggagagaagtgctgggcggggccaatgacggatgcctgtacgtgttcgacagggaacagaaccgccggaccctgcagattgagagccacgaggacgacgtaaatgctgtagctttcgccgatatctccagccagatactgttctcgggaggtgacgatgctatttgtaaagtgtgggatagaagaacgatgagagaagacgaccctaagcccgttggcgcattggccggacaccaggatgggattacattcatcgacagtaagggtgacgccagatacctgatatccaacagtaaagatcaaaccattaaactctgggacattcgcaggttttcttctagagaaggcatggaagcaagcagacaggccgcaacccaacagaactgggattatagatggcagcaggtgccgaaaaaggcatggagaaagctaaaactaccaggggatagcagccttatgacctacaggggccatggagttctccatactctgataagatgccgattttcccccattcactccacaggccaacagttcatctactcaggatgttccacaggtaaggtcgtggtatatgatctactctctggccacattgtcaaaaagttgaccaatcacaaggcatgtgtgagggatgtatcctggcatccattcgaagagaaaatagtgagttcttcttgggacggaaatctccgtctgtggcagtatcgtcaggctgaatatttccaggatgatatgccagaatccgaggagtgtgcgtccgcgcctgcgcctgtacctcagagctctacaccttttagttcccctcagtag

SEQ ID NO: 113896 - DNA, 273 bp, Artificial Sequence
  Description of Artificial Sequence: Synthetic coding sequence
atgggctcccgtaactcttcttctgccggttccggaagcggcgacccatccgaggggttgcccagaagaggagccggcctgagaagatcagaagaggaggaggaggaggatgaggacgtcgacttagcacaggcactgctagatagcgaagaggaaaatgatagagcctgggatggacggctcggggatcgctataatcctcccgtcgacgcaacacccgacaccagggaattagaatttaacgagattaagacccaagtcgagctcgcttag

SEQ ID NO: 113897 - DNA, 93 bp, Artificial Sequence
  Description of Artificial Sequence: Synthetic coding sequence
atgggctctcgcaactcctcatctgccggaagcggttctggagacccctcagaaggtctccccaggagaggagccggattaagaagaagctag

SEQ ID NO: 113898 - DNA, 429 bp, Artificial Sequence
  Description of Artificial Sequence: Synthetic coding sequence
atgggatcaaggaactcatctagtgcaggtagcgggtctggagacccctctgaggggttgccacggaggggcgccggcctgaggagaagtgaagaggaggaagaggaggatgaagacgtagatctggcccaagtcctggcatacctcctcaggcggggacaagtcagacttgtgcagggggggggcgcagcaaacctgcagtttatccaagccttgctggacagcgaagaggagaatgaccgagcgtgggacggacggttaggcgatcgctacaacccccccgtagacgcgaccccggacactagagagttggaatttaatgaaataaaaacacaggtggaactggccacaggacagctgggtctgcgaagagctgctcaaaagcattctttcccgcgcatgttgcaccaaagagagcggggtctgtag

SEQ ID NO: 113899 - DNA, 204 bp, Artificial Sequence
  Description of Artificial Sequence: Synthetic coding sequence
atggggtctagaaacagctcatctgcgggcagcggaagcggcgatccttccgagggactccctcgccgaggggctggtctcagaagatccgaggaagaagaggaggaagacgaggacgttgacctggcccagcgcccttcagaggtcggcgcaggacgccggtgcagcaaatttacaattcatagtgggcctctgggcctctag

SEQ ID NO: 113900 - DNA, 321 bp, Artificial Sequence
  Description of Artificial Sequence: Synthetic coding sequence
atggggtcgagaaacagctcaagtgccggtagcgggtctggcgacccctccgaagggctgccaaggcgcggggccgggctgcgcagatccgaggaggaggaagaagaagatgaggatgtcgatctcgcgcaagtgctggcatatcttttgcggaggccgtcttggacccagcggaaaaggatgaccgagctcggaatggttgtgttgggtattgacaccacccatctatggatgctgccactgaccccgggctcctggaattcaatgaggagtcgccacaagtggaattggcctcagggctcctggggtttgggcggctag

SEQ ID NO: 113901 - DNA, 387 bp, Artificial Sequence
  Description of Artificial Sequence: Synthetic coding sequence
atgggatcccgcaactctagctctgccggctcgggcagtggggacccatctgagggactgccgcgcaggggtgctggactgcgccggtcggaagaggaggaagaagaggacgaggacgtggatctcgcacaggcactgttggatagcgaggaggagaatgatcgggcatgggacgggaggctcggagacaggtataatccccctgtggatgccacccctgatactcgggagttagagtttaatgagatcaagactcaggttgagctcgcaactggtcagcttgggctacggagagcagcccaaaagcactcttttcccaggatgttacatcaacgcgaacgaggcttgtgccacaggggctcgtttagccttggggaacagtcatag

SEQ ID NO: 113902 - DNA, 465 bp, Artificial Sequence
  Description of Artificial Sequence: Synthetic coding sequence
atggggagtagaaactctagctcagccggctccgggtccggcgatccctcagagggactgcctaggaggggtgccggactcaggcgtagtgaagaggaagaagaggaggatgaagacgttgatttggctcaagttctcgcctatctgcttcggagaggccaggtgagactggtgcagggaggaggagcagctaacctacagtttatacaggcacttctcgactcagaagaggagaacgatcgcgcctgggacggacgcttgggtgacagatacaacccacccgtcgacgccacccccgatacccgagagttggagtttaacgagattaaaacccaagtcgagcttgctacaggacagctgggactcaggcgcgctgctcaaaagcactcattcccgcgaatgttacatcagagggagcggggactatgccacaggggatccttttccctgggagagcagagttag

SEQ ID NO: 113903 - DNA, 2829 bp, Artificial Sequence
  Description of Artificial Sequence: Synthetic coding sequence
atgaagcgccgcgccgggctgggaggctcaatgcgtagtgtggtggggtttcttagccagagaggacttcatggcgaccctctccttacccaggactttcaacggaggcgcctgagggggtgccgaaatctgtacaaaaaagacctgctgggacactttggatgtgtgaatgcaatagagttcagtaacaatggaggccagtggttagtgtccggtggggacgaccgccgagtgctgctgtggcacatggaacaggcaattcattcacgggtgaagccaatccagctgaaaggggagcatcatagcaacattttctgtctagcgtttaattcaggcaacactaaggttttctcgggtggtaatgacgagcaagtgatccttcacgacgtcgagagctctgagaccctggacgtgttcgctcacgaagacgcagtttatggtctgtccgtctctcccgttaacgacaatatcttcgcgtcctcctctgatgacgggagagtgctgatctgggacatccgcgaatcgccacacggtgagccattttgcctcgcaaactacccttcagccttccactctgtcatgtttaacccagtcgaaccaagactgctggccacagcaaatagcaaggagggagtgggattgtgggacatcaggaagcctcaatcgagtctcctccgctacggcggcaacctgtctttgcagtctgcaatgagcgtgaggttcaacagtaatggcacacagttgctggcactgaggcggaggctgcctcccgtcctgtacgatattcactcccgccttcctgtgttccagtttgacaatcagggctactttaatagctgtacgatgaagtcatgttgctttgcaggtgaccgagaccaatatatcctgagtggtagcgacgacttcaatctttacatgtggcggatacctgccgatccagaagcagggggaattgggcgcgtggtgaacggagccttcatggtgctgaaaggtcacaggtctatcgttaaccaggtccgctttaacccacatacctacatgatctgttccagcggagtagaaaaaatcataaagatctggtcgccgtataaacagcctgggtgcacgggagatttggacgggcgtattgaggacgattcgcgctgtctctatacccatgaagagtatatatccctggtgctcaattctggaagcggtctttcccatgactatgccaatcagagcgttcaggaggaccctcggatgatggccttctttgatagcttggtcaggagagagatagaagggtggtcaagcgactctgacagtgatctttcggaaagcacaattttacagcttcatgctggagtgtccgagagatcaggctacacagacagtgagagctctgcatcccttccccgctcccctccaccaacagtggacgaaagcgcagacaatgccttccatttgggtcctctgagggtaacaaccaccaatactgtcgcttcgaccccacctacgcccacctgtgaagatgccgcctcccgtcaacagcgcttgagcgctctgcgtcgctatcaggacaaacggctcctggcattgtctaatgaatcagatagcgaagaaaacgtctgtgaggttgagctcgatactgatctctttccaaggcctcgctccccatcacctgaggacgagtctagctcttcatctagcagcagctcaagcgaggatgaggaagagttgaatgaacgacgggccagtacatggcaacgcaatgccatgcgtaggaggcagaaaacaactcgtgaggacaaaccctcggctcctataaagccaactaatacatatattggggaagacaattacgattatccccagattaaggtggacgacctgtccagttctccaacctcctcccctgagcggtcaacaagcaccttggaaattcagccaagcagggcctcccccacctccgacatagagtcagttgagcggaagatttacaaggcctacaaatggttgcggtattcatatataagctattcaaacaataaggatggcgaaaccagtctcgttaccggggaagctgacgaagggcgcgctggaacgtcgcacaaggataaccctgccccaagttcgagtaaggaggcctgcttgaatatcgctatggcgcagagaaaccaggatctgcctcccgaaggctgcagtaaggacacatttaaagaggagaccccgcggactccatccaacggcccagggcatgagcacagctctcatgcctgggctgaggttcctgaaggcacatctcaggacactgggaattctggtagcgtagaacacccttttgagaccaagaaactgaacgggaaagcgctctcatcccgcgcagaggagccccccagtccgcctgtcccaaaggcttctggatccaccctgaacagcggttctggtaattgtccccggactcagtccgatgactcagaggagaggtcactggagaccatctgtgcaaatcataataatggaagattgcatccccgccctccccatcctcacaataacggccagaatctcggcgagttggaagttgtagcatactcgtcccctgggcacagcgacaccgaccgagacaattcatcccttaccgggactttgttgcacaaagactgctgcggatccgagatggcctgcgaaacccctaatgccggtactcgcgaggacccaacagatacgcctgctactgattcaagcagggccgtgcacggacactctggcctgaagcgtcagagaatagagctggaggacacagattccgaaaactcgagctcagaaaagaagctcaagacgtag

SEQ ID NO: 113904 - DNA, 2583 bp, Artificial Sequence
  Description of Artificial Sequence: Synthetic coding sequence
atggaacaagccatccactcgagggtgaagccaatccaacttaaaggtgagcaccacagcaatatattttgtttggcctttaacagcgggaacaccaaggtctttagcggaggcaacgacgagcaagtaattctccacgacgttgaaagctccgaaacactcgacgttttcgcccacgaagacgccgtgtatgggctgtccgtgtctccagtgaacgacaacatctttgccagctctagcgacgatggtagggtcctcatttgggacatccgcgaatctccacacggcgaacctttttgtcttgcaaattacccgtccgccttccattccgtaatgttcaaccccgtggaacctcgtctgctggccaccgctaacagcaaggaaggagttggcctctgggacatcagaaaaccccaaagttcattattgcgctatggtggtaatctctcactccagtctgccatgtcagtgcgctttaacagtaacggcacgcagctgctggcattaaggaggaggcttcccccagttctttacgacattcattcacgtctccccgtctttcagtttgacaaccaagggtacttcaattcttgtaccatgaagagctgctgtttcgccggcgaccgggatcaatacattctttccggctctgatgattttaatctgtacatgtggcgaatcccagctgaccctgaggcaggcggaatcggaagagttgtcaacggggcttttatggtgcttaagggtcacaggagcatcgtgaatcaggtgcgatttaaccctcatacctatatgatttgcagttcaggtgtggaaaagatcattaaaatatggtccccctacaaacagccaggctgcaccggagatcttgatggcagaattgaggatgattcacggtgcctctatacccacgaagagtacatatcattagtgctaaacagtggtagtggcctgagtcacgactatgccaaccagtctgtgcaagaagacccccggatgatggcattttttgattctttggtaagacgggaaatagagggatggtcaagcgacagcgactctgacctgtctgagagtacaattctccagctgcatgccggcgtcagtgagagaagcggctataccgattcagaatcatcggcctcactgccaaggagcccaccgccaactgtggacgaatctgccgacaacgccttccatctgggccctctccgtgtgaccaccaccaatacagtggcgtccacaccccccactccaacgtgtgaggatgctgcgtctcggcagcagcgcctgtcggccttgcgccggtatcaggataaaagattgcttgcactgagcaatgaaagcgatagtgaggagaacgtgtgcgaggttgagctagacactgacctgtttcctcgcccacggtctccttcaccagaagacgagtcttcctccagctcttcttccagctctagcgaggacgaggaggagcttaacgaacggagggccagcacttggcagcgtaacgccatgaggaggcgccagaagacgacccgggaagacaagcccagtgcacctataaagccaacaaacacatatattggcgaagacaactacgactatcctcagattaaagtggacgatctttccagctcaccaacgtccagccccgagagatcgacatctactcttgagattcaaccctcacgtgcatcaccgaccagtgacatcgagagcgttgagagaaaaatatacaaggcctataagtggctgaggtattcctacatctcgtacagtaacaataaagacggcgagacctccctagtcaccggagaggccgacgagggtagagccggtaccagtcataaagacaaccccgctccctcttcctccaaggaggcctgcctaaatatagcgatggcccaacgtaaccaagacttacctcctgaggggtgttccaaggacacgttcaaagaggagacaccacgaaccccttctaacggtccaggccacgaacatagctctcacgcatgggcagaagttcccgaaggcaccagccaggacaccgggaatagcggcagcgtggagcatccgtttgaaaccaagaagttgaatggtaaagcactctcttcccgagccgaggaacccccttccccgcccgtgccaaaggcaagcggatcaaccttgaattctggtagcggaaactgcccacgaacccagtcagacgactctgaagaacgctccctagagacaatttgcgctaaccataataatggcaggctgcatcctagacccccccacccacacaataatggccaaaatttaggagagctcgaggttgttgcgtattcatctccggggcactctgatacagaccgcgataacagcagcctcaccggcactttgctgcataaggactgttgcggatcagaaatggcatgcgagacccccaacgcaggcacccgggaagaccctaccgataccccggctacagatagttctcgcgccgtacacggtcatagcggtctgaagcgccagcgcatagaactggaggatactgacagcgagaatagttcgagcgaaaaaaagctgaagacatag

SEQ ID NO: 113905 - DNA, 633 bp, Artificial Sequence
  Description of Artificial Sequence: Synthetic coding sequence
atggagcaagcaatccatagcagagtgaagccaatccagctgaaaggcgagcatcactctaatattttttgcctcgcgtttaatagcggcaacaccaaggtgttctccggggggaatgatgagcaggtcatcctgcatgacgtggagtcggaaacgctggacgtatttgctcatgaagatgcagtgtatggcctgtccgtgtctcccgttaacgataacatattcgcctcttcatccgacgacggtcgggtactaatctgggatatccgcgagtctcctcacggcgagcctttttgccttgcaaactacccctctgctttccactcggtgatgtttaacccagtggagccgcggctcctagccactgctaattccaaagaaggagtcggactgtgggatatacgaaaaccccagtcttctctcttgaggtacggcggcaatttgtccctccagagtgcaatgagcgtgcggttcaattctaacggcacccagctcctggccttgcggcggcggctgcccccagtgctgtacgacattcactctcgcctccctgtgttccaattcgacaaccagggatacttcaacagttgtaccatgaaatcatgttgcttcgctggcgatcgagaccagtag

SEQ ID NO: 113906 - DNA, 2583 bp, Artificial Sequence
  Description of Artificial Sequence: Synthetic coding sequence
atggagcaggcaattcactcacgtgtcaagcctattcagttaaagggcgagcaccactctaacattttttgtcttgcattcaattcaggtaacactaaagtgttttcgggcggaaacgacgaacaggtaattctgcatgacgtggagtctagcgaaactctggacgtcttcgcccacgaagatgccgtttatggtctgtctgtgagtcctgtgaatgataacattttcgctagctcttcagatgatgggcgcgtgctaatttgggatattagggagagccctcatggggagccattctgcctggccaactacccgtctgccttccactccgtgatgttcaaccctgtggagccaagactgttggccactgccaactcaaaggagggtgttgggctatgggacataaggaagccccagtcgagtctcctcaggtatggcggaaacctgtctctgcaatccgccatgtccgtgaggttcaactcaaacggcactcagctcctcgcccttaggcgcaggctcccgcccgtgctgtacgatatccattcaaggctcccagttttccagtttgataatcaaggctatttcaattcatgtaccatgaagtcctgttgttttgccggagaccgtgaccagtacattctctccgggagtgacgacttcaatctgtatatgtggagaattccagctgatcccgaggccgggggaattggccgggttgtaaatggcgcgtttatggttctgaaagggcacagaagcatcgtaaatcaggtgcgatttaatcctcacacctacatgatctgttccagcggcgttgaaaaaatcatcaagatttggtccccctacaaacaacccggctgcaccggagacctggacggccgcatcgaggatgattctcgctgtctgtacacccacgaagagtatattagcttagttcttaactctggaagtggcctgtcccacgattacgcaaaccagtcagtgcaagaagatccgcgcatgatggccttttttgattcccttgttcggagagagattgaaggatggagctctgactctgacagcgacctctccgagtcaaccatactgcagcttcacgcaggcgtgagtgagcggtccggctacactgacagtgaatctagtgctagcttaccgcgaagtcccccaccaacagttgacgagtccgctgacaacgcatttcatctgggacccctacgcgtcaccacgactaatactgtggcatcaacaccgcccacacctacctgtgaggatgccgcttcaaggcagcagcgcctgtcagctcttcgcagataccaagataagagacttctggcccttagtaatgaatcagattccgaagaaaacgtgtgcgaggtcgagcttgacacagacctgttcccacgccccagatctcctagccctgaagatgagagctcaagcagttcttcatcaagctcctctgaggatgaggaggaactgaatgaaaggagggccagcacatggcaaagaaacgccatgaggcgtaggcagaaaacaactcgtgaggataagcccagtgcccccataaagcccaccaacacctacatcggcgaggacaactatgattatcctcaaataaaggtggacgacctcagttcgtcgcctacatcaagcccagagcggtctacgagcactttagaaatccagccaagcagagctagtccaacctccgatattgaatcagtagagcgaaagatttataaagcctataaatggcttcggtatagctacatcagctacagcaacaacaaggacggagagacttcactggtgaccggggaagctgacgagggtcgagcagggacttcacataaagacaaccccgccccgtcctctagtaaagaggcctgtctgaacattgcaatggcccaaaggaaccaggacctaccgcccgagggatgcagcaaagacacattcaaggaggagacccccaggacaccatcaaacggaccaggccatgaacattcctcacacgcctgggcagaggtgcccgaaggcacgagccaggacacaggaaattctgggtccgtggaacatccgttcgaaacaaagaaattaaatggcaaagcactaagcagtagggccgaggagcccccttccccacccgtccccaaggccagtggctcaaccttgaattcaggcagcggcaattgtccacgtacacagtctgacgacagcgaagagcgaagcctggagactatttgcgccaaccacaataatgggaggctccatccgagacctccccaccctcataacaatggacagaatctcggcgagctggaggtagtagcgtatagtagccctggtcacagtgacacagaccgggacaactccagccttactggcactctgctccacaaagattgctgcggctcggagatggcatgtgaaacacctaacgccggaaccagggaggaccccacagacacacccgctactgattcatccagggcagtgcatggtcattctgggttgaagcgtcagcggattgagctggaggataccgacagtgagaactctagcagcgagaaaaaactgaaaacgtag

SEQ ID NO: 113907 - DNA, 357 bp, Artificial Sequence
  Description of Artificial Sequence: Synthetic coding sequence
atgcccttcctcgagttggacacgaacttgcccgcaaatcgggtccctgcggggcttgaaaaacgtctgtgcgcagccgccgctagcatcctgggtaagccggcagatcgggtgaacgttacggtgcgccctgggctggcgatggccctctctggaagcacagagccctgcgctcaactttcaatatcaagtatcggcgtggttggaaccgctgaggataacagatctcacagcgcgcactttttcgagttcctcaccaaggagcttgctctgggacaagacagaattctgatcaggttttttccccttgaaagttggcagataggcaaaattggaactgtgatgactttcctttag

SEQ ID NO: 113908 - DNA, 357 bp, Artificial Sequence
  Description of Artificial Sequence: Synthetic coding sequence
atgccatttctcgagctggatacgaatttaccggcaaaccgagtcccggccgggctggagaagcggttgtgcgctgccgcagccagcattcttggaaagcccgcagatcgggtgaatgtgaccgtgcggcccggactcgctatggctctatcggggtcaacagaaccctgcgcgcaactgagtatcagcagcatcggagtggtgggtacagccgaagataaccgatcccacagcgcacactttttcgagtttctgaccaaagaactggcactagggcaagatagaattctgatcaggttcttcccccttgaatcttggcaaatcggcaagatcggtaccgtaatgacatttttatag

SEQ ID NO: 113909 - DNA, 399 bp, Artificial Sequence
  Description of Artificial Sequence: Synthetic coding sequence
atgcagctgttcctcctcgctgtgtccgtgcccctgcccgctatgccctttctggagctcgataccaacctgcccgcgaatagagtgcccgccggactcgagaaacggctgtgtgccgccgctgctagtatcctggggaagccagcagacagggtgaatgtgactgtacggccagggctagccatggctctctctgggtctacagaaccctgcgcacagctgtccatcagctccattggcgtagtggggaccgccgaggacaacagatcacatagcgcccatttttttgagtttctgactaaagagttggcacttggtcaagacaggatcctaatccgctttttccccttggaatcatggcagataggcaagatcggtactgttatgaccttcctctag

SEQ ID NO: 113910 - DNA, 348 bp, Artificial Sequence
  Description of Artificial Sequence: Synthetic coding sequence
atgcccatgttcattgtgaacactaatgtccctcgggcctccgtgcctgacgggtttttatcagaacttactcagcagctggcgcaggctactggcaagccaccccaatacatcgcggtgcatgttgtcccagaccagttgatggcgtttggcggatcaagcgaaccatgtgccctctgctccctgcattccattggtaaaatcgggggcgcacagaaccgctcctatagcaagctgctgtgtggacttctcgcagagagacttcggatatcccctgatcgcgtctacatcaactactatgacatgaatgcagccaacgtggggtggaataactccaccttcgcttag

SEQ ID NO: 113911 - DNA, 1224 bp, Artificial Sequence
  Description of Artificial Sequence: Synthetic coding sequence
atgaacaattcaggggcagatgagatcggcaagctgtttgtgggcgggctcgactggagcaccacacaggagacactgcgctcctatttctctcaatacggggaggtagtggactgtgtcatcatgaaggataagaccaccaaccagagtaggggttttggcttcgttaaattcaaggacccgaactgcgtaggcacagtgctcgcttctcgcccacacaccctggacgggcggaacatcgatcccaagccgtgcacgcccagaggcatgcagcccgagcggacacggcctaaggagggatggcagaagggtcctaggagcgacaacagtaagagtaacaaaatcttcgtaggtggcatcccacacaattgtggagaaacagaactgcgcgaatactttaaaaaatttggggtggtgacagaggtggtgatgatctatgacgccgagaagcaaaggcctcgaggcttcggctttatcacttttgaggacgagcaatctgtggatcaagcagtgaatatgcacttccacgatattatgggaaagaaagtcgaggtgaagagggccgaaccgcgcgattcgaaatcacaggcacctgggcagccgggggcctcacagtgggggagtcgcgtagtgcccaatgccgcaaacggctgggccgggcaaccgcctccaacttggcaacagggatacggcccccagggcatgtgggtgccagcaggtcaggcaatcggcgggtacggccccccccccgccggcagaggagctccaccccctcctccccctttcactagctatattgtctctaccccgccaggaggatttccacctcctcaggggttcccccaaggatacggtgctcccccccagttctcatttggatacgggcctccccccccaccccctgatcagtttgctcctcccggagtcccccctccaccagcaacacctggtgccgcacctctggctttcccaccccccccttcacaggctgcacccgatatgtcaaagcccccaaccgcgcagcctgacttcccttacggccagtacgcaggatatggtcaagacttgagtggcttcggtcaaggctttagcgatccctcacagcagccccctagctacggcggaccctctgtccccgggtccggtggccctccagctggcgggtcagggtttggaaggggccagaatcataatgtccaaggttttcacccatatcggaggtag

SEQ ID NO: 113912 - DNA, 2223 bp, Artificial Sequence
  Description of Artificial Sequence: Synthetic coding sequence
atggctgccttctctgagatgggagtgatgccagagatagctcaagccgtggaagaaatggactggctccttccaaccgacatacaggccgaaagcattcccctgatcctcggcggtggggatgttctgatggctgccgagacgggttcagggaaaacaggtgctttctcaatccccgttattcaaatcgtctatgagactttaaaggaccaacaggagggaaagaaggggaaaacgacgatcaaaactggcgcttctgtcttaaataagtggcagatgaatccttacgacaggggcagtgcattcgcaatcggctccgatggactttgttgccagagtcgagaggtgaaggagtggcatggatgccgagcaacgaaagggctgatgaagggcaagcattattacgaggtctcctgtcatgatcaaggattgtgtagggtcggttggagcacaatgcaggctagtctggacctgggaaccgataagttcggcttcggctttggcggcaccgggaagaagagtcacaacaaacagtttgataactatggagaggaatttactatgcacgacacgattggctgttacctcgatatcgacaaggggcatgttaagttttctaagaacgggaaagatctcggcttagcttttgagatccccccccatatgaagaatcaggcattgtttcctgcgtgtgtcctcaagaacgccgaactaaagtttaactttggggaggaggaattcaaatttccgccgaaagatggatttgtggccttgagtaaggcacctgatggctacatagttaagtcccagcatagcggcaacgcacaggtgacccagactaagttcttacccaacgcacccaaagccctgatagtcgaaccatctagggagctcgctgagcagaccctcaacaacatcaaacaattcaaaaagtacattgataacccaaaactgcgggagctgctgatcatcggtggggtggccgcccgtgatcaactgtctgtcctcgagaatggtgttgatattgtggttggcacccccgggagattggacgacttagtgagcaccggcaaactgaacttgtcccaggtaagattcctcgtgctcgacgaggccgacgggctactgtctcagggttacagcgacttcatcaatagaatgcacaaccagattccgcaggtgaccagcgacggcaaaaggctgcaagtgatagtgtgctcggcgacgttgcactccttcgatgtgaagaaactgtccgaaaagataatgcacttcccaacttgggtggaccttaagggtgaggactccgtgccagacacagtgcaccacgtggtggtcccggtgaatcccaaaacagatcgcttatgggagcgactcggcaaatcacacataaggacagacgatgtgcatgctaaggacaacactcgtcctggggcaaacagcccagaaatgtggagcgaagccattaagatcctcaagggggagtacgctgttcgggccatcaaggagcataaaatggatcaggccatcattttttgccgtactaaaattgattgcgacaacctcgagcagtattttatccaacaaggcggaggaccagacaagaagggccaccaatttagctgcgtctgccttcacggagaccgtaagcctcacgagcggaaacagaacctggaaaggtttaagaagggggatgtaaggttcctgatctgcacagatgtggccgcgcggggaatagacatacatggggtaccctatgtgattaatgtgacactgcccgatgagaagcaaaactacgtgcatcgcataggaagggttggaagggcagagcggatgggacttgctatctcactcgttgctaccgaaaaggagaaggtgtggtatcacgtgtgttcaagccgtggaaaaggctgctacaatacaagactgaaagaggacggagggtgtacaatctggtataacgaaatgcaactactgtctgagattgaggagcacctcaactgtaccatttcacaggttgagccagatattaaggtgcctgtggatgaatttgacggaaaggtgacctatgggcagaagagggcggcagggggaggttcttacaaggggcatgtagatattctagcccctaccgtacaggagctcgctgcacttgagaaagaagcacagacctctttcctgcatctcgggtaccttcctaaccagctgttccgtactttttag

SEQ ID NO: 113913 - DNA, 51 bp, Artificial Sequence
  Description of Artificial Sequence: Synthetic coding sequence
atggcagcattcagcgagatgggcgtgatgcccgagattgcccaagcctag

SEQ ID NO: 113914 - DNA, 1869 bp, Artificial Sequence
  Description of Artificial Sequence: Synthetic coding sequence
atggcagcattctcagaaatgggtgtcatgcccgaaatagcccaggccgtggaagaaatggattggttgctgcctactgacatccaggctgagagcatcccgctaattctgggcggcggggatgtgctcatggccgcagaaactggcagcgggaagaccggggccttcagcatccccgtgatccagatcgtgtacgagaccctaaaagatcaacaggagggtaaaaagggcaaaacaacaataaaaactggcgcatccgtcctgaataagtggcagatgaatccatacgaccgagaggtcaaagagtggcacggctgtcgtgccacaaaaggtctgatgaaaggcaaacactactacgaagtaagttgtcatgaccagggcctatgtagggtgggctggtcaaccatgcaagcctcactggacctagggacagacaaatttggcttcggatttggaggaacagggaagaaatcccacaacaagcaattcgacaactatggcgaggagtttacaatgcatgacacaattgggtgctatttagatatcgataagggacacgtgaaatttagcaaaaatggcaaagacctggggctggcatttgagatacctccccacatgaagaaccaagcactgtttcccgcttgcgttttgaagaatgctgaactgaaattcaacttcggcgaagaggagttcaaattccctcccaaggacggatttgtggctctgagcaaagcccccgatggttacatcgttaaatcacagcacagcgggaatgcacaggtgacccagacgaaattcttaccaaatgccccaaaagcactgattgttgagccatcccgcgaacttgctgagcagaccttgaataatatcaagcaattcaagaagtacatcgataatcccaaacttcgggagctgctcattattggaggcgtggccgcaagagatcagctgtcagtcctggagaatggagtagatatcgtcgtggggacacctggtagactggacgatctggtgtcgactggcaaactgaatctgagccaggtacggttcctcgtcctggacgaggccgacggtttgctgtcacagggctacagcgactttatcaacagaatgcacaatcagattccgcaggtcactagcgatggcaaacggctacaagtaatagtgtgtagcgccaccctgcatagcttcgatgtcaaaaagctgtctgaaaagataatgcacttccccacgtgggtcgatttaaaaggcgaagacagtgtccccgataccgtccatcacgtcgtcgttccagttaatccgaagaccgacaggctatgggagcggttgggaaaatctcacatacggactgacgatgtccacgcaaaggataacaccagacctggcgcaaatagcccagaaatgtggagcgaggctatcaagatcctcaaaggagagtatgctgtccgcgccataaaagagcacaaaatggaccaggctattattttctgtaggaccaagatagactgcgataacctggaacagtacttcattcaacaaggagggggtcccgacaaaaagggtcaccagttttcctgcgtctgcctacacggagaccgcaagccacatgaacgaaaacagaatctcgaacggtttaaaaagggcgatgtgcgatttctgatctgtactgacgtcgccgccagaggtattgacattcacggcgtgccatacgtaatcaacgtgaccctgccggacgagaagcagaactatgtacatcgaataggtcgcgtgggccgcgcggaaaggatggggttggcgatcagtctggtagctaccgaaaaggaaaaagtttggtaccacatggttcagagagacgctgtcaccatctag

SEQ ID NO: 113915 - DNA, 2628 bp, Artificial Sequence
  Description of Artificial Sequence: Synthetic coding sequence
atggggaagacagcaaacagccctgggtccggggctcgccccgatccagtgaggtcattcaacagatggaagaagaagcattcgcacagacagaacaaaaaaaagcagctgagaaaacagctcaaaaagccagaatggcaggtggagagagagtcaatttcccggttaatgcagaactacgagaaaatcaacgtgaacgagatcacgcggttttctgatttccctctgtcaaagaagaccctgaaggggctgcaggaagcccagtatcgactcgtgaccgaaattcagaaacaaaccatcggactggccctccaggggaaggacgttctgggcgccgcaaagaccggttcaggcaaaacactggctttcctggtaccagtgctcgaggcactgtaccggttacagtggacatcaactgacggcttgggggtgctcatcatatcacctacccgggaattggcttaccaaacctttgaggtgctgagaaaggtcgggaaaaaccacgacttttctgcagggctcataataggtgggaaagatctcaagcatgaggctgaacgcattaacaacattaacattctggtgtgtacgcccggccgcctactgcagcacatggatgagactgtaagttttcacgccacagatctccagatgctggtgctcgatgaggcagacaggatccttgacatgggtttcgctgatacaatgaacgctgtcatcgaaaatctgcccaagaagcgacaaacgctgctcttctccgcaacacagaccaaatcggtgaaggatttggcacggctcagtttgaagaacccagaatatgtatgggttcatgagaaggccaagtactcaacccctgcaaccctggaacaaaactacattgtgtgtgaactgcagcaaaaaatttccgtcctgtatagcttcctaaggtcacacttgaaaaagaagtcgatagtcttcttctcctcttgcaaggaagtgcagtacctgtacagagtgttctgtcgcctgagacccggggtgagcatcctcgccttacatgggaggcagcagcagatgcgccgcatggaggtctataatgagttcgtgaggaagcgcgcagcggttctgttcgctactgacatcgcagctcgcggactggatttccccgccgttaactgggtcctgcagttcgattgccccgaagatgccaacacatacattcacagagccgggcgcaccgccagatataaggaggacggcgaagctttactcatcctgctgccctccgaaaaggctatggtgcagcaactgttgcagaaaaaggtgccagttaaagaaattaagattaatccagagaaactgattgacgtgcagaaaaagcttgagtctatactggctcaggatcaggatttaaaggagcgggctcaacgttgtttcgtatcctatgtgagaagtgtttacctaatgaaagataaagaagtgtttgatgtctcaaaattgccaatacccgaatatgccctctctttggggctcgccgtggccccgcgggtgaggttcttacaaaaaatgcagaaacaacccaccaaggaactggtgcgctcccaggcagataaagttattgagcctagggctccgagcctgactaacgatgaagtagaggagtttcgcgcctactttaatgaaaagatgtcaatcctgcaaaaggggggtaaaagacttgaagggacagaacacagacaggacaatgataccggcaacgaagaacaggaggaggaagaagatgacgaagaggagatggaagaaaagttggccaaggccaagggctctcaagcaccctccctgccaaacacgtccgaggcccaaaagatcaaggaggtaccaacccaattcctcgaccgagatgaggaagaggaggacgccgacttcctgaaggtcaagcggcacaatgtatttggattagacctaaaggacgagaagaccctacaaaagaaggagccttctaagagttcaataaagaaaaagatgaccaaggtcgctgaagccaagaaggtgatgaagcggaactttaaagtgaacaagaagatcacatttactgatgagggcgagctagttcagcagtggccccagatgcaaaagagcgccatcaaagacgccgaggaggatgacgacaccggaggcattaatctgcacaaagctaaagaaagactgcaagaagaagataagttcgataaagaagagtatcggaagaagatcaaggcgaagcaccgagagaagcggctaaaggaaagagaggctaggagggaggccaataaaagacaggcgaaagcgaaagacgaagaggaagccttcctagattggagtgatgacgatgacgacgatgacgatggatttgatcccagtactctccccgatccagacaagtataggtcttctgaggattctgattccgaggacatggagaacaagatcagcgataccaaaaagaaacaaggcatgaagaagcgctcgaacagcgaggtcgaggacgtcggacccacatctcacaatcgtaaaaaggctagatgggacactctggaacccctagacaccgggctgtcgttagcggaagacgaggagctagtactgcatttgctgcgctcacagtcgtag

SEQ ID NO: 113916 - DNA, 2346 bp, Artificial Sequence
  Description of Artificial Sequence: Synthetic coding sequence
atgggtaagacggcgaactctccgggtagcggcgcaagacccgacccagtgcgcagttttaacagatggaagaaaaaacatagccataggcagaataagaaaaagcagctcagaaagcagctcaaaaagcccgagtggcaggtcgagcgagagagtatctcccggctgatgcagaattatgagaagattaatgtcaacgagatcaccagattttcagactttcccctgtccaagaaaacactgaagggtctgcaagaagctcagtatcgcttggtgacggagattcaaaagcagacgatcgggctggctctgcagggaaaagacgtcctgggcgcggctaagaccggatcaggaaagactctggccttccttgttcctgtgaacgaggcggaccggattcttgatatgggtttcgccgacacaatgaacgccgttattgaaaacctacctaaaaaaaggcagacactcctgttcagcgctactcaaacaaaatccgtgaaggacttggcccgcctatccctgaagaacccggaatacgtctgggtgcacgagaaggcaaaatacagtacacctgccacattagaacagaactacatcgtttgtgagttgcaacagaagataagtgtcttatattcatttctgaggtcccatctcaagaaaaaaagtatcgtgtttttcagttcctgtaaggaagtgcaatacctctaccgtgtcttctgcagactccgacctggcgtatcaatacttgctttgcatggacgccagcaacagatgcggcgcatggaggtctacaatgaattcgttaggaagcgagcagccgtcctgtttgctactgatatcgcagccagaggcttggattttcccgcagttaactgggtcctgcaatttgactgccctgaggacgcaaatacatatatccaccgggcaggcagaacggcccgctataaagaggatggcgaggcccttctgattctgcttccatctgagaaagctatggttcaacaactgctccaaaagaaagttcctgtgaaagagatcaagatcaatcctgaaaaactgatcgacgtgcaaaagaagttggaatctatcctggcgcaagaccaggatctgaaagaaagggcccaaagatgtttcgtttcatacgtacgttccgtatatctgatgaaggataaagaggtcttcgacgtttcaaagctgcccattcctgaatacgctctttcccttgggttagccgtggccccacgagtgaggttcctacaaaagatgcagaaacagccaaccaaggagctcgtgcggagccaggcagataaggttattgagccacgcgccccctcactgacaaacgacgaggtcgaggaattcagggcctattttaatgagaagatgtctattcttcagaagggaggcaagcgactcgaaggcactgaacacaggcaggacaacgacaccggtaatgaggagcaggaggaagaggaagatgacgaagaagagatggaagagaagctagcaaaggctaagggctcccaggcaccttccttacctaatacatcagaagcccagaaaatcaaggaagttccaacccaattcctagaccgcgacgaagaagaagaggatgctgactttctgaaggtgaagcggcacaatgtctttggcctggacttgaaggacgaaaagacactgcagaaaaaggagccgtctaagtcaagcataaaaaagaagatgacaaaagtggcagaggcaaagaaagtgatgaagagaaatttcaaagtgaataaaaaaatcactttcactgacgaaggcgagctggtccagcagtggccacaaatgcagaaatccgcaatcaaagacgccgaagaggacgacgacactggaggcatcaatctgcacaaggccaaagaacggctgcaggaagaggacaaatttgataaggaggaataccggaaaaagattaaggctaaacatcgggagaaacgactgaaagagagggaggccaggagagaagcaaataagagacaggccaaagcgaaagatgaagaggaggcgtttctggattggtcagatgacgatgacgacgacgatgatggattcgacccctctacactccctgacccggacaagtatagaagtagcgaagactcagattccgaggacatggagaacaagatttctgacactaaaaaaaaacagggaatgaagaaacgctcaaatagtgaagtcgaggatgtgggcccaaccagccacaacagaaaaaaagcacgatgggacaccttggagcctcttgatactggcctgtcgttagcggaggacgaggaactggtcctgcacctgctgcgttctcagagctag

SEQ ID NO: 113917 - DNA, 1959 bp, Artificial Sequence
  Description of Artificial Sequence: Synthetic coding sequence
atgagggggggcgggtttggcgaccgagatagggacagggaccgggggggcttcggcgcccgagggggcggtggcctccctccaaaaaagttcggaaatcctggagaacggctccgtaagaaaaagtgggatcttagtgaactccccaagtttgagaagaatttttatgttgaacacccagaagttgcacgattgacaccatatgaggtggacgaactaagaagaaaaaaagagatcactgttcggggtggggacgtctgtccaaagccagtctttgcatttcaccacgcaaactttcctcagtatgtcatggatgtgcttatggatcagcatttcaccgagccaacccctatccagtgccaggggttcccactggccctgtccggtcgggatatggtgggaatcgctcagacagggtcgggtaagacgctagcctacctcctccctgctattgtgcatattaaccaccaaccatatctcgaaagaggagatggtccaatctgtctggtattggcacctactcgggagctcgcacaacaggtgcaacaggttgcagacgactacggtaaatgttcacgtttgaaaagcacatgcatttatggcggggctcccaagggacctcagatacgggatctggagcggggggtggagatatgcattgccacgccaggacgcctgatagatttcctcgaaagcggcaagactaacctgaggcgttgcacataccttgtcctggatgaagcagacaggatgttggacatggggttcgaaccgcagatccggaagatcgtggaccagatcagacctgataggcagacactcatgtggagcgcaacatggccaaaagaagttaggcagctcgccgaagacttcttgagagattatacacagatcaacgtgggtaatctggaactcagtgcaaaccacaacatcttgcagattgtagacgtttgcatggaatcggagaaagaccacaagctgattcagctgatggaggaaattatggctgagaaagaaaataagactattatttttgtcgaaacgaagagacgctgcgatgacctgacgcgccgaatgcgccgcgacggttggccggccatgtgcatccacggcgataagagccagcccgagcgagactgggttctgaatgagtttcgcagcggcaaagcaccgatcttaatcgccacagacgtcgcaagtcgcggcctgggctttgacgtggaggacgtcaagttcgtaattaattacgattatcctaacagctccgaggactatgtgcacaggatcgggaggacagccaggtccacaaacaagggcaccgcttacacctttttcactccagggaacctgaagcaggctcgcgaactaattaaggtcttggaagaagcaaaccaggccattaatcctaagctgatgcaactagtcgatcataggggtggtggcggcggcgggggaggcaggtcccgttatcgcaccacgtcctctgcgaataacccgaatctgatgtatcaggatgagtgcgataggcgactgcggggcgtgaaggacggaggaaggagggactccgcgagttacagggaccggtccgaaactgatcgcgccggatacgccaatgggagtggctatggatcgccaaactcagcgttcggtgcccaggcgggtcagtacacgtacggccagggaacttatggagccgcggcctatggtacatcttcatatacggctcaggaatacggcgccggaacttatggcgcctccagcaccacttccactgggcggtcctctcagtcctcttctcagcaatttagcggcatcggtcgatcgggtcagcagcctcaacctctgatgtcccaacagtttgcccagccacccggcgccacaaacatgataggttacatgggccagactgcttaccaataccccccacctccccctccgcccccgccctcccgtaaatag

SEQ ID NO: 113918 - DNA, 2196 bp, Artificial Sequence
  Description of Artificial Sequence: Synthetic coding sequence
ctacccaccggctttgtcgcacctattttgtgcgtgctgctgccatcgccaaccagggaggctgcaactgttgccagcgccaccggcgattccgcttcagagcgagaatctgcagctcccgctgctgcgcccaccgcggaagcacccccgcccagtgttgttactaggcccgaacctcaggccttgccgagtcccgccattagggcgccccttccagatctatatccttttgggactatgagagggggtggcttcggagacagggaccgcgaccgagataggggaggctttggcgcgcgtggcggaggagggcttcctcctaagaaattcgggaatcctggcgaacgactgcgcaagaagaaatgggacctgtcagagttgcctaaattcgaaaagaacttttacgtggaacatcctgaggtcgcccggctgactccctatgaagtggacgagttaaggaggaaaaaggagataacagttcgtgggggggacgtgtgcccaaagcccgtattcgcctttcaccacgccaatttcccccagtacgtgatggatgtactgatggaccaacacttcaccgaacctactcccatccagtgtcagggattcccattggcgctgtccgggagggacatggtggggatcgctcagactggctccggcaaaaccttagcctaccttcttccagctattgtccacattaatcaccaaccctacctggagaggggagacggtccaatttgtctggtgttggccccaaccagggaactggctcaacaggtgcagcaggtggccgatgattatggaaagtgctccaggctgaagtctacttgcatctacggcggtgcacctaaggggccccagattcgggacctagaacgaggagtcgaaatatgtatcgccactcctggaaggctcattgactttctcgagtctggtaagaccaatctgaggagatgtacctacctggtgcttgatgaggccgatcggatgctggacatgggatttgagccccagatccgcaagattgttgatcagattaggcccgatcggcaaaccctgatgtggagtgctacttggcccaaggaggtgcgacagcttgcagaagatttcttgagagattacactcagatcaatgtggggaaccttgaactgtctgcaaatcacaacatactgcaaatcgtggacgtttgcatggaatcagagaaagatcacaaattgatccaactgatggaggaaatcatggccgagaaagagaataagacaatcatttttgtggagaccaagcggcggtgtgatgacctgacaagaagaatgaggagagacggctggccagccatgtgcatccacggagacaaaagccaaccagagcgcgattgggtcctcaatgaattcaggtcggggaaagctcctatcctgatcgccactgatgtagcaagtagggggctcgatgtcgaggatgtgaagtttgtgattaactacgactacccaaactcgtcagaggattacgtgcaccgcatcggacggacggctcgttctactaacaaaggtacagcatacaccttcttcacccccgggaacctcaagcaggctcgggaattgatcaaggtattggaggaagcaaatcaggccattaaccccaagctcatgcagttagtggaccaccggggcggcggcggtgggggagggaaaggaggtagatcccggtatcgaactacaagtagtgccaacaacccaaacttgatgtaccaagacgaatgcgatagacgcctccgcggcgtcaaagacggcggacggcgggattccgcatcatacagggatagatccgagacagacagagctggatacgcaaatggctccggatacggttctcccaacagtgcctttggagcccaggccggccagtatacctatgggcagggtacctatggcgctgcggcatatggcacatcatcctataccgcccaggaatacggtgccgggacgtatggggcaagtagcactacgtctacagggagatcttcacagagttcatcccagcagttcagcggcatcggccgatccggacagcagcctcagccacttatgagtcagcagttcgcacagcccccaggagctaccaatatgatcgggtacatgggtcagactgcatatcagtaccccccaccaccccccccccccccgccttcccgcaaatag

SEQ ID NO: 113919 - DNA, 2190 bp, Artificial Sequence
  Description of Artificial Sequence: Synthetic coding sequence
ctgccaacggggttcgtggcaccaatattgtgcgtgctcctgccctcgcctacaagagaagccgccactgtggcctctgccactggcgattctgcgtccgagagggagagcgcggcccctgcggctgcccccaccgcggaagcaccacccccaagcgtggtaactcgtcccgaaccacaggcactgccttcccccgcaattcgtgcccccctaccagatttataccccttcggcacaatgcgagggggaggattcggagatcgagaccgcgaccgggaccgtggaggattcggtgcccggggaggtggtgggttaccgccaaaaaagtttgggaatccaggagaaaggttgaggaagaaaaaatgggatctgtcagaactgcctaagtttgagaaaaatttctacgtggaacatccggaggtggcaaggttaactccatatgaggtcgacgagctccgtagaaagaaggaaataaccgtcagaggcggcgacgtgtgtcccaagccagtgttcgcatttcaccatgcaaactttccacagtacgtaatggatgtgctgatggatcagcacttcaccgaaccaactcctatccagtgccaaggattcccactcgctctcagtggaagggatatggtggggattgcccaaacaggaagcggcaagaccctggcttacctcttgccggccatcgtccatatcaatcatcagccataccttgaacgcggggatggtcctatctgtttggtacttgcgcctacccgagaattagcgcagcaggtgcaacaggtcgcagacgactacggtaagtgttccagactgaaatccacctgtatttacggaggtgctcccaaaggcccacagatacgcgatttagaaagaggagtcgagatctgcatcgcaactcccggaagattgatcgattttctcgaatccgggaagacaaacttgagacgctgcacctacttggtccttgatgaggcggaccggatgctcgacatgggcttcgagccacaaatccgcaaaattgtggaccaaattcgtcctgatcgacagaccctcatgtggtcagcgacttggcctaaagaggttcgccagttggcggaagactttcttagggactatactcagatcaatgtgggtaacttggaactaagtgccaaccacaatatcctccagatcgttgacgtttgtatggagtcagaaaaggatcataagctcatccaattaatggaggagattatggccgagaaggaaaataaaactataatcttcgtcgagacgaaaagaagatgtgatgatctgacacgtcgaatgcgacgggatggatggcctgccatgtgcatccacggggacaagagtcagccagagcgcgactgggtgctgaacgaatttcggtctggtaaggcacccatccttatcgccactgacgttgccagtcgcgggctggacgttgaagatgtgaaattcgtgatcaattacgattacccaaactcatctgaggattatgtgcatcggatagggcggaccgcaagatccaccaacaaaggcacagcctacactttttttacacctggtaacctcaaacaggcgagagagctgataaaagtgctcgaggaggcaaatcaagcaataaatccaaagctgatgcaactggtggatcataggggtggaggcggaggcggggggggcagaagtagatataggactacatcatctgctaacaatccgaatctcatgtatcaggatgagtgcgatcgcaggctcaggggcgtcaaggacgggggtagaagagatagcgcctcttatcgcgaccgctctgagacagatagggcgggatacgctaatggttcaggctacggaagcccaaatagcgccttcggcgctcaagccggacaatacacatatggtcagggtacctatggcgccgccgcatacggcacctcttcctacacagctcaggaatatggcgcaggcacatacggtgcctctagtacaacctcgacgggaagatcatcgcagtcctcctcacagcagttttccggaattgggcggtctggacaacagccccaacctctgatgtcacagcagttcgctcagccccctggtgcaaccaacatgatcggctatatgggtcagacagcctaccaatacccacctcctcctcccccccccccaccttcacggaagtag

SEQ ID NO: 113920 - DNA, 2214 bp, Artificial Sequence
  Description of Artificial Sequence: Synthetic coding sequence
ccaaacctgccaacgggattcgttgcacctatcctatgcgtgctgttgccgtcccccacaagggaggccgccacagtggcctctgctaccggtgacagtgctagtgagcgggaatcagctgctcctgctgctgccccaacagcggaagcacctcccccatctgttgtaacaaggccagagcctcaagccttgcctagcccagctatccgggccccactgccagatctgtaccccttcggcacaatgcgaggagggggatttggggatcgcgacagggatcgggacagagggggattcggagccagaggaggagggggcttgccccctaaaaagttcggcaatcccggtgagagacttcgtaagaagaaatgggacctgagcgaacttcctaaattcgagaaaaacttttatgttgagcatcctgaggttgccagactgaccccttatgaggtggatgagttgcgccgaaaaaaagagatcaccgtccgtggcggtgatgtctgtccaaagccggtttttgcatttcatcacgccaatttcccccagtacgtgatggacgttttgatggaccagcactttacagaacccacccccatccaatgccaaggtttccctttagcattatccggacgcgatatggttggaattgcacagaccgggtccggaaaaaccctggcttacttgttacccgccatagtgcatattaatcaccagccttacctggaacgaggagacggccccatctgcctcgtcctagcaccaactagagagctggcgcaacaggtgcaacaggtggccgatgactacggaaaatgctcgcgcctgaaatccacctgcatctacggtggggctcccaaagggcctcagattagggacctcgaaagaggggtggaaatctgcatcgcaacacctgggcgtctgatcgacttcctggagagcggcaaaaccaacctcagacgttgcacatatctggtgctggatgaggcagataggatgctggacatgggtttcgagccgcagatacgaaagatagtcgaccagattcgaccggaccgccagactctcatgtggtcagccacgtggccgaaggaggtcagacaactggccgaggactttctaagggactacacacagatcaacgtgggcaatcttgaactgtctgcaaatcacaacattctgcagatcgtagacgtgtgcatggagtctgaaaaagaccacaagctgatccagctcatggaggagatcatggccgagaaagagaacaagactatcatcttcgtggaaacaaagcgaaggtgcgatgacctgactagaagaatgcgtagagatggctggcccgccatgtgtattcacggtgacaagtcacagcctgaaagggactgggttctaaacgaattcagatccggcaaggcacctatactgatcgctacagacgtcgcctctagaggacttgacgtggaggacgtcaagttcgttatcaattatgactatccgaactcaagcgaggattacgtgcataggatcggcagaaccgccaggtccacaaacaaaggtaccgcgtacacatttttcactccaggtaatctgaagcaggcccgcgagctaattaaagtgcttgaggaagccaaccaggctataaaccccaagcttatgcagcttgtggatcataggggcggtggcggtggagggggaaaagggggccggtctaggtaccggacaacgtcttccgccaacaaccccaatcttatgtaccaggatgaatgtgatcgccggctgcgcggggttaaagacggggggcgtagagacagcgcgtcctaccgggatcggagtgagacagatcgggcaggctacgctaatggcagtggatacggatcgcctaattccgcgttcggcgcccaggccggccagtacacatatggccagggaacgtacggggccgctgcgtacggaacgagctcctataccgcacaggaatacggggccggcacgtatggtgcatcctccactacctcgacaggccgttcatctcagagctcctcacaacagttcagcggtattgggagaagcggccagcagccacaaccactgatgagccagcaattcgctcagccaccgggcgcgaccaatacacttctgcttcttcccttgctgctgctgcacgttaacgaaaccacacaggtcgttgtgacacctgcggatctaatcaccttttag

SEQ ID NO: 113921 - DNA, 546 bp, Artificial Sequence
  Description of Artificial Sequence: Synthetic coding sequence
atgcagctggtggatcataggggggggggaggcggcgggggcggacgaagccggtataggactactagcagcgctaataacccgaacttaatgtatcaggacgaatgcgatcgaagactcagaggagttaaggatggggggagaagagattccgcttcttacagagatcggagcgaaacagatcgagccggatatgcgaatggcagtgggtacggcagcccaaacagtgcatttggagcccaggcaggccagtacacatacgggcagggcacgtatggagccgccgcatatggaacgagctcctacacagctcaggagtatggagcgggtacctatggcgctagtagcaccacctcaactgggagatcatcccagagtagtagccagcaattctccggcatcggccgctctggacaacagccacaaccccttatgagccagcaatttgcacaaccacctggcgctacaaatatgatcggctatatgggccagacggcataccagtatcctccaccccccccgcctcctccaccaagccggaaatag

SEQ ID NO: 113922 - DNA, 2013 bp, Artificial Sequence
  Description of Artificial Sequence: Synthetic coding sequence
atgagccacctgcccatgaagttattgcgcaagaagattgaaaaaaggaacctaaagctccgacagcggaacctgaagtttcagggggcaagcaaccttactctcagcgagactcagaatggtgacgtgtctgaggagaccatgggaagcaggaaagtcaagaaaagtaaacagaaacccatgaacgtcggcctgagtgagactcagaacggaggtatgagccaggaagccgtgggcaacatcaaagtgaccaagtccccacagaagtctaccgtcctgacaaatggggaggctgccatgcagtcctctaattcagagagcaagaagaagaagaagaagaagagaaagatggtgaacgatgccgagcctgacactaaaaaggccaaaaccgagaacaagggcaaatctgaggaagaaagtgccgaaaccaccaaggagaccgaaaataatgtcgagaagcccgataatgatgaggacgagtccgaggtcccaagcttgccactgggtctcaccggcgcctttgaagacacatcttttgcatccctgtgcaaccttgttaatgagaatactttgaaagccatcaaggagatggggttcaccaatatgaccgagatccaacataagagtataaggccattactggagggaagggacctgctggcagctgcaaaaaccgggtctggtaagaccctcgccttcctcatcccagcagtcgagctgatcgtgaagctccgttttatgcctcggaacggtaccggggtgctcattttaagcccaaccagggagctggccatgcaaaccttcggggtccttaaggaactaatgacccatcacgtgcacacatatggcctcatcatggggggatctaaccggtcagccgaggcccaaaagctcggaaacggcatcaatatcattgtggccactccaggccggctgctggatcatatgcagaacacaccaggcttcatgtacaaaaacctccagtgtctggtaattgacgaggccgaccgaattctggatgtcggctttgaggaggagctgaagcagataattaagcttctacccactcggagacaaactatgttgtttagcgccactcagacccgaaaagtggaggaccttgcccgcatcagcctcaagaaagagcccctttacgtgggcgttgacgatgacaaagcaaacgcaactgtggatgggctcgagcagggatatgtcgtttgtccttcagaaaagcggtttcttctactgtttaccttcctgaagaagaataggaaaaaaaagctgatggtgtttttttcctcatgtatgagcgtaaagtaccattatgagttgcttaactacatcgaccttcccgtattggccatccatggcaaacaaaaacagaataaacgaaccacaactttctttcagttttgcaacgccgattcagggactctcctctgcactgatgttgcggcacgcggtctggatattccggaggtggactggattgtgcagtacgacccccctgacgatccaaaagagtatatccacagggttggaaggacagcacgcggactgaacggaagaggtcatgctctactgatcctgcgtccggaggagctggggtttctacgttacctgaaacagtctaaggtcccgctcagtgaatttgacttctcttggtctaagatctccgacatacagagccagctggaaaagcttatcgaaaaaaactacttcttacataaatccgcgcaggaggcgtacaagtcgtatattcgcgcgtacgactcacatagtttgaagcagatttttaacgtgaataacctaaatctccctcaggtagctctgagcttcggtttcaaagtgccacccttcgtggacctaaacgtaaactcaaatgagggaaaacaaaaaaaaaggggcggtgggggaggctttgggtatcaaaaaacaaagaaagtagagaaatctaagatttttaaacacatttccaagaaaagctcggattcccgacagtttagtcattag

SEQ ID NO: 113923 - DNA, 1230 bp, Artificial Sequence
  Description of Artificial Sequence: Synthetic coding sequence
atggagcaagaacagactttcggggtgctgaaagagttgatgacacatcatgttcatacttatgggttaattatggggggcagcaacagatctgccgaagcacagaagctggggaatggaatcaacatcatagtagcaacccctgggaggctgctcgatcacatgcagaacacaccggggttcatgtacaagaacctccagtgcctggtgatcgacgaggctgatcgaattcttgacgttgggtttgaggaagagctcaagcagataattaaactgctacctaccaggaggcaaacgatgttgtttagcgcaacccagacccgaaaggtggaagacctggctaggatctccttgaaaaaagagcccctctacgtgggagtggacgatgataaagctaacgctaccgttgatggcctggagcagggctatgtagtgtgtccttctgagaagaggttccttctcctgttcacttttctgaaaaagaatagaaagaaaaaacttatggtttttttttcctcatgcatgtccgtaaagtaccactatgaactgctgaattacattgacctccccgtgttggccatccatggcaagcagaaacagaacaaaaggactactaccttttttcagttctgtaacgcagacagcggcactctcctgtgcaccgacgtcgccgctagaggactggacattccagaggttgactggatcgttcaatacgatccccctgatgatccaaaggaatacattcaccgggtaggtcgcaccgctagagggctaaacggaagaggtcatgcactgctgattctgaggccagaagagctgggattcttgagatatttgaaacaatccaaagtgcctctctctgagtttgatttctcttggagcaagatatcagatatacaaagccagcttgagaagctgatagaaaaaaattacttcctgcataaatcagcccaggaggcttacaagtcctatatccgggcttacgatagccacagcctgaagcagattttcaacgtcaataacttgaatctgccccaggttgcactcagcttcggctttaaggtgccgccctttgtggacctcaatgtaaactctaatgagggtaaacagaagaaaagagggggaggaggcggctttggctatcagaagacaaagaaagtcgaaaaaagcaaaattttcaaacatattagcaagaaatcaagcgacagccggcagttttcccactag

SEQ ID NO: 113924 - DNA, 2475 bp, Artificial Sequence
  Description of Artificial Sequence: Synthetic coding sequence
atggctgctgcattcgaagcctccggcgctctggccgctgtggccacggccatgcctgctgagcacgtagcagtgcaagtacctgcacctgaacccactccgggccctgttagaatcttgcgaactgctcaagacctctcctctccaaggacccgaactggagacgtgctgctggctgaacccgccgactttgagagtttattactgagtcgacccgtcctggagggcctgcgcgcagccggcttcgagcgcccctccccagttcaactcaaagccatccctcttggaaggtgcggtctggacctgattgttcaggcaaagagcggaacagggaagacctgtgtgttcagcaccatcgctctggattcactggtgttggagaatctgagtacacagatcctaatcctggcacccacccgcgaaatcgctgttcagatacattctgtgatcactgctatcggaattaaaatggagggattggagtgtcatgtgttcattggcggcacgccattgagccaagacaagacacggctgaagaagtgtcacatcgctgttgggagccccggccgaattaagcagttgatcgagctggactatctgaatccaggcagcatacgcctgttcatactggatgaagccgataagctgctggaggaaggctcgtttcaggaacagatcaattggatttattcttccttgcccgcatcaaaacagatgctggctgtctcagccacttacccagagttcctcgcgaatgcccttacaaagtatatgcgggaccctactttcgtgagactgaactccagcgatccatctctcatcggtttgaagcagtattacaaggttgtaaacagctaccccctagctcataaggttttcgaggagaagacacagcatctgcaagaactcttctctcgtatcccatttaaccaagctctggtcttttccaacctacattcccgggcccagcatttagctgatattctgtcttcaaaaggattccctgctgagtgtatttctggcaacatgaaccagaaccagcgcctggacgctatggccaaactgaaacactttcactgtagagtgttaatcagtacagatctgacatccagaggcatcgatgctgaaaaggtgaacctggtggtgaacctcgatgttccgttggattgggagacgtacatgcatcgcatcggtagggctggtcgctttggaaccttagggctgactgtgacctactgttgtcgcggcgaagaggagaacatgatgatgcgcattgcccaaaaatgcaatataaatctgctcccactccccgaccctattcccagtggcctcatggaggaatgcgtggactgggacgtggaggtgaaggcagcagtgcacacttacggcatagcctcagtgcctaaccagcccctgaagaaacagatacagaagattgaaagaaccctgcagattcagaaagcccacggcgatcatatggcttccagcagaaataactccgtgtccgggctgtctgttaaatccaaaaacaatactaaacagaaactgcctgtgaaaagccattcggaatgcggcatcatcgagaaagccacttccccaaaggagctcggctgcgaccgacagtccgaggaacagatgaagaacagtgttcagactccggtcgaaaatagcacaaacagtcagcaccaggtcaaggaggctctgcccgtgagtctccctcagattccctgccttagctcctttaagattcatcagccgtatactctcacattcgcagaactggtcgaggactacgaacactacattaaagaaggtttagagaagccggttgagatcatccgccattacacaggacctggcgaccagacggtgaatcctcagaacggtttcgtgagaaataaagttattgaacaacgagtgccggtccttgcatcatcttcacagagtggcgatagcgagtccgattccgatagctactcctcacgcacctcaagccagtctaagggtaataagtcatatcttgagggttcaagtgacaaccaacttaaggatagcgagagtacgccagtggatgatagaattagtctggagcagcctcccaacggaagcgatactcccaatcccgagaagtatcaggaaagtcctgggattcaaatgaaaacgcgtctaaaggagggcgcctctcagcgggcgaagcaaagtaggcgcaatctgccaaggcgaagcagctttaggttgcagacagaagctcaggaagacgactggtatgactgccatcgcgagatccgcctttccttttcagacacataccaggattacgaggaatattggagagcatattatagggcatggcaggaatattatgcagccgcttcacacagttattactggaatgcacagaggcatccaagttggatggctgcgtatcacatgaataccatctacctacaggaaatgatgcactccaatcaatag

SEQ ID NO: 113925 - DNA, 417 bp, Artificial Sequence
  Description of Artificial Sequence: Synthetic coding sequence
atggccgccgcatttgaagccagcggggccttagctgccgttgccacagccatgcccgcggagcacgtggctgttcaggtgcccgctcctgaaccaacccctggccctgtcagaattctcaggacggcccaggacctgtccagcccaaggacacgcacaggtgacgtgttgcttgcagaacccgcagactttgaaagtctgctcctgtccagacccgtcctcgaaggattgagggctgctgggtttgagcgaccttccccagtgcagctgaaggccattccacttggacggtgcgggttggatctgattgtccaagccaagagcgggaccggcaagacgtgcgtcttctccactatcgccttggactctctggtgctggagaacctgtccacccaggctgagctgtccaacagttag

SEQ ID NO: 113926 - DNA, 2352 bp, Artificial Sequence
  Description of Artificial Sequence: Synthetic coding sequence
atgcctggcaaactgcgctccgacgcaggactggaaagtgacaccgcaatgaaaaagggggagacgctgcggaaacaaacagaggaaaaagagaaaaaggagaagcccaaatccgataagacggaagaaattgccgaggaggaagagacagtgtttcccaaagccaagcaggtgaaaaagaaggccgaaccctcagaggtggacatgaattctccaaagagcaaaaaagcgaaaaagaaagaagagccatcccaaaacgatatctccccaaagacaaagagccttagaaagaaaaaagagcccatagaaaaaaaggtagtgtctagtaagaccaagaaggtcacaaagaacgaggagcccagcgaggaagagattgacgcaccgaagccgaaaaaaatgaaaaaggaaaaagagatgaacggcgaaaccagagaaaaatctcctaagctcaaaaatggctttccacatccagaacctgactgtaacccttccgaggcagcatctgaagaatcaaattccgagatcgagcaggagatccccgttgaacagaaagaaggggcctttagcaattttcctatctccgaggaaactattaaactcctcaagggccggggagtgacctttctcttccctatacaggctaaaacgtttcaccatgtttactctgggaaggacctgatagctcaagctaggactggcacaggaaaaactttctccttcgccataccactaatcgagaagctgcacggggagctccaggaccggaagcgcgggagggccccgcaggtgcttgtgctggctcctactcgggagttggccaaccaagtatccaaggacttcagcgatattactaagaagttgagtgtcgcttgtttctacggtggtacgccctacggcgggcagttcgaaaggatgaggaacgggatagacattctcgtgggcacgccgggcagaataaaggatcacatccaaaatggaaagttggatctgaccaagctcaagcatgtcgtcctggacgaggtggaccagatgcttgacatgggctttgcggaccaagtcgaggagatcttatccgtagcttataagaaggactcagaagacaatccacagaccctgctctttagcgcaacgtgccctcattgggtgttcaatgtggccaagaaatatatgaagtccacatacgagcaggtggacctgattggcaagaaaacacagaagacggcaattaccgtggaacacctggccattaaatgtcattggacacagcgggcagccgtgattggggacgtcatccgagtgtacagcggacaccaaggcagaactatcatcttttgcgagacaaagaaggaggcccaagagctgagtcagaactcagctataaaacaagatgcccagagcttacatggagatattccacagaagcaacgggaaattactttgaaaggtttccgcaacggaagttttggggtgctggtcgctaccaacgtggctgcacggggtctcgatatccctgaggtggatctggtaatccagagctctccacccaaggatgtggagagttacatacacagatcaggccgcactggacgtgcgggcaggaccggggtgtgcatctgcttttaccagcacaaggaggaataccagctggtccaggtcgagcaaaaagcaggcatcaagttcaagcgaatcggcgtgccttcggcaaccgagataataaaggcctcttctaaagatgccattagactgttggattcagtgcctcctacggcgatatcccattttaagcaaagtgccgagaagctgattgaggagaagggtgccgtggaagctttggctgctgcactagcccacatttccggcgcaacatctgtcgaccagaggtctctaatcaattctaatgtcggttttgttaccatgattctgcagtgttcgattgagatgccaaacatttcctacgcttggaaagagctgaaagagcagctcggcgaagaaatcgatagtaaggtgaaggggatggtgttcctgaaggggaaactgggtgtctgtttcgatgtgcctaccgcctccgtgaccgaaatccaggagaagtggcacgattctcggcgttggcagctgtccgtagccaccgagcagcctgagcttgaaggacccagggaagggtacggtggcttccgaggccagcgcgaagggagcagggggttcagaggccaaagagatggcaatagaagatttaggggtcagcgtgagggttctaggggaccccgtggccagagaagcggtggtggaaataaaagtaacagaagtcagaacaagggtcaaaagcgaagcttcagcaaggcattcgggcagtag

SEQ ID NO: 113927 - DNA, 249 bp, Artificial Sequence
  Description of Artificial Sequence: Synthetic coding sequence
atgccagggaaactgcggagcgatgccgggctggaaagtgacacagccatgaagaaaggggagacattgagaaaacagactgaggaaaaggaaaagaaagaaaagcccaagtccgacaaaactgaggagattgcggaagaagaggaaacagttttcccaaaagccaagcaggttaaaaaaaaggccgagccaagtgaagtagacatgaactcgccaaaaagtaaaaagaagaagaagaagaagaaatag

SEQ ID NO: 113928 - DNA, 2463 bp, Artificial Sequence
  Description of Artificial Sequence: Synthetic coding sequence
atggccggagagcttgctgataaaaaagatagggacgcctcgccttcaaaagaagaacgcaaacggtcccggacccccgatagggaaagggatcgtgaccgggatagaaaatcctctcccagcaaagatcggaaaaggcaccgctctcgcgaccggaggcgtggcggttcccgctcaaggagtcgtagcaggagcaagagcgcagagcgggagcgcaggcataaggagagagagcgggacaaagaaagggaccgaaacaaaaaggaccgagatagagacaaggatggccaccggcgggataaggatcgtaagagaagtagcctcagccctggccggggaaaggatttcaaatcgaggaaggaccgggactcaaagaaggatgaggaggacgaacacggcgacaaaaaacccaaggcccaaccactgtccctcgaggaacttctggctaagaagaaggccgaagaagaagcggaggccaagccaaagttcttgagtaaagcagaacgagaagccgaggccttgaagaggcggcagcaggaagtggaggaaaggcagcggatgctggaagaagaacggaagaaacgtaagcagttccaagatctgggtaggaagatgctagaggaccctcaagagcgcgagcgcagagaacgccgcgaacggatggagcgtgagacaaacggcaatgaggacgaagaggggcgccagaagattagagaggaaaaggacaaatctaaagaattacacgccattaaggaaaggtatctgggtgggataaagaagcgcagacgtactcgccacctcaacgatagaaaattcgtgtttgagtgggatgcatctgaggatacgagtatagattacaatcccctgtataaggagcgccatcaggtacagttactggggaggggctttatagctggaatagatctgaagcagcaaaaacgtgagcagtcgcggttttacggggatctgatggagaagagacggaccctggaggaaaaggagcaggaggaagcacggttgcgcaagctaagaaagaaagaggctaaacaaaggtgggacgataggcactggagccagaaaaagcttgatgagatgaccgatagagactggaggatcttccgggaggactatagcatcacgacgaagggcgggaaaatccccaaccccattcgttcttggaaggactcgagtctgccacctcatatcctcgaggtgatcgacaagtgcgggtataaggaacctacacccattcaacgccaggccatacccataggcttgcagaaccgagacatcatcggggttgccgaaaccggttctgggaagaccgccgccttcttgatccctctgcttgtctggatcactacactgcctaagatagaccggattgaagagagtgatcaaggaccatacgctattattctagctcctacaagagaactggcccagcaaatcgaggaggagacaattaagttcgggaaaccgctgggaatccgcaccgtggccgtgataggcggtatctctcgcgaagaccagggttttagattgaggatgggttgcgagatcgttatagccactcccggtcgtttgatcgacgtacttgagaataggtacttggtgctgagcaggtgtacgtatgtagtcttggatgaagcagaccgcatgattgacatgggcttcgagccagatgtgcaaaagatcctggagcatatgcctgtaagcaatcagaaacccgataccgatgaggcggaggatccagagaaaatgctggccaactttgagagtgggaaacataaatatcgccagacagtgatgtttaccgctaccatgccccctgcggttgaacgccttgccagatcctatttacgacggcccgccgtggtgtacattggaagcgccgggaaaccacatgaacgcgtggagcaaaaggtgtttttgatgtcagaatcagagaaacgtaaaaaactactcgcaatcctggagcagggtttcgaccctccaattatcatattcgtgaaccaaaagaaaggctgcgatgttctcgccaagagcctggagaagatgggatataatgcttgtacgctgcacggcggcaaagggcaggaacagcgcgagttcgcgctgtcgaacctgaaggccggggcaaaggacatcctggtcgcgactgacgtggcgggacggggaattgacatccaggacgtaagcatggtcgtaaattatgatatggccaagaacatcgaggattatattcataggatcgggagaaccggccgggccggaaaatccggagtggctatcacttttctcacaaaagaggacagcgccgtgttttacgagctgaaacaggctattctcgaatctcctgtatcaagttgtccgcccgaactggccaatcatccagatgcgcagcataaaccagggacgatattgacgaagaagcgtagagaggagaccatttttgcttag

SEQ ID NO: 113929 - DNA, 417 bp, Artificial Sequence
  Description of Artificial Sequence: Synthetic coding sequence
atggccggcgaattagcagataaaaaggaccgggacgcgtctccttctaaggaggagagaaagcggtcccggactcccgatagggagagagatcgggatcgggaccggaaatcctccccttccaaagacaggaaaagacatcgcagcagagaccgccggcggggtgggtccaggagccgatccaggagccgtagcaaatctgctgagagagaacgcagacataaggagagggaaagggacaaggagcgcgaccggaacaaaaaagatcgggatcgtgataaagacgggcatagacgagataaggaccggaaacgttccagtctctcacccggccgaggcaaagacttcaaatcaagaaaagacagggactctaagaaagacgaggaggacgagcatggcgataaaaagcctaagtag

SEQ ID NO: 113930 - DNA, 549 bp, Artificial Sequence
  Description of Artificial Sequence: Synthetic coding sequence
atggcgggggagcttgccgacaagaaggaccgggacgcttccccctctaaggaggagcggaagagaagtcgtaccccagatcgggaacgcgaccgggaccgcgacaggaaatcaagcccttctaaagataggaagagacatagatcccgggaccgccggcgggggggttccaggtcccgctctcggtcccgaagcaagagcgcagagagagagaggaggcacaaagaacgcgagagagacaaagagagggatcgtaataaaaaagaccgagacagagataaagatggtcacaggagggacaaagaccgcaaaaggtcttccctgtcaccgggccgtggaaaagacttcaagtcgagaaaggaccgggactcaaagaaggacgaggaagatgagcacggggacaaaaaacctaaagcacaaccactgagtttggaggagctcctcgctaaaaaaaaagcagaggaggaggccgaagccaaacctaaatttctttcaaaggcggagagggaggcagaggctctgaagcgcagacaacaggaagtggagtag

SEQ ID NO: 113931 - DNA, 2580 bp, Artificial Sequence
  Description of Artificial Sequence: Synthetic coding sequence
atgaaattgaaagacactaaatcacgccctaaacagtctagctgtggaaaatttcaaaccaagggtatcaaagtggttggaaaatggaaggaggtaaaaattgacccgaatatgtttgctgacggccaaatggatgatttggtgtgctttgaggagctgaccgactatcagctggtgtctccggcgaagaatcctagcagtctgttttccaaggaggctccgaaacgaaaggctcaggctgtgtccgaggaagaagaggaggaagaagggaaatctagctcccctaagaagaaaatcaaactgaaaaaatctaagaatgtggccactgagggcacctccacacagaaggagttcgaggtgaaggaccctgagctggaagcacaaggcgacgacatggtctgcgacgatcccgaagctggggaaatgacatcagagaacctggtgcagacagcacctaagaagaaaaaaaacaagggaaagaagggactggagcccagccagtctacggccgccaaggtccctaagaaggctaaaacgtggattccggaagtccacgatcagaaggcggatgtttccgcttggaaggacctctttgtgccccgcccagtcctgagagccctaagctttctggggttttctgcccccactccgatacaggctctgaccctcgcaccggccattagagacaagctggacatattgggagccgctgagactggatcaggcaaaaccctggcattcgctattcctatgatacacgctgtcctacagtggcagaagaggaacgctgcaccacctccctccaatactgaggcccccccgggggaaacaagaaccgaggccggtgcagagacccgctctcctggcaaggcagaagcggagtctgacgcgctgcctgacgatactgtgatagaaagcgaggcgctgccgtctgacatcgctgctgaggctcgcgccaagacggggggcactgtgagcgaccaggcgctgttatttggtgatgacgacgccggcgaagggccctcttccctgatcagagagaagccagttcccaaacaaaacgaaaacgaggaggaaaatttggataaagagcagacggggaacttaaaacaggaactggatgataagtccgccacctgtaaggcatatcctaaaaggcccctccttggactagtgctgacccctacacgggagctcgcagtgcaagtcaaacagcatatcgacgcagtggcacggttcaccggaatcaagacagctattttagtcggcgggatgagcactcaaaagcagcagagaatgctcaaccgacgccctgaaattgtcgtcgccacccccggcagactgtgggagctcatcaaggaaaagcactaccacctgaggaaccttaggcagttaaggtgtttagtggtagacgaggcagataggatggtcgaaaagggccattttgccgagctgtcacagctgcttgagatgctcaatgacagccagtataaccccaaaagacagacattggttttctctgctaccttgaccctcgtccaccaagcccccgcccgcattctacataagaaacacaccaaaaaaatggacaaaacagccaagctagacttgctgatgcagaaaatcgggatgaggggtaagccaaaagtgatcgacctcacccgcaacgaggcaaccgtggaaactctgacagaaacaaagatccactgtgaaacagatgaaaaggatttttatttgtattacttcttgatgcagtatcccggacgttcgttggtctttgccaatagcattagttgtattaagaggctgtcaggcctcttgaaagtccttgatatcatgcctctgactctccatgcctgcatgcaccagaaacagcgcctcagaaatttggaacagttcgctcggttggaggactgtgtcctgctcgctacagatgtcgcagccaggggactggacattccgaaagtccagcatgtgattcattatcaagttcccagaaccagtgagatctatgttcacaggtcagggcgtactgcgcgtgctaccaacgaggggctctcccttatgttgatcggccctgaggacgtgatcaacttcaagaagatatacaagactctgaaaaaagacgaggatatcccactgttccctgtgcagacaaagtacatggacgtggtgaaggagaggatcagactagcacgacaaattgagaaatccgagtataggaacttccaggcttgcctgcataattcatggattgagcaggccgcggctgctctcgaaattgagctcgaggaagacatgtataagggcgggaaggccgaccaacaggaagagaggaggcgacagaagcagatgaaagtgcttaagaaagaactgcgccatcttttaagccagcccctcttcaccgagtctcaaaaaactaagtacccaacacagtccggaaaaccacccctcctcgtgtcagccccttccaaatctgagtctgcactcagttgcctaagcaaacagaagaagaagaaaacaaagaagcccaaggagccccaaccagagcagccgcagccctccactagcgcaaattag

SEQ ID NO: 113932 - DNA, 2415 bp, Artificial Sequence
  Description of Artificial Sequence: Synthetic coding sequence
atgaagctgaaggataccaagtctagaccaaagcaatcaagttgtggaaagttccagaccaagggcatcaaagtagtcggtaagtggaaagaagtgaagattgacccgaatatgtttgctgatggacagatggacgatctggtgtgtttcgaggagcttaccgattaccagctggtgtcccccgctaaaaatccatccagtttgtttagcaaggaggctcccaagaggaaggcacaggctgtgtccgaagaagaggaggaagaagaaggaaaaagcagtagtcccaagaagaagataaaactgaagaagtcgaaaaatgtggcaaccgagggaacctccacccagaaagaatttgaggtcaaggatccggagctggaggctcagggggacgacatggtctgcgatgatcccgaggcaggtgagatgacatcagagaacctcgtgcagaccgcccctaagaagaagaagaataaaggcaaaaaagggctggaaccaagtcaatctaccgccgcgattagggataagctggacatccttggagctgcagaaaccggctccgggaaaaccttggcttttgcaattcccatgatacatgcggttctgcaatggcagaaacggaacgctgcgcctccccctagtaacacggaggctcctcccggggagaccaggaccgaggcaggggctgagacacggtcgccaggcaaagcagaagctgaatctgatgctctgcctgacgacactgtcatcgaaagcgaagccttgccgtctgatatcgctgccgaggcccgcgccaagactggcggcactgttagcgaccaggccctgttgtttggagacgacgacgccggtgagggacctagctctctcatcagggaaaagccggtgcccaagcagaacgaaaatgaagaggagaacttagataaagagcaaacaggtaacttaaagcaggagctggatgacaaatctgcgacctgcaaggcttatcccaagcgacctctgctgggcctggtgctgactcccactagagaactggccgtgcaggtgaagcaacatatagacgccgtagctcgtttcaccggcatcaagacagcaattctggtgggcgggatgtctacacagaagcagcagcggatgctgaacaggagacctgagatcgtagtcgcgacgccaggtagactgtgggagctgattaaagagaaacattaccacctacggaacctacgtcagttacgctgcctggttgttgacgaggccgatagaatggtcgagaagggccatttcgcggaactgtcccagctgttggagatgctgaacgactctcaatacaaccccaaacgacaaaccttggtctttagtgccacgctcactcttgtccatcaggcccctgcacggatccttcataaaaaacacaccaagaagatggataagaccgctaagctggatttgctgatgcagaagatcggcatgagaggaaagcctaaggttattgatctgacaaggaatgaggctaccgtcgaaactttgacagagaccaagatccattgtgagaccgatgaaaaagatttttatctgtactattttttgatgcaatatccgggacgttccctggtgttcgctaactctatttcctgtatcaagagactgagcgggctactcaaagtcctcgacatcatgccattgactcttcacgcatgcatgcaccagaaacagcgacttaggaatctggagcagtttgcccgactcgaagactgtgtgttgctggccaccgatgtggcagcacgaggccttgatattcccaaggtgcagcacgtgatacactatcaggtcccgaggacatccgagatttatgtgcaccggtcggggagaactgcacgggccacaaacgaggggttgagcctgatgctcatcggtccagaggacgtgatcaacttcaagaagatctacaagacactgaaaaaggatgaagatatcccactattccctgtgcagactaaatacatggatgtggtgaaggaacgcattcggttagcaagacaaattgaaaagagtgaatacaggaatttccaggcttgcttgcacaacagctggattgaacaggccgcagcggccctggagattgaactggaagaagacatgtacaaaggaggaaaggctgatcagcaggaagagaggcgaagacaaaagcagatgaaggtcctaaagaaggaattgaggcacctgctatcacagccactgtttaccgaaagccagaagactaagtaccccacccagtccggtaaaccccccctactggtgtccgccccatctaaatcagaatccgccctgtcctgtctatccaagcagaagaagaagaaaaccaagaagcctaaagaacctcagcccgaacagccgcagcccagcacttctgcgaactag

SEQ ID NO: 113933 - DNA, 2292 bp, Artificial Sequence
  Description of Artificial Sequence: Synthetic coding sequence
atggacgacctggtctgcttcgaggagctgacagactaccaactcgtgtctcccgccaagaaccccagctcccttttttctaaggaagcccccaaaaggaaagcgcaggccgtgtcagaagaagaggaagaggaggagggcaagagcagtagcccaaaaaagaagatcaaactgaagaagtcaaagaatgtcgctacggagggcacaagtacacagaaggaattcgaagtcaaggatccagaacttgaagcccagggcgatgatatggtctgtgacgatcctgaggcaggcgagatgactagtgaaaacctcgtgcagacagctcctaaaaagaaaaagaataaaggtaagaagggcctggaacccagccagtcgaccgcggctaaagtcccgaagaaagctaagacgtggatccccgaggtgcacgaccagaaagcagacgtctccgcttggaaggatttgtttgtgcccagaccagtgttacgagcgctgtcctttctgggtttctctgccccaacgcccatccaggccctgacccttgctcccgctattcgggacaaattggatatccttggggcagccgaaactggtagcggaaagactttggcgtttgctatacctatgattcatgctgtgttgcagtggcaaaaacggaacgctgctccaccccccagtaatacggaggcgcctccaggggaaacacgtacggaggccggtgctgagaccagaagccctgggaaggccgaagcagagagtgatgcactcccggacgataccgtgattgagtccgaggcgctaccttctgatatcgcggccgaggctcgcgctaaaacagggggcacagtctcggatcaggcattgttgttcggcgacgacgatgccggtgaagggcctagcagcctaatcagggagaaaccagtgccaaagcaaaatgaaaacgaggaggagaacctggataaagagcagactggaaacctgaaacaggagttggacgacaagagcgccacctgtaaagcctacccgaaaagacctctgctcggtctggtcctcaccccaactcgggagctagccgtgcaggttaagcagcatatcgacgcggtcgccaggttcacggggatcaaaacagcgattctggtgggcggaatgtcaactcagaagcagcagagaatgcttaacaggcggcccgagatcgtggtggctacccccggtagactctgggagctcatcaaggaaaaacattaccacctgaggaacctccggcagctgcggtgcttggtggtggacgaggccgataggatggtggaaaaaggtcatttcgcggaactgtcacagctgctggaaatgctgaacgatagtcaatataaccctaagaggcagactttagtcttctcggcaactctgacactcgttcatcaagcacccgcccggattcttcataagaaacacacaaaaaaaatggacaaaaccgcaaagctggacctcctgatgcagaagattggtatgcgcggcaagcccaaggttatcgaccttacacggaatgaggcaaccgtagaaaccctcacagagacaaaaatccattgcgagaccgatgagaaagacttttatctttactattttcttatgcagtatcccggcaggtccctggtgtttgccaacagcataagctgcattaaaaggttaagcgggcttttaaaggttttagacatcatgcctctgacactccatgcttgcatgcaccaaaagcagcgactgaggaatctcgagcagtttgccagacttgaagactgtgtgttactcgccaccgacgtagccgctcggggtctcgatatcccgaaggtgcagcatgtgattcattaccaggtccctaggacctctgaaatctatgttcaccggagcggacggactgccagggccactaatgaggggctctcactcatgcttatagggcctgaggacgttataaacttcaagaagatctacaagacactcaagaaagacgaggacattccactcttccccgtacagacaaaatacatggacgtggtgaaggagcgcatccgtctggcccggcagatcgaaaagtctgagtaccgaaatttccaggcctgcctccacaacagctggatcgaacaggcagcagcagcgctcgaaattgagctggaggaggatatgtacaagggaggaaaagccgaccagcaggaggaacgccgccgacaaaaacagatgaaggtgcttaagaaagaattacgacatctgctatcccagccacagccaagcacttctgcaaactag

SEQ ID NO: 113934 - DNA, 1458 bp, Artificial Sequence
  Description of Artificial Sequence: Synthetic coding sequence
atgaccaaagccccatgcaaagcctatcccaaacgtcccctgctgggtttggttctcactcctacgcgggagctggccgtgcaggtgaagcagcacatagatgccgtggcccggtttactggcatcaagacagctatccttgtgggaggaatgtccacccaaaagcagcaaagaatgcttaaccggaggcccgagatagttgtcgcaacacccgggaggctttgggagcttatcaaggaaaaacattaccatcttcggaatcttaggcagctgcgctgcctggtggtagacgaggccgatcggatggtggaaaaaggccacttcgccgaactctctcagctgttggagatgttgaatgatagtcagtacaatcccaaaagacaaacacttgtgttctcagctacgcttactctcgtgcatcaggctccagccagaattcttcataaaaagcacaccaaaaagatggataagacggccaaactagacctcctgatgcaaaaaatagggatgagagggaaaccgaaagtcatagatctgacaaggaacgaggccaccgtcgaaactctgaccgaaacaaaaatccattgtgagacagacgaaaaagacttctatctatattatttcctgatgcagtatcccggccgtagcctggtgtttgccaattctattagctgcatcaagcggctgtctgggctgctcaaggttctagatatcatgcccctgaccctgcatgcctgtatgcatcaaaagcagagacttcggaatttagaacaatttgcccggctggaagactgtgtgctcctagccaccgatgtggcggcccggggtctagacattcccaaggtccagcatgtgattcattaccaggtgccccgcactagtgagatctatgttcacaggagcggtcggacagctagggccaccaatgaggggctatccctgatgttgattggcccagaagatgtgattaatttcaagaaaatttataagacactcaaaaaggacgaggacatccccctgtttcccgttcagacaaagtacatggacgtggtcaaggaaaggatacggctcgcacggcagatcgaaaagtctgagtatagaaacttccaggcctgtctgcacaacagctggatcgaacaggcagctgccgccctggaaattgagttagaagaagacatgtataagggcggcaaagcagaccagcaagaggaacggaggcgtcaaaagcaaatgaaggtcttgaaaaaagaactgaggcacttactgtcccagcccctatttacagaatctcaaaaaacaaaatatccaacgcaaagtggcaagccacctctcctcgttagtgcaccatctaaatccgagagcgcactttcttgcctctctaagcaaaagaaaaagaagacaaaaaagcccaaggaaccgcagccggagcagcctcaaccatcgaccagtgccaattag

SEQ ID NO: 113935 - DNA, 1623 bp, Artificial Sequence
  Description of Artificial Sequence: Synthetic coding sequence
atggctctcacccggccagtcaggctgttctcccttgtcactcgacttttactagcaccaagacggggactgacagtgagaagcccggacgaaccgctgcccgtcgtgcggatacccgtagcccttcagaggcagctcgaacagcgtcagagtaggcgacgcaatctcccccgcccagtattggtgcgtcccggcccactgctggtttccgcacggaggcctgaacttaaccagcccgcccggcttactctgggccgctgggagcgagctcctctcgcgagccagggttggaagtcccgaagggcacgacgcgatcacttttcaatcgaacgggctcaacaggaggctccagccgtgaggaaattgtcatccaaaggcagtttcgccgatttgggactggaaccccgtgtgttacacgctctgcaggaggcggctcccgaagtagtccagccaacaacggttcaatccagtaccattccttctttacttagaggcagacacgttgtgtgtgctgcggagactggctccgggaagaccctttcttacctcctcccactgctccagaggcttctgggacagcctagtctggattccttaccaattcctgccccacgcggactcgtgctggttccatctagagagctcgcccagcaggtgagagctgtggcgcaacctttgggccggtcgctcggtctcttagtgagggaccttgaaggcggacacggcatgcggcgcatcagactgcagttatctcgccagccaagcgccgatgtccttgtggcaacacccggggctctctggaaagccttgaagagtagactgatttctcttgaacaactctcctttctggtgttagacgaagcagacacactcctggatgagagttttttggaactggtggattacatcctcgaaaagagtcacatcgccgaggggcctgctgatttagaagatcctttcaacccaaaggcccagctggtcctcgtgggggctacttttccagagggcgtcggacagctgctcaacaaggtggcgagcccagatgccgtgaccaccattactagctccaagctgcactgcattatgcctcacgttaagcagacatttctcaggctcaagggtgccgataaggttgccgagctggttcatattctgaagcacagggaccgcgccgagcggacggggccatcgggcaccgtacttgtattctgcaattcctccagcacagtcaattggctgggatacatacttgatgaccacaagatacaacatctcagacttcagggacaaatgccagccttgatgagggtcggtatcttccagagttttcagaaaagcagtcgagacatactcctttgcactgacatcgcatcccgggggctagactcgacaggcgtcgagctggtggttaattatgattttccccccacactccaggattacatccaccgcgccggacgagtcggccgtgtcggctctgaggtgcctggcactgttattagcttcgtaacccatccctgggatgtgtctctagttcagaagatcgagctggccgccaggagaagacggtcactgcccggattagccagttctgtgaaggagccccttccccaggccacatag

SEQ ID NO: 113936 - DNA, 1989 bp, Artificial Sequence
  Description of Artificial Sequence: Synthetic coding sequence
atgtcacacgtggctgtggagaatgccctcggcttggaccaacaattcgcaggcctcgatctgaactcatcagacaaccagagcggaggttccaccgcgtccaaaggacggtacatccctcctcatctgaggaatagagaggctaccaagggattctacgacaaggactcctctggatggtccagtagcaaagacaaagacgcgtacagcagtttcggtagccggtccgactctaggggtaaatcctctttcttctctgatagaggctcagggagtagaggccgttttgatgatcggggccgctcagactacgatggcattggcagcaggggggataggagtggttttggaaaattcgaaaggggcggaaatagtagatggtgcgataagtctgacgaagatgactggtcaaagccactccccccaagcgagcggcttgaacaggaactgttttccgggggcaatactggaatcaattttgagaagtatgatgacatccctgtggaggctactgggaataattgtccaccccacatcgagagcttctctgacgtggagatgggggagatcatcatggggaacattgagctgacccggtatacaaggccgacacccgttcaaaagcacgctattcccatcatcaaggagaaaagggacctgatggcgtgtgcacagaccggtagcgggaaaaccgcggcgtttctattgcctatcctttctcaaatctattcagacggccccggggaagctcttagagctatgaaagagaacgggcgatacggacggcggaagcaatatcccatttctctcgtgttggcaccaacaagagagcttgcggtccagatctatgaggaagcccggaaattctcttatagatcacgagttaggccctgtgttgtttacggaggcgccgatattgggcagcagattagagatctcgagcgcggttgtcacctcctggttgctactcctgggaggcttgtggacatgatggaacgcggcaagatagggctggacttttgcaaatatctggttctagatgaggccgatagaatgcttgatatgggctttgagcctcagatccgcagaatcgtagaacaggacactatgccgcccaagggagtccggcacactatgatgttcagtgcaacgtttcctaaggagatacaaatgctcgctcgcgatttcctagatgaatatatctttcttgcagtcggtcgagtgggctctacatcagagaatatcacacagaaggttgtgtgggtggaggagagcgacaaacgctcattccttctcgacctcctgaacgccactggcaaagattccttaacactcgtgttcgtagagactaaaaagggggcagactctcttgaggatttcctgtaccacgaaggctacgcatgtactagtattcacggtgatcgcagccaaagggacagagaggaggcgttacatcagtttaggtcaggaaaatcccctatactcgtagcaacagccgtagcagcccggggcctggacatcagcaacgtaaaacatgtgataaatttcgatttgcccagtgatattgaagagtacgtgcaccgaatcgggcgtacagggagggtggggaatctgggactggccacatccttcttcaatgagcgcaacattaatatcaccaaagacctgctcgatctgctggtggaggccaaacaggaagtgccgagctggctcgaaaacatggcatacgaacatcactataaaggcagtagcagaggacgaagcaagtctagtagattctccggaggattcggagcacgggattaccggcagtcatctggggccagctcctcttcattctcgtcaagcagggcatccagctccaggagcggtgggggcggccacggcagctctcggggcttcggtggtggcgggtacggcggcttttacaactccgacggttacgggggaaattacaactcacaaggtgtcgactggtggggcaactag

SEQ ID NO: 113937 - DNA, 420 bp, Artificial Sequence
  Description of Artificial Sequence: Synthetic coding sequence
atgagtcacgtcgcagtggaaaacgctctgggcttggaccaacagttcgcaggtctggacctaaattcttccgataaccagtccggtggcagcactgcatccaagggcagatatatcccccctcacttgcgcaatcgggaagcaaccaagggattctacgataaagactcaagcggatggtcctctagcaaagacaaggacgcatactccagttttgggtccaggagcgactcacgaggcaaaagttccttcttttccgacagggggtctggttctagaggacgtttcgatgatagagggcgtagcgactatgatgggatcgggtcccgcggcgatcgaagtgggtacggaggcttctacaatagtgatggatacggcggcaactataatagtcagggagtcgactggtggggaaattag

SEQ ID NO: 113938 - DNA, 1941 bp, Artificial Sequence
  Description of Artificial Sequence: Synthetic coding sequence
atgagccatgtcgcagtggaaaacgcactgggtctggatcagcaatttgccggactagacctaaactcatcagacaatcagagcggcggctcgacagcttcgtccttctatgataaggatagctctggatggtcatctagcaaggataaagatgcctattcttctttcggttcccggtcggacagccggggtaaatcttcatttttttcagacaggggaagcggcagtcgcggtcgattcgatgatcgagggagatcagactatgacggcataggtagtcggggagataggagcggttttggaaagtttgagcgggggggaaatagccggtggtgcgacaagtctgatgaagacgattggagtaaacctctgccaccatctgaacgtctggagcaagagctgttctcgggggggaacaccgggatcaactttgaaaagtacgatgatataccagtggaggcgactgggaacaattgccctccccatatagagagtttcagcgacgtggaaatgggcgaaataattatgggcaatattgagctgactcgctacacccgccccacacccgtacagaagcacgccatccccataataaaggagaaacgggaccttatggcatgtgcacagacagggtcaggcaagactgctgcttttcttttgcctatcctcagtcaaatctacagcgatggccctggtgaggcacttcgcgctatgaaggagaacgggcggtatggccgtaggaaacagtatcccatttcactagtccttgcacccacaagagaactcgccgtgcagatctatgaggaagcaaggaagttctcataccggtcaagggtgcggccttgcgttgtgtatgggggcgccgacatcggtcagcagatccgcgacttagaaagggggtgtcacctccttgttgccacgccaggcagactagtagacatgatggagcgtggaaagatcggcttggacttctgtaagtatctcgtactggacgaggcagataggatgctggatatgggatttgagccccagatcagacgcatagtggagcaggatacaatgcctcctaagggcgttcggcacactatgatgttctcggcaacgttccctaaggagatccagatgctggcacgcgatttcttggacgagtatatcttcttagcagtgggtcgggtcggatcgacttctgaaaatataacacagaaagtcgtctgggtggaggaatccgacaagcgctcgtttctacttgatctgcttaacgcgacgggcaaggactctctcacgctcgtgtttgtcgaaacaaagaagggggctgatagcctggaagatttcctgtaccacgaaggatacgcgtgtacttccatacatggagacaggtcgcaaagggatagggaggaagccctgcaccaatttcggtctgggaagagccctatactggtagccacggcagtcgccgcccggggactagatatttcaaacgtcaaacacgttattaattttgacctcccgtcggatattgaagagtacgtacatcggatcggcagaacaggaagggtaggtaacctgggactggctaccagcttcttcaacgagcgaaacatcaatatcaccaaagacctgttagatctgctcgtggaagctaagcaggaagtgccatcctggctggagaacatggcatacgaacaccactacaaaggttcaagtcggggccggagcaagtcgtcaaggtttagcggggggttcggtgctcgcgattatagacaaagttccggggcctcctcatcatctttctccagcagtcgtgcatcctctagtcgtagtggaggaggtgggcatggctcttcaagaggcttcggggggggcgggtacggcggcttctacaacagtgatggctatggtggcaactataactctcagggggtggactggtggggaaattag

SEQ ID NO: 113939 - DNA, 927 bp, Artificial Sequence
  Description of Artificial Sequence: Synthetic coding sequence
atgagggagagtagactgatttccgacttggggggcttcgccggggtgcgtagcgctgccggccgcgattggcggcccttctggttaggcgggcttaggccctcaaggttagctcagcccgggttcccgtccggtggtccaggtgggacacgttgccttagagcttgtgaacaggggttcgcggggttggacctgaattcatcagacaatcagtcagggggctccaccgccagtaagggacgttacatcccgccccatctgcgtaatcgggaagccactaaggggttctacgataaggactcctctggctggtcctcttcgaaggacaaagatgcatattcctcattcggatcaaggtccgacagccggggcaagtcttccttcttctcagataggggcagcggatcaagaggacgcttcgacgacaggggacgctccgactacgatgggatcggctcaagaggtgataggagtggattcgggaagtttgaaagggggggaaacagtcgatggtgcgacaagtctgacgaagacgattggtctaagccactccctccatccgaacggctcgaacaggagctgtttagcggcggaaacaccggcatcaacttcgagaaatacgacgatatcccggtagaagccacaggtaataactgtcctccgcatatcgagtcgttttcagacgtagagatgggtgagatcatcatgggaaatatcgagcttacccggtacacccgacccacccctgtgcagaaacacgccatcccaataataaaggagaagcgagacctcatggcatgtgcacagactggtaagtggaaagtctgggctcctcaaactattcctaacctgcttggcatctcaactaacgagcgcgtaggttctactgacctgcgcggttcacagaaaatcttcatcccaatctag

SEQ ID NO: 113940 - DNA, 1983 bp, Artificial Sequence
  Description of Artificial Sequence: Synthetic coding sequence
atgagtcatgtagtggttaaaaatgaccccgagttggatcagcagcttgcaaaccttgatctcaactccgaaaagcagtccggcggggctagcactgccagcaaaggtagatacattcccccgcaccttaggaacagggaggcctccaagggctttcacgataaagacagcagtgggtggagctgtagtaaggataaggatgcttatagctcatttggatcaagagattcacgcggcaagcccgggtatttctccgagagagggtccggatctcggggaaggttcgatgaccgggggcggagcgactacgatgggattggcaatcgggagaggcccgggttcggacgctttgagagatcggggcattccaggtggtgcgataaaagtgtggaggatgattggtccaaacccctgccaccgtccgagcgcttggaacaggagctgtttagtggtggcaataccggcatcaactttgaaaagtacgatgatattccagtggaggctaccggctcaaattgtcctcctcatatcgaaaacttcagcgacatcgatatgggtgaaataatcatgggaaacattgagctaactcgatatactcgcccgacgccggtgcagaaacacgcaattcctatcataaaaggaaaacgtgatctgatggcctgtgcccaaactgggtccggcaagactgcagcatttctgctccccattctgtcacaaatctatacggacgggcccggggaagccttaaaggccgtcaaggagaatggcaggtacggaagaaggaaacagtatcctatcagccttgtgcttgctccaacacgggaattggcggtgcaaatctatgaggaggctagaaaattcagctataggagcagagtaaggccctgcgtggtgtatggcggagccgacattgggcaacagatcagagacctcgaaagagggtgccacctgctggtcgcaacccctggacggttagtcgacatgatggagagaggcaagatcggcctggatttttgcaagtacctagtgctcgacgaggctgacagaatgctggacatgggcttcgagccacagattcgcaggatagtggagcaggataccatgccccctaagggcgtccgtcacacaatgatgttctccgccaccttccctaaagaaattcagatgctggcgcgggatttcctagacgaatacatctttttggctgttggtcgagtggggagtacgtcagagaacattactcagaaggtggtgtgggttgaagatttggacaagagatcgtttctgctcgatattctgggggccaccggttccgactcactgaccctggtgttcgtcgagaccaaaaagggtgcagatagcctggaggactttctatatcacgaagggtacgcttgtacctcgattcacggagatcggtcccagagggatcgggaagaagccttgcaccagttccgatccggtaagtcccccatcttggttgctacagccgtggcagcaaggggactggacattagcaatgtgagacacgtgatcaatttcgatttaccgtccgatatcgaggaatatgttcatcgcattggacgaacaggtcgggtgggaaacttgggactggccacatccttctttaatgagaagaatatgaatattacaaaggacttgctggacttgcttgttgaagcaaaacaggaggtgccttcttggttggagaatatggcctacgagcatcactacaagggaggtagtaggggccgctctaaatccaatagattttcgggaggcttcggggcgagagactataggcagtcaagtggaagcagcagcagcggtttcggcgctagccgtggctctagcagtcgcagtggagggggtgggtatggaaattctcgcgggttcggcgggggcgggtatggcggattctacaacagcgatggatacgggggcaactataactcccagggcgtggactggtggggcaactag

SEQ ID NO: 113941 - DNA, 1983 bp, Artificial Sequence
  Description of Artificial Sequence: Synthetic coding sequence
atgagtcatgtcgtcgtgaaaaacgatcccgagctcgaccagcagttggccaacctcgacttaaactctgaaaaacagtctggcggcgcctcaactgcctccaagggtcggtacattcctccccacctacggaatcgcgaagcttctaaaggatttcatgataaggacagcagtggctggtcatgctccaaagacaaagatgcctactccagcttcggctctagggattctcggggcaagcccggatacttttctgagagagggagtggctctcgcggccgctttgatgatcgaggtaggagtgactatgacggcatcgggaaccgcgaaaggccaggctttggcaggttcgagaggtcaggtcatagtaggtggtgcgataaaagtgtggaagatgactggtcgaaaccactaccaccatctgaacgcctcgagcaggaactcttcagcggaggaaatacaggcataaactttgagaagtatgatgatattccagtcgaggcgacagggtcaaattgtcccccgcacatagagaacttttccgacattgacatgggcgagattattatgggaaatatcgaattgacccgttacaccaggcctacccctgttcagaagcacgcaatcccaataatcaagggcaaacgcgatcttatggcgtgtgctcagacaggctccggaaaaacagccgctttcctcctgcctattctttcccaaatttatacggacggccccggtgaggctttaaaggctgtgaaagagaatggaaggtacggccgcagaaaacaatacccaatatcattagtcttggcccctacccgggagctcgccgtgcaaatttatgaagaagcgcgtaagttcagctataggagcagggtgaggccatgcgtggtgtatgggggagctgatatcgggcaacaaattagggaccttgaaaggggatgccatttgctcgttgccacccccggacgcttggtggatatgatggagaggggcaaaattgggttggatttctgcaaatacctggtactggacgaagcggacagaatgctcgatatgggctttgagcctcagatcagacggattgtagagcaggacacgatgcctccaaagggtgtgaggcataccatgatgttttcagccaccttccctaaagagatccagatgctcgcgcgcgactttttggatgaatatatctttcttgccgtgggcagagtgggcagtaccagcgagaatatcacgcagaaggttgtttgggttgaggatctcgataaaaggtcctttctcttggatatcctgggagcgaccggaagcgactcgctgacactggtgttcgtggagactaagaaaggggccgatagcctggaggactttctctatcacgagggatatgcatgtacatcaatacatggcgatcggtcccagagggatcgcgaggaagccctgcatcagttcagaagcgggaaatcacccattcttgtggctaccgcagtcgcggctagaggactcgatattagcaatgtgcgccatgtcattaattttgacttgccatcagatatagaggagtacgttcataggatagggcgtaccggacgcgtgggaaacctcggtctagcaacatccttcttcaatgagaaaaacatgaacatcaccaaggacctgttggacctcctggttgaagctaaacaagaggtcccaagttggctagaaaacatggcatatgagcaccattacaaaggcggcagtcgcggccgaagtaagtcaaatcgattcagcggggggttcggagcccgtgattaccgacaatccagcggcagctcgagtagcggttttggtgcgtcccggggcagctcgtctagatctggaggaggcggctatgggaacagcagaggattcgggggtggcggatacggcggattctataattctgatggctatggtggaaattataacagtcagggggtggactggtggggtaattag

SEQ ID NO: 113942 - DNA, 753 bp, Artificial Sequence
  Description of Artificial Sequence: Synthetic coding sequence
atggagatcggtcgcccgcggaaggatacttggaagctcgcgaacctggacttgaatagtgaaaagcagtccggtggtgcttccaccgctagtaagggtcgctacatcccgccgcatctgcgtaaccgggaagcctctaaaggcttccatgacaaggattctagcgggtggagttgtagcaaggataaggacgcatattcatcctttggttccagagattcccgcggaaagcccggctacttcagcgagagagggagtggaagccgcggccgcttcgatgaccgtgggcgcagcgattacgacgggattggcaaccgcgagcgccccggctttggcagatttgagagatcaggacacagccgctggtgtgataaatctgttgaagacgattggtcaaagccactcccacccagcgaacggctcgagcaggagctcttttctggaggcaatacaggcatcaacttcgagaaatacgacgatatcccagtcgaagctactgggtcaaattgcccaccacacatagagaatttctccgatatcgatatgggagagatcattatgggtaatatagaactgacccgctacactaggcctacaccagtgcagaagcacgccatccccattattaagggcaagagagatttaatggcatgtgcacaaaccggcagcgggaagacggcagcctttctcctccctatcttaagtcagatctataccgacgggccaggagaggccctcaaggcagtgaaatag

SEQ ID NO: 113943 - DNA, 675 bp, Artificial Sequence
  Description of Artificial Sequence: Synthetic coding sequence
atgagccacgtggtggtgaagaatgaccctgagctcgaccaacagttggccaacctggatcttaattctgagaagcagagcggcggggccagtaccgcctcaaaaggtaggtacatacctccgcatttacgaaatagagaagcctctaagggctttcatgacaaagatagcagcggctggtcttgctctaaggacaaggatgcttactctagctttggctccagggatagtcggggcaaaccaggttacttttccgagaggggctcaggctcgagggggcgattcgacgaccgtggcaggtccgactatgatgggataggaaatcgagagaggcccggattcggcagattcgaaagaagtggacactctaggtggtgcgacaagtcagtcgaagacgactggagcaagcccctgcccccaagcgagcggttggagcaagagttattctccggtgggaacactggtataaacttcgagaagtacgacgatatacccgtggaagccactgggtccaactgtcctcctcacattgaaaatttttccgacatagatatgggagaaatcattatgggtaatattgagttgaccagatacaccaggccaacgcctgtccagaagcacgctatccccatcatcaaaggcaaaagggatctcatggcttgtgcgcagacttag

SEQ ID NO: 113944 - DNA, 1974 bp, Artificial Sequence
  Description of Artificial Sequence: Synthetic coding sequence
atggagatagggaggccacgcaaagatacatggaaacttgctaacctggatctgaatagtgagaagcagagtggcggggcaagcaccgctagtaaggggcgatacatccctccacatctccggaacagagaggcctcaaaggggttccatgacaaagattcttccggctggtcatgtagtaaggacaaagacgcttactcaagctttgggtcaagggacagcagagggaaacccggttacttcagtgagagggggagcgggtctcgcggccggttcgatgacagaggccgttccgattacgatggtataggcaacagggagcggcctggatttggccgatttgagcgcagtggccacagtcgatggtgcgacaagagcgtcgaagacgactggagcaaaccgctacccccttccgagcggctcgaacaggaattattctcaggtggaaatacagggattaattttgagaaatatgatgacataccggtggaggcaactgggagcaactgcccccctcacatagaaaacttctcggatattgatatgggggaaataattatggggaacatagagcttaccagatacacccgtcctactcccgtgcagaagcacgcaatcccaataatcaagggaaagagggatctgatggcatgcgctcagacgggcagtgggaagaccgccgccttcctactgcctatcctgtcccagatctatacggatgggcccggcgaagccctgaaagccgtgaaggaaaatgggcgttatggacgcagaaagcaataccccataagtcttgtcctcgcccccacaagggagctggctgtacaaatttacgaggaagcgcggaagttttcttacaggagtcgtgtacgcccttgtgtggtctatggtggtgccgatattggccagcaaatccgtgatctcgaacggggatgccatctgctggtggcaacgccaggacgtctcgttgatatgatggagcggggtaagatcgggcttgatttctgtaagtatctggtactggacgaggctgaccggatgctcgacatgggctttgagcctcagataaggcgcatcgtggaacaagacacaatgccccctaagggggtgcgtcataccatgatgttttctgctacatttccgaaggagattcagatgcttgccagagatttccttgacgagtacatcttcctggcagtgggacgggtgggatccacaagtgaaaacataacacagaaagttgtgtgggtggaggacctggacaaacggagctttctgcttgacatccttggggctaccgggagcgactcactaacgcttgtgtttgtggaaacaaagaagggcgccgatagcttagaagatttcctctatcacgaaggttacgcctgtacaagcatccacggagataggagtcagcgagatcgagaggaggccctgcatcagttccgttcaggcaagtcgcctattctcgtggccacggctgtggctgcgcgcggcctggacatcagcaatgtccgtcatgtgatcaactttgatctcccctcggacatcgaagagtacgtccatcggatcggccgcaccggccgagtcggcaacctcggcctggccacgtcatttttcaatgagaagaacatgaacatcaccaaggacctcctagacctcttagtcgaagctaaacaggaagtcccatcatggttggagaatatggcctacgagcaccactacaagggaggctctagagggcgaagtaaaagcaaccgtttctccgggggtttcggagccagagactatcggcagtcctctggatcatcttccagcgggttcggcgcatctcgcgggtcctctagccggtcaggcggcgggggttatggaaatagccgtggcttcggtggagggggctatggaggcttctataattcagacgggtatggtggaaactacaattcacagggggtggactggtggggtaattag

SEQ ID NO: 113945 - DNA, 1278 bp, Artificial Sequence
  Description of Artificial Sequence: Synthetic coding sequence
atggccgaaaatgacgttgacaacgagctcttggactatgaagacgacgaagtggaaactgctgctgggggggacggagccgaggctcctgccaaaaaggacgtgaaaggcagttacgtcagtattcactccagcggatttcgcgatttcctcctgaaacctgagttgcttcgtgcaatagttgactgtgggttcgaacatccatccgaagtccagcacgagtgtattcctcaggcaatcctgggcatggatgtgctgtgccaggccaaatcaggaatgggcaaaacagcggttttcgtactggctacgctccagcagcttgaacccgttactggccaggtaagcgttctcgtgatgtgtcacacaagagagctcgcttttcaaatcagcaaagaatatgagaggttcagcaaatacatgcccaatgtgaaggttgcggtcttctttggagggctcagcattaagaaggatgaggaggtcctgaaaaagaactgtcctcacattgtggtgggcacccctggtaggattcttgcacttgccagaaataagagtctcaacctgaagcatatcaaacactttatccttgacgagtgcgacaagatgttagagcagctggatatgagaagagacgttcaggaaatattccgtatgaccccgcatgaaaagcaggtgatgatgttcagcgctaccctctctaaggaaatcagacccgtctgcaggaaattcatgcaagaccctatggaaatttttgtggacgacgagaccaaacttaccctgcatggcctgcaacagtattacgtgaagcttaaggacaacgaaaagaacaggaaactgtttgacctcctggatgtgctggagttcaatcaggtggtgatcttcgtaaagtctgtgcagcgttgtatcgcattggcccagctcctggttgaacaaaattttcctgccatagctatccaccgcggcatgccccaagaggaaagactgtctcggtatcagcaattcaaagactttcagcgcaggatactggtggccactaacttatttggaaggggcatggacatcgagcgagtcaatatagcattcaactatgacatgcccgaggattccgatacctacttacaccgctgttatccactcagcccgtcgcggtggccagaacaggcgggcctcgccccccgagcatggctgtcacacctatgcccaatgcggatgatgccccgatcatctatgatgtgtcgcatcgcactgaggagcatcctggtgtcatgcttaatgcgatag

SEQ ID NO: 113946 - DNA, 1287 bp, Artificial Sequence
  Description of Artificial Sequence: Synthetic coding sequence
atggccgaaaacgacgtcgacaacgagttgcttgattacgaagacgacgaggtggaaacagcagctggcggagatggagctgaagcaccagccaaaaaggatgtgaaaggctcgtatgttagcattcatagtagcgggttccgcgactttcttttaaagcctgagctgctgagggctattgtggactgcggtttcgaacacccttctgaagtgcagcacgagtgtattccacaggctatcctgggtatggacgtgctctgtcaagcaaaatccggcatggggaaaactgccgtgtttgtcctggcaacacttcagcagcttgagccagtgacaggccaggtctccgttctggttatgtgccatacccgggagctagcattccaaatatctaaagagtacgagcgctttagcaagtacatgccaaacgtcaaagttgcggtcttcttcggcggcttgagtatcaagaaggatgaggaagtgctaaagaaaaactgtccacatatagtggtgggcactcccggacggatattggccctggcgagaaataaatctctgaacttgaaacacattaagcacttcatcctggacgaatgcgataagatgctcgaacaattggacatgcgacgggacgtgcaagaaatcttccggatgactccccacgagaagcaggtgatgatgttttctgcaacgctgtctaaagagatccgtcctgtatgcagaaaattcatgcaggatcccatggaaatctttgtggacgatgagaccaagctgactctgcacggccttcagcagtactatgttaagcttaaagataacgagaaaaatcgcaagctgttcgacctcctggacgtcttggaattcaatcaggttgtgatctttgtcaagtccgtccagagatgtatagcactcgcccagttattggtggaacagaactttcctgcaatagctatccatcggggcatgcctcaagaggagaggctatcccggtatcagcagtttaaggacttccagaggcggatcttagtcgctaccaacctgttcggccgcggcatggacattgagagggtcaatatcgcatttaactacgatatgccggaagactcagatacctacctgcacagagtggcacgggcaggacggttcggcacgaaaggactagcgatcacttttgtctccgacgaaaatgatgccaaaatattaaatgatgtgcaggacagatttgaagtgaatatttccgagctgccagatgaaatcgacatcagttcctacattgaacagacacgatag

SEQ ID NO: 113947 - DNA, 1287 bp, Artificial Sequence
  Description of Artificial Sequence: Synthetic coding sequence
atggctgagaacgatgtggacaatgagctcctggattacgaggacgacgaagtggagaccgcagccgggggtgacggggcggaggctcccgcaaagaaggatgtgaagggcagctacgtgagcatacacagctcaggtttcagagacttcctgctgaagcccgaactcctccgtgccatcgtcgattgcggcttcgaacacccctccgaagtccagcacgagtgcattccccaggctatcctgggcatggatgtgctgtgtcaggccaagtctggaatgggtaaaactgcagtgttcgtactggccaccctgcagcaactggagcctgtaactggacaggtgtccgttcttgtcatgtgccacacccgagagctggccttccaaatctctaaagagtacgagcggttcagcaaatacatgcccaatgttaaggtagcagtgttcttcggcgggctgagtattaagaaggacgaggaggttctcaaaaagaattgccctcatatcgtcgtggggacacctggccgaattctggccctcgcgaggaacaaatcactgaacttaaaacatattaaacattttattttggatgagtgtgataagatgttggagcagctcgatatgcgacgtgacgtacaggagatctttcgcatgactcctcacgagaagcaggtcatgatgtttagcgccacactgtccaaagaaattcggcctgtctgccgaaagttcatgcaggacccaatggaaatttttgtagacgacgagacaaagctcaccctgcatggtcttcagcagtactatgtcaaattaaaagataacgaaaagaaccgcaagctgttcgacctgttagatgtgctggagttcaaccaggtcgtgatatttgttaaatccgtgcagcgatgtattgctctggcccagctgctcgtggaacagaattttcccgcaattgcgattcacagagggatgccccaggaagaacggctatcccgatatcagcagtttaaagatttccagcgccggatcctggtcgccacaaacctattcggtagggggatggatattgaaagagtgaacatcgcttttaattatgacatgccagaggacagtgatacatacctccaccgagtcgcaagggccggaagattcggtacaaagggtcttgctatcacctttgtttctgatgagaatgatgctaaaatcctgaacgacgtgcaggaccgcttcgaagtcaacattagtgagctgccagacgaaatagatatctcatcgtatatcgaacaaacccgctag

SEQ ID NO: 113948 - DNA, 1278 bp, Artificial Sequence
  Description of Artificial Sequence: Synthetic coding sequence
atggcggagaacgacgtcgacaatgaactgttagactatgaggacgatgaggtagagactgctgcaggaggggatggggctgaggctccggcaaaaaaggacgttaaggggtcatatgtgtccatccacagcagcggttttagggacttcttgcttaaacctgagcttttgcgcgccattgtcgactgtggattcgagcacccatccgaagtacagcatgaatgtatccctcaggccatactgggcatggatgtgctgtgccaggctaagtccggaatgggaaaaacggcagtgttcgtacttgccactctgcaacagctggaacccgtgacagggcaagtgagtgtactggtcatgtgccatacaagagagcttgcctttcagatctctaaggagtacgagaggttttccaaatacatgcctaacgtgaaggtggccgtattcttcggtggattaagcatcaagaaggacgaggaagttttgaaaaagaattgtcctcacatcgtagtagggactcctggtcgcatcctcgccttggctaggaataagtccctgaatttgaagcatatcaagcacttcattttggacgaatgcgataaaatgttggaacagttagacatgcgcagagacgtgcaagagattttccgcatgaccccccatgagaaacaggtgatgatgttttctgcaaccctgtccaaggaaattcgcccggtgtgtcgcaagttcatgcaggatcctatggaaatttttgtggatgacgagacaaagctgaccctacatggtctgcagcaatattacgtgaagctgaaagataacgagaaaaatagaaagcttttcgatctgcttgacgtactggagtttaaccaggtggtgattttcgtgaaatccgtacagcgttgcattgccctagcccagctactggtagaacagaattttccagctatcgcaatccacagagggatgcctcaagaggagcgcctgtcccgctaccaacaattcaaagactttcagcgcaggattctggttgctaccaacctgttcggccgggggatggatatagaaagagtcaatattgctttcaactatgatatgccagaagatagtgacacctatctgcaccgctgctaccctctgagtccatcacgttggccggagcaggcaggtctggcccctcgcgcgtggctatctcatctctgtcctatgcggatgatgcccaggagttccatgatgtgccgcattgcccttaggtccatcctggtatcctgtctcatgagatag

SEQ ID NO: 113949 - DNA, 1287 bp, Artificial Sequence
  Description of Artificial Sequence: Synthetic coding sequence
atggcagagaacgacgtcgacaatgagctgctggactacgaggacgatgaggtcgagacagccgccggtggagatggagcagaggcaccagcaaagaaagacgtgaagggctcatacgtctccatacattcctcgggctttagagacttcctattaaagcccgaattactgcgggcgatcgtggattgtggctttgaacatcctagcgaggtgcagcatgaatgtatccctcaggcaatacttgggatggatgtgctctgtcaggcgaaatcaggaatgggaaagacagcagtattcgtcctggcaaccctacagcagctcgagcccgtgaccgggcaggtgtccgtcttggtgatgtgtcacacccgtgagctggcgttccagattagcaaagaatatgagcgcttttctaagtacatgcctaatgtaaaagtggctgttttttttggtggcctttcaatcaaaaaagacgaagaagtgctgaaaaagaattgcccacacatcgtagtggggaccccaggacggatcctcgctctggctcggaacaagagtctgaatcttaaacacatcaagcatttcattctagacgagtgtgacaagatgctcgaacaattggacatgcgcagggatgtgcaggaaatctttagaatgacaccacatgagaaacaggtaatgatgttttccgccacactgagcaaagaaataaggccagtctgccgcaagtttatgcaggaccccatggaaatcttcgttgacgatgagaccaaactgactttgcacgggctccagcagtattacgtcaaattgaaggataatgaaaaaaacagaaaactctttgatctcctggacgtcctcgaattcaatcaggtagttatctttgtcaagagcgttcagcggtgcattgcactggcacagttattagttgagcaaaactttcctgccatcgccatccatcgggggatgccacaggaggagagactctctcggtatcaacagtttaaggattttcaacgaagaatactcgtggccaccaatcttttcggccggggaatggatatcgaaagagttaacatagcgtttaactacgacatgcctgaagactctgatacttacttgcatcgtgttgccagggccggaaggttcgggacaaagggcctggctattacattcgtgtccgacgagaacgatgccaaaattttaaacgacgtgcaggacagattcgaggtcaacatcagcgagctgccagatgagatcgacatctcatcctacattgaacagactcgatag

SEQ ID NO: 113950 - DNA, 1287 bp, Artificial Sequence
  Description of Artificial Sequence: Synthetic coding sequence
atggcagagaacgacgtcgataacgagcttctcgactacgaggacgacgaggtggaaaccgccgccggcggtgacggtgctgaagccccagctaagaaagatgtgaagggttcctatgtttccatacattcttccggcttcagagatttcctgcttaagcctgaactgctgagggcaattgtcgattgcgggttcgagcacccatccgaggtccagcacgagtgcatcccacaggccattttaggcatggatgttctttgccaggcaaagtccgggatgggaaagactgcggtgttcgtcctggccactcttcagcagctcgaacccgtgactggtcaggtatctgtgctcgtgatgtgccacacacgggagctggcctttcagatctcaaaagagtatgagcgcttcagtaaatacatgccgaacgttaaggtggccgttttcttcggcggtctgtccattaaaaaggacgaagaagtcttgaagaaaaactgtccccacattgtggttggcacacctggtcgtattctggccctggctaggaacaagagtctcaacctgaaacacatcaagcatttcatcttggatgagtgtgacaaaatgctggaacaactcgatatgcgccgcgacgtgcaggagatatttcgtatgacgcctcacgaaaagcaggtaatgatgttctccgcgacattgtccaaagaaattcgcccagtgtgtaggaagttcatgcaggaccccatggaaattttcgtagacgacgagaccaaactgacccttcatggacttcaacagtactatgtgaaactgaaagataatgagaagaaccggaaactttttgacctgttggatgtcctcgagtttaaccaggtcgtaatcttcgtgaaatcagtgcaaagatgcatcgcactggcccaactgttggtggagcagaacttccctgcgattgctatccatagaggaatgccacaggaggagcgtctgtccaggtatcagcaattcaaagattttcagaggagaatcctcgtagctaccaatctgtttgggcgcggaatggacattgagagagtcaacattgcgtttaattacgacatgcctgaggattccgacacatacttacacagggtggccagggcaggacgtttcgggacaaagggcttggctatcacattcgtctctgatgagaacgatgcaaaaattttgaatgatgtccaggatcgattcgaggtgaacatctcggagctcccggatgagattgacatcagctcctacatagagcagactcggtag

SEQ ID NO: 113951 - DNA, 564 bp, Artificial Sequence
  Description of Artificial Sequence: Synthetic coding sequence
atgggcagctctcatatcggagggctcagtataaatgaacgacgatgctcagcgagcttgggcctggttatggccgaaaacgatgtagacaacgagctgttagattacgaagacgatgaggtcgagaccgcagcaggaggcgatggtgcagaagcacctgccaaaaaagacgttaaggggagctatgtgagtattcactcttcgggctttagggacttccttctcaaacctgagttgttgcgcgcgatcgtggattgcggatttgaacatccttctgaagtccagcacgaatgcatcccgcaagcaatactgggcatggatgtcctatgtcaggcgaaatccggaatgggaaagacagccgtgttcgtcctggccaccttacaacaactggaaccagtgacagggcaggtgtctgtcctagttatgtgtcatactagagagctggcctttcagatctcaaaagaatatgagaggttctctaagtacatgcccaatgtcaaggtcgcagtgttcttcggtggccttagcattaaaaaggatgaagaggttctgaaaaagaattag

SEQ ID NO: 113952 - DNA, 1287 bp, Artificial Sequence
  Description of Artificial Sequence: Synthetic coding sequence
atggcggagaatgatgttgataatgagctgctcgattacgaagacgatgaagtcgagacggcagcaggaggagatggcgcagaagcaccagccaaaaaggacgtgaagggcagctacgtgagtatccattcttcaggattcagagacttcctcctgaagccagaacttttacgagcaatagtggattgcggctttgaacaccccagcgaggttcaacacgagtgcataccccaggccatcttggggatggacgtcctgtgccaagcaaagtctgggatgggaaagactgcagtgtttgtgctcgccacactgcaacaactggagcccgttaccggccaagtctccgtgctggttatgtgtcacaccagggaactcgctttccagatatccaaggaatacgaacggttcagcaaatacatgcctaatgtgaaggttgctgtcttctttggtgggctcagcatcaagaaggacgaagaagtgttaaaaaagaactgtcctcatattgtcgtaggcacgcctgggcgcatccttgccctcgcccgcaataagagcctcaatctgaaacacatcaaacacttcatcctggatgagtgcgacaagatgctagagcaactggacatgaggcgagatgtgcaagagatcttcagaatgacgccccatgaaaaacaggttatgatgttttccgccaccctgtctaaggagattagacccgtctgccggaagttcatgcaagatccaatggagatatttgtggatgatgagacaaagctgaccctgcacgggctacagcaatattacgtgaagctgaaggataacgagaaaaatcgcaagcttttcgatttgctcgacgtgcttgagttcaaccaagtggtgattttcgtgaagagcgtgcagaggtgcattgctctagctcagctgctggtcgaacagaattttcctgcaatcgcaatccatcgggggatgcctcaggaagaaagattgagccgataccagcagtttaaggacttccagcgaaggatcctagttgccaccaacctgttcggacgtgggatggacattgaacgggttaatatagctttcaactatgacatgccagaggatagtgatacctacttgcatcgcgtggctcgggcagggcgcttcggtaccaagggtctggcgataacattcgtgtctgacgaaaacgatgcgaagatcctcaatgacgtacaggacagatttgaggtgaatatttccgaattgcccgatgagatagacatcagcagttacatcgaacaaactcggtag

SEQ ID NO: 113953 - DNA, 378 bp, Artificial Sequence
  Description of Artificial Sequence: Synthetic coding sequence
atggccgaaaacgacgtcgataacgagctgctggactacgaggatgacgaggtcgaaacagccgccggcggtgacggagcggaggcccccgcgaagaaggatgtgaagggtagctacgtcagcattcattcctccggatttagagacttcctactgaagccagaactgctgcgcgctatcgtggattgtggttttgagcacccttctgaggtgcagcatgagtgtatacctcaggcgatactggggatggatgtgctttgccaagccaagtctgggatgggcaagaccgctgtattcgtactggccacgctgcaacagttggagcctgttaccggacaggtgagtgtgcttgtcatgtgtcatacacgggagctgtag

SEQ ID NO: 113954 - DNA, 1287 bp, Artificial Sequence
  Description of Artificial Sequence: Synthetic coding sequence
atggcagaaaacgatgtggataacgagctgctggactatgaagatgatgaagtggagacagccgctggaggcgacggggctgaggctccggccaaaaaagacgtgaaaggctcctacgtgtccatccactccagcgggttcagagatttccttctcaaaccggaactactgcgggcaattgtcgactgtggcttcgaacacccatccgaggtccagcatgagtgcattccgcaagccatcttaggaatggatgtgttgtgccaagccaagagcggaatgggaaaaacggcagtgtttgtgcttgccaccctccagcagctagagcccgtgaccggtcaggttagtgtcctggtcatgtgccacacccgcgagctcgcatttcagatttccaaggagtacgagcgcttttctaagtatatgcccaacgtaaaggttgcagtgttttttggaggcctgagcatcaaaaaagatgaagaagtgctaaaaaagaattgcccgcacatagtagtgggtacccccggacggattctggcattagcccggaacaaaagtctgaatttaaagcatatcaaacacttcatcctggatgaatgcgataaaatgctggagcagcttgatatgcgccgcgacgtgcaggaaattttccgcatgaccccgcatgagaaacaggtgatgatgttttccgccaccctgtctaaggaaatcaggcccgtctgcaggaagttcatgcaagacccgatggagattttcgtggacgacgagaccaaattgaccctgcacggtctccagcagtattacgtcaagctgaaggacaacgagaaaaatcgcaaactctttgatctgctcgacgtactggaattcaatcaggtggtgattttcgtcaagtctgtccaaagatgtatagcactcgcccagctgctcgtggaacaaaacttccctgcaattgctatccatcggggaatgccgcaggaagaaaggctgagtcgctaccagcagttcaaagatttccagcgcaggatcttggtggcaacgaatctgttcggccggggaatggatatagaaagggttaacatcgcgtttaactacgatatgcccgaagattctgacacatatctacaccgagtagccagggctggccgtttcggcactaaagggcttgccattaccttcgtaagcgacgaaaatgacgccaaaatcttgaacgatgttcaagatcggttcgaggtcaacatttcggagctaccagacgagatcgacatcagttcgtacatcgagcaaacacgctag

SEQ ID NO: 113955 - DNA, 564 bp, Artificial Sequence
  Description of Artificial Sequence: Synthetic coding sequence
tgatctgaggagcgggatatcgggaagcccatggaaatcttcgtggatgacgaaactaagttgactctgcatggccttcagcagtactacgtgaagctgaaggataatgaaaaaaaccgtaagctgttcgacctcctcgacgtgcttgagttcaaccaggtagtgatctttgttaagtctgtgcaacgttgcatagcattggctcagctcctcgtggaacaaaatttccccgccatagccatccatcggggtatgccacaggaagaacgactgtcccggtaccagcagttcaaagattttcagcgacgcatcctggttgcgaccaacctttttggtcgaggcatggacatcgaaagagttaacattgcattcaactatgacatgccggaagattctgacacctatctgcaccgggtggccagggccggccgctttggaacaaagggactggcaataacattcgtgtccgacgaaaatgacgccaagatacttaacgacgtacaggatcgcttcgaagtcaacatttcggaattgcccgatgagatcgacatcagcagctattag

SEQ ID NO: 113956 - DNA, 378 bp, Artificial Sequence
  Description of Artificial Sequence: Synthetic coding sequence
atggccgaaaatgacgtggacaatgagttactggactacgaggacgacgaagtggaaacagctgctggcggagacggcgccgaagcgcccgcaaagaaggacgtgaaagggtcatatgtctctattcattccagcgggttccgggattttctgttaaaaccagagctgttgagagccattgtggactgtggcttcgagcatccctccgaagttcaacatgagtgcattccccaggctatccttggaatggatgtcctctgtcaggcgaagagcgggatgggcaaaacggcggtctttgtgctggccaccctgcagcagcttgagccagtgacaggtcaggtctccgtacttgtgatgtgccacacacgggaactttag

SEQ ID NO: 113957 - DNA, 1287 bp, Artificial Sequence
  Description of Artificial Sequence: Synthetic coding sequence
atggcagaaaatgatgtcgacaatgaattgctggactatgaggacgatgaggtcgaaacagccgccggaggcgatggtgccgaagcccccgccaaaaaggatgtcaaagggagttatgtcagtatacactcgtctggcttccgggacttcctgctgaagccagaattattgagggccatcgtggattgtgggttcgagcatccttcagaggtgcagcacgagtgcattcctcaagcaattttgggcatggacgtattatgtcaagccaaaagtgggatgggaaaaacagcagtcttcgtcctcgcaacactccaacaattagagcccgtgaccgggcaagtctcggtgcttgtcatgtgtcacacccgcgagctggccttccagatatcgaaggaatatgagcgtttcagcaagtatatgccaaatgtgaaagtggcagttttctttggcgggctatccataaaaaaggacgaggaggtactcaagaagaattgcccccatatcgtggtgggaaccccagggaggattttggctctggcacggaataagtcactgaacctgaaacatataaagcacttcattctggacgaatgcgataagatgcttgagcaactagatatgcgccgggacgttcaggagatctttcggatgacccctcacgagaaacaggtgatgatgttctcagccaccctttctaaagaaattcgcccggtgtgtagaaagtttatgcaggaccctatggagatcttcgtcgatgatgaaaccaagctgactcttcatgggctgcagcagtattacgttaagctcaaggataatgagaagaaccggaaactcttcgacctcttggatgtgctggagttcaaccaggttgtgatttttgtgaaaagcgtccaaaggtgtatagcgctggcgcagttgctcgtcgagcagaacttcccggctatagccatacatagaggaatgccgcaggaggagaggctctcacggtaccaacagttcaaagacttccagaggcgcatcttggtggcaacaaatctcttcggcaggggcatggacatagaaagagtgaacatagcttttaactacgatatgccagaggacagcgacacttacttgcatcgggtcgcgagagccggccggtttggaacgaaaggcctagcaattaccttcgtgtctgacgagaacgacgctaaaatcctgaacgacgttcaggataggtttgaagtgaacatttccgagctaccggacgaaatcgacatttcaagttatattgaacagactagatag

SEQ ID NO: 113958 - DNA, 870 bp, Artificial Sequence
  Description of Artificial Sequence: Synthetic coding sequence
atggctgagaacgatgtcgacaacgagctattggattacgaagacgacgaagtggaaactgccgctggcggagacggagctgaggccccagctaagaaggatgtgaaggggagctacgtcagcatccatagctcaggctttagagattttctgctgaaacccgaattactgcgcgcaatcgtggattgcggttttgaacacccctctgaggttcagcacgaatgtattcctcaggcaattttaggcatggatgtactgtgccaggccaagtctggtatgggcaagacagccgtgtttgtgctcgccactctgcagcagctggagccggttaccggccaggtgtcggttttagtgatgtgccacacgcgggagttagcttttcagatctctaaggaatatgagagattctctaagtatatgcctaatgtaaaggtagcggtcttttttggtggactttcgattaaaaaggacgaggaagtgctcaagaagaactgtccacatatagttgtggggactcccggtaggatactggccctggctagaaataaatctctgaatctgaagcacattaaacatttcattctggatgagtgtgataagatgcttgaacagctggacatgcgaagagacgtccaggagatattccggatgacgccccacgagaagcaggtcatgatgtttagtgctaccctgtctaaggaaattcggccggtgtgccgcaagtttatgcaggacccaatggagatcttcgtggacgacgagaccaaactgacactccatgggttacagcagtactacgtgaaactgaaagataacgaaaaaaaccgcaaactgttcgatcttcttgacgtgctcgaattcaatcagtag

SEQ ID NO: 113959 - DNA, 1287 bp, Artificial Sequence
  Description of Artificial Sequence: Synthetic coding sequence
atggcagaaaacgatgttgataacgagctgctggactatgaggatgatgaggtggaaacagcggccggtggggacggtgcagaggcacccgccaaaaaagatgtgaaagggagttatgttagcatccatagcagcgggtttagagattttctgctgaagccagagctactgcgtgctatcgtggattgtggctttgaacacccttcagaagtgcagcatgaatgcatccctcaggcgatacttgggatggacgttctttgccaggctaaatcaggaatgggtaaaaccgccgtgtttgtcctggccaccttgcagcagctcgagccagtgactggccaggtgagcgtacttgtcatgtgccacacacgcgagcttgccttccaaatcagcaaagaatatgaacgcttctccaaatatatgccaaacgtcaaggtggccgtgttctttggcggcttaagcataaaaaaagacgaagaagtcctgaaaaaaaactgcccccacatcgtggtggggactccaggccgcattttggctttggcccgcaacaagtctctaaaccttaagcacattaagcacttcattcttgacgagtgcgataaaatgttggaacaactggatatgaggagagacgtgcaggaaatctttagaatgaccccacacgagaaacaggtgatgatgttcagtgcaaccctctccaaagagatccgccccgtgtgtagaaaatttatgcaggatcccatggaaatcttcgtcgatgatgaaaccaagctgacacttcatggcctgcagcagtactatgtgaagttaaaagacaatgagaagaacagaaagctgtttgacctgttggatgtgcttgagttcaaccaggtggttatcttcgtcaagtccgtgcagcggtgtattgctctggcacaactgctggttgaacagaattttcctgcgatagctatacatcgggggatgccgcaggaagaaagattgagtcggtaccagcaattcaaggattttcagcggcgcattctggtggcaaccaacctttttggccgaggcatggacattgagagggtcaatatcgcttttaactatgacatgccagaggactcagatacgtacctccaccgagtggcacgcgctggacggttcggaacaaagggccttgccataacatttgtctcagacgaaaatgatgctaaaatccttaacgatgtgcaagacagattcgaggtgaatatcagtgaacttcccgatgaaatcgacatttctagctatattgaacagacccgatag

SEQ ID NO: 113960 - DNA, 291 bp, Artificial Sequence
  Description of Artificial Sequence: Synthetic coding sequence
atggccgagaacgatgtcgacaacgagctcctggattacgaggacgacgaagttgagacagctgctggcggtgatggcgctgaggcgcctgccaagaaagacgttaaaggctcctatgttagtattcatagctctggattccgcgatttcctgcttaagcctgaacttttgagagctattgttgattgtgggttcgaacatccaagcgaagtgcaacacgaatgcatcccccaggccatcctgggaatggacgtgctgtgtcaggccaagagtggtatggggaagacctag

SEQ ID NO: 113961 - DNA, 378 bp, Artificial Sequence
  Description of Artificial Sequence: Synthetic coding sequence
atggctgaaaatgacgttgacaacgagctgctggattacgaggacgacgaggttgagactgctgccggcggagatggcgccgaggcaccggctaagaaggatgtcaaaggctcttacgtgtctatacactcgtcagggttccgcgatttcctgcttaaacccgagctcctcagagcaatcgtggactgtggatttgagcatcccagtgaggtgcaacacgaatgcataccccaggcaattctgggtatggatgtgctgtgccaggccaaatccggaatgggcaaaaccgcagttttcgtgctcgccacactgcagcagctcgagcctgtgaccggccaggttagcgtgctagtcatgtgtcacacaagggaactgtag

SEQ ID NO: 113962 - DNA, 696 bp, Artificial Sequence
  Description of Artificial Sequence: Synthetic coding sequence
atggctgaaaatgacgtagacaacgagcttctggactatgaggacgacgaggtcgagaccgcagccgggggtgatggggcggaggcaccagccaagaaggatgttaaggggagctatgtgtcaatccactcctcggggtttcgagactttctcttgaaaccggagctgttgcgggctatagtggattgtggcttcgaacatccaagcgaggtgcaacatgagtgcattcctcaagcaatacttgggatggacgtgctgtgtcaggcgaaatctgggatgggtaagacggcagtgttcgttcttgctacactgcagcagcttgaaccagtcaccggccaggtttccgttcttgtgatgtgtcatacgcgcgagcttgccttccagatcagcaaagaatatgagcgcttcagtaagtacatgccaaacgtgaaggttgccgtgttctttggagggctatccatcaaaaaagatgaagaagtactcaagaagaattgcccacacatcgtggtcggcacgcccggaagaatcctggctctggcaaggaataagtcactgaatctgaagcacattaagcactttatcctggatgagtgcgacaaaatgctcgagcagttagatatgcggagggatgtgcaagaaattttccgtatgaccccgcacgaaaaacaagttatgatgttttcagcaacactgtag

SEQ ID NO: 113963 - DNA, 399 bp, Artificial Sequence
  Description of Artificial Sequence: Synthetic coding sequence
atggcggagaacgacgtggataacgagctattagactacgaggacgatgaggtggagactgccgctggcggggacggagctgaggcacccgcaaagaaggacgtcaaagggtcttatgtctctattcactcttccggctttcgagatttcctgctgaagccagagctcctccgcgctatagttgattgtggctttgagcatcctagtgaagtgcaacacgagtgtataccgcaggccatcctgggaatggatgtactgtgccaggcaaagagcgggatgggcaaaactgccgtgtttgtgctggccactctgcagcagctggagccagtcaccgggcaggtttgcttttgtgactcccactttccaaggggcgataacgaggagctgcatttgccctag

SEQ ID NO: 113964 - DNA, 1053 bp, Artificial Sequence
  Description of Artificial Sequence: Synthetic coding sequence
atgtggacaatgtcttcgtggactatgaaaatgatgcgttggcgacagcaacttggggagatgggcctacggcccctcccgcggaggatgtctcgtgcaccaatgtctccctccacagccctggcgttcgtgacctcttgtagctctcaatcatgctccggtcccctctcaaccgttgccctgtctatccgacaaaaggtggccgtgttcttcggtggccttagtattaagaaagacgaggaagtgctcaagaagaattgtcctcacatagtggtggggacaccagggcgcattttggccctggctcgaaacaaatcattgaacttaaaacacataaagcattttatcttggatgagtgtgataaaatgcttgagcaattagacatgaggcgggacgtgcaagagattttccggatgactcctcatgagaagcaggtcatgatgttcagcgcaacactctccaaagagattaggcccgtttgtagaaaattcatgcaagatcctatggagatattcgttgacgatgagacaaagctgactcttcatggcttacagcagtactacgttaagctgaaggacaatgaaaagaaccggaaactatttgaccttcttgatgtactggaattcaatcaggtggtaattttcgtaaagtcagtgcaacgatgtatagccctggcacagctcttggtggaacagaacttccccgcaattgcgatacaccggggcatgccccaggaagagcgtcttagccgctaccagcaattcaaggattttcagaggcgcattcttgtcgctaccaaccttttcggaaggggtatggacattgagcgggtaaacatcgcttttaactacgatatgcccgaggactctgacacttatctgcaccgggtcgcaagagctgggaggttcggtactaagggcctcgctattactttcgtgtctgacgaaaacgatgctaagattctcaacgacgtccaggacagattcgaggttaacatatccgagctcccagacgaaatcgacattagcagctatatcgagcagactcggtag

SEQ ID NO: 113965 - DNA, 738 bp, Artificial Sequence
  Description of Artificial Sequence: Synthetic coding sequence
atgtggactatgagctcgtggaccatgaaaatgatgcgctggcgacagcaactgggagagatgggcctccggcccctcccgcgaaggatgtcccgtgcacctatgagtcccagtaccgccctggcttttgttacaagttgctctagccaatcttgtagcgggcccctgtctaccgttgcattatctatccgacagaaggtggcggtgtttttcggcggcctgtctattaaaaaagacgaagaggtattgaaaaagaactgcccgcatatcgttgtggggaccccagggcggatcctggcgctggccaggaacaagtctcttaatctgaaacatatcaagcatttcatattagacgagtgtgacaagatgctcgagcagctggacatgcgaagggacgtccaagagatcttccgcatgacacctcacgaaaagcaggtgatgatgttttccgcaaccctatccaaagagatccgacctgtctgtcgaaaattcatgcaggacccgatggaaatttttgtcgatgatgagacaaaactcacactacacgggctccaacagtactacgtcaagttgaaggataacgagaagaataggaagttattcgatttgcttgatgttctggaatttaatcaagtggtcatattcgtcaaaagcgttcaacgctgtatcgccctagctcagctgctggttgaacagaactttccggctatcgctattcatcgagggatgcctcaatag

SEQ ID NO: 113966 - DNA, 411 bp, Artificial Sequence
  Description of Artificial Sequence: Synthetic coding sequence
atgggtggtggtagacggccctatgacgttttcttctccaaggtgatggccgaaaatgatgtggataatgagctgttggactacgaggatgatgaagtggagacggcagcaggtggcgatggggctgaagcacctgccaaaaaggatgtgaagggtagttacgtgtcaatccattcctccggctttagagatttcctgcttaagcccgagttattacgcgcgatcgtggactgcggctttgagcatccttctgaggtccagcatgagtgtataccccaggccattctgggaatggacgtcttgtgtcaggccaagtccggaatggggaaaaccgctgtcttcgtcctcgccacgcttcagcagctggagcctgtgactggccaagtatctgtactcgtgatgtgccactag

SEQ ID NO: 113967 - DNA, 1287 bp, Artificial Sequence
  Description of Artificial Sequence: Synthetic coding sequence
atggccgagaacgatgtggataatgagctgctcgattacgaggacgacgaggtcgagaccgctgccggcggagatggggccgaagctcccgccaagaaagacgtgaaaggctcctatgtgagcattcatagtagtggcttccgggatttcctgctgaagcccgaactgctgagagcaattgtcgattgcggctttgagcatcccagcgaagtgcagcacgagtgtataccacaagcaatcctcggaatggacgttctgtgccaggctaagtcggggatgggaaagacagcagtattcgtactcgctacactgcagcagctggagccggtgacgggccaggtcagcgtgctggtgatgtgccatacccgtgaattggcatttcagatctccaaggagtacgagagattttccaagtacatgcctaacgttaaggtggccgtgttttttggaggccttagcattaagaaggatgaggaggtgttaaaaaagaattgccctcacattgtagtcgggacaccaggccgaattcttgcccttgcaagaaataagagtctcaacctgaagcacataaagcacttcatactcgacgaatgcgacaagatgctcgaacagctggatatgcgacgtgacgtccaggagattttccgcatgacaccccatgaaaagcaggtaatgatgttcagcgcaaccctctcaaaggaaattagaccagtttgccgcaaatttatgcaggatcccatggaaatcttcgtggatgacgagacaaaactcaccctgcatggcctgcaacaatactacgtcaagcttaaggacaatgagaaaaatcgaaaactgtttgacctgctggatgtactcgagtttaatcaggtcgtgatctttgtgaaaagcgtgcaaaggtgtattgccctggcccagctgctcgtggaacagaatttccctgcaattgctatccacaggggaatgccccaggaagagaggctgtccagataccagcaattcaaggatttccagaggaggatcctcgtggcgacgaacctcttcggcaggggtatggacatagagcgggtgaacatagcttttaactacgacatgcctgaagatagcgatacatacctccaccgcgtggccagagcagggagattcgggacaaaggggttagccatcacatttgtgtcagacgagaatgatgctaagatcctcaacgatgtgcaagatagatttgaggtcaacatttctgagctgcctgatgaaatcgatatctcttcctacatagagcaaacaaggtag

SEQ ID NO: 113968 - DNA, 594 bp, Artificial Sequence
  Description of Artificial Sequence: Synthetic coding sequence
atggcggagaatgacgtggacaatgaattgctggattatgaggatgatgaggtcgagactgcggccggtggggacggcgctgaagcccccgctaaaaaggatgtgaaagggtcctatgtgtccatccatagcagtgggttccgggactttttactcaagccagagttgctgcgcgcaattgtagattgtggttttgagcatcctagcgaagtgcagcacgagtgtataccccaagccattttgggaatggatgtgctgtgtcaggcaaaatctggaatgggaaagacggctgtgttcgtattggccactttgcaacagcttgagccggtgacaggccaagtttgcttttgcgactctcatttccccaggggcgataatgaggagctgcatctaccctatgtgagcgtgtactttctacccaaggtgagcgtactagtcatgtgtcacacccgcgagctcgcgtttcagatcagcaaagagtatgaacggttttcaaaatacatgcccaatgtgaaggtggccgttttcttcggcggcctgtctatcaaaaaggacgaagaagtcctgaaaaagaattgtccacacatcgtgtag

SEQ ID NO: 113969 - DNA, 570 bp, Artificial Sequence
  Description of Artificial Sequence: Synthetic coding sequence
taagccactcttcagcagctggagccagtcacgggtcaggtttctgtcctggtcatgtgtcatactagagaacttgcatttcagataagcaaagaatatgaacggtttagcaaatacatgccaaacgttaaggtcgccgtgttctttggtggtctgagcataaagaaagacgaagaggttctgaaaaaaaattgccctcacatcgttgtaggtacgccaggcaggattctggcgctggcacgcaacaaaagcctgaatctgaaacacatcaaacacttcatcctggacgaatgcgacaagatgctggagcagctggacatgcggagggacgtgcaggaaatatttcgcatgaccccacacgaaaagcaggtaatgatgttttcagccacactgagcaaggaaatccgccctgtgtgccgcaaattcatgcaagatccaatggaaatttttgtcgacgatgagaccaaactgaccctccacggcctgcagcagtactatgtgaagcttaaggataatgaaaagaataggaagctcttcgacctcttagatgtgctagagtttaaccagtag

SEQ ID NO: 113970 - DNA, 1287 bp, Artificial Sequence
  Description of Artificial Sequence: Synthetic coding sequence
atggctgaaaatgacgtggacaacgaactgcttgactacgaagacgacgaagtggagaccgccgcaggtggcgatggcgccgaggcgccagccaagaaagatgtaaaggggagctacgtgtcaatccattccagcggcttccgggatttcctcctgaaacctgagctgcttcgcgccatcgtggactgcggctttgagcacccttccgaagtacaacatgaatgcataccacaagctatcctggggatggacgtcctgtgccaggctaaatctggtatggggaagacagccgtgttcgtgctagcaaccctccaacagcttgaaccggtgaccggacaagtctctgttctcgttatgtgccatacgcgtgagctcgcctttcagatttccaaggagtacgaacgtttttctaaatatatgcccaatgtgaaagtggccgtgttcttcggcggcttgagtattaagaaggatgaagaggtactcaagaagaactgcccacatatcgtggtcggaaccccaggccggatcctcgccttagctcgcaacaaatcactcaatctcaagcacatcaaacattttatactggacgagtgtgacaagatgctcgagcagcttgatatgcgtagagacgttcaggagatcttccgcatgactccccatgagaagcaggtgatgatgtttagtgccacactgagtaaggaaatcaggcctgtgtgtcgtaagtttatgcaggaccctatggagatatttgtggacgatgagacaaagctgacactccacgggctccagcaatattacgtgaagctgaaggacaacgagaagaacaggaagctgtttgatctcctagacgtgctagaattcaaccaggtggtcatcttcgtaaagtcagtgcaaaggtgcatcgcactggcgcagttactagtggaacagaacttcccagccattgcaatccatcgcgggatgcctcaagaggaacgtctttcacgatatcaacagttcaaagattttcagcgccggatcttagtggctaccaacttattcggaagggggatggacatcgaaagagtgaacattgcattcaattacgatatgcccgaagactcggacacctacctgcatcgggtggcacgagctggcaggttcggcacgaagggcctggctatcacatttgtgtctgatgaaaacgacgccaagattttaaacgacgtgcaggacagattcgaagttaatatcagcgagctgcccgatgagatcgatatcagctcttacatagaacagacacgatag

SEQ ID NO: 113971 - DNA, 711 bp, Artificial Sequence
  Description of Artificial Sequence: Synthetic coding sequence
atggcagaaaatgacgtggataatgagctgttggattatgaggacgatgaagtggagacagccgcgggaggtgatggcgccgaagccccggccaaaaaagatgttaaggggtcttacgtctctatccactcttctggatttagagatttcctgcttaaaccggagttactgcgcgctattgtagattgtggatttgaacacccaagcgaggtccaacatgaatgtattccacaggccatccttggcatggatgtgttgtgccaggcgaagtccggtatggggaaaactgccgtcttcgtactggcgacattacagcaacttgagcctgttaccggacaggtatcagttttggttatgtgccacacccgcgaacttgcctttcagatcagtaaagaatatgagcgattctctaaatacatgcccaacgtcaaggttgccgtgttcttcgggggactcagcatcaaaaaagacgaagaggttttaaagaagaactgcccacacattgtcgtgggcaccccaggtcggatccttgccctggctaggaataagtccctcaacctgaaacacataaagcactttatccttgatgaatgtgataagatgctggagcagctggacatgagaagggacgtgcaggagatcttcagaatgaccccgcacgagaagcaggtaatgatgttttcagcgacactaagtaaggaaattagatag

SEQ ID NO: 113972 - DNA, 564 bp, Artificial Sequence
  Description of Artificial Sequence: Synthetic coding sequence
atgggatcctcacacatcgggggcctgtccataaatgagaggcgaaggtccgcatcactcggtctggtcatggccgagaacgatgtagacaatgaactgctcgactacgaagatgatgaggtggaaactgctgccggtggggacggcgcggaagcccccgccaagaaggatgttaaagggagttacgtttctatccactctagtggcttcagagattttctgctcaagcccgagctgctgcgcgccatcgtggactgtggtttcgaacacccatccgaggtgcagcatgagtgcatcccccaggctatcttgggtatggatgtgttgtgtcaggctaagtctggaatgggaaagacagctgtttttgtgctggctacccttcagcagctggagcccgtcacaggccaggtcagtgtgctcgttatgtgccacactagagagcttgctttccagattagtaaggaatacgaaagattctcaaagtacatgcctaacgtcaaggtggcggtgttctttggtggtctgtctattaaaaaggatgaagaggtcctcaagaagaactag

SEQ ID NO: 113973 - DNA, 399 bp, Artificial Sequence
  Description of Artificial Sequence: Synthetic coding sequence
atggctgagaacgacgttgacaacgaactgctcgattacgaagatgacgaagtcgaaacggccgctgggggagatggtgctgaggctcctgccaaaaaggatgttaaagggagttatgtttccatccattcctctggtttccgggacttcttactgaagccggagctgctgcgggcgatcgtggattgcggattcgaacacccatccgaagtgcagcacgagtgcattcctcaggcaatcctcgggatggacgtcctatgccaggctaagtccgggatgggcaaaactgccgtctttgtccttgcaacactccagcaacttgagccagttacaggtcaagtgtgcttttgcgacagccatttcccccgaggcgacaacgaagaattgcatttgccgtag

SEQ ID NO: 113974 - DNA, 1332 bp, Artificial Sequence
  Description of Artificial Sequence: Synthetic coding sequence
atggctgagaatgatgtagacaatgagctgctggattacgaggacgatgaggtagagaccgccgccggaggtgatggggcagaagccccagcgaagaaggacgtgaaaggatcttatgtgagcatccactcatctggcttcagagacttcctgctcaaacctgagctgctgcgggccattgtcgactgtggattcgagcaccctagcgaagtccagcacgaatgtatccctcaagctatcttaggtatggacgtgctgtgccaagcgaagtccggcatgggcaaaaccgctgtgtttgtcttggcaactctacagcaactcgagcctgtgactggtcaggtctacctcggacgggtgttaggcaggggcttttggtgcgtatttgtcagcgttctcgtgatgtgtcacacgagggaactggctttccagattagtaaagagtatgaaagattttccaaatacatgcccaatgtgaaggtcgccgtcttttttggcggccttagtattaaaaaggatgaggaagttctgaagaagaattgtccacacattgtggttggaaccccaggccgcatcctggccctggcccgcaataagtcgctgaacttgaagcacattaagcacttcattctggacgaatgcgacaaaatgctcgagcagttggacatgcgtcgggacgtacaggagatctttcgcatgacccctcacgaaaagcaggtgatgatgttcagcgcaacgctaagcaaggagatacggccagtatgccgaaagtttatgcaagacccaatggagattttcgtcgatgacgaaacaaaattaactctgcatgggctgcaacaatactacgtcaagctcaaggacaacgaaaaaaacagaaagctctttgatctgctcgacgtgctggagttcaaccaggtggtgattttcgttaaatccgtgcagcggtgtatcgctttggcacagctactagtggaacagaacttccccgccattgctatccatagaggcatgccacaagaggagaggctttcacgctaccagcagttcaaggactttcagaggcggattctggtggccacaaacttgttcggccgcgggatggatatagaacgagttaatatcgcttttaattacgacatgccagaagactccgatacttaccttcaccgagtagcacgagccggacgctttggaaccaaggggctcgccattacgttcgtgagcgacgagaatgacgccaagatacttaacgacgtgcaggatcgtttcgaggtgaatataagcgagctccccgatgagattgacatctcgtcatacatcgagcagaccaggtag

SEQ ID NO: 113975 - DNA, 870 bp, Artificial Sequence
  Description of Artificial Sequence: Synthetic coding sequence
atggccgagaatgacgtagacaatgagctattggactacgaagacgacgaggtggagaccgccgccggaggggacggagcggaggctccagcaaagaaggacgtcaaggggtcttatgtctctatacattcatccggttttagagatttcctcttaaagccagaattgctaagggccattgtcgactgcgggttcgagcatccatctgaagtgcagcacgagtgcattcctcaggcaattctcgggatggacgtgttatgccaagctaagagcggcatggggaaaaccgcggtgtttgtcctggctaccttgcagcaattggagccggtgaccggtcaagttagcgtgttggtgatgtgtcatacaagagaactggcatttcaaatttcaaaagagtacgagcgcttctcgaaatacatgcctaacgtgaaagtggctgtgttcttcggaggactgtccattaagaaagacgaagaagtactgaaaaagaactgccctcacatcgttgtggggacaccgggcaggatcctagcccttgccaggaataagtctctgaacttgaagcacatcaagcacttcatcctggacgaatgcgataaaatgctcgagcagctagatatgcggcgagatgtccaggagatttttcgaatgacgccccacgaaaaacaagtgatgatgttcagcgcaaccttatctaaggagattcggcctgtgtgcaggaagttcatgcaggacccgatggagatttttgtggatgatgagactaagctgactctgcacggcttgcagcagtattacgtgaagttgaaagataacgagaaaaaccggaaactgttcgatctgctcgatgtgctcgaattcaaccagtag

SEQ ID NO: 113976 - DNA, 564 bp, Artificial Sequence
  Description of Artificial Sequence: Synthetic coding sequence
taatctgaggaacgggacattggcaaaccaatggagatctttgtggacgacgagacaaaactgaccctccacgggctacaacaatattacgtaaagctgaaggacaatgagaaaaaccgtaagctgttcgacctgcttgacgtgcttgagttcaatcaagtcgtgatcttcgtaaagtcggtgcagaggtgtatcgcattagcccagctcctcgttgaacagaactttcccgccatagcaattcataggggaatgcctcaggaggaacgccttagccgctatcagcagttcaaagactttcagagacggatcttagtcgcgactaatctatttggccggggcatggacatagagcgggttaatatcgccttcaactacgacatgcccgaagatagtgacacatacttgcatcgcgtggcgagggccggtagatttggaaccaaaggactagccatcacctttgtgagtgacgaaaatgacgctaagattctcaacgacgtgcaggatagattcgaagtgaacatctcagagctgccggatgaaattgacatcagctcctactag

SEQ ID NO: 113977 - DNA, 411 bp, Artificial Sequence
  Description of Artificial Sequence: Synthetic coding sequence
atgggcggcggtaggcgaccttacgacgtctttttttctaaggtgatggccgagaacgacgtggataacgagctactggattatgaggatgatgaggtggagacggccgctggcggggatggggccgaggctcctgctaagaaggatgtcaaggggtcatacgtaagcatacattcttccggttttcgggatttcctgttaaaacctgagctgctgcgtgcaattgtggactgtggctttgaacatccatctgaggtgcaacatgaatgcattccgcaagcaatcctgggcatggacgtgctttgtcaggctaaatccggcatgggaaaaacagccgtgttcgttttggctactcttcaacagctggagccggtgaccggtcaggtgagcgtcttagtaatgtgccattag

SEQ ID NO: 113978 - DNA, 411 bp, Artificial Sequence
  Description of Artificial Sequence: Synthetic coding sequence
atgggagggggacggaggccttatgacgtgttttttagtaaggtgatggctgaaaatgatgtcgacaatgagttgctggactatgaggacgacgaagtggagacagccgcgggtggagatggcgccgaggcacctgccaaaaaagatgtcaagggttcctatgtgagtatacactcctccggattccgcgattttcttcttaaacccgagctactccgcgcaatagtggactgcggattcgagcacccaagcgaggtgcagcatgaatgcattccacaggctatcctgggcatggatgtattgtgccaggctaagtctggtatggggaaaaccgctgtgtttgttctggccacactgcaacagctcgagccggtgactgggcaagttagcgtgctggttatgtgtcactag

SEQ ID NO: 113979 - DNA, 399 bp, Artificial Sequence
  Description of Artificial Sequence: Synthetic coding sequence
atggctgagaacgatgtggacaatgagctgttagattatgaggacgatgaggtggaaaccgccgccggcggcgatggtgccgaggcgcctgcgaaaaaagacgttaaggggagctatgtgtcaatccattctagcgggttccgtgatttcttgttaaaacccgagctcctgcgcgccatcgtggactgcgggtttgagcacccaagtgaggtgcagcacgagtgcataccccaggcaattctaggaatggacgtgttatgccaggcaaagtccggtatggggaaaacagcagtcttcgtgctcgctacactgcaacagctggaacctgttaccgggcaggtgtgcttttgcgactcgcatttccctcgcggggataatgaagaactgcatctgccctag

SEQ ID NO: 113980 - DNA, 711 bp, Artificial Sequence
  Description of Artificial Sequence: Synthetic coding sequence
atggcggaaaacgacgtggacaatgaacttctcgactacgaggacgacgaggtggagacagctgctgggggcgatggggccgaagcgcctgcaaaaaaggatgtgaaggggtcctatgtatccattcattcaagcggtttcagggacttcctgctcaagccagaactgctgagagctatagtcgattgtggatttgagcacccatcagaggtccagcacgagtgcataccgcaggcaatcttgggtatggacgttctctgccaggcaaaaagcgggatggggaagactgccgtatttgttcttgccacgctccaacaattagagccagttaccggacaggttagtgtcctggtaatgtgccacactcgtgaactcgcgtttcagatttccaaagaatatgaacggttcagtaagtacatgcccaatgtgaaggtggcggtgttttttggcgggctgtccattaaaaaggacgaggaggtgctcaagaaaaactgcccacatatagtcgtaggcacgcccggacggatcttagcccttgcgaggaacaagtcacttaacctgaagcacatcaagcacttcattctcgatgagtgcgacaagatgctcgaacaattagacatgcgccgggatgtccaggaaatcttccgaatgactccacacgaaaagcaggtgatgatgttcagcgcaaccctttcaaaggaaatccgatag

SEQ ID NO: 113981 - DNA, 378 bp, Artificial Sequence
  Description of Artificial Sequence: Synthetic coding sequence
atggctgagaacgacgtagataacgaactattggactatgaagatgacgaggtggaaacggcggccgggggcgatggcgccgaagcaccagcaaagaaggacgtaaagggtagttacgtgagcatccacagcagtggattccgagactttctgctgaagcccgagctgctacgggccattgtcgattgcggcttcgagcaccctagcgaagtgcaacatgaatgcatccctcaggccatcctcggcatggatgtgctgtgccaggccaagtcaggtatgggaaagaccgctgtctttgtgctggccaccttgcagcagttggagcctgtgacaggacaagtctccgtcctggtgatgtgccacaccagggagctctag

SEQ ID NO: 113982 - DNA, 987 bp, Artificial Sequence
  Description of Artificial Sequence: Synthetic coding sequence
taagccaccctccagcaattggagcccgtgacaggacaagtgagcgtgctggttatgtgccacaccagagagctggcatttcagatttccaaagagtatgagcgatttagcaagtatatgccaaacgtcaaggtcgcggttttcttcggaggattgagcatcaagaaagacgaagaggtgttaaaaaagaattgtccccacatcgtcgtgggaacccctgggcggattctggctctagcccgcaacaaatccctgaatctgaaacatattaaacactttatccttgatgagtgtgacaaaatgcttgagcaactggatatgcggagagacgttcaggagattttcagaatgacgcctcacgagaagcaggtgatgatgttttcagccacactcagcaaggagattaggcccgtgtgcagaaagtttatgcaggatccaatggagattttcgtggatgacgaaaccaaattgacacttcacggattacagcagtattatgtgaaactgaaggataatgagaagaacaggaagttattcgatcttttggacgtgcttgagttcaaccaagtggtgatatttgtgaagtccgtgcagcgatgtatcgccttggctcagctgctcgtcgaacagaacttccctgccatagctatccaccgtgggatgccccaagaggagagactgagtcgttaccagcagttcaaagactttcagaggcgcatcctggtggcaactaatctgtttgggcggggaatggatatcgagcgagtcaacattgctttcaattacgacatgcctgaagattctgacacctacctgcatcgggtcgcaagagccggccgattcggaactaagggactcgctatcacgttcgtatccgatgagaatgacgccaagattctcaacgatgttcaggatcgattcgaagtcaacatctctgaactccccgatgagatagacatcagtagctatattgagcagacacggtag

SEQ ID NO: 113983 - DNA, 711 bp, Artificial Sequence
  Description of Artificial Sequence: Synthetic coding sequence
atggctgagaatgatgtcgacaacgagctcctagattatgaagacgacgaggtggagaccgcagctggcggggacggcgccgaggcccctgcgaaaaaggatgtcaaaggctcatatgtgtcgatacattcatcgggcttccgtgactttctgctgaagccagagctgctccgcgccatagtggactgcgggtttgaacaccctagtgaagtgcaacacgagtgtatcccacaagcaatattagggatggacgtactctgccaggccaaatctggcatgggaaagactgcagtcttcgttcttgccacgctccagcagctggaacccgttaccgggcaggtttcggttttagtcatgtgtcatacaagagagctggcgtttcagatatctaaagagtacgagcgtttttctaaatatatgcccaatgtaaaggtggccgtattcttcggaggcctctccatcaagaaggacgaggaggtgctcaaaaagaactgtccccacattgttgtgggtacccccggccgaatcctggcactggcccggaataagtctctgaaccttaagcacataaaacattttatacttgacgagtgtgacaaaatgctggaacaactggacatgagacgcgacgtgcaggaaatctttcgaatgaccccgcacgagaagcaggtgatgatgttcagtgctactctcagtaaggagatcaggtag

SEQ ID NO: 113984 - DNA, 564 bp, Artificial Sequence
  Description of Artificial Sequence: Synthetic coding sequence
tgatcggaggaacgcgatattgggaaacccatggaaatcttcgtcgatgatgagaccaaacttactctgcatggtctgcaacagtactatgtgaagttgaaggataacgagaagaacagaaagctcttcgacctgctcgacgtcttagagttcaaccaggttgtgatatttgtgaagtccgttcagcggtgcattgccctcgcccagctgcttgtggagcagaactttccagccatcgcgatccatcgtggcatgccccaagaagagagactctcccgatatcagcaatttaaggacttccagcgtcgaattctggtcgcaaccaacctgtttgggaggggcatggacatagagagagtaaatatcgcctttaactatgatatgcctgaggattcagatacctatctgcacagagtcgctagagctgggaggtttggcacaaagggactggcgatcacttttgtaagtgatgagaatgatgccaaaatcctgaacgatgtccaggacagattcgaagtgaacatttccgagctgcctgacgagatcgacatatcttcatattag

SEQ ID NO: 113985 - DNA, 378 bp, Artificial Sequence
  Description of Artificial Sequence: Synthetic coding sequence
atggctgagaatgacgttgacaacgaactgttggattatgaggatgatgaagtggaaactgcagccggtggagatggcgcagaggcccccgcaaaaaaggacgtcaagggatcctacgtgagcatccactcgtcgggctttcgcgacttccttctcaaacccgagctgcttcgggccatcgtggattgtgggtttgaacacccctcggaggtgcagcacgaatgtattcctcaggctatactgggcatggatgtactttgccaggcaaaaagcggaatggggaaaacggcagtctttgtgctggccactctgcagcagctggaacccgttacgggccaggtgtcagtgctcgtgatgtgccacacacgcgagctttag

SEQ ID NO: 113986 - DNA, 291 bp, Artificial Sequence
  Description of Artificial Sequence: Synthetic coding sequence
atggcagagaacgacgtggataatgaactgctggattacgaggatgatgaggtggaaaccgcagctgggggagatggcgccgaggccccagctaaaaaggatgtgaagggttcatacgtatcgatccattcatcaggtttccgcgacttcctcttaaagccggagcttctgcgagccatagtagactgtggatttgaacatccctcagaagttcagcatgaatgcatcccccaggccatactcggcatggatgtgctgtgtcaggctaagtcagggatgggcaaaacctag

SEQ ID NO: 113987 - DNA, 378 bp, Artificial Sequence
  Description of Artificial Sequence: Synthetic coding sequence
atggctgaaaacgacgtggataatgagttactcgactacgaagatgacgaagtcgagactgctgcgggtggggatggggctgaggccccagcaaaaaaggatgtcaaaggatcctacgtctctatccacagttccggcttccgggatttccttctcaaacccgagctcttgcgggcaatcgttgattgtggatttgaacacccttctgaagtgcagcatgagtgcatacctcaagctatcttgggcatggatgtcctttgtcaggccaaatccgggatgggcaagactgccgtctttgttctggccactctgcagcagctggagccggtgacaggccaagtgtctgtccttgtaatgtgccataccagagagctctag

SEQ ID NO: 113988 - DNA, 987 bp, Artificial Sequence
  Description of Artificial Sequence: Synthetic coding sequence
taagctactcttcagcagctggagcccgtgacaggtcaggtgtccgtcttggtgatgtgccatacccgcgaacttgcatttcaaatctctaaagagtacgagaggttctccaaatacatgccgaacgttaaggttgccgtttttttcgggggactctccataaagaaagacgaagaggttctgaaaaagaactgcccacacatagtcgtgggtactccaggccggatcttagccctcgctagaaacaagagtttaaacctcaagcatatcaaacacttcatcctggatgaatgtgacaaaatgctggaacaactggacatgcgccgcgacgtgcaggagatctttcgaatgacacctcacgaaaaacaagtgatgatgttcagcgccacattgtcaaaagaaatccggccggtgtgtaggaaattcatgcaggatcccatggagatctttgtggacgatgagaccaaactgaccctccacggattgcagcaatattatgtgaagctgaaggataatgagaagaaccgaaagctttttgaccttctggacgttcttgagtttaatcaggtagtaatctttgttaagtcggttcaacgttgtattgccttagctcagctgctggtagaacagaatttcccagccatagcgattcacaggggcatgcctcaggaggagagactaagtcgatatcaacagtttaaggacttccagcgcagaatcctcgtcgctaccaatcttttcggccgggggatggacattgaacgcgtgaacatagccttcaattatgacatgccagaagacagcgatacatatcttcaccgggtggcaagggctggccgctttggtacaaagggcctggcaatcactttcgtctcggacgaaaacgatgccaagatcttaaacgacgtgcaagaccgctttgaagtcaatatctccgaacttcccgatgaaatcgatatcagcagctatatagaacaaactcgctag

SEQ ID NO: 113989 - DNA, 870 bp, Artificial Sequence
  Description of Artificial Sequence: Synthetic coding sequence
atggccgaaaacgacgtggacaatgaattattagattacgaagatgacgaagtggaaactgccgcagggggggacggcgccgaagctcctgctaaaaaagatgttaagggctcatatgtctctatccattctagcggcttcagggacttcctgctgaaaccagagctcctcagggcgatcgtggattgtggattcgagcacccaagtgaagtccaacatgaatgcatccctcaggcaatcctcgggatggatgtgctttgccaagctaaaagcggaatgggtaagacggctgttttcgtgttggcgaccttgcagcaacttgagcctgtgaccggccaggtctctgtattggtgatgtgtcacacaagggagctggcttttcagatttccaaggagtatgagcgattctctaagtacatgcccaacgtcaaggttgcagtgttcttcgggggcctaagtatcaagaaggacgaagaggtgttgaaaaagaattgcccgcacatcgtggtggggacacctggccgcatcctggcattggctcgtaataagtctcttaacctcaagcacatcaagcactttatactggatgagtgtgacaagatgctcgaacagctggatatgaggcgtgacgtgcaggagatctttagaatgacaccccatgagaagcaggttatgatgttctcggcgacgctgagcaaagaaatcaggcccgtgtgtagaaagtttatgcaagatccaatggaaatttttgtcgatgacgagaccaaactgaccctgcatggactgcagcagtattatgtcaaactcaaggataacgaaaaaaacagaaagctttttgaccttctcgacgtgcttgagttcaaccaatag

SEQ ID NO: 113990 - DNA, 738 bp, Artificial Sequence
  Description of Artificial Sequence: Synthetic coding sequence
atgtggactatgagctcttggaccatgaagatgatgaggtggcgccaacaactgggggaaatgggtcttcgcccgttaccacgacggatgtctcgggcgcccatgagcccctcgacagcactggcatttgtcacttcctgctcttcccaaagttgttcgggccccctgagcacagtggcactatcaatacgacagaaagtggccgtgttctttgggggcttgagcataaagaaggatgaggaggttctgaaaaagaattgcccacatattgtggtcggcactcccggccgcattctagcccttgcgcgtaataagtctctgaacttgaagcatattaaacatttcatcctggacgagtgcgacaagatgttagagcagctggatatgaggcgcgatgttcaggagatttttcgcatgactccccatgaaaagcaggttatgatgttttcagccactctcagtaaagagattcgccctgtgtgtcgtaagttcatgcaggatccgatggaaattttcgtggatgacgagacaaagttgacactccacggcctccagcagtattacgtgaagttgaaggacaacgagaaaaacagaaaactgttcgacttgctggacgtgctggagttcaaccaggtcgtgatttttgtcaaaagcgtccagcgttgcatcgcacttgctcaattgttagtggaacagaactttcctgcgatagcaattcaccgcggcatgccacagtag

SEQ ID NO: 113991 - DNA, 738 bp, Artificial Sequence
  Description of Artificial Sequence: Synthetic coding sequence
atgtggacaatgtccagctggaccatgaaaatgatgcgttggagacagcagctgggagagatggggctccgccctttgccacgtagaatgtcacgagctcctatgtcacctagtactgcgttagcttttgtaacatcatgtagctctcaaagctgttcaggccccctcagcaccgttgcacttagtatccgccaaaaggttgcagtgttcttcggaggcctgagtattaaaaaagacgaggaggtgcttaagaagaactgtccccatattgttgtgggtacccctgggcggatcctggcattagcccggaataaaagtttaaacctgaagcacataaagcattttatcctggatgagtgtgacaagatgctcgaacagctggacatgcgcagagatgtacaagagattttcagaatgacaccccatgagaagcaggttatgatgttcagtgccacccttagcaaagaaattagaccagtgtgtcgcaagttcatgcaagaccctatggagatcttcgtggatgatgaaaccaaactgacactccacggtttacaacagtattacgtaaaactcaaggacaatgaaaagaacaggaagctctttgacctgctggatgtgctcgagttcaaccaggtggtaatatttgtcaaatcggtgcagagatgtattgctttggctcagcttctcgttgagcagaatttcccagccatcgcgattcaccggggtatgcctcaatag

SEQ ID NO: 113992 - DNA, 396 bp, Artificial Sequence
  Description of Artificial Sequence: Synthetic coding sequence
taagctacactgcagcagttagagcctgtgacaggccaggtgagcgtactggtgatgtgccatacacgagagctcgctttccagattagcaaggagtatgagcgtttcagtaagtatatgccaaatgttaaagtggcagtgttctttggtggattaagcatcaagaaggatgaagaagtcctgaaaaaaaattgtcctcacattgttgtggggacgcctggcaggatcctggcgctggccagaaacaagtcattgaatctcaagcatataaaacacttcatcttagacgagtgcgataagatgctggaacaacttgatatgagacgagacgtacaggaaatcttccggatgacaccacacgagaaacaggtgatgatgttctcagccactctctag

SEQ ID NO: 113993 - DNA, 411 bp, Artificial Sequence
  Description of Artificial Sequence: Synthetic coding sequence
taagcgactttgcaacagcttgaaccagtgactgggcaagtctctgtccttgtgatgtgccacactcgcgagctcgcattccagataagcaaggagtatgagaggttctccaagtacatgccgaatgtcaaggtcgcagttttcttcggtgggctgagcatcaagaaggacgaggaggtgctcaaaaagaactgcccccatattgtcgtagggacacccgggagaatcctggctctggctcgcaataagtctttgaatctcaaacacatcaagcattttattctggacgaatgcgataagatgctggaacagctcgatatgcggagagatgtgcaggagatcttcaggatgactccccacgagaagcaggtgatgatgttctccgctactctgtccaaagaaataaggtag

SEQ ID NO: 113994 - DNA, 717 bp, Artificial Sequence
  Description of Artificial Sequence: Synthetic coding sequence
atggcagaaaacgacgttgacaacgaattactcgattatgaggatgacgaggtcgaaactgcggccgggggcgacggggcagaggcccctgcaaaaaaggatgtgaaaggctcttacgtgtccatacactcgagtggcttccgcgactttttactgaagcctgaactgcttagggccattgtggactgtggtttcgagcatccttccgaagtccagcacgagtgtataccgcaggcgattctcggcatggatgtgctctgtcaggctaaatctgggatgggaaagacagcggtgtttgttctggccacgctacagcagctggaacccgtaacggggcaggtctcagtgttagttatgtgtcacacacgcgagctggcttttcagatcagtaaggaatacgagcgcttctcgaagtatatgccaaatgtgaaggtggccgtgtttttcggtggactgagcattaaaaaggacgaggaggtcctcaaaaaaaactgcccacacattgtcgtgggcactcctgggagaatcctggccttggctagaaataagtccctgaacttgaagcatattaagcactttatactcgatgagtgtgacaagatgttggaacaactagacatgagacgtgacgtgcaagagattttccggatgacaccacacgagaagcaggtcatgatgttctccgccaccctcagcaaagaaataagacccgtgtag

SEQ ID NO: 113995 - DNA, 564 bp, Artificial Sequence
  Description of Artificial Sequence: Synthetic coding sequence
tgaagcgaagagcgggacatcggcaagcctatggaaatttttgtcgacgacgagacaaaactaactctgcatggacttcagcagtactacgtgaagctgaaggacaatgaaaagaatcggaaactgttcgatttgttagacgtgttggaattcaaccaggtggtgatattcgtaaaatctgtgcaaaggtgcatagctctagcccagctgctggtcgaacaaaatttccctgcaatcgcgatccaccggggaatgccccaggaggaacggctctctcgatatcaacaattcaaagatttccagcgccgaatcctggtggccacgaacctcttcggccgtggcatggatattgaacgcgtgaatatcgccttcaattatgatatgccggaagactccgatacttatttacatcgtgtggcccgtgcaggccggtttggcaccaaggggctcgctataacctttgtctccgatgagaacgatgctaagattttgaatgatgtgcaggatcgcttcgaggtcaatatcagtgagctccccgacgaaatcgatatcagctcatactag

SEQ ID NO: 113996 - DNA, 594 bp, Artificial Sequence
  Description of Artificial Sequence: Synthetic coding sequence
atggccgaaaatgatgtagataacgagttgttggactacgaggacgatgaagttgaaactgctgccgggggagatggggccgaggcgcccgccaagaaagacgtcaaaggatcgtacgtgagcatccatagcagtgggtttagagatttcctgctgaagcctgaactcctccgggctatcgtggactgtggatttgaacaccctagtgaggtgcagcacgagtgcattccacaagcgatcttaggaatggacgtgctctgccaggccaagagcggcatgggtaagaccgcagttttcgttctggctaccctacaacaactggaacctgtgactggccaggtctgtttttgtgactcccattttcctcgtggcgataacgaggagctccaccttccgtatgtgtctgtgtacttcttgccgaaagtgtcagtactggtgatgtgccatacccgggaactcgccttccagatctccaaagaatatgaacggttttctaaatacatgcctaacgtgaaagtcgctgtcttctttgggggcttaagcataaaaaaggacgaggaagttttgaaaaagaattgtccacatatcgtgtag

SEQ ID NO: 113997 - DNA, 594 bp, Artificial Sequence
  Description of Artificial Sequence: Synthetic coding sequence
atggcagaaaatgatgttgataacgagctcctcgactacgaagatgacgaagtcgagaccgccgctggcggcgatggcgccgaagcgccagctaaaaaagacgtcaagggctcctatgtcagcattcactcatccgggttccgggatttcctgttgaagcctgaactgttgcgtgctatcgtcgattgcgggtttgagcatccatccgaggtgcagcatgagtgtatcccccaagctattttaggaatggacgtcctatgccaagcgaaaagcggcatggggaagactgcagtgtttgttctggctactctgcaacagctggaacctgttaccggacaagtctgtttctgcgactcccactttcccagaggcgataacgaagagctgcatctcccctatgttagtgtttactttcttcctaaagtcagcgtgctcgtcatgtgccacactcgggaactggccttccaaatttctaaagaatacgagagattcagcaagtacatgcctaacgtgaaagtcgcagtcttcttcggaggcctgtccataaagaaagacgaagaagtcttgaagaagaattgtccacatatagtctag

SEQ ID NO: 113998 - DNA, 411 bp, Artificial Sequence
  Description of Artificial Sequence: Synthetic coding sequence
atgggagggggtcgccgaccttacgacgtgtttttctctaaggtcatggccgagaacgatgtggacaacgaactgctagattatgaggatgatgaagtggaaaccgccgcaggtggagacggcgcggaagccccagcaaaaaaggacgtgaaaggaagttacgtgagtatccattcttcaggtttccgagattttctgctcaaaccagagctgcttcgggcaatcgttgattgcggctttgagcacccctccgaagtccagcacgagtgtatcccccaggcaatccttgggatggacgttctttgccaggctaaaagcggcatgggcaagactgcagtcttcgtgctcgcgaccctgcagcagctcgagcctgtgacgggtcaggttagtgtgctggtgatgtgccactag

SEQ ID NO: 113999 - DNA, 1278 bp, Artificial Sequence
  Description of Artificial Sequence: Synthetic coding sequence
atggcagagaacgatgtggataacgagctgctggactacgaggacgatgaagtagagacagccgcaggcggcgatggggcggaggctcctgctaaaaaggatgttaaaggctcctacgtgagtatacattctagcgggtttagagatttcctcctgaaacccgaattattgcgcgccattgttgattgcgggttcgagcacccgtccgaggttcagcatgaatgcataccacaggccattcttggcatggacgtgctgtgtcaggctaagtctggaatggggaagacagcggtgttcgtgttagccacactacaacaattagagccagtgacaggccaagttagcgtccttgtgatgtgtcacactcgggaactggccttccagatcagcaaggagtacgagcggtttagcaagtacatgcccaatgttaaggttgccgtgttctttggaggcctaagcatcaagaaggacgaagaagtgctcaagaaaaactgcccccatattgtggtggggaccccaggcagaatcctcgccctggcacggaataagtctctgaacctgaaacacataaaacacttcatactcgatgaatgcgataagatgcttgaacagcttgatatgcggagggatgtgcaggagattttcagaatgaccccacatgaaaaacaggtgatgatgttctccgccacgctgtcgaaggagattagacctgtctgcaggaagttcatgcaagatcccatggaaatcttcgtcgacgatgaaacgaaacttaccctgcatggcctgcagcaatattacgtcaaactgaaagataatgagaagaatagaaagctgttcgatttactcgacgtcctcgaatttaatcaggtggtgatcttcgtcaaaagcgtgcagcggtgcatcgcgttggctcagcttcttgttgagcaaaattttcccgccatcgcaatacatcggggaatgccccaggaagaacgcctgtcccgctatcagcagttcaaggatttccagaggaggatcctggtggccaccaatctgtttggcagggggatggatattgagagggtcaacattgcatttaactatgatatgcccgaggattctgacacgtatcttcatcgatgctatccactcagcccatccagatggcccgaacaggcagggctcgcgcctcgcgcatggctctcccacctctgtccgatgcggatgatgccgcgaagcagcatgatgtgtcgcattgccctgcggtccatcctagtgtcttgcctgatgaggtag

SEQ ID NO: 114000 - DNA, 1287 bp, Artificial Sequence
  Description of Artificial Sequence: Synthetic coding sequence
atggctgagaatgacgtggacaacgagctgcttgactacgaagacgatgaagtggagactgccgcaggaggagatggggccgaggctccagctaaaaaagacgtgaaaggcagctatgtctcaatccactccagcgggtttagagacttcctcctgaaacccgagctgcttcgtgcaatcgtggattgtgggtttgaacatcccagcgaagtgcagcacgagtgtataccacaagcgattctcgggatggacgtgctgtgccaggccaagtcaggaatggggaagactgccgtgttcgtgctggctaccttacagcaactggagccagttaccggtcaggtcagcgtcctagtgatgtgtcacaccagggagttggccttccagattagcaaagagtatgaacgattcagcaaatacatgccaaacgtcaaggtcgcagtttttttcggagggctgtccatcaagaaagatgaggaggtacttaaaaaaaattgcccacacatagtcgtcggcaccccaggacgtattcttgccctggccaggaacaaatctttgaatttaaagcacatcaagcactttattttagatgaatgtgacaaaatgcttgaacaactcgatatgaggagagacgttcaggagatctttcggatgacaccccatgagaaacaggtaatgatgttctctgcgacgttatccaaagagattcgcccggtgtgtagaaaatttatgcaggaccctatggagattttcgtcgacgacgaaacaaagctgactctacacggtttgcagcagtactatgtgaagcttaaggacaacgagaagaatcgcaagctgttcgatctcttagacgttctcgaatttaatcaagtggtcatctttgtgaagtcagtgcagcgttgcatcgcccttgcacagctcctagtggagcagaattttcccgctatagccattcaccgaggcatgccacaggaggaaagactgtcacgatatcagcagttcaaggattttcaacgaagaatacttgtcgccactaatctctttggcagggggatggacatcgagcgagtgaacattgccttcaactacgacatgccagaagacagtgatacatacctgcatagagtggcccgagctggtcgcttcggcacaaagggtttggccataacttttgtttctgatgaaaatgacgcgaagatcctaaatgatgtgcaagaccgctttgaggtcaacatttcagaactgcctgatgaaatcgacatctcttcctatatagagcagacccggtag

SEQ ID NO: 114001 - DNA, 1287 bp, Artificial Sequence
  Description of Artificial Sequence: Synthetic coding sequence
atggctgagaacgacgtggataacgaactgcttgattatgaagatgacgaggtggagaccgccgcagggggtgatggagctgaggcccccgctaagaaagacgtcaaagggagctatgtgtctatccacagctctggctttcgtgacttcctgctgaaaccagagcttctgcgggctatcgtcgactgcggcttcgagcatcccagcgaggtccaacacgagtgtatcccccaggcaatcctggggatggacgtgctgtgtcaggctaaaagtggcatgggtaagacagcagtgttcgtgctggccacactccagcagctggaaccagtgaccggtcaggtatccgtcttggtcatgtgccatacgcgcgagttggcattccagatctccaaagaatatgaacgctttagtaagtatatgcccaatgtaaaagtagctgttttctttgggggactttctattaagaaagatgaggaagtcttgaagaaaaactgtcctcacattgtggtgggtacacccggccgcattttagcccttgcacgaaataaatctctgaacttgaagcacataaaacactttatcctagacgagtgcgataagatgctggagcagcttgacatgaggagggacgtccaggagatattcaggatgactccccatgagaagcaggtaatgatgttctctgctaccctttcaaaagagattagaccggtttgcagaaaattcatgcaggaccctatggagatcttcgtagatgatgagaccaagttgacactgcacggattgcagcagtattatgtgaagctcaaagataacgaaaaaaatcggaagctgtttgatctgctggacgtgctagagttcaaccaggtggtgatcttcgtgaagtccgtgcaaaggtgcattgccctagcccaacttttggttgaacagaatttcccagcaatagcaatccatagaggtatgccccaagaggagagattgtcacgctatcagcagtttaaggactttcagcgccggattttggtcgccaccaacttgtttggaagagggatggacatagagcgggttaacatcgcctttaactatgacatgccagaagactccgatacctacctgcaccgcgtggctcgcgccggaagattcgggaccaagggacttgctattaccttcgtgtccgacgagaacgatgccaagatccttaatgacgtgcaggataggtttgaagtgaacattagcgagctgccagacgagatcgatatcagctcctatatcgaacagactcggtag

SEQ ID NO: 114002 - DNA, 738 bp, Artificial Sequence
  Description of Artificial Sequence: Synthetic coding sequence
atgtggaccatgagcagttggaccatgaagatgatgaggtggagacagcagctaggggagatggggcttcgccccttacccagacgaatgtcacgggctcccatgtcgccctccactgctctggcctttgttacatcctgctctagtcagagctgttctggcccattatcaacagtcgctctgagtataaggcagaaagtggctgtgttcttcggcgggctctcgataaagaaagacgaggaggtcctcaagaaaaactgcccccatatcgtcgttgggacccctgggagaattctggcactcgcccggaacaagtccctgaatcttaagcacatcaaacacttcattctggatgaatgcgacaagatgttagagcagctggacatgcgccgtgacgtgcaggaaattttcagaatgacaccccatgagaaacaagtaatgatgttcagcgccacgctgtcaaaagagatccgccctgtatgccgtaaattcatgcaagaccctatggagatcttcgtggatgacgaaacaaagctaacactgcatggtctccagcagtattatgtgaaacttaaggacaacgagaaaaaccgcaagctgttcgaccttcttgacgtgttggaatttaaccaagtggtcatattcgtgaagagcgtacagcggtgtatagccctggcccaacttctcgtggaacaaaatttcccagcaattgccatccacaggggaatgccccaatag

SEQ ID NO: 114003 - DNA, 696 bp, Artificial Sequence
  Description of Artificial Sequence: Synthetic coding sequence
atggccgagaacgatgttgataatgagttactggactacgaagatgatgaggtggagacagcagcaggcggggacggcgcggaggccccagccaagaaggacgtcaagggtagctatgtgagcattcattcttctgggttccgggacttcctgctgaagcccgagttgctgcgcgccatagtggactgcgggtttgaacacccatcagaagtccagcatgagtgcattccccaagcaatcttgggcatggacgtgctgtgtcaggcaaaatcaggaatgggcaaaacagccgtttttgtactggctactctccaacaactcgagcccgtgaccgggcaagtttctgtcttagtgatgtgtcacacacgggagctggctttccaaatcagtaaggagtacgagaggttcagcaagtacatgccaaacgttaaggttgccgtattcttcggtgggctgtctatcaagaaagacgaggaagtcctaaaaaagaattgccctcacatcgtagttggcaccccgggaagaatcctggcgctggcccggaacaagtctttaaacttaaaacatatcaagcattttatattggacgaatgtgataaaatgctggaacagttagacatgaggagggacgtgcaggaaatcttccgaatgacaccacacgaaaaacaagtcatgatgttctcggccacactctag

SEQ ID NO: 114004 - DNA, 594 bp, Artificial Sequence
  Description of Artificial Sequence: Synthetic coding sequence
atggccgagaacgacgtggataatgaactactggactacgaagatgacgaggtggagacagcagcaggcggtgacggggccgaggcgccagcgaagaaagatgtaaaggggtcttacgtgtccatccattccagtggatttagagattttctcctgaagcccgaattgctcagagcgattgtagattgcggattcgagcacccctccgaagtgcagcacgagtgcatcccacaggccatccttggaatggatgttctgtgccaggctaaatcagggatgggaaaaactgcggtcttcgtgctcgccacccttcaacagctagagcccgtcacaggccaggtgtgtttctgcgattctcacttcccacggggcgataatgaagaactccacctgccttacgttagtgtgtacttcctgcccaaggtgtcggtgctggtgatgtgccacactagagagctggccttccagatctctaaggaatacgagagatttagtaaatacatgccaaacgtaaaggtggctgtgtttttcggtggcctgtccatcaagaaggatgaggaagtgctgaagaaaaactgtccacatatcgtctag

SEQ ID NO: 114005 - DNA, 594 bp, Artificial Sequence
  Description of Artificial Sequence: Synthetic coding sequence
atggctgaaaacgatgtagataacgaactgttggactatgaggacgacgaagtggagacagccgctggcggggacggggccgaggccccggcgaaaaaagacgttaaaggctcctatgtgtctatccactcatctggatttcgagactttctgttaaagccagagttgctgcgagcaattgtggactgtggctttgagcacccctctgaagtgcaacacgagtgcatacctcaggcaattctgggcatggatgtactctgccaggctaagagcgggatgggcaagaccgctgtttttgtgctcgccacccttcaacagctggaacctgtgaccggtcaagtctgtttttgtgactcgcattttcccagaggcgacaatgaggagctccacctaccgtacgtgagtgtgtatttcctgcccaaggtttcagtcctagtgatgtgtcatactcgggagttagcctttcagatatctaaagaatacgaacgattctcaaagtacatgcccaacgtgaaagtcgctgttttcttcgggggtctctccattaaaaaggacgaggaagtccttaagaagaattgccctcatatcgtgtag

SEQ ID NO: 114006 - DNA, 540 bp, Artificial Sequence
  Description of Artificial Sequence: Synthetic coding sequence
gtggcggtgtttttcggtggtctgtctataaagaaggatgaggaggtactgaagaagaactgcccacatatcgtagtcggcacccccggccggatactggctctcgcacgcaacaagtccttaaatcttaagcatataaaacattttatcctcgacgagtgtgacaagatgctagagcaattggatatgagacgtgatgtgcaagaaatctttagaatgactccacacgagaagcaggtgatgatgttctccgctacactcagcaaggagatccgccctgtgtgtagaaaattcatgcaagatcctatggagattttcgttgacgatgaaacgaaacttacactccacggcctacagcagtactacgtcaagctgaaggacaatgaaaagaatagaaagttgtttgacctcttggatgtcttggaattcaaccaagtggtgatctttgtgaagagcgtacaacggtgcatagccctggcacaactactggtagagcagaacttccccgcaatcgccatccatcggggcatgccccagtag

SEQ ID NO: 114007 - DNA, 594 bp, Artificial Sequence
  Description of Artificial Sequence: Synthetic coding sequence
atggccgagaacgatgtcgacaacgagctcttggattatgaagacgatgaggtggaaactgctgcggggggagatggggctgaggccccggcaaaaaaagacgtgaaagggagctacgtttctattcactcatctggtttcagagactttctcctgaagcctgagctgctccgcgccattgtagattgtggtttcgagcatccttctgaggttcaacacgaatgcatcccccaggcaattctgggcatggatgtattatgccaggccaagtcagggatggggaaaactgccgtctttgtcctggccacactgcagcagctggagccggtgacgggtcaagtctgtttttgtgatagccatttcccaaggggcgataacgaagaactacatctaccttacgtgtctgtatatttcctccctaaggtgtctgtgctggtgatgtgccacacccgggagttggccttccagattagcaaagagtatgaacgatttagcaaatatatgccaaacgtcaaggtggccgtttttttcgggggactgtctataaaaaaagacgaggaggtgctaaagaaaaactgcccccatatagtttag

SEQ ID NO: 114008 - DNA, 564 bp, Artificial Sequence
  Description of Artificial Sequence: Synthetic coding sequence
tgatctgaggagagagacataggaaaacccatggagatcttcgtggacgatgaaacaaaactaacactacacggtctgcagcagtactacgtcaagctgaaggataacgaaaagaaccgaaagttgtttgacctgttggacgtgctggaattcaatcaagtcgtgatattcgtgaagtcagttcagaggtgcattgcgttagcccaactccttgttgagcaaaattttcctgctatagccatccatcgcgggatgccccaggaggagagactgtccagataccagcagttcaaagattttcaacgccgaatcctcgtggccacgaatctgtttggacgcgggatggatattgagcgagtgaatattgcttttaactacgacatgcccgaagactccgatacttacttacacagagtcgcacgggccggacgttttgggaccaaaggattagccatcacctttgtgtccgatgaaaatgatgcgaagattcttaacgacgtgcaagatcgatttgaagtgaatatttctgagttgccagatgagatcgatatcagcagctattag

SEQ ID NO: 114009 - DNA, 195 bp, Artificial Sequence
  Description of Artificial Sequence: Synthetic coding sequence
taggccacccttcagcagcttgaacctgtcacaggacaggtgagcgtcctcgtgatgtgccacacacgtgagcttgctttccagatatccaaggagtacgaaagattctcgaaatacatgcccaatgtgaaggttgccgtgttttttggtggtctgagtatcaagaaagatgaggaggtgttgaagaaaaactag

SEQ ID NO: 114010 - DNA, 78 bp, Artificial Sequence
  Description of Artificial Sequence: Synthetic coding sequence
tgagcaactcttcaacaactggaacctgtgaccggccaggtttcagtattggtgatgtgtcacaccagggagctatag

SEQ ID NO: 114011 - DNA, 66 bp, Artificial Sequence
  Description of Artificial Sequence: Synthetic coding sequence
tgagctactctgcaacagctggagccggttacaggccaggttagtgtgttagtcatgtgtcactag

SEQ ID NO: 114012 - DNA, 870 bp, Artificial Sequence
  Description of Artificial Sequence: Synthetic coding sequence
atggccgagaacgatgtggataacgaactgctagattatgaggacgacgaggtcgagaccgccgccggcggggatggcgctgaggcccctgccaagaaggacgtcaagggaagctatgtgagtatccacagtagcgggttccgcgacttcttgctgaaacctgaactcctgagggcaatcgttgactgcgggtttgaacacccctctgaggtgcagcatgaatgcatccctcaagcaatattgggaatggacgtcttatgccaggcaaaatctggaatggggaaaactgctgtatttgtgcttgctaccctgcagcagcttgaacccgtgacagggcaagtctctgtgctcgtgatgtgccacacacgcgagttggcctttcagatatccaaagaatacgagcggtttagtaagtacatgcccaatgtcaaggtcgcagtcttcttcgggggactgtctatcaagaaggatgaggaggttctgaaaaagaactgtcctcacatagtggttgggacccctggacgcatactggcacttgctcgcaacaagtccttgaacctcaaacacattaagcatttcatattagatgaatgcgacaaaatgctggagcagctggacatgaggagagatgttcaggagattttccgaatgacaccgcatgaaaagcaagtcatgatgttcagcgcgactctaagtaaggagattagacccgtctgccggaaatttatgcaagacccgatggaaatcttcgtagacgacgaaactaagcttactcttcacgggctgcagcagtactatgtcaagctcaaagataatgagaaaaaccggaagttattcgacctgcttgatgtcctcgaatttaatcagtag

SEQ ID NO: 114013 - DNA, 711 bp, Artificial Sequence
  Description of Artificial Sequence: Synthetic coding sequence
atggctgagaacgacgttgacaatgagttgctggactacgaggacgacgaggtagaaaccgctgccgggggagacggagccgaggcgcctgctaaaaaagacgtcaaaggcagctacgtatccatccactccagcggattccgcgatttcttgctcaagcccgaactgctccgagccattgttgattgcggttttgaacacccgagcgaagtacaacacgagtgcattccacaggcaatattagggatggatgtgctgtgccaggctaaaagcggtatgggcaagactgcagttttcgtgctggcaacactgcagcagttggaacccgtgaccggacaagtctcagtgctagtaatgtgccatacaagggagttagccttccagattagtaaagaatacgaacgcttctctaagtacatgccaaatgtcaaggtggccgttttttttggggggctatccattaaaaaagatgaagaggtgcttaagaagaactgcccacacatcgtcgtcggtacccccggccgaatcctggccctggccaggaacaaatccttgaatctgaaacatatcaaacattttatattggacgagtgcgacaagatgttggagcagctagacatgcgaagggacgtgcaggagattttcaggatgacaccacatgagaagcaggtcatgatgttctcagccacattatcaaaagagatccggtag

SEQ ID NO: 114014 - DNA, 711 bp, Artificial Sequence
  Description of Artificial Sequence: Synthetic coding sequence
atggctgaaaacgacgtggacaatgaactcctcgactatgaggacgacgaggtcgagacagcagccgggggagatggggcagaagcaccagccaagaaggacgtcaagggatcatatgtatcgatccactcctccggcttcagagacttcttgctgaagccggagttactgagagccatcgtggattgtggtttcgagcatccaagtgaggtgcagcacgagtgtattccacaagcgatcttgggcatggatgtactctgccaagccaagagcggtatgggcaagaccgccgtctttgtgctcgccactttgcagcaactggagccggtcacaggtcaggtgtccgtcctggtgatgtgtcacaccagggagctggcgttccaaattagcaaagagtacgagaggttcagtaaatatatgcccaatgtgaaagtagcggtattttttggtgggctctcaatcaaaaaagatgaagaggtgctgaagaagaattgcccccatattgtggtaggcacccccggtcggatactcgcactggcgcggaacaagtcgcttaacctcaagcatattaagcattttatcctggatgagtgtgataagatgttggaacagcttgacatgaggcgggacgttcaggagatctttcggatgaccccgcacgagaagcaggtgatgatgtttagcgctacgctctccaaggagatccggtag

SEQ ID NO: 114015 - DNA, 978 bp, Artificial Sequence
  Description of Artificial Sequence: Synthetic coding sequence
taggctaccctgcagcagctggagccagtcacaggtcaggtgtcagtcctggtcatgtgtcatactcgcgagcttgcatttcagatctccaaggagtacgagcggttctctaaatatatgccaaacgtcaaggtggctgtctttttcggaggcctgtctataaagaaggatgaggaagtcctaaagaagaattgcccccatatagttgtgggcacaccaggacgtatattggccctggctcgaaacaaaagtttaaacttgaagcacattaaacacttcatcttagatgaatgcgataaaatgctggagcagctggatatgcgaagggacgtgcaggaaatcttcaggatgaccccacacgagaagcaagtgatgatgtttagcgctacactctcgaaagagatcaggccggtgtgcagaaagtttatgcaggatcccatggagatttttgtagatgatgagacaaaactgacgctacacgggctccagcagtactatgtgaagctgaaggacaacgagaaaaacagaaaattatttgacttgctcgatgtcctggaatttaaccaggttgtgatctttgttaaatctgtccagcggtgtattgcattggcgcaattgctggtggaacagaatttcccggcaatcgcaattcacagaggaatgccccaggaggagcggctgtcccgatatcagcagtttaaggacttccagcgccgcatactggtggcaacaaacttgttcgggcggggaatggacatcgaacgcgttaatattgcttttaattacgatatgcctgaggacagtgacacatacctacatagatgttaccccctctcacccagcaggtggccggagcaggccgggctggccccccgcgcttggctgtctcacctctgtccgatgcgaatgatgcctcgtagctccatgatgtgtcgcatcgctttacgatctatactggtttcatgtctgatgcggtag

SEQ ID NO: 114016 - DNA, 717 bp, Artificial Sequence
  Description of Artificial Sequence: Synthetic coding sequence
atggcagagaatgacgttgacaacgagctcttagactatgaggatgacgaggtcgaaacagccgctggcggggacggcgccgaggccccagcaaaaaaggacgtgaagggcagttacgtgtcaatacattcgagcgggtttcgtgactttctcctgaaacccgagcttcttcgggccatcgtagattgcgggttcgaacaccctagtgaagttcaacacgaatgcattccacaggccattctgggcatggatgtcctgtgccaggccaagagcggaatggggaagacggccgtgtttgtactggctacactacagcagcttgagcccgtcactggccaggtgtcggtcctggtgatgtgtcacactcgagagctcgcgttccagatatctaaggagtatgagcgattttcaaagtacatgccaaatgtcaaggtggccgtattctttgggggactgagtataaagaaggatgaagaggttctgaaaaagaattgcccacacatcgtcgtaggcacaccgggccggattttggctcttgccagaaacaaaagtctgaacctgaaacatatcaaacattttattctggacgagtgcgacaaaatgctggagcagttggacatgagaagggacgttcaggagattttccggatgacgcctcatgaaaagcaagtcatgatgttttctgccacgctcagcaaagagatccggcccgtgtag

SEQ ID NO: 114017 - DNA, 717 bp, Artificial Sequence
  Description of Artificial Sequence: Synthetic coding sequence
atggccgaaaacgatgtcgacaatgaactgttagattatgaagatgatgaagttgagactgctgcaggtggcgatggtgcagaggcacccgcaaagaaagacgtaaagggatcctacgtatccatccactccagtggatttcgagacttcctcctcaagccagaactgttacgcgcaatcgtcgattgcggtttcgagcacccttcggaggttcagcatgaatgcatcccacaggcaatactggggatggacgtgctgtgccaagctaaaagcgggatgggcaagacagctgtttttgtcctggcaactctgcaacagctcgaacccgtgacaggacaggtgagcgtcctggtcatgtgccatacccgagagttggccttccaaatcagtaaagaatacgaacggttttcaaagtacatgcctaacgtgaaggtggccgtgtttttcggtggattgtcaattaagaaggacgaggaggtcctgaaaaaaaactgtccacatattgtcgtaggtaccccaggacgtatactcgctctggctaggaacaaatctctgaacctaaaacacattaagcatttcattctagacgaatgtgacaaaatgctcgagcaactcgacatgcgacgcgatgtccaggaaatcttccggatgacaccccacgagaaacaggtgatgatgttctcagccacgttgtcaaaggagatcaggccagtgtag

SEQ ID NO: 114018 - DNA, 870 bp, Artificial Sequence
  Description of Artificial Sequence: Synthetic coding sequence
atggccgagaatgatgtcgataacgagctcctagactatgaagatgatgaagtcgagaccgccgctggaggagatggcgctgaagctcctgctaagaaggatgtcaagggctcatacgtcagcatccatagcagtgggtttagggattttcttctgaagcctgagctcctgcgcgctatcgtggattgtggattcgagcatccgtccgaagtacaacacgaatgcattcctcaagctatactgggcatggatgtcctgtgtcaagcaaagagtggaatgggtaaaactgcggttttcgtgcttgctactcttcagcaattagagccagtgaccggacaggtgtccgtcctggtgatgtgccatacacgagagttggcctttcagatatctaaggagtatgagcggttttccaaatatatgcccaacgtcaaggtggctgtatttttcggcggcttgagcatcaagaaggacgaagaagtgctcaaaaaaaactgcccacatatcgttgtcggcacccctggccggattctggccttggcaagaaacaagagcttaaacctgaagcacatcaaacactttatacttgacgagtgcgacaagatgttggagcagttggacatgcgtcgggatgttcaggagattttccggatgacaccacatgaaaagcaagtcatgatgttctcagcgaccctctcaaaggaaatacggccagtctgccgcaagtttatgcaggacccaatggaaatattcgtggatgacgagacaaaactgacattgcacggtcttcagcagtactacgtgaagttgaaagacaatgagaaaaaccgaaagctgttcgacctgcttgacgtcctggaatttaatcagtag

SEQ ID NO: 114019 - DNA, 1278 bp, Artificial Sequence
  Description of Artificial Sequence: Synthetic coding sequence
atggccgagaatgacgtagataacgagctcctggattatgaagacgacgaagtggaaaccgccgccggcggggacggcgccgaggcgccagctaagaaggacgtgaagggttcctacgtcagtatccattccagtggattccgcgactttctcttgaaacccgaactcctgagagcaatcgtcgactgcgggtttgagcatcctagtgaagtgcagcacgaatgcatcccccaagctattctcgggatggatgtgctttgtcaagcgaagtctggaatgggcaagactgcagtgtttgtgctggcgactctccagcagctggagcctgtgaccggccaggtttccgttctggtcatgtgtcacacacgggagctagcctttcagatcagtaaggagtatgaaaggtttagtaagtatatgcccaacgtaaaggtagccgtgttttttggcggcctgtccattaaaaaggatgaggaagtgcttaagaaaaattgcccacacatcgtggtgggtaccccggggcgtattcttgcattggccagaaacaaaagcctcaatttgaaacacattaagcactttatcctcgatgagtgtgataaaatgctagagcagctggacatgagacgagatgtgcaagaaattttcagaatgactccacacgagaaacaggttatgatgttctccgccactctgtccaaagagataagacccgtttgtagaaagttcatgcaggatcctatggaaattttcgtggacgacgagaccaagcttaccctccacggattgcagcagtactacgtgaagctgaaggataatgagaagaacagaaaactgtttgatctgctcgatgtgctagagttcaaccaggtagtcatctttgtcaagtcagttcagcgctgcattgccctggcgcagttgctggttgagcagaattttcctgctattgcaatacatcggggaatgccccaagaagaacgactttctcgctaccagcaattcaaggacttccagcgacggatccttgtggccaccaacctcttcggacgtggtatggacatcgagcgagtgaacatcgcgtttaattatgacatgcctgaggatagtgacacctatctgcataggtgttacccactgtctccatccaggtggccggaacaagcaggcctggcccctagggcctggctctctcacctgtgtccaatgaggatgatgccccggtcctcgatgatgtgcagaattgcattaaggagcatcctggtgtcatgcctcatgcgttag

SEQ ID NO: 114020 - DNA, 411 bp, Artificial Sequence
  Description of Artificial Sequence: Synthetic coding sequence
atgggggggggcaggaggccgtacgatgtgttctttagcaaagtaatggcggaaaatgacgtggataacgaattgcttgattacgaggacgacgaggtcgagaccgccgccggcggcgatggggcggaagcacccgcaaaaaaagacgtgaaaggaagctatgtgagcatacactctagtggtttccgggactttttgctgaagcctgaactgcttcgggccatcgtcgactgtggattcgaacatcccagcgaggttcagcacgagtgtatcccccaagccatcctcggcatggacgtactgtgccaggcaaagtcaggaatgggtaagaccgcagtctttgtgctggcaaccctacagcaactggaacctgtgaccggacaagtcagcgtgcttgtcatgtgtcattag

SEQ ID NO: 114021 - DNA, 564 bp, Artificial Sequence
  Description of Artificial Sequence: Synthetic coding sequence
atgggatcatctcatattggcggactgtcgattaatgagcgtcggtgctccgctagtctgggactggtgatggccgagaatgacgtggacaacgaattgctggactatgaggacgacgaagtggaaacagcagccgggggggatggcgcagaggcaccagctaagaaagacgtcaaaggcagttacgtgtccattcactcttccgggttcagagacttcttgctaaaaccggaattgctgcgagctattgttgattgcggcttcgaacacccatccgaagtacagcatgaatgcatcccacaggcaatcctgggaatggatgttctttgtcaagctaaatcaggcatgggcaagaccgcagtgttcgtgctggccacacttcagcagctcgagcctgtcacaggacaggtgagtgtgctggtgatgtgtcacacaagagaattagccttccagatcagcaaggagtatgagagattctcaaagtacatgcccaacgtgaaagtcgcagtctttttcgggggactatcaataaaaaaggacgaggaggtgttaaaaaaaaactag

SEQ ID NO: 114022 - DNA, 399 bp, Artificial Sequence
  Description of Artificial Sequence: Synthetic coding sequence
atggcggagaatgacgttgataatgagcttctggattacgaagacgacgaagtggaaacagctgctggcggcgacggagcagaggctcctgccaagaaagatgtcaagggctcatacgtctctattcactcctcaggatttcgcgatttcctactgaaacccgaactcttgagagccatcgttgattgcggattcgaacatccatctgaggtgcagcacgaatgtattccacaggcgatattggggatggatgtgctctgtcaagccaaaagcgggatgggaaagacagctgtgtttgtccttgccacactgcaacaacttgagccagtcaccggccaggtatgtttttgtgatagccactttcctcgcggggataatgaggagctacaccttccttag

SEQ ID NO: 114023 - DNA, 870 bp, Artificial Sequence
  Description of Artificial Sequence: Synthetic coding sequence
atggccgagaacgacgtggacaatgagctgttagattatgaagatgatgaggtagagacggctgccgggggcgatggggcagaggcgcccgcaaagaaggacgtgaaaggcagttatgtgagcatccactcttcggggtttagggattttcttctgaagccggagctgctgcgtgctatcgtcgattgtggctttgagcatccctctgaagtgcaacacgaatgtatcccacaagcaatactggggatggatgtgctctgtcaagctaaatcagggatggggaagactgccgtgtttgtcctcgccactctgcagcagttagagcctgtcacaggccaagtgtcagtccttgttatgtgtcatacaagagaactggcatttcagatcagcaaggaatatgagaggttctccaagtatatgcccaacgtgaaggtggccgttttcttcggcggcctcagcataaaaaaagatgaagaagtcttgaagaagaactgtccacacatcgttgtgggaacaccagggcgcatcctggcgctggctcggaataagtctctgaatctgaaacacatcaaacattttatcctggatgaatgtgacaaaatgctcgagcagctggacatgagaagagacgttcaggaaatattcaggatgactccgcatgagaagcaggtgatgatgttttccgccaccctgtctaaagagatccggccagtctgtcgcaagtttatgcaggatcccatggagatctttgttgacgacgagaccaagcttactctccacggtctccagcagtactatgttaaactgaaggacaatgaaaaaaacagaaaactgttcgatctattagatgtgcttgaattcaaccagtag

SEQ ID NO: 114024 - DNA, 1287 bp, Artificial Sequence
  Description of Artificial Sequence: Synthetic coding sequence
atggcagagaacgacgtcgataacgagctgctcgactacgaggatgacgaggtcgaaactgcagctgggggcgatggtgctgaggccccagccaagaaggatgtgaaagggagctatgtatcaattcattctagcggtttcagagacttccttctgaaacccgagcttctccgggcaattgtggactgtggatttgagcacccctccgaagttcagcacgagtgtataccacaggccatattaggtatggatgtcctttgtcaggctaaatccgggatgggaaagacagctgtgttcgtgctggccacgctgcagcagctcgagcccgtgacaggacaggtcagtgttcttgtaatgtgtcacactcgggaactagcgtttcagattagtaaagaatatgagcgcttctcaaagtacatgcctaacgtcaaagttgcagtgtttttcggcggactctcaattaaaaaagacgaagaggtgttgaagaagaattgtccacatatagtcgtgggtactccagggagaattctggcccttgctcggaataagtccctcaatcttaaacatatcaaacatttcatcttggacgagtgtgacaagatgctcgagcagcttgatatgcggcgagacgtacaggagatcttcaggatgacgccacacgagaaacaggtaatgatgttctccgctactttaagtaaggagatacgacctgtttgcagaaagtttatgcaggatcctatggagatttttgtcgacgatgaaaccaaacttacactgcacggactacagcaatactacgtaaaattgaaagataatgaaaagaaccggaaacttttcgacttgctcgatgttctggagttcaaccaggtggttattttcgtgaaatcggtgcagcgctgcatcgccctggcccagctgttggtggagcagaattttccggccattgccatacaccgtgggatgccccaagaggaacggttaagccggtaccagcagttcaaggattttcagaggcggattctggtagccaccaacctgtttggtcgcggaatggacatcgagcgggtaaatatcgcctttaactatgatatgccagaggactccgacacctacttacatagagtggcccgagctggcagatttggcaccaaagggctcgctattaccttcgtaagtgatgaaaacgacgctaaaatcctcaacgacgttcaggatcggtttgaggtcaatatcagcgaactgccagacgaaattgacatatctagttacattgaacagacaaggtag

SEQ ID NO: 114025 - DNA, 564 bp, Artificial Sequence
  Description of Artificial Sequence: Synthetic coding sequence
atgggcagctcccacataggcggcctaagtatcaacgagcgtaggtgtagcgcctcgctgggtctggtgatggcggaaaacgacgtggacaacgaattgctggactacgaggacgatgaggttgagactgctgccggcggggacggggcagaggcacctgcaaagaaagacgttaagggctcttacgtctcaatccactcatccggtttcagagacttcttgttaaagcccgagctcttaagagccatagtggattgcggctttgagcaccccagcgaagtgcaacatgaatgcatccctcaagccattctagggatggatgtcttatgccaagccaagtcgggaatgggtaaaacagccgtctttgttctggcaaccctccagcagctggaacccgttaccggacaggtatccgtgttggtcatgtgtcacactagggagctggccttccaaatctcaaaggagtatgaacggtttagcaagtatatgccaaatgtgaaggttgccgtattttttggcggactgtcgattaagaaagatgaagaggtgcttaaaaagaactag

SEQ ID NO: 114026 - DNA, 291 bp, Artificial Sequence
  Description of Artificial Sequence: Synthetic coding sequence
atggctgaaaatgacgtcgataatgaactgttggattacgaagacgacgaagtggaaacagcagccgggggcgacggtgcagaggcacctgcaaagaaagacgttaaaggatcttatgtcagtattcacagcagcgggtttcgcgatttcctgctcaaaccagaactactacgcgccatcgtcgactgcggcttcgagcacccttcagaagtacagcatgagtgtattccgcaagcaatcctggggatggacgtgctgtgccaggcaaagagcggcatgggcaagacatag

SEQ ID NO: 114027 - DNA, 564 bp, Artificial Sequence
  Description of Artificial Sequence: Synthetic coding sequence
atgggctcatcccatatcgggggcctgtcaataaatgagaggcgctgttctgcctccttggggcttgtcatggccgagaatgatgtggacaatgagttgcttgattacgaagacgatgaggtggaaacggcagctggtggtgacggcgcggaggcgcctgccaagaaggatgtaaaaggctcttacgtctccatacattcaagcggattccgggacttcctcttgaagcccgaactactccgggccatcgtcgactgtggctttgaacatccaagcgaagtgcagcacgagtgcatccctcaggccatcctcggaatggacgtcctgtgccaggcgaagagtggcatggggaaaaccgccgtgtttgtgctagcaaccttgcaacaacttgaaccagtaacaggccaggtgtcagtgctggtgatgtgccatacacgtgagttggcatttcaaattagtaaagagtacgagcggttcagtaaatacatgcccaacgtcaaggttgcagtcttttttggcgggctgagcattaagaaagacgaggaggtactaaagaaaaattag

SEQ ID NO: 114028 - DNA, 594 bp, Artificial Sequence
  Description of Artificial Sequence: Synthetic coding sequence
atggccgagaatgacgtggataatgagctgctagactatgaggacgacgaggttgagactgccgccggaggtgacggcgctgaggcgcctgccaaaaaggacgtgaaagggtcatatgtgtccattcactcctctgggtttagagacttcctgttgaagccagagctgctccgcgcaatagttgattgtggctttgagcatccttcggaagtccaacacgagtgcatcccacaagccatcttagggatggatgtgctgtgtcaagctaaatccggtatgggtaagaccgccgtttttgtccttgccaccctgcagcagctggagccagtcactggccaggtgtgtttctgtgattcccatttccctagaggggacaacgaggagctgcatttgccgtacgtatcggtttatttcctccctaaagtgagcgttctcgtcatgtgtcatacacgcgaattagcatttcagatcagtaaggagtatgagcgcttctccaaatatatgcccaatgttaaggtagcagttttcttcggcgggctcagcatcaaaaaagatgaagaggtcctgaaaaaaaactgtcctcatatcgtgtag

SEQ ID NO: 114029 - DNA, 291 bp, Artificial Sequence
  Description of Artificial Sequence: Synthetic coding sequence
atggctgaaaatgacgtcgacaacgaactgctggattatgaagacgatgaggtcgagaccgcagctggcggcgatggggcagaggcccctgcaaaaaaggacgttaagggcagctatgtcagcatccactcgagcggcttcagggacttcctgctgaagccggaactgctgagggctatcgtcgactgcggtttcgaacatccgagtgaggttcagcatgagtgcatccctcaggctattctcgggatggacgtactgtgtcaagccaaatctggtatggggaaaacctag

SEQ ID NO: 114030 - DNA, 696 bp, Artificial Sequence
  Description of Artificial Sequence: Synthetic coding sequence
atggctgagaatgatgtggataatgagctccttgactatgaggacgacgaagtggagaccgcggcaggcggggacggggctgaggcccccgctaaaaaagacgtcaaaggatcttacgtaagtattcatagttcaggcttccgcgattttctgctaaagcctgaactactgagggctatcgtggactgcgggtttgagcatcccagcgaagtgcaacatgagtgcataccccaggcgattctgggcatggacgtcctgtgtcaagccaaatccggcatgggcaagaccgctgtgttcgtgctcgccaccctccaacagttagagcctgtaactggtcaagtgagcgtcctggtcatgtgccatacacgggagctcgcatttcagatctctaaggagtacgaacgatttagcaagtatatgcctaacgtgaaagtcgccgtttttttcggaggtctgtccattaagaaggacgaggaagtgctcaagaaaaattgcccgcacatcgtagtggggacgccgggacgcatcctggcactcgctcgtaacaaatcactgaacttaaaacatattaagcactttatactggatgaatgtgacaagatgctggaacagctggacatgaggagagacgtgcaggaaattttcagaatgacaccccacgagaaacaggttatgatgttctcagcaacactatag

SEQ ID NO: 114031 - DNA, 696 bp, Artificial Sequence
  Description of Artificial Sequence: Synthetic coding sequence
atggcagaaaacgacgtggacaacgagctcctggactatgaagatgacgaagtcgaaactgccgccggtggggatggcgcagaggcacctgctaagaaggacgtaaagggtagctacgtgtctatccattcatccggctttcgggacttcctactgaagccagaattactgcgggcgattgttgattgtggcttcgaacatccaagtgaagtgcaacacgaatgcatcccacaagccattcttgggatggatgtgctgtgtcaagctaaaagcggaatgggtaagactgcagtcttcgttctggctacactgcaacagctagaacccgtgacagggcaggttagcgtgctcgttatgtgccacacgagggagttggcatttcagattagcaaagagtacgagaggttcagcaaatacatgcctaatgtgaaggttgcagttttcttcggagggctgagtattaaaaaggacgaggaggtactgaagaagaactgcccccacatcgtggtgggcactcctggccggattctcgctcttgcaaggaataaatcactcaatctgaagcacatcaagcacttcatccttgacgaatgtgacaagatgctcgaacagcttgacatgcgcagagatgttcaggagatctttcgcatgaccccccacgaaaaacaggtaatgatgtttagcgcaacactctag

SEQ ID NO: 114032 - DNA, 717 bp, Artificial Sequence
  Description of Artificial Sequence: Synthetic coding sequence
atggctgagaatgacgttgacaatgagttgttggactacgaggacgacgaggtagaaaccgcagctggcggggatggagccgaagccccggctaaaaaagacgttaaaggttcttacgtgtccatccattcatcgggttttcgagacttcctgctgaaaccggagctattgcgtgcgattgtcgattgcggattcgaacacccgtccgaagttcagcacgaatgtatccctcaggcgatactgggtatggacgtgttgtgtcaggctaagtctgggatgggcaagaccgccgtattcgtgcttgccaccttacagcagctggaaccggtaaccggacaagtgtcagtgctggtcatgtgccacacacgggaattggccttccaaatttccaaggagtatgaaaggttttcaaaatacatgcctaacgtgaaagttgccgtcttttttggcgggctgtctattaaaaaagatgaggaagtgctgaagaagaactgcccgcatattgtggtgggtactccaggacgaatcctggccctggccaggaataaaagcctgaatttgaagcacatcaagcacttcatactggatgagtgtgacaagatgttagaacagctggatatgcggagagacgtacaggagatattcagaatgactcctcacgagaagcaggtgatgatgttttctgccaccctgtcaaaggagatcaggcctgtgtag

SEQ ID NO: 114033 - DNA, 1287 bp, Artificial Sequence
  Description of Artificial Sequence: Synthetic coding sequence
atggccgaaaacgatgtcgataacgaactcctggactacgaagatgacgaggtggagactgccgcgggcggggacggagccgaggctccggccaaaaaagacgtgaaggggtcttacgtttcaatccatagcagtggttttagggactttctgcttaagcccgagttgctaagagccatcgtggactgcggtttcgaacacccatctgaagtccaacacgaatgcatcccgcaggcgatcctgggaatggacgtcttatgtcaggctaaaagcggcatggggaagaccgctgtgttcgtgctcgcgactctgcagcaactggaacccgtaaccgggcaggtgtccgtgctggtcatgtgtcacactagggaattggcctttcagatttccaaagagtacgagaggttcagcaaatacatgccgaacgttaaagtggcagtttttttcggcgggttaagtatcaagaaggatgaagaggtgctaaagaagaactgtcctcatatcgtcgtcggaactcccggccggattctcgctctggcgaggaataagagcctgaacttgaagcatatcaaacacttcatcctggacgagtgcgataagatgctggaacaactagacatgaggagggatgtacaggagatcttcagaatgactcctcatgagaaacaggtcatgatgttcagtgccacgcttagtaaggagattcgcccagtctgcagaaagttcatgcaagatcccatggagatatttgtggatgatgagacgaagcttacactgcacggactacagcagtattatgtgaagctaaaggacaacgagaagaacagaaagctgttcgacctgttggatgtgctcgaattcaaccaggtcgtgatcttcgtcaagtcagtgcaacgctgtatcgccctggctcagcttctggtggaacagaacttcccagctattgcaatccaccgtggcatgccacaagaagagcgccttagtcgctaccagcagtttaaagacttccagagaagaatcctagtagcgaccaatctgttcggtcggggaatggacattgagcgagttaatatcgcgtttaactatgatatgcccgaggacagcgacacttatctgcaccgggtcgcccgagccgggcgatttggaaccaagggtctggcaatcactttcgtaagtgacgaaaacgatgccaagattttgaatgacgtgcaagatcggtttgaagtaaatattagcgaactgcccgacgagatagacattagcagctatatagagcaaacacgctag

SEQ ID NO: 114034 - DNA, 564 bp, Artificial Sequence
  Description of Artificial Sequence: Synthetic coding sequence
tgaagtgaagaacgggacattgggaagcccatggagatcttcgtcgacgacgagacaaaactgacgttacacgggctgcagcagtattatgtcaaattaaaagacaacgaaaaaaataggaagcttttcgaccttctggatgttctcgagttcaaccaagtcgtgattttcgtgaagagcgtacagagatgcatagctctagcccagctcctggtcgagcagaattttcccgcgatcgccatccaccgggggatgccccaggaggagcggctgagccggtaccagcagtttaaagacttccagcgcagaatcctggtagctacgaacctgtttggaagaggaatggacattgagagggttaatatcgctttcaactacgacatgccggaagattcagacacttacctgcatagagtcgcacgcgccggacggtttggcactaagggattagccattacctttgtgtcagatgagaatgatgccaagatcctgaatgatgtgcaagatcggttcgaggtcaatatttccgagttgccggatgaaattgacatttcttcgtattag

SEQ ID NO: 114035 - DNA, 564 bp, Artificial Sequence
  Description of Artificial Sequence: Synthetic coding sequence
atgggcagtagccacatcggaggcctatcgatcaacgagcgccgatgttctgcctcgcttggtctcgtcatggctgaaaatgacgtcgacaatgaactcctagactacgaggacgacgaggtggagaccgccgccgggggtgacggcgcagaggccccggccaagaaggatgtgaaaggctcctacgtctcaattcattcttcgggctttcgggacttcctgttgaagccagagctgctgcgcgctatcgtggattgcgggtttgagcacccttccgaggttcagcacgaatgcattcctcaggcgattctgggtatggacgtgctttgccaagcaaaatccgggatgggtaaaaccgccgtgttcgtgctggcaacactgcaacagctcgagcctgttaccggacaagtgagcgtattagttatgtgccacacacgggaattagcattccagattagcaaggagtatgagcgttttagcaaatacatgcctaacgtaaaagtggccgtgtttttcggaggcctgagtattaagaaggacgaagaggttctgaaaaagaactag

SEQ ID NO: 114036 - DNA, 717 bp, Artificial Sequence
  Description of Artificial Sequence: Synthetic coding sequence
atggcagaaaacgacgttgataatgagctgcttgattatgaagatgacgaagtggaaacagctgccggcggcgatggcgccgaggcaccggccaaaaaggacgtgaaggggtcatacgtgtcaatacattcaagcgggtttcgcgatttcctgctgaaacccgaattgttacgcgcgattgttgactgtggattcgagcatccctccgaggttcaacatgagtgcattcctcaagctatcctgggtatggatgtcctgtgccaggctaagtccggcatgggcaaaacagccgtttttgtgttggcaaccctccagcagctcgagcctgtcacaggtcaggtctccgttctggtgatgtgccataccagggagctggcttttcagatctccaaggagtatgaacgattttccaaatacatgcccaacgtaaaagtcgcagtattcttcggtggacttagcatcaaaaaagatgaagaagtcttaaaaaagaattgtccacacattgttgtggggacccctggcagaatcctggctctagctaggaataagagcctgaatctcaaacatattaagcacttcatcttggacgagtgtgataagatgctggaacagttggatatgcggcgcgacgtgcaggagatcttcaggatgacaccacacgagaagcaagtcatgatgttctctgcaactttgtcgaaggaaatccgccccgtgtag

SEQ ID NO: 114037 - DNA, 738 bp, Artificial Sequence
  Description of Artificial Sequence: Synthetic coding sequence
atgtggaccatgagctcctggaccatgaaaatgatgcgctggcggcagcaactaggtgagatgggcctcaggcccttaccgagacgtatgtctagggcacccatgagcccctctacagcacttgcatttgtcacatcctgcagcagccagtcatgttcagggcccctgagcacagttgctctgagtatcaggcagaaggtcgcagttttctttggggggttaagcataaagaaagacgaggaagttctcaagaagaactgtccccacattgtcgttggaacccctgggagaattctcgccctggcgagaaacaagagcctgaatctgaagcacatcaaacacttcattctagacgaatgtgacaaaatgttggaacagttagacatgaggcgcgatgttcaggagatcttccgcatgacgccacatgagaagcaggtgatgatgttctccgcaacattgagcaaagagattagaccagtgtgccgcaaatttatgcaggacccaatggagatttttgtggacgacgaaacaaagcttaccctgcacggcctgcagcagtattacgtgaagctgaaagataacgagaaaaataggaaactcttcgacctcttggacgtgctggagttcaaccaggtggttatcttcgttaagtccgtgcagaggtgtattgccttagcccagctcctggttgagcagaattttcctgcaatcgctatacaccgcggcatgccccagtag

SEQ ID NO: 114038 - DNA, 1278 bp, Artificial Sequence
  Description of Artificial Sequence: Synthetic coding sequence
atggccgaaaacgatgttgataacgagctgttggactatgaggacgatgaggtcgaaacggccgctggaggtgatggcgcggaggcccctgcaaagaaagacgtaaaaggtagttatgtatccatacactctagcgggtttagagactttctgcttaaaccagagctcctaagagctattgtggactgtgggtttgaacaccccagcgaggtgcagcacgaatgtattccccaggcaatcttgggcatggacgtgctctgtcaggctaagagtggaatgggtaagactgccgtcttcgtcctcgctaccctacagcagttggagcctgtcactggtcaggtatccgtcctagtgatgtgccacacccgagaattagcatttcagatatcaaaagaatatgagcggtttagcaagtacatgcctaatgtgaaagtcgccgtgttcttcggcggactgagcatcaagaaggatgaggaagttctgaagaaaaattgcccccatatcgtggtgggtacacctgggagaatactagcgcttgcgaggaataagtctctcaacctgaaacatataaaacattttatcctagacgaatgtgacaaaatgcttgaacagctggacatgagaagagacgtccaggagatttttcgcatgactccgcatgagaagcaggtgatgatgttttcggcaaccttaagcaaggagatcaggccagtctgtcggaagttcatgcaggaccctatggaaatctttgttgatgatgagaccaaactgaccttacatggcctacaacagtattatgttaaactgaaggacaatgagaagaaccggaaactgttcgacctgctcgatgtgcttgaatttaaccaggtggtgatcttcgtcaagtctgtgcagaggtgcattgccttggcccagctccttgtggaacagaactttcccgccatagctatccaccggggtatgcctcaggaagagcgcctgtcccggtatcaacagttcaaagactttcagcgccgtattctagtagcaaccaatctgttcggcagggggatggacattgagcgggtgaacatagccttcaactatgatatgccggaggatagcgatacttacctccatagatgttatccccttagtccttcaagatggcccgagcaggccggtctggctccccgggcctggctcagtcatctgtgtcctatgagaatgatgccccgcagcagcatgatgtgcagaatcgctcttcggagtatcttagtgagctgcctcatgcgttag

SEQ ID NO: 114039 - DNA, 711 bp, Artificial Sequence
  Description of Artificial Sequence: Synthetic coding sequence
atggcggaaaatgacgtagataacgaactgctggactatgaagacgacgaagtcgagacagccgccggcggagacggagccgaagctccggccaagaaggacgtgaagggctcttatgtgagcattcattccagcggtttcagggatttcctgctcaagccagagctgctgagagccatagttgactgtgggttcgagcatcccagcgaggtgcagcatgagtgcatcccacaggctatcctggggatggatgttctctgtcaggctaaatctggaatgggaaaaacagctgtatttgttctggcgaccctgcaacagctggagccggttacggggcaggtgagcgttttggttatgtgccacacccgcgagctggcctttcagatcagtaaagaatatgagcggttttcaaaatatatgccaaatgtgaaggttgccgtcttctttgggggcctgagcataaagaaggacgaggaggtgttaaaaaaaaattgtcctcatatcgtggtgggaaccccaggccgcatactggcacttgcacgcaacaagagcttgaatttaaaacatattaagcattttatactggatgagtgcgataagatgctggaacagcttgatatgcgcagggatgtccaagagatattccgaatgaccccacacgaaaagcaggtgatgatgtttagtgccacattgtctaaagagatccggtag

SEQ ID NO: 114040 - DNA, 738 bp, Artificial Sequence
  Description of Artificial Sequence: Synthetic coding sequence
atgtggactatgtcttcctggacaatgaagatgatgagatggcgacagcagcttggagaaatgggactgcggcctctgccaagacgcatgagccgcgccccaatgagtccttcaacagctctggccttcgtgacctcatgctcctcacagagctgcagcggtcccctgagcacggtcgctctttccattaggcagaaggtggccgtctttttcggagggctgagcatcaagaaggatgaagaggtgttgaagaagaattgtccccacattgtggtgggcacaccaggtagaatccttgccctcgcaaggaacaagtccctgaatttaaagcatatcaaacatttcatcctcgatgagtgcgataagatgttagagcagctggacatgagacgcgatgtgcaggagatattcaggatgaccccgcacgagaaacaggttatgatgttcagtgcaaccctctcaaaagagattagacctgtatgtcgtaaattcatgcaagatccaatggaaattttcgtggatgatgaaacgaagctgacactccatggcctgcaacaatactatgtgaaactaaaggacaacgagaaaaacaggaaactgttcgacctattagatgtgctggagtttaaccaggtggtgatcttcgtcaagtcagtgcagagatgtattgctcttgcccagctactcgtagaacagaactttcccgccattgctatccatcgtggcatgcctcagtag

SEQ ID NO: 114041 - DNA, 1287 bp, Artificial Sequence
  Description of Artificial Sequence: Synthetic coding sequence
atggccgaaaatgacgtagacaacgaactcttggattacgaggatgatgaggtggaaactgccgccggtggtgacggagcagaagccccagccaaaaaagatgttaaaggaagctatgtgagcatacattcttccggttttagggatttcttattgaagccagagctgctccgggctattgtagactgcggcttcgagcacccttcggaggtgcagcatgaatgtatccctcaggccatactcggaatggatgtcctgtgccaggccaagagcggtatgggcaagactgctgtcttcgtgcttgccactctgcagcagctggagcccgtgaccggccaagtgagcgtgctcgtgatgtgtcatacgagggaactggccttccagatctccaaagagtacgagcgctttagcaaatatatgcccaatgttaaggtcgctgtgttctttggcggcctgtcaatcaagaaggacgaagaagtgcttaaaaaaaattgcccccacattgtggtgggaacccctggtcgcatcctcgcgctggctcggaataagagtctgaacttaaaacatattaagcattttatcttggacgagtgcgataaaatgctcgaacagctggacatgcgtcgagacgtgcaagaaatctttaggatgactccccacgagaaacaggtgatgatgttcagcgcgacacttagtaaggaaattcggcccgtatgcagaaaattcatgcaagacccaatggaaatttttgtggacgacgagacaaaactcaccttgcacggactccagcagtactacgtgaaactgaaagataatgagaaaaatcgaaagctgttcgatctgttagatgttctggaatttaaccaggtcgtcatcttcgtcaagagtgtacagaggtgcattgcgctggcacagcttctggtcgagcagaactttcccgccattgccattcatagggggatgccacaggaagaacggcttagccgctatcagcagtttaaggactttcagagacgaattcttgtcgccacaaatctgtttggacgcggtatggacattgaacgcgtgaacatcgcttttaactacgatatgccagaagattccgacacttatttacaccgggttgcccgggccgggcgattcggaacaaaaggcttggcaattacattcgtgagcgacgaaaacgacgccaagattttgaacgacgttcaggacaggtttgaagtgaatatttcagaacttccagacgaaattgacattagcagctacatcgaacagactaggtag

SEQ ID NO: 114042 - DNA, 411 bp, Artificial Sequence
  Description of Artificial Sequence: Synthetic coding sequence
atggggggaggccggaggccttacgacgtttttttcagcaaagtcatggccgaaaacgacgtcgataacgagttactcgactacgaagacgacgaggtggagacggcagccggaggtgacggcgctgaggctcctgccaaaaaggatgtcaaaggttcctatgtgagcattcatagctccgggtttcgggatttcctgctgaagcccgaactcttacgcgccatcgtggactgcgggttcgagcatccatccgaagttcagcacgagtgtataccccaggctatcctcggaatggatgtgctctgtcaggccaaatccgggatggggaagacggccgtctttgtgcttgccactctgcagcagctggagccggttacaggacaggtgtccgtgctggtgatgtgccactag

SEQ ID NO: 114043 - DNA, 987 bp, Artificial Sequence
  Description of Artificial Sequence: Synthetic coding sequence
tgagccacgttgcagcagctcgagccagtgaccggtcaggtgtcagtacttgtgatgtgtcatacacgcgaactcgcctttcagatatccaaagaatatgaacgtttcagtaagtatatgcccaacgtgaaagtcgccgtgtttttcggcggattaagcatcaagaaggatgaggaagtgctcaagaagaactgtccacacatagtagttggcactccaggccggattctcgccctggcaagaaacaaatctttaaacctgaagcatatcaaacactttatcctagatgagtgcgacaagatgctggaacagctggatatgaggagagatgttcaggagatattcagaatgaccccccacgaaaagcaagtgatgatgttttccgctaccctgtctaaagagatccgcccagtgtgtaggaagtttatgcaggatccaatggagattttcgttgacgacgaaacaaagctaacactccacggcctgcagcagtattatgtcaaactgaaagacaatgaaaaaaatcgtaagctcttcgacctgctggacgttcttgagtttaaccaagtggtgatatttgtcaagtcagtgcaacggtgcatcgctttggcccaactcctcgtcgaacagaacttcccagcaattgcaatccacagaggaatgccacaggaagagcgtctatctagatatcagcagttcaaggattttcagcgaaggatcctggtggcaactaacctttttggcaggggaatggacattgaacgagttaatatcgccttcaattatgatatgccagaggatagtgacacctacttacaccgcgtggctagagcagggcgcttcggtaccaaaggtctggccatcacttttgttagtgatgaaaacgacgccaaaattttgaatgatgtccaggacagattcgaggtgaatatcagcgaactgcctgacgaaattgatattagttcatatattgagcagacccggtag

SEQ ID NO: 114044 - DNA, 399 bp, Artificial Sequence
  Description of Artificial Sequence: Synthetic coding sequence
atggctgagaacgacgtggataacgaactgcttgactacgaagatgacgaggtcgagacagcagcaggcggagacggcgccgaagcccctgccaagaaggacgttaagggctcctatgtgtccatacatagctctggcttcagagatttcttattaaaacccgaacttctcagggcaattgtcgactgcggctttgaacatcctagcgaggtacagcatgagtgcatcccccaggccatacttgggatggatgtgctctgtcaagcaaagtccggtatgggcaagacggccgtcttcgtgttggcaaccctgcagcagttggagcccgtgactggccaggtgtgtttttgcgacagtcactttccgcgaggtgacaacgaagagctgcacctcccttag

SEQ ID NO: 114045 - DNA, 420 bp, Artificial Sequence
  Description of Artificial Sequence: Synthetic coding sequence
atggcagaaaacgacgtcgataacgagctgctcgactacgaggacgacgaagtcgagaccgctgctggaggtgatggtgccgaggcacctgccaaaaaggatgtaaaaggctcgtatgtgagcattcatagctcaggcttcagagacttcttactgaagcctgaactgctaagggcgattgtggactgtggattcgagcacccctccgaggtgcaacacgaatgtatccctcaagccatcttaggaatggacgtcctgtgtcaggctaagagtggaatgggtaagacagcggtgttcgtgctcgccaccctgcaacagttggagcccgtaacaggtcagtcacatgagcacatgaccagtgtgacactcgataacctcaccgctgtgggagacgtgctgagccaagcctggggctcttag

SEQ ID NO: 114046 - DNA, 717 bp, Artificial Sequence
  Description of Artificial Sequence: Synthetic coding sequence
atggctgagaacgacgtggataacgagctcctagattacgaggatgatgaggtggagacagccgccggcggggacggggccgaggcacccgccaagaaagacgtgaaaggatcctacgtatcgatacattcctctgggtttcgcgacttcctcctgaagccagagctcctcagagccattgtggattgcggctttgagcatccgtccgaggtccagcatgagtgcattccccaagccatcttgggcatggacgtactttgccaggccaagtctggtatgggaaaaacagcagtgtttgtccttgccacactgcagcagttagagcccgtgaccggtcaggttagcgtgctcgttatgtgccacactagggagctggcatttcagatttccaaggagtatgagcgattcagcaagtacatgcccaatgtgaaggtcgctgtgttcttcggaggactgagtattaaaaaggatgaggaggtgttgaagaaaaactgcccacacattgttgtgggcacccctggaagaatcctcgctctggcccggaacaagtctttaaatttgaaacacattaaacatttcatccttgacgaatgcgataagatgctggaacagctggacatgcgcagggacgtccaagagattttccggatgactcctcacgagaaacaggtcatgatgttctccgcaaccctgagtaaggaaatcagacctgtgtag

SEQ ID NO: 114047 - DNA, 564 bp, Artificial Sequence
  Description of Artificial Sequence: Synthetic coding sequence
atgggatcctcgcacattggaggattaagcatcaacgagaggcgacgctccgccagcttaggcctagtgatggctgaaaatgatgtcgataacgaactgctggactatgaggacgacgaggtcgaaaccgcggctggcggggatggggcagaggctccagccaaaaaagatgttaaaggcagttatgtgtcaatccattcaagcgggttccgggactttttgctcaagccagagctgttacgggcaattgtggattgcgggtttgaacacccaagcgaagttcaacatgagtgcatcccacaagccatattgggaatggacgtgctgtgccaggcaaagtccggtatgggcaaaactgccgttttcgtgctagccactctgcagcagttggaaccggtgactggccaggtgagtgtcttggtgatgtgccacacacgggagctcgccttccaaattagcaaggagtatgaacgatttagtaaatatatgcctaacgtgaaggttgccgtcttttttggcgggctctcaattaagaaagacgaagaggtgctcaagaaaaactag

SEQ ID NO: 114048 - DNA, 711 bp, Artificial Sequence
  Description of Artificial Sequence: Synthetic coding sequence
atggcagagaacgatgtggataacgagctgctggactacgaggacgatgaagttgagacagccgcaggcggggacggagccgaagccccagctaaaaaggatgttaaagggtcctacgtttctatccatagttctggattcagggatttcctgctcaaacccgagctcctacgtgccatcgtcgactgtgggtttgagcacccctctgaagtgcagcacgagtgcatcccccaagcgatcctcggaatggatgtcttatgtcaggctaagtcaggaatggggaaaacggccgtgtttgtcctggcaactctccagcagttagagcctgtcacaggacaagttagcgtcttggtcatgtgccatacaagggagctcgcatttcagatctcaaaagagtatgaacggttctctaagtacatgcccaacgtgaaagtcgctgtcttcttcggcggattgtccataaaaaaagacgaagaggtcttaaagaagaactgtcctcacattgttgtgggaacccccgggaggatactggcactggcgcgaaataagtccttgaacctcaagcatattaaacactttatcctagacgaatgtgataagatgcttgaacaacttgacatgcgcagggacgtacaggaaatcttccgaatgacgccccacgagaaacaggtcatgatgttctctgccacgctttcgaaggagattcgttag

SEQ ID NO: 114049 - DNA, 1278 bp, Artificial Sequence
  Description of Artificial Sequence: Synthetic coding sequence
atggccgagaacgacgtggataacgaactgctggactacgaggacgacgaggtcgaaaccgctgccggcggggacggagcagaagcacccgctaagaaagacgtgaaaggaagctatgtgagcatacacagctccggctttcgcgattttctgttgaaacccgaactgttacgggcaattgtggattgtggcttcgagcacccctcggaagttcagcacgagtgtatccctcaggccatcttgggaatggacgtcctgtgccaagctaagtcgggcatgggaaagactgccgtatttgtattggccaccttacagcagctagaacccgtgaccggacaagtctcggttctggtgatgtgccatacaagagagcttgcatttcagattagcaaagaatatgagaggttcagcaagtatatgccaaacgttaaggtggccgtgttctttgggggcttgtcgatcaaaaaagatgaggaggtgctcaaaaaaaattgcccacatatagtggttggtacccctggaaggattctcgcattagctagaaacaagagcctcaatcttaagcatatcaaacacttcattctggacgaatgtgacaaaatgttggaacagctcgacatgcgccgagacgtccaagagatttttcggatgacaccacacgaaaagcaggtcatgatgttcagtgctacactctctaaggaaatcagacctgtgtgtaggaaattcatgcaggaccccatggagattttcgttgacgacgaaacaaaactaacactgcatgggttacagcagtactacgtgaaattaaaagacaatgaaaagaataggaagcttttcgatctcctagacgtccttgagttcaaccaggtagtgatctttgtgaagagcgtgcagcggtgcattgcacttgctcagctcctagtcgagcaaaatttcccagcgattgccattcatcgaggcatgccacaagaagagagactgagccgttatcagcagtttaaagactttcagcgccgcatcctggtcgccacaaacctgttcggccgaggaatggatatagaaagagtgaacattgcattcaactatgatatgccagaagactcggatacttaccttcaccggtgctatccactatctcctagtcggtggcctgaacaagcgggactggcgcccagggcatggctgagtcacctttgcccaatgcggatgatgccccgatccagcatgatgtgcagaatcgctctgcggagtatacttgtctcctgtctcatgcggtag

SEQ ID NO: 114050 - DNA, 696 bp, Artificial Sequence
  Description of Artificial Sequence: Synthetic coding sequence
atggcggaaaacgatgttgataatgagctcctggactacgaggacgacgaagtggagaccgcagcagggggcgacggcgctgaagccccggcaaaaaaggacgtgaagggatcctacgtcagcattcatagttccggctttcgcgacttcctcctgaaaccagagcttctccgcgcaatcgttgactgcggtttcgaacaccccagcgaggtgcagcacgagtgtatccctcaggccatcctgggaatggacgtgctctgtcaagctaaatccggcatgggcaagacggccgtatttgtattagccactctccagcagctcgagcccgtcaccggacaagtgtcggtcctggtaatgtgtcatacacgcgaactcgcatttcagataagcaaggaatatgaacggtttagcaaatatatgcccaacgtaaaagtggctgtcttcttcggcggcttgtctatcaaaaaggacgaagaggtgctgaaaaagaactgccctcacatagtggtcggcacacccggaagaatactggccctggcgagaaataaatctttaaacctgaaacatatcaagcattttattttggatgaatgtgacaagatgctggagcagttggacatgcgcagggatgtacaggagatatttcggatgacccctcacgagaagcaggttatgatgttctcagccacactctag

SEQ ID NO: 114051 - DNA, 99 bp, Artificial Sequence
  Description of Artificial Sequence: Synthetic coding sequence
taagcgaccctccagcagctggagccagttactgggcaggtttgtttctgtgattcccattttcctcggggtgataatgaggagctgcacttgccctag

SEQ ID NO: 114052 - DNA, 399 bp, Artificial Sequence
  Description of Artificial Sequence: Synthetic coding sequence
atggcggagaacgacgtagataacgaattactcgactatgaagatgacgaggtcgagaccgctgccggcggcgacggagccgaggcacccgctaaaaaggatgtgaaagggagttacgtgagtatccactcatccgggttcagagatttcctgctgaagcccgaacttttgagggccatcgtggactgtggattcgagcacccaagcgaggtgcagcacgagtgtatcccccaggcaattctggggatggacgtcttatgccaggccaaaagcggaatggggaaaacggccgtcttcgtgctggccaccctgcagcaactagaaccagtgaccgggcaggtgtgcttttgcgactctcacttcccccggggggacaacgaagagcttcacctgccatag

SEQ ID NO: 114053 - DNA, 399 bp, Artificial Sequence
  Description of Artificial Sequence: Synthetic coding sequence
atggcagaaaacgacgtagacaatgagttgctcgactacgaggatgatgaggtcgaaacagctgcaggaggcgatggagcggaagcacctgccaagaaggacgttaaaggctcatacgtgagcatccactccagcgggttcagggactttctgctaaaacctgagctgctgcgtgctattgtggattgtggctttgaacacccttctgaggtccagcacgagtgcatcccccaagccatcctgggtatggatgtcctctgtcaagcgaagtccggcatgggaaaaactgccgtgtttgtgctggccaccctgcagcagctggagcctgttaccgggcaagtatgtttttgcgattcacatttcccgcgaggcgataatgaggagctgcacttgccatag

SEQ ID NO: 114054 - DNA, 738 bp, Artificial Sequence
  Description of Artificial Sequence: Synthetic coding sequence
atgtggaccatgtcctcgtggactatgaagatgatgaggtggaggcagcagttaggcgaaatgggcctccgacctctgcccagaagaatgagcagggctccaatgtcgcctagtaccgccttggcattcgtgacaagctgctcctcacagtcatgctctggacctctgtccactgtggctctgtctattcgccaaaaagtcgcggtcttcttcggggggttgtccattaagaaggacgaggaggtcctgaagaaaaactgccctcacattgtcgttggcaccccaggtagaattctggctctggcaagaaacaaaagtctgaacctgaagcatataaagcactttatcctggatgaatgcgacaagatgctcgagcaactggacatgcggagagatgttcaggaaattttcagaatgactcctcacgagaagcaggttatgatgttctccgcaaccctgagcaaagaaatccggcccgtatgccgcaaatttatgcaagatcccatggagatattcgtggatgatgagacgaagctgactctacacgggctccagcagtattacgtaaagctgaaggataatgagaaaaacaggaagctgttcgacctgcttgacgtgttggagttcaaccaggtggttatattcgtgaagtctgtgcaaaggtgtatcgcactcgcacagctgctggtggagcaaaacttccctgctatagccatccatcgggggatgccccaatag

SEQ ID NO: 114055 - DNA, 696 bp, Artificial Sequence
  Description of Artificial Sequence: Synthetic coding sequence
atggcagagaatgacgtagataatgaacttctggattatgaagatgacgaggtggagaccgccgccgggggcgacggcgctgaggcccctgctaagaaagatgttaagggaagctacgtctctatccattcaagcggcttcagagactttcttctgaagcccgagctgttacgagccatagtggattgtgggttcgagcacccgtcagaggtgcaacatgagtgtatcccacaagcaattctgggcatggatgttctctgtcaagctaagtccggaatgggcaagaccgctgtgttcgtattggcgaccctgcaacagctcgagcctgtaaccggccaggtctccgtgttggtgatgtgccacacacgcgagctggcctttcaaataagcaaagagtatgaacggttcagtaagtacatgcctaacgttaaagtggccgtgttttttggaggactaagtatcaagaaggacgaagaggtcctgaagaagaactgcccacacattgtcgtgggtacccccggaaggatccttgcactggcgaggaataagtcattgaatctgaaacatataaagcactttatcctggacgaatgtgacaaaatgttggagcagctcgatatgcggagagacgtccaagaaatctttagaatgactcctcacgaaaaacaggtgatgatgttcagtgccaccctctag

SEQ ID NO: 114056 - DNA, 732 bp, Artificial Sequence
  Description of Artificial Sequence: Synthetic coding sequence
atgtggaccatgagcagctggactatgaaaatgatgaggtggcgacagcagttgggagagatgggccttaggcctcttcccaggcgcatgagcagagccccaatgagcccgagcacagcactggccttcgtcacttcatgctctagccagagctgttccggccccctgagtaccgtggcattatcaattcggcaaaaagtctcagtcctggtaatgtgtcacacccgtgagctggcttttcagatctccaaagagtacgaaagattcagcaagtatatgcctaatgtaaaagtagccgtcttcttcgggggcttatccatcaagaaagacgaggaggtgttgaagaagaactgcccgcacattgtggtggggacccctggaagaattctggcactggctagaaacaagagcctcaacctgaaacacataaaacacttcattttggacgagtgcgacaaaatgttggaacagctagacatgagacgggacgtgcaggagatttttcggatgactcctcatgaaaaacaggtaatgatgttctcagccaccctgtctaaggaaattcgtccggtgtgtcgaaagttcatgcaggacgtcaacacactgctcccgagtctgccgccgctccccgcaaggtgcctgctgccattcctggcacttttccttagactgccatgtcattcatcagccaaaaaggctgcctgcgcccagctgggcgtgatgaccccttag

SEQ ID NO: 114057 - DNA, 1287 bp, Artificial Sequence
  Description of Artificial Sequence: Synthetic coding sequence
atggcagagaatgacgtggataacgaactgctggactacgaggacgacgaggtagaaactgccgccggcggcgatggcgccgaggctccagcgaaaaaagacgttaaaggtagttatgtgagcattcattcctctggattccgcgattttctgctgaagcctgaactgctgagagcaatagttgattgcggattcgagcacccttcagaggtgcaacacgagtgtattcctcaggccatcctgggcatggatgtcctttgccaggcaaaatctggcatgggcaagaccgcagtgttcgtgctagcaacactgcagcagctggagcctgtgacagggcaggtgagtgtcctcgtcatgtgccacacaagggagctggccttccagatttccaaagagtatgaacggtttagtaaatatatgcccaacgtgaaggtggccgtgttcttcggggggctgtccattaagaaagacgaggaggtgctgaagaagaactgtcctcacatcgtagtgggaaccccaggacgcatcctggctctcgctcgaaataaaagtcttaatctaaagcatatcaagcatttcatcttggatgagtgcgacaaaatgcttgagcagttggatatgcgaagggatgtgcaagaaatcttccgtatgactccccacgagaagcaagtcatgatgttctccgccaccctgtccaaagagatacggcctgtgtgccgaaagttcatgcaggatccaatggaaatatttgttgatgatgagactaaactcaccctccatggtttgcagcagtactacgtaaaactgaaggataacgaaaaaaatcgcaaacttttcgacctgctggatgtgttagagtttaatcaagtggtgattttcgtgaagtctgtccagagatgtatagcacttgcccaactgcttgtagagcagaatttccccgctattgccattcatagaggaatgccccaggaggagcgcctatcccgttatcagcaatttaaagactttcagagaagaattctcgtagcgaccaatctgttcggacgcggtatggacattgagcgtgttaacatcgcctttaattacgatatgcctgaggactccgatacctatctgcaccgcgtcgcacgagccgggcggttcggcaccaaaggcttagccatcacgttcgtgtccgacgagaacgacgccaagatcctgaatgatgtacaggaccggtttgaggtaaatatcagcgaactgccggacgaaatcgatatcagcagctatatagagcaaacaaggtag

SEQ ID NO: 114058 - DNA, 1278 bp, Artificial Sequence
  Description of Artificial Sequence: Synthetic coding sequence
atggctgagaacgacgtcgacaacgagctactggactatgaggacgacgaggttgaaacagccgcaggcggtgacggagccgaagctcccgctaagaaagatgtcaagggaagttacgtctctatacatagttctggatttcgcgacttcttgctcaaaccagagctactgagggccatcgtagactgcggattcgagcacccctcggaggtgcaacacgagtgcattccacaggccatactggggatggatgtgctgtgccaggccaagtctggaatgggcaaaacagcggtgtttgtgctggccaccttacagcagctagaaccggtgacaggccaggtatctgtgctcgtgatgtgccacacgagggaactcgcgtttcaaatttccaaggagtacgagagatttagcaaatacatgcctaacgttaaggtggccgtctttttcgggggactgtctatcaagaaagatgaggaagtactgaaaaaaaactgccctcacattgtggtcggcacgccaggtcgaatattggccctcgcccgtaataaaagtcttaatctcaaacacataaagcatttcattcttgacgaatgcgacaagatgctagagcaactggacatgagacgcgatgtgcaagaaatcttccggatgacccctcacgaaaaacaggttatgatgttttccgctacactctctaaggaaattcgaccagtgtgtagaaagtttatgcaagaccctatggagatcttcgtggacgacgaaactaagctgacactgcacggcttacagcagtactacgtaaagctgaaagacaatgagaagaatagaaagctgttcgacttactggacgttctggaattcaatcaggtcgtcatcttcgtgaagtcggtccagcgatgtatagcactggcccagctactggtggagcaaaattttccagccattgctatccatcgaggcatgcctcaggaagaacggctatcccgatatcagcaattcaaggacttccaaagaaggatcctcgtcgcaactaacctgttcgggcgggggatggatatcgagcgggtgaatattgcattcaactatgatatgccagaggatagtgatacttatttgcaccgctgttatcccctaagcccaagccgctggccagagcaggctggactggcccctagggcctggctgtcccacttatgccccatgcggatgatgccgaggtcctctatgatgtgccgcatcgccctacggtctatactggtgtcctgcttgatgcgctag

SEQ ID NO: 114059 - DNA, 291 bp, Artificial Sequence
  Description of Artificial Sequence: Synthetic coding sequence
atggcagagaacgatgtggacaacgagctgctggattatgaggacgatgaggtggaaacagccgctggaggcgatggcgcagaagctcccgcgaaaaaagatgtgaaaggctcctacgtgtcgattcactctagtggatttcgcgactttctgctgaagcccgagttactgcgagccatcgtggattgcgggttcgaacaccccagtgaagtgcagcacgagtgtattccccaggcaatcttggggatggacgtgttatgtcaggctaagagcggtatggggaagacatag

SEQ ID NO: 114060 - DNA, 411 bp, Artificial Sequence
  Description of Artificial Sequence: Synthetic coding sequence
atgggcggtggacgcagaccatacgatgtgttcttttccaaagttatggccgaaaatgacgttgataatgaactattggactacgaggatgacgaagttgagaccgcggcaggcggagacggggctgaggccccggctaaaaaggatgtgaagggatcctacgtgtctattcattcttcaggatttcgagactttcttctgaaaccagagctccttagggcaatcgtcgactgcgggttcgaacacccgtcagaagtccagcatgaatgcattcctcaggccattttggggatggacgttctgtgccaggccaaatctgggatgggtaaaacagcagtgtttgtcctggctactctgcaacagctggaaccagtgactggacaggtctcagtactggtgatgtgtcactag

SEQ ID NO: 114061 - DNA, 564 bp, Artificial Sequence
  Description of Artificial Sequence: Synthetic coding sequence
tagtcagaagaaagggatatagggaagccaatggagatcttcgtggacgatgagacaaagttgacactgcatggactgcagcagtactatgtcaaactgaaggataacgagaaaaaccgtaaattatttgatctcctggatgtcctggagtttaatcaggttgtcattttcgttaaatccgtgcagagatgcattgctctggcccagcttctggttgagcagaactttccagctatagcaattcacagaggcatgccccaggaggaacgacttagcaggtatcaacagtttaaggactttcagagacggatcctggtggccaccaatctgttcggcagaggtatggacatcgagagagtcaatatcgcatttaactatgatatgcccgaggattctgacacatatctgcaccgggtcgcgcgggcaggccgctttggaaccaaagggctcgctatcacattcgtatctgatgagaatgacgcaaagattctgaacgatgtccaggaccgattcgaggtcaatatctctgagctccccgacgagatagacatttcctcttactag

SEQ ID NO: 114062 - DNA, 717 bp, Artificial Sequence
  Description of Artificial Sequence: Synthetic coding sequence
atggcagagaacgacgtcgacaacgaactgttggactatgaggacgacgaagtagaaaccgccgccgggggggatggagctgaggctcctgctaagaaagacgtcaaggggagctacgtgtctatccactcttccgggtttagagatttccttctgaaacctgaactattgcgggctatcgtcgactgcggcttcgagcatccatctgaggtgcaacacgagtgcataccccaagccatcctgggaatggacgtgctctgtcaagccaaatcaggcatgggaaagaccgctgtttttgtccttgccactctgcagcaactggaaccagtcactggccaggtcagtgtccttgtgatgtgccatacaagagagctcgcgttccagatcagtaaggagtacgagcgattctcgaagtacatgcccaacgtgaaagtcgctgtgttcttcggcggcctgtccatcaaaaaagatgaagaggtactgaagaaaaactgcccgcacatcgtggtaggaacgccaggaaggattctggcgcttgcccgcaacaaaagcctgaatctcaaacatatcaagcatttcattcttgacgaatgtgataaaatgctcgaacagctcgacatgagacgcgatgtccaagaaatttttcgcatgactccacacgaaaaacaggttatgatgttcagtgccaccctttccaaggagatcagacccgtctag

SEQ ID NO: 114063 - DNA, 417 bp, Artificial Sequence
  Description of Artificial Sequence: Synthetic coding sequence
tgagccaccttacaacagctcgagccagtgacaggacaggtgtccgtgctggtcatgtgtcacactcgagaactcgccttccagatctcgaaggagtatgaaaggttttctaaatacatgcccaacgtcaaagttgcagttttctttggcggcctgagcatcaaaaaagacgaggaggttctcaaaaagaactgccctcacatagtggtcggaacccctggccgcattctcgctctcgcaagaaacaagtccttgaacctgaagcatataaagcactttatcctggacgagtgcgataagatgctggagcagcttgacatgagaagggatgtccaggagatctttcgtatgactccacacgaaaagcaggtcatgatgttcagtgccacactgtccaaagagatccgacctgtttag

SEQ ID NO: 114064 - DNA, 870 bp, Artificial Sequence
  Description of Artificial Sequence: Synthetic coding sequence
atggctgaaaatgacgtggataatgagttgttggattatgaggacgacgaagtcgagactgcagcaggcggagacggagcagaggctcctgctaaaaaagatgttaagggctcatacgtcagtatccactctagcggcttccgagacttcttactgaagcctgagctactcagggctatcgtggattgtgggtttgagcaccccagtgaagtccagcatgaatgcatacctcaggccatcctagggatggatgttctgtgccaggctaagagcggaatgggcaagactgctgtctttgtcttggctacattgcagcaactggaaccagtgactggacaggtttcggtgctggtaatgtgccacacacgagaactggctttccagatctcaaaggagtacgagaggttcagtaaatatatgccgaacgtgaaggtggctgtcttctttggcggactctctatcaaaaaagacgaagaagtactcaagaagaactgtcctcacatcgttgtgggcaccccgggtcgcatccttgcactggcccgaaataaatctctgaatctaaaacatattaaacatttcatcctggacgaatgcgataagatgctcgaacagctcgacatgagaagagacgtccaggaaatcttcagaatgacgccacacgagaaacaggtcatgatgttcagcgctacactgtcgaaagagatcaggcccgtgtgtagaaagtttatgcaggacccaatggagatcttcgtcgacgatgagacaaaactgacactccacggcctgcagcagtactatgtgaagcttaaagacaatgagaaaaaccgcaaattatttgatctgttggacgtccttgaatttaatcaatag

SEQ ID NO: 114065 - DNA, 1287 bp, Artificial Sequence
  Description of Artificial Sequence: Synthetic coding sequence
atggcggaaaatgacgtagacaacgagctccttgattacgaagatgacgaggtggaaaccgcggccgggggtgacggcgcagaggcccccgccaagaaagacgtaaaaggtagttatgtcagcattcatagctctgggttcagggattttctgctgaaacccgagcttctgagggccatcgttgactgtggcttcgaacacccctcggaagtccagcacgagtgtatccctcaggctatcctgggcatggacgttctgtgccaagctaaatctggaatgggaaagaccgccgtgttcgtgctcgccaccctacagcagctggagcccgttacagggcaggtgagcgtgctggtcatgtgccacaccagagagctggccttccaaattagcaaagaatacgaaaggttttcaaagtacatgcccaacgtgaaggtagccgttttttttggagggctcagcataaagaaagatgaggaagtactcaagaaaaactgccctcatatcgtcgttggaacgccagggcgcatcctggccttggccagaaacaaatctcttaacttgaaacatatcaagcatttcatcctggacgagtgcgacaagatgctagagcaactggacatgcgaagagacgtgcaggagatttttaggatgaccccacacgagaagcaggtgatgatgttttcagccactttgagcaaagagattagacccgtgtgccggaaatttatgcaggacccaatggaaatcttcgttgacgatgagacaaagcttaccctccacggactgcagcaatattacgttaaattgaaagacaacgaaaaaaataggaaactctttgacctactcgatgttctggaatttaatcaggtggtgatcttcgtcaagagcgtccaacgctgcatcgcactcgcacaacttctcgttgagcagaactttcctgccatagccatccatcgcggaatgccacaggaagaaaggctcagcagataccagcagttcaaggacttccaacgacgcattctggtggcaacgaatctctttggacgcggaatggatattgagcgggttaatattgcttttaattacgacatgcccgaagacagcgacacctatttacatagagtggcccgtgccggtagattcggaaccaaaggtctggcgataacatttgtctccgatgaaaatgatgccaagatcttgaacgacgttcaagacagattcgaggtgaacataagtgagcttcctgacgaaattgatatctcctcctacatcgaacagacgcgttag

SEQ ID NO: 114066 - DNA, 696 bp, Artificial Sequence
  Description of Artificial Sequence: Synthetic coding sequence
atggcagagaacgacgttgataatgaattgctggactacgaagatgacgaggttgaaaccgccgctggtggtgacggtgcagaggcacccgcaaagaaagatgtgaaaggctcctatgtctcaatccacagctccggcttccgagatttcctcctgaaacccgaacttctcagggccatcgtggattgcgggtttgaacatccatcagaagtgcaacacgagtgtattccacaggctatactcggtatggatgttttgtgtcaggctaagtctgggatgggaaaaactgcggtgttcgtactcgctaccctccagcaactcgagcctgtcacaggacaagtaagtgtcctcgtgatgtgtcacacgagagagctggcctttcagatctccaaagagtacgaaaggttcagtaaatacatgcccaacgttaaggtggccgtgtttttcggaggcctaagtatcaagaaggacgaagaagtcctgaagaagaactgtcctcatattgtagtagggacccctgggcgcattctggccctggcccgcaacaagtctcttaatctgaaacacataaagcacttcatcctggatgaatgtgataagatgttggaacaattggacatgcgaagagatgtacaggaaattttcaggatgactccacatgagaaacaagtcatgatgttcagtgccaccttgtag

SEQ ID NO: 114067 - DNA, 1287 bp, Artificial Sequence
  Description of Artificial Sequence: Synthetic coding sequence
atggcggaaaatgacgttgacaatgagttgcttgattatgaggacgatgaagtggagactgccgccgggggggacggcgccgaagctcctgctaagaaggacgtcaaaggatcctatgtctccatacatagcagcggattccgcgatttcctgttgaagcctgaacttctacgcgcgatcgtggactgcggcttcgagcatccctctgaggtccagcacgaatgcataccgcaagctatccttggaatggacgttttatgccaggccaagtccggcatggggaaaaccgctgtctttgttctcgccactctacaacagctggaacctgtgactggccaagtgtctgtacttgtcatgtgtcatacacgggagctcgcttttcaaatctcaaaggaatacgagcgcttctcaaagtacatgcccaatgtaaaggtcgctgtttttttcgggggccttagcatcaagaaggacgaggaggtgttgaagaaaaactgccctcatatcgtagtcggcactccaggacgcatcttggctctggctaggaataaatctttgaatttgaagcacattaagcacttcattctggacgagtgcgacaaaatgctcgaacagttggacatgagacgggatgtgcaggaaattttccggatgaccccccacgaaaaacaggtgatgatgttcagtgctaccctgtccaaggagataaggcccgtgtgtcgaaaattcatgcaggatcccatggaaatcttcgtagatgacgagaccaaactgactttgcatggcttgcaacagtactacgttaagcttaaggataacgagaagaaccggaagctgttcgatttactggatgtgctcgagttcaatcaggttgtgatcttcgtgaagtccgtacagaggtgcatcgcactggcccagctgttagtcgagcagaactttcccgccatagccatacatcgggggatgccccaggaagagcggctttccaggtaccaacagtttaaggactttcaacgtaggatactggtggccacaaacttgttcggtagaggaatggacatcgagagggtgaatatcgcctttaattatgacatgcctgaggatagcgacacttacttgcacagagtggcgcgggccgggaggtttggaaccaaaggtctcgccattaccttcgtttccgatgagaacgatgctaagattttgaacgatgtgcaggataggtttgaggttaacatctcagagctgcctgatgaaatcgacatttcctcttacatagaacagactcggtag

SEQ ID NO: 114068 - DNA, 378 bp, Artificial Sequence
  Description of Artificial Sequence: Synthetic coding sequence
atggctgaaaatgacgtcgataatgaactactggactatgaggatgacgaggtagagacggccgctggcggggacggggctgaagcccccgccaagaaggacgtgaagggcagttacgtgagcatccatagtagcggtttccgcgactttttactgaaaccggagttactgcgggctatcgttgactgtgggtttgaacacccctcagaagttcagcacgagtgtattccacaggcaattctggggatggacgtcttatgtcaggcgaaaagtggcatggggaagaccgctgtgtttgtcctagcaaccctccagcaactcgagcctgttaccgggcaagtatctgttctagtgatgtgccacacccgagaattatag

SEQ ID NO: 114069 - DNA, 294 bp, Artificial Sequence
  Description of Artificial Sequence: Synthetic coding sequence
taggctaccctccagcagctggagccagttacgggacaggtgtgcttctgtgatagtcactttccccgcggcgataatgaagaactccatctcccatatgtgagtgtgtacttccttcccaaggtgagcgtgctggtcatgtgtcacacccgggagttggcatttcaaatatctaaagaatacgagcgttttagtaagtatatgcccaacgttaaggtggctgtgttctttggcggtttaagtataaagaaggacgaggaagtgttaaagaaaaattgccctcatatcgtctag

SEQ ID NO: 114070 - DNA, 291 bp, Artificial Sequence
  Description of Artificial Sequence: Synthetic coding sequence
atggccgagaacgacgtagacaacgaactactggactacgaggacgatgaagtggagacggctgccggaggtgatggagctgaagccccagcaaagaaggacgtgaaagggtcttatgtatcaattcactcttctggtttccgcgattttctcctgaaaccagagctgctgagagccattgtggactgcggcttcgagcacccctccgaagtccaacatgagtgcatccctcaggcaatcttaggaatggatgtgctgtgccaggccaaaagtggaatggggaaaacctag

SEQ ID NO: 114071 - DNA, 291 bp, Artificial Sequence
  Description of Artificial Sequence: Synthetic coding sequence
atggccgaaaacgacgtggacaatgaacttcttgattacgaggacgatgaggtggagacggcagccggcggagacggcgcagaggcccccgcaaagaaagacgtgaagggaagttatgtgtccatccactctagtggtttcagagattttctgctgaaaccagagctgttgcgtgccattgtcgattgcggcttcgagcaccccagcgaggtgcagcatgagtgcatccctcaggctatcctgggcatggatgttctatgccaggccaaatctgggatgggcaaaacctag

SEQ ID NO: 114072 - DNA, 1287 bp, Artificial Sequence
  Description of Artificial Sequence: Synthetic coding sequence
atggccgaaaatgacgtcgacaatgaactcctcgactatgaagacgatgaggtagagaccgctgccggaggagacggcgccgaggctcctgcaaagaaggatgtcaagggcagctacgtttccatccattcaagcgggtttcgcgacttcttgctgaagccggagctgctgagggccattgtggactgtggttttgagcaccctagtgaagttcagcacgagtgcatcccccaagccattctgggcatggatgtgttgtgccaggctaaatcgggaatgggaaagactgcagtcttcgtgctggccacgctgcaacaacttgagcccgtcacaggccaggtatctgtcctggtgatgtgccacactagggagttagctttccagatctcaaaggagtacgaaaggtttagcaagtacatgccgaacgtgaaagtcgcagtgttcttcggcggactcagcattaagaaggacgaagaggtgctgaagaaaaattgcccccatatagtggtaggtacaccgggacggattcttgctctggcccggaacaagtcactcaacctgaagcatataaagcactttatcctcgacgaatgtgataagatgctggaacaactcgacatgcggcgggatgtgcaggagatcttccgcatgactccacatgagaagcaggtcatgatgtttagcgcgaccttgtctaaggagatccggccggtctgtagaaagttcatgcaggatcctatggagatttttgtggatgacgaaaccaaactaacactgcacgggctgcagcagtattacgtcaagctgaaagataacgagaagaatcggaagctgtttgatcttcttgatgtgctggagtttaatcaggtggtgatctttgtcaagagtgtgcaacgatgtattgcactggcccaacttttggtagagcaaaacttccctgccatagccatccatcggggtatgccacaggaagaacgactcagcagataccaacaattcaaagacttccagcgccgcatcctagtggcaaccaaccttttcggccgcggaatggatattgagcgggttaatatcgcatttaattacgacatgccagaggatagtgatacttatctccaccgagtggctcgagccggtcgatttggtaccaaaggcctcgccattacgtttgtatctgacgagaacgatgcaaagatcttaaacgatgttcaggacagattcgaggtcaatattagtgagctgcccgatgagatagacatttcctcctacatcgagcagacacgctag

SEQ ID NO: 114073 - DNA, 732 bp, Artificial Sequence
  Description of Artificial Sequence: Synthetic coding sequence
atgtggactatgtccagctggaccatgaagatgatgagatggcgacagcaactgggagaaatgggtctgcgacctctgccgcgccggatgagcagagcacctatgtccccttccacagctctggccttcgtcacatcttgctccagtcagagctgttctgggccgctatcaaccgtggccctctcaatcagacagaaagtgagcgttctggttatgtgtcacactcgggaactggcttttcaaatatccaaggagtacgagaggtttagcaagtatatgccaaacgtcaaagtcgcggtgtttttcgggggcctatccatcaaaaaggacgaggaggttctgaagaaaaactgtccgcacatagtggtcggtactcctggaaggatccttgcacttgctagaaataaaagtctcaatctgaaacacattaagcatttcatcttggatgagtgcgataagatgcttgaacagcttgacatgaggcgcgacgtccaggagatattccggatgactccacacgagaaacaagtgatgatgttcagcgcaacactctccaaggagatcaggcctgtgtgccgtaagttcatgcaggacgtcaacacactcctgccgtccctcccaccactccccgcaaggtgtttactgccattcttggccctcttcctgcgcctcccctgccacagttctgccaagaaagccgcctgtgcccagctgggagtaatgaccccgtag

SEQ ID NO: 114074 - DNA, 972 bp, Artificial Sequence
  Description of Artificial Sequence: Synthetic coding sequence
atggctgagaatgatgtggacaacgagcttctagactatgaggatgatgaagttgaaactgcagccgggggggacggggccgaggcgcctgctaagaaggatgtgaaaggaagctacgttagcattcactcaagcggttttcgggacttcctgctgaaacccgagctgctgagagctattgtagactgcggatttgaacatcccagtgaagtgcagcacgaatgtatcccccaggcaatcctcgggatggacgtactctgtcaagccaaatccgggatgggcaagaccgcagtattcgtactggccactttacagcaacttgagcctgttaccggacaagtcagcgtactggtcatgtgtcacacgcgcgagcttgctttccaaatttcaaaagagtatgagcggttctccaagtacatgcccaatgtgaaagtcgcagtctttttcggtgggctgagcataaagaaagatgaagaggtactgaaaaagaattgcccccacatagtcgtcggaacgcccgggcgcatattagcgctcgcaaggaataagagcctcaacctcaaacatatcaaacatttcatcctcgatgagtgcgacaaaatgctggaacagttagacatgagaagagatgtgcaagaaatctttagaatgactccacacgagaagcaagtcatgatgttttccgcgactctttccaaggaaataaggcccgtgtgtcgcaagtttatgcaggacccaatggaaatctttgtggatgacgagactaaacttacccttcatggcctgcagcaatattatgtcaagctgaaggacaacgagaaaaataggaagctctttgatttacttgacgtgctcgagttcaatcaagagatcacatgcaaatccgtccaacgtttttcaaccacaaattcctgcggatatcaacccatttggccacgtcacgggcaccgggctggggagcactgcttctag

SEQ ID NO: 114075 - DNA, 972 bp, Artificial Sequence
  Description of Artificial Sequence: Synthetic coding sequence
atggcagagaacgacgtggataatgaactgctggactatgaggacgacgaggtggagacagctgcaggcggggatggagcagaagcccccgctaagaaggatgtcaagggcagctatgtgagtattcatagcagcggattccgtgattttctccttaaaccagagctgttgcgtgccatcgtagactgtgggtttgagcatccaagtgaggtccagcacgagtgcattccccaggccatcctcggcatggacgtgctctgtcaggctaagtccggcatgggcaagactgcagtgtttgttttggccacactccagcagcttgaacctgtgacaggtcaagtttccgtgttagtgatgtgccacacgcgcgaactggcgttccaaatcagcaaagagtacgaacgcttctcaaaatacatgcccaacgtgaaagtcgctgtctttttcggcggactgtcaataaagaaggacgaggaggtgctgaaaaagaattgtccccatatcgtggtcggcacgcccgggcgaatattggcactcgctcgaaacaaatctctcaacctcaagcatatcaagcacttcatcctcgacgagtgtgacaaaatgctcgagcagttggacatgagacgcgatgtgcaggaaatttttagaatgacaccacatgagaagcaggtgatgatgttctccgccaccctttccaaggagattcgcccagtgtgtcgtaagttcatgcaggaccctatggagattttcgttgatgatgagaccaagctgacgctccatggtctgcagcagtactacgtaaagctcaaggataacgaaaaaaaccgcaaacttttcgaccttctggacgtgctcgagtttaatcaggagatcacctgcaagtccgttcagaggttttcaaccaccaactcttgcggctatcaacccatctggcctcggcacggtcacagagcgggagagcactgtttttag

SEQ ID NO: 114076 - DNA, 1332 bp, Artificial Sequence
  Description of Artificial Sequence: Synthetic coding sequence
atggcagagaatgacgtcgacaacgagttactcgactacgaagatgatgaagtagagaccgccgccggaggtgacggggcagaagcccctgccaaaaaagatgtgaaaggttcctacgtgagcatacacagttccgggttccgtgactttttactgaaaccagaattgctgcgggccatagtggattgtggatttgagcacccctctgaagtgcaacacgaatgtatccctcaggcaatattagggatggacgtgctttgtcaggcgaagtctggaatgggaaagacagccgtattcgtgctggcaaccctgcagcagttagaaccggttactggacaggtttatttaggtagagttctcggccgtggattttggtgcgtgtttgtgagtgttctcgttatgtgccacacacgcgaattggcttttcagattagtaaggaatatgaaaggttcagcaagtacatgccaaatgtcaaagtcgcggtgtttttcggggggttgtccattaagaaagacgaagaagtccttaagaagaactgcccacacatcgtggtgggcactccaggcagaatcctggccttggcccgtaacaagtccctgaacctgaagcacatcaaacatttcatactggatgaatgcgacaagatgctcgaacaactggatatgcgccgcgatgtccaggagatcttccgaatgacccctcatgaaaaacaggtgatgatgtttagcgccactctctctaaggaaattcggcccgtgtgtcggaagttcatgcaggacccgatggagattttcgtggacgacgagacaaaattgactctgcatggacttcagcagtactatgtgaaattgaaggacaacgagaaaaacaggaagctattcgacctcttagacgtcttggaatttaaccaggtcgttatttttgttaagtcagttcagagatgcatcgcattagctcagcttctcgtcgaacagaactttcctgccattgccatccaccgagggatgcctcaggaggagaggctctccagatatcaacaattcaaagacttccagcgccggattctggtggccacaaacctcttcggtcggggcatggacatagaacgggttaacatagctttcaactatgatatgccagaagatagcgacacctacttgcaccgcgtggcacgcgccggcaggttcggaaccaaagggctggctattaccttcgtgagtgacgaaaacgacgcaaagatcttgaatgacgtgcaggataggtttgaggtcaatatctcagaactccccgatgagattgatatttcctcatatatcgaacagaccaggtag

SEQ ID NO: 114077 - DNA, 732 bp, Artificial Sequence
  Description of Artificial Sequence: Synthetic coding sequence
atgtggacaatgtcctcatggactatgaagatgatgcgttggcgccagcaactgggcgagatgggcctgagacccttgccaagaagaatgtctcgagctcctatgtctcctagcactgcgctggccttcgtgacgtcctgctcgtcgcagtcctgttccggtcctttgagtaccgtcgccctgagcattcgccaaaaagtctctgtcctcgtcatgtgccacaccagagaacttgcctttcagatttctaaggaatacgagcgattttccaaatacatgcccaatgtcaaggtcgcggttttcttcggcggcctctctatcaagaaggacgaggaggttttaaagaagaattgcccccatatcgttgttggcacccccgggagaattctagccctggctagaaacaagagcctgaatcttaagcatataaagcactttattcttgatgaatgcgacaagatgcttgagcaactggacatgcggcgcgacgtccaagagatctttagaatgaccccccatgagaaacaggttatgatgttctccgctacattgtcaaaagagataaggcccgtttgccgcaaattcatgcaggatgtgaacacactgctgccatccctgccacctctgcctgccaggtgtctcctgccctttctggccctattcctccgcctcccctgccacagtagtgctaagaaggcagcgtgtgcgcagctcggcgtgatgacaccgtag

SEQ ID NO: 114078 - DNA, 1332 bp, Artificial Sequence
  Description of Artificial Sequence: Synthetic coding sequence
atggctgagaacgatgtcgacaacgagcttttagactacgaggatgacgaagtcgaaacagcagcgggtggggatggagcggaggcgccggcaaaaaaggatgtgaagggctcatatgtgagcatccacagctctgggttccgagactttctcctgaaacctgaactcttgcgggccatcgtggactgtggctttgaacatccttctgaagtccagcacgaatgtattccccaggccattctcgggatggacgtgctctgtcaggcaaaaagcgggatgggaaagactgctgtgttcgtgcttgccaccctccagcaactggaaccagtcaccggccaggtttacctgggaagggtgctcggcaggggcttctggtgcgtgtttgtgtccgtgctggttatgtgtcatacccgtgagttggccttccagatttccaaggagtacgagcgattttccaaatatatgccaaatgtgaaggtggccgtcttctttggagggctcagtatcaagaaggacgaagaagtcttgaaaaaaaactgccctcatatagttgtggggactccaggacggattctggcattggcccgcaataaatctctcaacctgaaacacatcaagcattttattttggacgagtgcgacaagatgctcgagcagttggacatgcggcgggacgtccaagaaatatttaggatgaccccccacgaaaaacaggtgatgatgttttctgccaccctgtctaaggaaatcagacccgtttgccgcaagttcatgcaggatcccatggaaattttcgtggatgacgagaccaagctgacccttcatggactgcagcaatattacgtaaaactgaaagacaacgaaaagaatcgcaagctttttgacttgcttgatgtgctggaatttaaccaagtagtcattttcgtgaagtctgtgcagagatgcattgcgctggcacagctactggtggagcagaactttcctgccattgccattcatcgaggaatgccacaagaagagaggctaagcaggtatcagcaattcaaagacttccaacggcgtatcctagtcgctactaacctgtttggccgcggcatggatattgagagagtgaacatcgccttcaattatgacatgcctgaagactccgatacatatcttcatcgtgttgctagagccggaaggttcggcacaaaaggtctggctatcacattcgtctccgacgagaatgacgcaaaaatcctgaacgatgttcaggacagatttgaggtaaatattagtgaattgcccgacgagatcgatattagctcttacatcgagcagaccaggtag

SEQ ID NO: 114079 - DNA, 420 bp, Artificial Sequence
  Description of Artificial Sequence: Synthetic coding sequence
atggcagaaaatgatgtagataatgagctgctcgattatgaagatgacgaagtggagactgctgccggcggcgacggagcagaagcaccagccaagaaagatgtgaaaggctcctatgtgtctatccatagctccggattccgcgatttcctgttgaaacctgaactcctacgcgcgatagtggactgcgggttcgagcacccatccgaggtgcagcatgagtgcatcccccaagctatcctcgggatggatgtactgtgccaggccaagtccggcatgggcaagacagccgtgtttgtactcgcaaccctccagcagctagaacctgtgaccggccagtcccacgaacacatgacgagcgtaacacttgataacttgactgcggtgggagatgtgctttcacaggcttggggatcttag

SEQ ID NO: 114080 - DNA, 732 bp, Artificial Sequence
  Description of Artificial Sequence: Synthetic coding sequence
atgtggacgatgagctcatggacaatgaaaatgatgcgctggagacagcaactgggggagatggggttacgacccttgcctagacgaatgtctagagctccaatgtccccatcaaccgcgctggccttcgtgacgtcttgcagtagccagagctgctccggtcccctgtctaccgtggccctctcaatccggcaaaaggtctccgtgcttgtcatgtgccatacccgcgaacttgcattccaaataagtaaggagtacgagcgcttttccaagtatatgcccaatgtcaaggtagccgtgttttttggggggttatccattaagaaggacgaagaggtcctcaaaaagaattgtcctcacatcgtggtcgggaccccagggcgaattctggccctcgcccggaacaaaagcctgaacttgaagcacattaagcactttattctggatgaatgcgacaagatgttggaacagctcgacatgagacgggatgtgcaggagattttccgaatgactcctcacgagaaacaggtgatgatgttctcagctacccttagcaaagaaatccggccggtgtgcagaaaattcatgcaggacgtgaacacgctcttgccatcacttcccccactgccagcccggtgcctgctgcctttccttgccctgtttttgcgactgccttgtcatagcagtgcaaaaaaagctgcctgcgcacaattgggcgtgatgactccatag

SEQ ID NO: 114081 - DNA, 732 bp, Artificial Sequence
  Description of Artificial Sequence: Synthetic coding sequence
atgtggactatgtctagctggactatgaagatgatgagatggcgccagcagctgggagagatgggactccgccctctgccgagacgtatgtccagagccccaatgagccccagcacagcactcgctttcgtgacttcatgtagcagccagtcctgttccgggcccctatctactgtggctctgtccatccggcagaaggtgagcgtgcttgtgatgtgccacactcgcgaattagctttccagatatccaaggaatatgagcgctttagcaagtatatgcctaacgttaaggtggccgtcttctttggcggactttctataaagaaggacgaggaagtcttaaaaaagaactgcccacacattgtcgtcgggaccccagggcgcatccttgcactcgcgcggaacaaatccttgaaccttaaacatatcaagcatttcatcctggacgaatgtgacaaaatgctggaacagctcgatatgcgcagggacgttcaggaaatttttcggatgacccctcatgagaaacaggtgatgatgttctccgcaacccttagtaaggagattagaccagtttgccgaaagtttatgcaggacgtgaacaccctcctgccatcactgccacccctgcccgcccgttgcctcctgccattccttgccctgttcctcaggctgccatgccattcatcagccaagaaggccgcctgcgctcagctgggggtcatgacgccttag

SEQ ID NO: 114082 - DNA, 420 bp, Artificial Sequence
  Description of Artificial Sequence: Synthetic coding sequence
atggcggagaatgatgtcgataacgagttgctcgattatgaagacgacgaggtggagacagcagcaggtggggatggagcagaggctcccgctaagaaggacgtgaaaggctcttatgtctctattcattcttcaggtttccgagatttcctcctcaagcccgagttgctgagagccatagtggattgcggcttcgaacatccctctgaagtgcaacacgagtgtatcccccaggcgatcctcggtatggacgtgctgtgtcaggccaaatccggaatgggaaagaccgcagtctttgtcctagccaccctgcagcagctggaaccagtgactgggcaatcacacgagcacatgacgtcagtaactcttgataatctgaccgcagtcggcgatgtcctctctcaggcctggggctcctag

SEQ ID NO: 114083 - DNA, 972 bp, Artificial Sequence
  Description of Artificial Sequence: Synthetic coding sequence
atggccgaaaacgacgtggacaatgagcttctcgattatgaagacgacgaggtggaaacagcagctggaggcgacggggcagaggcacccgcaaaaaaggatgtgaaaggttcttacgtgtctatccattcaagtggattccgcgactttctcctgaaacccgagctgctgcgggcgatcgttgattgtggtttcgagcacccatctgaagttcaacatgagtgtatccctcaagcgatactgggaatggatgttctgtgtcaggctaaatctgggatgggaaagactgctgttttcgttctggcaacattgcagcagcttgaacctgtgacagggcaggtgagcgtgcttgtgatgtgtcacacgagggagctggcctttcaaataagcaaagagtatgaacggtttagcaagtacatgcctaatgtgaaagtggcagtctttttcgggggcctgtcaatcaaaaaggatgaagaggtccttaaaaagaattgtcctcacatcgttgtgggcacgcctgggcgaatcctcgccctggcccgaaataaatccctcaatttgaaacacatcaaacattttatcctcgatgagtgtgacaaaatgcttgagcagttggacatgcgacgggacgtacaagagatttttcgcatgacccctcacgaaaagcaggttatgatgttcagcgcgaccctgagcaaggaaattcgccctgtgtgtaggaagtttatgcaggaccctatggagatcttcgtagacgacgagacgaagttgaccttacacggcctccagcaatattatgtcaaactgaaagacaacgagaagaatagaaaattgttcgatcttttagacgttctcgagttcaaccaggagatcacatgcaagtccgtgcagcggttctctactacaaacagctgtggatatcagcccatttggccacgtcatggtcacagagctggcgaacactgtttctag

SEQ ID NO: 114084 - DNA, 1332 bp, Artificial Sequence
  Description of Artificial Sequence: Synthetic coding sequence
atggccgagaacgatgttgacaacgaactgctcgattatgaagacgatgaggttgagaccgcggctggaggggacggggctgaggctccagctaaaaaagacgtgaaaggttcttacgtttcaattcacagctccggcttcagggatttccttttgaagccggaactgttaagagctattgtggactgtggctttgaacaccccagcgaggtgcaacacgaatgtattccacaggcaatcctgggcatggacgttttgtgccaggccaaaagcggcatgggaaagacagcagtattcgtgctcgcaactctgcagcagcttgaaccagtcaccggccaggtttatttagggcgagtccttgggagagggttttggtgcgtctttgtgagcgtgttggtcatgtgccacacacgcgaattagcgtttcagatttcgaaagagtacgagcgcttctcaaagtacatgccaaatgtaaaggttgcagtgttttttggtggtctttctatcaagaaggacgaagaagtgctgaagaaaaattgccctcacattgttgtggggacacctggaagaattttggccttggcacgaaataagagcctcaatctgaagcacatcaaacactttatcttagacgagtgcgataaaatgctggagcagctggacatgaggagagatgtccaagaaatctttcgaatgactcctcacgaaaagcaagtgatgatgttctccgcaacactgtctaaggagatacgccccgtctgtcgcaaattcatgcaggatccgatggaaatatttgtggacgacgaaaccaagcttaccctgcacggcctccagcaatattatgtgaagcttaaagacaacgaaaaaaaccggaagctttttgatcttcttgacgttctcgaatttaatcaggtcgtgatcttcgtgaagtccgtgcaaaggtgcatcgctctggctcagttactggtggaacagaacttccccgcgatcgccattcaccgaggcatgcctcaagaagagcgattatctcggtaccagcagtttaaggacttccagcgccgcattttggttgccaccaatttgtttggcaggggaatggacattgaaagggttaacattgccttcaattatgatatgcctgaggactctgatacctatctgcaccgcgttgcacgagccgggcggttcggcactaaaggactggcaatcaccttcgtgagtgatgaaaacgacgctaagattctgaacgatgtgcaagaccgctttgaggtgaatatatcagagctgcccgatgaaatagacatctccagctacattgagcaaacacggtag

SEQ ID NO: 114085 - DNA, 732 bp, Artificial Sequence
  Description of Artificial Sequence: Synthetic coding sequence
atgtggacgatgtccagttggaccatgaaaatgatgaggtggcggcagcagcttggcgagatgggcttgagacccctaccccggagaatgtcccgcgctcccatgtcccctagtacagctctggcctttgtcacctcatgtagctcccagagctgctccgggcctttaagcacagtggcactgagtattcgccagaaggtttccgtcctcgttatgtgtcacaccagggagttggcctttcagattagtaaagagtacgagcgcttctccaagtatatgcctaatgtgaaagtggccgtgtttttcgggggtctgagtataaagaaagatgaggaggttctaaagaaaaactgcccacacattgtggttggcactcctgggagaatcctggcactggcaaggaataagagcttgaatttaaaacacatcaaacacttcatcctggatgaatgtgataaaatgctggagcagttagatatgagacgcgacgtgcaggaaatcttcagaatgacgcctcacgaaaaacaggtgatgatgttttccgccacactttcaaaagaaattagacctgtctgccggaaattcatgcaagatgttaacacactcctgccatccttgcctccgctacccgctaggtgcttactccccttcctcgctcttttcctaagattgccatgtcatagcagcgccaagaaggctgcatgtgcccagctcggcgtgatgaccccttag

SEQ ID NO: 114086 - DNA, 1053 bp, Artificial Sequence
  Description of Artificial Sequence: Synthetic coding sequence
atgtggacaatgagctcctggacaatgaagatgatgcgatggcgtcagcagctgggtgaaatggggctgagaccactcccccgccgtatgtcccgcgcacccatgtcgccatccacagccctggccttcgtgacatcatgcagtagtcagtcatgttctggacctctttccaccgtggccctgagcatccgccagaaagtcgccgtgttttttggaggactaagcatcaagaaggacgaggaggtgcttaagaagaactgtcctcacattgtggtgggaacgccaggaaggattctcgctttagctagaaataagtcattgaatctgaaacacattaagcacttcattcttgatgagtgcgacaagatgctggaacagctggatatgaggcgagatgtgcaggagattttccgaatgacaccacacgagaaacaggttatgatgttttccgcaacactgtcaaaggaaattcgcccagtctgccggaagttcatgcaggatccaatggaaatcttcgtggatgatgagaccaagcttacactgcacgggttgcagcaatactacgtgaagctgaaagataacgaaaagaaccgaaaacttttcgatctgctggacgtactggaatttaaccaggtagttatcttcgtcaaaagcgtgcagaggtgtattgcacttgcccaattactggtagaacaaaacttcccagcaatcgctattcataggggaatgccccaggaggagcggttgtctaggtaccagcagtttaaagacttccagcgcaggatccttgtagcgactaacttgtttggcaggggaatggacatagaacgggtaaatattgcatttaattacgacatgccagaagattcagatacctacctgcacagagttgcacgagctggaaggttcggtaccaaaggcctcgccattactttcgtgagtgacgagaatgatgctaaaatactgaacgacgttcaggatcggtttgaagtcaacataagtgagctgccagacgaaatcgacatttccagctacatcgaacaaacgcgctag

SEQ ID NO: 114087 - DNA, 1332 bp, Artificial Sequence
  Description of Artificial Sequence: Synthetic coding sequence
atggccgagaacgatgtggataacgagctgttagattacgaggatgatgaggtagagacagccgcaggcggcgacggtgctgaggcccctgctaagaaggacgtcaagggatcctatgtgagtattcattcctcaggctttcgggactttctgttaaaaccggagttactccgagctatagtcgattgtggcttcgaacatccttccgaggtacaacacgaatgcatcccccaggctatcttgggcatggacgtgttgtgtcaagccaaatctgggatggggaaaactgcggtgtttgtgctggcgacactgcagcagttggagcctgtgacaggccaggtgtaccttggaagggttctaggacgtggattttggtgcgtcttcgtatcggtgttagtcatgtgccatactagggagcttgcgttccaaatttcaaaggagtacgaacggttttctaaatacatgccgaacgtgaaagttgctgttttcttcgggggactgagcattaaaaaggacgaggaggtgctgaagaaaaattgtccgcatattgtcgtaggcacgccaggacgaattcttgctctggctcgtaacaagtccttaaacctgaagcatatcaaacattttatactggacgagtgtgataaaatgctcgagcaacttgatatgagacgcgacgtacaggaaatattccgaatgactcctcacgagaaacaagtcatgatgttctccgcaacactcagcaaggaaatccgccccgtgtgcaggaaatttatgcaagatccaatggaaatcttcgtagacgacgagactaaactgacactgcacgggttacagcagtattatgtcaagctgaaggataacgagaagaaccggaaactctttgatcttctagacgtgctcgagtttaatcaggtggtaatctttgtcaaatcagtacaaagatgcatcgccctggcgcaattattagtggaacagaattttccagctattgcaatccataggggcatgccccaagaagagaggctgagtcggtaccagcagtttaaagacttccaaagaagaattttggttgccactaacctattcggtcgggggatggacatcgaacgggtgaatattgcctttaattacgatatgccagaagactccgatacatatttgcatcgggtggctcgcgctggccggtttggcaccaagggtctggctatcacatttgtaagcgatgaaaatgacgccaagattctcaatgacgtccaggaccgattcgaggtgaacatctcagagctgcctgacgaaattgatatatcctcctacatcgagcaaactcgctag

SEQ ID NO: 114088 - DNA, 1053 bp, Artificial Sequence
  Description of Artificial Sequence: Synthetic coding sequence
atgtggaccatgagttcctggacaatgaaaatgatgcgctggaggcagcaactaggggaaatggggcttcgtcctcttcctaggcgaatgagtcgggcccccatgtcgccaagcactgccttggccttcgtaacgtcttgctctagtcagagttgtagcggccctctttcaaccgtggccctctctataagacagaaggtcgcagtttttttcggtggtctctccattaagaaggacgaagaggtcctgaaaaagaactgtccacacatagtagtcggaactcctggccgaatcttggccctggcccggaacaagagtctcaatctcaaacacattaagcacttcatcctggacgaatgcgacaagatgctcgagcagcttgacatgaggagagatgtgcaggagatcttcaggatgacaccacatgagaaacaagtgatgatgttctccgcaaccttatcaaaagaaatcagaccagtgtgcaggaagttcatgcaggaccctatggaaattttcgtcgatgatgaaaccaagttaacccttcatggcttacaacaatactatgtcaagctcaaagacaacgagaagaatcggaaacttttcgacttgttagacgtcctggagttcaatcaagtggtgattttcgtcaaatccgtgcagcggtgtatcgccctggcccagttactggtggagcagaattttccagcaattgcgatccacaggggaatgccccaagaggaacggctgtcccgataccagcagttcaaagatttccaaaggcggatcctggtagccaccaatctgtttgggagggggatggacattgagagagtgaatattgcgtttaattatgatatgcccgaggactccgatacctacctgcatcgcgtcgcacgcgctgggcgctttggaactaagggcctggccatcacctttgtgagtgacgaaaacgacgctaagatactgaacgatgtacaggaccgctttgaggtgaacataagtgaactgcccgacgaaatcgacatcagtagttacatagaacagacaagatag

SEQ ID NO: 114089 - DNA, 732 bp, Artificial Sequence
  Description of Artificial Sequence: Synthetic coding sequence
atgtggacgatgtcctcctggacaatgaaaatgatgagatggcggcagcaacttggtgagatggggcttaggcctctgccccggaggatgagtcgcgctcccatgagcccaagcacagcgctggcctttgttacgtcctgttccagccagtcttgctctggacccttgagtacagtggccctcagcatccggcagaaagtgtccgtgctcgtcatgtgtcacacgcgtgagctcgcgttccagatttcaaaggaatacgaacggttctcgaaatacatgccaaacgtgaaagtcgcagtgtttttcggcggcctcagtatcaagaaagacgaagaggtgttgaaaaagaattgccctcatattgtggtcggtactccaggacgcatattggcactggctcggaacaagtccctgaacctgaagcatatcaaacattttatcttggatgaatgtgacaaaatgctggagcagttagacatgagacgggacgttcaggagatatttagaatgactcctcacgagaaacaggtgatgatgttctccgctacactcagcaaggagataagacctgtatgtcgaaaatttatgcaggacgtgaatacactgttaccatccctgccacctctgccagcccggtgtttactaccatttctagcactgtttctccggctcccttgccacagctcggctaaaaaagccgcctgtgctcagctgggagtcatgacgccttag

SEQ ID NO: 114090 - DNA, 420 bp, Artificial Sequence
  Description of Artificial Sequence: Synthetic coding sequence
atggccgaaaatgacgttgataatgagttgctggattacgaggacgacgaagtcgaaacagctgccggaggagatggcgctgaggcgcctgcaaagaaggatgtgaagggcagctatgtttccatccactcgtcagggttcagggattttctgcttaaacctgaactattgagggcaatcgtagactgtggattcgaacatccctccgaggtgcagcatgagtgcataccgcaagccattctggggatggacgtcctgtgccaagctaagtcaggtatggggaaaaccgccgtgtttgtgcttgctacccttcagcagttggagccagtgaccgggcaaagccacgagcacatgacaagcgtgactcttgacaatctgacagcagtgggtgacgtcctctctcaagcatggggatcctag

SEQ ID NO: 114091 - DNA, 1053 bp, Artificial Sequence
  Description of Artificial Sequence: Synthetic coding sequence
atgtggactatgagcagttggactatgaagatgatgcgctggcggcagcaactaggtgagatgggtctgcggcctttgcccaggagaatgtcccgggcacccatgtcaccctcaacagcactggcgtttgtcacgtcctgcagctcccagtcatgttccggccccttgagcactgtggccttaagcatcaggcagaaggttgctgtgtttttcgggggcctcagcattaaaaaagacgaggaggtcctgaaaaaaaattgcccgcacatagtggttggcacaccaggccggattctggctttggccaggaataaatcattaaacttgaagcacattaagcacttcatcctcgatgagtgtgacaaaatgctggaacagttagatatgcggcgggacgtgcaggagatcttccggatgactccacatgagaaacaggttatgatgttctcagccacgctctctaaagagatacgtccggtgtgcagaaaattcatgcaggatcccatggagattttcgtcgacgatgaaactaagctgacgctgcatggcctgcagcagtactacgtgaaactcaaggataatgagaagaacagaaaattgtttgatctgctggatgttctcgaatttaaccaagtcgttatctttgttaagtccgtccagcggtgtatcgcactggctcagttgctggtagaacaaaattttcctgccatcgcaattcaccgcgggatgccccaggaggagcggctcagcaggtaccaacaatttaaggacttccaaagacggatcctcgtggccactaacctgttcggtcggggaatggacatagagcgggtgaacattgcctttaactatgacatgccggaagacagcgatacttacctgcatagggtggccagggccggacggtttggcacaaagggcctcgctatcacatttgtgtcagatgagaacgacgccaagattctgaacgacgtccaagatcggtttgaggtcaacatctcagagctaccagacgaaatcgatatcagctcctatatcgagcaaacaaggtag

SEQ ID NO: 114092 - DNA, 972 bp, Artificial Sequence
  Description of Artificial Sequence: Synthetic coding sequence
atggcagaaaacgatgtcgataatgaattactggactatgaggatgatgaagttgagacggcggcagggggagatggtgcagaggcaccagctaagaaagacgtgaagggatcgtatgtgagcatacatagctccgggtttcgcgactttctgttaaagccagagctcttgagagctatcgtcgactgcggctttgaacacccaagcgaagttcaacacgagtgcatcccccaagcaattctgggcatggatgttctgtgccaggctaaaagcggcatgggcaagactgcagtttttgtgctcgctactcttcaacagcttgagcctgttacaggacaagtgagtgtgctggtgatgtgtcacacccgggaactggcctttcaaatttcaaaggagtatgaacggttcagtaaatacatgcctaacgttaaggtggcagttttcttcggaggcctgagtattaaaaaggatgaagaggtgctgaaaaagaattgcccccatatcgtcgtaggtactccgggccgcatcctggcactcgcaagaaataagtcactcaaccttaagcacatcaaacattttatattagatgagtgcgataaaatgctggagcagctcgatatgcgaagagatgtgcaagaaatcttcaggatgactccccacgagaaacaagtgatgatgttttcggctactctgagcaaggagatacgtcctgtgtgcagaaaattcatgcaggatccaatggaaattttcgtagacgacgagacaaaattgactctacacggactgcagcaatattatgtcaagctgaaagacaatgagaaaaatcgaaagctcttcgatcttctggatgtgcttgaattcaaccaggaaattacttgcaagtctgtccaacgcttctccaccaccaactcctgtggataccaaccaatctggcccagacacgggcatagggccggcgaacactgtttttag

SEQ ID NO: 114093 - DNA, 1053 bp, Artificial Sequence
  Description of Artificial Sequence: Synthetic coding sequence
atgtggacaatgtcctcttggacaatgaagatgatgcgctggaggcagcagctgggggagatgggcttgcgaccgcttcctaggcgtatgtcccgggccccaatgtccccaagtaccgcgctggcgttcgtgacctcttgcagtagccagtcttgcagtgggccgctgagtaccgttgccttaagcattcggcagaaagtggctgtgtttttcgggggtctgtccatcaagaaggacgaggaagtgctgaaaaaaaattgcccgcatatagtcgtcggcacacctggacgaatacttgctctggcccgcaataaatccctaaatttgaaacatataaaacatttcattctggacgagtgcgataaaatgcttgaacagctggatatgagacgcgacgtgcaagaaatttttcgcatgaccccccacgagaagcaggttatgatgttcagcgccactctatcaaaggagattaggcccgtgtgccgcaaattcatgcaggaccccatggagatctttgtagacgacgaaaccaagctgacactgcatggcctgcaacagtattacgttaagttgaaagataatgagaagaatcgaaagctattcgacctgctagatgtcctcgagtttaaccaagtcgtgatatttgtgaaatctgtacagagatgcatagcattggcgcagcttctggtggaacaaaacttccctgcaatcgcaatccatcgggggatgccccaagaggaacggcttagcagataccagcagtttaaagacttccagagaaggatcctggtggcaacaaacctgttcgggaggggcatggacatcgaacgcgttaatatagcctttaactatgacatgcctgaagattcagacacataccttcatcgtgtcgccagagccgggcgattcgggaccaagggtctggccatcacgttcgtgagcgatgaaaacgatgcgaagatcttgaacgacgtgcaggacaggtttgaggtcaacatcagcgaactgcctgacgagattgacattagctcttacattgagcaaactcgttag

SEQ ID NO: 114094 - DNA, 420 bp, Artificial Sequence
  Description of Artificial Sequence: Synthetic coding sequence
atggctgagaacgatgtcgacaatgagctactggattacgaagacgatgaagtagagaccgccgccggtggcgatggggctgaggcacccgccaagaaagacgtcaaaggcagctacgtttctatccatagctccgggttcagggatttccttctgaaacccgaattacttagagccatcgtggattgcggcttcgagcaccctagcgaggtgcagcacgaatgtattccacaggccattcttgggatggatgtgctgtgccaggccaagagtggtatgggaaagacagccgtctttgtcttggccactctgcagcagctggaacccgtgacaggccaaagccatgaacatatgaccagtgtcactttagataacctaaccgccgtgggggatgttctttctcaggcttggggctcatag

SEQ ID NO: 114095 - DNA, 1332 bp, Artificial Sequence
  Description of Artificial Sequence: Synthetic coding sequence
atggcagagaatgacgtcgataatgagttattagactacgaggatgatgaggtggagaccgccgctggaggcgatggagctgaagccccagccaaaaaagacgttaaggggtcttacgttagtatccatagctcaggattccgcgatttcctcctgaagccagagctgctgagagccattgtcgactgtgggtttgaacacccctccgaagttcaacacgagtgtataccacaggccattctagggatggatgtcctgtgccaggccaagagtgggatgggcaaaactgcagttttcgtactggcaaccttgcagcagctggagcccgtgactgggcaagtttacctcggcagagtgcttggccgcgggttctggtgtgtgtttgtgtcagttttggtcatgtgccacactcgggagcttgcgttccagatcagtaaagagtacgaacgcttcagtaaatacatgcccaatgtaaaggtggcagtcttttttgggggtctgtcgattaagaaggacgaggaggttttgaagaagaactgcccccacattgtggtgggaactcccggacgaattctcgccctggccaggaacaaatcacttaacctcaaacatatcaagcactttatcctggacgaatgtgataaaatgcttgagcagttagatatgcgcagagacgtgcaggaaattttcaggatgaccccgcatgaaaaacaggtgatgatgtttagtgctaccctgagcaaagaaatacgacccgtgtgtcgcaagttcatgcaggaccctatggagatcttcgtggacgatgaaacaaagttaaccctgcacggcctgcagcaatattacgttaagctgaaggataacgagaagaacaggaagctctttgacttgctcgacgtcctcgaatttaaccaagtggtgatcttcgtgaaatccgtccagcggtgtatcgccctggctcagcttcttgtcgagcagaacttccccgctatcgctattcaccgaggaatgcctcaggaggagagactgagccggtaccagcagttcaaggatttccagcgtcggatactcgtagccacaaatttattcggcagagggatggatatcgagagagtaaacatcgctttcaactacgacatgcctgaagatagtgatacgtaccttcatagggtggccagggctggcaggttcgggaccaagggccttgcaatcacttttgtgtcggatgagaatgatgccaagatacttaatgatgttcaggataggttcgaggtgaatatctcagagctgcctgatgagatcgatatatcctcttacatagagcagacacgatag

SEQ ID NO: 114096 - DNA, 972 bp, Artificial Sequence
  Description of Artificial Sequence: Synthetic coding sequence
atggctgagaacgatgtggacaacgaactgttggattatgaagacgacgaagtggagaccgccgctggcggagacggtgccgaggctccggccaaaaaagacgtaaaaggcagttatgtctcaatccacagctctggttttcgagacttcttgcttaagccggagctgctgagagctatcgtcgactgcggctttgagcacccctccgaagtgcagcacgagtgcatcccccaggctattttagggatggacgtgctgtgccaggccaagtcggggatgggtaaaacagctgtttttgttctggcgaccctccaacagctagaaccagtaacaggacaggtctctgttcttgttatgtgccataccagagaattagcattccaaattagcaaggagtacgagcgcttctccaaatatatgcccaatgttaaagtggctgttttctttggtggtctctcaattaaaaaagacgaggaagtgcttaaaaagaactgtccccacattgtggtgggtaccccaggcaggatcctggcactggctaggaataagtctcttaatttgaaacacattaaacattttatcctggacgagtgcgacaagatgctagagcagctggatatgagaagggatgtccaggaaatctttcggatgacgcctcatgaaaagcaggtgatgatgttcagtgcaaccttgagtaaagaaatcaggccagtctgcagaaaatttatgcaggatcctatggaaatcttcgtggatgatgaaactaaactgacattgcacgggctgcaacagtactacgtgaaactcaaagacaatgaaaagaaccgcaagctttttgacctgctggacgtgttagaattcaatcaggagataacctgcaagtccgtgcagcgcttctccaccactaacagctgtggctaccagccaatctggccacggcacgggcatcgcgccggtgaacactgtttctag

SEQ ID NO: 114097 - DNA, 972 bp, Artificial Sequence
  Description of Artificial Sequence: Synthetic coding sequence
atggccgagaacgacgtagacaatgaactgctagactacgaagatgacgaagtggagaccgccgctggtggcgacggcgcagaggcaccagctaagaaggatgtcaaaggatcatacgttagtatacattcgagcggctttagggacttcctccttaaacctgagctgctcagagcgatagtggattgcgggttcgaacacccctcagaagttcagcacgagtgtatccctcaggccattttaggtatggatgtcctgtgccaggccaagtcaggtatgggcaaaaccgcagtgttcgtgcttgctacactgcagcagctggaaccagttaccgggcaggtttcggttttagtaatgtgccacaccagagagctcgcgttccaaatctcaaaggagtacgaaagattttcgaagtacatgccaaatgtgaaagtggctgtattcttcggcgggcttagtataaaaaaggacgaggaggttttgaaaaagaattgcccacacatcgttgtgggtacccctggaaggatactcgcactggctcggaacaagagcctgaaccttaaacacatcaagcacttcatcctggatgagtgcgataaaatgttggagcagctggacatgagaagggatgttcaggaaatctttcgtatgacccctcatgaaaaacaggtaatgatgttttcggcaactctgtccaaggagatccgacctgtgtgcaggaaattcatgcaggaccccatggagatcttcgttgatgacgaaactaagctgacgttgcacggccttcaacagtactacgtgaaactcaaagataacgaaaaaaatagaaagttgttcgacctgttggacgtgcttgagttcaaccaggagatcacatgtaagtcagttcagcgattcagtaccactaatagctgtggatatcagcccatctggcctcgtcacggacatcgggctggcgagcattgtttttag

SEQ ID NO: 114098 - DNA, 1053 bp, Artificial Sequence
  Description of Artificial Sequence: Synthetic coding sequence
atgtggaccatgtcctcatggacaatgaaaatgatgagatggcgacaacaactgggagaaatgggcctgagacccctgcccaggcgcatgagccgcgcacctatgagcccctctactgccctggctttcgtgactagctgttcaagccaatcatgcagcggacctcttagcaccgtggccctgagcatcaggcagaaggtggcagtattctttggcggcctctctattaagaaggacgaggaagttctgaagaaaaactgtccccatattgttgtgggaacccctggtaggatcctggccctagccagaaacaagagtctgaacctcaagcacattaagcacttcatcctggatgaatgcgacaagatgctagaacaactggatatgcgtcgcgacgtgcaggaaatttttcgcatgactcctcacgaaaagcaagtgatgatgtttagtgccactctttcaaaagagataagacctgtctgtaggaaattcatgcaggaccctatggagattttcgtcgatgacgaaaccaaactgacactgcacgggcttcaacagtattatgtgaagctgaaagacaacgagaaaaatcggaagttgtttgacctgctggatgttctggagtttaatcaagtggttatctttgtgaaatccgtgcagcggtgtatcgcgctcgcccagcttctggtggagcagaactttcctgccatcgctatccaccgagggatgcctcaggaagaacgcctgtcgaggtatcagcagttcaaagacttccaaagaagaattctagtcgccaccaatttgttcggccgagggatggacatcgagagggtgaatattgcctttaactatgatatgccagaggattccgacacatatcttcatagggtggcccgggctgggagattcgggaccaaaggcctggctatcacgtttgtatcagacgaaaatgacgctaagatacttaatgatgtgcaggacaggtttgaagtgaatatttccgagctacccgacgaaatcgacatttcgtcctacatcgaacaaaccaggtag

SEQ ID NO: 114099 - DNA, 420 bp, Artificial Sequence
  Description of Artificial Sequence: Synthetic coding sequence
atggcagagaatgacgttgacaacgagctcctggattacgaagacgatgaagtcgagacggccgccgggggcgatggcgcagaggcccccgcgaagaaggatgtgaagggatcttatgtatccattcacagttctgggtttagggacttcctccttaagccggagctgcttagggccatcgttgattgcggattcgagcatccaagcgaagtccagcatgagtgcatcccccaagccatcctcgggatggatgtgctgtgtcaggcgaagagtggaatgggcaagactgctgttttcgtgcttgcaacactccagcaactggagccagtcaccggtcagagccacgagcacatgactagcgtgacgctggacaacctgaccgccgtgggggatgttctcagccaggcttggggaagctag

SEQ ID NO: 114100 - DNA, 1053 bp, Artificial Sequence
  Description of Artificial Sequence: Synthetic coding sequence
atgtggacaatgtctagttggacgatgaagatgatgcgatggaggcaacagctcggcgagatgggactgcgtccgcttccacggcggatgtcacgtgctcctatgtccccctctactgctctggcctttgttacatcctgtagttcacagagctgtagcggcccattatctaccgtcgcactgtccattagacaaaaggtggcggtcttcttcggtgggctgtccataaagaaggacgaagaagtgttgaaaaagaattgtccgcatatcgtcgttggtacccctggacggattctggccctagctcgtaataaaagtttaaaccttaagcatataaaacacttcatcctggacgagtgtgataaaatgctggagcagctggacatgcgtcgggacgttcaagaaatattccgtatgacacctcacgagaagcaggtgatgatgttttcagccacactctcgaaggaaattcgcccggtctgtcggaagttcatgcaggacccaatggagatttttgtggatgatgaaactaagctcacccttcacgggctgcagcagtactacgtcaagctgaaagataacgagaagaatagaaagctgtttgacttactcgatgtgctggagtttaatcaggtggttatctttgtcaaatcggtgcagcgctgcatcgctttagcccagttactggtggaacagaacttcccagcgatcgcgatccatagaggcatgccacaggaagagcggcttagccgttaccagcagttcaaagatttccagaggcgcattttggtggcgaccaatctcttcggccggggaatggacattgagagggtgaatatcgctttcaactacgacatgcccgaagacagcgatacctatttgcacagagtggcacgggctggacgcttcggtaccaaaggactcgccatcacattcgtctccgacgagaacgacgccaaaatacttaatgacgtgcaggatcgcttcgaggtgaatatctccgagctgcctgacgaaatcgacatatcatcatatattgaacagaccaggtag

SEQ ID NO: 114101 - DNA, 420 bp, Artificial Sequence
  Description of Artificial Sequence: Synthetic coding sequence
atggccgagaatgatgtcgacaatgagttgttggattatgaggatgatgaagtggagacggctgctggaggagacggtgctgaggccccagctaagaaagacgttaaaggctcttatgtgtcaatccattcttctgggtttcgtgactttctactaaaaccagaactgcttcgcgctattgtggattgcggctttgagcacccttctgaagtgcagcacgagtgtattcctcaagctatccttggtatggacgtactttgccaggccaagtctggaatggggaaaactgcagtcttcgtgctggccacactacagcagctagaacccgtgacgggacagagccacgagcacatgacatctgtaacactggacaatctgactgccgtaggagatgttctatcccaggcctggggctcttag

SEQ ID NO: 114102 - DNA, 1332 bp, Artificial Sequence
  Description of Artificial Sequence: Synthetic coding sequence
atggccgagaacgacgtggacaatgagcttctagattacgaggacgatgaggttgaaactgccgcgggcggcgacggggcagaggccccagcgaagaaagacgtgaagggctcttatgtaagtatccacagctccggtttccgcgactttctgctgaagcctgagctccttcgcgccatcgttgattgtgggtttgagcatccctccgaagtgcagcacgagtgcatcccccaggctatccttggaatggacgttctgtgtcaagctaagtccggcatgggtaagacagctgtgttcgtcctggccaccctgcagcagctcgagccagtgaccgggcaggtgtaccttggccgggtactgggtcggggcttctggtgcgtgttcgttagtgtgctggtgatgtgccacacaagagagttggcgttccagattagcaaagagtacgagcgcttctcaaagtacatgccgaatgtgaaagttgctgtgtttttcggaggattatcaatcaagaaagatgaggaggtcctaaagaaaaattgtccgcatattgtggtgggaacgccaggccgcattctggccctagcccggaataaatccttgaacctgaagcatattaagcatttcattctcgacgaatgcgataagatgttagaacagttggacatgcggcgggatgtgcaggaaattttccgcatgaccccccatgaaaagcaggttatgatgttcagcgctactcttagcaaagaaatccgccccgtctgtcgaaaatttatgcaagaccccatggagatcttcgtcgatgacgaaacaaaacttaccctccatggattacagcagtattacgtcaagttgaaagataacgagaaaaataggaagctgttcgatctgctagatgtcctggagtttaaccaggtggtgatctttgtcaaaagtgtccaacggtgcatcgctcttgcgcagctgttagtggaacaaaatttccccgctattgccatccatcgtggaatgccacaagaagagcgattgagcaggtatcaacaatttaaggactttcagaggaggatcctagtagctactaacctattcggccgcggcatggatatcgaaagggtgaatattgcgttcaactatgatatgcctgaagactcagatacatacctgcatagggtggctagggccggtcgatttggaacaaaagggctggcgattacctttgtatccgacgaaaatgacgctaagatcctcaacgacgtgcaggacagatttgaggtgaacatatcggaactacccgacgaaattgacatttcaagttatatcgaacaaacaagatag

SEQ ID NO: 114103 - DNA, 552 bp, Artificial Sequence
  Description of Artificial Sequence: Synthetic coding sequence
atggaaatctttgtggacgacgagactaaactgactttgcatggtctacagcagtactatgtcaagctcaaggataacgaaaagaataggaaactcttcgacctgctggatgtgctcgagttcaatcaggttgtgatttttgtgaagagcgttcagcgctgtatcgctttagcgcagctacttgtggaacagaattttcccgctatcgctatccaccgtggcatgccacaggaggagaggtggctgtctcggtatcagcagttcaaggattttcagaggaggatccttgtagccacaaatctgtttggaagagggatggatatcgagcgggtcaacattgcatttaattatgatatgcctgaagactccgacacttacctccatcgggtcgcacgggccggacggttcggcactaagggattggccataacctttgtaagcgatgaaaacgatgccaagatcttaaatgatgtgcaagacagatttgaggtaaacatctccgaactgccagatgagatcgacatctcctcatatatcgagcagacccggtag

SEQ ID NO: 114104 - DNA, 2073 bp, Artificial Sequence
  Description of Artificial Sequence: Synthetic coding sequence
atgggggatgaggactgggaggccgagatcaatcctcatatgtcttcatacgtacctatttttgagaaagatagatacagcggcgagaacggcgacaattttaacaggacccccgcatcttcttcagagatggatgatggcccctctaggcgagatcactttatgaagtctggcttcgccagcggcagaaattttggcaatagggacgccggagagtgtaacaagcgggacaatacatcaaccatgggtggcttcggagtcgggaaatcattcggcaatcgcggattctcaaattctcgttttgaggatggcgacagctctggattttggcgagaaagctcgaacgattgcgaagataatcccacccgcaacagaggtttttccaaaagaggcgacaacgatctggacccagatgagtgtatgcagagaaccggaggcctctttggttcaagaaggcccgtgctgtccgggaccggcaacggggatacgtcacaatctaggtctggctcgggaagtgagcggggagggtacaaaggcctaaatgaggaggtgatcactggttcaggcaaaaatagctggaagagcgaagcggaaggaggtgagtcatccgatacccagggtcctaaagtgacttacattccacccccaccaccagaagacgaggacagtatttttgcacactatcagaccggtattaatttcgataagtacgacacaattctggtcgaagtgagtggtcacgacgcacctcccgccattctgacctttgaagaggcaaatttatgccagactctgaacaacaacatagccaaagccggttacaccaaactgaccccagttcagaaatactcaatacccattatcctcgccggaagagatctcatggcctgcgctcagacgggttccggcaagactgccgcctttttgctaccgatcctggcccacatgatgcacgacgggatcacagcatccagattcaaagaactgcaggaaccagagtgtatcattgttgcacctacgagggaattagtgaatcagatttatcttgaggcacggaagttttcattcggaacgtgcgtccgcgcagtggtgatttacggagggacacagctgggtcactccattagacagattgtgcagggatgcaacattctttgtgctacgcccggtcgcctgatggatatcatcggaaaagagaagattggtctgaaacaaattaaatatctcgtcctggacgaagcagataggatgttggacatgggattcggccccgaaatgaaaaagcttatctcatgccccgggatgccctccaaagagcagaggcagactcttatgttctcggccaccttcccggaggagatccagagactggcagccgagttcctgaaatctaactatctttttgtcgctgtcggacaggtgggaggtgcttgtcgcgacgtgcagcagactgtgctccaggtggggcaatttagtaagagggaaaaactggtggaaattctgcgaaatattggagatgagagaacaatggtgttcgtcgaaacaaaaaaaaaggccgacttcattgcgaccttcctttgccaagagaagataagtacaaccagtatccacggcgacagagaacagagagagcgcgagcaggccctcggtgatttccggtttggaaaatgtccagtgcttgtagccacatccgtggctgcaaggggcctagacattgaaaacgttcagcatgtcataaattttgacctgccatccacgatagacgaatacgttcaccggattggacggaccggaagatgcgggaacaccgggcgagctattagcttctttgacctcgagtctgataatcatttggctcagcctctggttaaagtactcactgatgcacagcaggatgttcccgcttggctggaggagatcgctttttcaacctatatcccgggattttccggctccacaaggggcaacgtctttgccagcgttgatacgcgtaagggcaaaagcaccctgaacaccgccggcttcagcagctcccaggcccctaatcccgtagacgatgagtcatgggattag

SEQ ID NO: 114105 - DNA, 2073 bp, Artificial Sequence
  Description of Artificial Sequence: Synthetic coding sequence
atgggagatgaggattgggaagccgaaataaacccccatatgtctagttatgtccccatattcgaaaaggacaggtactccggcgagaatggggataactttaaccgcaccccggcatcctcctccgaaatggatgacggaccatcccggagggaccactttatgaaaagcgggttcgcttcgggacggaatttcggtaacagagatgctggtgaatgcaacaagcgagataacacatcaaccatggggggattcggagtaggcaagtcctttgggaacagagggttcagcaactctaggttcgaagatggtgacagttccggcttctggcgtgaatccagcaacgactgcgaggataaccctaccagaaaccgggggttttctaaaaggggcgacaacgacctggacccagacgagtgtatgcaaaggacagggggactttttggttctagaagacccgtgctgtcagggaccggcaacggggacaccagccagtcgaggtctggatccggatccgaacggggcgggtataaaggcctgaacgaggaggtcatcaccgggtcaggcaaaaattcttggaaatctgaggcagagggaggcgaatcctctgatacacagggccccaaggtcacttatatacccccccctcctcccgaggatgaggatagtatttttgcccattatcagacaggcatcaacttcgacaaatacgacaccatactcgtggaagttagtggtcatgacgccccacccgccatcctgacattcgaggaagcaaacctatgccagacactgaataacaacattgctaaggccggatacaccaagttaacccccgtgcagaagtatagcatcccaattatcttggctggccgggatctgatggcttgtgctcagaccggatctggaaagactgctgcctttctgcttcccattctggctcatatgatgcacgacggcataaccgccagcaggttcaaggagctgcaggagcctgaatgtatcattgttgccccaactagggaattggtgaaccagatctacctggaggcccgaaagttcagctttggcacgtgtgttagggccgtcgttatatatggcggtacacaattgggacatagcatcaggcagatcgtccagggctgcaacatcctgtgcgccaccccaggacggctgatggacattatcggcaaggaaaaaattggattaaaacagatcaagtacttagtactggacgaggccgatcgcatgctcgacatgggctttggcccagaaatgaagaagctcatttcgtgccccggcatgccatctaaggaacagcgtcagaccctgatgttctccgctacctttcctgaggagattcagagactggccgcggagttcctgaagtccaactatctgtttgtggcggtcggccaggtcggtggcgcctgccgagacgtgcaacagacagtactacaggtgggccagttctcgaagcgcgaaaagttggtggaaatcctgcggaacatcggcgatgaacgcactatggtcttcgtggaaactaaaaaaaaagccgactttatcgccacctttctgtgccaagaaaaaatatcaaccacgtccatacacggagaccgcgagcagcgtgagcgagagcaagctctaggagacttcaggtttgggaagtgccccgtccttgtggccacatctgtggccgcaaggggcctggacatcgaaaatgtgcagcatgtcattaactttgacctgccttccacaatcgatgagtatgtgcatcggattggaagaactggccgctgcgggaacactggaagggcaatttcatttttcgatctcgaaagcgataaccatctggctcagcctctggttaaagttctgaccgatgctcagcaggacgtgccagcttggcttgaagagatagctttctccacttatatcccaggattcagcgggtctacaaggggcaatgtgttcgcatcggtcgacaccagaaaaggcaagtccacattgaacacggcagggttttccagttcccaagctccaaatcctgtggatgatgagtcatgggattag

SEQ ID NO: 114106 - DNA, 2175 bp, Artificial Sequence
  Description of Artificial Sequence: Synthetic coding sequence
atgggagatgaggattgggaagcagagataaatccgcatatgagcagctatgtacctatttttgagaaagacagatatagcggagagaacggcgacaattttaatcgcacccccgcctcgtcttccgagatggatgacggtccatcccgcagagatcactttatgaaatctgggttcgccagtggccggaactttggcaaccgagacgccggcgaatgcaataaacgggacaacacctcaactatgggtggcttcggtgttggtaagagtttcggcaacaggggtttctcaaacagccgcttcgaagacggggattcctcaggattctggcgcgagagttccaatgactgtgaggataatccgactagaaaccgcggattctctaaacggggcggctaccgagacggtaataacagcgaggcctctggcccctaccgcaggggtggccggggctcatttcgcggatgccggggagggttcgggttaggctctccaaataatgacctggacccagacgagtgcatgcaacgtaccggcgggctgtttgggagcaggcggcccgtgttatctggcaccgggaacggagatacaagtcagtctaggtctgggtctggctcagaaaggggtggctacaaagggctgaacgaggaggtcataacagggtccggtaaaaatagctggaaaagtgaggcagaaggaggagaatctagtgacacacagggccccaaggtgacctacattcccccaccaccaccagaagacgaagattctatctttgcccactatcagaccgggattaactttgataagtatgacaccattctagtcgaggtgtccgggcatgacgcccctcctgccatcctaaccttcgaagaggcgaatctctgccagaccctgaacaacaacatcgcaaaagcgggctatactaagcttacccctgttcagaagtattcaatccccattatcctggccggcagggacctaatggcctgcgcccagactgggtctggaaagactgccgcgttccttctgcctattctcgctcatatgatgcacgatggcatcaccgcttcccgttttaaagagctccaggaaccggaatgcattatcgtcgcaccgacccgcgagctcgttaaccagatctatctggaggcacggaagtttagcttcggcacctgcgtcagagctgtcgttatttatggaggcactcaactggggcattcaatccgccaaatagtacaagggtgtaacatcctgtgtgcgacacctggccgtctgatggatatcataggcaaagaaaaaattggcctaaaacaaattaaatatctggttcttgatgaggccgaccgcatgctagatatggggttcggccctgaaatgaaaaaactgatttcctgccctggtatgcccagcaaggaacaacggcagaccctgatgtttagcgcaaccttccccgaggagatccagcgcctagctgccgaattcctgaagtcaaactatttgttcgttgccgtgggccaggtcggcggggcctgtcgggacgtgcaacagaccgttttacaggtgggacagttctcaaaacgtgagaaactggttgagatattgcggaacatcggcgatgaaaggacgatggtttttgtggaaacaaagaaaaaagccgattttattgccactttcctgtgccaggaaaagatctctacaacgtccattcatggagacagagagcagagagagagagagcaggccttgggcgacttcagattcggcaaatgcccagtgctcgtcgccacaagcgttgctgcgcgcggtctggatatcgagaatgtacaacacgtgatcaacttcgacctaccctcaacaatagacgagtacgtgcacaggatcggccgtactggtagatgtgggaacacagggagagccattagtttctttgatctggaaagcgacaatcatctcgcacagccccttgttaaagtgttgaccgatgcacagcaagacgtgcctgcgtggctggaggagattgcatttagtacctacattcccggttttagcggatctacccgcgggaacgtgtttgctagcgtcgacacccggaagggaaagtccacattaaataccgccggtttcagcagcagtcaggctcctaaccccgtcgacgatgagagctgggactag

SEQ ID NO: 114107 - DNA, 318 bp, Artificial Sequence
  Description of Artificial Sequence: Synthetic coding sequence
atgggcgacgaggactgggaggctgagattaatcctcacatgtcatcttatgtccctattttcgaaaaggataggtactccggagaaaacggggataacttcaaccgaactcccgcgtcctcctcggaaatggacgacgggccatcacgccgcgaccattttatgaaaagcgggtttgcatccggcaggaatttcgggaacagggatgcgggcgaatgcaataaacgggataatacatctaccatgggaggattcggcgttggtaagagtttcggaaatcgggggttctccaactcacggtttgaggacggagattag

SEQ ID NO: 114108 - DNA, 2115 bp, Artificial Sequence
  Description of Artificial Sequence: Synthetic coding sequence
atgggcgacgaagactgggaagccgaaatcaatccccatatgagctcctacgtccctatcttcgagaaagaccggtacagtggagaaaacggcgacaattttaacagaaccccagcttcttctagcgaaatggatgacgggccatcccgccgggaccactttatgaaaagtgggtttgccagcggccggaattttggcaatcgagacgctggtgaatgtaacaaacgggacaatacgtcgactatggggggcttcggtgtgggcaagagcttcggtaatcgaggttttagcaattcacgtttcgaggacggagatagtagtggattctggcggggataccgcgatgggaataactccgaagcaagtggaccttataggcggggaggccggggcagttttcgaggctgtaggggagggtttggacttgggagccctaacaatgacctggacccggatgagtgtatgcagaggacggggggcctgttcgggtctcgaaggcccgtgctgtcaggcaccggcaatggtgatacaagccaatcacggtccggcagtggaagcgagaggggcggttacaaagggctgaacgaagaagtaattactggctccggaaaaaatagttggaagtccgaggctgaaggtggggaatcgtctgatacccaaggtccaaaagtcacatacattcctcctccgccgcctgaggacgaagactcgatttttgctcattatcaaaccggaatcaattttgacaaatacgataccatcctggtagaggtgtccggacacgatgctcccccagctattttgacatttgaggaagcaaatctgtgccagaccctgaacaacaatattgcaaaggccggctacactaaattaacccccgtgcaaaaatactctatccccattatcctggccggcagggacctcatggcctgtgcccaaacaggctccggcaagacagcagcctttcttctgcccatactggctcatatgatgcatgacggtattactgcgtctaggtttaaggaactgcaggaaccagaatgtattatcgtcgccccaacacgagaattggtgaatcagatttatttagaagcccgtaagttcagcttcggcacctgcgtgcgcgctgtggtcatttacggcggcactcagctcggtcattcaattcgtcaaattgtgcaggggtgtaatatcttgtgtgctactcccggccggctcatggatatcatcggaaaagaaaagattggcctgaaacagataaagtacctggttctcgatgaggctgatcggatgttggacatgggattcgggccagagatgaaaaagctgatctcctgccccggcatgccctctaaggagcagcgtcagaccttaatgttctcagccactttcccggaagaaatccagcgcttggcagcagagtttctgaagagcaactatctattcgtagccgtcgggcaggtgggcggggcgtgtcgagatgtgcaacagaccgtcctgcaggttggccaattttcaaagcgagaaaagctggtcgaaatcctgaggaacatcggggacgagaggaccatggttttcgtcgaaactaagaagaaggccgactttattgccacctttttgtgccaagagaagatttctacaacttctattcacggtgatcgggaacagagggaacgggaacaagccctcggcgatttcaggttcggtaaatgtccagttcttgtggccacgagcgtcgctgcaaggggactggacattgagaacgtccagcatgttataaattttgatctgcctagcaccatcgatgagtacgtccatcgaattggtagaactggcaggtgtggaaacacagggcgtgccattagtttcttcgacctcgagtccgacaatcatctggctcagccacttgtgaaggtgctgacggacgcccaacaggatgtgccagcctggctcgaagagatcgctttttccacttacatccctggtttctcgggttcaactcgaggcaacgtcttcgccagtgttgatacacgtaaagggaagagcactctgaataccgctggcttcagttcatcgcaggccccaaaccctgtagacgacgagtcctgggattag

SEQ ID NO: 114109 - DNA, 480 bp, Artificial Sequence
  Description of Artificial Sequence: Synthetic coding sequence
atgggcgacgaagattgggaggctgagattaacccccatatgtccagctatgttcctatattcgagaaggaccggtattccggggagaacggtgacaattttaacaggacaccggcctcttcttctgagatggatgacggaccatccaggagagatcacttcatgaaatctggatttgctagcggccgcaacttcggcaacagagacgcaggcgagtgtaacaaacgagataatacgtccacgatgggtggttttggcgtgggcaagagcttcggtaaccgaggctttagtaactcaagatttgaggacggcgattccagtggtttctggagagaatctagtaacgactgcgaggataaccccactagaaatcgcggctttagcaagagaggcggttaccgtgacgggaataattcggaagcttcggggccataccggcggggcggccggggcagtttcagaggttgtcgggggggctag

SEQ ID NO: 114110 - DNA, 1728 bp, Artificial Sequence
  Description of Artificial Sequence: Synthetic coding sequence
atggggagtagaaacctcttcctgacaaattctcccgaatccagcaacgactgtgaagacaacccaacccgcaatcgcggatttagcaagcgcggggataatgatctcgatcctgatgagtgtatgcagcgcaccggtggcctgtttgggtcacgcagaccagtgctctccggaactggcaatggagatacaagccagtcccgttctggctcaggtagcgaaagagattcatggaaaagcgaggcagaagggggtgagagcagtgacacacagggacctaaagtgacctacataccacctccaccccccgaagacgaagactcaatctttgcccactatcagacgggcatcaattttgataaatatgacacaattctcgtggaagtatcaggacacgacgctccccctgctattttgacattcgaggaggccaatttgtgccaaaccctcaataataatattgccaaggcaggttatactaaactgacaccagtgcagaagtactcaatacccatcattctagccgggcgggatctcatggcctgtgcccaaaccggctctggcaagacggctgccttccttctgccaatcctcgcccacatgatgcacgacggcattacagcatctaggttcaaagagctgcaggagccagaatgcataattgttgcgcctacaagggaattagtgaatcagatctatctagaggcccgcaagttttccttcggtacgtgcgttagagcggtcgtgatctatggcgggactcagctgggacactccatcaggcaaatcgtccagggttgtaacattttgtgtgcaacacctggtcggctcatggacattatcggcaaggaaaaaatcggcctaaagcagattaagtacctcgtgctcgacgaagctgaccggatgctggacatgggctttggccctgaaatgaaaaagttgatctcatgtccgggcatgccaagtaaggagcagcggcagactctgatgtttagcgccacctttcccgaggagatccagagactggctgctgagtttctgaaaagcaactatctcttcgtggccgtggggcaggtgggcggggcctgtcgagacgttcagcagacggtcttgcaggtaggtcaatttagcaagcgtgaaaaacttgtggagatcctgcgcaatatcggcgacgagagaacaatggtgttcgtagagacgaagaagaaagccgactttatcgcaacattcctctgtcaggaaaaaattagcacaacgagcattcacggagatcgtgaacagagggaacgggaacaggcgctgggagatttccgttttggcaaatgtccggtgttagtggccaccagtgtagcagcgcgagggctcgacatcgagaatgtgcagcatgtgattaacttcgatcttccaagtaccattgatgagtacgtccataggatcggccgcactggaagatgtgggaatactggaagggccatctcattctttgatttggaatccgataaccatttggcacagccactggtgaaagtgctgacagacgcccagcaggacgtgcccgcttggctagaggagatcgcgttttctacttatataccaggcttcagtggttctaccaggggcaatgttttcgctagtgttgacaccaggaaaggcaagagtactctgaacaccgctgggttcagttccagccaggcaccgaaccccgtggatgatgaaagttgggattag

SEQ ID NO: 114111 - DNA, 1869 bp, Artificial Sequence
  Description of Artificial Sequence: Synthetic coding sequence
atggaagaatccgagcccgaaaggaaacgtgctaggacagacgaagtgccggctggcggttcaaggtcggaggcggaagatgaggacgacgaggattatgtgccatatgtgccactgcgacagcgtcgccagcttctactacaaaagttacttcagcgccgacggaaaggcgctgctgaagaggagcaacaggactcgggcagtgagccccggggcgatgaggatgatataccacttggacctcagtcaaatgtatctctcctggaccaacaccagcacctgaaggaaaaagccgaggccagaaaagaaagcgctaaagagaagcaattgaaggaagaagagaagattctggagagcgtggctgaagggagggccctgatgtcggtcaaggaaatggcaaagggcatcacgtatgacgaccccattaaaacatcatggactcctcctagatacgtgctctctatgagcgaggaaagacatgaacgggtgcgaaagaagtaccacattctggtagagggcgacggcattccaccccctatcaaatcctttaaagaaatgaaattccctgcggccattctcagggggcttaagaaaaaaggcatccaccatccgactcctattcagatacagggcatccccacaatcctgagtggccgcgacatgatcggcatcgcattcaccgggagcggaaaaacgctggtgttcacgctaccagtcatcatgttttgcctggagcaggagaaacgactccccttttctaaaagggagggcccatatggcttgattatttgcccaagtcgggagcttgcccggcaaacacatggcatccttgaatactactgtcggctcttgcaggaggattccagtcccctgttgagatgcgcactgtgcatcggcggtatgagtgtgaaggagcaaatggagacgatcagacatggggtccacatgatggtcgccactccagggaggctgatggacctcctacagaaaaagatggtctcactagatatctgtcgctacctggcactggatgaggccgataggatgattgatatggggttcgagggcgacataaggacaatctttagctactttaagggtcagcggcagactcttttattttccgccaccatgccgaaaaagattcaaaatttcgccaaatcagctctggttaagccagtgacaataaacgtcggacgggccggggcagcatctctggacgtaattcaggaagtagagtatgtcaaggaagaagcaaaaatggtatacctgctggaatgtttacagaaaacacctcctccagtcctgatctttgctgagaaaaaagcagatgtggacgcaatacatgagtatttgttgttgaaaggcgtggaggctgtcgccattcatggcggtaaagaccaggaggagcggactaaagccattgaggcctttcgagagggcaagaaggatgtgcttgtagctaccgacgtggcgtctaaaggtttggatttcccggcaattcagcacgtgatcaactacgatatgccggaggagatcgagaactacgtacaccggattggacgcacaggaaggagcggaaatactggcattgcgacgacatttataaacaaggcgtgtgacgaaagcgtcttgatggatttgaaagcccttctgctcgaggcaaagcagaaggtgccaccagtattgcaggttttgcattgtggggatgaaagtatgctggatatcgggggcgagagggggtgtgccttttgtggcggtcttggacacagaatcacggattgtcccaagctggaagctatgcagacaaagcaggtgtcaaacatcgggagaaaggactacttggcccattcctctatggacttctag

SEQ ID NO: 114112 - DNA, 1881 bp, Artificial Sequence
  Description of Artificial Sequence: Synthetic coding sequence
atgcatcaaatcagaaagagtgagtatacccaacccactcctattcagtgtcagggagttccagtggccctgtcgggtagagatatgataggaatagccaaaaccgggagcgggaagactgcagcttttatttggcccatgctcattcacatcatggatcagaaggaattggaaccaggagatggccccatcgcggttatcgtctgtcctacacgcgaactgtgtcagcagattcatgcagaatgcaagaggttcggaaaagcatacaacctacgctcagtggccgtgtacggcgggggtagtatgtgggagcaggctaaggctctgcaggaaggggccgaaatcgtggtatgtacccctggcaggttgatcgaccatgtgaaaaagaaagcaaccaacctgcagagggtgagctaccttgttttcgatgaagcagacagaatgttcgacatggggtttgaataccaggtgcgttccattgcctctcacgttaggcctgaccggcaaaccctgctgtttagtgcgacctttcgcaaaaagatcgagaagttggctcgtgatatactgattgacccaatcagagtagtacagggagatattggggaagccaacgaggacgtaactcagatagttgagattctccactcgggaccttcaaagtggaactggctgacccggcgcttggtcgagttcacctcatcgggttcagtcctgctctttgtcacgaaaaaagcgaacgctgaagagttagcaaacaatctcaaacaagagggtcacaacctggggctgcttcatggagacatggatcagagcgagaggaacaaggtgatttcagattttaagaaaaaggatatacctgttctcgttgccactgatgttgccgcccgcgggctggacatcccgtccatcaagacggtgatcaattatgatgtcgctcgggatatcgacactctcctgacgcctaaggatagcaattttgcaggcgacctggtgcggaatctggagggggctaaccaacacgtgtctaaggaactgctggatctggccatgcagaacgcctggttccgcaagtcacgtttcaagggcggcaagggcaagaagctcaacattggggggggcggattagggtacagggagcggcctgggctgggctctgagaatatggatagaggtaataacaatgtcatgagtaattatgaagcctacaaacccagcacaggagccatgggcgatagactgaccgcaatgaaagccgcttttcagtcccagtataaaagccacttcgtggcagcatctctgagtaatcagaaagctggctcttccgcggccggcgcaagtggatggacctctgccgggagcctgaattcagtgcctacaaactctgcccaacaggggcacaattctcccgactcacctgtcacttcagccgccaaggggatacccggctttggcaacaccggcaatatttcaggagctccagtaacgtacccaagtgcaggtgcacagggcgtaaacaatacagccagcggcaataattctcgcgaaggcacgggaggcagtaacggaaagcgcgagcgctataccgaaaaccgaggatcctcccgccattcgcacggcgagacaggaaaccggcattcagattcgcctcggcacggcgacggggggagacacggcgacgggtacagacatccagaatcgagcagtcgacatacagatggccatcgacatggagagaaccgtcacggcggtagtgctggacgtcatggcgaaaatcggggcgcaaacgacggtcgaaatggagagtctagaaaagaagccttcaaccgcgaatccaagatggaaccaccgcccaaacggaaaaagagccggtgggatagctag

SEQ ID NO: 114113 - DNA, 2817 bp, Artificial Sequence
  Description of Artificial Sequence: Synthetic coding sequence
atgaattggaacaaaggcggccccggtactaaaagggggttcggcttcggcgggtttgctatctctgccggcaaaaaggaagaacctaaactgccccagcagagccactccgcatttggcgctacgagcagctcaagcggattcggaaagtcggctcccccacagctcccttctttctataagatcggttccaagcgcgctaattttgacgaggaaaacgcctacttcgaagacgaggaagaggactctagcaatgtggatctgccgtatatcccagcagaaaatagccctacccggcagcagttccacagtaagccagtagattccgattccgatgatgacccccttgaggcctttatggcagaggtggaggatcaggccgcccgcgatatgaaaagactcgaggagaaagacaaagaacggaagaacgtaaaggggatcagagatgacattgaggaagaggatgatcaggaggcatattttcggtatatggctgagaatccaaccgcgggggtggtacaggaagaggaagaggacaatttagagtacgacagtgatggcaatcctatcgctcctacaaagaagattatcgaccccctgcccccaatcgatcattccgagatcgattacccacctttcgaaaagaatttctacaatgagcatgaagagataaccaatctgaccccacagcagttaatcgacctacgccataagctcaatctgcgggtctctggcgcggcccccccccgccctggatcatccttcgcgcacttcggattcgatgagcagttaatgcatcagattaggaagtccgaatacactcaaccaacccccattcagtgtcagggcgtaccagtcgccctcagcggccgggacatgatagggatcgctaaaaccggctcaggtaaaaccgcagcgttcatctggccaatgctcatacacataatggatcagaaggagctggagccgggagacggccctattgcagtaattgtgtgtccaactcgggagctgtgccagcaaattcacgcagagtgtaagcgcttcggcaaggcttataatctccggagtgtcgctgtgtatggcggtgggtcaatgtgggaacaggcgaaggccttgcaggagggggcagagatcgtggtctgcacacccggacgcctgatagaccacgtaaaaaaaaaggcaactaatctgcagagagtctcatacttggtttttgatgaagcagatcggatgtttgatatgggctttgaatatcaagtccgttcaatagcaagccacgtaaggccagacagacagacactcctatttagtgcaacattcaggaaaaagatcgaaaagctggcacgggatatcctaatcgacccaattcgcgttgtccagggcgacattggggaggcgaacgaggatgttacccagatagtggagatacttcacagtggtcctagcaagtggaattggcttacccgccgtctggtggaatttacaagctccgggtcagtattgctgtttgtcacaaaaaaagcgaatgccgaggagctcgccaacaacctaaagcaagagggccataaccttgggttgttacatggagatatggaccaatctgagcgcaacaaagtcatctctgacttcaagaaaaaagacattccggtgctggtggctactgacgtggctgcccggggtctcgacatccccagtatcaagactgttatcaactacgacgtggcgagagatatcgacacacatacccatcgaatcggccgcactggtcgcgcaggcgagaagggggtggcttacacacttttgactcccaaagacagcaacttcgcaggagacctggtgcggaatctcgagggagctaatcagcatgtttcaaaggagctgctcgacctggccatgcagaacgcgtggttcaggaaaagccgttttaaaggcggcaagggcaaaaaactcaatatcgggggtggaggactggggtatagagaacgtcctggactcgggtccgagaacatggataggggtaataataacgttatgtcaaactacgaagcctacaagccctcgaccggagccatgggggacaggttaaccgctatgaaggcagctttccaaagccaatacaagagccatttcgtggctgcaagcctctcaaatcagaaggccgggtccagcgctgccggtgcatcagggtggacttctgccggtagcctgaattccgtgcccaccaattctgctcagcaaggacataattctccggacagccccgtaacgagcgccgccaagggaattcctggcttcgggaacacaggtaatatctctggtgctcccgtcacatatccaagcgccggagctcagggtgtgaacaacacagccagcggcaacaattcccgcgagggcaccggcggtagcaacggcaagcgggagagatatacagagaatcgtggcagctctaggcatagccatggcgagactggcaatcggcatagcgacagcccaaggcatggggatggtggcaggcatggagatgggtataggcatcccgagagcagctcgagacacaccgacggccatcggcatggagaaaatcggcacgggggcagtgctgggcgccacggcgagaacagaggggcaaatgatggacgcaacggtgaatccagaaaggaggccttcaacagggaatccaaaatggaaccgaaaatggagccaaaggtggattctagcaaaatggataaagttgacagtaaaacagataagacggcggacggattcgccgtgcccgaaccgcccaagaggaagaagtctcggtgggactcatag

SEQ ID NO: 114114 - DNA, 2817 bp, Artificial Sequence
  Description of Artificial Sequence: Synthetic coding sequence
atgaattggaacaaggggggacccggtaccaagcggggcttcggatttgggggattcgccattagcgcaggaaagaaggaggaacctaaactcccccagcagtcacactccgcatttggcgcgaccagtagctccagcggcttcggcaagtctgcccctccacagttgccctccttctacaaaatcgggtccaaacgcgccaactttgatgaggaaaatgcttactttgaggacgaagaagaggactcaagcaacgtggacctgccttatattcctgccgaaaatagcccgaccaggcaacaattccatagtaaacctgttgactcagacagtgatgatgatccgttagaggcgttcatggccgaggtcgaagatcaggcagccagggacatgaaacggctcgaggagaaggacaaggagcggaagaacgtcaaagggatccgagacgatattgaagaggaggatgatcaagaggcttactttcggtacatggctgaaaatcctactgctggtgttgtgcaggaggaagaggaagacaatctggagtacgactccgatggcaaccccatagctccaacaaagaagataatcgaccccctccccccaatcgaccactccgagatcgactaccccccctttgagaaaaatttctataacgaacatgaggagatcacaaatttgaccccacagcagctaatcgacctgcggcacaaactgaacttgagagtgtccggtgccgctccaccaaggcctgggtcctcgttcgcccactttgggttcgatgagcagctgatgcaccagattaggaagagtgagtacactcagcctacacccatacagtgccagggagttcccgtcgctttatccggtagggatatgattggcattgcaaaaacaggaagcggtaaaactgccgcattcatctggccgatgttaatccacatcatggaccagaaggagctcgagcccggggatggcccaatcgccgtaatcgtgtgtccgacacgggagctttgccagcagatccatgcggagtgtaaaagattcgggaaggcttacaatctgcgaagtgtggcagtgtacgggggcggaagtatgtgggagcaagccaaagccctgcaggagggcgccgaaatcgtagtttgcacccctggcagattaatcgatcatgttaagaagaaggcgaccaatctgcagagagtctcctacctggtgttcgacgaggccgacaggatgttcgatatgggtttcgagtaccaagtgcgatcgattgcgtctcacgtgcggccagaccgtcaaaccctgctgttctcagctaccttccggaagaagattgaaaagctggcaagagacatcctcatcgacccaatccgggtcgtgcagggagacatcggagaggccaacgaggatgtgacccagattgttgaaatcctccatagcggtcccagcaagtggaactggctcaccagacggctggtcgagttcactagctccgggtctgttctgctgttcgtgaccaagaaggcgaacgcagaggagcttgctaacaacttaaaacaagagggacacaatctgggcctgttacacggagatatggaccagtccgagagaaacaaagtgatcagcgattttaagaaaaaagacatccccgtactagtggcaacggatgttgcagctagaggcctggacattccatctatcaaaactgtgattaactacgatgtagcccgggatatcgatacacacactcatcgaattgggcggaccggtcgtgcgggcgagaaaggtgttgcctatacacttctcaccccgaaagattcaaacttcgccggagacttggtacgtaatctggaaggtgccaaccagcacgtgagtaaagagctgttggacttggctatgcagaacgcttggtttcggaagagtaggttcaaaggggggaagggcaagaagctgaatattggcggcgggggcctgggctaccgtgaaaggcccggactgggttccgaaaacatggatagagggaataataacgtgatgagtaactacgaagcttataagccttccaccggagcgatgggggatagactcaccgccatgaaagccgcgttccaatcccaatataaatctcatttcgtggcagcttctctaagcaaccagaaggccgggagtagtgctgccggtgccagcggttggacttctgccggctccctgaattcagtccctacgaactcagctcagcaaggacacaattcccccgattcacccgttacgagcgctgccaaaggcatccccggcttcggtaacactggtaacatttctggcgccccagtaacctacccctcagcaggggctcagggggtaaacaacacagcaagcggaaataattctcgcgaggggaccggggggtctaacggcaaaagggagcgctacactgaaaaccgcggatcctccaggcactctcacggcgagacagggaatcggcatagcgactcccccagacatggcgatggcggacgacacggagatggatatcgccaccccgaatctagtagccgacacacggatgggcaccgccacggcgagaaccgccatgggggcagcgcgggcaggcacggtgagaaccggggtgccaacgacggtaggaacggcgagtccagaaaggaggcattcaacagagaatccaagatggagcctaagatggagccaaaggtggactcgtcaaagatggacaaggtagattcaaagactgataaaacagcagacggattcgccgttcctgaaccccctaagcggaaaaagtcgaggtgggattcttag

SEQ ID NO: 114115 - DNA, 2817 bp, Artificial Sequence
  Description of Artificial Sequence: Synthetic coding sequence
atgaactggaataaaggcggacctggcacaaaaagaggcttcggattcggaggcttcgctatcagtgcaggtaagaaagaagaacctaaactcccccagcaatcgcattccgcttttggggctacctcatcaagtagtggcttcggtaaatccgcccccccacaactgccctcattttataaaatcggctccaaacgtgcaaattttgatgaggagaatgcgtatttcgaggatgaagaggaagatagcagtaatgtcgatctgccttacatacctgcagaaaattcccctacgagacaacagtttcatagcaagcccgtcgacagtgattccgacgacgatcctctggaggcattcatggcagaagtcgaggatcaggccgctcgggacatgaagagattggaggagaaggacaaggaacgcaaaaacgtgaagggcatacgagatgatattgaagaggaagatgatcaggaggcttatttcaggtatatggcagagaatcccaccgccggtgtggtgcaggaggaggaggaagataacctggagtatgatagcgatggaaaccctattgcccccactaagaaaatcatcgatccgttaccgcctatagaccacagcgagatcgactaccctccctttgagaaaaatttttataacgagcacgaggaaatcaccaatctgacaccccagcagctgatcgacttacgacacaagctgaatctaagagtaagcggggcagccccccctcggcccggcagcagtttcgcacactttggatttgatgagcagctcatgcatcagattcgcaaaagcgaatatactcaacctacccctattcagtgccaaggggttccggtggccttgtcaggccgcgacatgatcggtatcgcaaagacagggtcagggaaaaccgctgctttcatctggcctatgttaatccacataatggaccaaaaggaactcgaaccaggggatgggcctattgctgtgatcgtctgccccacgagggagctgtgccagcagatccatgcagagtgtaagaggtttggaaaagcctacaacctgaggtccgtggctgtgtatggaggaggcagcatgtgggaacaggcaaaagccctccaggaaggagccgagatcgtagtctgtacccccggccgcctcatcgaccacgtcaaaaagaaggccaccaacctgcaaagagtgagttaccttgtcttcgatgaggcagatagaatgtttgatatgggcttcgaatatcaggtgagaagcattgcctcccatgttcgaccagatcgacagactctgctcttttcagccaccttcaggaagaagatagagaaactggcccgcgacatcctcattgatcctattagggtggtgcagggtgacataggggaggctaacgaggatgtcacccagatcgtcgagattttgcacagtgggcctagcaagtggaactggttgactcggcggctcgttgagttcaccagtagtgggtcagttctgctgttcgtcactaaaaaggccaacgccgaggagctggccaacaatttgaagcaggagggccacaaccttgggttgctgcacggagatatggaccagtctgagcgaaacaaagtgatctcagactttaagaagaaagacatccctgtgctcgtggcaaccgatgtcgctgcaagggggctcgacatcccctctattaagacagtcatcaactacgacgtggctcgggatatagatacacatactcatcgcataggacgcacaggacgggctggggagaaaggggtcgcctacacactgctgactccaaaagactccaatttcgccggagatcttgtgcgcaatctggaaggcgctaatcagcacgttagtaaagagttactggacttggccatgcagaacgcctggttccgcaaatcaaggttcaaggggggaaagggcaagaagttgaacattggcggaggcgggctcgggtatagagaaagacccggattggggtctgagaacatggaccgcgggaacaataacgtgatgtctaactacgaagcatacaagccttctaccggtgcaatgggcgaccgtcttactgcaatgaaagccgccttccagtcccagtacaaaagccactttgtggccgcaagtctgagcaatcagaaagccggcagcagcgctgcaggcgccagcggctggaccagcgcaggatccctgaatagtgtccccacaaattccgcgcagcagggacacaactccccagatagccctgtgactagtgctgcgaaaggcatccctgggttcggcaatactggcaatatatctggggcaccagttacctacccctcagccggcgcccagggtgtcaacaataccgcaagtggcaataatagccgtgaaggcacgggtggatcaaacggcaagcgggaacgctatacagaaaatcgggggagctccaggcattctcatggggaaacaggcaatcggcatagcgattcccctcgtcacggggatggtggccgtcacggagatggatatcgccatccagagagctcctcccgccacacagacggccaccggcatggtgagaatcgacacggcggatctgccggtcggcacggcgagaaccggggcgccaatgacggaaggaatggtgagtcaagaaaggaggcgttcaacagagagtccaaaatggagcccaagatggaacctaaagtcgacagttcaaaaatggataaagtggacagcaagaccgacaagacagctgacgggtttgctgtacctgagcctccgaaacgcaagaagtcacgatgggactcttag

SEQ ID NO: 114116 - DNA, 2817 bp, Artificial Sequence
  Description of Artificial Sequence: Synthetic coding sequence
atgaactggaataaggggggaccgggaacaaaacgaggttttggttttggaggattcgctatctccgcaggtaagaaggaagagcctaagttgcctcagcagtcacattcagcttttggcgctacatcttcctccagtggcttcggcaagtctgcaccgccccaactccccagcttttacaagatcgggagtaagcgggctaacttcgatgaggaaaacgcatactttgaagatgaagaggaggactcatctaacgtagatcttccgtatatccctgccgagaacagcccaaccagacaacagtttcacagtaagcctgttgactctgattccgacgacgatccactggaggccttcatggcagaggttgaggaccaagcagcaagggatatgaagcgcctcgaggaaaaggataaagaacggaaaaatgtgaaggggatcagagatgatatcgaggaagaggacgatcaggaagcctattttcgctatatggcagagaatcccaccgcgggggtagtccaggaggaggaagaagacaacttagaatacgattcagacggtaacccgattgcacccacaaaaaaaattattgatcctttgcccccaatcgaccactccgagatcgattacccacctttcgagaagaatttctataatgaacatgaggagataaccaacttaaccccccagcagctgatagatcttaggcataaactgaacctgcgggtgtcaggggctgccccacccagacccggctctagctttgcccatttcggattcgacgaacagctcatgcaccagatccggaaatccgaatatacccaacccactcccatacagtgtcagggtgtacccgtcgcgctcagtggcagggacatgattggaattgccaaaacaggtagcggcaagaccgccgcttttatctggcccatgctgattcatatcatggaccagaaggagctcgaacctggggatggcccaatcgccgtgatagtctgccctaccagggaactatgccagcagatacacgctgaatgcaaacgattcggcaaagcatacaacctacgtagtgtggccgtgtacggagggggatctatgtgggagcaggccaaagctttgcaagagggggccgaaattgtggtctgtacgcccgggaggctgattgatcacgtaaagaagaaggcaactaacctccagcgagtgtcatatctggtttttgatgaggcggacaggatgttcgatatggggttcgagtatcaggtgaggtcgatcgcatctcatgtgcgtccggacagacagaccctgctgtttagcgctacctttcgcaagaagatcgagaagctagctagggacattctgatcgaccccatccgtgtcgttcagggagacattggcgaggccaatgaggacgtcacccagatagttgaaatcttgcactccggaccctccaagtggaactggttgacaaggcggctcgtggaattcactagcagcgggagtgtcctgctgttcgtgacgaagaaagctaacgctgaggagctcgcgaataatctgaaacaggaaggtcacaatttgggcctcctccacggtgatatggatcagagcgagcgcaacaaagtgatttccgactttaaaaagaaggacattcccgtgctcgtggctacagacgtggctgcccgcggcctggacatcccatccattaagacggttattaactatgacgtcgctagggatatcgatacccacacccatcgcattggcagaacgggtcgggcgggggaaaagggtgttgcctatactctcctgactcccaaggattccaacttcgcgggggaccttgttagaaatctcgagggggctaaccagcacgtgtcgaaggagctgctggatctagccatgcagaatgcctggtttcgaaagtccagattcaagggcggcaagggcaagaagctcaacatcggcgggggggggctgggctaccgtgagaggccgggcttgggaagcgagaatatggaccggggcaacaataacgtgatgtctaattacgaagcttataagccctccacgggagccatgggtgataggctaacagccatgaaagctgcgttccagtcccagtataaatctcactttgtcgccgcctcgctctctaaccagaaagccggatcctccgccgcaggagcatctggttggacatcagccggctcattaaatagcgtgcctacgaactccgctcagcagggtcacaattctcctgattcccccgttacatctgccgctaaggggatcccaggcttcgggaatacagggaacatatcaggagcccccgtcacctaccctagcgctggcgcccaaggcgttaataataccgcctccggtaacaattctagagagggtaccggagggtctaatgggaaaagggaaagatacactgagaacagaggaagtagccgacattcccacggcgagaccgggaatcggcactcagactcccctcggcacggtgatggtggaagacacggagacggttatcgacacccagagtctagctcccggcatactgatggacaccgccatggggaaaaccgccatggtggttctgctggcagacacggggaaaaccgcggcgccaacgatggtcggaatggagaatcacggaaggaggcttttaatcgggagagtaagatggagccaaagatggagccgaaagtcgacagcagtaaaatggacaaagtcgattcgaagaccgataagaccgctgacggattcgctgtgcccgaaccccccaagagaaagaagagcaggtgggactcttag

SEQ ID NO: 114117 - DNA, 1947 bp, Artificial Sequence
  Description of Artificial Sequence: Synthetic coding sequence
atgtcgcatcatgggggagcgcccaaggccagtacttgggtagtggccagcagacggagtagcaccgtgtctcgggcacccgagcggagaccagccgaagaactgaatcgaactggacctgagggttattccgtgggaagaggcggcaggtggagaggaacgtccaggccacctgaagctgtggctgccggacacgaagagctcccactgtgcttcgcacttaagtcccactttgtgggtgccgtcatcggaaggggcggaagtaagatcaagaacattcagagtacgacaaataccaccattcagatcattcaggaacagcctgaatctttggttaaaattttcggctctaaagcaatgcagaccaaagcgaaggcggtcatcgacaactttgtgaagaagttagaggaaaactataattccgaatgtggaattgacacagcttttcagcccagcgtcggtaaagacgggtcaaccgacaacaacgtagtggccggagaccggccactcattgactgggatcaaatccgggaggaaggcttgaaatggcagaagaccaaatgggccgatcttccacccatcaaaaagaacttttacaaagaaagcacagccacgagcgccatgtctaaggtggaggctgactcctggagaaaggaaaactttaatatcacttgggatgatctgaaggacggggagaaaagacctataccaaacccaacctgcacatttgacgatgccttccagtgctacccagaagtgatggagaacattaagaaggcaggattccagaaacctactcccatccagtcccaggcatggcctattgtgctgcagggcatcgatctgattggcgttgcccagaccgggacaggaaaaactctgtgctatctgatgcctggcttcatccacctcgttctgcagccttcgctcaagggtcagcgcaatcgacccggcatgctggttctgacgccaactagggagctggctctgcaggtggagggggagtgctgtaaatacagttacaagggcctgaggtccgtgtgtgtatatggcggcggaaatcgagacgaacagattgaagagctcaaaaagggtgttgacatcattatcgctactccgggccgcctgaacgacctgcagatgtctaacttcgtgaatcttaaaaatataacatacctagtgctggatgaggccgacaagatgctggacatgggctttgagccccaaattatgaaaattctccttgatgtgcgcccagaccgccagacagtgatgacctcggccacctggccccactctgttcatcggctggcacagtcttatctaaaggagcccatgatcgtatatgttggaaccctggacttagtggctgtcagttcagtaaagcagaatatcatagtcaccactgaagaagagaaatggtcacacatgcaaacattcctgcagagtatgtccagcacagataaggttattgttttcgtcagcagaaaggccgttgccgatcatctatcaagcgacctcatcttgggcaatatctccgtcgagagtcttcacggggaccgcgagcaaagggaccgagagaaggctctagaaaactttaagactggaaaggtgaggatcttgatcgcaactgaccttgcatcaagaggacttgatgtccacgatgtcactcacgtgtataatttcgattttccgcggaatatcgaggagtacgtgcacagaattggacggaccggtagggcagggcgaacaggagtgtctatcactacactgactagaaatgattggcgggtggcatcagagcttatcaatatccttgaaagagctaaccagtctatacccgaggaactcgtgtcaatggcggaaagattcaaggctcatcagcagaagagggaaatggagcgcaagatggaaaggccccaaggccgtcctaagaagtttcattag

SEQ ID NO: 114118 - DNA, 588 bp, Artificial Sequence
  Description of Artificial Sequence: Synthetic coding sequence
atgtcccaccacggcggggccccaaaagcgtccacgtgggtagttgcttctcggcggtcatctactgtgagccgcgctccagaaagaagacccgctgaggagctgaatagaacagggcctgagggatactcggtcggccgaggtggtcggtggagaggtacttctaggccccccgaggcagtggccgccggccatgaagaactgcctctgtgtttcgcccttaaatcacactttgtaggagccgtcattggccggggtgggtctaagatcaagaacattcagtccaccactaacacaacaatccagatcatccaggaacagcctgagagccttgtaaagatctttggcagcaaggccatgcagactaaggcaaaggcagtgatcgacaactttgttaagaaactggaagagaactataattctgagtgcggtattgacactgccttccaaccctcggtagggaaagatggctccaccgacaataatgttgtcgccggggatcgaccactgatagattgggaccagataagggaggagggactaaaatggcagaaaacaaaatgggccggaaaaaagatcctgatttag

SEQ ID NO: 114119 - DNA, 675 bp, Artificial Sequence
  Description of Artificial Sequence: Synthetic coding sequence
atggagagcggtgcatacggagctgcgaaagcagggggatcctttgacttgcgtagattcctgactcagccgcaggtggttgctagagccgtttgcttagttttcgcattgatagttttcagctgcatctacggcgaggggtactctaacgctcacgaatccaaacagatgtattgcgtcttcaacaggaacgaggacgcctgtaggtatgggtccgctattggcgtacttgcctttctggcgtcagctttttttttagttgtcgatgcctatttccctcagattagcaatgccacggatagaaagtacctggtgatcggcgatctactgttcagtgcactgtggacatttttatggtttgtcgggttttgcttccttacgaaccagtgggccgtgacaaaccccaaggatgtcctcgtgggcgccgatagcgtgcgcgctgcaatcacattttcatttttttcaatcttctcgtggggggtccttgcctccttagcctatcagaggtacaaggcaggagtggatgatttcattcagaattacgttgatccgacgcctgatccaaatactgcttacgcctcataccctggtgcgtctgttgacaactaccagcagcctccctttacgcagaatgcagaaactaccgaaggatatcagccacccccggtgtattag

SEQ ID NO: 114120 - DNA, 1635 bp, Artificial Sequence
  Description of Artificial Sequence: Synthetic coding sequence
atgagcggatatagctccgaccgggaccggggccgggaccgcggtttcggcgcccctagattcggcggctcgcgcgccggccctctatccggcaaaaaattcggcaatcccggcgaaaagctggtgaaaaaaaaatggaacctggatgagctccccaaattcgaaaagaacttctatcaagaacatccagacctggctcgcaggacagcccaggaggtggagacttaccggtatttacttccagctattgtccatataaaccaccagcccttcctcgagcgcggggatggccccatctgcttggtgttagcgccaacaagggagctggcccaacaggttcaacaagtggcggctgaatattgccgggcctgtcgtctgaagtctacctgcatttacggtggggcgcccaaaggaccccagattcgtgatttagagaggggtgtggaaatctgcatcgccaccccagggcgccttattgacttccttgaatgtggcaaaacaaatctcagacgaaccacctacttagtgttggacgaagcagaccgcatgttggacatgggcttcgagccccagattcgtaagattgtagaccaaatccgccccgaccgtcagacacttatgtggagcgccacttggccaaaggaggtgaggcaactcgctgaagatttcttgaaagattacatccacattaatataggcgctcttgagctctcagcaaaccacaacatattgcaaatagtggatgtgtgtcacgacgtggaaaaggacgaaaagcttattagactgatggaggaaatcatgtctgaaaaagaaaacaagaccattgtgtttgtcgagactaagaggagatgtgacgaattgactcggaagatgagacgggatgggtggccagctatggggattcacggcgataagagtcagcaggaacgcgattgggtcttgaacgaatttaaacatgggaaggcccctattctgattgcaaccgacgtggcaagtcgaggcctggatgtagaggatgtgaaatttgtgatcaattatgattatcctaactcatctgaagattacatccatcgtatcggacggacagcacggagcactaagactgggacggcctacaccttttttacccccaataacattaagcaagtctccgatcttatctccgtgttgagagaggccaaccaggccatcaaccctaagttgctccagctggtagaggatagaggatcaggtcgctctcgcggcagaggcgggatgaaggacgatcgccgagaccggtattccgctggaaaacggggcgggttcaacacatttagggatagagagaattacgaccggggttattcatcacttctcaagcgggattttggagctaagacacagaacggtgtatatagcgcagccaactatacaaacgggagcttcggaagcaattttgtgtccgcaggcatccagacttcatttcgaaccggcaacccgactggcacatatcagaacggatacgactcgacacaacaatacgggtcaaatgttccgaacatgcacaacggcatgaaccagcaagcctacgcctatccagctacggccgccgccccgatgatcggatatcctatgcccacgggatactcccagtag

SEQ ID NO: 114121 - DNA, 1845 bp, Artificial Sequence
  Description of Artificial Sequence: Synthetic coding sequence
atgagtggctactcttcagaccgagatcggggcagagatcggggctttggcgccccacgctttggaggctctcgtgctggccctctttctggtaaaaagttcgggaatccaggcgagaagctcgtcaaaaaaaaatggaaccttgacgaactgcctaaatttgaaaagaatttttaccaagagcatccggatctggctaggcggaccgcccaggaagtcgaaacatacagacgcagcaaggaaatcacggtgcgtggccacaattgtcccaagcccgttctgaatttctacgaagcaaatttcccagccaacgtgatggacgtcatcgcacgccaaaactttaccgaacccaccgcaatccaggcccagggctggcctgtggcactctctggcttggatatggtcggcgtggcccagacaggctccggaaagactctgtcctaccttctgcccgccatcgtgcatattaatcaccaaccgttccttgagaggggagatggacctatatgtttggtgttggctccaaccagagagctggcccagcaggtccagcaagtggcagccgaatattgccgggcatgtcgactgaaatcaacttgcatctacggcggggccccaaaggggcctcagatccgtgatttggagagaggtgttgagatttgtatcgccacccccggacgtctgattgatttcctcgaatgcggtaagactaaccttcgcagaaccacataccttgtactggacgaagctgatcggatgctggatatgggtttcgaaccacagatccgcaagatagttgatcagatcaggcccgaccggcaaacccttatgtggtcagccacctggcctaaagaggtgaggcagcttgccgaagactttcttaaagattatatccacataaacatcggggctctggagctgagcgccaatcacaacatcttacagatcgtcgatgtatgccatgatgtagagaaagacgagaagcttattagacttatggaggaaattatgtctgagaaagagaataagaccatcgtattcgtcgagacgaagcggaggtgcgatgaactgactcgcaaaatgaggcgcgacggatggccagcaatgggcattcacggcgataagagccagcaggaaagggattgggtcctgaacgaatttaaacatggtaaagccccgattcttattgcaactgatgtcgcaagccgaggattggatgtggaggacgtgaaattcgtcataaattacgactatcctaacagcagcgaagactatattcacaggatcggccgaactgcaagatcgacgaaaaccgggacagcatacacattctttacacctaacaatatcaaacaggtctccgacctcattagcgtgctccgggaagccaatcaagccattaatcccaagcttctgcaacttgtggaggatcgcggatcaggcagaagcagggggagggggggcatgaaggatgaccgccgggaccgctattccgctggcaagagaggcgggttcaacacattccgggacagagagaattatgacagaggctattcctctctgctcaagcgggactttggcgccaagacgcagaacggagtgtattctgctgcaaattatactaacggctcttttggatctaactttgtctctgccggaatccaaactagtttcagaactgggaatcctaccgggacttaccaaaatggatacgactcaacacagcagtatggcagtaacgtgccaaatatgcataatggtatgaatcagcaagcctacgcctatcccgccacagcagccgcgccaatgatcggctatccaatgcctactggctactcccagtag

SEQ ID NO: 114122 - DNA, 1800 bp, Artificial Sequence
  Description of Artificial Sequence: Synthetic coding sequence
atggatgttcatgaccttttccgccgcctgggcgccggagccaaattcgatacaagacgtttttctgccgacgcagccagatttcagattggtaagaggaaatatgacttcgacagctcagaggtgctgcaggggcttgatttcttcggaaataagaaatcagtgcctggcgtgtgcggagcttctcagacacaccagaaaccacagaatggtgaaaaaaaggaagagtctctcaccgaacggaagagagagcagagcaaaaaaaaaagaaagaccatgacatccgagatagcatcccaggaagaaggtgccactatccagtggatgtcttctgtggaggcaaaaattgaggacaagaaggttcagagggagagcaagctgacaagcggaaagctcgagaacctgagaaaggaaaaaattaatttcctgcggaataagcataagatacatgtccagggtacggatctcccggatcctattgccacttttcaacagctggaccaggagtacaaaatcaactctagactgcttcagaatattctcgatgctggcttccaaatgccaacacctattcaaatgcaggcgatccctgtaatgctccatgggcgagagctgctagcctcagcacccactggttccgggaagacactggctttttccattccaatcctgatgcaactcaagcaacctgctaacaagggatttagggctttgataatatcccccacacgggagctggcaagtcagatccacagggagctcataaagatttctgaaggtacggggttccgtatccacatgattcacaaggcagcagtcgccgcgaaaaagtttggcccgaagtcttcgaagaagttcgacatcttagtgaccacaccaaataggctgatctaccttcttaaacaagatccgcccggcattgacttagcaagtgtcgaatggctggtggtcgatgaatcggataagctctttgaggatggtaagaccgggtttagggatcaactggcctctatttttctggcatgcactagtcacaaggtccgaagggcaatgttctccgcaacattcgcctacgatgttgagcagtggtgtaagctgaaccttgataatgtgataagtgtatcaattggcgcccgcaacagcgctgtggagacggttgaacaggagctcctgttcgttggctctgaaactggcaagctgcttgctatgcgagaacttgtcaagaagggattcaaccctccggtcttggtgttcgtacagtcaattgagcgggccaaggagctgttccatgaactgatctacgaaggtatcaacgtggatgtaattcatgccgagaggactcagcagcaaagagataatacagtacactcgttcagagccggcaaaatctgggtgttaatctgcaccgcactcttagccagaggaatcgactttaaaggggtcaacctggtgattaattacgacttcccgacctcaagcgtggaatacatccaccggattgggaggactggtagagccggaaacaagggaaaagcaatcactttctttaccgaggatgacaagcccctgctgaggagcgtagcgaacgtgattcagcaggccggatgtcctgtgcctgaatacattaaagggtttcagaaattgctcagcaaacagaagaagaagatgatcaaaaagcccttagaacgggaatctatctccactaccccgaagtgctttttagagaaagctaaggacaagcaaaagaaagtaacagggcagaatagcaagaaaaaggtcgctttagaagacaagtcctag

SEQ ID NO: 114123 - DNA, 1476 bp, Artificial Sequence
  Description of Artificial Sequence: Synthetic coding sequence
atgtcaagcgttgaagctaaaatcgaagataagaaagtgcagcgtgagtcaaaacttacttcgggaaagttggagaacctgaggaaagagaagattaactttctgagaaataaacacaagatccacgtccaggggaccgacctaccagaccccatcgcaacgttccagcagctcgaccaggaatataaaattaattcacggctgctacagaatatactggacgctggatttcagatgcctacacccattcagatgcaggccattcccgttatgttgcatgggcgtgaattgctagcgtcagctcccactgggagtgggaagacacttgctttcagcatcccaattcttatgcaactgaaacaacctgctaataaaggattccgcgcactgatcatttcgcccaccagggaactggcgagccagatccaccgggagctaatcaaaatctccgaggggaccggttttcgtattcacatgattcataaagcagctgtggccgccaaaaagttcggacccaagtcctcgaagaaattcgatatactggtgaccactcctaaccggctcatctacctcctgaagcaggatccgccgggaattgacctagccagcgtggaatggttggtggtggatgagtcggataaactcttcgaggacggcaagactggctttagagaccagttggcatccatatttctcgcatgtactagccataaagtaaggcgggcgatgtttagcgcgaccttcgcctatgacgttgagcagtggtgtaagcttaatctggacaatgtcatttccgtcagcatcggtgccaggaatagcgcagtggaaaccgtagaacaagaactcctttttgtcggatctgagactgggaagcttctcgcgatgcgagagctcgtgaagaagggcttcaaccctccggttttggtttttgtgcaatctattgagagggcaaaggaactcttccacgaacttatctatgagggaatcaacgtagacgttatccatgctgaaaggacgcaacagcagagggacaatacggtgcactcttttcgtgccggaaagatctgggtcctgatctgcacagccttattggcccgggggatcgatttcaaaggtgtcaatctggtgatcaactacgacttccctacatcatctgttgaatatatacatcgtataggaagaacagggagagccgggaataagggaaaagccattacattttttacagaagacgataagcctctcctgaggtccgtggccaatgttatccagcaagccggctgtccggttccagagtatatcaaggggttccagaaactgctcagcaaacagaagaagaagatgatcaagaagcctttggagagggaatccatctctacaacccccaaatgttttctcgagaaggctaaagacaagcagaaaaaagtgacggggcagaactcaaagaaaaaagtcgcactggaggataagtcttag

SEQ ID NO: 114124 - DNA, 2646 bp, Artificial Sequence
  Description of Artificial Sequence: Synthetic coding sequence
atggccgcagataaggggccggccgccggccctagatcgagggccgccatggctcagtggagaaagaaaaaagggctgcgaaagaggcggggcgctgccagtcaggcccgcggaagcgactcggaggatggcgaattcgaaattcaggctgaggatgacgcacgcgcacgtaagctcggacctggcaggccgctgccaacatttcctacctccgagtgcactagcgatgtggaacccgacactagggagatggtgagggcccaaaacaagaaaaaaaagaagagcgggggctttcagagcatggggctgagctacccagtttttaaaggaattatgaaaaaaggctacaaggtccccacaccaatccagaggaagactatacctgtgatccttgatggcaaggatgtagttgcgatggcacgcacgggaagcgggaaaaccgcatgtttcctgctccccatgttcgagcgtcttaagactcactccgctcagacgggagcgagggcgctcatacttagccctacgcgagaacttgcgctgcagaccttaaagttcactaaggagcttggaaagtttacaggccttaagacggcacttatccttgggggagataggatggaggaccaattcgcagctctacatgaaaatcccgacattattattgccactccagggcgtctggtccatgtggccgtggaaatgtctctgaagcttcagtcggtggaatatgtcgtatttgatgaagccgaccggctttttgagatggggttcgcagagcaactccaggaaattatcgcccgattgcctggcggccatcagacagtgttattctcagccactctgccaaagcttcttgtagaattcgccagggctggattgactgagcccgttctcattcggctcgacgtcgatacgaagctcaatgagcaactgaagacatcattcttcctggtgcgtgaagacacaaaggccgctgttctcctgcatcttctgcataacgtggtacgtccccaggatcagacagttgtgttcgtggccactaagcatcacgccgagtacctgaccgagctcctgactactcagagagtctcttgcgcccatatctattctgccctcgatcccacggctcggaagataaatctggcaaaattcactctgggaaaatgttcgactttgatagtgacagacctggccgctcgggggctcgatatcccgctcctggacaacgtgatcaactatagctttcctgccaagggcaaattatttctgcatcgggtgggccgagtggccagagccggtcgtagcggaactgcctatagcctcgtcgcaccagacgagatcccctatctcctggatctccatctgttcttaggccgcagtctgacgctggctcgcccactaaaggagcctagcggggtggcgggggtggatggtatgctcggcagggtgccacaatccgttgttgacgaagaggacagtggcttgcagtcgactcttgaagccagtctcgaactgagaggtctggcaagggtcgctgacaatgctcagcagcagtatgtccgctccaggccggcccccagtcccgaatccataaagcgcgccaaggagatggatctggtgggtctgggccttcaccctttattctcatcaaggttcgaggaagaggaactccagcgtttaagactcgtggactctataaaaaattatcgtagtcgcgccaccatcttcgaaatcaacgcaagctctagagacctatgctcacaggtgatgagagccaagcgccagaaagaccgcaaagctattgcacgatttcaacagggacagcagggccgacaggagcaacaggaagggccagtgggcccagctccctctcgacccgccctacaagagaaacagcccgaaaaggaggaggaggaggaggctggggaaagcgtcgaagacattttctctgaagtggttggacgcaagcgccagcgctccggaccaaatcggggagccaagcggcgtagagaggaggcccgccagagggatcaagagttttacatcccataccgccccaaggattttgactctgagagaggcctgtctatctccggagaaggtggtgctttcgagcaacaggctgccggcgctgtgctggacctgatgggtgacgaggcccaaaacctgacccgcggacggcagcagttgaaatgggatcggaagaagaagcgtttcgtcggccagtcagggcaggaggataagaagaaaatcaagacagaaagcggccgatacatttcctcctcttacaagcgtgacctgtaccagaaatggaagcagaagcaaaaaatcgacgatcgcgattccgacgaggagggggcttcagatcgtcggggccctgagcgaagaggcggaaagagggacagagggcagggcgccagcaggccacatgctcccggaaccccagcgggtagagttaggccagagctcaaaacaaagcagcagattctgaagcaacgcagacgggcacagaagttgcactttctccagcgcgggggcctcaaacagctgtccgcccgcaatcgcaggcgtgtacaggagctccagcagggcgcttttggcaggggggcgagaagcaaaaaaggtaagatgcgcaagcgtatgtag

SEQ ID NO: 114125 - DNA, 2649 bp, Artificial Sequence
  Description of Artificial Sequence: Synthetic coding sequence
atggccgccgataagggccccgctgctggtcctaggagcagggccgctatggctcagtggcgcaagaaaaagggtctcaggaagaggagaggcgcagcttcccaggcacgaggaagcgattcagaggacggcgagtttgaaatccaggcagaggatgatgcacgggccagaaagttaggtccagggcggcccctcccgaccttccctacgagcgagtgtactagtgacgtggagccagacacacgtgaaatggtcagggcgcagaacaagaagaagaagaaaagcggtggttttcaatccatgggactctcctatccagtgttcaaaggaataatgaagaagggttataaggtccccactccaattcagcggaaaactatccctgtgatactcgacgggaaagacgtagtagcaatggcaaggaccggctctggcaagacagcatgtttcttactgcccatgtttgagaggctcaagactcatagcgcccaaaccggagcacgagctctgatcctgtccccgacccgggagctggccctgcagaccctgaagttcactaaagaactgggcaaatttaccggcttaaaaaccgcccttatcctgggaggcgatcgcatggaagatcagtttgccgctctccatgaaaatccagacattattatcgcgacccctggccgactcgttcatgtcgcagttgaaatgagcctaaagctccagagcgtagagtacgttgtttttgacgaggctgaccgcttattcgaaatgggcttcgccgaacagttacaagagattatagccaggctgccaggaggacatcagactgtgcttttcagcgccacactgccaaagctgctcgttgagttcgcgcgcgcaggcctcacggaaccagtcctgattcgtctggatgtagacaccaaactgaacgaacagttaaagacgtcttttttcctcgtgagggaggacactaaagcagctgttctactacatctgctgcacaatgtggttaggcctcaggaccagaccgtagttttcgttgccactaaacaccatgctgagtacctgactgaacttttaactacccagcgcgtgtcttgcgcccatatttactctgcccttgatcccacagcccgcaagatcaacctcgccaaatttacactggggaaatgctctacgctcatcgtgacggacctcgctgcacggggattggatattccactattagataacgtgataaactattcctttccagcgaagggtaaactctttctccaccgggtagggcgggtcgcccgtgcaggacgctctgggactgcttacagccttgtggcacctgacgaaatcccatacctactcgacctgcatctgtttctggggcgtagcctgacactggcaaggcctctcaaggagccttccggggtggcaggagtcgatggtatgcttggccgggttccccaatcggtcgtagatgaagaagacagtggactgcagtctacactggaagcttctttagaactgagaggcctggcgagggtcgctgacaacgctcagcaacagtatgtgcgctctcggccagccccaagcccagagtccataaagagagccaaagagatggatctggtggggctagggctccaccccctgttcagctctcggtttgaagaggaagagctacagcggctgagactggtcgattccattaagaactatcggagtagggcaaccatattcgagattaatgcctcgagcagggacctgtgctctcaagttatgagggcaaagcggcaaaaggaccggaaggcaatcgcccgattccaacaggggcagcaagggcgccaggagcagcaagagggtccggtgggccccgcgccatcacgcccagctctacaggaaaagcagcccgagaaagaagaagaggaggaggccggcgagagcgtcgaggatatcttcagtgaggtcgtcgggaggaaaaggcagcgaagtggccccaatcgaggcgccaagcggcgccgcgaggaagcccgtcaacgagatcaggaattctacatcccataccgtccgaaggacttcgactcagagcgcggactcagtatctcgggcgaaggaggtgcttttgagcagcaggccgccggggccgtgctggatctgatgggcgacgaggcccagaacctgaccagaggccgacaacaactgaagtgggatcgaaagaaaaagaggtttgttgggcaatcaggccaggaggacaaaaagaagattaagaccgagagcggccggtacattagctcttcttacaaacgagacctctaccagaagtggaagcaaaaacagaaaatcgacgatcgagactcagacgaagagggggcctcagatcgccggggcccggaaaggagaggaggaaaacgcgatcgcgggcaggcgggagcaagtcggcctcacgcccctggaactcccgctgggcgcgtgagacccgaactaaagacaaagcagcagattttaaagcagcgtcgtcgcgcacagaaacttcacttcttacagagagggggcctgaagcagctgtctgcccgcaaccgtcgacgcgtgcaggaactgcaacagggcgccttcgggagaggggccagatccaaaaaaggtaaaatgagaaagcgcatgtag

SEQ ID NO: 114126 - DNA, 1452 bp, Artificial Sequence
  Description of Artificial Sequence: Synthetic coding sequence
atgtccactgctaggacggaaaaccctgtgataatgggcctgtctagccagaatggccagcttcggggaccggtgaagcccactggcggacccgggggcggaggcacccaaactcaacagcaaatgaatcaactgaagaatactaacacaattaataacggaacccaacaacaggcccaatcaatgacaacaacaattaaacctggggatgattggaaaaagacactcaagctccctcctaaggacctgagaattaagacaagcgatgttacgtccacaaagggcaacgaatttgaggactactgcctgaagagggagctgttaatggggatctttgagatgggatgggagaaaccatcccccatccaggaagagtctattcccatcgccttgtctggtcgcgatattctggcccgggcgaagaacggcaccggcaaatctggcgcttatctgatccccctccttgagagactggatctcaaaaaggacaacatccaagccatggtcatcgtgccaaccagggagctagcactccaagtgtcacagatatgtatccaggtgtcgaaacacatgggtggggcaaaggtcatggctaccactggcgggactaaccttcgcgacgacatcatgcgacttgatgacacagtccacgtggtcatcgccactccagggcgaatcttggatctcataaagaagggagtagcaaaagttgaccacgtccagatgattgtgctggacgaggcagataagctgctttcccaggacttcgtccagatcatggaagatatcatcctcacattgccgaaaaaccgccagatcttactgtattccgccacctttcctttgagtgtgcaaaaatttatgaattctcacttgcagaagccctacgagataaacctaatggaagagcttacactgaagggggtgactcagtattacgcctatgttactgaacggcaaaaagtgcattgcctgaataccctgttctctagattgcagatcaatcagagcatcattttctgtaatagtagtcagagggttgaactgctggccaaaaagatttcgcaactgggatactcttgtttctatatacacgctaagatgagacaagagcacagaaatagagtgtttcacgactttcgtaatggcctctgcaggaacctggtgtgcaccgacctcttcaccaggggcattgatatccaggcggtgaacgtagtcattaattttgacttccccaagctcgcggagacctatctccacaggataggaagatccggtcggtttgggcatctcggccttgccataaatctgattacatatgacgacagattcaacctgaagagtattgaggaacagctgggcaccgagattaagcccataccatccaacatcgacaaatccctgtatgtcgctgagtaccacagcgagcctgtggaggatgaaaaaccctag

SEQ ID NO: 114127 - DNA, 1452 bp, Artificial Sequence
  Description of Artificial Sequence: Synthetic coding sequence
atgagtactgccaggacggagaatcctgtgatcatgggcctgtctagtcagaatgggcagctcagagggccggtgaagcctaccggcggccccggcggtgggggaactcagacacaacagcagatgaatcagttgaagaacacgaacaccataaataacggaacacagcaacaggcccaaagtatgacgactactatcaagccaggggacgactggaagaaaacgcttaaactacctccaaaagacttacggattaaaacatccgatgttacctcgaccaagggcaatgaattcgaggactattgtctgaaaagagagctgcttatgggaattttcgagatgggctgggagaagccgagtcctattcaggaagagtctatccccatagccctcagtggccgcgacatactcgcccgggctaagaacgggacaggaaaaagcggagcatacctcatccctctgctggagcggctggatctgaagaaggacaacatccaggccatggtgattgtgccaacccgagaacttgcgctgcaggttagccagatctgtatccaggtctctaagcacatgggcggagcaaaggtcatggcaactaccggcgggaccaacttacgagacgatataatgcgactcgatgacaccgtgcatgttgtgattgccacccccggcagaatcctggatttaatcaagaaaggtgtagccaaagtggatcatgtccagatgatcgtccttgatgaggcggacaaattgctaagtcaggatttcgtgcagatcatggaagatattatactgacgctgcccaaaaatagacagatcctgctatatagtgctacctttccattgtctgtgcagaaattcatgaattctcacctacaaaaaccctacgagattaacctcatggaggaactcactctgaaaggagtcacccaatattacgcctatgtgaccgagagacaaaaagtgcattgcctgaacacactgttttcgcggttacagatcaaccaatctattatcttctgcaacagctcccagcgcgtggagctcctggccaagaaaatctctcagctcggttattcctgtttttacatccacgcaaagatgagacaagagcatcgaaatagagtgttccacgacttccggaacgggctttgcagaaacctcgtttgcactgacctttttacaaggggaatcgacattcaggcagtgaacgtggtcatcaatttcgattttcctaagcttgctgagacctatctccaccggattggcagaagcggccgcttcggtcacctcggtttagccatcaacctcatcacgtatgatgatcgtttcaatttaaagagcattgaagagcagttggggacagaaattaaacccatcccgtccaacatcgacaaaagtttatacgtggcggaataccattctgagcccgtggaggacgagaagccctag

SEQ ID NO: 114128 - DNA, 1452 bp, Artificial Sequence
  Description of Artificial Sequence: Synthetic coding sequence
atgagcactgccagaaccgaaaatcccgtcattatgggcttgagcagccaaaatggacaattgcgcgggccggtcaaaccaacaggcggaccaggcggcggcggcacacaaacacagcagcagatgaatcagctcaaaaacacaaacacaattaacaatggaacccagcagcaggctcagtcaatgacgacaacaatcaaacccggggatgactggaaaaagaccttaaaactgcccccgaaggacctccgaattaagactagtgacgttacaagtaccaagggaaacgagtttgaggattattgcctcaaacgtgaacttctaatgggcattttcgagatggggtgggaaaaaccatctcccatacaagaggaatctattcccatagcactgtccggccgcgatatcctggctcgagcaaaaaatggcaccgggaaatcgggcgcctacttgatcccgcttctggaacgactagacctgaagaaggacaacatccaggcaatggtaattgtccctaccagagaattggcgctccaagtttcccagatatgtattcaggtatcaaagcatatgggaggtgccaaggtgatggctacgaccggcggtactaacctgcgggatgatatcatgcgtttggatgataccgttcatgtggtgatcgccacccctggccgcattctggatcttatcaagaagggggtcgctaaggtggatcatgtacaaatgatcgtgctcgacgaggcagataagctcctgtctcaggacttcgtccagatcatggaagatattattctgaccctacccaaaaacaggcagatcttgctctacagcgccaccttcccactatcagttcagaaattcatgaactctcatctgcagaagccctacgaaatcaacctcatggaggagttgaccttgaagggggtgacccagtactacgcatacgttaccgagaggcaaaaagtccattgcctaaatacactgttcagccgcttgcaaattaaccagagcatcatcttctgcaactccagtcagcgagtggagctgctcgccaaaaagatctcacaattgggctattcgtgcttctatattcacgcgaagatgcgccaggagcataggaacagggtgttccacgacttccggaacggactgtgtagaaatttagtttgtacagacctctttaccagaggcatcgacatccaggctgtgaacgtggtgatcaacttcgacttccccaagcttgcagagacatatctgcaccggatcggtcggtcagggaggttcggtcacctggggctggccatcaatctgattacctacgacgatcggttcaacttgaagtcgatcgaggagcagctggggactgagatcaagccaatcccctccaatattgacaagtccctctatgtggctgagtaccatagcgagccagtggaggacgagaagccttag

SEQ ID NO: 114129 - DNA, 564 bp, Artificial Sequence
  Description of Artificial Sequence: Synthetic coding sequence
atgagtacagctcgtactgagaacccagttatcatgggccttagtagccagaacggccagcttcgagggcccgtgaagcctaccgggggcccaggaggaggaggtacgcagacacagcagcagatgaaccagctcaaaaatactaacactattaacaatggcacccagcaacaggcacaatcgatgaccacaactatcaagccaggcgacgattggaagaaaacccttaaactcccccccaaagacctgcgcattaagacatcagatgtcaccagcaccaaaggcaacgagttcgaagattactgtcttaaacgagagttattaatgggcatattcgagatgggatgggagaaaccctcccctattcaggaggagtcaatccctattgccttgtctggtcgcgacatcctggcccgagcaaaaaacggcaccggaaaaagcggggcctatctgatcccactactggagcggctagacttaaagaaggataatatccaagccatggttatagtgcctaccagggagttagcactccaggtctctcagatctgcactgtgtgttag

SEQ ID NO: 114130 - DNA, 5139 bp, Artificial Sequence
  Description of Artificial Sequence: Synthetic coding sequence
atggagagaaatgttcttacaacattctcacaagagatgtctcagctaattcttaatgagatgcccaaggctgaatatagctctctgttcaacgacttcgtcgaaagtgagtttttcttgatagacggggattccctcctcattacttgtatctgtgaaatctcttttaagccaggacagaacttgcatttcttctatttggtcgaacgctatttagtagacctcattagcaagggggggcagttcaccattgtctttttcaaggacgccgaatacgcgtacttcaatttccctgagttgctgtcattaaggacagcactcattcttcacctgcagaaaaacacgacgatagatgttagaacaacctttagtcgttgcctcagcaaggagtgggggtctttccttgaagagtcttacccttacttcctgatcgtcgccgacgaagggctgaacgatttgcagacacagcttttcaatttcttgataatccacagttgggctcgtaaagtcaatgtggtcttaagtagcggccaagaatcggatgttctctgcttgtacgcctatctcctgccgagcatgtatcggcaccagatcttctcctggaagaataagcagaacattaaggacgcatatacaacgctcctcaatcagctggagagatttaaactaagcgcactggcgcctctgtttgggagcctgaaatggaataatataacggaagaggcccataaaaccgtaagccttctgacccaggtctggcccgaggggagtgatatccgtcgggttttttgcgtcaccagctgtagtctgagcctccggatgtatcatcgatttctggggaatagagagccctcctcagggcaggaaacagagattcaacaggtcaattcaaattgtctaactctgcaggagatggaggatctgtgcaagttacactgtctaactgtagtattcctgctccacctcccactcagtcagcgagcctgtgcgcgggtgatcacatcacactgggccgaagatatgaagccactgttgcaaatgaagaagtggtgcgaatatttcatactgagaaatatccatacttttgaattctggaatcttaatttgatccacctctccgatctgaatgacgagcttttattgaagaatatcgcgttctattacgaaaacgaaaacgtgaagggtctgcacttgaaccttggggatacaatcatgaaggactacgagtacctgtggaacaccgttagtaaattggtgagagattttgaagttggacagcccttcccattgagaactactaaggtgtgtttcttagagaagaagccaagtcctatcaaggactcctccaacgaaatggtgccaaacctcgggttcatcccaaccagctcattcgtggtggataagtttgcaggggatatactgaaagacctgccttttttgaagagcgacgatcccatcgtaacgtccctggtgaagcagaaagagttcgacgagctggtccactggcacagccacaagcccctgtccgatgactacgaccgtagccggtgccagttcgatgaaaagtcgcgggacccacgcgtgctgagatccgtgcagaaataccatgtctttcagcgcttctatggtaatagcctggaaaccgtcagctccaaaatcattgttactcagacaatcaaaagcaagaaagatttctccgggcctaagagcaaaaaggctcacgagacaaaagctgagattatcgcacgggagaacaaaaagaggctgtttgcccgggaggagcaaaaggaagaacaaaaatggaacgcactgtctttcagcattgaggaacaattgaaggagaatctccactctgggattaaatccctggaagatttccttaaatcatgcaaaagcagctgcgtgaagctccaggtagaaatggtcggacttacagcatgcctgaaggcctggaaagaacactgtcgctcagaggaaggtaagaccactaaggacctatccattgcagtccaggtgatgaaacggatccactctttgatggagaagtatagcgaactactccaagaggacgacaggcagctcatagccagatgcctgaagtatttgggttttgacgagctagcttcaagccttcatcctgcccaggatgctgagaacgacgtgaaggtaaagaaacgaaacaagtacagcgttggtattggtcccgcaagattccaactccagtacatggggcattatctgatcagagatgaacggaaggatcctgacccacgagttcaagacttcatcccagatacgtggcagagagaactattagacgtcgttgacaaaaacgagtccgctgtaatcgtggccccaacgagcagcggtaagacgtatgcaagctattattgcatggagaaggtactgaaggaatccgacgatggggtggtggtttacgttgccccgactaaggctctagtgaatcaggttgccgcaacagtgcaaaatcggtttaccaagaatctgccaagcggcgaagtgctgtgcggcgtctttacgcgcgaatatcggcacgacgccctgaattgtcaggtgcttattaccgtgcccgcctgtttcgagattctgctgcttgccccccatagacaaaattgggtgaagaagattcgttacgttatttttgatgaggttcattgtcttggaggcgaaattggagctgagatctgggaacatctcctggtcatgatcaggtgtccttttctagctctctcggcaacaatctctaatcccgagcatctcacggaatggttacagtcagttaagtggtactggaagcaggaggataaaattatcgagaataatacggcttccaaacgacacgtcggaaggcaggctggcttccctaaggactatcttcaggtcaagcagtcctacaaagtacgcctggtgctgtacggggaacgctataacgacctggaaaagcacgtttgcagtattaaacatggagacattcacttcgaccatttccatccatgtgcagcactcactacagatcatattgagcgatacggatttccacccgatctgaccctcagcccaagggaaagcattcaattatacgatgccatgttccagatctggaagagctggccgcgagcccaggaattgtgtccggagaactttatccactttaacaacaaactggtcataaagaaaatggatgcacggaagtatgaggaatccctgaaggcggagttgacatcgtggattaaaaatggcaatgtggagcaggcacggatggtgctacagaacctctctcccgaagccgatctttctcccgagaacatgatcaccatgtttcctttgctggtcgagaagctccgtaagatggagaagctcccggctctgttcttcctcttcaagttgggagctgtggagaatgccgcagaaagcgttagcacctttttgaagaaaaagcaggagacaaaaaggcctccaaaagccgacaaggaggcccatgttatggcaaacaagctgagaaaggtgaagaaaagcattgagaagcagaaaattattgatgaaaaaagccaaaaaaagacaaggaacgtcgaccagagcctgattcacgaggctgagcatgacaacttggtgaaatgcctcgagaagaacctcgagatcccgcaggactgcacgtatgccgatcagaaagctgtggacacagaaacactccagaaagtctttggccgggtgaagttcgagcgaaagggtgaggagcttaaggctcttgcagagaggggcataggttaccaccactccgcaatgtcttttaaagagaagcagttggttgaaatcctgttcagaaaggggtacctgcgcgtggtaacggccactgggactctggcactcggagtgaacatgccatgcaagagcgttgttttcgcacaaaactcagtatatctcgacgctttgaactaccggcagatgtctggccgggctggccgaagaggtcaggatctgatgggcgacgtgtactttttcgacatcccatttccgaaaatcggaaagttgatcaagtcaaatgtgccagaattacgtggccatttcccactcagtatcacgctggtactcagacttatgcttctggcctctaagggggacgatcccgaagatgctaaggcaaaggtgctttccgtgcttaagcactccctgttgtcctttaagcaaccaagggtaatggacatgcttaaactgtatttcttattctccctgcagtttcttgtgaaggagggctacttagatcaggagggcaatcctatgggctttgctggactcgtctctcatctgcattaccatgagcctagcaacctggtgtttgtgtccttcctcgtgaacggcctgttccacgacctgtgtcagcccacacgcaaaggatcaaagcacttctcccaggacgtaatggaaaagcttgtgttggtcttagcacatctattcggccgcagatacttccctccgaagtttcaggatgctcatttcgaattttaccagagtaaggtctttctggatgacctacccgaagacttttctgatgccctcgatgagtacaatatgaagattatggaagatttcacgacctttcttcggatagtaagcaagctggcagatatgaatcaagagtaccagctgccactctcgaaaatcaagtttactgggaaagaatgcgaggattctcagctagtgtcacacctcatgagctgtaaggaaggaagggttgccatttcgccgttcgtgtgtctcagcggcaattttgatgacgacctgctgcggttggagactccgaatcatgttaccctcggaaccatcggcgtgaaccgctcccaggctcctgtgctgctatctcagaaatttgataaccgcgggcggaaaatgtctctgaacgcctatgctcttgatttttataagcatgggtcccttatcggacttgttcaggacaatcgcatgaatgagggtgacgcctactatctgttaaaagactttgcgcttacgattaaaagcatcagcgtctcattaagggagttatgcgagaacgaagatgacaacgtcgtcttggcattcgaacagctgagcactaccttctgggagaagctaaataaggtgtag

SEQ ID NO: 114131 - DNA, 363 bp, Artificial Sequence
  Description of Artificial Sequence: Synthetic coding sequence
atggaacgcaacgtgctcactacttttagtcaggagatgtcccaactgatcctgaacgaaatgccaaaagctgagtatagttcactgtttaacgattttgtcgagtctgagttcttcttaatcgacggcgacagcctgctgattacgtgtatttgtgaaatttcatttaaaccaggccagaacctgcacttcttttacttggtcgaacgctatttagtcgatctcataagtaaagggggacagtttaccatcgtgttctttaaggacgctgagtacgcctactttaatttccccgagctcctatctctccgcaccgcactgatcctgcatctccaaaagaatactaccatcgatgtgagatag

SEQ ID NO: 114132 - DNA, 885 bp, Artificial Sequence
  Description of Artificial Sequence: Synthetic coding sequence
atgatccgctgtcctttcctcgcactgagcgccaccatcagcaaccctgaacatttgacggaatggctccagtccgtcaaatggtactggaaacaagaggacaaaattatcgagaacaacacagcctctaaaagacacgtgggaaggcaggccggctttcccaaggactatcttcaggtgaagcagtcttacaaggtccgcctggtgctgtatggcgagagatacaacgatctggagaagcacgtttgttctatcaagcacggcgacattcattttgatcacttccatccctgtgccgccctgacaactgaccatatagaaagatacggtttccctcctgacctaacactcagcccacgcgaatctatccaactgtatgacgctatgttccagatatggaaaagttggccgcgagctcaagaactgtgtccggagaactttatccacttcaataataaattagtgattaagaaaatggacgccaggaagtacgaggaatcactaaaggcagagctcacctcctggatcaagaatggcaacgtggagcaagccaggatggtgcttcagaacctgtcacccgaagcagacctttcgccagagaacatgattacaatgtttcccttgcttgtggagaaactcaggaagatggagaagctgcctgcactatttttcctgtttaagctgggagcagtggaaaatgctgcggagtctgtgagtacgtttctgaagaagaagcaggagacaaagaggccacccaaagctgacaaagaggcccatgtcatggccaacaagttgaggaaggttaagaaatccattgaaaagcagaaaatcattgacgagaagtcgcaaaagaaccaaaaatgtggttctaagcccaacacatag

SEQ ID NO: 114133 - DNA, 1062 bp, Artificial Sequence
  Description of Artificial Sequence: Synthetic coding sequence
atgcagtccaaaagggattgcgagctttggtgtgaaagagtgaatcccgaaaataaggccgccttggaggcgtgggtgagggagaccggtattcgactggtccaagtgaacgggcagcgcaagtatggtggacctccccccggctgggtcggatcccctccgcctgctgggagcgaggtcttcatcgggcgtctaccccaagatgtctatgagcaccagctaatcccattgtttcagagagtagggcgcctgtatgaatttcgcctgatgatgacattttctggactgaataggggattcgcttacgcgagatatagcagccggagaggcgcccaggcagccatagccactcttcataaccaccccctcaggccttcgtgtccacttctggtctgccgttcaactgaaaagtgtgaactgagtgtggacgggttacctcccaatctcaccaggagtgctctccttctcgcactccagcccttaggtccaggactgcaagaagcccgcctgctaccctcccctggaccagcaccgggtcaaattgctctgctgaagttttcgagtcatagggctgcagccatggccaagaaagccctggtggaagggcaaagtcacctgtgcggagagcaggtggcggtcgaatggctcaagcccgatctgaagcaacggctgcggcaacagctagttggacctttcttaaggagccctcagcccgaagggtcccagctggctctggcccgtgataaactgggatttcaaggtgccagggccaccctgcaattactgtgtcagcgcatgaagctgggctcaccggtctttttgactaagtgcctggggattggacctgccggctggcacaggttctggtatcaggtggtaattcccggccacccggtgcctttttctggactcatttgggtcgtgctcactctagacggtcgagacggacatgaagtggctaaagatgccgtatcagtcagactgcttcaggcactgtctgagtcaggcgccaatctgctgtggagcgccggagctgaggccgggactatggtgaaacagtag

SEQ ID NO: 114134 - DNA, 1491 bp, Artificial Sequence
  Description of Artificial Sequence: Synthetic coding sequence
atgtttgcgaaagcaacccggaatttcctacgagaggtagacgccgacggagacctgatcgcagtatcaaatctgaatgattccgataaactccagctgctctcactggttactaagaaaaagcgtttctggtgctggcagaggccaaaatatcagttcctgtcactgacactgggggacgtgttgatagaggaccagttcccctcccccgtcgttgtggagagcgattttgtgaaatacgaaggaaagttcgccaaccacgtttcaggaacccttgaaacagcactgggtaaggtgaaacttaatctcgggggatcttcacgcgttgagtcacaatcctcctttggtaccctgcgaaaacaggaggtggatttgcagcaactgatcagggactccgccgaacggacaataaacctgcgcaatcctgttttacagcaggtgctggaggggcgcaatgaggtattatgcgttcttacccagaagattactacaatgcagaagtgcgtcatcagtgagcacatgcaggtggaggagaagtgcgggggcatcgtggggatccaaaccaagaccgttcaggtgtccgctacagaggatgggaatgttacaaaagactctaatgtggtcttggaaatcccagctgctacaactatcgcctatggagtaatagagctgtatgtgaagctggatggccagtttgagttttgtctgctgaggggaaagcagggcggtttcgagaacaaaaagcgtatcgacagcgtctatcttgaccccctggtgttccgggaattcgcatttatcgacatgccggacgccgctcatggtatttcgagccaagacgggcctttgagtgtattgaagcaggcaacactcctgctggagcgtaactttcacccattcgccgagctgcctgagccccaacagacggccctgtcagatatattccaggccgtgctgttcgatgatgagttgctaatggtcctggagcccgtctgtgacgatctggtcagcggcctgtctcctactgtggctgtcttaggcgagctgaaacctagacagcaacaggatctcgtcgcttttctgcagctggttggttgttccctccagggtggctgtccaggccccgaggacgccggctccaagcagctgttcatgaccgcttacttcttggtttccgccctagcagagatgcccgactcagctgccgccctgctcggcacctgctgcaagctccaaatcatccctacattatgccacctgttacgggcgctgtccgacgatggagtgagtgacctggaggaccccacacttacaccactcaaggataccgagcggttcggcatcgtccaaagactgttcgccagtgccgacataagtctggaaaggctgaagtcaagcgtgaaagcggtcatcctaaaagactccaaagtattcccattactgctgtgcatcaccctaaatggactatgcgctctgggaagagagcactcttag

SEQ ID NO: 114135 - DNA, 1491 bp, Artificial Sequence
  Description of Artificial Sequence: Synthetic coding sequence
atgttcgcaaaggcaacacgcaacttcctacgagaggtggatgcagacggcgacctgatagcagtgtccaatttaaacgacagcgataagcttcaactgctatccttagtgacaaagaagaaacgattttggtgctggcaacggcctaaatatcagtttctttccctcacactcggggacgtcctgatcgaagaccagtttccttctcctgtagtggtggaaagtgacttcgtgaagtacgaaggtaagttcgccaaccatgtaagtggcactctggaaacagcccttggcaaggttaaactgaacctcggtggttcgtcacgggtagagtcgcagtcgtccttcggaacattacgcaaacaggaggtggacctccagcagctgatcagagactcggccgaacgaacaatcaatctgagaaatcctgtgctacaacaggtgctggaaggacgcaatgaagtgctttgcgtcctgactcagaagataactactatgcaaaagtgcgtgatctctgagcacatgcaggtagaagagaagtgcggcggcattgtcggaattcagactaaaactgtacaggtgagcgccacggaggatggtaacgttacaaaagacagcaacgtcgttctggagatacccgcagccacgacaatagcctatggcgtaattgaactctatgtcaagctggacggacagtttgaattctgccttctcaggggcaagcaggggggcttcgaaaataagaaaagaatagattccgtctacctagatcctctcgtgtttagggaatttgcgttcattgatatgccagatgccgcccacgggatatcttctcaggacggccctctgagtgtgctgaaacaggcaactttgctgttggagcggaatttccatccgttcgccgaactgcctgagcctcagcagacggctctgtccgatatatttcaggccgttctctttgacgatgagcttttaatggtcctggaaccggtgtgcgacgacctcgtcagcggtctgtcccctaccgttgccgtgctcggggagttgaagccccggcagcaacaggatttggtggcattcctgcagctggtgggctgttcactgcaggggggctgtcccgggccagaagacgcagggtctaaacagctgttcatgactgcctattttcttgtcagtgctctagcggaaatgccagattcagccgccgccctgctggggacatgctgcaaattacagattatccctaccctgtgtcatctgctccgggccctttctgacgacggagtatctgatttggaagaccccaccttgactcctcttaaagacactgagcggtttgggatcgtgcaacgcctattcgctagcgctgatatcagcctagagagactcaagtcgagtgtcaaggcagtgattctgaaagactctaaagtcttcccccttcttctgtgcattaccctcaacggattgtgcgcgttgggccgggagcacagctag

SEQ ID NO: 114136 - DNA, 999 bp, Artificial Sequence
  Description of Artificial Sequence: Synthetic coding sequence
atgcagaaatgtgttattagtgagcacatgcaggtggaggagaaatgcggaggcattgttggtatccaaacaaagactgtccaggtgagcgcaacggaggatggaaacgtgacgaaggactccaatgtagtgcttgaaattcccgcggccaccaccattgcatatggcgtgatcgagctctacgttaaattagacggccaattcgaattttgtctgctcagaggcaagcaggggggctttgagaacaagaagcgcatcgatagtgtatatttggatcccctcgtgttcagagaattcgcgtttatcgatatgcccgacgccgctcacggaatctcctctcaggacggccccctctccgtgctgaaacaagctactctcctgctcgaaaggaactttcacccattcgccgagcttcctgaaccacaacaaaccgcactgtctgacattttccaggctgtcctattcgacgatgagctgctgatggtgctcgagcccgtttgcgacgacctggtgtcagggctctcgcccacagtggctgttttgggggagctgaagccaaggcagcagcaggacctcgtggcctttctgcagcttgttgggtgctctctgcagggagggtgcccaggaccagaagatgccggcagcaagcaactcttcatgacagcatacttcctggtatccgctttagccgagatgccagacagcgcggccgcattgctaggaacgtgctgcaaactgcagataattcccaccctgtgtcacttgctaagagctctctcagatgacggggtaagtgacctggaggacccaacgcttacccccctcaaagatacagagcggttcggtattgtccagcggctgttcgcatccgccgacattagcctggagcgtctgaagtcaagtgttaaggcagtgattctgaaggacagtaaagttttcccactgctgctgtgtataacgcttaatggcttatgtgccctggggcgcgaacattcctag

SEQ ID NO: 114137 - DNA, 999 bp, Artificial Sequence
  Description of Artificial Sequence: Synthetic coding sequence
atgcagaagtgcgtgatctctgagcacatgcaagtggaagagaaatgcggcggtattgttggcatccaaaccaaaaccgttcaagtgagcgccacagaggatgggaatgtgacaaaggattcgaatgtcgttctggaaattcccgctgccactacaatcgcttacggggtcatagagctgtatgtaaagctcgacggacagttcgagttttgtctgctccgggggaagcaaggcgggttcgagaacaagaaacggatcgattccgtctatttggatcctctggtcttcagagaatttgcatttatcgatatgccagatgccgcccatggcataagtagtcaggatggacccctgagtgtgctcaagcaagcaacactgttgctggagcgcaacttccaccccttcgctgagctacctgagccacaacagaccgctctctccgacatcttccaggccgtactttttgacgacgagcttctaatggtcctggaaccagtctgtgatgatctggtgagcggcctgtccccaacagtggcggtccttggtgagctcaagccgcgccagcagcaggatctggttgccttcttacagctggtcggctgtagcctccaggggggctgtccaggcccagaggacgctggttctaaacaactctttatgacggcctactttctcgtgagtgcactggccgagatgcctgatagtgctgctgcgctgcttggtacttgctgcaagctgcaaataatacctacactgtgccatttacttcgcgccctgtcagacgatggagtcagtgacctggaagaccccaccctaacaccactcaaggacacggagagatttggcattgtccagagactcttcgcctccgcagacatctctctagagcgattgaagagttccgtgaaagctgtgattttgaaggatagcaaggtgtttcccctcctgctttgcattaccttgaatgggctctgtgccttaggccgagagcattcgtag

SEQ ID NO: 114138 - DNA, 1575 bp, Artificial Sequence
  Description of Artificial Sequence: Synthetic coding sequence
atggcaaattcggctgggttcctgggagacctaactaccgaagggataaacaaaccaggcttctataagggacctgctggttcgcaagtcaccttaagctccctgggtaaccagaccagggtcctgttggaagaacaggcgcgccacctgcttaacgaacaagagcatgctactatggcttattatctggatgagtacaggggaggctccgtgtcagtggaagccttagtcatggcactgttcaagttactaaacacacatgccaagtttagcttactctcagaagtgcgtggaacaatttcaccacaagacctcgagaggtttgatcacctcgtgttgcgccgcgaaatcgagtccatgaaggctagacagccccctggccccggcgccggcgatacatattctatggtgagctactccgacacaggatcatcgaccgggagtcatggcacaagcactactgtgtcgtccgcgcgaaacaccctggatcttgaagagacaggggaggccgtccagggcaacatcaacgctctgccagacgtgtctgtggacgacgtgcgatccacgtcccagggcctgtcctcttttaagccgctccctagacctccaccccttgcccaggggaatgatcttcctttgggacagccacgcaaacttgggcgagaagatctccagcccccatcctcaatgcctagttgtagcggtactgtatttagcgctccccagaaccggtcccccccagctgggacagccccaacccccgggaccagttccgcacaagatctgcctagtagccccatctatgcatcagttagccccgccaatccgagcagcaaacgccccctcgatgctcatctcgcactggtgaatcaacaccccatcggcccttttccgcgggttcagagccccccccatttgaagtcaccttccgccgaggccactgtggcagggggatgtctgctgcctccgtcccccagcggacaccctgaccagaccggaacgaaccagcatttcgtcatggttgaggttcaccggccagactctgagcccgacgtgaatgaagtgagggcattaccccagactcgaaccgcttcaacgctgtcgcacttgagcgactcagggcagaccctctcagaagacagtggcgtcgacgccggcgaagcggaagccagtgctcctggcagaggtaggcaatcggtatccaccaaatcacgcagcagcaaagagttgccacggaatgagcggcctacagacggtgccaataagccgcccggcctgctggagccaacatcaacacttgtgcgtgtgaagaaatccgccgccaccctcggtatagccatcgagggcggggccaatactcggcaaccacttcctcgtatcgtcacgatccagagagggggctccgctcacaactgcggacagttaaaggttggccacgtaatcttagaggtgaatggcctgacccttaggggcaaggagcacagagaagcggctcgtattatcgccgaggctttcaaaactaaggatagagattacattgatttcctggtgaccgaattcaacgtcatgctgtag

SEQ ID NO: 114139 - DNA, 2724 bp, Artificial Sequence
  Description of Artificial Sequence: Synthetic coding sequence
atgaatgctcctctggacggattgtccgtcagtagtagcagcactggctccctcgggtcagcagctggtgccggaggcggtggcggggctggacttcgcttgctgagcgcaaacgtgcgccaactccatcaagccctgacagcacttctgtccgaggccgagagggaacagtttacccattgcctcaacgcataccacgccagacggaatgtttttgacttggtgcgaactctccgagtactgttagattcgcctgtcaagaggcggctgctgccaatgctgcgactggtcattcccaggtcggatcagctgctcttcgatcagtacactgccgagggcctctacctccccgctacaacgccatataggcaacctgcttggggcgggcccgatagtgctggacccggcgaagttagactggtgtctctcaggcgggcaaaagcccatgagggcctcggattctctatccgcgggggcagcgaacatggggtagggatctatgtgtccttggtggagcccgggagcctggctgaaaaagaaggtctccgggtgggggaccagattctcagggtgaacgataaaagcttggcccgcgtgacccacgccgaagccgtcaaagcacttaaagggtccaagaaactggttctcagcgtgtattccgcaggccgaatccccggaggctacgtgactaaccatatctatacatgggtcgatccgcaaggcaggtctataagccctccctccggcctccctcagccacacgggggagcactgaggcagcaggagggggatagaaggtccacgcttcaccttctgcaggggggggacgaaaagaaggtgaatctggtgctaggtgatggacggtcgctggggctgactattcgcggtggagctgaatatgggcttggcatctacatcactggagttgatcccggatcagaagcagaaggttcaggcctcaaagtaggggaccagattttggaagtgaatgggcgctccttcctgaacattctccacgatgaggccgtccgtttgttgaaatcctcccgacacctgatcctgaccgtgaaggacgtgggacgcttgccacgcgcccggactaccgtcgacgagaccaaatggattgcctcatctagaattagggaaaccatggccaatagcgctggcttcctcggggatctcactactgaaggtatcaacaagccagggttctataagggtcctgcgggctctcaggttaccttgagtagtttaggtaaccaaacaagggttttgttggaggagcaagccagacacctactgaatgagcaggagcacgccacgatggcatactatctggacgagtaccgggggggaagcgttagcgtagaagctctggtgatggcccttttcaaattgttgaacacccacgctaaattctcactgctgtctgaagtgcgtggaaccatttccccacaggacctggagaggttcgatcatctcgtcttaagacgggaaattgagagcatgaaagcccggcagcctcccggaccaggcgcaggcgacacatatagcatggtgagctactcagacaccggttcatctaccgggtcgcatggaacctcgacaaccgtttcttcagcccggaacacattggacttggaagagaccggtgaggccgtgcaaggtaacataaacgctctacccgacgtttcagtggatgatgtgcggagcacttcccaaggtctctctagtttcaaaccactgccaagaccgcctcctctggcacagggcaatgatctgcctctaggccagcccaggaagctcggcagggaggatctccagccaccaagctcaatgccaagttgctccgggaccgtattttcggcgccccagaatcgatcacccccagctggcaccgccccgacacctggaacgagttccgctcaggacctcccctcttctcccatctatgccagcgtcagcccagccaacccttcgtccaagagacctttggatgcccatctggccttggtgaatcagcaccctatcgggcctttccctcgggtgcagtcgcctccacacctgaagtcaccaagcgctgaggccaccgtcgccggcggctgcctgctaccgccctcaccatctggccacccagaccaaacaggaactaatcaacacttcgtgatggttgaggttcaccgacctgattctgaacctgatgtgaatgaagttagagccttgccacagacaaggaccgcatcaaccctgtcacacctcagcgacagcggacagactctatcggaggattcaggagtagacgctggcgaggccgaggcctccgccccagggaggggccggcaatcggtgtccacaaagagcagatcatccaaagagctgccccgtaatgagcgcccaactgacggcgctaataaaccacctgggctcctagagcccacaagcacgttggtgcgagtgaaaaagagcgccgccaccctcggaattgccattgaagggggggcgaacactaggcagccactgccccgaattgtgacgattcagcggggaggaagcgcccacaattgcggccagctgaaagtcgggcatgtcatcttggaagtcaatggacttactcttcgtggcaaagagcatcgtgaggccgctagaattatcgctgaggcctttaagacgaaagaccgcgactacatagactttcttgtgaccgagtttaatgtgatgctctag

SEQ ID NO: 114140 - DNA, 1038 bp, Artificial Sequence
  Description of Artificial Sequence: Synthetic coding sequence
atgaacgcgccattggatggtctgtccgtcagttcgtcaagtaccgggtccctgggttcggcagcaggcgcgggaggcggaggaggtgccggacttaggctgctgtctgcgaacgtcaggcagctgcaccaggcattgactgcgctcctgtcagaggcagagagagaacagtttacacattgcctcaatgcctaccacgctcggagaaacgtgttcgacctggtgcgaaccttgagagtgctactggactcacctgtgaagcgaaggcttttgcctatgctgagactcgtaattcctcgctcggaccagctgctgtttgaccagtatacggctgagggcctgtacctccctgctactaccccttaccgccagcccgcttgggggggtccagacagcgccgggcccggggaggtgagactggtctccctgcgacgcgctaaggcacatgaagggctcggattttccatccgtggtggcagtgaacatggggtgggcatctatgtaagtctggttgaacctggatcgcttgccgagaaagagggactgagggtcggtgaccagattctccgggtgaacgacaagagtctggccagagtcacccacgccgaggccgttaaggctttgaaggggagcaagaaacttgtgctgtccgtttactctgctggcaggataccaggcgggtatgtgacaaaccatatctatacatgggttgacccgcaaggtaggagcatctcaccacctagcggactgcctcagcctcacggcggcgcgttgaggcaacaagaaggcgaccgccgctccactctccatctcttgcagggtggagatgaaaagaaggtatcgggcgtggggaaggggggccagcccctgcgccaccggatactgccacccaatcccgagcagcagagctgtctcgaagctgcaaggcgggggtggttctgtccgggcagcgtcttcccacaggtgtgcaccgaagggtggtgtttcttcttcgctttcttatttgatctgtgctctgtatgctataacactggctag

SEQ ID NO: 114141 - DNA, 1671 bp, Artificial Sequence
  Description of Artificial Sequence: Synthetic coding sequence
atgcacgggagcctggaagccctcttgttcttaccccaggtgacactgtcacttgcacatgcgcacttgatttgttccaatgcccagctggagatgtgtgtgttcccgcaccggttcctgggagatttaacgactgaggggataaacaaacccgggttctataagggcccagcaggaagccaggtgactctgagcagccttggcaaccagacacgggtgttactggaagagcaggcacgccacctccttaatgagcaggagcacgccaccatggcatactatctcgatgaatatcggggcggctcagtgtccgtggaggccttagtaatggccctgtttaagctgctgaacactcacgctaagttttcactgctcagcgaagtgaggggcactatttcacctcaggacttagaaagatttgatcatttggtccttcgacgggagatcgaatctatgaaagcacgacagccacctggcccaggggctggtgacacatattctatggtgtcctatagcgatactggcagcagcaccgggtcacacggcacctccacaacggtttcgtcagcacgcaatactctggaccttgaagaaaccggggaggcggtacaagggaacatcaatgctcttcctgacgtgtctgtggacgatgtacggtcgacatcccagggtttgagcagcttcaagcctctgccccgcccccccccactggcccagggaaatgacctgcccttgggacagcctagaaaacttggcagagaagatcttcagcctcccagctcaatgccatcttgttctgggacagtgttttccgctccccagaaccgctctccccccgcggggaccgcccccactcccggcaccagctcagcccaggatcttcccagctctcccatatatgcatcagttagccccgctaacccgagctccaagcgtcccctggacgcccacctcgcactcgttaaccaacaccccattggtccatttcctagagttcagtcacctcctcatcttaagtccccttccgcggaagcaacggttgctggcggctgcctcctgccaccctcaccatcaggccatccagaccagaccggcaccaaccaacattttgttatggtcgaagtgcacagacctgattcggagcctgacgttaacgaagtgcgggccctgccgcagacgcgaaccgccagtacactgtcacacctgagtgacagtgggcagacactgagcgaagactctggcgtagacgcgggagaggccgaagcctccgcccccggcagagggcgccaaagcgtctccactaagtccaggtcatctaaggagctcccgcggaacgagcggccaactgacggagctaataagccacccggactgctggaaccaacgtctaccctcgttcgcgtcaagaaatctgcagcaaccctgggaatagctatcgaggggggagctaatacaaggcagccccttccaaggatcgtgactatacagcgcggcggcagtgctcacaattgcgggcagctgaaggtgggccatgtgatcctcgaggtcaacggactcacgttaagggggaaggagcatagagaggcagccagaatcattgctgaggcctttaaaaccaaggaccgcgactatatcgattttctggtgactgagtttaatgtgatgctctag

SEQ ID NO: 114142 - DNA, 1059 bp, Artificial Sequence
  Description of Artificial Sequence: Synthetic coding sequence
atgtttgcagcagccacgaagagcttcgtgaaacaagtgggagacggtgggagactagtcccagttccctctctgagcgaagctgacaaataccaacctctatcactcgtggtgaaaaagaagcgttgctttctgtttcccaggtacaaatttacctcaactccatttacactgaaggacatcctgctgggcgacagagagattagcgccggcatcagtagttatcagttgctgaactacgaggacgaatcagatgtgtcactgtatggacggcgtggtaaccacattgtgaacgacgtcgggattaacgttgctggttcagatagcatcgctgtcaaggcctcctttgggatcgtgaccaagcacgaggtggaagtctcaaccctcctgaaggaaatcaccacccgaaagattaatttcgatcattccttgattagacagtcacgttcaagtcggaaagcagtgttgtgcgtggtaatggagagtattcgtaccacgcgccagtgttcactgagtgtgcacgcaggaatccgcggcgaagcaatgcgctttcattttatggacgagcagaatccaaaaggccgcgacaaggctatcgtgttcccggcccacacaaccatcgcgttctctgtcttcgaacttttcatttatcttgatggagccttcgatttatgcgtcaccagtgtgagcaaaggcggttttgaaagagaggagacagccacattcgccctactgtacaggctccggaacatcctatttgagagaaaccgaagagttatggacgtgatcagtaggagccagttatacctcgatgaccttttcagcgactattacgacaagcctcttagcatgacagatattagcttaaaagaaggcacccacattagggtcaacttgctcaatcacaacatccctaagggtccatgcattctgtgcggtatggggaatttcaaaagagaaactgtgtacggttgctttcagtgctcagtggacggacagaagtacgtacgtttgcatgcggtgccttgttttgacatctggcacaagcgtatgaaatag

SEQ ID NO: 114143 - DNA, 1059 bp, Artificial Sequence
  Description of Artificial Sequence: Synthetic coding sequence
atgttcgccgccgcaaccaagtcctttgtgaagcaggtcggggatggaggaagacttgtccctgttcctagtctctccgaagcagacaagtatcagccactgagtctggtggttaagaagaagagatgcttcctcttcccccggtataagtttacctccacccccttcaccttgaaggacatcctcctgggagatagagaaatctctgcaggtatttcctcttatcagctcctgaactacgaggacgagagcgacgtttcactttatggccgtcggggtaatcatatcgttaatgacgtggggatcaacgttgccggctcggacagcattgcagtcaaggcctcttttggaattgtcaccaagcacgaggttgaggtttccacactcctcaaggagattacaactaggaagattaatttcgaccacagtttaattcgccagtctcgctccagcaggaaggccgttctgtgtgtggtgatggaatctatcaggactactaggcagtgctcactgagcgtgcacgctggaattcgcggggaggccatgagatttcacttcatggatgaacagaaccccaagggcagggataaggcgatcgtgtttcccgcccacactactatcgctttttctgtattcgagctgttcatctatctagacggagccttcgacctttgtgtgacaagtgtatctaaaggaggattcgagagggaggaaaccgctacgttcgctctcctgtatcgcctccgtaacattctgtttgaaagaaatcgtcgtgttatggacgtgatttcccgcagccagctctacctagatgatctattttccgattactatgataagcccctgagcatgaccgacataagtctcaaagaaggtacgcatatcagagttaacctgctgaatcacaacattccaaaggggccatgcatcctgtgtggcatgggaaactttaaaagggagactgtgtatggatgctttcaatgctccgtcgacggccagaaatatgtacggctgcatgctgtgccgtgtttcgacatctggcataaacggatgaaatag

SEQ ID NO: 114144 - DNA, 2388 bp, Artificial Sequence
  Description of Artificial Sequence: Synthetic coding sequence
atgtccaagagacaccggcttgaccttggagaggattacccgtcaggcaagaaaagggcgggaaccgacggcaaagaccgggacagggaccgcgatcgagaagaccgatcaaaggaccgtgatcgggagcgagaccggggggatagggagagagaacgggaaaaagaaaaagaaaaggaactgcgagccagcactaacgccatgctcatttccgcaggcctgccacctcttaaagccagtcacagtgcccacagcacccattccgcgcatagcacacattccacccatagcgcccactctactcacgcgggccatgcgggccacacctcgttacctcagtgcatcaatccgttcactaacctgccccatacacccaggtattacgatatactcaagaagaggctgcaactgcctgtttgggaatataaagaccggtttaccgatattttggtgcgccaccagtcgtttgttcttgtgggggaaacaggatccggtaaaactacccagatacctcagtggtgcgtggaatatatgagatcattgcccggccccaaaagaggcgtcgcctgcacccagcctcgcagggtagcagcaatgtctgtggcccagcgggtggcggacgagatggacgtcatgctcggccaggaggttgggtactctatacgctttgaggactgcagcagtgcgaaaacgatcctgaaatatatgactgatggaatgctgctgcgtgaagccatgaatgatcccttgctggaaaggtacggcgtgatcattctggatgaggcgcatgagaggaccctggccaccgacatactgatgggcgtgctcaaggaagtggtccgccagaggtcagacctgaaggtcatagtgatgtctgccaccttagatgcaggaaaattccaaatttattttgacaactgcccgctgctcactattccaggccgcacccaccctgtggaaattttttatacacctgaaccagaacgcgactaccttgaagccgctattcgcactgtgatacagatacatatgtgtgaagaagaagagggtgacctcctcttgttcctcacaggtcaagaagaaattgatgaggcatgcaaacggattaagagggaagtagacgatctcggccccgaggtcggggatatcaagatcatcccactctacagtaccctgcccccccagcagcaacagcgcatcttcgagccacctccccccaagaagcagaacggggccatcggcagaaaagtggtggtgtctaccaatatagcggaaaccagtttaacgatcgacggagtcgttttcgtcatcgaccccggctttgccaaacagaaggtgtataatccccggatccgagtggaatcactgcttgtgaccgcaatctctaaggcctctgcccagcagagggccggacgggccgggagaactagaccaggcaagtgttttagactctatacagagaaggcctataagactgagatgcaggataacacatacccagagatcctgagatctaacctgggtagtgttgtgctgcagctgaaaaaactgggaattgacgacctcgtgcactttgatttcatggaccccccggcaccggaaactctaatgcgtgcattggagttactcaactacctcgccgccctgaacgacgatggggacctgactgagctagggagcatgatggctgagtttcccctggatcctcagctagctaagatggtgattgcatcttgcgactacaactgctcaaacgaggtgctgtcaatcacagccatgctgagtgtgcctcagtgcttcgttagaccaacggaagccaaaaaggctgccgacgaagctaagatgagatttgctcatattgacggggatcacctgacacttctcaatgtgtaccatgcctttaagcagaaccacgagtccgtgcagtggtgctacgataattttattaattacagatcattgatgagcgccgataatgtccggcagcagctttcacgaatcatggaccgcttcaacctgcccaggcgctccacggacttcaccagtcgcgattactacatcaacattcgaaaggcgctggtcacgggctacttcatgcaggtagcccacctggaacgcacgggtcactatctgactgtaaaggataatcaggttgtacagcttcacccctccaccgtgctcgaccacaagccagagtgggtcctatacaacgaattcgtccttaccaccaaaaattatatcaggacctgtaccgatataaagcctgaatggttggtgaagattgctccccagtactacgacatgagcaacttcccgcaatgtgaagcaaagcgccaactggataggatcattgccaagttgcagtctaaggagtattcacagtattag

SEQ ID NO: 114145 - DNA, 2355 bp, Artificial Sequence
  Description of Artificial Sequence: Synthetic coding sequence
atgagcaaacgacaccggttggacctcggcgaagactatccctcaggtaagaagagagcaggaacagacgggaaagatagggaccgggatcgggaaagagataggggagatagggagcgggagagagagaaagaaaaggagaaagagctgcgggcctctaccaacgccatgctcataagtgcaggtctgcctcccctgaaggccagtcatagtgcccattccacgcacagtgcccactccactcacagcacacatagtgcccactcaacacatgccgggcacgccggacatacaagtctgccacagtgcataaatccatttactaacttgccgcatactcctcgctattacgacattctgaagaaaaggctgcagctcccagtgtgggagtacaaggacagatttacagatatactggtgcgccatcaatcattcgtgctggtgggcgaaaccggatcaggaaagacaactcagatcccccagtggtgcgtagagtatatgcgatccctccccggacctaagagaggtgtggcatgtactcagcccagaagggttgcggctatgtccgttgcccaacgcgtagctgatgagatggatgttatgctggggcaagaagtgggctatagcattcggttcgaggactgctctagcgctaaaaccatcctcaagtatatgacagacggaatgctgcttcgagaggccatgaacgatcctctgcttgagcgctacggcgttatcattttggatgaagcacacgagagaacattggcgacagacattttaatgggagtgctgaaggaggtcgttcggcagcgtagcgacctgaaggttattgtgatgtcggctactctcgacgctggaaaatttcagatttactttgacaattgccccttgctaacaatcccagggaggacacatcctgtggaaatcttctacaccccagagccagagcgggactatctcgaggcagcaatacggaccgtaattcagatacatatgtgtgaggaggaggagggcgacctgctcctcttccttacaggtcaagaggagattgatgaggcctgcaagcgcatcaaacgcgaagtcgacgatttgggtcctgaagttggagacatcaagattatccccctctacagtactcttccgcctcagcagcaacagcggatattcgagcctcccccccccaaaaaacaaaacggcgccattggccgaaaagttgtggtatcaaccaacattgctgagacgagcttaaccatcgacggcgtggtctttgtcatcgaccccggcttcgctaaacagaaggtctacaatccccggatcagggtcgagtcattactggtgaccgccatctctaaagcttcagctcaacagagggcaggccgggcaggccgcacgcgccctggaaaatgttttagactgtacaccgagaaggcctataagacggagatgcaggataacacatatccagagatcttaaggagtaatttggggtctgtggtgctgcagctcaaaaagctcggaattgacgatttagttcattttgatttcatggaccctcctgcacctgaaaccttgatgagagctcttgagctgctgaactacctggccgcattgaacgatgacggagatctcaccgaactggggtctatgatggccgagttcccccttgacccgcagctggctaagatggtgatcgcttcatgcgactacaactgttctaacgaggtactatccattactgccatgctctctgtcccacaatgcttcgtccgtccaaccgaggcaaaaaaagccgccgatgaggctaagatgaggttcgctcacatcgacggcgaccacttgacactgcttaacgtttaccacgctttcaaacagaatcatgaatcagtccagtggtgttacgacaatttcatcaattaccgatccttgatgagtgccgacaatgtgcgtcaacaactctctcggatcatggaccgtttcaacctgcctaggcgatccaccgacttcacctcacgcgattactacattaatattagaaaagccctcgtgaccggctactttatgcaggtggcacatctcgaacgcactggccattatctgactgtcaaggataaccaagtggtgcagttacacccaagcacagtgctggatcacaaaccagagtgggtcctttataatgaattcgtattgacgacgaagaattacattcgtacgtgtaccgacatcaaaccggagtggctcgtgaaaatagccccacagtactatgacatgagtaactttccccagtgcgaagccaagcgacagctggatcggataatcgctaagctgcagtccaaggaatatagtcagtattag

SEQ ID NO: 114146 - DNA, 1683 bp, Artificial Sequence
  Description of Artificial Sequence: Synthetic coding sequence
atggaatcccaaccagcgcaggaatgtttgatgcagatgttcctgcctattgaacccgcgtgtttcgtcgagtggcttggaacctctccctcccaactgggagtcgtgatggtagatgaagcacatgagcgtacactgcacacagatatccttttcggcttaatcaaggacgtcgctcggtttcgccccgagttgaaagttctcgtagcaagtgcaaccatggatactgccaggttcagcacattcttcgatgacgcaccagtgttccggataccgggtcgtcggttccccgtggatatcttttatacgaaggccccagaggctgactatctggaggcatgcgtcgtgagtgttttgcaaatccacgtaacccaaccccccggggatatcctggtgtttcttacaggacaagaggagatcgaggcagcctgcgagatgctgcaggaccgttgcaggcgactgggctccaagattcgggaactcctggtgctgcctatctacgctaacctcccttctgacatgcaggctcgtatttttcagccaacccccccgggcgccaggaaggtcgtggtggccaccaatatcgctgagacgagcctcaccattgaggggattatttacgtgctcgaccccggcttttgcaaacagaaatcctataatccccgcactggcatggagtcactcacagtcaccccatgttctaaggcctcagcaaaccaacgggccggccgcgccggacgcgttgccgcaggcaagtgcttcaggctctacacggcctgggcctaccagcacgagctggaggaaacaacagtaccggaaatccaacgcacctcactcggaaacgttgtactcctgttaaagagcctggggatacacgacttgatgcactttgattttttggatccacccccatacgagacactcctattggctcttgagcagctctatgccctgggggccctgaaccacctgggcgagttgactacttctggccgcaaaatggctgagctacctgtcgaccccatgctctcgaagatgatcctggcgagcgaaaaatacagctgcagcgaagagatcctgaccgtggccgccatgttgtccgtgaataattctatcttctacaggcctaaggacaaagtcgtacacgcggacaacgctcgcgtcaatttcttcttacccgggggggatcacctggtgctgttaaacgtatatacacagtgggcagaaagtggatactcctcacagtggtgttatgaaaactttgtccagttcagatccatgcgtagggcccgggacgttcgagaacagctggagggcttactcgagcgcgtcgaggtggggctgagctcctgccaaggcgattatattagagtgagaaaagccattacagccggttatttctaccacactgctcggctgacaaggtccggttataggacggtgaagcaacaacaaacagtgttcatccatccgaattcttctttgttcgaacaacagcctcgatggttattgtaccatgagctggtgcttaccaccaaagaatttatgagacaggtgctggagatcgagtcctcttggctgctcgaagttgctccacactattacaaggccaaggaactcgaggacccccatgctaagaaaatgcctaagaagataggcaaaacccgggaggaactgggctag

SEQ ID NO: 114147 - DNA, 3126 bp, Artificial Sequence
  Description of Artificial Sequence: Synthetic coding sequence
atggcaaccccagctgggttggagcgctgggtccaagatgaactgcacagtgtcttaggactgtccgaacgccacgtggcccagtttctgatagggacagcccagcggtgtacctcagcggaggaatttgtgcagcggctgagggatacggataccctcgatctgtctggcccggcacgggattttgcacttcgcctatggaacaaagtgcctaggaaggccgtggtggagaagccggcaagagccgccgagcgcgaagctagggcacttctcgagaaaaacagaagttatcgtctgttggaggactctgaggaatcaagcgaggaaaccgtcagccgggctggcagctctctgcaaaagaagcggaagaaaagaaagcatctgcggaaaaagcgggaggaagaggaagaggaggaagcctcagagaagggcaagaaaaagaccggggggtccaagcaacagacagagaagccagaaagtgaggacgagtgggagcgaactgaacgagagagactccaggaccttgaggagagggatgcatttgctgaaagggtacgtcagcgcgacaaagatagaacccgtaatgtgctggaacgatcggataaaaaagcctacgaggaagcgcagaagcgattaaaaatggccgaggaagatcggaaagctatggtcccagagcttcgtaagaaatccaggcgtgaatacctcgccaagcgcgagcgggaaaaactggaggacctggaagcagagctggcagacgaggagtttctgtttggcgatgtcgagctgtccaggcatgaaagacaggagcttaaatacaaaagacgcgttagagatcttgcccgagagtacagagctgccggcgagcaggagaagttagaagcaaccaatcgctatcacatgcccaaggaaacgcgggggcagcccgctcgagccgtcgacttggtagaagaagagtccggcgcccccggcgaagagcagagaaggtgggaggaggctcggctgggggcagcttcacttaagtttggcgctcgcgacgccgccagccaagaacccaaataccagctagtgctcgaagaggaggaaacaattgagtttgtgagggctacacagctgcagggcgacgaagaacccagtgcaccacccacatcaacccaggcccagcaaaaagaatcaattcaggcagtgcgtcgttccctgccggtttttcctttccgcgaagagttgctggctgccatcgccaaccaccaggtcctaattattgagggcgagaccggatcaggcaaaacaacccagatccctcagtacctgttcgaggaaggctataccaataagggaatgaaaatcgcatgtacccaaccccggagagtggcagccatgtcagtggccgctagggtggcccgggagatgggagttaagctgggtaatgaagttggctattcaatcaggttcgaggattgcacatccgaaaggacggttttaaggtatatgacagatggaatgcttctgagggaatttctgagtgaaccagatctagcttcctactccgtagtgatggtggacgaggcccatgaacgaactctacatactgacatactgttcggcctcataaaagacgtggcccgcttccgacctgagttgaaggttctggttgcatcagccacgatggacacagcccggttcagtacttttttcgacgacgcaccagtgtttagaatccctggcaggagatttccagtcgatattttttatacgaaagcacctgaagctgactatctcgaggcttgtgtggtgtcagtcttacaaattcacgtcacccaaccaccaggagacatcctcgtgttcctgaccggacaggaggaaatcgaggcagcctgtgaaatgctccaggatagatgtagacgcctcggcagtaagatacgggaacttttggttctgcccatctacgctaacctcccaagcgatatgcaagctaggatcttccagccaacacctcccggcgctagaaaggttgtggtcgctaccaatattgccgagactagtctaaccatcgagggtattatctacgtgctggaccctggcttttgtaaacaaaagtcttataaccctcggaccgggatggaatcattgaccgtgaccccctgttcgaaagccagtgcaaatcagagagccggcagagccgggagagtagccgccggtaagtgttttagactgtataccgcgtgggcataccaacacgagctggaggagacaaccgtacccgaaatccagcgcactagtctgggcaatgtagtgctcctcctgaagtctttagggatccatgaccttatgcatttcgatttcctggatcccccgccctatgagaccctccttctggcactcgaacagttgtacgcacttggcgcgctgaatcatctcggtgagctcactactagcggtcgaaagatggccgaattacctgtagacccaatgctgtctaaaatgatcctggccagcgagaagtacagttgttcagaggaaattctcaccgttgccgccatgttaagcgtgaacaactctatcttctaccggcctaaggacaaggtggtacacgccgacaacgcgagggttaactttttcctcccgggaggggatcacctggtgctgctcaacgtgtacacacaatgggcagaatctggctactccagtcagtggtgttacgaaaattttgttcagtttagatctatgcgcagagcacgcgatgtgagggagcagcttgagggactattggagagagtcgaagtggggctgtcctcgtgccagggggactatatcagagtcagaaaggccatcaccgccggatatttctaccacactgctcggctgacacggtccggttatcggacagtgaagcagcagcagaccgttttcattcacccaaattccagcctgtttgagcaacagccccgctggctcctgtaccacgagctggtgcttacgactaaagaatttatgaggcaggtgcttgagattgaatcctcctggttattggaagtggcaccacactactataaggccaaggaactcgaagatccgcacgccaagaagatgcccaagaaaattggcaaaacccgcgaggagctgggatag

SEQ ID NO: 114148 - DNA, 1683 bp, Artificial Sequence
  Description of Artificial Sequence: Synthetic coding sequence
atggaatcgcagcccgcccaggagtgtttgatgcagatgtttttgcccatcgagccagcctgcttcgtcgaatggctggggacctccccaagccagctgggtgtcgtcatggtggacgaagcccacgaacggacactgcatacagacatcctgttcgggctgattaaagacgtcgctcggttcaggccagaattgaaagtgcttgtggccagcgctacaatggacaccgccaggttttctaccttctttgacggcgctccagttttcaggatcccgggccggagatttcctgttgatatattctacactaaggcccccgaggcagactatcttgaagcatgtgtcgttagtgtgctgcagattcacgtcactcagccccctggagatatcctggtgtttctaactggtcaagaggagatcgaagctgcgtgcgaaatgctgcaggacaggtgcagaagactggggtcgaaaattagagaactgctggtgttgcctatctatgctaaccttcccagcgatatgcaggcacgcatcttccagcccaccccaccaggggctaggaaggtcgtggtcgcaactaatatcgccgagacctcccttacaatagaaggtattatctacgtgctcgatccggggttctgcaagcagaaatcctacaaccccagaacgggaatggaaagcctcacagtgaccccctgctccaaggcgagcgctaatcagagagccggacgcgcgggacgtgtggcggccggtaagtgcttccgactttacaccgcatgggcttaccaacatgagttggaggagactaccgtccccgagatacagaggacaagtcttgggaatgtggtgctcctgctgaagtctcttgggatccatgacctgatgcattttgacttcctggatcctccaccatacgaaaccttgctgctggccctcgaacaactgtacgccctcggcgccctgaatcacttgggcgagctgacgaccagcgggagaaagatggccgagctgccagtggaccctatgctgagtaagatgatcctggcctctgagaagtacagctgcagtgaagagatcctgaccgtggcggccatgttatcagttaataattccatcttttacagacctaaggacaaggtggtgcacgctgataatgcgcgggtgaatttctttctgcccggtggtgatcacctcgttttgctgaatgtgtacacccaatgggccgaatctggctacagcagtcagtggtgttacgaaaacttcgtgcagtttcgttcaatgcggagagcgagggatgttcgagaacagctcgaagggttgctcgaaagggtagaggtggggctgagctcctgccaaggcgactacatcagggtgcgaaaggccatcacagccggctatttctatcataccgcccgcttgacccgcagtggttacagaacagtgaagcagcagcagaccgtgttcatccaccctaattcttcactgttcgagcaacagcctcgctggctgctttaccatgaattagtccttacaactaaggaatttatgagacaggttcttgagatcgaaagtagttggctcctggaggtggcaccccattactataaagcaaaagaactggaggatccacacgcgaaaaaaatgccgaagaaaatcggaaaaactagagaggaactcggatag

SEQ ID NO: 114149 - DNA, 3126 bp, Artificial Sequence
  Description of Artificial Sequence: Synthetic coding sequence
atggcgacccctgctggactggaaaggtgggtgcaagatgaactccactcagtactgggtctcagcgaaagacacgtggcacagtttttgatcgggaccgcccagaggtgtacatctgcagaagagtttgtgcagcggctgagggacacagatactctggatctctctggccccgctagagacttcgcactgcggctgtggaataaggtgcctcgcaaagccgtggtggagaaacccgcacgcgcagctgagagggaagccagggccctacttgagaaaaatagatcatatagactccttgaagattcggaggagtcctccgaagaaactgtgtctcgggccgggtcatccctgcaaaagaagagaaagaaacgaaaacatctgagaaagaaacgagaagaggaggaggaagaggaggcctctgagaaaggtaagaagaagaccggcgggtccaaacagcagactgaaaaaccggagtctgaagatgagtgggaacgtaccgagagggagcgcctccaggacctggaagaacgagatgcctttgccgagagagtccgacaacgggacaaggaccgcactcgcaatgtgctggagcgctcagacaagaaggcatacgaagaggcccagaaacggttaaagatggcagaagaggacagaaaagccatggtccccgagcttcggaagaagagccgaagggaataccttgctaagagggagcgggagaagctggaggatctagaagccgaactcgctgatgaggaatttctctttggagatgtcgagctctcccgccatgaaagacaggagcttaagtataaaagaagagtgcgggacctcgctcgggagtatcgcgcggccggcgagcaagagaaactcgaggctaccaaccgatatcacatgcccaaagagacaaggggccaaccagcacgagcggtggacctggttgaggaagaaagtggcgctcccggtgaagaacagagacgttgggaggaggctaggttaggcgctgcgagcttgaagtttggggcacgcgacgccgcttcccaggagcccaagtatcaacttgtgctagaggaagaggagactatcgaattcgtgagggctactcagcttcagggcgatgaggaacccagcgccccaccaacttccacacaagcccagcagaaggagagtatccaggctgttcggcggtcactccccgtgttcccattccgcgaagagcttttggccgccattgccaaccatcaggtcctgatcattgagggggaaactggtagtggcaagaccacccaaatcccgcagtatctgttcgaagaaggctacacaaacaaagggatgaaaattgcatgcacccagcccagacgggtcgcagctatgtccgtggccgcacgggtcgccagggaaatgggcgtgaaactcggaaacgaagtcggatatagcatcaggttcgaggattgcacctctgagaggacagtgctgcggtatatgacggacggaatgctgcttcgggaattcttgtctgagcctgatttagcgagttactctgtggtcatggttgatgaagcacacgaaagaaccttacacacggatatattgttcggcttgattaaagacgtggctagatttagaccagaactgaaggtgctggtggcatccgcaacgatggacaccgcccgattcagcacgttcttcgatggtgcccccgtttttaggatccctgggcgccgatttcccgtcgacattttttatacgaaagcacccgaagccgattacctggaggcctgcgtggtgtccgtgctgcagatccacgtcactcaaccccccggcgacatcctggtcttcctcacaggccaggaggagattgaggccgcatgcgaaatgctgcaggaccgctgcaggaggttagggagtaagatccgcgagctgctagtactgcctatatacgcgaatctccccagtgacatgcaggcccgaatattccaacccactcccccaggagctcggaaagtagttgtcgccacaaatattgctgagacaagtctgactattgaagggatcatttatgtgctcgacccaggtttctgtaagcagaaaagctacaacccccgaactggaatggagtccctgacagtcacgccgtgctctaaggcctctgcaaaccagcgggctggccgcgccggacgcgtcgctgccggcaagtgcttcaggttgtatactgcgtgggcttatcagcatgaactggaagagaccacggtacccgagatacagaggacaagcctaggaaacgtagttcttctgctgaagtccttgggtattcacgacttaatgcacttcgatttcctcgaccctcccccttacgagactctgttgctggcgcttgagcagctctatgccctgggagcgctgaaccacctcggcgaactgacaactagcggtagaaagatggccgagctccccgtcgatccgatgctgtccaagatgattctggcgtcagaaaagtactcttgttccgaggagattcttacagtcgctgccatgttgtcggttaataattcaatattctataggcctaaggataaggtcgtacacgcagataacgcgcgggtgaactttttcttgcccgggggggaccaccttgttctgttaaatgtctacacacaatgggcagagtcaggctatagtagtcagtggtgttacgagaacttcgttcaattccgctctatgcggagggcacgggacgtacgggagcagcttgagggtctcttagagcgagtcgaagttggcctctcgtcctgtcagggggactatatacgagttcggaaggctatcactgccggctacttttaccatacggctcggcttactcgctccggctatcggactgtgaagcagcagcaaactgtgttcatacaccctaacagttctctattcgaacagcagccccgatggctgctctatcacgaacttgtactcacaaccaaggagtttatgagacaagtactcgagatcgagtcaagctggttgcttgaggtcgcaccccattactataaagccaaagagctagaagatccacacgcaaagaagatgcccaaaaagataggcaaaacccgcgaggagctagggtag

SEQ ID NO: 114150 - DNA, 1683 bp, Artificial Sequence
  Description of Artificial Sequence: Synthetic coding sequence
atggagtctcaacccgcccaggagtgcctcatgcagatgttcctgcccatcgaacccgcctgctttgtcgaatggctgggcacttccccctcacagctgggtgtcgtcatggtggacgaggcccatgaaaggacgctgcacactgatatcctttttggtctgattaaagatgtggcacgctttaggccagaactcaaagtcctggtagcctccgcaaccatggacaccgctagattcagcacctttttcgatgatgcccctgtgttccgaatcccggggcgacgttttccagtggacattttctataccaaggccccagaagcggactatttagaggcctgcgtagtgagtgtcctgcagatccatgtgacgcagccccccggagacattttagtcttcctgacggggcaagaggaaatagaggccgcttgcgagatgctacaagatcgctgcaggcgtctagggagcaaaatcagagagcttttggtgttgcctatctatgcaaacctaccgagtgacatgcaggcaagaatcttccaacccacaccaccaggggcaaggaaggtggttgtggctacgaatatagctgagacaagtcttaccattgagggaatcatttacgtgttggatcctggcttctgtaaacagaagtcttacaatccccgcaccgggatggagtcccttactgttacaccgtgctccaaagcctctgccaatcagcgcgctgggcgggccggacgcgtggcagccgggaaatgcttcagactttacactgcatgggcttaccaacacgaactggaagagactacggtccccgagattcaaagaacctcattagggaacgtcgttcttcttcttaaaagtctcggtattcatgatctgatgcactttgactttctcgatccccctccttatgagaccctcctactggcactggagcaactctatgcactgggcgctctgaaccatctcggggaattgacgacctcaggacggaagatggcagagctgcccgtggacccgatgctttcaaagatgattcttgccagtgagaagtacagctgtagtgaggagattctgaccgtcgcagctatgctgtccgtgaacaattccatcttctaccgacccaaagataaggtggttcacgcggacaatgcccgggtgaactttttcttgccaggtggagaccacctggtgctgctcaacgtctatacccagtgggcagaaagcggctactcttcccagtggtgttatgagaacttcgtacagtttagaagtatgcgccgggctcgcgatgtacgagagcaactggaaggactcctggagagggtcgaggtgggccttagttcttgccaaggtgactacatcagggtgaggaaggcgatcaccgcagggtacttttaccacaccgcaagactcacaaggagcggataccgcacggtgaagcagcagcagacagtgttcattcacccgaacagttcactgtttgagcagcaacctagatggcttttgtatcacgaacttgttctgaccaccaaggagttcatgcgtcaggtcctggaaattgaaagctcctggctcctagaagtggctcctcattactacaaggcaaaagaactagaagatcctcacgcaaaaaaaatgccaaagaagattggcaagacccgggaggaactaggctag

SEQ ID NO: 114151 - DNA, 888 bp, Artificial Sequence
  Description of Artificial Sequence: Synthetic coding sequence
atgtccgaagaccccagaggtcctaaagtgcctagaaaggcagtggtcgagaagcctgctagggccgctgaacgagaagcccgcgcactgttggagaaaaaccgaagttataggctgctggaggatagtgaggagtcatccgaagagaccgtcagccgggcgggatccagcctgcagaaaaagcggaagaaacgcaaacacctgagaaagaaaagggaggaagaggaagaggaagaggcaagcgagaagggaaagaagaagacagggggtagcaaacaacaaacggagaaacctgaatctgaggatgagtgggaacgcactgagagggaacgtctgcaggacctggaggagcgcgacgcctttgccgagcgagtgaggcagagggacaaggaccggacgcgaaacgtgttggaaagaagtgataagaaggcatatgaggaggcccagaagcggcttaagatggcagaggaggaccgaaaagccatggtgccagagctgagaaaaaagtccaggagggagtatctggccaagcgagagcgggagaaactcgaggatcttgaagcagagcttgcggatgaggagtttctcttcggcgacgtggagctttcccggcatgagcggcaggagttaaagtataaacgccgcgtgcgggatttggcacgcgagtaccgcgccgccggggagcaggagaagctggaggcaacaaatagatatcatatgcctaaggaaacaaggggacagccggcacgcgcagtggacctggttgaagaggagtctggagcccctggcgaagagcagaggcggtgggaagaagcacgtctcggcgcagcatcactaaagttcggggcgagagacgccgcaagtcaggagccgaaataccagctgtag

SEQ ID NO: 114152 - DNA, 3126 bp, Artificial Sequence
  Description of Artificial Sequence: Synthetic coding sequence
atggctactccagctggcctggaacgctgggttcaagacgagcttcattctgtcctgggcttatcagagcgccatgttgcacagttccttataggaaccgcccagaggtgcacttcggctgaagaattcgtacaaaggctcagagacacagacactttggatctgtctgggcccgctagagactttgccctgaggctgtggaataaagttccacgcaaggctgtggttgaaaagcctgcccgggccgctgagagagaggcgcgtgcactgctcgaaaaaaacaggtcataccgcttactagaagactctgaggaatcttcagaagaaactgtcagtcgggcggggtctagtctccaaaaaaagagaaagaaacgaaagcacctgcgcaaaaagcgggaggaagaggaggaggaggaagcttccgagaaagggaagaagaagacaggtgggagcaaacagcagactgagaaaccggagagcgaggatgagtgggagcggacggagagagagagattgcaggacttagaagagcgggatgccttcgccgagagagtgcgccaaagggataaggaccggacgcgcaacgtgcttgagagatctgataaaaaagcttacgaagaggcccagaaacgccttaagatggctgaggaggaccgcaaggccatggtcccagagctacgaaagaaatcgcggcgggagtatctcgccaagcgggagcgcgaaaagttggaagacctggaagccgaactggcagacgaagaattcctgtttggcgatgttgaactgtctcgccacgagcgtcaagaattgaaatacaagagacgagttcgcgaccttgcccgagaatacagggccgcgggcgagcaggagaaactcgaagctacgaatcgttatcatatgccaaaggaaacccggggtcagcccgcacgagcggtcgacctggttgaggaggagagcggggcccccggcgaagagcagcggcggtgggaagaagcccgcctaggagctgctagccttaaattcggcgccagggacgccgcctcccaggagccgaagtaccagctcgtgctcgaggaagaagagactatcgagtttgtgagagccacgcagctgcagggagacgaagaaccatctgcaccccccacatccacccaggcccagcagaaagaaagtattcaggccgtgaggcgcagcctgccagtattcccctttagggaggagctcctggccgctattgcaaatcatcaagtgctgattattgagggcgaaacgggcagtggaaaaaccacccaaataccacagtatttatttgaggaagggtataccaacaaggggatgaagatcgcctgtactcagcccaggagggtggccgctatgtccgtcgccgctagagtcgctcgtgagatgggagtgaagctgggcaatgaggtggggtacagtatccggtttgaagattgtacatctgaacggactgtgctgaggtacatgactgacggtatgctgctgcgggagtttctctccgagcccgatctcgctagctactccgttgttatggtcgatgaggcccatgagcgcacgctgcatacagatatcctattcggacttattaaggacgtagctcgattccgacctgagttgaaagttttagtggcatcagctaccatggacacagctcgcttcagcaccttctttgatgacgcccctgtgttccggattcctggccggcgcttccctgtggatatcttttatacaaaagccccagaggcagattacctggaggcttgtgtggtgtccgtcctgcaaatacacgtcactcagcctccaggagacatcctggttttcctgactggccaggaagaaattgaggcagcgtgtgagatgctgcaggaccgctgtcgcagattagggagcaaaattcgggagctcttagtgctgccaatttacgctaatctcccaagtgacatgcaggcacgcatctttcagcctactccaccaggtgctcggaaggtggtcgtggctactaacattgctgaaacaagcctaaccatcgagggaattatttacgtcctggacccaggattctgcaagcagaagtcatacaacccacgtactggaatggagtctttgactgtaacaccatgctcaaaggccagcgctaatcagcgagctggacgggccgggagagtcgcagcaggcaaatgttttcgtctgtatacagcttgggcataccagcatgaactggaagaaaccactgtccccgaaatccagagaaccagtcttggcaatgtggtactacttcttaaaagcctgggcattcatgatctcatgcacttcgacttccttgacccccctccttacgagaccctgctgctggcactcgagcagctgtatgcgctgggggcgttgaaccacctcggagagttgaccacatctggccgaaagatggcagaactccctgtcgaccccatgctttccaaaatgatactcgcgagcgaaaagtactcctgctccgaagagatcctgaccgtcgctgctatgctgtctgtaaacaattccatcttctataggccaaaagacaaggtagtgcacgccgataacgctagggttaatttcttcctccccgggggcgatcatttggtgctgctgaacgtgtacacacaatgggcagagtcaggctactcatcacagtggtgttatgagaatttcgtccagttcagatccatgcggcgggcgagagacgtgcgcgagcaactcgaaggcctgctggaacgtgtggaggttggattatctagctgtcagggagactacataagagtgagaaaggcaattacagctggttacttctaccacactgcaagacttaccaggtcagggtatcggactgtgaaacaacagcagaccgtatttattcaccctaacagcagtctcttcgagcagcagccacgatggcttctgtaccacgagctcgtgctcaccacgaaagagttcatgcgccaggtgcttgagattgaaagctcgtggctgctagaggtcgcacctcattattacaaagcaaaagaattggaagacccacacgccaagaagatgcccaagaaaatcgggaagacacgtgaagagttggggtag

SEQ ID NO: 114153 - DNA, 3126 bp, Artificial Sequence
  Description of Artificial Sequence: Synthetic coding sequence
atggcgacacccgctggactggagaggtgggtgcaggacgagcttcacagcgtgctgggacttagcgaaagacacgtggcacagttcctgatcggcacagcccagcggtgcacttcagccgaggagtttgtgcaaaggctgagagacactgataccctcgatctctccggacctgcccgagactttgctctccggctgtggaataaagtaccccgaaaagctgtggtggagaaacccgctagggccgccgaacgcgaagcacgcgccctgctggagaagaatcgatcatatagactcttggaggattccgaggaatcctcagaggagacggtatcacgcgccgggtcatctcttcagaaaaaaaggaaaaagcgcaaacatctgcgcaagaaacgggaagaggaagaggaagaggaggcctccgagaaggggaagaagaaaacaggcggaagcaagcagcagactgaaaagcccgaatcagaagacgagtgggagaggacagaaagggaacgtctgcaggacctggaggagcgcgatgccttcgcagagcgcgtgcgccagcgcgacaaagatcggacgagaaacgtcctggaacgaagcgataaaaaagcttacgaagaggcccaaaaaagactcaagatggccgaggaagaccgaaaggccatggtgcctgagttgcggaaaaagtcccgccgagagtacctggccaaacgcgagcgggagaagttagaggacctggaagcggaattggccgacgaagaatttctgtttggggacgtagagcttagtagacatgagcggcaggagctgaaatataaacggcgggtacgtgacctagctcgggaatatcgggccgctggggaacaggaaaaattggaggccactaacagatatcacatgcccaaagagacaagggggcagcccgcgagggctgtggaccttgtcgaggaggaaagcggcgctccaggcgaggagcagcggaggtgggaagaggcgcgactgggagctgcatctctcaagtttggcgctcgtgatgcggcatcacaggaacccaagtatcagcttgtgctagaggaggaggagactatcgagttcgttcgggctactcagctccagggtgacgaggaaccaagtgcaccaccaacgtcaacgcaagcccagcaaaaagagtccattcaggctgtgcgcaggtcactcccggtgtttcccttcagagaggagctgctcgccgcaatcgcaaaccatcaggtactgattatcgagggcgaaacaggaagcggaaagactacccaaattcctcaatatttgttcgaggaaggttataccaacaagggaatgaagattgcatgtacgcagccccgaagagtcgcagccatgtccgttgccgcccgagtggcgagagaaatgggcgtgaaattaggtaacgaggttggctacagcataagattcgaagattgtacctccgaacgcactgtcctgaggtacatgaccgatggcatgctgctcagggagtttctttccgagcctgacctcgcttcttacagcgtcgtgatggtagacgaggcacacgaaagaacacttcacactgatattttgttcggcctgattaaggatgtcgcccgcttcagaccggaactgaaagtgctggtggccagcgccacaatggacacagcccggtttagtacattcttcgacgacgcgccggtcttcagaattcctgggcggcggtttccggtggatatcttttatactaaggccccagaggccgactacctggaggcttgcgtagtgagtgtactgcagatccatgtgacgcaaccccccggcgacattctggttttcttaaccgggcaggaggagatcgaggccgcatgtgagatgctccaggataggtgcaggaggctgggctctaagattagggagctcctggtgctgccaatctatgctaacctgccttcagacatgcaggctaggattttccagccgacaccacccggagcacggaaagtggtggttgcaacaaacatcgcagaaacctcattgaccatcgaggggattatttacgtccttgatcctggcttttgcaagcagaaatcatataatccacgtaccggaatggagagcctcacggtcactccttgttccaaagcctcagccaatcaaagagccgggagagcaggaagagtggcagccggaaaatgttttaggctgtacaccgcctgggcataccaacacgagctggaggagacaacagtccccgagatacagcgcacttcgctgggaaatgtggtcctacttctgaagtctctgggcattcacgatctgatgcacttcgatttcttggacccgccaccttacgaaactctcctgctggccctggagcagctgtacgcgctaggggctctgaatcacctgggcgagctgactacatccggccgaaagatggctgaactgccggtggacccaatgctctctaagatgatactcgcatctgaaaaatattcatgcagtgaggaaatcctaaccgtggccgctatgctgagtgttaacaacagcattttttacagacccaaggacaaggtcgtacacgcggataatgcacgcgtcaatttttttctgccaggcggggaccacctggttctgctgaatgtgtatacacagtgggccgagtccggctactcatctcagtggtgctacgaaaattttgtccagttccgcagcatgagaagggcaagggacgtgcgcgagcaattggaaggcttactcgagagggtcgaggtcggcctctctagctgccagggagactacatccgggttcgaaaagctataaccgccggctacttctaccatacagccagactgacaaggtccggttataggactgttaagcagcagcagactgtctttattcaccccaactcttctttatttgagcagcagcccagatggcttctgtatcacgagctggtgctgacaacgaaagaattcatgcggcaagtcttggagatcgagtcttcctggcttcttgaggttgcgcctcattactacaaagccaaggagctggaggatccacacgccaaaaaaatgcctaagaagattgggaaaacacgggaggaactgggatag

SEQ ID NO: 114154 - DNA, 3126 bp, Artificial Sequence
  Description of Artificial Sequence: Synthetic coding sequence
atggccacacctgccggactggagcgatgggtgcaagacgagctacactccgtgctaggactgtccgaaaggcacgtggctcaatttctcattggtaccgcacagaggtgcacatcggccgaggaattcgtgcagcggctccgtgacaccgataccctcgacctttctgggcctgctcgagatttcgccctgcgcttgtggaacaaagtgccaaggaaagccgtggttgaaaagcctgctagagccgctgagcgggaggcaagggcccttttggagaaaaatcggagctatcggttattggaggactctgaagagagtagtgaagagaccgttagtcgggcggggtcgtccttgcagaagaagcgaaaaaaaaggaagcacctgcggaagaagcgcgaggaagaagaggaagaagaggctagcgagaagggcaaaaagaaaactgggggctccaagcagcagacagaaaaacctgaatccgaagacgaatgggaaagaaccgagcgcgaaagacttcaggatttggaggagagagacgctttcgcagaaagagtgcggcagcgcgacaaggataggacccgaaacgtgctggaacggtctgacaaaaaggcctacgaggaagcccagaagcgactcaagatggcggaggaggacagaaaagccatggtgcccgagctccgtaagaaaagtcgcagggagtacctggccaaaagagagagggaaaagctggaggatcttgaggcggagttagcggacgaggagttcttgttcggagacgtcgagttgtctcgccacgagagacaagagctgaagtacaagagacgggtacgcgatctggcgcgcgagtaccgtgccgccggtgagcaggagaagctggaagccaccaacagataccacatgccgaaggagacccggggccaaccggctagagcagtggatctggtggaggaggagagcggcgcccccggagaagagcagcgcagatgggaggaggcccggctcggggccgcaagcctgaagttcggtgccagagatgcagcatcccaagaaccgaaatatcagctggtgttagaagaggaggaaactattgaatttgtacgcgcaacacagctgcaaggagacgaggaaccttcagctcctccaacatccacacaagctcagcagaaagagtcaattcaggccgtcaggcgctcactgcccgtgttcccatttcgggaagagctcctagctgcgatagcaaatcaccaggttcttatcatcgagggcgagacaggctccggaaagacaacccagatcccccagtatttgtttgaggaaggctacactaacaaggggatgaaaatcgcgtgcactcagcctaggagggtcgccgctatgagcgtggccgcccgtgttgcccgtgagatgggggtcaagctgggaaacgaggtcggatacagtattcggttcgaggattgtacatcggaaagaaccgtgctgcgctacatgaccgacgggatgttactccgtgagttcctgagtgaacccgaccttgcatcctactcagtcgtgatggtggacgaagcacacgagcgaaccttgcacacggacattctgttcggtctcattaaggacgtcgctagatttcgacccgaactgaaggtgctggtcgcatcagccactatggacacagcccggttttcaacattcttcgacgatgctcctgtgtttcgcatccctgggaggagattccccgttgatatcttttacacaaaagcacccgaggctgactaccttgaggcttgtgtcgtgtctgtcttacaaattcatgtgactcaacccccaggcgacatcctagtgttcttgacaggccaggaagaaatcgaagctgcatgcgagatgctccaggatagatgtagacggttagggtccaaaatcagggagttgctagtgctgcctatctacgccaatttgccctccgacatgcaggcccggatctttcagccaacgcctcctggggcaagaaaggtcgtggtcgcgaccaacatagctgaaacatcccttactatcgaaggtattatatacgtactggaccccggcttttgtaagcagaagtcctacaaccccagaaccgggatggagtccctgacagtgactccctgcagcaaggctagcgcgaaccagcgggcaggccgcgcaggccgggtggccgccggtaaatgcttccgcctgtatacagcatgggcctaccagcatgagttggaggaaactacagtgcctgaaatccagagaaccagtctggggaacgtcgttctgctgctgaagagcctgggcattcacgatcttatgcattttgacttcttagatcctcccccgtacgaaaccttgctgctggcgcttgagcagctctatgctcttggggcactgaatcatctgggggagctgactacctccgggagaaagatggccgaattgcccgtggatccgatgctttccaagatgatcctggcatccgaaaaatattcttgttctgaagaaatattgactgttgccgccatgttgagtgtgaacaacagtattttttaccgccctaaagataaggtggtccacgccgataacgcccgcgttaacttttttctccctggtggagaccatctggtgctcctgaacgtttatacccagtgggcggaatccgggtactcaagccagtggtgctacgagaacttcgttcaatttagatcaatgcgacgggccagggacgtccgtgagcaacttgaagggctgctggagcgagtggaggtggggctttcaagttgtcagggcgattacatacgagtacgcaaggccattaccgctggctatttttatcatacggctcgtttgacacggtctggttaccggaccgtcaagcagcagcagacggtgtttatccacccaaactcttcgctgtttgaacaacagcccaggtggttgctgtatcatgagcttgtgttaaccaccaaggagtttatgcgacaagtgctggaaattgaatcttcttggctgctagaggtggcgccccactattataaagctaaagagttagaagatccccacgcgaagaagatgcccaagaagatcgggaaaactcgcgaagagctggggtag

SEQ ID NO: 114155 - DNA, 888 bp, Artificial Sequence
  Description of Artificial Sequence: Synthetic coding sequence
atgtcagaggatccccgggggcccaaggttccaaggaaggctgtggtggaaaaacccgctcgcgcagcagaacgagaggccagagctctcttagaaaaaaacaggagctaccgcttgcttgaggatagcgaggaatcctccgaggaaacagtctcccgggccggtagcagcctgcagaagaagcgcaagaaacgcaaacacctgcggaagaaacgggaggaagaggaagaggaagaagcctctgagaagggcaaaaagaaaaccggtgggtccaagcagcagactgagaaacccgagtccgaggacgagtgggagcgaacagagcgcgagcgactccaggaccttgaggagcgagatgctttcgctgagagagtgcggcagcgcgataaagacagaactaggaacgtgctggagagaagtgacaaaaaagcatacgaggaggcgcaaaagcggctgaaaatggcagaggaagacaggaaggcaatggtccctgaactgaggaaaaaatcccgcagggagtacttggctaagcgggagcgggagaagctggaggatctggaggccgagctggctgacgaggaattcctgttcggcgacgtggaactttcgcgccatgagcgacaggaattaaagtataaacgcagagtccgcgatctcgcgagagaatatcgcgccgcaggtgaacaggagaaactagaggcaactaacagataccacatgcctaaagagacacggggacaacctgccagagccgtcgatctggttgaggaggaaagtggggcccccggtgaggagcaacgccgctgggaagaagcccggttaggtgccgcatcactcaaattcggcgcacgtgacgccgcctcacaggagcccaaatatcagctgtag

SEQ ID NO: 114156 - DNA, 888 bp, Artificial Sequence
  Description of Artificial Sequence: Synthetic coding sequence
atgagcgaagaccctcgcggccccaaggtcccccggaaagcggtggtagagaagcccgctcgggccgcagagagagaggctcgggccttgctagaaaagaaccggtcctatagacttctagaggattccgaggaatcatctgaggagactgtttcccgtgccggctcatccctgcaaaagaagcgtaaaaaaagaaagcacctgaggaagaaacgagaggaagaagaggaagaagaagcctccgagaagggtaagaagaaaaccggcggctcgaagcagcagaccgagaaaccggaaagcgaggacgagtgggaacggacagaaagagaaaggttacaggatctggaggagcgggatgcattcgctgaacgggtgcgacagagagacaaggacaggacgagaaacgtgctggaaagatccgacaaaaaagcatacgaggaggcccagaagaggctaaaaatggcagaggaagaccggaaagccatggtccctgagctgagaaaaaaatctaggagagaatatctggctaaacgagaaagagaaaagcttgaagatctggaagccgaactggccgacgaggagtttctcttcggagatgtggagctctccaggcacgaacggcaagagctgaagtataaacgacgggtacgggatctggcgcgggagtatcgggccgccggagagcaagagaagctagaggccactaacaggtaccacatgcccaaagaaaccaggggccagccagcacgggccgttgacctagttgaagaggagtccggcgcccctggagaggagcagcgacggtgggaggaagctagattaggagccgctagcctcaagttcggagcgcgggacgccgcttctcaagagccaaagtaccagctttag

SEQ ID NO: 114157 - DNA, 1683 bp, Artificial Sequence
  Description of Artificial Sequence: Synthetic coding sequence
atggagtcccagccagcccaggaatgtcttatgcagatgttcctgcccatcgaaccggcgtgttttgtcgagtggttgggaacttcaccttcccagctgggggtagtgatggtcgacgaagcacacgagcggactctgcacaccgatatcttgtttgggctgataaaggacgtggcccgtttcaggcctgaactaaaagtgctcgtcgcatccgctaccatggacacggctaggttctccactttctttgacgacgccccagtctttaggatccctggacggcgatttcctgtagacatattctacacaaaggcaccggaggcggattatctcgaggcatgcgtcgtgagtgttttgcagatacacgtaactcaacctcccggggacatcttggtgtttctgacgggccaggaagagatcgaagctgcatgcgaaatgttgcaggaccgttgcaggcgtcttggaagtaagattagggagctgcttgtgctgccgatttacgctaatctgccaagcgacatgcaggcacgtatattccagcctacgcctccaggcgcccgaaaggtggtcgttgctactaacatcgctgagacgtcactcactatcgagggcatcatctatgtgctggacccaggtttctgcaagcaaaagtcttacaatcccaggacagggatggaaagcttgacagttaccccatgctccaaagcatccgccaaccagcgtgccggaagggcgggccgggtggcagcgggtaaatgcttcaggttgtacactgcatgggcttaccagcacgagctggaagaaaccacggtgcctgaaattcaacgcacatcactgggaaatgtggtgctgttgctgaaatcgcttggaattcacgacctgatgcactttgactttttagacccccctccatacgaaactctgctactggccttagaacagctttatgctcttggcgctctgaaccaccttggcgaactgaccacctctgggcgtaaaatggcagagctcccagtggatccaatgctgtctaagatgattctcgcctcagaaaaatacagttgttcggaagaaattctgactgtcgccgccatgttatctgttaataactctattttttacaggcccaaggataaagtagttcatgccgataacgctagagtgaatttcttccttcctgggggtgaccacctggttctgctgaatgtgtacacccagtgggctgaaagcggctatagttcacagtggtgctacgaaaattttgtgcagtttagatccatgaggcgcgcgagagatgtgcgagagcaacttgaagggctcctggagcgagttgaggtgggtctatctagctgccagggagactacattcgcgtgaggaaagctataactgcaggatacttctatcatactgcaaggctgacccgcagtggctacaggaccgtcaagcagcaacagaccgtgtttatccaccctaattcaagcctgttcgagcagcaacctcgttggcttctttaccacgaattagtactgacaactaaggagtttatgcgtcaggtgttagagatcgaatcctcctggcttctagaggtagccccgcactattataaggcaaaggagttggaagatccccatgcaaagaaaatgcccaagaagattggaaagaccagggaggagctgggctag

SEQ ID NO: 114158 - DNA, 888 bp, Artificial Sequence
  Description of Artificial Sequence: Synthetic coding sequence
atgagtgaagacccccgcgggcctaaggttccccgcaaggccgttgtcgagaagccagcccgcgcggcagagcgagaagcccgggccttactggagaagaaccggtcctatcgtttactggaggattccgaagagtcaagcgaggagaccgtgtccagagcgggctcatccctacagaagaaaaggaagaaaagaaagcacttaaggaaaaagcgcgaggaggaggaagaggaagaagcgtcggagaagggcaagaaaaagaccggaggatcaaaacagcagaccgagaaacccgagagcgaggatgaatgggagagaacagagagagagcggttgcaggatttagaggagcgcgacgcctttgccgaaagagtgagacagagggacaaggatcgcactcggaatgtcttggagcggtctgacaagaaagcttatgaggaagcgcagaagcgcctaaaaatggccgaggaagaccggaaagcgatggtgcccgagctaagaaaaaagtccaggcgcgagtatttggcaaaaagggaaagggagaaattggaagacctggaggccgagctggccgacgaagagttcctgttcggagacgtggaactgtctcggcacgaaagacaggagttgaagtacaaaaggcgggtacgtgatctggcaagagagtaccgcgcagctggcgagcaagaaaagctggaagcaacaaatcggtatcacatgcccaaggagacccgtggccaacccgccagggccgtcgacctcgtcgaagaggagtctggcgcccctggtgaagagcagaggcggtgggaggaggccaggctgggcgcagcgagcctcaagttcggcgctagagatgccgcaagtcaggaaccaaagtaccagctgtag

SEQ ID NO: 114159 - DNA, 888 bp, Artificial Sequence
  Description of Artificial Sequence: Synthetic coding sequence
atgtctgaggacccacgcgggccaaaggtaccgaggaaggccgttgtcgagaaaccagctcgcgccgccgagcgagaagcccgggctctacttgagaaaaaccggtcttacagactcctcgaagattcagaagagtcgtctgaagaaaccgtgtccagggccggctcaagcttacaaaagaagagaaaaaaacggaaacacctgcgaaagaagcgtgaggaggaagaggaagaggaggcttcggaaaagggaaaaaagaagaccggcggttcaaagcaacagactgagaagcctgagtccgaggatgaatgggaaaggaccgagcgggagagattgcaggatttagaggaaagggacgcgttcgccgaacgagtccggcagagggacaaggatcggactagaaacgtgctggaacgtagcgataagaaggcgtacgaggaggcccagaaacggcttaaaatggccgaagaggatcgaaaagccatggtcccagagctcagaaagaaaagtcggagggagtatctggccaagcgagaacgcgagaaactggaagatctcgaggcggagctcgcagacgaggagttcctattcggtgatgtagaactgtcccggcatgaacgccaggaacttaagtacaagcgaagggtgagagatctggctcgtgagtatagggcagccggcgagcaggagaagctcgaggctactaatcggtaccatatgcctaaggaaaccagaggccagcctgccagagccgtagacttagtggaggaggagtctggtgcacccggcgaggaacaaaggcggtgggaagaagcacggctgggagctgccagtcttaagttcggggcacgagatgccgccagtcaggaacccaagtaccaactgtag

SEQ ID NO: 114160 - DNA, 888 bp, Artificial Sequence
  Description of Artificial Sequence: Synthetic coding sequence
atgagcgaggatccccgagggcccaaggtaccaagaaaggcggtggtagagaagccggcccgggcagccgaacgggaagctcgcgcactgctagaaaaaaaccgcagctatcggctcctggaggactcagaagagtccagcgaggagactgtgtcaagagccggcagtagtcttcaaaaaaagcgcaagaaacggaagcacctccgcaaaaagagggaggaggaggaagaggaggaggcatcagagaagggaaagaaaaagacggggggaagcaaacagcagacagagaaacctgagtcagaagacgaatgggagaggacagagcgcgagcggcttcaagatctcgaagagcgggatgcgttcgcagagcgcgtcaggcagagggacaaggacaggacacgcaatgtgctggagaggtccgataagaaggcttatgaagaggcacagaagaggttgaagatggctgaagaggatcggaaggctatggtaccagagttacgcaaaaaatcgagacgagagtatctcgccaagcgcgaacgcgaaaaactggaggatctcgaagcggaactagccgacgaagagttcctcttcggcgacgttgaactctctcggcatgaaagacaggaactgaagtacaagagacgggtaagggaccttgctagggagtatcgcgctgctggtgaacaggagaaactggaggctactaaccggtaccacatgcccaaggagacccgcggtcaaccagcccgggccgtcgacctggtggaggaagagagcggtgcccccggagaggaacaacgcagatgggaggaagcgaggctgggagctgcgtccctcaagtttggggctagggacgccgcaagtcaggagcctaagtatcagctgtag

SEQ ID NO: 114161 - DNA, 888 bp, Artificial Sequence
  Description of Artificial Sequence: Synthetic coding sequence
atgtcagaggacccaagaggtccgaaagttcctagaaaggccgtcgtcgaaaagcccgctcgcgcagccgaaagagaggccagagccttgttggagaaaaacaggagttatcgccttttagaggatagcgaggaaagctctgaggagactgtatcccgagcaggctcaagtctgcagaaaaagaggaagaaaaggaagcacctgaggaagaaacgcgaggaagaagaggaggaagaagcttcagaaaagggaaaaaaaaaaaccggagggagcaagcagcagaccgaaaaacctgagtcggaggatgaatgggaacggaccgagagggaacgtctccaggacttagaagagcgcgatgccttcgccgagcgagtgagacagcgggataaggaccggacgagaaacgtgctcgagaggtcagataagaaggcctatgaagaagcgcagaagaggctgaaaatggccgaggaagacagaaaggcaatggtccctgagttgagaaagaaaagccggcgggagtacctggctaagcgggagcgcgagaaattggaggacctcgaggctgagctggctgacgaagagtttttatttggcgatgtcgagttatcacgacatgagcggcaggagcttaagtataaacggcgtgtgagagatctggcccgagagtacagagccgccggcgagcaggaaaaactggaagccaccaaccggtatcatatgccaaaggaaactaggggtcaacccgctagagccgtggatctcgtagaggaggagagcggtgctcctggagaggaacaacggaggtgggaagaagcaagacttggggcggcaagtctcaagttcggtgcacgcgacgccgcttctcaggagcctaagtaccagttgtag

SEQ ID NO: 114162 - DNA, 1683 bp, Artificial Sequence
  Description of Artificial Sequence: Synthetic coding sequence
atggaatcccagccagctcaggagtgcttgatgcagatgtttctgccgattgagccagcatgtttcgtggagtggctggggacatccccgtcgcagctcggggtcgttatggtcgatgaggcccacgagcggactctccacaccgacattctgttcggcctcatcaaagacgttgctcggtttcgccctgaattaaaggtgctagtggcatctgctaccatggacacggctcgattcagcaccttctttgatgatgccccagtatttcggattccaggcagaagatttcccgtcgacatattttacaccaaagctcccgaggcggattacctggaagcctgcgtcgttagcgtactgcagattcatgtgacacaacctcccggggacatcctggtgtttctgaccggacaggaggagattgaagccgcctgtgaaatgcttcaggacagatgccggcgattgggcagtaagataagggaactgcttgtgctccccatatatgctaatctgccaagtgatatgcaagctcgcatatttcagccaacccctcctggagcgcgcaaagtggtggtggcaacgaatatcgccgagacaagtctcacgatcgaggggatcatatacgtattggatccgggattttgcaagcaaaagagctacaatccgcggacaggaatggaatctttaaccgtaactccctgcagtaaggcttcagcgaatcaacgggccggccgcgccgggagagtcgcagctggcaagtgttttaggctgtacactgcctgggcatatcagcatgagttagaggagacgaccgtaccagagatccagagaacctccctgggcaatgtggtgctgttgctcaagagtttagggatccatgatctgatgcacttcgacttcctagaccctccgccttatgagaccttactgcttgctctcgagcaattatatgctcttggcgccctgaaccatctgggtgagcttacgacctcagggaggaaaatggcggagctccccgtggaccctatgctaagcaaaatgatcttggcctctgagaaatattcctgttccgaagagatcctgacggtcgctgcgatgctgtcagtgaataatagcatcttctatcggcccaaagataaggtggtccatgctgacaacgctagagttaattttttcctaccgggtggtgaccacttggtcctcctcaatgtctatactcaatgggcagaatccgggtactcgtcccaatggtgttacgaaaattttgtccagttcaggtcgatgcggcgtgcacgcgacgttcgcgaacagctcgagggcctgctggaaagggtggaagtcggcctgtcaagctgccagggggattacatcagggttaggaaggcaatcaccgccggctacttttatcacaccgcccgactgacaaggagtggataccggacagtcaagcaacaacaaactgtcttcatccaccctaacagcagcttgttcgaacagcagcctaggtggctcctctatcatgagttggtactcaccaccaaagaatttatgaggcaggttctggagatagaatcttcatggttgttggaggtggcaccgcattattataaagcgaaggaactggaggatcctcacgctaaaaagatgccaaaaaaaatcggcaagactcgtgaagaactcgggtag

SEQ ID NO: 114163 - DNA, 888 bp, Artificial Sequence
  Description of Artificial Sequence: Synthetic coding sequence
atgtcggaggaccctaggggacccaaggtcccacgcaaggccgtagtggagaagcctgcccgcgcggctgaacgagaggcccgcgcactcctggagaagaatcggtcctatcgccttttggaagatagcgaggaaagttccgaagagaccgtatctcgggccgggagtagtctgcagaaaaaaagaaagaaacgaaaacatcttcgcaagaagcgtgaagaggaagaggaagaggaggccagcgagaagggtaaaaagaagactggaggttcaaaacaacagacagaaaagccagagtctgaggacgagtgggagaggaccgaaagggaacggttgcaggacttggaggaacgggacgctttcgccgaaagagtcagacaaagagataaggaccgcactcggaatgtgctcgagcgatccgacaaaaaggcatatgaggaagcccagaagaggctcaagatggccgaggaagatcgtaaggccatggtgcctgaactccggaagaagtctcgccgcgaatatctggcaaagcgggagcgcgaaaaactggaagacctggaggcagaattggccgatgaggaattcttatttggcgatgttgaactgtctagacatgagcggcaagaattgaagtacaagaggcgggtgcgcgatttggcacgagaatatagggcagctggcgagcaagaaaaactggaggctaccaataggtaccatatgcctaaggagacccgtgggcagcccgctcgggcagtggatctcgtggaggaggaatccggggccccaggggaagaacaacgccgctgggaggaggcccgtctgggcgctgctagcttgaagtttggggccagggacgctgctagccaggaacccaagtaccagctctag

SEQ ID NO: 114164 - DNA, 2010 bp, Artificial Sequence
  Description of Artificial Sequence: Synthetic coding sequence
atggccacgcccgcgggtcttgagagatgggtgcaggacgagctacacagtgtcctagggctgtctgagaggcatgtggctcagttcctgatcggtaccgcgcaaagatgcacaagtgccgaagagtttgtgcaacggctgagagatacggatacgctggatttgagtggcccggcccgcgacttcgccctcaggctctggaataaggttccaagaaaggcggtagtggagaaacctgcgcgggcggcagagagagaggctagagccctgctcgagaagaataggagttaccgtcttctggaagattcagaggagtcctcggaggagacagttagcagggctggctcttccttacagaagaaacgaaagaagagaaaacacttgcggaagaagagagaggaggaagaggaagaagaggcaagtgaaaagggaaagaaaaaaacaggtggttctaagcagcaaacggaaaagcccgagagcgaggacgaatgggagaggacggaacgggagcggctgcaggatctggaagagcgcgatgcgttcgcagagcgggtgagacagagggacaaagataggacaagaaacgtgctcgaaagatccgacaagaaggcatacgaggaagctcagaaacggcttaagatggccgaagaggacaggaaagccatggttcccgaacttcggaaaaaatccagacgagaatatctggccaaaagagagcgtgaaaagctagaggacctggaggctgaactagcagacgaggagttcctgttcggggatgtggaactcagccggcacgaaaggcaggagctcaaatataaacgcagggtgagagacctggccagagagtacagagctgctggagagcaagaaaaacttgaagctaccaaccgctaccatatgcccaaagagactagaggacagcccgccagagcagtcgacctagtggaggaggagagcggcgctcccggtgaagaacaacgtagatgggaagaggcaagactgggggccgcctctctgaaatttggagccagggacgccgccagccaggagccgaagtatcagctggtgctggaggaagaagagacaatcgagtttgtccgggccactcagttgcagggggatgaagaaccttctgcaccacctacctcaacacaagcccaacagaaggaaagtatccaggccgttaggcggagtctgccggttttcccctttcgtgaagaactgctcgctgccatcgctaatcatcaggtgctcattatcgaaggtgagacaggtagcgggaagacaacccagataccccagtatctgtttgaggagggatatactaataaaggcatgaaaatagcttgtacacagcctagacgagtcgccgcaatgagcgttgcagcccgtgtggctcgggagatgggtgtgaagttggggaatgaagtgggttatagcatacggtttgaagattgtacgtcagaacgcacagtgctgagatatatgaccgacggaatgctgcttcgggagtttctgagcgaaccggatctcgccagttattcggtcgtgatggtcgacgaggcccacgaacgcacacttcacaccgatatcttgtttggcctcatcaaggatgtcgccagattccgtcctgagttaaaagtattggtggcaagcgctaccatggataccgcacggttcagcaccttctttgacgacgcacccgtatttcggatacccggaaggaggtttccagtcgatatattctacacaaaggctcctgaagccgattacctggaggcttgcgtcgtcagcgtgctgcagattcacgttacccagccaccaggtgacattctagtgttccttacaggacaagaggagattgaagccgcctgtgagatgttgcaggatcgttgtcgccgtctgggctccaagattcgggaactactagtacttcctatctacgctaatttaccctcagatatgcaggcgcggatctttcagcccactcctcctggtgcccgcaaatag

SEQ ID NO: 114165 - DNA, 3126 bp, Artificial Sequence
  Description of Artificial Sequence: Synthetic coding sequence
atggctactcctgctggactagaacgctgggtacaggacgagctgcacagtgtgctcgggctgagcgagagacatgtcgcccaattcctcattggcaccgctcaacggtgcacctctgcagaagagtttgtgcagagattacgcgacacagatacgctggatttgtcgggccccgcaagagactttgcgctgaggttatggaacaaggtgcccagaaaggcagtggtggaaaagcctgcacgggccgcggagcgcgaagcccgtgcccttcttgaaaagaacagaagctaccgcttgctcgaggacagtgaggaatcttcagaagagactgtgagcagggctgggagttctttgcagaaaaagaggaaaaaacgtaaacacttacgcaagaaaagggaggaggaggaggaggaagaggcttccgagaagggaaaaaagaaaacaggcgggtcaaagcagcagaccgagaagccagagtctgaagacgagtgggagagaacagagcgggaacggttgcaggatcttgaagagcgggacgctttcgctgagcgggtgcgccagagagacaaggacaggaccaggaacgtcctagaaagatcagataagaaggcatacgaggaggcccagaaacgtctcaagatggctgaggaggacaggaaagccatggtcccagaactgaggaaaaaaagccggcgggagtaccttgctaaacgtgaacgcgaaaagctcgaagatctggaagcagaactcgctgacgaggagtttttgttcggggacgtggagctttctcgtcacgagcgccaggaacttaaatataagcggcgggtacgcgatctggcacgggaatatcgggccgcgggcgagcaagagaagctggaagcaacaaacagataccatatgcctaaggaaacccggggccagcccgctcgggccgtcgacctggtcgaggaagaaagcggtgctcccggcgaagaacaaagacggtgggaagaagcgcgcctcggcgctgcaagtcttaagttcggcgcaagagacgctgcatctcaggagcccaagtatcagttggttctggaggaagaggagactatcgaatttgtgcgggctacccagttacagggggatgaagagcctagcgcacctccaaccagcacccaagcacagcagaaggagtccattcaggctgtgcgacggtcattacctgtcttcccctttagggaggagctgttagctgccattgcaaaccaccaggtactcataatcgagggagagacgggaagcgggaagactacgcagataccacagtacctgttcgaggaaggctacaccaacaaagggatgaaaatagcgtgtactcagcctagacgcgtggccgccatgtcagtcgctgcccgggttgcccgcgaaatgggtgtaaagcttggaaacgaggtgggttactcaatacggttcgaggactgtaccagcgagcgtaccgttttacgctatatgaccgatgggatgctcttgcgcgaattcctttccgaacccgacctcgccagctacagcgtggtgatggttgacgaagcccatgagaggaccctccacaccgacatcctgttcgggttgatcaaagacgtggctcgattccggccagagttaaaagtgttggttgcgtctgcaaccatggacacagccagattcagtactttttttgatgatgcccccgtgttcagaatccccgggagaagattccctgtggatattttttatacaaaggcccctgaggccgactacctggaagcttgtgtcgtgagtgtgctgcagatacacgtgacccagccaccgggcgatatcctggttttcttaaccggtcaggaggagatcgaggcagcgtgtgagatgctgcaggatcgatgtcgccggctggggagtaaaattcgcgaactccttgtcctgcctatttacgctaacttaccttcggacatgcaagcccggatattccagcctacccctcctggggctaggaaagtcgtggtagctacgaacattgccgaaacgagcctcacaatcgaaggaattatctacgtgcttgacccagggttttgtaaacaaaagtcctataatcctcggactggtatggaaagtctgaccgtgacaccctgttctaaggctagtgcaaaccagcgagcaggaagggccgggagagtggctgccggcaagtgtttccgcctgtatacagcttgggcttaccagcatgagctggaggagaccaccgtgcccgagattcaaagaacaagcttgggcaatgtcgttcttctgctaaagtcactggggattcacgatctcatgcactttgattttcttgacccaccaccctatgaaaccctgctgttggccttagaacagctgtacgctctgggggctcttaatcacttaggtgagctgacgaccagtggccgcaaaatggccgaattgccagtcgaccccatgctgagtaaaatgatcctggcatcagaaaagtactcctgcagtgaggagatccttacagtggcagccatgctgtctgtcaataactctatattttaccggccgaaagataaggtggttcatgctgacaacgctagagttaacttttttctgccaggcggcgaccatctggtcttactcaatgtatatacccaatgggctgagtctggatactcctcccaatggtgctacgagaactttgtgcagttccggtcaatgcgtcgggctagagacgtgagggagcagctggaagggcttctagaacgggtggaagtaggattgtcaagctgtcagggagattatatcagagtgaggaaggctataacggccgggtacttctatcatacggctaggctaacgaggagtggttatcgcaccgtgaaacagcaacagacagttttcattcaccctaattcatcccttttcgagcagcagcctagatggctcttatatcacgagctggtgcttaccacgaaggagttcatgcgccaggttctcgagatcgaatctagttggttgctggaggtggctccccattattacaaggccaaggaactcgaagacccgcatgctaagaaaatgcccaaaaaaatcggaaagacccgggaggagctgggctag

SEQ ID NO: 114166 - DNA, 1683 bp, Artificial Sequence
  Description of Artificial Sequence: Synthetic coding sequence
atggagtcccagccagcccaggaatgtctgatgcaaatgtttttgccaattgagcccgcttgctttgtcgaatggttggggacttcaccatcacagttaggggtagtgatggtagatgaggctcacgaaaggacactccacacagacatcttgttcgggttgatcaaagacgtagcgagatttagacccgagctcaaggtgcttgtggcttctgccacgatggataccgccagattctccaccttcttcgatgatgcacctgtcttcagaattccgggtcgccgctttcctgttgatattttctataccaaggctcccgaggcagattacctcgaagcttgcgtggttagcgtgctccagatccacgttactcagccacccggcgatattttggttttcctgactggccaggaagaaattgaggccgcctgcgaaatgctccaggatagatgtaggaggctgggatcaaaaattcgggaactactggtgctacctatttatgccaatcttccatctgacatgcaagcccgaatctttcagccgacaccacccggcgcccgcaaagtggtcgtcgcaacaaatattgccgagacaagcctgaccattgaaggtataatttacgtgctggaccccggcttctgtaagcagaagtcttacaacccccgcactggcatggaatcccttaccgtgacaccctgcagtaaagcctccgcaaaccaaagagccgggcgagctggtagagttgccgccgggaaatgctttagattatatacagcctgggcctatcagcacgagcttgaagagacgacggtgccggaaatccagcgaacaagccttggaaacgtagtcctgctgctgaaaagcctgggcatccatgatctgatgcatttcgactttcttgatcccccaccttatgagactttgcttctcgccctggaacaactgtacgcgctcggggccctcaatcaccttggcgagctgaccacaagcggtagaaagatggctgagctccctgtcgatccaatgctcagcaagatgatactggcgtcagagaaatacagctgttccgaagagatcctcaccgtggccgctatgctgtcagtgaataactctattttttaccggcctaaggataaggttgtccacgccgacaatgctcgagtgaacttcttcctgccaggcggagatcacctggtccttctgaacgtgtacactcagtgggccgagagcgggtactcatcccagtggtgttatgaaaattttgtacagttccggagtatgcgcagggcccgggacgttagggaacagctagagggacttctcgagagggttgaggtggggctcagcagttgtcaaggcgactacatccgggtgagaaaggctatcactgccggttatttttaccacacggcaagactgactcggtccggatatcgcacagtaaaacaacagcagacagtgtttatccatccaaattcctctctgtttgaacaacagccacgctggctgctgtaccatgaattagtcttgactactaaggagttcatgaggcaggtccttgaaattgagagctcatggcttctggaggtagcaccccactattataaggccaaggaactggaagacccacacgccaaaaagatgccaaagaaaataggcaaaaccagggaggagctcggttag

SEQ ID NO: 114167 - DNA, 1683 bp, Artificial Sequence
  Description of Artificial Sequence: Synthetic coding sequence
atggaatcacagcccgctcaggagtgcctgatgcagatgttcctcccaattgaacctgcgtgtttcgtagaatggctgggaacgtccccgtcccagctcggcgtggtcatggtggacgaagcgcacgaaagaactctccatacagatatactcttcggactgatcaaagatgtggccaggtttagaccagagctgaaggtcctcgtggccagcgccacgatggacaccgccaggttttctacttttttcgacgacgcacctgtatttcgcattcctggacgacggttccccgtagatatcttttacaccaaggctcccgaggccgattacctggaggcttgcgtggtatcagtcttacaaatccacgtgacacagcccccaggagatatcctggtgtttctgactggacaggaggagatagaagcggcctgcgaaatgctacaagaccgatgcaggcgcttggggtcaaagatccgggaactcctggttttacccatatacgctaacttgcccagcgacatgcaggcccggatattccagccgactccccccggcgccaggaaagtcgtggtggcgactaatatagccgagacttcactgactatcgaaggaattatctacgttctggatcccgggttctgtaagcaaaaatcttataatccccgcactggtatggagtcgcttactgtcaccccctgctcaaaggcatcagcaaaccagcgagccggtcgagctggtcgggttgccgctgggaagtgttttaggctttatacagcatgggcctaccaacatgagttggaggagaccaccgtgcctgaaattcagaggacttcactggggaacgtggttttgctgctaaaatccctgggcatccatgacctcatgcactttgattttcttgatccaccaccctacgagacattgctgctagctctggaacagctttacgctctgggagccctcaatcatttaggcgagctgacgacaagtggtaggaagatggccgagctgcccgtggacccgatgctgtcaaaaatgatcctcgcatccgaaaaatactcatgtagcgaagaaatactaactgtggcggccatgctgagtgttaataatagcatcttttatcggcctaaagacaaagttgtgcacgctgataatgctagggtcaattttttcctgccaggcggagatcaccttgtactgctgaacgtatatactcagtgggccgagtcaggctacagttctcagtggtgttacgagaatttcgtgcaatttcgaagtatgaggcgcgcccgcgatgttcgggagcagctcgaaggcctcctcgaacgggtcgaagtggggctgtcctcatgccagggcgattatattcgcgtccgaaaagcgatcacagccggatacttctaccacaccgcccgcttgactcgtagtggataccggactgttaagcaacaacagaccgtatttatacacccaaacagctcgttgtttgaacaacagcccaggtggcttctctatcacgagctggttctgaccacaaaagagtttatgcgccaggtgcttgaaatcgagtccagctggctgttggaggtcgccccccactactacaaggccaaggagctggaggatccgcacgctaagaagatgccaaagaaaattgggaagacacgcgaggagttgggctag

SEQ ID NO: 114168 - DNA, 567 bp, Artificial Sequence
  Description of Artificial Sequence: Synthetic coding sequence
atggaaagccagcccgcccaggaatgtctgatgcagatgttcctgccaatcgaacccgcctgcttcgtcgaatggctgggaacgtcccccagccagctgggggtggttatggtcgatgaggcacacgagagaactttgcacacagacatcctctttggactgatcaaggacgtcgcaaggtttcgccccgagcttaaagttctcgtcgcgtcagctactatggatactgccagattctctactttttttgatgacgctcctgtcttcagaatcccaggcaggagatttcccgttgacatcttttacaccaaggctcctgaagccgattacttggaagcttgcgtagtcagcgttctccagatccacgtgacccaaccccctggagacattctggttttcctaaccggacaggaggagatagaagcagcctgtgaaatgctgcaggatcgctgtaggagattgggctccaaaattagggagttactggtgctgcccatctatgcgaacttgccttccgatatgcaggctcgaatattccaaccaacccctccaggagctagaaaatag

SEQ ID NO: 114169 - DNA, 3126 bp, Artificial Sequence
  Description of Artificial Sequence: Synthetic coding sequence
atggctacccccgctggtctagagagatgggttcaggacgagctgcattccgtgttagggttaagtgagcgacacgtggcacagttcctcatcggcaccgcacagagatgtacatctgctgaagaattcgtgcagcgcttgcgtgatacagacacactagacctgagtggacctgccagagattttgctttaagactgtggaacaaagtcccccgcaaggccgtcgtggagaagcccgcacgtgcggcagagcgggaggccagagctctgctcgaaaaaaatagatcgtataggctcctggaggattcagaagagtctagtgaggagaccgtgtcacgagccggctcttctctgcaaaagaaaagaaagaaacgaaagcacttgagaaaaaagcgagaagaagaggaggaggaagaagcatcagaaaagggaaaaaagaagaccggaggatccaagcagcagactgaaaagcctgaatcagaagatgagtgggaacgtacggagcgcgagcggctccaggatttagaagagagggacgcattcgcagagagggtaaggcagagggataaagacagaacgaggaatgtccttgagcgcagtgacaaaaaggcttacgaggaagcacagaagcggctcaagatggccgaggaggatcggaaggccatggttcctgagctccgaaagaaatctcgcagggaatatctggccaagcgtgagagggaaaagcttgaggatctggaagcggagttagctgacgaagagttcctgtttggcgacgttgaattgagtcggcatgaaagacaggaattgaagtataagcggcgtgtccgtgacctggcaagagagtacagagccgccggcgagcaggagaaactcgaggccaccaaccgttaccacatgcctaaggagacccgtgggcagccagctagagctgtagacctagtggaggaggagtccggagctcccggggaggaacaacggcgatgggaagaggcacggctcggcgctgcaagtctgaaatttggcgctcgcgatgctgcctcccaagagcccaaataccaattggttctcgaagaggaggaaactattgaatttgtgagagctacccagttgcagggagacgaggaaccaagcgcaccccctactagtactcaggcccagcagaaagaatctattcaagcagttaggagatcgttgccagtcttcccgtttagagaggagcttctcgccgccattgctaatcaccaggtactgattatcgagggggagaccgggagcggcaagactactcagataccgcaatacctcttcgaagagggatataccaacaaagggatgaagatcgcctgcactcagccacgtcgagtcgccgccatgtcagtggccgcaagggtcgcgcgagaaatgggggtgaaattaggaaatgaggtgggctatagcattagattcgaggattgcacatcagagaggacagtgttgaggtacatgacagacggaatgctattaagggaatttctgtcggagcctgacctggcatcatactctgtggttatggttgacgaagcccacgagagaacactccacacagacattctgttcggactgatcaaagacgtggcccggtttagacccgagttgaaagttttggtagcctccgccaccatggacacagctcggtttagcacatttttcgacgatgccccagtgttcaggatccccggccggcggtttccagtggatatcttctacactaaagctcctgaagctgattacctagaagcttgcgttgtcagcgtgctccagattcacgtaacccagcctcccggggatattctggtgttcttgaccggtcaggaggagatagaagcggcctgcgaaatgcttcaggaccgctgtagacgcctgggcagcaagatccgggaactgttagtgttgccaatttatgctaacctgccctccgacatgcaggctcggatttttcaaccaactccaccaggggccagaaaagtggtggtggcaacaaacattgcagagacttccttgacaattgagggaatcatctacgttctggacccaggcttctgcaaacagaagtcttacaacccgagaaccggaatggaatctctgaccgtgaccccgtgctcaaaggcatccgccaaccagcgagccggccgggcaggccgggtggcagctggcaagtgttttcgattgtacacagcatgggcctaccagcatgagttggaggaaactaccgttccagagatccaacgaacctcattggggaatgttgtactgctcctgaaatccttaggcatccatgacctcatgcacttcgactttttggacccccctccctacgagacactccttctggcccttgagcagctctacgcattgggggctcttaatcatttaggcgagctcacaacttcgggacgaaagatggcagagttacctgtggacccaatgttgtccaaaatgatcttagccagcgagaagtactcctgttccgaagaaattttgactgtggcagcaatgctgagcgtcaacaatagtatcttttacagacccaaggacaaagtagtccacgccgataatgcccgggtcaacttcttcctgccaggtggtgatcacttagtgctgctcaacgtatatacccaatgggccgaaagtggatattcaagccagtggtgctatgagaattttgttcaattccggagtatgagaagagctcgcgacgttagggagcaactcgaggggctactcgaacgcgtggaggttggactgtctagttgtcagggagattatatcagagtgcggaaggctataacggccggatatttttatcatacagcgcggctaacaagaagcggttatcggaccgtgaaacagcagcaaaccgtcttcattcaccctaatagcagcctcttcgagcaacagccacgatggttgctctaccatgaactggtcttgactaccaaagaatttatgcgccaagtgctagaaatcgagtccagctggctgctcgaggtggcaccgcattactacaaggccaaggagctcgaagatccccacgctaaaaagatgcctaaaaagatcggaaagacccgcgaagagctcggatag

SEQ ID NO: 114170 - DNA, 444 bp, Artificial Sequence
  Description of Artificial Sequence: Synthetic coding sequence
atggcaactccagcgggactcgagagatgggtgcaggacgagttgcactctgtgttgggtctttcagagcggcatgtcgcacaattcctaattggcactgcacagcgttgtacctctgctgaagagttcgtacagagactccgggacaccgatacactagacctgtcaggccccgcccgggatttcgccttaagactgtggaataaagtgccccggaaagcagtcgtcgaaaaacccgcccgagctgccgagagggaggctcgcgctttactggaaaaaaacagaagctacagactgctggaagactctgaagagagttcagaagagactgtgagtcgcgctggaagcagcctgcagaagaaaagaaaaaagcgcaaacacctgaggaaaaagcgggaggaagaagaagaagaagaagcttccgagaaaggcaagaagaaatag

SEQ ID NO: 114171 - DNA, 4110 bp, Artificial Sequence
  Description of Artificial Sequence: Synthetic coding sequence
atgggagggaaaaataaaaagcacaaggcgcctgctgctgccgtcgtgcgtgctgccgtgagtgccagccgggccaagagcgcagaggccggtattgctggcgaggcgcagtccaaaaaaccagtttcccgccctgcaactgcagctgctgctgcagctggctcgcgcgagccgagagtgaaacagggccctaaaatatatagctttaattccactaatgacagttcaggaccagccaatcttgacaaatccatccttaaggtggttatcaacaacaagctggagcagaggatcattggagtgattaatgagcataagaagcagaataatgacaagggaatgatatccggtcgcttaacagccaagaaactgcaggatctttatatggccctgcaagccttcagctttaagacgaaggacatagaagacgccatgacaaacaccttactgtacggtggggacctgcactccgccctggactggttgtgtctcaatctaagcgacgatgcgttgccggagggctttagtcaggaattcgaggaacaacagcctaaatccagaccaaagtttcagtcaccacaaattcaagccacaatcagccctcctctgcagcccaaaacaaagacctatgaggaggaccccaagtcaaagcctaagaaggaagagaaaaacatggaggttaatatgaaagaatggatcctgcggtacgccgagcagcaaaacgaagaagaaaaaaacgagaactcgaaatcccttgaagaggaagagaagttcgaccctaacgagagatatctgcatctagctgccaagttactggacgcaaaagagcaggccgcaacgttcaaactggagaaaaataagcaggggcagaaagaagctcaagagaaaattcggaaattccaacgagagatggagactctggaggaccaccccgtctttaaccctgcgatgaagatctctcatcagcaaaatgagaggaagaaaccccctgtggccacagaaggagagagtgctctcaactttaacttatttgaaaagagcgctgccgcgaccgaggaggaaaaggacaagaaaaaagaacctcatgatgtcaggaactttgactacaccgcccgttcgtggactggcaagtcacctaaacagtttctgattgactgggtaaggaaaaatctgcccaaatctcctaacccgagttttgagaaagttccggtcggccggtactggaaatgccgtgtgagagtgattaaaagcgaagatgatgtgctagtggtctgccccactatccttactgaggacggcatgcaagcccaacaccttggcgcgaccctggctctgtaccgcctggtgaagggccagagcgttcaccagttgctgccgccgacctacagggatgtttggttagaatggtctgacgccgagaagaagcgtgaagaactgaacaaaatggagacaaacaagcctagagacctcttcatcgcaaaactgctcaataaactgaaacagcagcagcagcaacagcaacagcactctgagaacaagagggagaacagcgaggatcccgaggagtcctgggagaatctggtgtcagacgaggatttcagcgctttgagcttagagagcgccaatgtcgaagacctggaaccagtccgtaatttatttcggaaactgcaatcaacacctaagtaccagaagttgctgaaggaacgccagcagctgcctgtgtttaaacaccgggatagcatagtcgagaccctgaaacgccatcgggtggtggtggttgctggggagacaggatcaggtaagagtacacaggtcccccattttcttctggaggatttactcctcaacgaatgggaggcttccaagtgcaacatagtgtgcacgcagccaaggcgaatatccgcagtatccctggccaaccgcgtttgcgatgagctgggatgcgaaaatggacccgggggtaggaactccctatgcggttaccagatcaggatggagagcagagcctgtgagtcaacccggctgctctactgcactaccggtgttcttctgcgaaagctgcaggaggacggactgttgtcaaatgtctcccatgtgattgtagacgaggtgcatgagcggagcgtgcagagtgacttcctcctgattatcttgaaagagattctgcaaaagcgaagcgacctccacttgatcctaatgtctgctactgtcgactctgaaaaattttctacttactttacccactgtcccatcctccggatcagcggaaggtcatatcctgtggaggtgttccacctagaggacatcattgaagaaaccggctttgtgcttgagaaagacagcgaatactgccagaagttcctcgaagaggaagaggaagtgactattaatgtaacaagcaaggccgggggtataaagaagtatcaagagtacatccccgtccaaaccggagcccacgccgacttgaaccccttctaccaaaaatattcttcccggacccagcacgcgatcctgtatatgaacccccacaaaatcaacttggatctcattcttgaactgttagcctaccttgataagtccccacagtttcggaacatagaaggagccgtgctgatctttctcccgggtcttgcccacattcagcagctgtatgatctgctgtccaacgaccggcgattctactctgaacgatataaagttattgctctgcattccattctgagcactcaggaccaggccgcagctttcacactccctccccctggcgtgcgcaagatcgtcctggctaccaatattgctgaaaccggtattaccatcccagatgttgtgttcgttattgatacaggcagaacgaaagaaaataaataccatgaaagtagtcagatgagctcgttggttgagacattcgtgtccaaagcgtccgcacttcaacgccagggaagggccgggagggtacgggatgggttttgctttaggatgtatacgcgcgaacgttttgagggcttcatggattactcagtccccgagatcttgcgcgtgcctttagaggagctttgcttgcatatcatgaagtgcaatctgggaagtccagaggacttcctttcaaaggctctggacccccctcaactgcaagtgatcagcaacgctatgaacctccttcggaagattggagcatgtgagctgaacgaacctaaactcacaccgctgggacagcatctggccgcactcccagtaaacgtcaaaattggtaagatgctcatatttggtgcaatcttcggctgtctggaccctgtagccaccctggctgctgtgatgactgaaaaaagtcctttcaccactcccatcgggagaaaagatgaggcggatctcgccaaaagtgcattagcgatggctgattctgatcatctgaccatctataacgcttacttgggctggaaaaaagccaggcaggaaggcggttataggtcagagatcacctactgccggaggaacttcctgaaccgcacaagccttctcacactggaggacgtcaaacaggagctcatcaagctggtgaaggctgctggctttagtagcagcacaactagtaccagctgggaaggtaaccgggcaagccagacattgagctttcaagaaatcgcactgttgaaggctgtactggtggccggcctttatgacaatgttggcaagattatatatacaaaatctgtcgatgttactgaaaagctcgcttgcattgttgagacggcccagggaaaggcacaagtgcacccttcctccgttaatagggacctgcaaactcatgggtggctcctgtaccaggaaaagatccggtacgcccgtgtttacctaagagaaaccacgcttattactccttttcccgtgcttttatttggaggtgacatcgaagtccagcatagggaacggttactctccattgacggttggatctattttcaggcaccagtgaagattgcggttattttcaagcaactccgcgtgctgattgacagcgtgctgcgaaaaaaactggagaaccctaaaatgtccttggagaacgataaaatcctgcagatcatcactgagctcataaagaccgagaataattag

SEQ ID NO: 114172 - DNA, 1989 bp, Artificial Sequence
  Description of Artificial Sequence: Synthetic coding sequence
atggaggaggaaggtttggaatgtccaaatagcagctcggagaagcggtacttccctgagagcctcgactcgtctgacggcgatgaggaggaagttctggcctgcgaagatctcgagctgaacccttttgacggcctgccctatagctcgcgatattataaattactgaaagagcgagaggacctgcccatctggaaagagaaatatagcttcatggaaaatctgcttcaaaaccagattgtgatcgtctcgggggatgccaagtgtgggaaatctgcccaggtcccacagtggtgcgctgagtactgcttaagcatacactaccaacatggcggcgtgatttgcacccaggttcataagcaaacagttgtccagctcgccctcagggtggcggacgaaatggacgtgaatatcggtcatgaggtcggctacgtgatacctttcgaaaattgttgcactaatgaaacgatcctgaggtattgtacagacgatatgttacaacgcgagatgatgtccaatccattcttgggaagctacggcgttatcatactcgacgacatccacgagcgttctattgccaccgacgttctgctgggtctgcttaaggacgtgctactggcaagaccagagttgaaactcattattaactctagcccccatctgatttccaagctcaacagttactacggaaacgtgccagtgatcgaggtgaagaacaaacatcctgtcgaggtggtttacttgagcgaagcccagaaggacagctttgagtccattttgagacttattttcgaaattcaccacagcggggaaaagggggatatcgtagtctttctcgcatgtgagcaggtgtataatccgaggattcgtgccaactcattggtcatgcagccaatcagccagtcacaagctgaaatcagaaaacaaattctaggctcaagcagtagcggtaaatttttctgcctgtatactgaggagttcgcgtcgaaggatatgacaccactgaagccggctgaaatgcaggaggcaaacctcacaagcatggtactgtttatgaaaaggattgatatcgcaggccttggccactgcgattttatgaatcgacctgcccccgaaagcctaatgcaggcccttgaagatctggattacctagctgcactcgacaatgacggcaacctttccgaattcggaataatcatgtcagagttcccactcgaccctcagctgtcaaagtctattctcgcaagttgcgaattcgactgcgtggatgaggttcttacgatagcggccatggttacagcaccaaattgcttttcccacgtgccacatggggccgaggaggctgctctgacatgctggaagactttcctccacccagaaggggaccacttcacacttatcagtatctacaaagcctaccaggatacaacccttaatagcagctccgaatactgtgtggagaagtggtgcagagattattttttaaactgttccgccctgagaatggcggatgtgatacgcgccgagctgttggaaattatcaaacggatcgagctgccttacgcagaacccgcgtttgggtccaaggaaaacacccttaatatcaagaaggcattgctgagcggctactttatgcaaatcgcaagggacgtggacggctccgggaattatctgatgctgacacacaagcaggtcgcccagctgcacccccttagtggctactctattactaaaaaaatgccggaatgggttctgtttcataagttttctatctcggagaataactatatccggattacatctgaaataagtcccgaattgtttatgcagctggtcccacagtattattttagtaatctgcctcctagcgaatcaaaggacatactccagcaggttgtagatcatctcagccctgtgagcaccatgaacaaggaacagcagatgtgtgagacttgccccgagacggaacagagatgcacccttcaatag

SEQ ID NO: 114173 - DNA, 2232 bp, Artificial Sequence
  Description of Artificial Sequence: Synthetic coding sequence
atggaagaagaaggcttagagtgtcccaactcaagtagtgagaagaggtactttccggagagtctcgactcctccgatggggatgaggaggaagtgctggcatgcgaagacctggagctcaacccgttcgacggtcttccttattctagtcggtactataagctcctcaaggagcgggaagatctccctatctggaaggaaaagtatagttttatggaaaatttactgcagaatcagatcgtgatagtttctggcgacgccaaatgtggcaagtctgcacaggttcctcaatggtgtgcagagtattgcctctctattcactaccagcacgggggtgtgatatgtacccaggtacacaaacagaccgtcgtgcaactcgcactacgagttgctgatgagatggatgtcaatatcgggcatgaagtcggttatgtgatccctttcgagaattgttgcacgaacgagactatcctgaggtactgcaccgacgacatgcttcaaagggagatgatgagtaaccctttcctcggctcatatggcgtgatcattctcgacgatatacatgaacggtcaattgccacagacgtcctgctggggctgctgaaggatgtcttactggcccgccctgaactcaaacttataatcaattcctctccacatctcatctcgaaactgaattcctattatgggaatgttcctgtgatcgaggtgaagaataagcacccagttgaagtggtctacctgagcgaggctcagaaggactcttttgagagtattcttaggttaatcttcgagattcaccactctggagaaaagggggacattgtggtattcctggcgtgtgagcaggatatcgaaaaagtatgtgagacagtttaccagggcagcaatctgaaccctgatcttggagagctggtcgtcgtacccctttatcccaaagaaaagtgtagcttgttcaaaccattggacgagactgaaaaacggtgtcaagtatatcagagaagagttgtgctgactacatcttcgggagagttcctcatctggagcaacagcgtccgtttcgttatcgatgtgggcgttgaaaggcgcaaggtctataatcctaggatcagggccaattccctggttatgcagccaattagccaaagtcaagcggagatcaggaaacagatattgggcagctcatcatcagggaagtttttctgtctgtatacagaggaattcgcgtccaaagatatgaccccacttaaacctgccgagatgcaagaagccaacctcacgtccatggtactctttatgaaacgcatcgatatcgcaggcttaggccattgcgatttcatgaatagacctgcgcctgagtcacttatgcaggctctagaagacctggactacctagccgcacttgataacgacggcaacctttccgagttcggaattatcatgtcagagttccctctggatccccaactgagtaaaagtattctggcctcatgtgaatttgactgtgttgatgaagtcttgaccatcgccgctatggtgacagcacccaattgttttagtcatgtgccacatggggcagaagaagccgccttgacgtgctggaaaactttcctacatcctgagggtgaccacttcacgctgatttccatttacaaagcttaccaggacacgacactcaatagcagtagtgaatattgtgttgagaaatggtgtcgcgattacttcttgaattgcagtgctctcagaatggccgatgtgattagagccgagctcctggaaatcattaagagaatcgaactgccgtacgcagaacctgccttcgggtctaaagaaaacaccttgaatattaaaaaggctttgctttcaggctactttatgcagatcgccagggacgtggatgggagcggaaactatctgatgcttacgcataagcaagttgcgcagttgcatccgctttccggttacagcattaccaagaagatgccggaatgggtgctttttcacaaattctcaattagcgaaaacaattacataaggatcacgtcagagatatcccccgaactgttcatgcagctggtccctcagtactacttctccaatctgcctccctcagagagtaaggacatcctgcagcaggtggtagaccacctctccccagtttctaccatgaataaggaacaacagatgtgcgagacttgtccggaaacagagcagcgctgcactctacagtag

SEQ ID NO: 114174 - DNA, 1104 bp, Artificial Sequence
  Description of Artificial Sequence: Synthetic coding sequence
atgcagcccatctcacagtcccaggccgaaatcagaaagcaaatcctaggatcctcctcatctggtaaattcttctgcctctacactgaggaatttgcatccaaggacatgacacccctgaagccagcagagatgcaggaggctaacctgacaagtatggtgctgtttatgaagcgcatcgacattgcgggcctgggacactgtgattttatgaatcggccagctcctgagtcccttatgcaggccctggaggatctggattatctggcagcattggataatgatggaaacctgtcagagtttggtatcatcatgtccgagttcccgctggacccccagctctctaaatctattttggccagctgcgagttcgattgtgtcgacgaggtactgacaatcgccgccatggttacagcgcctaactgcttctcacatgtgccccatggcgccgaggaggctgccctaacgtgttggaagacattcctccacccagagggagaccacttcaccctaatatccatttataaggcatatcaggacaccacacttaattcttcttccgagtattgtgtagaaaaatggtgcagagactactttctgaattgctccgctcttcgcatggctgacgtaattagggccgaattgctcgaaatcattaaaaggattgagctgccatacgccgagcccgcatttggaagtaaggagaatactctcaatataaaaaaggctctgctaagtgggtacttcatgcagattgccagagacgtggacggttcagggaattatctgatgttaactcacaagcaggttgctcagttgcaccctctgtctggctacagcatcacgaaaaagatgccggagtgggtgttgttccataagttcagtatcagtgagaataactacatccgtatcacttccgagatctcgcctgagctgtttatgcagctagtgccccaatattatttctccaacctgccaccatccgagagcaaagatattctgcagcaggtggtcgaccatctgagtcccgtgtctactatgaataaagaacaacaaatgtgtgaaacctgccccgaaacagaacagcgctgtaccctgcagtag

SEQ ID NO: 114175 - DNA, 339 bp, Artificial Sequence
  Description of Artificial Sequence: Synthetic coding sequence
atggaggaagaaggcctggagtgcccaaatagctcaagtgaaaagcgctatttccccgagtccttagattcatcggatggtgacgaagaagaggtgctcgcatgtgaggacttagagctcaatccatttgacgggctcccatattcctcccggtattataagctgctcaaagaacgtgaggatcttccgatatggaaagaaaaatatagttttatggagaatctgttgcagaatcaaatcgttatagtgtctggggacgccaaatgcggaaagagcgctcaggtgcctcagtggtgtgcggagtattgtctgtccatccattatcagcacgggggctag

SEQ ID NO: 114176 - DNA, 1935 bp, Artificial Sequence
  Description of Artificial Sequence: Synthetic coding sequence
atgaccatcgagatagatttcctgcagaaaaaatccattgactccaacccctacgataccgataaaatggctgccgaatttattcagcagtttaacaaccaagccttctcagtgggccagcaactagtgtttagttttaacgaaaagctgtttggcctgctcgtcaaggacattgaggcgatggaccccagcattttgaaaggcgagccagccacaggtaaaaggcagaagattgaggtgggattagtcgtgggaaacagccaggtggccttcgaaaaagctgaaaactcttccctgaacttaattgggaaggctaaaaccaaggagaatcggcagagcataattaaccctgactggaactttgagaagatggggattggcggtctggacaaagagtttagtgatatttttcggcgcgccttcgccagcagggtgttcccaccggagattgtggaacagatgggttgtaaacacgttaagggcatcctcctctatggcccacctggctgcggcaaaaccctgctggctcgccagattggtaaaatgctaaacgcacgggaacctaaagtcgttaacggaccagagatattaaataagtacgtgggagaatcggaggccaacatacgcaagttatttgccgacgctgaggaagagcagcggcgtctgggcgcaaattcaggcctgcacatcattatcttcgacgaaatcgacgcaatttgcaagcagaggggatctatggctggatcaactggtgtacatgacacagtcgttaatcagcttttgagcaaaattgatggggttgagcagctgaataacattctggttataggcatgactaatagacctgacctgattgatgaagctctgctgagaccagggcgcctggaggtcaagatggagataggactacccgacgaaaagggaagacttcagatactccacatccatacagcacggatgagaggccaccagttactgtctgcagatgtggacataaaggaattggccgttgagacgaagaatttcagtggtgcagaattggagggacttgtccgggcagcccagtcaacggccatgaatcgccatataaaagctagcaccaaggtagaagttgacatggagaaagctgagtccctccaggttacacgcggagacttcctcgcatctcttgagaatgatataaaacctgcgtttggtaccaatcaggaagactatgccagctatatcatgaatggaatcattaagtggggcgaccccgtcacgcgggtgctggacgatggggaactgttggtccagcagacaaagaattcagaccgaactcctcttgtgtcggtgttgttagaaggcccaccgcactccgggaaaacagcactggcagcaaagatcgccgaggaaagtaactttccgtttataaaaatctgttcgcccgataaaatgatcgggttctctgaaactgctaaatgtcaggctatgaaaaagatcttcgacgatgcatacaaaagccagctgtcgtgcgtggttgtggacgatatcgagaggctcctcgattacgtgccaatcgggccaaggttttctaacttggttttacaggccttgctggtgctcttaaagaaggcacccccccagggtcgcaaactgctcattatcggaacaacaagtaggaaggatgttctgcaggaaatggaaatgctgaatgcattttccacgacaatccacgtgccgaacatagctacaggcgagcagctcctggaggccctagaactactgggcaactttaaagataaagaaaggactaccatcgcacagcaggtcaaggggaaaaaggtgtggataggtatcaagaaactgctgatgttgattgagatgtcgttgcagatggatccggaataccgagtccgcaaattcctcgctttgctccgtgaggaaggcgcttag

SEQ ID NO: 114177 - DNA, 1452 bp, Artificial Sequence
  Description of Artificial Sequence: Synthetic coding sequence
atgcctgaagaggctggcttccctcctgctaaacgtttcaggcccgggagcggaccaccttctcgggctgggtcctttccgcccggccgacaagtcgttatgctacttaccgccggaagcgggggccgaggtggtggagggggacgccggcagcaaccaccccttgcacagcctagcgcctctccatatcctgaggctgttgaactgcagcgccgaagtctgccaattttccaggcacgcggccagctgttggcccagcttagaaacctcgacaacgccgtgctgatcggcagcccattttttaccgggcatccgggagttcctcattgggccggtggcgaccgcagtcatgagcaagacgtaccaaggcactgcaaggcgcccccgagaagacttccttgtgacgccgggccatcttccgtacgactccctgcactttgcacagcagccccttccctacctcgtggaccaaaagatagcggtctcgaggtcctggcggttcagcgcgtaagcaaaacccaggcgtggcagcggacaggtagagcgggaagagaggactctggtatttgttacaggctgtacacagaagacgaatttgagaaatttgataaaatgacggtgcctgaaatccagcgctgcaacttggcttccgtaatgttgcagcttttagctatgaaggttccaaatgtcctgacatttgatttcatgagtaagccgtcaccggatcatattcaggccgccatcgcacagttggaccttctgggagccctcgaacacaaggacgatcagttaactttgactcccatgggtcggaaaatggctgcgttccccttggaacccaaatttgcaaaaactattctgatgagtcccaaattccactgtaccgaggaaattttaactatcgtctctctgctgtccgtagattccgtgttgcataacccaccctcaaggcgcgaggaagtgcagggcgtacgcaaaaaattcatctcttctgagggtgaccacatgacattgctcaatatttatcgcacctttaagaatctggggggaaacaaggactggtgcaaggagaatttcgtgaacagtaaaaacatgactctggtggctgaggtcagggcgcagttgcgagatatatgcttgaaaatgtccatgcctattgccagtagcagaggtgatgttgaatcagtacgacggtgcctggcccactcactgtttatgagcacggctgaactgcagccagacggcacctacgctactaccgatacacaccagcctgtggctattcatccgagcagcgtgctgtttcattgcaagccagcctgtgtagtgtatactgagctgctgtacaccaacaaatgttacatgagagatttgtgtgttatcgatgcccagtggctatatgaggctgctcctgagtacttcagaagaaaactccgtactgctaggaattag

SEQ ID NO: 114178 - DNA, 2940 bp, Artificial Sequence
  Description of Artificial Sequence: Synthetic coding sequence
atgagctatgactaccatcagaactggggaagggacggaggccctcgttcttccggcggaggctacgggggaggacctgccgggggacatggtgggaaccgcggtagtggtggtggaggtggtggaggcggcggaggaagaggtggccgcggtcgacatcccggtcacctgaagggaagagagatcgggatgtggtatgctaaaaagcaaggccaaaagaataaagaggccgagcgtcaagaaagagcagtggttcatatggacgagcgcagggaggagcagatagtgcagttgcttaattcggtccaggcgaagaacgacaaggaatcggaagctcagatctcctggtttgctcctgaggatcatgggtacggcacagaagtgagcacaaagaataccccatgctcagaaaacaagctggatatacaggaaaaaaagttaatcaaccaggagaagaagatgtttcgaattaggaataggtcctatatcgatcgcgacagtgagtatctgctgcaggaaaacgagcccgacggaactttagaccagaagttgctggaagatctgcagaagaagaaaaatgatctgagatacatcgaaatgcaacacttccgcgaaaagctgccgtcctatggaatgcaaaaagagctggtcaatctaattgacaatcaccaggtgacagttatcagcggtgagactgggtgtggcaaaaccacgcaggttacccaatttatccttgataattatatagaaaggggcaagggtagtgcatgcagaattgtttgtacacagccaaggaggatttcggccattagtgtcgctgaacgggtggccgccgaacgtgccgagagctgcggttctgggaacagcacgggctatcagattcgcctccagagtcgacttccacgcaagcaaggttccattctctattgcactacaggaatcatcctgcagtggttgcagtccgatccatatctgtcttccgtcagtcacatagtgctggacgaaatccacgaaaggaacctgcagtccgatgtcttgatgaccgtcgttaaagacctgctgaatttcaggagtgacttgaaggtgatactgatgagcgcaactctgaacgcggaaaaattttccgagtactttgggaattgccccatgattcatatccctggattcacctttccagtggtggagtatctgctggaggacgtgattgagaagattaggtacgttcctgagcagaaagagcaccgctcccaatttaaaaggggattcatgcagggccatgtgaatagacaggaaaaggaagagaaggaagcgatctataaggaacggtggccagattacgtgcgggagcttaggagacggtactcggccagtacagtcgacgtcattgaaatgatggaggacgacaaagtagacctcaatctgatcgtggccctgatccgatatatcgtgctggaggaagaggacggggctatccttgtcttcctgcccggctgggataacatctcaactctccatgatctcttaatgagtcaagtgatgtttaagagcgataagttcttgatcatccctctacacagcctgatgcccaccgtcaaccagacacaggtgttcaagcggacgccccctggtgtccggaaaattgtgatcgccacaaacattgctgagacctcaatcacaatcgatgacgttgtgtatgtgattgacggtgggaagatcaaagagacccactttgatactcagaacaatataagtacaatgtcagctgagtgggtctctaaggcaaatgctaaacagaggaaggggcgtgctggcagagtccagccgggccactgctatcatctgtacaatgggctccgggctagtctccttgacgactatcagttgcccgagatcttgcggactccgctggaggagctttgccttcagatcaaaattctccggcttgggggcattgcttatttcctttcccgcctgatggatccaccatccaatgaggcggtcctgttatcgatccggcacctcatggagttgaacgctctcgataaacaggaggaactcactcctctgggcgtgcatctcgctcgcctccctgtagagcctcatatcggcaagatgatcctttttggcgctctgttctgctgcctagatccagtgcttacgatcgccgctagcctgtctttcaaagacccgtttgttatcccacttgggtgggaagaggctagacgtcgcggtttccgctacgagaaggactattgctgggagtactttctgtcctctaatacactgcagatgctccacaacatgaagggtcagtttgccgagcacctgttgggcgccggatttgtgtcgagcaggaatccaaaggatcccgagtccaacatcaatagcgataacgagaagatcatcaaggcagtcatctgcgccggcctctaccctaaggtggcaaagatccgattgaatctggggaaaaaacggaagatggtgaaggtatacacaaaaacagacggcctggtcgctgtgcatcccaagtcagtaaatgttgagcaaacggattttcactacaactggctaatataccacctgaaaatgcggacatccagtatatacctttacgattgcaccgaagtgtccccttattgtctgctctttttcggcggtgacatctcaattcagaaggacaatgaccaggagacaatcgccgtggatgaatggatagtcttccagtctcctgcccgcattgcgcacctggtcaaagagttgcggaaggaactggatattctgctgcaggaaaagattgagtctccgcatcccgtggactggaatgataccaagtcccgcgactgtgcagtactgtcagcaattatagatctgatcaaaactcaggagaaggccactcctcgcaactttcccccgagatttcaagatgggtactacagttag

SEQ ID NO: 114179 - DNA, 2985 bp, Artificial Sequence
  Description of Artificial Sequence: Synthetic coding sequence
atgagctacgactaccaccagaattggggacgggacgggggccctagatcctctgggggcggctatggcggcgggccagccggggggcatggcggtaatcgggggtctggcgggggaggaggtggcgggggtgggggcaggggcggacgcggtcgacacccaggtcatctgaagggcagggagatcggcatgtggtacgctaaaaaacaaggccagaagaataaggaggcagaacgccaggaaagggcggtggtgcacatggatgagagaagggaagaacagatcgtgcagctgctgaactcagttcaggccaaaaacgacaaggaatctgaggcacaaataagttggttcgctcccgaagatcacggctacgggactgaggtaagcaccaaaaacactccctgctccgagaacaaactcgatatccaggagaagaagttgatcaatcaggagaagaaaatgtttcgaataagaaatcgcagctacattgatagggacagcgaatacctgctgcaggaaaatgagcctgacggaaccctagatcagaagctgctggaggacctgcaaaagaaaaaaaacgacctgcggtacatagaaatgcaacattttcgggaaaagctacctagctacggcatgcagaaagagttagtgaacctcatagacaaccaccaggtgaccgttatttctggcgagaccggctgcggcaaaaccacacaggtgacacagtttattctagataactatatcgagcgggggaaaggcagtgcctgcaggattgtgtgcacccagcccagacgaatctccgccatctcagttgcagagagggtcgccgccgaacgagcggagtcatgcggctctggaaactctaccggctatcagatccggcttcagagcaggctgcctagaaagcaaggctccatcttatattgtacaaccgggatcattctgcagtggctacagagcgatccttacctaagctcggtttcacatattgtactggatgaaatccatgaaagaaacttgcagagtgatgttctgatgacggtggtcaaggacctgttgaactttagatcagatctcaaggtcattttaatgtccgcaactctgaacgccgagaaattttccgagtattttgggaactgtcccatgattcacataccaggatttacgttccctgtggtggagtacctgctggaggacgtgatcgaaaagatcaggtacgtgcccgaacagaaagagcaccggtcacagttcaaacgcggcttcatgcaagggcatgtcaacaggcaagagaaagaggaaaaggaggctatctacaaggagcgctggcctgattacgtgcgggaactccgacgtcggtattctgcgtccaccgtcgatgtgattgagatgatggaagacgataaagtggatctgaacctgatcgtggctttgatcagatatatagtgcttgaggaagaagacggtgccattttggtgttcctgccaggatgggacaacataagcaccttacatgacttgttaatgagccaggttatgtttaagagcgtaaatcagactcaggtgttcaaacggacaccaccaggagtgagaaaaatcgtgatcgctaccaatattgcggaaaccagtatcacaatagatgacgttgtctatgtgatcgatggaggcaagattaaggagacccatttcgacacacaaaataacattagcactatgtctgccgaatgggtgtccaaggctaacgccaagcagcgaaagggcagggccggccgggtccagcctggccactgctatcatctctataacggcctgcgagctagtcttctggacgactaccaattgcccgaaattctgcgaacacccctcgaagagctttgtcttcaaatcaaaattctgagactaggaggtatcgcatatttcctgtcccgccttatggaccccccttctaatgaagcagtgctcctgtccattcgacaccttatggaattgaatgcccttgataagcaagaagagctgacacctctgggcgttcacctggcccgcttgccagtggagcctcacatcgggaagatgatactgtttggagccctcttctgctgccttgacccagtccttactatcgccgcgtctttatccttcaaggacccctttgtgattcctctgggaaaagaaaaaattgcggacgctcggagaaaggagctcgcgaaagatacacgatcagatcacctgaccgttgtgaatgctttcgaggggtgggaagaagcgagaaggcggggatttcggtatgagaaggattactgctgggagtatttcctcagctctaacacgctgcagatgctccataacatgaaggggcaatttgcagagcacctattgggagctggcttcgtgtcatcccggaaccccaaggaccccgaaagcaatatcaactccgataacgagaaaattatcaaggctgtgatctgtgcaggcctgtaccctaaggtcgcaaagatacgtctcaacctgggcaaaaaacgaaagatggtgaaggtgtataccaagaccgacggcctagtagccgtgcatccgaagtcagtgaacgtggagcagacagattttcactataactggctcatctatcatctcaaaatgcggacctctagtatctacctgtacgattgtaccgaagtctctccttactgtcttctctttttcggcggggatatcagcatacaaaaagacaatgatcaagagaccatagctgtcgacgagtggattgttttccagtccccagcccgaatcgctcacctggtcaaagagttacgcaaggagctcgatatcctgctccaggaaaaaattgaatcaccacatcctgttgactggaacgacactaagagccgggattgtgccgtcctctcagctatcatcgaccttatcaagacccaggagaaggcaactcctagaaactttccccccaggtttcaggatggttattatagctag

SEQ ID NO: 114180 - DNA, 3027 bp, Artificial Sequence
  Description of Artificial Sequence: Synthetic coding sequence
atgtcatatgactaccaccagaactggggaagagatgggggcccccgatcctccgggggcggttatggcggtggcccagctggcggtcatggcgggaacaggggaagtggcgggggaggagggggtggaggaggcggacgtggcgggcgaggaaggcatcccgggcacctgaaggggcgcgaaatcggcatgtggtatgccaaaaagcaaggccaaaaaaacaaagaagctgagcgccaggaaagagccgttgtccatatggatgaaagacgcgaggagcagatagtccagctgctgaatagtgttcaggccaagaatgacaaggaatccgaagcccaaatcagctggtttgcacccgaggaccacggctacggtacggaggtgtctacaaagaacacaccctgctcagagaacaaactggacatacaggagaagaagctgattaaccaagagaagaagatgttcaggattagaaacagaagctatatcgaccgcgattctgagtatttacttcaggaaaacgagcccgacggcacattagaccaaaagttgctggaggacctgcagaaaaaaaaaaacgacctccgctatattgagatgcagcactttcgtgagaaactcccatcatacgggatgcagaaggaactggtcaatctaatagacaatcaccaggtgaccgtgatcagcggcgagactggctgcggtaaaaccacacaggtgactcaattcatactggataactatatcgagcggggaaaaggatcggcctgcagaatagtgtgtactcagccacggaggatttccgccatctccgttgcggaacgcgtggctgcagagagagctgagtcctgtggtagcggcaactccaccgggtaccaaatccgtctgcagtccagattgccaagaaagcagggcagcattttgtactgcactactggtatcatcctgcagtggctgcagagtgacccatacctgagttccgtaagtcatatcgttctcgatgagatccacgagagaaacctgcaatctgatgtgctgatgaccgtagtgaaagacctgttgaactttcgttccgatttaaaagtgattctcatgtccgcgactttaaatgccgagaaattctcagagtacttcggcaattgtccaatgatccatattccgggattcacattcccagtggtagagtacctcctggaagacgtgatagaaaaaatccgctatgtgcctgagcagaaggagcacaggagccaattcaagagaggctttatgcagggccatgtcaacagacaagagaaggaggagaaggaagcgatctacaaggagagatggccggattacgtgcgggaactgcgtaggagatactcagccagtactgtcgatgtcattgaaatgatggaggatgacaaagtggatctcaacttgatcgtagccctgattcgatacattgtgttagaagaagaagatggagccatcctggtgtttctccccggctgggacaatattagtacacttcatgacttgctaatgagccaagtcatgttcaaatctgataaattcctgattatccctctccacagcttgatgcctacagtcaaccagacccaggttttcaagagaactcccccaggagttagaaaaatcgtgatcgcaaccaatattgctgagactagtattactatagacgatgtcgtctacgtcatagatggagggaagatcaaggaaacccacttcgatacccaaaataacataagcaccatgtccgccgaatgggtctctaaagcgaatgcaaagcagaggaagggtagagctggaagagtgcagcctggacactgttaccatctatataatggtctacgcgcctccctgttagacgactatcagctccccgaaattttgcgcacccccctagaggagctgtgtttacaaatcaagattttacgcttgggcggcatcgcatattttctcagtcgcctgatggatccacctagcaacgaagccgtcctccttagcatcaggcacctgatggaactgaatgccctcgacaagcaggaggagcttactccgcttggagtccatcttgccagactgcctgtagaaccgcatatcggcaaaatgattttgtttggcgcccttttttgctgcctggaccctgtgctaactatcgccgcaagcttgtcattcaaagatccttttgttatccccctcggtaaggagaagattgctgatgccaggaggaaggagctcgctaaggatactcggtctgatcacctaactgtcgttaatgccttcgaaggctgggaagaagctcggcgaaggggtttccgttatgaaaaggattactgttgggagtactttttgtcttccaataccctccagatgctccataatatgaaaggacagttcgcggagcatttactcggagcaggttttgtgtctagcagaaacccaaaagacccagaatcgaatatcaattccgacaacgagaaaattattaaggcagtgatctgcgctggattataccccaaagtagctaaaatcagactcaacctggggaagaagcggaagatggtgaaggtatacactaaaaccgatggacttgtcgcggtgcacccaaagagcgtcaatgtggaacaaactgatttccattacaactggctaatttaccatctcaagatgaggaccagttctatttacctctatgattgcaccgaggtgtccccctattgccttctgttctttgggggggacataagcattcagaaggataatgatcaggagacaattgcagtcgacgaatggatcgtcttccagagtcctgcgcgtattgcccatcttgttaaggaacttcgtaaggagcttgacatcctcctacaggaaaagatcgaatctcctcatcccgtggactggaacgatacaaaaagccgcgactgcgcagtgctgtcagcaattattgacctgatcaagacccaggaaaaggccacacctcgaaactttccgccacgctttcaagacggatattatagctag

SEQ ID NO: 114181 - DNA, 2985 bp, Artificial Sequence
  Description of Artificial Sequence: Synthetic coding sequence
atgtcttacgactaccaccagaactgggggagggatggaggaccacggtctagtggggggggctacgggggtggcccagctggtgggcacggagggaaccgcggttcaggcgggggggggggagggggcggcggaggccgaggtgggagagggcggcaccccgggcacctgaagggaagggagatcggaatgtggtatgcaaagaagcaggggcagaaaaacaaagaagcagagagacaggaaagagccgttgtacacatggacgagcgaagagaggaacagattgtgcagctgctaaactctgtacaggccaagaatgacaaggagtcagaagctcaaatctcttggttcgcgccagaagaccacggctacggtaccgaagtgagcaccaagaatacaccttgcagtgagaataagctggacattcaggagaaaaagctcatcaaccaggagaagaagatgtttcgcattcgcaatcgcagttacatagaccgggattctgaataccttcttcaagaaaatgaacctgacggcaccctggatcagaagctgctggaagatctgcaaaaaaagaagaatgatctcagatacatagagatgcagcactttcgtgagaagctacctagctacggtatgcagaaggaactcgttaacttgatagataaccatcaagtcacagttatatcgggtgaaacgggttgcggaaagacaacgcaggttacccagtttattttagacaactatattgagcggggtaagggaagcgcctgtagaatcgtgtgcactcagccccgcaggatctccgcaataagcgttgcagagcgggttgccgcggagcgggccgagtcctgcgggtccgggaattccactgggtatcagatccgcctgcagagtcggttgcctcgcaaacagggcagtattctgtattgcacaactggcatcatcctacaatggctgcagtccgacccctacctctcctccgtctcccacatagtcctggatgagattcatgaacgcaacttgcagtcagacgtgctcatgacagtggtgaaggaccttctgaattttagatcagatttgaaggtgatactcatgtcggctactctaaatgcagagaaattcagcgagtattttggtaactgcccgatgatccacatacccggattcacctttcccgtggttgaatatttgctggaagatgtgatcgagaagattcgctacgtccctgagcagaaggagcacagatctcagttcaagcggggatttatgcagggacacgtgaatagacaagagaaggaggagaaagaggccatttataaggagcgctggcccgactatgtgcgtgagctcagaaggcgctatagcgcctctacagtcgacgtaatcgaaatgatggaggacgataaggttgatctgaacttaattgttgcactcatccggtacattgtgctggaggaggaagatggtgcgatacttgttttcctccctggctgggataatatatcgaccctgcacgacttgctaatgtcccaggtgatgttcaaaagtgggaccatgtctcaggtgtttaaaaggacccctccgggggtgcgcaagattgtgatcgctacaaatatcgccgagacttccattaccatcgacgacgtggtttacgtgatcgacggtggcaaaatcaaggagacccacttcgacactcaaaataatatctctactatgtcggctgaatgggtatctaaggccaacgcgaaacagcgcaaaggaagagcagggagagttcagccggggcactgctaccacctgtataatggcttgagggccagcctgctggatgattatcagctaccggaaatcctgaggaccccgttggaagagctatgccttcagatcaagatcctcagactgggaggcatcgcatatttccttagcagattgatggacccccccagtaatgaagcggtgctcctgagcatccgacatttgatggagcttaacgctcttgataagcaggaagagctgacacctttgggtgtgcaccttgcaaggctgccagtggaaccccatataggcaagatgatcctgtttggggccttgttttgctgcctagaccccgttctgaccatcgcagcctcactatcttttaaagacccgttcgtgatcccactggggaaggaaaagatcgcggatgcccggcggaaggaactagccaaggataccaggtccgatcatttaacagttgtgaacgctttcgaaggctgggaggaagcccggaggagaggttttcggtacgagaaggactattgttgggagtacttcctaagcagcaatactctgcagatgctgcataatatgaaaggccagtttgctgagcacctgttaggggcggggtttgtgtcatcccggaatcctaaagatccagagtctaacatcaacagtgataacgaaaagatcatcaaggcggtcatttgcgctggtctctatcccaaagtcgctaagattcgtctgaacctgggcaaaaagagaaaaatggtgaaagtatacacaaagaccgatggattggttgcagtgcacccgaaatcagtcaacgtagagcaaacggattttcattacaattggttgatctaccatcttaagatgcgaacctcaagcatctacctatacgattgtacagaagttagtccgtactgtctgttgtttttcgggggagacatatcgattcagaaggacaacgatcaggaaaccatagcagttgatgagtggatcgtttttcagtcgccggctcgcatcgctcacctggttaaggaactcagaaaggagttagacattctcctccaggagaaaatcgaatctccacaccctgtggactggaatgacactaaaagcagggactgtgccgtgctttccgctattatcgacctgatcaaaactcaggaaaaagccaccccaaggaactttccacctcggtttcaggatggatattattcctag

SEQ ID NO: 114182 - DNA, 3684 bp, Artificial Sequence
  Description of Artificial Sequence: Synthetic coding sequence
atgggagatacatccgaggacgcatccatccaccgcctggaaggcactgatttagattgccaggtcggcggacttatctgcaagtccaaatctgcagccagtgagcagcatgtcttcaaagctcctgctcccagaccgagcttgctaggtctggatcttctcgcctcgttgaaacggcgcgaaagagaggagaaggatgacggtgaggataagaaaaagtcaaaagtctcctcctacaaagactgggaagaaagtaaggacgaccagaaggacgcagaggaagaaggaggagaccaagctgggcagaatatccgcaaggaccggcactataggtccgctcgggtcgaaacccctagccacccaggcggggtaagtgaggagttttgggaacgctctaggcagcgcgagcgcgagcgccgcgagcatggcgtctacgcaagctcaaaggaggaaaaagattggaaaaaagagaagtcgagggacagagattacgatagaaagcgcgacagggacgagcgcgacaggtcaagacactcttcccgcagcgaaagagatggggggagcgaacgatccagtaggagaaatgaacccgagtcgcctcgacacaggcccaaggatgccgccacgccctcgcgcagcacctgggaagaagaggactccgggtatggatcatcacgaaggtcccagtgggaaagcccctcccccactccttcctacagagattccgaaaggtcccatagactgagcacaagagatagggatcgatccgttcgcgggaaatacagcgacgatacacctcttcctacacccagctacaagtataacgaatgggctgatgatcgccgtcatttgggcagcactcctaggttgagcagaggtaggggacgtagagaggaaggagaggaggggattagttttgacactgaagaggagagacagcagtgggaagacgatcagcgtcaggctgaccgagattggtatatgatggatgagggttacgacgaattccacaaccccttggcttattctagtgaggattacgttcgccggagagaacagcacctccacaaacagaaacagaagcgcatatccgctcagcgcaggcagatcaacgaagataatgagcgatgggaaactaataggatgctgacttccggtgtggtgcatcggttggaggtcgacgaagacttcgaggaggataacgccgccaaagttcacttaatggtccacaacttggttcccccatttctggacggccggattgttttcactaagcagccagaacccgtaataccagtgaaagacgccacctccgatttggcaatcatagcgcgtaagggcagtcagactgtgaggaaacatcgcgaacaaaaagagcgcaagaaggctcagcacaaacactgggaactcgctggcaccaaactaggcgatatcatgggggtgaagaaggaagaagaaccggacaaagccgtgacggaggatgggaaggtagattaccgaacagagcagaagtttgctgaccatatgaagcggaagtcggaggcttcctctgaatttgcaaagaaaaagagcatcctggagcagagacagtacttacccatattcgctgtacagcaggagctcctcacgattatccgggataactcaatagtaatcgttgtgggggagacaggatctggcaagaccacccagcttactcagtacttgcatgaggatggttataccgactatgggatgatagggtgcacgcagccacgcagggtggccgcaatgagcgtcgcaaaacgagtgtcagaagagatgggtggtaaccttggcgaggaagtgggatatgcaattagattcgaagattgcacgtcagaaaataccttgattaaatacatgaccgacggcatcctactcagagagtcccttagggaggcggacctcgatcactattcggccatcatcatggatgaagctcatgaaagaagcctgaatacagatgttctgttcggcttgctaagagaggtcgtcgcacgccgctcagatctgaagttgatcgtgacctcagctaccatggacgcagagaaattcgcagctttcttcggcaatgttccaatttttcatattcctggccggactttccccgtcgatatcctgtttagtaaaacacctcaggaggattatgtcgaagccgctgtgaaacaatcgcttcaggttcatctttccggagcaccgggcgatatactcatttttatgccaggccaggaggacattgaagtgacgtctgaccaaatagtagagcacctggaggaactggagaatgcccccgctttggccgtgctgcccatttacagccagctgccatcagatcttcaagccaaaatctttcagaaagcccctgatggagtgcgaaaatgtatagtggctacaaacatcgcggagacatcacttacggtcgacggtattatgttcgtcatcgactccgggtattgcaagcttaaagttttcaaccctaggatcggaatggatgccctgcagatctaccccatttctcaggcaaacgccaaccagcggtccggaagggcaggtcgaacaggtcctggacagtgttttcggctgtacacacagagcgcatacaaaaatgagttgctgaccaccactgtgcctgaaattcagcgcacaaacctggcgaacgtagtgttactgttgaaatctctgggagtccaggacttattgcagtttcatttcatggaccctcctccggaagacaatatgctgaattcgatgtaccagctgtggattcttggggccctggacaatacgggcggtttgactagtaccggtaggttaatggttgaattcccactggaccctgctctatccaaaatgcttatcgtctcctgtgatatgggctgctcatccgaaattctgttgatcgtatccatgctgagcgtgccagccatattctacagacccaagggacgcgaggaggagtctgatcaaatccgggagaagttcgctgttcctgagagcgatcaccttacatacctcaacgtgtacctgcagtggaaaaataacaattactccactatttggtgcaacgatcactttatccatgccaaagcaatgcggaaagtgcgtgaagtcagagctcagctaaaagacattatggtacagcagagaatgagtctggcctcttgcggcactgactgggacattgtccgaaagtgtatctgtgcggcctactttcaccaggcagcaaagcttaagggcataggggagtatgtgaatattagaacaggtatgccttgtcatcttcatcctacgtcctcgttgtttggaatggggtatacacctgattacattgtttaccacgagttggtgatgactacaaaggagtacatgcagtgcgttacagccgtcgacggcgagtggctcgcagaactgggccccatgttttactcagtgaagcaggcaggcaagagcagacaagaaaaccggcggcgcgccaaggaagaggcgagcgccatggaagaagaaatggctcttgccgaagagcagcttcgcgcacggcggcaggaacaggaaaagcgctctcccctgggatcagtgcgctcaacgaaaatttacactccaggtcgcaaggagcagggcgaaccaatgactccaagacggacacctgccaggttcggcctgtag

SEQ ID NO: 114183 - DNA, 1620 bp, Artificial Sequence
  Description of Artificial Sequence: Synthetic coding sequence
atgggagacacctctgaagacgcctcaatccatcgcctcgagggaacagacttagattgtcaagtcggaggactgatttgtaagtccaagtctgcagcttccgagcagcacgtctttaaggctccagcaccgcggcctagcctgctgggattggatctgctcgccagcctgaaaagaagggagcgtgaagaaaaagatgacggagaggacaaaaaaaaatctaaggtatccagctacaaagattgggaagagagcaaagatgaccagaaagatgccgaggaggagggcggcgatcaagctaaaatcttccaaaaggctcctgacggagttcgaaaatgcattgtggccaccaatattgccgagaccagcctgaccgtggatggtattatgtttgtgatcgactccggctattgcaaactgaaggtctttaaccccagaataggcatggacgccctgcagatttatccaatcagtcaggccaatgctaaccagcgttccgggcgagccggacgtaccggacctggccaatgttttcgcctctacacccagtccgcctataagaacgagctgctgactacaaccgtacctgaaattcaaaggacgaatctcgcaaacgtggtcctgctcctaaagtcgctgggagtgcaagacctcctccagtttcactttatggaccctccacctgaggacaatatgctgaatagcatgtatcagttgtggatactcggcgctctggataacaccggtggattaaccagcacgggcaggctcatggtggagttccccctagaccccgctcttagcaagatgttaattgtgtcctgcgatatggggtgtagctctgagattctgttgattgtaagtatgctaagtgtcccagctatattctatagacccaagggccgtgaggaggagtccgatcagatccgcgagaaattcgcggtgccagagtcagaccacctgacgtacttgaatgtgtacctgcagtggaaaaataataattatagcactatctggtgcaatgaccactttatacatgcgaaagctatgcggaaggtgcgggaagtcagggcgcaactgaaagacatcatggtgcagcaaaggatgtccctcgcatcatgcggcactgactgggacatagtccggaaatgtatttgtgcagcctacttccaccaggctgcaaagctgaaagggattggtgagtacgttaacatcaggactgggatgccatgtcatctgcaccctacaagctccctgttcggtatgggatacacccccgattacattgtgtaccatgagctggtcatgaccaccaaggagtacatgcagtgcgtgacagccgttgatggcgagtggctggctgagttaggaccaatgttttattcagtaaagcaagccggaaagtctcgtcaagagaatagaagacgcgccaaagaggaggcatccgcaatggaagaagagatggcgcttgccgaggaacaactccgcgcaagaaggcaggaacaggagaagagaagtccattaggaagcgttcgatccacgaagatctacactcctggaagaaaagagcaaggcgaaccaatgacgcctcggcggacgcccgctcgctttggcctgtag

SEQ ID NO: 114184 - DNA, 2340 bp, Artificial Sequence
  Description of Artificial Sequence: Synthetic coding sequence
atgtcacgattccctgcagtggccgggcgggctccacggcgccaggaggagggtgagcggtcccgcgacctgcaggaggaaaggctgagtgccgtgtgcatagctgaccgcgaggagaagggatgcacatctcaggaaggaggaaccactccaaccttccccatacagaaacagcgcaaaaagataatccaagccgttagagataattcattcctcatcgtcaccggcaacaccgggtcaggcaaaaccacacagttaccaaagtatctctatgaagccgggttctcccagcacggaatgattggtgtcactcagccaaggaaggtggccgccatcagtgtggcacagcgtgtggctgaagagatgaaatgcactctaggatctaaggtaggttaccaggtcagattcgacgattgttcatcaaaggagactgcaatcaagtacatgaccgatggatgtctccttaaacacatcctaggtgatcctaacctaacaaagttctctgtcattatactggatgaagcgcacgagcgaactttgactaccgatattctgtttgggctgctaaaaaagctgttccaggagaaatcacccaaccgcaaggagcacctcaaagtcgtcgttatgtcagccaccatggaacttgccaagctgtccgccttttttgggaattgccctatcttcgatatcccgggacgcctctatccagtacgggaaaaattctgcaatttgataggtcctagagaccgtgagaacaccgcctacatccaggccatagtgaaagtcacaatggatattcatctgaatgagatggctggagatattctagtgttcctgaccgggcagtttgaaattgagaagtcttgtgagctgctctttcagatggcggaatcagtggattacgattatgacgtacaagacaccaccctggatggtctgctgattctgccctgttacggctcaatgaccaccgaccaacagaggcgtatttttctcccacccccacccgggatacggaagtgtgttatttctacgaacatatctgctacttctctaacaatcgacgggatccgctatgtggtggacggcgggttcgtgaagcagctcaatcacaaccccagactcgggcttgacatcctggaagttgttcccatcagtaagagcgaggccctccagcggagcggtcgagctggaagaacttcttcaggaaagtgcttccggatatactcaaaagatttctggaaccagtgcatgcctgaccacgtgattcccgagattaaacgaaccagcctgacaagtgttgttttaaccctgaaatgcctcgccattcacgatgtaatacgcttcccgtacctggacccacctaatgaacggttaatcctcgaggccttgaaacagttgtatcaatgcgatgctattgatagatcaggacatgtgacgagattgggactttctatggtggaatttcccctccccccacacctcacctgtgcggtcatcaaagcagcctccctcgattgtgaagacctgctcctcccaattgcagcgatgctgtcagtggagaacgtcttcattcgccccgtggatcccgagtaccagaaagaagccgagcagcgacacagggagctggctgctaaagccggcggtttcaacgactttgcaacattagctgtgatctttgagcaatgtaaaagttcaggagcccctgcttcttggtgtcaaaaacactggatacactggaggtgtttgtttagtgcattccgggtcgaagcgcagcttcgggaacttataaggaagcttaagcaacagagtgattttccaaaagaaacatttgagggtccgaagcacgaggtcctgaggagatgcctgtgtgccggatacttcaaaaacgtcgctcggagaagtgtcgggaggactttttgtactatggatggcagaggttccccagtgcatatacatccatcgtcagctctccacgagcaggaaaccaagctcgaatggatcatttttcatgaagtgctggttactacaaaggtctacgcccgaatcgtatgccccattaggtatgaatgggtaagggacctgctgcctaaactgcacgagttcaacgcccacgatctgagtagcgtagcccggcgagaagtcagggaagatgcccgccgacgttggactaacaaggagaacgtgaagcaactcaaagatgggataagcaaagatgtgttaaagaagatgcagcggcgtaacgacgataagtccatctccgatgctagggcccgattcctggagcggaaacagcagagaacacaggaccactccgacacaagaaaggagaccggttag

SEQ ID NO: 114185 - DNA, 2169 bp, Artificial Sequence
  Description of Artificial Sequence: Synthetic coding sequence
atgagccggtttccggctgtcgctggccgcgctccgaggcggcaggaggagggggagcgcagtagagatctgcaggaagaaagattgagcgctgtgtgcatagctgacagggaggaaaaggggtgtacaagtcaggagggtggcactacccccacatttccaatccagaagcagcgaaaaaaaattatccaagccgtgcgcgacaactcatttttgatcgtgaccggcaacaccggctccgggaaaacaacgcagctgcccaaatacctgtatgaggccggattttctcagcatggcatgataggcgtaacacaaccgagaaaagttgcagccattagcgtggcgcaacgggtcgcggaggaaatgaagtgcacactgggttccaaggtcgggtaccaggtccgcttcgatgactgttccagcaaggagaccgccattaagtacatgacggacggctgcttgctcaaacacattctgggggacccaaacctgactaagttctcagtaatcattcttgacgaagcccacgaacgtaccctgaccacggacattctttttggactattgaagaaactttttcaggagaagagccccaacagaaaagagcatcttaaagtggtggtgatgtccgccacaatggagctggcgaagctgagcgccttctttggaaattgcccaatcttcgacatccctgggcgtctctatccagtgagagaaaaattttgtaatcttattgggccccgggaccgcgaaaacacggcttacatacaggctatcgttaaagtgacaatggacatccatcttaacgaaatggccggagacattctggtgtttctcacgggtcaatttgagatagagaagtcttgcgaactgctgtttcaaatggcagagagcgtcgactacgactacgatgtgcaggacactactctcgatgggctgctcatactgccctgctacggcagtatgactaccgatcagcagaggcgcatctttctgcccccaccgcccgggattaggaagtgtgtcatctcaacaaatatcagcgccacctcactgaccatagacggcatacgttacgtggtggatggaggcttcgtgaagcagctcaaccacaacccaagacttggtctcgacatcctggaggtggtgcccatcagcaagtctgaggctctgcagcgcagtggtagagcaggacggacgtcgtccggtaagtgtttcagaatttattcaaaggacttctggaatcaatgcatgcccgatcacgtcatacctgagattaagcgaacatctcttacctccgtggtgctcaccctcaagtgtctggccattcatgacgtgatccgttttccatacctggacccgcctaatgagcgtctgattctggaggctctgaagcaattgtaccagtgcgacgccatagaccgttctggtcacgtaactcgtctcggactatcaatggtcgaatttcctttgcccccacacctgacttgtgcagtcatcaaagccgcatccctcgattgtgaagatttgttgctccctattgccgccatgctgtctgtggagaatgttttcatccggccagttgacccggagtatcagaaggaagcagagcaacgccacagggagctagctgctaaggctgggggattcaacgactttgctaccttagcagtgatttttgagcagtgtaaatctagcggcgccccggctagttggtgtcagaagcactggattcactggcgctgtctgttctcagcgttcagggtagaagcccagctgagggaactcattcggaagctcaaacagcagagcgattttcccaaggagacgttcgaaggacctaaacatgaagtactccgaaggtgcctgtgcgctgggtacttcaaaaatgtggcacgccgttcagtcgggaggaccttttgtactatggacggtagggggagcccggtgcatatccatccctcctcagccctgcacgaacaggaaacaaagctggagtggatcatcttccacgaggtgctggtcactacaaaggtgtacgctcgcattgtgtgcccgattagatacgaatgggtccgcgacctgttaccgaagctccacgagtttaacgcacacgatctgtcatctgttgcccgccgggaagtttcaaagattaaactgtttcagtag

SEQ ID NO: 114186 - DNA, 2196 bp, Artificial Sequence
  Description of Artificial Sequence: Synthetic coding sequence
atgattggcgtgacacaacctaggaaggtcgcagctatcagcgtagctcaaagagttgccgaagagatgaagtgtacactgggctcaaaggtgggctaccaggtgcgttttgatgactgcagctccaaggagacagccataaagtacatgaccgacggctgccttctcaagcacattctcggcgacccgaacctaaccaagttctccgtgatcattctggatgaggctcacgaacggacccttactaccgacattctcttcggcctactgaaaaaactcttccaagagaagtccccaaatcggaaagagcatctcaaagttgtcgtgatgtccgctacgatggagctagccaaactgagtgccttttttgggaactgtcctattttcgacatccccggccgtctctacccagtgcgcgaaaaattctgtaacctgatcggtcctcgcgacagagaaaacactgcatacattcaggcgatcgtgaaagtgaccatggatatacatctcaacgaaatggccggcgacattctcgtatttctgacggggcaattcgagattgagaagagctgcgaactacttttccagatggcagagtccgtggattacgattacgatgtgcaggacaccactctggacgggctgctgatactcccctgttatggcagtatgactacagtgagccaaacctccctgaccttcgtgacacacatacaaataatgaagcagatatccgagaaccagcactcattgacagggcttaccattgccggcatcacgggcgtgtctcaccacgctaggcccagaaacatgacctgtaatgagaagctgaatcagcagcggaggatcttcctcccacccccacccggcattcgaaagtgtgtgatcagcactaacataagcgctacctctttaaccatcgacggcatcagatacgtcgtggatgggggcttcgtgaaacaactgaaccataaccctcgattggggctcgatattctcgaagtggtgccaatctccaagtccgaggccctgcaaaggtctggacgagccgggcggacctcgtccggtaaatgttttagaatttactcaaaggacttctggaatcaatgtatgcctgaccatgtgattcctgagatcaagcgaacctctctgacgagtgtcgtactcaccttaaaatgtctggcaattcatgatgtcatccgcttcccctacctcgaccctccgaacgagcggctgattctggaagcgctaaagcagctctaccagtgtgatgccatcgaccgtagcgggcacgtgacgagactcggcttgagcatggtagagttccccctcccaccccacttaacatgcgccgtgattaaggccgcctctctcgactgtgaagacctcttgctgcctattgctgcaatgctttcagtggaaaatgtgtttatcaggccagtggaccctgaataccaaaaagaggcggaacaaagacatagggagctagccgcaaaggctggggggttcaacgatttcgccaccctcgcagtcatttttgaacagtgtaagagcagtggggccccagcttcatggtgccagaagcactggatccactggcgatgtcttttctcggcttttcgggtcgaggcacaacttagggagctgatacgtaagcttaagcagcaaagcgactttcctaaggagaccttcgagggaccaaaacacgaggtgttgaggcggtgtctgtgtgccgggtactttaaaaatgtggctaggcgatccgtgggtcggaccttctgtacaatggatgggagggggtcgcccgttcacatccacccgtctagtgctctacacgagcaagagacgaagctcgagtggataatattccacgaagtgttggtgacgaccaaagtatatgccagaatcgtctgcccaataagatatgagtgggtcagggacctgctgcctaagttgcatgagttcaatgcccacgatctgagctctgtagctcgtcgagaagtgagggaggatgcccggagaagatggaccaacaaggaaaacgttaaacagcttaaggacgggattagcaaagacgtgctaaagaagatgcagcggaggaacgacgataaatctataagcgacgctagagcgcggtttctcgagagaaaacagcagaggactcaagaccactctgatacacgtaaagaaacaggctag

SEQ ID NO: 114187 - DNA, 2109 bp, Artificial Sequence
  Description of Artificial Sequence: Synthetic coding sequence
atgagtcgcttccctgctgtggccggacgagcgccgcggagacaggaagagggggaaagatcccgcgatctgcaagaggagcgcttgagcgccgtgtgcatcgctgaccgggaagagaaaggctgcacgtcccaagaggggggaaccaccccaacgttcccaatccaaaaacagcgtaaaaaaattatccaggctgaaacagccattaagtacatgaccgacggttgtctgctcaagcacattcttggcgacccaaacttgaccaaattcagcgtcatcattctggatgaggcacatgaacggaccttgaccaccgacattctttttggactactaaaaaagctgttccaggagaaaagccctaacagaaaggagcatctaaaggtggtcgtgatgagcgccaccatggagctcgccaaattaagcgccttcttcggcaactgccccattttcgacattcctggaagactttatcccgttcgggagaaattctgtaatctgatcggacctcgcgatcgggaaaacaccgcctatattcaggctatagttaaggtgacaatggatatacatctgaacgaaatggccggagacatactggtgttccttactggacagttcgaaatcgaaaagtcatgcgaactgctgttccagatggccgaatccgtcgactatgattatgatgttcaggacacaaccctcgacggtttactcatcctgccttgttacggaagcatgactacagatcagcagagacgtatctttcttccccctccccccggtataaggaaatgcgtgatttcaactaatatatcagcaacatccttaaccatcgacggcattcgatacgtggtcgatgggggtttcgttaagcaactaaatcacaatccgaggctgggcctcgacatcctggaggtcgtcccaattagtaaaagtgaagccttacagcggtcaggacgcgctggccggacaagcagcggcaaatgttttcgcatttactcgaaggatttctggaaccagtgcatgccagatcatgtcattccggagatcaaacgcacctccttgacctcagtggtgctgacactgaaatgcttagctatccatgacgttatcagatttccatacctcgacccaccgaacgagcgtcttatcctggaagcattgaagcagctgtaccagtgtgacgctattgacaggagcgggcacgtcacaaggctgggcctcagtatggtggaattcccacttccaccccatctgacctgcgccgtcatcaaggctgcgagtctcgactgtgaagacttgcttctgcctatcgcggcgatgctctcggtagagaacgtattcatcaggccagtcgatcctgaataccagaaggaggctgagcagcggcatagggagttggctgcaaaggctgggggttttaatgactttgccacactggccgtaattttcgaacagtgtaaaagttccggagcgcctgccagctggtgccagaagcactggatacattggagatgtctgttcagcgcatttcgtgtggaggcccagctgcgggaactgattcgcaagctaaaacaacaaagtgactttcctaaagaaacctttgaggggccaaagcacgaagttctgcgccggtgcctctgcgctggatattttaagaacgtggcaagaagatccgtgggtcgaaccttctgcactatggatggaagagggtctcccgtgcacatccatccttccagcgcattgcacgagcaagagaccaaactagagtggatcatatttcatgaggtgctggtcacaaccaaggtttatgcacgaattgtctgcccaatcagatatgagtgggtgagagatctcctgcccaagctgcatgaattcaacgcccatgatctgtcttctgttgccaggcgcgaagtcagagaggacgccagacggcgctggacaaataaggagaatgtaaaacaactgaaagacggcatctctaaagacgtgcttaaaaagatgcaacgaaggaacgacgacaaatcaatttcagacgcaagggcccggttcctggaacggaaacaacagaggacgcaggaccactccgacacaagaaaggaaaccggctag

SEQ ID NO: 114188 - DNA, 3663 bp, Artificial Sequence
  Description of Artificial Sequence: Synthetic coding sequence
atggccgttgctgtggctatggcaggagctttgattggctctgagccaggccctgctgaggagctggctaagctagagtacctgagcctggttagcaaggtttgtactgagctggataaccatctgggcattaatgataaggacctcgcagagtttgtgatctcactggctgagaaaaacactacctttgacaccttcaaagccagtcttgtcaaaaatggcgcggaatttaccgattcactgatcagcaatctgctccgtctgattcaaacaatgcgcccaccagcaaaaccaagcacctccaaggacccagttgtgaaacctaagacagaaaaggaaaagctgaaggagctgtttccagtcctgtgccagcccgacaaccctagcgtgaggacaatgctggacgaggatgacgtgaaagtggccgtcgacgtgttgaaggagctcgaagctcttatgccatccgccgcgggccaggagaaacaacgcgatgctgagcacagagacagaacgaagaagaagaagcgatctcgcagccgcgaccggaatcgcgaccgagaccgggaccgggagaggaaccgagatcgagaccataaaaggcgtcatagatcaaggtcccggtcccggtcgcggactcgggaacgcaataaggtgaaaagcagatatagatcccgctctcgtagccaaagtccaccgaaagacagaaaagatcgtgataagtatggggagagaaacctggaccgctggcgggacaaacacgtcgatcgaccccctccagaggagcctacaataggggatatctataacgggaaagtaacgagcattatgcagtttgggtgttttgttcagcttgagggcctcagaaagcggtgggagggcctggttcatatctccgagctgcgccgagagggtagggtcgccaacgtggctgatgtggtgtctaaggggcagagagtgaaggtgaaggttctgagttttaccggcacaaagacaagcttgagcatgaaggatgttgatcaggaaacaggcgaggacctgaatccgaacaggcggcggaatttggtgggcgagaccaacgaagagacttccatgcggaaccccgaccgacctactcatttgtcattggtgagcgcccctgaggtggaagacgactcactggaacgtaagcgcctgaccaggattagtgatccagagaagtgggagatcaaacagatgattgctgcaaacgtgctgtcaaaagaggagttccctgatttcgacgaagagaccggaatactccccaaggtcgacgatgaggaggacgaagacttggagattgaactggtggaagaggagcctcctttcctccgaggccatacaaagcagtctatggatatgtcaccaattaagattgtgaaaaatcctgatggatcactctcacaagcagcgatgatgcagagcgcccttgcgaaagaacgacgggagttgaagcaagctcagagggaagctgaaatggatagcatcccgatgggcctgaacaagcactgggtggatcctcttcccgacgcagagggtcgacaaattgcggcaaacatgagaggcattggtatgatgcctaatgatatcccagaatggaagaagcacgcctttggtggtaacaaagcttcatatggcaagaaaacccagatgtccatactggagcagagggaaagcctccctatctataagctgaaagaacagcttgtacaagctgtacacgataaccagatactcattgttattggagaaacgggaagcggtaagacgactcagatcactcagtatcttgcagaagcggggtacacgtcgcgcgggaaaattggatgtacccagcccaggagggtagcagcaatgagtgtggcaaagagggtttctgaagagttcgggtgttgtctcgggcaggaggtcggctataccatccggtttgaggattgtacaagccccgagacagtaattaaatatatgacagatgggatgttacttagggagtgtctcattgatcctgatctgacacagtatgcgattattatgctggacgaagcacacgaacggaccatacatactgatgtcctgtttggcctgctgaaaaagacagttcagaagcggcaggacatgaagctaatcgtcacgtcagcgactcttgacgcagtgaagttctcccagtatttctacgaagctccaatattcactatccccggcaggacgtatccagtggagatcctttatacaaaggagccagagaccgactacctggacgcgtcgctgattacagtcatgcagattcatctcactgaaccaccaggagacatcctggtgttcctgactggacaggaggaaatcgataccgcatgcgagatcctgtatgagcggatgaagtctctgggccctgatgtgcccgagctaatcatcctcccagtgtattcagccctgccctccgagatgcagacccggatcttcgaccccgccccgccaggcagtcgcaaggtggtcattgctaccaatatcgccgaaacatccttgacaatcgacggaatctactatgtagttgaccctgggttcgtcaagcagaaggtctataatagcaagaccggcatcgatcagttggtggtaacacccatctcccaggcacaagcgaagcagagggcaggacgagctgggagaacaggaccgggcaagtgctatcggctatataccgagcgggcctatcgggacgaaatgctgaccacaaatgtgcccgagatccaacgcaccaacctcgccagtacagtactgtcgttgaaagcaatgggtattaacgacctgctttcattcgacttcatggacgcccccccaatggaaaccctgatcaccgcaatggaacagctatacaccctgggagccttggacgacgaaggtctgttgactaggctggggcgcagaatggccgagtttccgctggagcctatgctgtgtaaaatgctcatcatgagtgtgcacctgggttgtagcgaagaaatgctgactattgtgtccatgctgtccgtccagaacgtgttctatcggcctaaggacaagcaggcactcgccgaccaaaaaaaagcaaagtttcaccagaccgagggtgaccatctgactctgctagcggtgtataacagctggaagaataacaagttcagtaacccctggtgctatgaaaatttcatccaggcacggtcccttaggagagcccaggacattcgaaagcagatgctcggcattatggaccggcataagctggatgtggtgtcatgcggaaaaagcacggtgcgagttcagaaggctatttgctccggtttcttccggaatgctgccaaaaaggacccccaggagggctacaggactttaattgatcagcaagtcgtgtacattcatccatccagtgcacttttcaatagacagcccgaatgggtggtgtaccatgaactggtactcactacaaaggagtacatgcgggaagtcaccaccatcgacccgcgctggctggtggagtttgcccctgccttttttaaagtgtcggaccccacaaagctgagcaaacagaaaaaacagcagagactcgaaccgttgtataatcgctacgaagagcctaacgcctggcgtatatctcgcgctttccgccgcagatag

SEQ ID NO: 114189 - DNA, 3546 bp, Artificial Sequence
  Description of Artificial Sequence: Synthetic coding sequence
atggccgtggcagtggcaatggcaggcgctctgataggctccgaacccgggcctgcagaggagctggcaaagcttgagtacctcagcttggttagcaaagtgtgcactgaactagataatcatctcggaatcaatgacaaggatctggccgagttcgtgatctccctagccgagaagaacacgacctttgataccttcaaagcatctctcgtgaaaaacggagccgagttcaccgactccctgatttccaatctgttgcgtctgatacaaacaatgagacccccggccaaaccgagcactagtaaggatccagtggtgaagccaaagacagaaaaggaaaagttgaaggaactgtttcccgtgctgtgtcagccagacaacccgtccgtgcgtaccatgcttgacgaggatgacgtgaaggtggctgtggatgtactgaaggaactcgaagctttaatgccaagcgccgcgggccaagaaaagcagcgagacgccgaacacagggaccgcacaaaaaaaaagaagcgttcacgatcaagggaccgaaaccgggaccgggatagggatagggaacggaaccgggacagggaccataaacgccggcaccgtagccggtcccgaagcagatcaagaaccagggagaggaataaagtcaagagcagatataggagccggtcaagatcacagtctccgccaaaagatcgcaaggacagagataagtacggtgagagaaacctggataggtggcgcgacaagcacgtggatcgtccccctcctgaggagcctacaattggcgacatttacaatggcaaggtgacaagtataatgcagttcggttgctttgtgcagttggaaggcctgcggaagcgttgggagggactggtacacataagcgagttgcgccgagaaggccgagtagccaacgtggcagacgttgtgtctaaaggccagcgtgttaaagtgaaagtgctgagtttcacaggaaccaaaaccagtctgtctatgaaggacgtggaccaggagactggcgaagatcttaatccaaaccgcaggcgcaatctcgtgggagaaactaacgaagaaacctcaatgaggaacccggaccggccgacccatctgtcccttgtatccgcacctgaagttgaggatgacagcttagagcgaaagcgcctgacaagaatctccgaccccgaaaagtgggaaatcaaacagatgatcgcagctaatgtgctctccaaggaagagttccccgacttcgacgaggagaccggcattttgcccaaagtagacgacgaagaggacgaggacctcgagattgagttggtcgaagaagagccccctttccttcgagggcataccaagcagtccatggatatgtcccctattaagatcgtgaagaatccggacgggagcctgtctcaggccgctatgatgcagtctgccctggctaaggagagacgagagctcaagcaggcccaaagagaggctgaaatggactccatccccatgggcctcaataagcactgggtagatcccctgccggatgctgaaggacgacagatagctgccaatatgcgtggtatcgggatgatgccaaacgacatccctgagtggaagaagcatgcttttggcggaaacaaagcatcctacggaaaaaaaacccagatgagcatcctggagcagagagagtcactccctatctacaaactcaaagagcagctcgtgcaggctgtccacgacaaccaaattctgattgtgatcggggaaaccggctcaggcaaaaccacacaaatcactcagtatctcgctgaagcgggatacacatcaagaggcaaaattggatgtacccagccaaggagggtggccgcaatgtccgtggctaagcgcgtctctgaagagtttggatgttgtctaggccaggaagtgggctacaccattaggttcgaagattgcaccagccccgagaccgtgattaagtatatgacagacggcatgttgcttcgtgaatgtcttattgatcctgatttaacacaatatgccatcattatgttggacgaggcccacgagagaacaattcacaccgacgtcttgtttgggctattgaaaaagaccgtgcagaaaagacaggacatgaaactcattgttacctcagccacgcttgacgcagtgaaattttcccagtatttctatgaggctccgattttcaccattccaggccggacatatcccgtcgaaatcctttacacaaaggagcctgaaacagattacctagacgcatctcttatcacagtcatgcagattcatttgactgagcccccaggggacattctcgtgtttcttactggacaggaggaaatcgatacagcttgcgaaatcctgtacgagcgcatgaaatccctgggcccagacgtgccagaacttataatcctgcctgtctacagcgcgctcccgagtgaaatgcagactaggattttcgatccggctccccccgggtccaggaaggtggtcatcgccaccaacattgcagaaacttctctgaccatcgacggtatatattacgtggtggaccctggcttcgtcaaacagaaggtgtataatagcaaaacgggtatcgaccagttggttgttacccctataagtcaggcacaggcaaaacagcgggccggcagggctggtcgaactgggcccggcaaatgctaccggctgtacactgagagggcttaccgggatgagatgctgacaacaaatgtgccagaaatacagcggacgaacctggcctccactgttctatctctcaaagccatggggatcaatgatttgttgagcttcgatttcatggacgccccccccatggaaacactgattaccgccatggagcagctgtacaccctaggtgcattggacgacgagggcttactaacacgcctggggcggcgtatggcggagtttccactggaacccatgttgtgtaagatgctcattatgtcagtgcacctcgggtgttcagaagagatgctcactattgtgtcaatgctaagtgtgcagaatgtgttctaccggcccaaagataaacaggccctggcagatcagaaaaaagctaagttccaccagacggaaggggatcacctgactctcctcgccgtatacaacagttggaaaaacaacaagttctctaatccgtggtgttatgagaatttcatccaggcaaggtcgcttcgtagagcccaagacatacgcaagcagatgttgggtatcatggatagacataaactggacgtcgtgtcgtgtggaaagtctacggtcagggtgcagaaggccatttgctcaggctttttccgcaatgccgccaagaaggatccacaggagggatacaggaccctgattgaccaacaagtcgtctatattcatccatcaagtgcgctctttaacagacagccggagtgtccaaagcattttctgcctgtcgtcgctgttgcagtttctttggagcagtgcctctctaagttcgaagatctgaataaggaattgggattggtcacctgctag

SEQ ID NO: 114190 - DNA, 3813 bp, Artificial Sequence
  Description of Artificial Sequence: Synthetic coding sequence
atgggtgacgtgaaaaattttctgtacgcctggtgcggaaagcggaaaatgaccccctcctatgagatcagagctgtcggtaacaaaaacagacaaaaattcatgtgtgaagtccaggtcgagggatacaactacacagggatgggaaacagcactaataagaaagatgcacagagtaacgctgcacgcgactttgtgaactacctggtcagaattaacgagataaaatccgaggaagtgcctgcttttggcgtggcttcaccaccgcccctgacggacacacctgatactacggcgaatgctgagggcgatctccccaccactatgggaggtcccctgcccccccacctcgccctcaaagctgagaacaacagcgaggtcggtgcttctggctatggcgttccaggtcctacatgggaccgcggtgctaacttgaaggactactatagtcggaaggaggagcaggaggtccaggcaaccctagaaagtgaagaagtcgatctgaatgccggtcttcacggcaactggacacttgagaacgcgaaagcgcgcttgaaccagtattttcaaaaagagaagattcaaggcgaatacaagtatactcaggtgggtcccgatcataatagatcattcattgcggagatgaccatatatatcaaacagttgggcagaaggattttcgctagggagcacggcagtaataaaaaattagccgcccagtcttgcgcgctgtctctggtccgtcagctgtaccatcttggggtagtcgaggcctattccggccttacgaaaaagaaggaaggcgagactgtggaaccttataaggtcaacctgtctcaagacctagagcaccagctccaaaacatcatacaggagttgaacctagagatcttgcccccgcccgaagatcccagtgttcccgttgctctcaatatcggcaaactggcacaattcgaaccgtctcagaggcagaaccaggtgggtgtggtaccatggtcacccccacagagcaactggaacccctggaccagctcaaacattgatgaaggaccactcgcctttgccactccagagcagatttcgatggatttgaagaacgaactgatgtaccagctggaacaagaccacgaccttcaggcgattttgcaagagcgcgaactcctgccagtaaagaagtttgaatcagagatcctcgaggccatcagccagaacagtgtcgtgattatccgcggggctactggatgcgggaaaacaacccaggttccgcagtttattctggacgactttatccagaatgaccgtgccgccgagtgtaatatcgtggtgacccagccacgcaggatcagtgccgtcagtgtagctgagcgtgtggcattcgaaagaggtgaggaacctgggaagagttgcggttactccgtgcgatttgaatctatcctcccgcggccacatgctagcataatgttttgtaccgttggggtcctcttgcgaaagttagaggccgggataaggggaatctcccacgtaattgttgatgagattcatgagcgagacattaacaccgactttctgctcgtggtccttagagatgtggtccaggcctacccggaggtaagaatagtgctgatgtccgctaccattgatacatccatgttctgcgaatattttttcaattgccctatcattgaggtgtacggccgtacctacccagtgcaggagtactttctggaagactgtattcagatgactcatttcgtccctcctcccaaggataagaagaagaaggataaagatgatgacggtggggaggatgatgatgctaactgtaatcttatctgcggggatgaatacgggcccgaaaccagattgagtatgtctcaacttaatgaaaaggagacccccttcgagctgatagaggcactgctgaagtatattgagactctgaacgtaccgggcgcagtactggtttttctcccaggttggaatctgatttatacaatgcaaaaacatcttgagatgaaccctcatttcggatctcacagatatcaaattctccccttgcacagccagattccccgcgaggagcaaaggaaggtgtttgatcccgtgccagtaggcgtgacaaaagtcatcctgagcaccaatatcgctgaaacaagtatcacgatcaacgacgtggtgtatgttattgacagttgcaagcaaaaggtgaaactatttacagctcacaataatatgacgaactatgcaactgtgtgggccagcaagactaacctggaacaaaggaagggcagagcaggccgagttagacccggtttctgcttccatctctgttcacgagctaggttcgaacgtctagaaacacatatgacccccgaaatgttccgcactccgctgcacgaaattgcgctctcaattaaactcctcagactcggtggtatcggacaattcctcgcaaaggcaattgagcccccccccctggacgctgtgatagaagcggagcacacccttcgcgaactcgatgctttggacgcgaacgatgaactgaccccacttggaagaatcctggccaagttacctatcgaaccacgattcggcaaaatgatgatcatgggatgtatcttttacgtgggagacgcaatttgcactatagccgccgcaacctgcttccctgaacccttcatcaacgagggaaagcgactcggctatattcacagaaacttcgcggggaatagattcagcgaccacgtcgccctcctatcagtcttccaagcctgggatgacgccagaatgggaggagaagaagcagagatccgcttttgtgagcacaagaggctgaacatggccaccctacgaatgacctgggaagctaaggtgcagctaaaggagatcctgataaactctggatttcctgaggattgtctgctgacacaggtgttcaccaataccggacctgacaacaaccttgacgttgtgatctctctcctggctttcggcgtatatccgaacgtgtgttaccataaagagaaacggaaaattctcacaaccgaggggaggaacgcattgatccacaaatccagcgtaaactgcccttttagcagtcaggacatgaagtatccaagccctttcttcgtttttggtgaaaaaattagaactcgcgccatcagtgcgaaaggtatgactctggttacccccctacaactgttgttgtttgcatcgaagaaagttcagagcgacggacaaattgtactcgtggacgattggataaaacttcagattagccacgaagccgccgcatgcattactggactacgcgcggccatggaggctttggtggtggaggtgacaaagcagccagcaatcatcagccaactggaccctgtcaacgagcgtatgttgaatatgatccgacaaattagccgcccctccgcagcgggaatcaatctgatgatcggatccactaggtacggggacggacctcgccctcccaaaatggccagatacgataatgggtccgggtataggaggggtgggagcagctatagcggtggtggttatggcggtggctattcaagcggaggatacgggtcaggagggtatggcggaagcgctaattcattccgagccggatatggagcaggagtcggtggcggctataggggtgtgtcccgtggcggttttcgcggaaactcagggggcgattatcgaggcccgagtgggggctacagaggtagtggcggatttcagcgcggcggcggccggggagcttatggtaccggctatttcgggcagggccgcggagggggcggctactag

SEQ ID NO: 114191 - DNA, 1800 bp, Artificial Sequence
  Description of Artificial Sequence: Synthetic coding sequence
atgggagacgtgaaaaacttcttatacgcatggtgtggcaaacgaaagatgacaccaagttatgaaattagagccgtaggcaacaagaatcgtcagaaatttatgtgcgaagtccaggtggaggggtataactacacgggcatgggaaactctacgaataaaaaagacgcgcaatcgaatgccgcgagggatttcgtaaattacttagttcgcattaatgaaattaaatcggaggaggttcccgcttttggcgtggcatctccccctccgttgactgacaccccggataccaccgccaatgctgaaggggatctgccgacaacaatgggcgggccgctgccccctcatcttgcactcaaggcagagaacaatagcgaggtgggagcttcagggtacggcgtccccggcccaacctgggaccggggcgctaatctgaaggactactactcgcgtaaggaggagcaggaagtgcaagctactctggaatcagaggaagtggatctcaatgcggggttgcacggaaattggacattggaaaatgctaaggcacggctcaaccagtacttccagaaggaaaagattcagggtgaatataaatatactcaagtcgggccggaccacaatcgcagctttatcgcagagatgaccatctacatcaagcagcttgggcgtcgcattttcgcgagagagcacggatcaaacaaaaaattagcagcccaaagctgtgccctgagcttagtgaggcagctgtatcacctaggtgtggtcgaagcatacagcggattgacaaagaagaaagagggggaaactgtggagccttacaaggtgaacctgagccaggacctggaacaccagttgcaaaacataatccaagagctgaacctggagatacttcctccgccagaagacccatctgtaccagtggccctcaatattggcaagctggcccagtttgagccatctcagagacagaaccaggtcggggtagtaccctggtcacccccacaatccaattggaacccctggacatcctccaatattgacgaaggacccctcgccttcgcaacaccagagcagatctccatggatctgaaaaacgagcttatgtatcagctggagcaagatcatgacctacaggccatcctccaggagcgcgaactgttacccgtcaagaagttcgagtctgagattctggaagcaatctctcagaattcagtggtcattatcagaggagccaccggctgcggtaagacaactcaggtgcctcagttcatcctggatgactttattcagaacgatcgcgctgccgaatgcaatatcgtagtaacccaacctaggcgtatttccgctgtgtctgttgcagaaagggtggcgttcgaacggggggaagaacctggaaagtcatgtggttactctgtgcggttcgaaagcattctgccacgccctcacgcgagtatcatgttttgcaccgtgggagtgttgctgcgaaaattagaggctgggattcggggtatatcccacgtcatcgttgacgagatccatgaaagagacataaatactgacttcctgcttgtagtactgcgagatgtggtgcaagcctaccctgaagtgagaattgttttaatgagcgcgaccattgatacatctatgttctgtgagtattttttcaattgcccgatcatcgaggtttacggccggacctatccagtgcaggaatacttcctcgaagattgcatacagatgacccactttgtgcctcccccaaaagacaagaagaaaaaagataaaaagaagaaatag

SEQ ID NO: 114192 - DNA, 1197 bp, Artificial Sequence
  Description of Artificial Sequence: Synthetic coding sequence
atgatgttgaagggcataactcgcctgattagtagaattcataagctcgatcctgggaggtttctgcacatggggacacaagctagacaaagcattgccgcacatttggacaaccaggttcctgtggaatcccctagagccattagccgtaccaacgagaatgatcctgctaagcacggagatcagcacgagggacaacattacaacatcagtccccaggatctcgagaccgttttcccccacggactacctcccagattcgtgatgcaggttaagacatttagcgaggcctgtctcatggttcgtaagcctgcacttgagctgcttcactacctgaaaaacacttcttttgcctaccccgctatccggtatctcctgtacggagagaagggcaccgggaaaacactgagtctgtgccacgtgatccatttctgtgcgaagcaggattggttgatcttgcacattcctgatgcgcatctgtgggttaagaattgtagagacctgctgcagagctcttacaacaagcagcgctttgatcaacctctggaggcctctacctggctcaagaactttaagacaacaaacgagcggtttctgaatcaaattaaggtgcaggagaagtatgtgtggaataaaagagagagcacagagaagggtagtcccctgggggaggttgtggagcagggcataacacgggtgcggaatgccacagatgcagtgggcatcgtgctaaaagagctgaagagacagtcctctttaggtatgtttcacttgctggttgcagtggatggaatcaatgctctatgggggcggaccacactgaagcgcgaggataaaagccctatcgcccccgaagaattagcgctcgttcataatctgaggaaaatgatgaagaacgattggcatggtggggctattgtgtccgccctcagtcaaacaggttccctgtttaagcctcgcaaggcgtacttgcctcaagagctgttaggaaaagaagggttcgatgcattagacccattcatccctatcttggtctcaaactacaatcctaaagaatttgagtcttgtatacaatactacctggaaaacaactggctccaacacgaaaaggccccaacagaagagggcaagaaggagttgttgttcctctcaaacgccaatcctagtttgcttgagagacattgcgcctatctttag

SEQ ID NO: 114193 - DNA, 1197 bp, Artificial Sequence
  Description of Artificial Sequence: Synthetic coding sequence
atgatgctgaaaggcatcactcggctgatttctcggattcataaactggaccctgggcgcttcctgcacatggggacccaagctcgacagtctattgctgcacatctggacaaccaggtgcctgtggaatcaccacgcgctatcagccgcacgaacgaaaatgaccccgcaaaacacggtgaccaacatgagggacaacactacaatatttccccacaggacctggagacagtcttcccacacgggcttcctccccggttcgtaatgcaggtcaaaacctttagtgaggcttgtcttatggtccgtaagccagcgctggagctgctccattacttgaaaaacacctcttttgcctatcccgcgattcggtaccttctatacggtgaaaaaggcaccggaaaaactctgtccctatgccatgtaatccacttctgtgcaaagcaggattggctcatcctgcacattcctgatgcgcacctctgggttaaaaattgccgcgacctcctgcagtcttcatacaataagcagcggtttgaccagccactggaggcttctacatggttgaagaacttcaaaacaaccaatgagagattcctcaatcagatcaaagtgcaggaaaaatatgtttggaacaaacgggagagcaccgagaagggttctcccctcggtgaggttgttgaacagggtattactcgcgtgcggaacgctacagacgctgtggggatcgtgctcaaggaactcaaaagacagagctctctgggcatgttccacctcctggtggccgtcgatgggattaacgccctgtggggcaggacaaccctaaagagagaggataagtccccaatcgctcccgaagagctggccctggttcacaatctgagaaagatgatgaaaaacgactggcacggaggagcaattgtgagcgctctatcccagacaggctcgcttttcaaaccgcgtaaagcctatcttccgcaagaactcttgggaaaggagggcttcgacgcattagacccgtttattcccatcctggtgtcaaactacaatccgaaggagtttgagagctgtatacagtactatttggagaacaactggttgcagcacgagaaagcacccaccgaggaaggcaagaaggagctgttattcctgagcaatgcaaacccttctctactcgaacggcactgtgcatacttgtag

SEQ ID NO: 114194 - DNA, 1095 bp, Artificial Sequence
  Description of Artificial Sequence: Synthetic coding sequence
atgatgctcaaagggattactcgcctgatatcccgcatccacaaactggacccgggtcggtttctccacatgggcactcaggcccggcagtccatcgctgcacatctcgataaccaggtcccagtagaatcaccaagggctatctctaggacaaatgagaacgacccggtgaaaacattcagcgaagcctgcttaatggtgcgcaaacccgcacttgagttattgcactacctgaagaacacttcttttgcctacccggctattcgctatctgctgtacggcgaaaaaggcaccgggaagacactctcattatgccatgttattcacttttgcgctaagcaggattggctgatcctgcatattcccgatgcgcacctgtgggtgaagaattgcagggacctcctccagagctcttacaataaacagcggttcgaccagcctctggaggcttcaacctggctgaagaattttaagacgactaatgagagattcttgaatcagatcaaggttcaggagaagtacgtatggaataagcgtgaatcgacagagaaagggtcacctctgggagaggttgtggagcaaggcatcacgagagtgcggaatgctaccgatgccgtcggcatagttctgaaggaacttaagagacagagcagcctcgggatgtttcacctcctggtggctgtggatggaatcaacgccttgtgggggcggacaacactgaagagagaggacaagagccccatcgcccccgaagaactcgccttggtgcacaatctgcggaagatgatgaaaaatgattggcatggcggcgcgattgtctctgccctgagccagactggtagcctgtttaagccccgcaaggcttacctcccacaagaactgcttggaaaggaggggtttgacgcccttgatccattcatcccaattctcgtgtcaaattacaacccaaaagaatttgagtcctgcatccagtattatctggagaacaattggctccagcacgagaaagctcccactgaagagggcaaaaaggaacttctgtttctgtccaacgcaaaccccagcctccttgaaaggcattgtgcctacttatag

SEQ ID NO: 114195 - DNA, 1074 bp, Artificial Sequence
  Description of Artificial Sequence: Synthetic coding sequence
atgatgcttaaggggataacccggctgattagccggatccacaaggccaagcacggcgatcagcacgaagggcagcactacaacattagccctcaggatctcgaaaccgtattcccccacggcctcccacccagattcgtcatgcaggtgaagacatttagtgaggcttgtttgatggtcaggaaaccggcactagagcttctccattacctgaaaaatactagctttgcctaccctgcaatcaggtacctgctgtacggcgagaaaggcaccggaaagactctctctctgtgccatgtcattcacttttgtgctaagcaagattggctcatactgcatattccagacgctcatctctgggtgaaaaactgccgggacctcttgcagagcagctacaataaacagcgcttcgatcagcctttggaggcatccacttggctcaaaaatttcaaaactactaatgagcgcttcctcaaccagatcaaggtgcaggagaaatacgtgtggaataaacgggaaagcacagaaaagggttctcccctgggcgaggtggtggagcaggggattaccagggttcgcaatgccacggatgctgtgggaattgttctcaaagagctgaaaaggcagtcttcactcgggatgtttcatcttctcgtagccgtagacggaataaacgccctgtgggggcgcacaacgttgaaacgtgaggacaagtcccccatcgctccagaagagctggccctggtgcacaacttgaggaagatgatgaagaatgactggcatgggggcgcgatcgtttctgccctgtcccaaacgggctctctcttcaaaccccggaaggcttatctgcctcaggaattgctaggcaaggaggggttcgacgcgctcgaccctttcattcctatcttagtgtccaactacaatcctaaagagtttgagtcgtgtatccagtactacctcgagaacaattggttgcaacatgagaaggcacccactgaagagggaaagaaagaattactgttcctgtctaacgccaacccgtccctgctggagcgacactgtgcctacttgtag

SEQ ID NO: 114196 - DNA, 1047 bp, Artificial Sequence
  Description of Artificial Sequence: Synthetic coding sequence
atggccgggctgaaacgacgcgcatcgcaagtttggcctgaagagcatggggagcaggaacacggtctctacagcctgcacagaatgttcgatatcgttggcacccatcttacacatagggacgtccgcgttctgtctttcctgtttgttgacgtgattgacgaccacgaacgcggattgattcgcaatgggcgtgattttctcctagccctggagcgccaaggtcgctgtgacgaaagtaatttccgacaggtcctgcagctgcttcgaatcatcaccaggcatgacctcctgccctacgtgacacttaaacgtcggagagctgtctgtccagatctggtggacaaatacctagaagagacctccataaggtatgtgactccacgggccctctctgacccagaaccgagaccacctcaaccaagtaagaccgtgccccctcactatcctgttgtctgttgccctacatcagggccacaaatgtgctccaaacgcccagccagaggaagggctacgctggggtcccagaggaagcgcagaaaaagcgtcactcctgatcctaaagaaaagcaaacctgcggcgaggaagtgcaaggattccaacggtggtccagactcgagggggaatataaggagctgctcggccattgggcagtttacgctatacagtatatacgattgagggtgagggccgaatactgtcagcatgagacagccttgcaaggcaatgtctttagcaacaagcaggatccactggagcgccagtttgagagattcaaccaggcgaacaccattctgaaaagtcgagatctgggcagtatcatctgcgacatcaaattcagtgaactgacctatttagatgcgttctggcgggattatattaatggctccctgttagaggcgcttaagggagtatttatcacagattccctgaagcaggcagtgggccacgaggccataaagctcctcgtgaacgtggacgaagaggactatgaactcggcagacagaagctgctgagaaacttgatgctccaggccctaccctag

SEQ ID NO: 114197 - DNA, 957 bp, Artificial Sequence
  Description of Artificial Sequence: Synthetic coding sequence
atggccgggctaaaaaggagggcttctcaggtttggcccgaagaacacggagagcaagaacatgggctgtatagtctccaccggatgttcgacattgttggaacgcacctgacgcaccgtgacgtgcgggtgctctcctttttgttcgtggacgtaattgacgatcatgagcgaggacttattagaaatggccgggatttcttgcttgccctggagaggcagggacggtgcgacgaatctaattttaggcaggtgctccagctactaagaattattacaagacacgatttgcttccctatgtaaccctgaagaggaggcgggccgtctgcccagacctggttgacaaatatttggaggagacttctatccgctacgtgacaccccgggccctgtccgacccagaaccacgccctcctcagccatccaaaaccgtccctccacactaccccgttgtttgctgcccaacaagtgggccacagatgtgcagcaaacggcccgccaggggcagggctaccctgggaagtcagagaaagagacgtaaatccgtaaccccagatcccaaggaaaaacaaacttgtgatatcagactgagggtgcgcgctgaatattgtcagcatgaaaccgccctccaaggcaacgtgtttagtaacaagcaggatccactggaacggcagttcgaacggtttaaccaggcaaacactattttgaaatcacgggacctgggcagcattatatgcgacatcaaattcagtgaactaacctatttggatgcattctggagggactatatcaacggctctttgctggaagcacttaagggtgtgtttattaccgacagcctgaaacaggctgtagggcatgaagctatcaagctcctcgtgaacgtggacgaggaggactacgaactgggtagacagaagctgctccggaatctgatgttgcaggcactcccttag

SEQ ID NO: 114198 - DNA, 1047 bp, Artificial Sequence
  Description of Artificial Sequence: Synthetic coding sequence
atggccggactgaagcggagggcaagccaagtatggccagaggagcacggcgagcaggaacatggactttacagtctacatcgcatgtttgatatagtggggacccacctgacacaccgcgacgtgcgagtgttatcattcctgttcgttgacgtgatcgacgaccacgaacgcggactgatccgtaatggaagagactttctactagcactcgagagacaggggagatgcgacgagtctaacttccgacaggtacttcagcttttgagaataataacaaggcacgatctgctcccttatgtgactttaaagagacggcgtgcagtctgtcccgacttagtggataaatatttggaggaaactagtattcgctacgtcactcccagagctctgtccgaccctgaaccaaggccaccccagccttcgaagacagtaccccctcactaccctgtcgtctgttgtccaacctctggccctcagatgtgttcaaagcggccagccagaggacgagctacactggggtctcagaggaagaggagaaagagcgtaactccggaccccaaggagaaacaaacctgcggcgaggaggtccagggattccagagatggtccagattggaaggtgaatataaggagctgctggggcactgggctgtctatgcaattcagtacattcgactgagagtgagggctgagtactgccaacacgagaccgcactgcagggcaatgtgttctcaaacaagcaggatcctctggagcgccagtttgagcgattcaaccaggcgaatactattctgaagagtcgcgacttgggttcaattatatgcgacataaagttttccgaactcacgtaccttgacgccttctggagagactatattaacggtagtctcctagaggctctgaagggcgtctttattacggacagtttgaagcaggcagtggggcatgaggccattaagctgctggtgaatgttgatgaggaggattatgaactgggtcgccagaaactcctgaggaacttgatgctacaggccctcccctag

SEQ ID NO: 114199 - DNA, 957 bp, Artificial Sequence
  Description of Artificial Sequence: Synthetic coding sequence
atggcagggctgaaacggagggcatcccaggtgtggcctgaggagcacggcgaacaagaacacggcttgtatagccttcaccggatgtttgacattgttggtacccacctgactcatagggacgtccgcgtcctctcgtttctgttcgtcgacgtaattgacgatcatgagaggggactgatccggaatggacgtgacttcttattagctctggaacgccagggaaggtgcgatgaaagcaacttccgccaggtcctgcagctcctacggatcattaccagacacgacctgctgccttacgtaactctgaagaggaggagggctgtctgcccggatctcgtcgataagtacttggaagaaaccagtattcggtacgtgacaccccgtgctttgtctgatcctgagccacgaccgccacaacctagtaagacagtacccccccattatcctgtggtgtgttgtcctacctctggcccacagatgtgctctaagaggccagccagggggcgtgccaccctgggatcacagaggaaaaggcgcaaatccgtcactcctgaccctaaagaaaaacagacatgcgacatacggctgcgcgtccgggcagagtactgtcaacatgagactgcactccagggaaacgtattcagcaacaaacaggacccactagaaaggcagttcgaaagatttaaccaggccaatacaatcctgaaatcacgtgatctgggctccattatttgtgatattaaattctcagagctgacctacctggatgcgttctggcgcgattatatcaatggctcattactagaagcactcaagggcgtgttcatcactgacagcctgaaacaagcggtcgggcatgaggccataaaactgctggtgaatgtggatgaagaggattacgagctgggtaggcagaagttactgcgaaatctgatgctccaggcgctgccatag

SEQ ID NO: 114200 - DNA, 828 bp, Artificial Sequence
  Description of Artificial Sequence: Synthetic coding sequence
atggccggactgaagcggagggccagtcaggtttggcctgaggagcacggagagcaagagcatggactgtatagtcttcaccgtatgtttgacatcgtaggaactcaccttacccaccgggacgtccttcaattactcagaatcattacccgccatgacctgttaccttatgtgaccctcaagaggcgccgggccgtatgccccgaccttgtggacaagtaccttgaagaaacctccataagatatgtaactccccgtgcattatcagacccagaaccccgacccccccagccctcgaaaaccgttccccctcattacccagtggtctgttgcccgacatccggtccacagatgtgcagcaagagacccgcacgagggagggccaccctcggatcgcagcggaagcggcgcaaatcagtgacccccgatcccaaggagaaacagacctgcgacatacgtttgcgagtgagggcagagtattgccagcacgagacagctctccagggcaatgtgttctctaataagcaggacccactggagaggcaattcgagagatttaaccaagctaacacaatcctcaagagccgggatcttggctctatcatttgtgacataaagtttagcgaactgacctacctcgacgccttctggagagactacataaacggtagcctcctcgaggcattaaagggggtgttcatcacagactccctgaagcaggcagtagggcacgaggccatcaaactcctggtcaacgtggacgaagaggactacgagttggggcggcaaaaactactgagaaacctgatgttacaggctttgccctag

SEQ ID NO: 114201 - DNA, 957 bp, Artificial Sequence
  Description of Artificial Sequence: Synthetic coding sequence
atggccggcctgaagcgacgtgcttcgcaggtctggcctgaagagcacggcgagcaggaacacggcctctattctctccaccgcatgtttgatatcgtgggcacacatctcacccacagagatgtgcgcgtgctttcgtttctgttcgttgatgtcattgatgaccacgagagaggactgattcgcaacggaagagacttcctgctggcgcttgaacgtcaggggagatgcgatgagagtaattttcgtcaggtgctacagctcctccgaatcatcacgcggcatgacctgctcccatacgtaacactgaagaggagaagagctgtttgcccggaccttgtggacaagtacttggaggagacttctatcaggtacgttacgccacgagccctgtctgatcccgagcctcggcctcctcaaccctccaagacagtgccccctcactacccagtggtatgctgcccaacgtcaggtcctcaaatgtgttccaagcgccccgcacggggccgggcaaccctgggctcccagaggaaacgccgtaagagtgtgacaccagacccgaaggaaaagcagacctgtgacatccggctacgggtgagggcggagtattgtcagcacgaaacggctctgcagggtaacgtcttctccaataagcaggacccactggagagacagtttgagagatttaaccaggccaacactatcctaaaatcacgcgacctgggatcaatcatctgtgatatcaagtttagcgaactgacctacctggatgctttttggcgagattacatcaatggttcattgcttgaagcactgaaaggtgtttttatcacagactccctgaagcaagctgtgggtcatgaagctatcaaattgcttgttaatgtggacgaggaggactacgagctgggaaggcagaagctgctccggaatctgatgttgcaagccctcccatag

SEQ ID NO: 114202 - DNA, 957 bp, Artificial Sequence
  Description of Artificial Sequence: Synthetic coding sequence
atggccgggttgaaacgcagggccagccaggtgtggcccgaagaacacggggaacaagaacacggcttgtactccctccatcggatgttcgacatcgttgggacccatcttacacaccgcgatgtaagggtcctctcttttctttttgtggatgtgattgacgaccacgagcgtggattgattagaaatggccgggactttctgctggctttggagcggcagggaaggtgtgacgagtcaaactttcgacaggttttgcagctgttgcgcatcatcacccgtcacgacctgcttccttatgtcaccctgaaacggcgaagagcagtgtgtccagacctggtggacaagtatctcgaggagacgtcaatccgctatgtcactcccagagccctctccgaccctgagccacggccaccccagccaagtaaaaccgtgcctccacattaccctgtagtatgttgtcccacaagtggacctcaaatgtgttcgaaaagaccagctcggggaagggccactctcggctcacaaaggaaacgccgcaaatctgtgacccccgacccgaaggagaaacaaacttgcgatattaggctgcgcgtgcgggcagagtactgccagcatgaaactgccctacagggaaacgtattctctaacaaacaagacccgctggaaagacagttcgagcgctttaatcaagcgaacactatcctgaaatcacgtgacctgggtagcataatctgtgacatcaaatttagtgagcttacctatttagacgccttctggagagattatattaacggctcattgctggaagcgttaaagggcgtgtttatcacagactcgcttaagcaggctgtcggccacgaagcgattaaattactggttaatgtggatgaggaggattacgagttaggccgccagaagctactgcgcaaccttatgctgcaggcactgccttag

SEQ ID NO: 114203 - DNA, 1917 bp, Artificial Sequence
  Description of Artificial Sequence: Synthetic coding sequence
atggacttgtggcagctgctcctgacactagctttggcaggtagtagcgacgctttttccggttccgaggccacggcagcaatactttctcgggccccctggagcctgcagtctgtgaatccagggctcaaaaccaatagctccaaagagcctaaattcaccaaatgtagatctcccgagcgcgaaacattctcctgccattggacggatgaggtgcaccatggcacaaagaacctaggacccatacagctgttttacacccggcgcaacacccaggagtggacacaggaatggaaagagtgccccgattacgtgagcgccggagagaactcttgctacttcaattctagctttacaagtatatggatcccttactgcatcaagctgacgtccaatggggggaccgtagatgaaaagtgcttctcggtggacgaaattgtacagcccgaccctcccatcgcactaaattggactctgctaaatgtgtctttaacaggcattcacgccgatatccaggtcagatgggaggctcctagaaatgcagatattcagaaaggctggatggtgctggaatatgaactgcagtacaaagaagtgaatgaaaccaagtggaaaatgatggatcctattctgaccacaagcgtcccagtctatagtctaaaagtcgataaggaatatgaggttagagtgcggtccaagcaacgcaactcaggaaactacggggagttttccgaggtgctgtatgtgacgctgccccagatgagtcagttcacatgtgaagaagacttttactttccctggctcctgattatcattttcgggatattcggcttgacagtaatgctgtttgtgtttctatttagcaaacagcagaggatcaagatgctgatactgcctcccgtcccagtgccgaaaatcaaggggatcgatcctgatctcctgaaagaaggaaagctggaggaggttaacactatactggcaatacacgactcatacaaacccgaattccatagcgacgactcatgggtagagttcatcgagcttgacattgacgaaccagacgaaaaaaccgaggagtctgacacagatcgcctcctcagttccgaccacgagaagtctcactccaatctgggagttaaagatggagattccggcaggaccagttgttgcgaacccgatatcctcgaaaccgacttcaacgccaatgacatccacgagggtacctccgaagtagcacagccccagaggctcaagggagaggccgatctcttgtgcctggatcagaagaatcagaataactccccttatcatgacgcctgtcctgctacccagcagccatccgtcattcaggctgagaaaaacaaaccccagccattgcccaccgaaggagctgagtctacacatcaggccgcccacatccagttatccaatcccagcagcctgtctaacatagatttttacgcacaggttagtgatattactccagctgggtcagtggttctctcccccgggcagaaaaataaggcagggatgagccagtgcgacatgcaccctgagatggtgagtctatgtcaggagaactttttgatggacaacgcttacttctgcgaagccgacgcaaagaagtgcatccctgtggcaccccatataaaagtggaatcacacattcagcccagccttaatcaggaggacatatacattacgaccgaatctctaaccactgcggccggccgcccaggcacaggcgagcacgttccagggagtgagatgcccgttcccgactatacctccatccacatagtgcaatctccccagggtttaattctgaatgctacagcactgcccctacccgataaagaattcctgtcctcctgcggctacgtctccacagaccaactgaacaagataatgccctag

SEQ ID NO: 114204 - DNA, 1113 bp, Artificial Sequence
  Description of Artificial Sequence: Synthetic coding sequence
atgttccaggccagtatgaggagcccgaacatggagccttttaaacagcagaaagttgaggacttttatgacatcggagaggagctgggatctgggcagttcgcaatagtcaaaaagtgcagggaaaaaagcaccggactcgaatacgctgcaaagtttatcaagaagcggcagtcccgcgcctcgcgacgcggggtgtcccgggaagaaatcgagcgagaggtttcaattctgcgccaggtgctccaccacaacgtgatcacgttgcatgatgtgtatgagaatagaacagacgtggtactcattctggagctcgtcagtggaggggaattattcgattttctcgcccagaaggagtccctgagtgaggaggaggccacaagcttcataaaacaaattctcgacggggtcaattacctacacacaaagaaaattgcccactttgatttgaaaccagaaaatatcatgctcttggataagaacatacctatcccacacatcaagcttatagacttcggcttagctcacgagattgaagacggtgtggagtttaaaaacatttttggcaccccagaattcgtggcaccagagattgttaactacgaacccttagggctcgaagctgacatgtggagcatcggcgtcataacatatatcctgctaagcggggcctcgccgtttctgggggacaccaagcaggagacattagcaaacatcaccgctgtgtcttacgactttgatgaagaattctttagccagacatcagaactggccaaggatttcatccggaagctcctcgttaaagagactaggaaacggctcaccattcaggaagcacttcgccacccttggattaccccggtagacaatcaacaagccatggttcggagggaatctgtagtcaatttagagaacttccggaaacagtatgtcaggagacggtggaaactgtcgttcagcattgtgagcctgtgcaatcacctcacaaggtcccttatgaagaaggtgcacctgaggcctgatgaggatcttcggaattgtgagagcgatactgaggaggacattgcccgcaggaaagctttacatccaagacggaggtctagcacttcttag

SEQ ID NO: 114205 - DNA, 1113 bp, Artificial Sequence
  Description of Artificial Sequence: Synthetic coding sequence
atgtttcaggctagcatgcgcagtccaaatatggaaccgtttaaacagcaaaaggtggaagacttctatgatattggggaggagctgggaagcggccagtttgccatcgttaaaaagtgtagggaaaagtccaccggactggaatatgccgctaagtttatcaagaaacggcagagcagagcaagtagaagaggagtttccagggaggaaatcgaacgtgaagtgtccattctcagacaggtgcttcatcacaatgtgattacactgcacgacgtttacgagaatcggactgacgttgtgctgatcttggaattagtctcaggcggagaacttttcgacttcctcgcccagaaggagagcttatctgaggaggaggccactagcttcataaaacagatcttggacggagtgaactatctccacacaaaaaagattgcacacttcgatcttaagcccgaaaacattatgctgctcgacaaaaacattccaattcctcatataaagctcatagactttgggctcgcccacgagatcgaagatggcgtcgaatttaagaatattttcgggacacctgagttcgtggctcccgaaatcgtgaactacgaacccctggggctggaggctgacatgtggagcataggagtgattacatatatactcctttcaggtgcttctccattcctgggggatacaaaacaggaaacgctggcaaacatcaccgctgtttcttatgattttgatgaagagtttttctcacagacgagcgagcttgcaaaggacttcatcaggaaactccttgtaaaggaaactcggaaaagactcactatacaggaagcattgcggcacccctggattacacctgtggataatcaacaggccatggtacggcgcgagtcagtagtgaatcttgagaatttccgtaagcagtacgttaggaggcgctggaagctgagctttagtatcgtcagtttatgtaatcatctgacgaggagccttatgaagaaagtgcatttaagacctgatgaagacctgcgcaattgcgagtcagacacagaggaggacatcgcccgaagaaaagccctgcaccccaggaggagatcttccacttcttag

SEQ ID NO: 114206 - DNA, 246 bp, Artificial Sequence
  Description of Artificial Sequence: Synthetic coding sequence
atgtttcaggccagcatgaggtcacctaacatggaaccgtttaaacagcagaaggtggaagacttttacgacattggcgaagaattaggaagtggacagtttgccattgtgaagaaatgcagagagaaatcaaccggcctggaatatgccgccaagtttattaaaaagcgccagtcccgagctagtcgtagaggggtgtcgcgcgaagaaatcgagagagaggtcagcattctgaggcaggtgtag

SEQ ID NO: 114207 - DNA, 2223 bp, Artificial Sequence
  Description of Artificial Sequence: Synthetic coding sequence
atggccaccgccaactccataatcgtgctcgatgacgacgacgaggacgaggccgctgcccagccaggcccttcacaccccctgcccaacgcggcgtcgccgggagcagaggccccttctagttccgagccccacggggcaagaggatctagctcctccggaggaaaaaagtgctataagctggaaaacgagaagctgtttgaagagttcctggagctgtgcaagatgcagacagctgaccaccccgaggtagtgccttttctgtacaacagacagcagcgagcacactctctgtttctggcatcagctgagttttgtaacatcctgtcacgagtcctctctcgcgcacgctcccggccagctaagctgtacgtctacataaatgaactctgcactgtcctgaaggcccactctgccaaaaagaagctgaacctggcccccgcagctacaacaagtaatgaaccttctggaaacaatccgcccacccatctgagtctggatcccacgaacgcagaaaacacggcttcacagtctccccggaccaggggctcgaggaggcagattcagagactcgagcagctactagccttgtacgtggccgagattcggcggttgcaggagaaggaactagatctgagcgagttagatgacccagattccgcatatcttcaggaagccaggctaaagagaaagctaattagactattcggacggctatgtgaactgaaagactgttcgtccctcactggtcgggttatcgaacaacgtattccataccgggggacgcggtaccctgaggtcaatagacggattgagcggctcattaacaagccaggccctgacacgtttcccgactatggggacgtcttgcgggctgtcgaaaaagctgcagcacgtcatagtctaggattaccaaggcagcaattacagttgatggcacaggatgcgtttcgagatgtaggcattaggcttcaggaacgtcgccatttggatctcatttataacttcggctgtcacttaacagatgattatcggcccggcgtggaccccgctttgtccgatcccgtgttagcacgcagactgagggagaaccgcagtcttgcgatgagtcggctggatgaggtgatttccaagtacgccatgctgcaggacaagagtgaagaaggggagaggaaaaagaggagagcacggctgcagggcacctcctctcacagcgctgacactcccgaggcttctttagactctggagagggccccagcggcatggcctctcagggttgtcccagcgctagtcgagccgagacggacgatgaggacgacgaagagagtgacgaggaggaagaggaggaagaggaggaggaagaagaggaagccacagactctgaggaggaagaggatttggaacagatgcaggagggccaagaagacgacgaggaagaagacgaggaagaggaagccgctgctggtaaggatggggacaagtctccgatgagctctctgcagatctccaacgaaaaaaaccttgaacccggtaagcagatttcccgtagcagcggggagcagcagaacaaaggacggattgttagcccatctttgctgtctgaggagcctcttgccccctcatccattgacgctgaatcaaacggggaacaaccagaggagttgaccctcgaagaagagtctcctgtgtcccagctgtttgagctggagatagaagccctccctctcgatactccctcatctgtagaaacagatataagcagctcgcgtaagcagtccgaggagccctttaccacggtgcttgagaatggagcgggaatggtgagctccaccagttttaatgggggcgtgtcccctcataattggggcgacagcggtccgccttgcaagaagagcagaaaggaaaaaaaacagacaggctccggccccctggggaattcctatgttgaaaggcagcgctccgtccacgaaaagaatggaaaaaaaatctgcaccctgcctagtcccccaagcccactcgcttcactggccccagtggcggatagtagtactcgcgttgactctcctagccacggacttgtaacctcctccctgtgcatcccgagcccggctcggcttagccagactccccatagccagccgcccaggccggggacctgtaagacatcagtcgctacccagtgtgatcctgaggagattatcgtattatccgattctgattag

SEQ ID NO: 114208 - DNA, 2223 bp, Artificial Sequence
  Description of Artificial Sequence: Synthetic coding sequence
atggccacagccaacagtattattgttctggatgatgacgatgaggatgaggctgctgcccaacccggaccttcccatccattgccaaatgccgcctctcccggagctgaggccccgagttctagcgaaccacatggcgctcggggcagtagctcttctggggggaagaagtgttacaaactagagaacgaaaaacttttcgaggagtttctggagctatgtaagatgcagaccgccgatcatcctgaagtcgtgccatttctgtacaaccgccaacagagagcccacagtctcttcttagcgtctgcagaattttgcaacatcttgtcccgggtgttatcacgagcaagatcccgtccggccaagctctatgtgtacatcaacgagctgtgtacagtgctgaaagcccactccgccaagaaaaagcttaatttagctccggcggctacaacttcaaacgaaccctctggcaacaatccacccactcacctctctctcgatcctacaaacgccgaaaacaccgccagtcaaagccccaggacacgcgggtcacgaaggcaaattcaacgtctggaacagctcttggccttatacgtcgctgaaattaggaggctgcaggaaaaggagctggacctgagtgaattagacgacccggactctgcttacttgcaggaagccaggctgaaaaggaaactgatccgactatttggtcggctgtgcgagttgaaggattgctcgtcgcttacagggcgcgtgatcgaacagagaatcccttaccggggaacaaggtacccagaagtgaaccgccggattgaaagattgataaataagccaggcccagacacatttcctgattacggggacgtgctcagagccgtcgagaaggcagcagccagacacagcctgggactaccccgtcaacaactgcagctgatggcccaggatgcattccgcgatgtgggcataagactgcaggaacgaaggcatctggacctgatttataacttcggctgtcatctgactgacgactaccgtcctggagtggaccctgctctgtctgatccagttctcgctcggcggctgagagaaaatcgaagcctcgccatgtctcggctcgatgaagttatttccaagtacgctatgctccaagacaagtcagaagagggtgaacgaaagaagcgccgggcccgactgcaaggcactagttcacactctgcagacacccccgaggctagtttggactccggcgaaggcccttccggaatggcttcacaaggatgtcccagcgcttctcgagccgaaactgacgacgaggatgatgaggagtccgatgaggaagaagaggaggaagaagaggaggaagaggaagaggccaccgactccgaggaagaggaagatttggaacagatgcaggagggtcaagaagacgacgaggaggaggatgaggaggaagaagccgcagctggcaaggacggggacaagtctccaatgtcctcccttcagattagtaacgaaaagaatctagaacctggaaaacaaataagcaggtcatccggggagcagcagaataaagggagaatagtatccccatccctgctgtcggaggaacccctcgctcctagctctatcgacgcggagagtaacggcgagcaacctgaggagttaacactcgaggaagaaagcccagtgtcccagctgtttgaactagagatcgaagctttgcctctggatactcccagctcggtggagacagatatcagtagctctagaaagcagtccgaggaaccattcaccaccgtgctggagaatggtgcagggatggtgagtagcactagtttcaatgggggggtctctccacataactggggggactcaggaccaccttgtaagaaatctcggaaggagaaaaaacagacaggttccggcccactcggaaattcttacgtcgaacgtcagcggagcgtgcacgaaaagaacggcaaaaagatatgtactttacccagccccccaagcccgctggcttccttagctcctgtggctgatagttctacaagggtcgattcaccttcacacggactggtgaccagctccttatgcatcccttctcctgccaggctctctcaaacaccacacagccaacctccccgacccggaacttgtaagaccagcgtggcgactcagtgtgacccagaagagattatcgttcttagtgatagtgattag

SEQ ID NO: 114209 - DNA, 2223 bp, Artificial Sequence
  Description of Artificial Sequence: Synthetic coding sequence
atggccacagctaactcaataattgtgttggacgacgatgacgaagatgaagccgccgcccagccaggcccaagccatccactgcccaatgcggcctctcctggggccgaagcaccgtcctcttccgaaccgcatggcgctagaggtagttctagcagcggcgggaagaaatgttataaattagagaatgagaaactttttgaagaatttctggagctttgcaagatgcaaactgctgaccatcctgaggtggtaccgtttctgtataacagacaacagagagcccactcactatttcttgccagtgcagaattttgtaacatattgagtcgcgtgctgtcccgggctagaagcagaccagccaaattatacgtctacattaatgagttatgcactgtactcaaggcacactctgccaagaagaagttgaacctcgctccagcggctacgacctctaatgagccatctggaaacaaccctcccacgcacctttctctagatccaaccaatgctgagaacactgcctcccagagcccacgcacccggggcagtaggaggcagattcagagactcgagcagctcctcgctctttatgtagcagagattcgacgattacaggaaaaagagttagacctgtcagagctggatgacccagactcagcctacctgcaggaggccaggttaaaacgcaaattgataagactgtttgggaggctctgtgaattgaaggactgttcaagcctgacgggaagggtgatcgagcagagaatcccctacagaggcacacgctaccccgaggtgaatcgtaggatcgagcgacttatcaacaaacctggcccggatacattccctgattacggggacgtgctgagggctgtggaaaaggcagccgcacgtcactctctggggctgccacggcagcagttacagttaatggcgcaggatgcctttagagacgtgggcatccggctccaggagagaagacatctggaccttatttacaattttggctgccacctgacggatgactatcggcctggtgtagatcccgctctctctgaccccgtgctggctaggagacttcgtgaaaacaggtcactggccatgtccagattggatgaggtgatctccaaatatgccatgcttcaggacaaaagcgaggagggagaaagaaagaagcggcgggccaggctacagggcacaagttcacattccgcagacacgcccgaggcctcactcgacagcggagaagggccctcagggatggccagtcaaggatgtccatctgcctccagggccgagactgacgacgaagacgacgaagagtctgacgaggaagaggaagaagaggaggaagaagaggaagaggaagcgaccgactctgaggaggaggaagaccttgaacaaatgcaagaggggcaggaggatgatgaggaagaagatgaggaagaggaagccgcagccgggaaagacggagataaaagtcctatgtcttcactccagatatccaatgagaagaatctcgaacctggaaagcagatatccagatcatccggcgaacaacagaataaaggtcgcattgtgagtccatctttactatcagaagagccgctcgctccgagttccattgatgcagagtcgaacggagaacagcccgaagagttgacattggaggaagaaagcccagtgtctcagcttttcgagctcgaaattgaggctctgccactggacactccttcctctgttgaaacagatatatcgagctcccgaaagcagtccgaggagcccttcactactgttttggagaacggagccgggatggtcagctcaacttcatttaacgggggtgtttcccctcataactggggggactccggcccgccctgtaagaaatcaagaaaagagaagaagcagactggttccgggcctctaggtaattcttacgtggagaggcagagatcagtgcacgagaaaaatgggaaaaagatctgcactctgcccagtcccccctcccctttggcctcgttagctcctgtggctgatagttccactcgtgtagatagtccaagccacggtctggtgactagttctctctgtatacctagtccggcaaggctcagtcagactccccactctcagcctccgcgacccggcacatgcaagacttctgtggccacacagtgcgatccggaggagatcatcgtgctgtcggatagtgactag

SEQ ID NO: 114210 - DNA, 2223 bp, Artificial Sequence
  Description of Artificial Sequence: Synthetic coding sequence
atggccactgccaattcaataattgtactggacgacgatgacgaggatgaagctgccgcacagcctggaccatcccaccccctgccaaacgccgctagccccggcgcagaagctccttcttcttccgaaccccacggagccagggggtctagtagcagcggcggaaagaagtgttacaagttagaaaatgagaaactttttgaggagttcctggagctctgcaagatgcagaccgccgaccaccccgaggtcgttccttttctttacaataggcagcagcgggcacactccctgttcctggcatccgctgaattctgtaatatcctgtctagagtgctgtcaagggcaagaagccggccagcaaagctttacgtatatatcaatgagctctgtaccgttctgaaggcgcattcagctaagaaaaagctaaacctagcgcccgctgccacaacatctaatgaacctagcgggaataatccacctacacatctgtcactggatcctaccaatgccgagaacaccgcctcccagtccccacgcacgcgtgggagtcgtcggcagatacagagactggagcaattactcgcgctatatgtcgcagaaatccgtcgtcttcaagaaaaagagctcgacctgtctgagctggacgaccctgacagcgcctacttgcaagaggcccggttaaagaggaaacttattcggctgtttgggcggctctgtgaattgaaggattgttcaagccttaccggtagggtaattgagcaacgcattccataccggggcactcgataccctgaagtcaaccggaggatcgaacggcttattaacaagccaggccctgatacctttccagactacggtgacgtgcttagggctgtggagaaggcagcggctagacactctctcgggcttcctcgtcagcaactgcaactcatggcgcaagacgctttccgggacgtgggcattcggttgcaggaaagacggcatctcgacctgatatacaactttgggtgccacttgaccgacgattatcgtcctggggtcgacccggcacttagcgaccctgttctggcacgccgccttagagagaaccgcagcttagcaatgtcacggctcgatgaggttatcagcaaatacgccatgcttcaggataagtcagaagagggagagaggaagaagagaagggcacgtctgcagggcaccagctctcactccgcagatacaccagaggcttcattggattccggtgaggggccaagcgggatggcgtcccagggttgtcccagcgcatcgagggcggagacagatgacgaggatgatgaagagagcgacgaagaagaagaggaggaggaggaagaggaggaggaggaagctaccgactcagaggaggaagaagatctggaacagatgcaggaagggcaggaagatgacgaggaagaggacgaggaggaggaggccgcagcggggaaagacggtgacaagtcgcctatgagttcacttcagattagcaatgagaaaaatctagagcctggtaagcaaatctccaggtcaagtggagagcagcagaacaagggccgaatcgttagtcctagtctgctatctgaagagcccctggcaccctcaagtattgacgcggagtctaatggggagcagcctgaggaactgacgttggaggaggaatctccggtgtctcaactattcgagctggaaatcgaggctctgcctctcgacaccccatcctccgttgaaacggacatcagctcctctaggaaacagtctgaagagcctttcactactgtgttggaaaatggagccgggatggtgtcctccaccagcttcaatggaggcgtgtccccacacaattggggcgacagcggtccaccctgtaagaagagcagaaaagaaaagaagcaaactggctcaggtcccctcgggaattcctatgtggaaagacagcgctccgttcatgagaaaaatggaaaaaaaatctgtactctgcctagccctccctccccactggcctcgctagcccctgtggcggactcttcgacaagagtggactctccgagccacggtctggtcacatctagtctatgtattcccagtccagctaggctgagccagactccacattcacagccaccccgtccggggacctgtaaaactagtgtggccacccagtgtgaccctgaagaaatcatcgtgctgagcgatagtgactag

SEQ ID NO: 114211 - DNA, 393 bp, Artificial Sequence
  Description of Artificial Sequence: Synthetic coding sequence
atggccacggcaaacagcataatcgtgctggacgatgatgatgaggacgaggccgccgctcaacctggtccctcccatccgctgcccaatgctgcaagtcccggcgccgaagccccctctagtagcgaacctcatggcgctcggggtagctcctcatccggcggcaagaagtgctataaactggagaacgagaagctgttcgaggagttcctagagctgtgtaaaatgcagacagcggaccaccccgaagtggtgcccttcctatacaacagacaacaacgcgcccacagcttgtttctcgcctccgccgagttctgtaacatcctgtccagggtcctatctagagctcggtcccgaccagccaagctgtacgtgtacatcaatgagctctag

SEQ ID NO: 114212 - DNA, 147 bp, Artificial Sequence
  Description of Artificial Sequence: Synthetic coding sequence
atggctacagccaactccatcatcgtgcttgatgatgatgacgaggacgaagcagccgcacaacctggccctagtcaccctttgcccaacgccgctagtcccggagcagaagccccatcctcctcagagcctcacggagcgaggtag

SEQ ID NO: 114213 - DNA, 393 bp, Artificial Sequence
  Description of Artificial Sequence: Synthetic coding sequence
atggcaacagcgaacagcatcattgtgcttgacgatgatgatgaagacgaggccgccgcacagcccggcccgtctcatcctcttccgaatgcggcctcccccggagccgaagctccatcttccagcgagcctcatggggccaggggtagctcttcctccggaggcaaaaaatgctacaagctggaaaacgaaaaactttttgaagagtttcttgaactctgtaagatgcaaaccgcggaccaccctgaggtcgtgccctttctctacaaccgtcagcaacgggctcattcgttgttccttgcatcagctgagttctgcaacatcctctctcgcgtactgtcccgagctcgctcaaggccagccaagctgtatgtgtacattaatgagctgtag

SEQ ID NO: 114214 - DNA, 147 bp, Artificial Sequence
  Description of Artificial Sequence: Synthetic coding sequence
atggctacagccaattctattatcgtgctggacgacgatgatgaagatgaagccgcggcacaacccggcccctcccatccgctgcctaatgcagcttctcccggagctgaggcaccttccagtagcgagcctcacggagctagatag

SEQ ID NO: 114215 - DNA, 537 bp, Artificial Sequence
  Description of Artificial Sequence: Synthetic coding sequence
atggctaccgcgaactcgatcatcgtgcttgacgacgatgatgaggacgaagccgcagcccagcctgggcccagtcaccctctccccaatgctgcctcacccggagccgaagctccgtcgtccagcgaacctcatggtgcccgaggctcaagcagcagcggaggcaagaaatgttataagctggagaacgaaaaactctttgaggagttcttagaactgtgtaagatgcagacagcagaccacccggaggtggtaccctttttgtacaacagacaacagagagcccatagcctgtttctagcttccgctgagttttgcaacatactgagtcgggtcctctctagagcccggagccgccctgctaagctctacgtgtatatcaatgagttgtgtacagttctgaaggcccacagcgccaagaagaaactgaatctagcgcctgccgctactactagtaatgaaccttccggaaataatccacctactcacttgtctctcgatcccacaaatgctgaaaataccgcttctcaatcctag

SEQ ID NO: 114216 - DNA, 537 bp, Artificial Sequence
  Description of Artificial Sequence: Synthetic coding sequence
atggccaccgcaaacagcattattgtgctggacgacgacgatgaggacgaagctgctgcacagcctggccccagtcacccgctgccaaatgctgcatcacctggcgccgaagctcccagcagctccgaaccgcacggtgcccgtggatctagcagctctggaggaaagaagtgctacaaactcgaaaacgagaagttatttgaggagttccttgaactttgtaagatgcaaaccgccgaccacccagaagtcgtcccctttttatataaccgacagcagagagctcacagtctgttcctggcctccgccgaattctgtaatatactgagcagagtactcagcagggcgagatcaagaccggccaaactatacgtttatataaatgagctttgcactgtcttgaaagctcactcagcgaagaagaaactgaatctggcacctgccgctactactagcaacgaaccatctggaaacaaccctccaacgcacctgagtctggaccccacgaatgccgaaaacaccgctagtcaatcctag

SEQ ID NO: 114217 - DNA, 2223 bp, Artificial Sequence
  Description of Artificial Sequence: Synthetic coding sequence
atggccacagcgaactccattatcgtactagatgacgacgatgaggacgaagccgctgctcagccagggcccagtcatcccttgccaaacgctgctagcccgggcgccgaggcgccaagtagctcagagcctcatggagccaggggctccagctctagtggaggaaaaaaatgttataaattagagaacgaaaagttgtttgaggaatttctcgagttgtgcaagatgcaaaccgccgaccaccctgaggtggtaccatttttatataataggcaacaaagagctcactctctgtttctcgcctccgcagagttttgcaacatactatcgcgcgttcttagcagggctaggtcgcgacctgcaaagctctacgtgtatatcaatgagctgtgtacagtgctgaaggctcactccgctaagaaaaaactgaatctggcccccgcggctaccactagcaacgagccctcaggtaataatccccctacccacctgtccttagacccgaccaatgctgaaaacacagcgtcccagtcccccaggacccgcggttcaagacgccaaattcagagactggagcagctcctggctctttacgtggccgaaattcgccgccttcaggaaaaggaattggatttatccgaactggacgatcccgattccgcctatctacaggaggctcgactcaagaggaaactgatccggctttttggtagactttgcgagctcaaggactgttcctccctgacaggtagagtgatcgagcagaggataccatatcgggggactcgttaccctgaggttaataggaggatcgagcggttgatcaataaaccagggcccgacaccttcccggactacggggacgttctgagagctgtggagaaggcagcagctaggcattctttgggattgcccaggcaacaactgcagctgatggcccaggatgcattccgcgacgttgggattagactccaggagagacgacacctcgacctgatatataattttggatgccacttgactgatgattacagaccaggcgttgatccggccctcagtgaccccgtcctggcacgcaggctcagagaaaaccgaagtttggccatgagccgattggatgaagttatatctaagtacgcgatgctgcaggacaaatctgaggaaggagaacgaaaaaagcgccgcgcaagattacagggcacttcctcgcattccgcagatacccctgaagcctccctcgacagtggcgagggcccatcaggcatggcctcccaaggttgcccctcggcatcaagggctgaaacagacgatgaggatgatgaagagagtgacgaggaggaagaagaggaagaggaggaggaggaggaggaggctacagacagtgaggaagaagaagacctggagcagatgcaagaaggacaagaggatgacgaagaggaggatgaggaggaggaagcggctgctggtaaagacggcgacaaaagccccatgtcatcccttcagatctccaacgaaaagaacttggaacccgggaagcaaatcagtcgatccagcggtgaacagcagaataaggggaggatcgtctcccccagcctgttatcggaggaacccttggcgccaagcagcatcgacgccgagtcgaatggagagcagcccgaagagctgacgctggaagaggaatcaccagtctctcagctgtttgagttggagattgaagccctgcccttggacaccccttcatctgtggagacagatatatctagcagtagaaagcagagcgaggaacctttcaccacagtcctggagaacggcgcaggaatggtgagctccactagcttcaatggaggagtgagtccacacaactggggagattccggtcctccatgtaaaaagtcaagaaaggaaaagaagcagacagggtctggacccttgggcaattcttacgtggaaagacagcgaagcgttcacgaaaagaacggtaagaaaatttgtacccttccatcccccccatcacccctcgcctcactggctcctgtggctgactcatcaacacgggtcgattccccgagccatggtctcgtgacctctagtctgtgtataccctctccagcccgtctgtctcagacaccccacagccagccgcccagaccgggcacttgcaagacctctgttgctactcagtgcgatccagaggagatcattgtattatctgatagcgattag

SEQ ID NO: 114218 - DNA, 2223 bp, Artificial Sequence
  Description of Artificial Sequence: Synthetic coding sequence
atggcaacagccaacagcataatagtgctcgacgatgacgatgaagacgaggccgctgcccaaccagggcccagtcaccccctgccaaatgccgcatcacctggcgccgaagccccttcttcaagcgaaccccatggtgcccgcggctcgtcaagcagtggaggaaaaaagtgttacaaactcgagaatgagaagctctttgaggagttccttgagttatgcaagatgcagaccgctgatcacccagaggttgttccttttctgtataatcggcagcagagggcccatagcctgttcctcgcttctgcagaattctgcaatatactgagtagagttctgtcaagagcccggtctcgcccagcgaagctctacgtctacataaatgagctttgcacagtgctaaaagcacactccgcaaagaagaaattaaaccttgcaccggccgctaccaccagcaacgagccgtccggcaataatcccccaacacacctgtctctcgacccaacaaatgctgaaaacaccgctagtcagtcacctaggacccggggctctcgcaggcagattcaacgcctggagcagctccttgcactctacgttgccgaaatcagacgcctgcaagaaaaagagcttgacctgagtgagctcgacgatcctgattctgcctacttgcaggaggctcggctaaagcgcaagctgatccgactgttcggccgtctctgcgaactgaaggactgttcctcattaaccggaagagtgattgagcagagaattccctatcgaggaactcgttatcctgaagtgaaccggaggatcgaaagactgatcaacaagcccggccccgataccttccctgattatggcgatgtgctacgggctgtggagaaagctgcagccagacacagccttggtttgccaagacagcagttgcagctgatggcacaggatgcctttcgcgatgtgggtatccgcctgcaagaaagacgccatctggatcttatttataattttggttgccaccttaccgatgattacaggcctggagtagatcctgcactcagcgaccctgtgctggctcgtcgcctgagagagaatcggagtcttgcaatgtctagactcgatgaggtgattagcaaatatgcaatgttacaggacaagagtgaggagggggagaggaagaaaagaagagcacgccttcagggcacaagctctcacagcgccgacacacccgaagccagcctggattcaggtgagggaccaagtggcatggcgagccagggctgcccaagcgcaagcagggcagaaacagatgatgaggacgacgaggagtctgacgaagaagaggaggaagaggaggaagaggaagaggaggaagccacagacagcgaggaggaggaagatctggagcagatgcaggagggtcaggaagacgatgaagaagaggatgaggaggaagaggcagccgcaggaaaggacggagacaagagcccaatgtcaagtttgcagatctcaaacgaaaaaaaccttgaacccggtaagcagattagcagatcatctggagagcaacagaacaaaggccgcatagtctcaccttcacttctctccgaggaaccccttgcgcctagttctatcgatgctgagtcgaacggcgagcaaccagaagagctgaccctggaggaagagtccccagtgagccagttgtttgaactggagatcgaagctcttccgctagatacaccctccagtgtggagactgatatcagctctagccggaagcaatcagaggagcccttcacgaccgtactcgagaatggcgcgggcatggtgagcagcacttcctttaacggtggcgtgtccccacacaactggggagattcaggaccaccttgtaaaaaaagcaggaaggagaagaagcagaccggatccggcccactcggcaattcttacgtggagcgccagagatccgtgcacgaaaaaaacggaaaaaagatatgcacattaccgagtcccccatcgccgcttgcatctttggctcctgttgccgactccagtactcgcgtggattctccttcacatgggctagtcaccagctccctctgcatcccttcgccggctaggctgtcccagacccctcactcacagccaccgaggccaggcacctgcaagacgagcgtggcaacccagtgcgatcccgaagagatcatagtcctgtccgacagcgactag

SEQ ID NO: 114219 - DNA, 393 bp, Artificial Sequence
  Description of Artificial Sequence: Synthetic coding sequence
atggccactgccaactccataatagtacttgatgatgacgacgaagatgaagccgctgcccagcctggaccgtcacaccctcttcctaatgccgccagtcccggagccgaggcaccgagcagttcagaaccacacggcgcaagggggtcatcttcctctggggggaaaaaatgctataaacttgagaacgagaagctcttcgaggaattcttggaactctgcaagatgcaaaccgcagatcacccagaagttgttccctttctgtataacagacagcagcgcgcacactctctgttccttgccagcgccgagttctgtaacatactcagccgggtgctttctagagcgagatccaggccagcaaagctgtacgtttacatcaacgagctgtag

SEQ ID NO: 114220 - DNA, 537 bp, Artificial Sequence
  Description of Artificial Sequence: Synthetic coding sequence
atggctaccgcaaactcaattatcgtgctggatgacgacgatgaggacgaggctgccgctcagccaggaccttcccaccctttacccaatgcggctagtcccggagcggaggccccttcaagtagtgaacctcacggcgcaaggggctcatcctcctcgggcggaaagaagtgttataagctcgaaaacgagaagctgttcgaggaatttctggagctgtgcaagatgcagaccgctgaccatccggaggtggtgcccttcctgtacaacagacagcagagagcccattctttgtttctagcaagcgcagaattttgcaacatactcagcagagttctgagtcgggcacggagtcgaccagctaagctgtacgtatacataaacgagttatgcactgttctgaaagctcacagtgcgaagaaaaaattgaacctggctcccgcagctactaccagtaacgaaccttccgggaacaacccgcccacccacttgagccttgaccccaccaacgccgagaatacggcatcacaatcgtag

SEQ ID NO: 114221 - DNA, 2223 bp, Artificial Sequence
  Description of Artificial Sequence: Synthetic coding sequence
atggccactgcaaatagtatcatcgtactggatgatgatgacgaagatgaagccgccgcgcaaccaggaccctcacaccccctccctaacgcagccagcccaggagctgaggcaccatcctcgagcgagcctcatggggcccgcggctcttcctcgagtgggggcaaaaagtgctataagctggaaaacgagaagctgtttgaggaattcctcgagttgtgcaagatgcaaacggccgatcacccggaggtcgtgccatttctatacaatcgccaacagcgggcacatagcctgtttctggcgagtgccgagttttgtaatatcttgtcccgcgttctaagtcgggccaggtccagaccggccaaactgtatgtgtatataaatgagttgtgcacagtgctgaaggctcattccgccaagaagaaacttaacctggcacccgctgccaccactagcaacgaaccatcgggcaacaatcccccgacccacctgtcactggatcctactaacgccgagaacaccgccagtcagagtcccaggacacggggctccaggcgacaaattcagcgcctagagcagcttttggctctgtacgtcgctgagatcagacgacttcaggagaaagagcttgatctgtcagagttagacgaccctgattctgcgtacttacaggaagctaggctcaaaagaaaactcattcggctgttcggtaggctgtgtgaactaaaggactgttcatcgctgaccgggcgggtgatcgagcagagaattccttatcgaggcaccaggtatcccgaggttaatagacgaatcgaaaggctaattaacaagcccggccctgatacgttccccgactacggggacgtgttgcgtgctgtagaaaaagccgccgctcgtcactctctcggtctgccaaggcaacaactccaactgatggcacaggatgcattccgcgatgttgggatccgactgcaggagcggaggcacttagacttgatatacaattttgggtgccaccttactgacgactacaggccgggggtggacccggccctaagtgaccccgtcctggcccggaggctgcgggagaaccgctctctggcaatgagccgcctagatgaggtgatatctaaatacgcaatgctccaggataaaagcgaggaaggagagagaaaaaaacgccgggcacgcctgcagggcacttcaagccattccgcggacacgcccgaggcctccttagatagcggcgaggggcccagtggcatggctagccaggggtgccccagcgcctctcgcgccgaaactgacgacgaggacgatgaggagagcgacgaggaggaggaggaggaagaggaggaggaggaagaagaggctactgattctgaagaagaagaagacctggaacaaatgcaggaggggcaggaggacgatgaggaagaggatgaggaagaagaagccgctgcagggaaagacggcgacaagtctccaatgtcctcactgcaaatcagtaacgaaaagaatctggaaccaggaaagcagatttcacgttcatcaggggaacaacaaaataaaggcagaattgtgtcccctagtttacttagcgaggagcctttggcgcccagcagtatcgatgccgagtcaaacggggaacagcccgaggaactgacccttgaagaggaatcccctgtcagtcagctgtttgaactagaaatcgaagctctgcccctcgacacacctagctcagtagagacagacatatcaagctcccgaaagcagtctgaagaacctttcacaactgtcttggagaatggtgccgggatggtaagctccactagcttcaacggcggggtgagccctcataactggggagattcaggacccccatgcaaaaagagtcggaaagaaaagaaacaaacaggtagtgggccgttgggtaacagttacgtggagaggcagcgctcagtgcatgagaaaaacggaaaaaagatttgtaccctgcctagccctccctccccgctggccagtctggctcctgtggccgattcctctacaagggttgattcgccctcacatggccttgtcacaagttcactgtgcataccctctccagctcgcctgtcccagacaccgcattcacaaccaccccggccagggacatgtaagaccagcgtcgctactcagtgtgatcctgaggagatcatcgtcttgagtgatagcgattag

SEQ ID NO: 114222 - DNA, 147 bp, Artificial Sequence
  Description of Artificial Sequence: Synthetic coding sequence
atggcaacagcgaactccattatcgtgctcgacgacgacgatgaggacgaggccgccgctcagcctggtcccagccaccctctgccaaatgccgctagtcctggggccgaggctcctagctctagcgagccccacggcgcaagatag

SEQ ID NO: 114223 - DNA, 393 bp, Artificial Sequence
  Description of Artificial Sequence: Synthetic coding sequence
atggctaccgccaactcaataattgtgcttgatgatgacgacgaagatgaagcagccgcacaaccgggccccagtcaccccctgccgaatgccgccagccccggggcagaggctccgtccagcagcgagccacacggtgcccgcggcagcagcagctcgggggggaaaaagtgctataaactcgagaatgagaagttgtttgaagaatttctggagctctgtaagatgcagactgcggaccatcctgaagttgttcctttcctctacaatcgccagcagcgggctcatagtctttttcttgcatccgctgagttctgtaatattctctccagggtcctcagtagagcacggagccgtcctgccaaactctatgtttatatcaacgaattatag

SEQ ID NO: 114224 - DNA, 537 bp, Artificial Sequence
  Description of Artificial Sequence: Synthetic coding sequence
atggccactgctaactctatcattgtgttagacgatgatgatgaagatgaagccgccgcccaaccagggccaagtcatcctttgccaaacgccgcctctccgggggctgaggccccctcctccagcgagcctcacggcgccaggggcagttcttcttccggcgggaaaaagtgttacaaactggaaaacgagaaattattcgaagaattcctcgagttgtgcaaaatgcagacggccgaccaccccgaggtggtaccctttctgtataaccgccagcagcgagcgcacagcctgtttctcgccagcgccgagttctgcaacatcctatccagggttctctcaagggcccgctcaagaccggctaagctgtacgtttatatcaacgagctgtgtactgtgttgaaggcacacagcgccaagaagaagttgaatctggctcctgcggccacaaccagcaatgagccgtcaggcaacaatcctcccacacacctgagtctggatcccacgaacgccgagaatactgcctcacagagctag

SEQ ID NO: 114225 - DNA, 2223 bp, Artificial Sequence
  Description of Artificial Sequence: Synthetic coding sequence
atggcaacagcaaacagtattatcgttctagacgacgacgatgaggacgaagccgccgcccagcctggtcctagccatccacttcccaacgccgcatcgccaggagccgaagccccctcaagttctgagccacacggagcccgaggctcgagttccagtggcggaaagaaatgctacaagttagagaacgaaaaactgttcgaggaattcctggaactctgcaaaatgcaaacagcggatcacccggaggttgtcccctttctctacaaccgccagcagcgggctcactccctcttcttggcctctgcagagttttgtaatatcttgagcagggtcctctctcgggcccgcagtcgtccggcaaaactctatgtgtacattaatgagctttgtacagttcttaaagcacatagtgctaagaagaagttaaatctcgctccagctgcaactaccagcaacgagcctagcgggaacaaccccccaactcatctttctctggaccctacaaacgcagaaaacaccgctagccagagccctcgcacacgcggctcacggcgccagattcagcgcctggaacagctcctggcactctatgtcgccgaaattaggcgactgcaagagaaggagctggatttgagtgagctcgatgacccagactccgcttacttgcaagaagcccgattaaaacgcaagctgatacggctcttcggccgcctttgtgagctgaaggattgttcgagtttaacaggcagggtaatagaacagcgaatcccgtacagggggacacgttatccagaagtcaatagaaggatcgaacgattgatcaacaagcctggccccgatacgtttcccgattacggtgatgtgctgagggccgtcgagaaggcagctgcacgtcattcattggggctcccccggcaacagctgcagctgatggcccaggatgccttccgtgacgtggggatcaggctgcaagaaagacgtcacctggacctaatttacaactttggatgtcacctgaccgacgattacagacctggagttgaccctgctctttcagatcccgtgctggccagaagactgcgggagaacaggagcctagccatgtcccgactggatgaggttatctctaaatatgcaatgcttcaggacaaatccgaagagggagagcgcaaaaaacgtcgcgcccggctccagggcacttcaagtcattcagccgatacgcctgaagccagcctcgactctggtgaagggccttcaggcatggcgagtcagggatgcccctcagccagccgggccgagactgatgatgaagatgatgaggagtccgacgaagaggaggaagaagaagaagaggaagaggaagaagaggcaacagactcagaagaagaggaggatctcgagcagatgcaggagggccaggaagacgacgaggaggaggacgaggaagaagaagccgcggccgggaaggacggcgataagtccccgatgagttcattgcagatcagcaacgaaaaaaacctggagcctggcaagcagatttcccgatccagcggggaacagcaaaacaaaggccgaatcgtgtccccgtctctgctgtccgaggaacctttggctccatcaagtatcgatgcagaatcaaacggagaacagcccgaggagctcacacttgaggaggaaagcccagtgtcccaactttttgagctagagattgaagccctgcccctggacacccctagctctgtggaaacagacatctcaagttcacgtaagcagtcggaggagcctttcaccactgtgttagaaaatggggccggcatggtttccagtaccagctttaacggcggcgtgtcacctcacaattggggcgatagcggtccgccgtgcaaaaaaagccgcaaggaaaaaaagcagaccggatctggtcccctgggtaactcatacgtggaaaggcagagatcggtccacgagaaaaatgggaaaaaaatctgtacattgccaagtccaccgtccccactggcgagcctggcgcctgtggctgacagctctaccagggtcgattccccgagccacggccttgtgacttcaagtttatgcatcccttcgccggcacgtttaagtcagacgccgcactctcaacctcctcgaccagggacatgtaaaaccagcgtggctacccagtgcgacccagaggagattatcgtgttgtctgacagtgattag

SEQ ID NO: 114226 - DNA, 147 bp, Artificial Sequence
  Description of Artificial Sequence: Synthetic coding sequence
atggctacagccaatagcatcattgtgttggatgacgatgatgaagacgaagcagccgcacagccaggccctagccacccactcccgaacgccgctagtccaggtgccgaggctcccagctcctccgagccacatggtgcccggtag

SEQ ID NO: 114227 - DNA, 1998 bp, Artificial Sequence
  Description of Artificial Sequence: Synthetic coding sequence
atgcagaccgcggaccacccggaagtggtcccattcctatataatagacaacagagggcccattccttgtttcttgccagtgcagaattttgtaatattctgtctagagtgctctcaagagcgcggagccgcccggccaagctgtatgtgtacatcaacgagctgtgtactgtactgaaggcgcactccgccaaaaaaaagttgaacctcgccccagcggctaccacttctaatgaacccagcgggaataatcctcccacccacctgtctctggatcccaccaatgccgaaaataccgccagccagtctccgagaacacgaggctcaagaaggcagatccagagattggagcagctcctggccttgtacgtggccgaaatccgccgcttacaagaaaaggagctggatctatctgaactggacgacccagacagtgcctatcttcaggaagcgagattgaagcgaaagcttatacgactgttcggcagactgtgcgagcttaaggactgtagtagcttgactgggcgggtgatagagcagaggatcccttaccggggtacaaggtacccagaggttaatcggaggatcgagcgactcattaacaagcctggtccggatacgttcccagactacggagacgttcttagagccgtagagaaagctgctgctcgccattccttagggttgccacgccagcaattgcaactgatggctcaggacgcatttcgagatgtcggaattaggctgcaggagcggaggcacctcgacctgatttataattttggatgccaccttacagacgattacagacctggagtcgacccagccctctccgatcctgtcttggctcgcagactccgcgagaatcggtctctggccatgtctcgcctcgacgaggtgatttcgaaatatgctatgttacaagacaagtccgaggagggggaacggaaaaaacgtagggccaggttacagggaacttcatcacattcagctgatactccagaagcaagtctggatagcggcgagggcccttccgggatggcatcacagggctgtccctcagctagcagagccgaaacagatgatgaagacgacgaagagtccgatgaggaggaagaggaggaagaagaggaagaggaagaagaagctaccgacagcgaggaggaggaagacctggagcagatgcaagaaggccaggaggacgacgaagaagaggatgaggaagaggaagcggccgccggtaaggacggtgataagtccccaatgagctctcttcagatctctaatgaaaagaatctcgagcccggtaaacaaatcagccgttcatcgggcgagcagcagaacaagggcagaatcgtgagcccgagccttttgtccgaagagccacttgccccatcgtcgatcgatgctgagtctaatggtgaacaacctgaggagttaacacttgaggaggagtcccctgtaagtcagctatttgagctggaaatcgaggcgctccccctcgacacacctagttccgtcgaaaccgatatctcctcttctcgaaagcagagtgaagagcctttcactactgttctggaaaacggagctggaatggtatcctctacatcgttcaacggcggggtgagcccacataattggggtgattcgggccccccctgcaagaaatctagaaaggagaagaaacagacggggtcaggacctctgggcaatagctacgtagagaggcagcggtcagtacacgagaaaaatggtaaaaaaatttgcacactgccatccccaccaagtcccttggcttcacttgcacccgtcgccgattcttccaccagggttgactcaccctcacacggccttgtgacttctagtctgtgtattccatcgccagcccgtctgagccagaccccacactcccagcctcccaggccgggcacctgcaaaacatcagtagccacgcagtgtgatcccgaggagattatagttctctctgacagcgattag

SEQ ID NO: 114228 - DNA, 1998 bp, Artificial Sequence
  Description of Artificial Sequence: Synthetic coding sequence
atgcaaacagcagaccaccccgaagtggtcccgttcctttataacagacagcagcgggcgcacagcctgttcctcgcctcagctgagttctgcaacattttgtcacgagtgttaagccgggcccgctcaaggcctgccaagctctacgtgtacatcaatgagttatgcacagttttgaaagcacactccgcaaagaagaagctgaacttggctccagccgcgacaacaagcaacgagccgtcaggaaacaatccacctactcatttgtcgttggaccctacaaatgccgaaaacacagcctcccagagccctcggacgagaggttcgcggcgccaaattcagaggctggagcaattactagccctgtacgtcgctgaaatccgtaggttacaggaaaaggaactggatctgtctgagctggatgatcccgacagcgcttatctgcaggaagcaaggctgaagcgcaaattgataaggctgtttggaagactgtgcgagttaaaggactgctcttccctgactgggagggtcattgagcaacggattccctaccgggggacccgttacccggaggttaatcgacgcatcgaaaggcttattaacaagccaggacccgacacgttccccgactacggcgatgttctaagagctgtggagaaggccgctgcgcgacattcccttggtctgccaagacagcagttacagttaatggcgcaggatgcattcagggacgtgggtatccgcctccaggaaaggaggcacctggatctgatctacaattttggatgccacttgacagatgattaccgcccgggtgttgacccggcccttagcgaccccgtactggccaggcgcctgcgtgaaaatagaagtcttgccatgagcagattagacgaagtgatcagtaaatacgccatgctgcaagacaagagcgaggagggagaacgcaaaaagcggagggccagactacagggcacttcctctcactcagctgacactcctgaagccagccttgattcaggggaaggtccctccggcatggcctcacaaggctgccctagcgcctctagggctgaaacggacgacgaggatgacgaagagtcagacgaagaggaggaagaggaggaggaagaagaagaggaggaggctacagactccgaggaggaagaagacctggaacagatgcaggagggacaagaagacgacgaagaagaagacgaggaggaggaggcggctgcgggaaaagacggggataagagcccgatgagttcgctccaaattagcaatgagaaaaacttggagcccgggaaacagatttctcgaagttccggtgagcaacagaacaagggccgcatcgttagcccatcccttctctctgaggagcccctcgcccccagtagcattgatgcagagtccaatggggagcaaccagaggaactgaccttggaggaggagtctcctgtatcacagcttttcgagcttgaaatcgaggctttgccgcttgacacaccctcatccgtagagaccgatatctccagctcacggaaacagagtgaggagccattcactactgttctggaaaacggggccggtatggtctcatccacaagcttcaatggtggggtctccccgcacaattggggtgactccggacccccttgtaaaaagtcacggaaagaaaagaagcagacagggtccgggcccctcggcaactcttacgttgagcgacaaagatcagtacacgaaaagaacggcaagaagatttgcactctcccgagtcctccatcccctttggccagcctggcgccggtcgctgatagttctacaagagtggattctccatctcacggactcgtcacaagcagtctgtgtatccccagccctgcccggttgtcacaaaccccgcacagtcagccccccaggccggggacatgcaagacatccgttgccactcagtgtgatcctgaagaaatcatagtgttgagcgatagtgattag

SEQ ID NO: 114229 - DNA, 1998 bp, Artificial Sequence
  Description of Artificial Sequence: Synthetic coding sequence
atgcagaccgctgatcatccagaggttgtcccattcttgtacaatcgccaacaacgcgctcattcgctgtttctagctagcgcagagttctgcaacatcctcagccgtgtcctttccagagcacggtctcgcccagctaagctgtatgtgtatatcaacgagctgtgtacagtgcttaaagcacactctgccaaaaagaaacttaatctggcgccagccgcaacaaccagtaacgaacctagcgggaacaacccgcccacccatctctcattagacccaactaacgctgagaataccgcttcacaatcaccccgaacgagggggagccgccggcaaatccaaagacttgagcagttgctggccttgtacgtcgcggagatcagaaggctacaggagaaagagcttgacctttcagagttggacgatcctgacagcgcctacctgcaggaggcacgtctcaaacgcaagctgatccggctttttggcagattgtgtgagctgaaggattgcagttctctgaccgggagagttattgaacagaggatcccttacaggggcaccagatatccagaggtgaaccgccgcatagagcgcctaatcaacaagccagggcctgatacatttcccgattacggcgacgtactgagagcagtggagaaagccgctgcccgccacagcctcgggctgcctcgccagcagttgcagctgatggcccaggatgccttccgggacgtgggcatcaggttacaggaacgacgccaccttgatctgatttataatttcggttgtcacctgacggatgattatcgacctggggttgaccctgctctgagtgaccccgtactggcgagaagactgagggagaatcgatccctcgctatgtctaggctggatgaagtgatttccaaatatgccatgttacaagataagagcgaagagggggagcggaagaagaggcgggcaaggcttcagggcactagtagccactccgccgacactcctgaggcctcactcgacagtggggagggaccgtctggcatggcctcccaaggatgcccgtcggctagcagagctgagaccgatgacgaggacgatgaggagagtgatgaagaagaggaagaagaagaggaagaggaagaggaggaagctacagactccgaagaggaggaggacctcgagcaaatgcaggagggacaggaggatgatgaggaagaagacgaggaggaggaagccgcggccggaaaggatggtgataagagtcccatgtcgtcgctccagatcagcaatgagaagaatcttgagcccggaaaacagatcagtcgctctagcggagagcaacagaataagggccggattgttagcccttcactcctctccgaagaacctttggccccctctagcatcgatgccgagagcaatggtgaacagccagaagagctgacactcgaggaggagtcacctgtttctcagctcttcgagctggagatcgaagctctgccactggataccccctcctctgtcgagaccgacatctcaagttctcgaaagcagtccgaggaacccttcaccaccgtgttagagaatggcgccgggatggtgtcgtcaacctccttcaacggaggcgtgtcaccacataattggggcgactcgggcccgccttgcaaaaagtccagaaaagaaaagaaacagaccggaagcggccccctcgggaatagctatgttgagcgtcaacgatctgtgcacgaaaaaaatggaaagaaaatctgtacgctgcctagccctccaagccccctcgcatctttggcaccagtggctgattcctccactcgtgtggactcaccaagtcatgggctggtcacatcttcattgtgtatcccgtctcctgcccgcctgtcccaaacacctcattcccagccacctaggccaggcacctgtaagacatcggtggccacgcaatgtgacccagaggaaatcatcgtgctcagcgattcagactag

SEQ ID NO: 114230 - DNA, 1998 bp, Artificial Sequence
  Description of Artificial Sequence: Synthetic coding sequence
atgcaaaccgcggaccatccagaagttgtcccctttctttacaatcggcagcagagggcccactctctgtttctggcgagcgcagaattctgcaatattcttagtcgcgtactgtccagagccagatctaggccagctaagctctatgtgtacatcaacgagctctgcacagtgctcaaagctcattcagcgaaaaaaaaattaaacctagctcctgctgcaactacgtccaatgagccgtcggggaataacccgcctacacacttgtccctcgacccaaccaatgcagaaaacactgccagccagagccctcggactcgagggtcacgaagacaaatacagcggctggaacaattgttagctttatacgtcgcagaaattcggaggctgcaggagaaggaacttgatctttctgagcttgacgacccagactctgcttacctgcaggaagctcgccttaagcgaaagctgattagattgttcgggcgcctctgtgagctgaaagactgctccagcctcaccgggagagttatcgaacagaggatcccgtataggggtacaaggtaccccgaggtgaatcgacgcattgaaaggctcattaacaaaccaggtcccgatacgtttcccgattatggcgatgtgctaagagccgtggagaaggctgcagcacggcacagcctggggcttccaaggcaacagttgcagctgatggctcaggacgcttttcgcgacgtgggaatcagactgcaggagagacggcacctggacttaatctataatttcggctgccatttaaccgatgattaccgcccgggggttgaccccgcccttagtgaccctgttctcgccaggaggttgcgggaaaaccgttccctggccatgtctcgtctggatgaggtcatttcaaagtatgccatgctgcaagataagagtgaagaaggagaaaggaaaaagcgcagggcgagattacaaggcacgagcagtcattcagccgatacaccagaggcttcgctcgattcaggggaaggtccctctggaatggcatcgcaaggttgtccctcagcttctcgagctgagactgatgatgaggatgacgaggagagcgatgaggaagaggaggaggaggaggaggaagaagaggaggaggcaactgactcagaagaagaagaggacctggagcagatgcaggaaggccaagaggatgacgaagaagaggacgaggaggaagaggctgctgccggaaaagacggcgataagagccctatgagctcactgcaaatatctaacgaaaaaaatctggagcccggcaagcagatcagcaggtcttccggtgagcagcagaacaaaggcaggattgtctctcctagcctgctgtccgaggagcccctagccccttcctccatcgacgccgagagtaatggagagcagccagaagagctgaccctggaggaggaaagtccggtcagccagctgttcgagcttgagattgaagccttgcctctggataccccctccagtgtcgagacggatatttcatccagcaggaagcaatccgaagaaccatttaccacggtgctggaaaatggagctggtatggtgtcctctacatctttcaatggcggggtcagccctcataactggggtgacagcgggcctccatgcaagaaatcacggaaggaaaagaagcaaacgggtagtggccccttaggcaatagctatgtcgagagacaaaggagcgtccacgaaaagaatgggaagaagatctgtaccttgccatctccaccaagcccgctcgcttccctggcccccgtggccgatagtagtacccgcgtggatagcccaagccatggtcttgttacatctagtctctgcatcccttctcccgctaggttgtctcagacaccgcattcccaacccccccggcctggcacctgcaaaacaagcgtagctacccaatgcgaccctgaggaaatcattgtgctttcagacagtgattag

SEQ ID NO: 114231 - DNA, 1080 bp, Artificial Sequence
  Description of Artificial Sequence: Synthetic coding sequence
atgaaagccaccataatcctgctgttgttggcccaggtgagctgggcaggcccgttccagcagcgcggacttttcgacttcatgctcgaagacgaagcctcaggcatcgggcctgaagtgccagacgatcgggatttcgagccaagtttaggacccgtatgtccattccggtgtcagtgccacctgagagtggtgcagtgctccgatctgggacttgataaggtaccaaaagatctccccccagacacgacactcctcgacctgcaaaataataaaattaccgagattaaagacggagactttaaaaatttaaaaaacttacacgctttaatcctggtgaataacaagatctctaaagtgagtccaggcgcattcacacctctggttaaacttgaaagactgtatctctccaagaaccaacttaaggaattacccgagaaaatgcctaagacactgcaggagctgagggcgcacgaaaacgagattacaaaggtgaggaaggttacattcaatggactgaatcaaatgattgtgatcgagcttggtaccaaccccctaaagagttcaggcattgaaaacggcgccttccaaggcatgaagaagctgtcgtatataagaatcgcagataccaatattacttccatcccacagggactccccccatcactgaccgagctccatctagatggtaacaaaatcagccgcgttgatgcagcatctctgaaagggctcaataatctcgcaaaattaggcctgtcctttaattcgatcagcgcagtggataacggcagcctagctaatactcctcacctgcgtgagctccaccttgacaataataagctaacccgggttccaggcggccttgccgaacacaagtatattcaggtggtgtacctgcataacaataacatcagcgtggtggggtcgagcgacttttgcccccctggccacaataccaaaaaggctagttactctggagtgtctctgttttctaaccctgttcagtactgggagattcagccatctacctttagatgcgtctatgtgcgctctgcaatccaattgggcaattataagtag

SEQ ID NO: 114232 - DNA, 7092 bp, Artificial Sequence
  Description of Artificial Sequence: Synthetic coding sequence
atgccggttctgggggtcgcatccaaattgcggcagcccgctgtggggtctaagccggtacacacagccctacctatccccaatcttggaactaccgggtcgcagcactgctcatcccggcccctagaactcaccgaaaccgaatccagcatgctctcctgccagctggctctgaagagtacttgcgagtttggcgagaagaaaccactgcaaggtaaggcaaaagagaaggaagactctaagatctacaccgactgggctaaccactatctggctaagtccggccacaagcgacttatcaaagaccttcagcaggatatcgccgatggagttctgctcgcggagattatccaaatcatcgctaacgaaaaggtggaagacataaacggctgtcccagatcccagagccaaatgattgaaaatgtcgacgtatgcctgagcttcctggctgcacgcggagtcaacgttcagggactatcagccgaggagatcagaaacggcaaccttaaggccattctcggcttattctttagcctttctcggtacaagcagcaacagcatcatcaacagcagtactaccaaagcctcgttgaacttcagcagcgcgtgacccacgctagccctccttcagaagcctctcaagcgaagacccagcaagacatgcagtctagcctggcagcaagatatgccactcagagtaaccattctggtatcgcaacttcccagaagaaacccactagactccctggtcctagcagggtgcccgccgccggaagtagctccaaggtgcaaggcgccagtaacttgaacagaaggagtcagagctttaactctattgacaagaataagcctcctaattacgctaacggaaacgaaaaggacagctcaaagggacctcagagctctagcggagtcaatggtaacgttcaaccacccagcaccgcaggtcagccccccgcctccgccattccatcccccagcgcctctaagccctggcgctccaagtcaatgaacgtaaagcattcagctactagcactatgttaacggtgaaacaaagtagtacagccacttcccccactccctctagcgatagactgaagccgccagtttcagagggggttaagactgctcccagcgggcagaaatccatgctcgagaagtttaagctggttaatgcccgcaccgcgttgaggccccctcagccccctagcagcggacccagcgatggaggtaaagacgatgacgctttctccgagtcaggggagatggagggcttcaattccgggttgaattcaggcggatccacgaacagtagcccgaaggtcagcccaaaactcgccccaccaaaagccgggtctaaaaatctgtcaaacaaaaagtctctattacaacctaaagaaaaggaagagaaaaaccgcgacaagaataaggtttgtaccgagaaacctgttaaagaggaaaaggatcaggtgaccgaaatggcaccgaagaagacctccaagatcgcttctctaattccaaaaggcagtaaaactaccgctgcgaaaaaagagtcgcttatcccttccagtagcggtattcccaagccagggtcaaaagtgccaacagtaaagcagaccatctcacccggctccaccgccagcaaggagtctgaaaagttccgtacgactaaggggtcgcccagccaaagcctgtcaaaacctatcaccatggagaaggccagtgcatctagttgccctgccccgctcgaggggcgggaagcgggacaggcaagcccaagtgggagctgtacgatgaccgtcgcccagtccagcggccaaagtacagggaacggggcagtacaactcccacaacaacagcagcatagccacccaaacaccgcaacagtagccccctttatctacagagctcactctgaaaacgaaggcacggcactgccgtcggcagactcgtgcacttccccgaccaagatggatttgagttattccaagacggccaaacagtgcctcgaagagataagtggggaagaccctgagaccaggcgaatgcgaacagtgaaaaacattgcagacttaagacagaatttggaggagacaatgtcttccctccgaggcacacagatcagccacagcacactcgagaccactttcgatagcaccgtgaccacagaggtgaatgggagaactatccccaacttgacgtctaggccaactccaatgacgtggcgacttggacaggcttgccccaggctgcaggccggggacgctccgagtcttggcgcgggctatcctagaagcggcacaagcagattcattcacactgatccttcgaggttcatgtacaccaccccgttacggagggcagccgtatccagactggggaacatgtcacaaattgatatgtccgaaaaagcctcttcagacctcgacatgtctagtgaggtggatgtgggtggatacatgagcgatggcgacatcctgggaaagtccctgcgaacagacgacatcaattcaggttatatgaccgacgggggcctgaacctgtacactcggtctctgaacagaatcccggacacagcaacctcacgggacattatccagcggggtgtgcatgacgtgaccgtggacgctgacagttgggacgattcttcctccgtctcctccggactgtcggacaccctcgacaatattagtaccgatgatttgaacaccacgtcatccgtctcaagctatagcaatattaccgttcctagccgcaaaaacacacagcttcggacggatagtgagaaaaggagcacgactgatgagacctgggacagtcctgaagaactaaagaagccggaggaggatttcgacagccacggggacgcgggtggtaagtggaagacggtgtccagcggactcccagaagaccctgagaaggccggtcagaaggcaagtttgtccgtctcccagacaggaagctggaggagggggatgagtgcccagggcggcgcacccagcaggcaaaaggcaggaactagcgctctcaagacacctggaaaaactgacgacgctaaagcaagcgagaaaggcaaggccccactcaaaggcagctcacttcagagatcgccgtcagatgccggaaagtccagcggggatgaggggaagaagccaccctccggaataggccgcagcaccgcaaccagctcctttggtttcaagaagccttccggagttggctccagtgccatgatcacaagttcgggggccacaattaccagtggctcagccacactgggtaaaattcccaaaagcgctgctatcggcggaaagagcaacgcaggacggaagacctccctagatggtagtcagaaccaagacgacgttgtccttcatgtgagctctaaaactactctccagtaccggagtctccctagaccctccaagtccagtacatccggcatccccggcagagggggtcaccgcagctccacttcttcaatcgatagcaatgtgagcagtaagtctgcaggagcaaccacaagtaagttgagagagccaactaaaattgggagcgggaggtccagtccggtaactgtcaaccagactgacaaggagaaggagaaggtggcggttagtgattcagaatccgtcagtctttccggatcccccaaaagctcacccaccagcgcctcagcttgtggagcacagggactgcgccaacctggcagcaagtacccggacattgcctctcctactttccgacgactgtttggtgccaaagctggcggaaagtccgcaagcgcccctaacacggagggcgtgaaatcctcatctgtgatgcccagtccttcaacgacactcgcgcgccaggggagcctggagtccccatcctccgggacagggtctatggggagcgcaggaggtctctcggggtcctcatcacccctctttaataaacctagcgacttgacaactgatgtgattagcctctcacattctttggcaagctctcccgcctcggtgcattcgtttacctccgggggcctggtgtgggctgccaatatgtcctcatcatccgccggcagtaaggatacgccctcataccagagtatgacctcactgcacacatctagcgagtctatcgatctgcccttgagtcaccatgggtcactatctggcctgactactggtactcacgaggtgcaatctttgctgatgagaaccggctcggtgaggtccacactgagtgagagcatgcaactggacaggaacactctgcccaagaagggtctgcgctatactccatcctctagacaggcaaaccaggaagaaggaaaggagtggctcagaagccacagtaccgggggcttgcaggacacaggcaaccaatccccgctggtgtcaccctctgccatgtcttcctcagccgcgggtaagtatcacttctcaaatctggttagccccacgaatttatcacagttcaatctccccggtccctctatgatgcggagcaattccatcccggctcaggactcctcttttgatttgtatgatgattctcagctgtgtgggtccgcaacttccctcgaggaacgcccaagagccattagccacagcggatcatttagggatagcatggaggaggtgcacgggtccagtttaagtcttgtgagttctacaagctccttgtattccaccgcagaggcaggcggttcactggagcagattcacaagttaagaagggaactggtggctagtcaggaaaaggtagccactctaaccagccagctaagtgctaacgcgcatctcgttgccgctttcgagaagtcactaggaaatatgaccgggcgccttcagagcctgaccatgacagcggagcagaaggagtcagagctgattgagctccgcgagaccatcgagatgctgaaggcccagaattcagctgctcaagcggctatccagggtgcgcttaacggacctgaccaccctcccaaggatcttcgtatacgccgccaacacagctcagagtccgtttcatccatcaacagcgccacttctcattcatctataggttctgggaacgatgccgactctaagaaaaaaaagaaaaagaactgggtaaatagccggggcagtgaactgaggtcttccttcaagcaagcctttggcaaaaagaagtctacaaagccacccagttcccatagcgatatcgaagagcttacagactcgtccctgccggcctcaccaaagctgccgcacaacgcgggagattgtggctctgcttcgatgaaacccagccagagtgcctccgccatatgtgagtgtaccgaagctgaggctgagatcatcttgcaattgaagtccgagcttagggagaaagaactgaaactaacagacattcgattagaggcactcagctccgctcatcacctggatcagatccgcgaggccatgaatcgcatgcagaacgagatcgagatcttaaaagctgagaatgatagactgaaggctgagacgggtaacacggcgaagcccacgcgcccaccatctgagtcatcctctagtacctcatccagtagttccaggcaatccctgggtctgagcttaaacaatttgaatattacagaggccgtgtcaagcgatatacttttagatgatgctggggatgcaacaggacacaaggacggaagatcggtgaagatcatagttagcatttccaagggatacgggagggccaaggaccagaaaagtcaagcttatctaatcggatccattggagtttccgggaaaactaaatgggatgtgctggatggcgtgattcggaggctttttaaggaatatgtcttccgcatagatacgtccacctccctggggctctcgtctgattgtattgcttcctattgcataggcgacttgatccgcagccataatcttgaggtcccggagttgctgccatgcggttatttggttggtgataacaatatcatcacagtgaaccttaaaggtgtggaggagaatagtctggactcatttgtcttcgacaccttgattcccaaacccataacgcagagatacttcaatttgttaatggagcaccatagaattattctgagcggcccgagtgggacaggaaagacatacctcgccaacaagctggccgagtatgtgatcactaagtctggtcggaaaaagacagaggatgccatcgccaccttcaacgtcgatcacaagtcctcgaaagagctccagcagtacctagctaacttagccgagcaatgcagcgccgacaacaatggagttgagctgcccgtcgtgattatactagacaacctacaccatgttgggtctcttagcgatatttttaacggatttttaaattgtaaatacaacaaatgcccttatatcattggaactatgaatcagggtgtttcttcctcacccaacctggagctgcaccacaatttcaggtgggtactgtgcgccaatcatacagagccagttaaaggtttcctcgggaggtacctgaggcgcaagctgatagaaattgaaatagaacgaaacatacgcaataacgatctcgtgaaaattattgattggatccctaagacttggcaccacctgaattcctttcttgaaactcactcctcgagcgatgtcacgatcggaccccgtctctttttgccttgccctatggatgtcgagggctctcgtgtttggttcatggatctctggaattactcactggtcccatacattctggaagcagtgcgcgaaggcttacaaatgtatgggaagaggactccctgggaagatcccagcaagtgggtgctggatacatatccttggagcagcgcaaccctgcctcaggagagccctgcactgttacagctgcgacctgaagatgtcggctatgagtcctgcacatccacaaaagaagctactacctcaaagcacatcccccagaccgacactgaaggggaccctttgatgaacatgctgatgaagttgcaggaggctgccaattattcttcaacccaatcttgtgactcggaaagcaccagtcaccacgaagatattctggacagcagcctggagagtaccctgtag

SEQ ID NO: 114233 - DNA, 519 bp, Artificial Sequence
  Description of Artificial Sequence: Synthetic coding sequence
atgaaggctaccattattctcctactcctcgcccaagtcagttgggcaggcccgtttcagcaacggggactctttgatttcatgctggaggacgaagcatctggcatcggccctgaagtgcccgacgaccgtgacttcgaaccttctcttggccccgtctgtccctttaggtgtcagtgtcaccttagagtggtgcagtgcagtgacctcggcctcgacaaagtgccaaaagatctgccgccagacactactcttctggatctgcaaaataataagataacggaaatcaaagatggcgacttcaaaaatctaaagaaccttcacgtggtttatctccataacaataatatctcagtggtcgggagcagtgacttctgcccacccggccataatactaagaaggcctcctactcaggggtgtccctctttagcaaccctgttcagtattgggagattcaaccctcaacgttccggtgcgtctacgttcgcagtgctatccaactggggaattacaagtag

SEQ ID NO: 114234 - DNA, 1080 bp, Artificial Sequence
  Description of Artificial Sequence: Synthetic coding sequence
atgaaagccaccatcatcctccttctgctagcccaggtatcatgggcaggaccatttcagcagcgtgggctgtttgacttcatgctggaggacgaggcaagtggaattggacctgaggtgccggacgaccgggacttcgaacccagcttgggtcctgtgtgcccatttcggtgccagtgtcacctgagagtagttcagtgttccgacctcgggctcgacaaagttccgaaggacctgcctccagataccaccttgctggacctgcagaacaacaagatcaccgagatcaaggacggagattttaagaatcttaaaaacctgcatgccctgattcttgtaaataacaaaatatctaaggtgagccccggagcgttcaccccgttggtgaagcttgagagattgtacttgagcaagaaccaattgaaagagctgcctgaaaagatgcccaaaactcttcaggaactcagagcccatgagaacgaaatcacgaaagtaaggaaggttactttcaatggcctcaatcagatgatcgtcatagagttagggacaaatccccttaagtcttcaggcatagaaaatggtgcatttcagggaatgaagaagttgagctacatcagaatcgcggacacaaatattacgtcaatcccacagggactgcccccctctctcacagagctgcatctggacggtaacaagattagtagggtcgatgcagcctccctgaaaggattgaacaacctcgccaagcttgggctcagttttaacagcatttcagccgtggacaatggctccctggcaaataccccccatctgagagagctgcatctggacaacaacaaactaactcgcgtacctgggggcctggctgaacataagtacatccaggtggtgtatctgcacaacaacaatattagcgtcgtgggttcctctgatttttgtccaccagggcacaataccaagaaggcttcctattccggcgtttcactgttttccaaccctgtgcagtattgggagatccagccgtcaaccttcaggtgcgtgtatgtcagatcagcaattcagctgggcaattacaagtag

SEQ ID NO: 114235 - DNA, 753 bp, Artificial Sequence
  Description of Artificial Sequence: Synthetic coding sequence
atgaaggcaactattattttgctgctcctggctcaagtctcatgggctggcccatttcagcaacgagggctctttgacttcatgctggaggacgaggcaagcggaatcggtccggaagtgccagatgacagagatttcgagcccagtttaggcccagtttgcccatttcgctgtcagtgtcacctgcgagtggtgcagtgtagcgatctcgaattgggaaccaaccccctgaagagttccggaatcgagaacggtgcatttcaggggatgaagaagctgtcgtatataaggatagctgatacaaatattacctcaatcccgcaaggtcttcctccatccctgacggaactgcacctggatggaaacaaaatctcccgggtggatgccgcgtccttgaaaggtcttaacaacctagcaaagttaggcttgtctttcaattcaatctccgctgttgacaatgggtcactggccaacacacctcacctcagggagctgcatttagacaacaacaaactgactagggttccgggaggactcgccgaacacaaatatatccaagtggtgtatctgcataacaacaacatctcagtggttgggtccagtgacttttgtccacccggtcataatacaaagaaggcttcatattctggcgtgagtctgttctccaatcccgtgcagtactgggaaatccagccgagcacatttcgctgtgtgtatgtaagatctgccatccagcttggcaattataaatag

SEQ ID NO: 114236 - DNA, 639 bp, Artificial Sequence
  Description of Artificial Sequence: Synthetic coding sequence
atgaaggctaccattatcctcctacttttagctcaagtgagctgggccggccctttccagcaacgcgggctcttcgactttatgctcgaagacgaagcttctggaatcgggccggaggtcccggatgacagagattttgaacctagcctggggccagtatgcccttttaggtgccagtgccacttgcgcgtcgttcaatgtagcgatcttgggctcccaccatctctcaccgaactgcatttagacgggaacaagatctctagagtcgacgcagcttctcttaaaggtcttaataatctggctaaattagggctgtcctttaattccatcagtgctgtcgacaatggtagtttggccaacactccccacctgcgagagctgcacctagataataacaagctaacacgggtgcccggtggactagcggaacacaagtacattcaggttgtctatctgcacaacaataatatttccgtagtaggtagttccgacttctgtccccctggccacaatacgaagaaggcttcttattcaggagtgagcctgttttcaaatccagtgcagtactgggaaatccagccgtccacttttaggtgtgtttacgttagatctgccatccagctggggaattacaagtag

SEQ ID NO: 114237 - DNA, 519 bp, Artificial Sequence
  Description of Artificial Sequence: Synthetic coding sequence
atgaaggccaccattatactcctgctactggcccaggtgtcatgggctggacctttccagcagcggggcctgttcgactttatgctagaggacgaagcctccggaatagggccagaggttcctgacgatcgcgatttcgaaccgagcctgggtcctgtatgtccattccgttgtcagtgtcacttacgagtagttcagtgcagtgacctggggctggacaaggtgccgaaggatttgccaccagacacaacactcctcgatcttcagaataacaagattaccgaaataaaggacggtgactttaagaatcttaagaacttacacgtcgtttatctccacaataacaacatttcagttgttggctcatctgacttctgtcctccagggcacaacactaaaaaggccagctattccggtgtgtctctctttagtaaccccgtccagtattgggagatccagccgagcacattccggtgtgtgtacgtgcggtccgccatccagctcggcaactacaaatag

SEQ ID NO: 114238 - DNA, 228 bp, Artificial Sequence
  Description of Artificial Sequence: Synthetic coding sequence
atgaaggccactattatcttgctcctcctggcccaggtgtcgtgggccgggccttttcagcagcgcggtctgtttgacttcatgctggaggacgaggcgagcgggattggccccgaggtgccagacgatagggactttgagccctctctgggacccgtgtgtcccttccgctgtcaatgccatttgcgcgtagtgcaatgtagcgatctggggtgcctgccctcatag

SEQ ID NO: 114239 - DNA, 639 bp, Artificial Sequence
  Description of Artificial Sequence: Synthetic coding sequence
atgaaagcgactatcattttactcctgctggcccaagtcagctgggccggcccctttcagcagcgaggtctgttcgattttatgttagaagatgaagcgtctggaatcggccctgaagtgcccgatgaccgagatttcgagccctcattgggcccagtttgtcctttccgttgccagtgtcacctgagagttgtgcagtgtagtgacctaggcctgcctccttctttaacagagttacatcttgatgggaataagatcagcagggttgatgctgccagcttgaaggggttaaataacctcgcaaaactcggattgtcctttaacagtatctccgccgtggacaatgggtctctggcaaatacaccccatttaagggaactgcacctggacaacaataaactgactcgcgtgccaggcggcctggcagagcacaaatatattcaggtggtgtatctgcataacaataatatttctgttgttgggtccagtgacttctgtcctccaggacacaacacaaaaaaagcctcctactctggtgtgtccctgttttcaaaccctgtccagtattgggagattcaaccgagtacttttagatgtgtgtatgtgaggtctgctattcagttgggtaattataaatag

SEQ ID NO: 114240 - DNA, 540 bp, Artificial Sequence
  Description of Artificial Sequence: Synthetic coding sequence
atgaaggcaactattattttgctgcttctcgcccaggtatcttgggctggcccatttcaacaacgcggcctcttcgatttcatgctcgaggacgaagcatctggaattgggcctgaggtgccagatgatagagatttcgagccaagtttagggccagtatgcccatttcgatgccaatgccatctgcgagtcgttcagtgcagcgatttgggcttggacaaggtgcccaaggacttgccacccgacacaactctgctggatctccagaacaataagatcacagagataaaagatggagatttcaaaaacctcaaaaacctgcacgccctgatacttgtgaacaataagatctctaaagtgagcccgggagcgttcacacccctggtcaagctggaaagactatacctcagcaagaatcagctgaaagagctgcccgagaagatgcctaagaccctgcaagaactcagagctcatgaaaacgaaattactaaggtgaggaaagttacattcaacggcttaaatcaaatgatcgtcatttag

SEQ ID NO: 114241 - DNA, 360 bp, Artificial Sequence
  Description of Artificial Sequence: Synthetic coding sequence
atgaaagccacaatcattctgctgctgctggcccaggtgtcgtgggctggtccattccaacagaggggcctgtttgatttcatgctcgaagatgaggcatcaggcatcggacccgaggtacctgatgacagagacttcgagccctctctgggccccgtgtgccctttccgctgccagtgtcacctccgcgtggtgcaatgttctgatctggggctggacaaggtgccaaaagatctgccaccggacaccacactgctggatctccagaataacaagatcaccgagatcaaggacggggattttaaaaatctgaagaatctacacgcgcttattctggtgaataacaaaatttcaaaatag

SEQ ID NO: 114242 - DNA, 525 bp, Artificial Sequence
  Description of Artificial Sequence: Synthetic coding sequence
atgaaagcgactatcattttgctgctcctagcacaggtgagctgggcgggacctttccagcaacggggcctattcgacttcatgttggaggacgaagcaagcggtattggaccggaggttcctgatgatagggacttcgaaccttctttgggtccagtctgcccatttcggtgccaatgtcatctgagagtcgtccagtgctctgatctaggactcgacaaggtgcctaaagatctcccaccagacactactctactggacctccagaataataagattacggaaatcaaagacggggatttcaagaatctcaaaaacctgcacgccctgatcctggtgaacaataaaatctcgaaagtgtcacccggtgcctttactccgctggtgaagcttgagcggctttacctgagcaagaatcaactgaaggagttgccagagaaaatgcctaagactctgcaagaactcagagctcacgaaaacgagatcacaaaagtgagaaaggttacctttaatggacttaactag

SEQ ID NO: 114243 - DNA, 537 bp, Artificial Sequence
  Description of Artificial Sequence: Synthetic coding sequence
atgaaggctactattatattgcttctgctggctcaggtgtcttgggctggcccctttcagcaaaggggactgtttgattttatgctagaggacgaggcctctggcatcgggcctgaagtgcctgacgatagagatttcgagccttcccttggtcctgtgtgtccctttcggtgtcagtgtcaccttagggtggtgcagtgtagtgatctaggtctggacaaggtgccaaaggacctgcctcccgataccactctgctcgatctgcaaaacaacaagatcaccgagatcaaagatggcgactttaaaaacttgaagaatctgcacgcccttatacttgttaataataaaatctcgaaggtgtcacccggcgccttcaccccattagttaagcttgaacgcttatacttgtccaagaatcagctgaaggagctgccagagaaaatgcctaagaccctccaggaactgagagcccatgaaaatgaaattaccaaggtcagaaaagtcactttcaacgggcttaatcagatgatcgtctag

SEQ ID NO: 114244 - DNA, 1080 bp, Artificial Sequence
  Description of Artificial Sequence: Synthetic coding sequence
atgaaggccaccattatcctcctgctcctggcacaggtatcttgggcggggccatttcaacaacgcgggcttttcgactttatgttggaggatgaagccagcggaatcggtccggaagttcccgacgatagagatttcgagccctcactcgggccagtttgcccatttcggtgccagtgtcatctcagagtcgtacagtgctcagacctgggactggacaaagttcccaaagacctgccccccgacaccactctactggacttacagaacaataaaatcaccgagattaaggatggcgactttaagaatcttaagaacttgcatgcactcatcctggtgaacaacaaaatttcgaaggtctcccccggggcttttacgcctttggtcaaactggaacgcttatacctaagcaagaatcagctgaaagaactccccgagaaaatgcccaagacgctccaggagttgcgcgctcacgagaacgagataacaaaagtgcggaaagtcacctttaacggactgaatcagatgatcgttatagaactcgggaccaatccgttgaagagcagcgggatcgagaacggcgcttttcagggcatgaaaaaactttcatacatcagaatcgcagacacaaatatcacatccattccacaaggtcttcctccatctctgaccgagcttcatctggatggtaataagatctcccgcgtggacgccgcctccttgaaagggttaaacaacttggcaaagcttgggctgtctttcaatagtattagcgccgtcgacaatggatctctggccaacacgccacacttgagagagctgcacttggataataataagttgacgcgtgtgcctgggggtttagccgaacataaatacatccaagtcgtctatcttcacaataataacattagcgtcgtgggatcctcagatttctgtccgcccggacataacaccaaaaaagcatcctatagtggagtgtcgctcttctcaaacccagtccaatactgggagatccaaccttcaaccttcaggtgtgtgtacgtgcgctcagctattcaactcggtaattataagtag

SEQ ID NO: 114245 - DNA, 5598 bp, Artificial Sequence
  Description of Artificial Sequence: Synthetic coding sequence
atgacacgctgggtccccacaaagagggaggaaaagtacggagtcgcgttttacaattatgacgctcgcggggccgacgagttaagcctgcagattggagacactgtgcacatcctggaaacctatgaaggatggtatagaggctacactttacgcaaaaaatccaaaaaaggtatcttccccgcttcttacatccacctcaaagaggccatcgtcgaaggaaaagggcagcatgagactgtgatccccggcgacctgcccctgattcaggaagtgacaacaaccctgcgcgaatggagtacaatttggcgccagctctatgtccaagataatcgggagatgttcagaagcgttcggcacatgatctacgatctgatcgagtggcgctcgcagattctgtccggtacgcttccccaggatgaattgaaggaactgaaaaagaaggtgacagccaaaatcgactacgggaatcgcattttggacctagatctcgtggtgagagatgaggacggtaacatcctggaccccgagctcacaagtaccatatctttatttagagcccacgaaatagcatcgaagcaagtcgaggagcggctgcaggaagaaaaaagccagaagcaaaacatcgatataaataggcaagccaaatttgccgccacaccttccctggccctgttcgtaaatctcaagaatgtcgtgtgcaagatcggagaggacgccgaggtgctaatgagcttgtacgatccagtcgagagtaagtttataagcgagaactacctagtgcggtggtctagctccggcttgccaaaggatattgatcgtttacacaatctacgcgccgtttttactgatttgggaagtaaagacctgaagagggagaaaatcagcttcgtgtgtcaaatcgtgagggtgggcaggatggagctccgggataacaacactagaaagctcacatccggcctgagacgtcctttcggggtagccgtgatggacgttaccgatattataaatgggaaagtcgacgacgaggataaacagcattttattcccttccagcccgtggccggcgagaatgatttccttcagaccgtcataaacaaagtcatagctgctaaagaagtgaatcacaagggccaaggtctctgggtgaccctaaaactccttcccggagatatccaccagatcagaaaagagtttccacatttggttgatcggaccaccgccgtggcccgcaaaacgggctttccggaaatcattatgcccggggacgtgagaaatgatatatatgtcaccctcgttcagggtgatttcgacaaaggctctaaaaccactgccaaaaacgtggaagttacagtgagtgtctacgatgaggatggtaaaagacttgagcatgtgatcttcccaggggctggtgatgaggctatttcagagtacaagagtgtgatctattatcaggtaaaacaaccacgatggtttgaaacagtgaaagtggcgatccccatcgaggacgttaatcgctctcacctgagattcacatttcggcatcgtagctctcaggattcgaaagataagtcagagaagattttcgcattggccttcgtgaagctcatgagatatgacggtaccacacttagagacggggagcacgatttgattgtctataaagcagaggccaagaaactggaagacgctgcaacgtacctgtccctcccgagcactaaggccgagcttgaggagaaaggtcactccgctaccggcaaatctatgcagtcgctcggaagctgcacaatttcaaaagactcattccagatttccacccttgtctgctctacaaaactgacccagaatgtagacctgctcggcctgctgaaatggcgaagcaacacgtcgctactgcagcagaatctgcgccaattaatgaaggtggacggtggagaagtcgtcaaatttcttcaagatactctcgacgccctgtttaacattatgatggaaaatagtgaatccgaaacgttcgacactctagtgttcgatgcattggtttttattatcggtttgatagccgacaggaagtttcagcattttaatcctgtactcgagacctacataaagaaacatttttccgctaccttggcatataccaagcttaccaaggtgcttaagaactacgtcgatggagctgagaagcccggcgtgaatgagcagctctacaaggccatgaaagcacttgagagtatcttcaagttcattgtgcgcagtagaattttatttaaccagctgtacgagaataagggcgaggccgatttcgtggagtccctgcttcagttgttccggtcaattaatgatatgatgtccagtatgagtgatcagaccgtgagagtaaagggcgctgcacttaagtacctgcctacaattgtcaatgatgtaaagttggtgttcgatccaaaagagctcagcaaaatgttcaccgaatttatcctgaatgtacccatggggctgctgacaatccagaagctctactgtctcatcgaaattgtgcatagtgatctgtttactcagcacgactgtcgggaaattctgctacccatgatgactgaccagttgaagtatcatctcgaacggcaggaggacctcgaagcctgttgtcagctgctgagtcacattctcgaagtgttgtaccgaaaggatgtgggcccaacgcaaaggcacgttcagataataatggagaagcttctgagaaccgtgaatcggactgtgattagtatgggtagggactctgaactgataggcaattttgtggcttgcatgacggcgatcctgagacagatggaagactatcactacgctcatctgattaagacctttggcaagatgagaacagacgtggtggattttctcatggagacgtttattatgttcaaaaacctgatcggtaagaatgtatacccctttgattgggtgatcatgaatatggtccagaacaaagtgttccttcgtgcaatcaaccagtacgcagatatgctgaacaagaagttcctggatcaggcaaatttcgagctccagctgtggaacaattattttcacctcgcggtggcgtttctgacacaggagagccttcagctcgaaaacttctcatccgccaagagggctaagatcctgaataagtatggggacatgagacgacagattggctttgagattagggatatgtggtacaatctgggccaacacaaaatcaagtttattccagagatggtcggtcccatcctagagatgactctgattccagagactgagctgaggaaggccacaatacctatcttcttcgatatgatgcaatgtgagttccactccacccgctcctttcaaatgttcgaaaacgagatcatcaccaaactggaccacgaagttgaagggggccgcggcgacgagcagtataaagtgctcttcgacaaaatccttctggaacattgtcggaagcataagtacttagccaagaccggagaaactttcgtgaagctagtggtgaggcttatggagcgcctgcttgactaccggacaattatgcacgatgagaacaaggaaaaccggatgtcatgtaccgtgaatgtgttaaatttctacaaagagattgagagagaggagatgtatattcgatacttatataaactctgcgatctccataaggagtgcgacaactacacagaagcagcatataccctgctactgcacgcaaagttgcttaagtggagcgaggatgtgtgcgtggctcatcttacccagagggacgggtaccaggcgaccactcagggtcagctgaaagagcagctgtaccaggagataattcattattttgacaaaggaaagatgtgggaagaagccatcgccctcgggaaagagttggccgagcagtacgagaatgagatgttcgattatgagcagttgagcgaactactgaagaagcaggcccagttctacgagaacattgtgaaggtaatccggcctaagcccgattattttgccgtcggatattatggccagggattccccacatttcttcgcgggaaggtctttatctaccgcggtaaagaatacgaaagaagggaggacttcgaagcccgccttctgacccagttcccaaacgctgagaagatgaaaaccaccagtccccctggagatgacattaaaaattcacctggccaatatatccagtgcttcactgttaaacctaaactggatctcccccctaaattccaccgtcctgtgtccgagcagatcgtcagcttttatcgcgttaatgaggttcaaagatttgagtattcccgtccaattcggaaaggagaaaaaaatcctgacaacgaatttgcaaacatgtggattgagcggacaatctataccaccgcctacaaactgccaggcattctcaggtggttcgaggtaaaatctgtgtttatggttgagattagcccacttgaaaacgctatcgagaccatgcagctgacgaacgataagattaactctatggtgcagcaacatcttgacgaccctagcctaccaatcaacccgttaagcatgctgcttaacgggattgtcgacccagctgtcatgggcggctttgcgaattacgagaaagccttttttaccgatagatatttacaagagcaccctgaggcccacgaaaaaattgagaaactcaaagacttgatcgcgtggcagattcctttcctggcagagggaatcaggattcatggtgataaagtcaccgaagccctgaggccttttcatgagcggatggaggcgtgcttcaagcagttgaaggagaaagtcgagaaggaatatggtgtcagaataatgccttcgtctctagatgataggcgcggaagcaggccccgtagcatggtccgaagttttacgatgccaagttcttctaggcccttgtctgtggcctctgtgtcaagtctgagtagcgacagtaccccctcccgaccaggctcggacggttttgccctcgaaccactccttcctaagaaaatgcattcgcgctcgcaggataagctggacaaggacgaccttgagaaagagaagaaggacaagaaaaaagaaaagcggaactccaagcaccaggagatctttgaaaaggagttcaaacctactgacatctccctgcaacaatctgaagcagtgatattgtccgagactattagccccctgagaccacagaggccaaaatcccaggtaatgaatgtcatcggctctgagcgccggttcagcgtctcaccaagttccccaagttcccaacagacgccgcccccggtcacacctcgcgctaagttgtcattttcaatgcagtcatcgctggagctcaacggtatgactggtgcagacgtcgcagacgtgccgccacccctgcccctgaagggaagtgttgctgattacgggaacctgatggagaaccaggatctgctaggttctcctacaccgccccccccaccaccacaccagcggcacctgcccccaccactgccctcaaagacacctcctccccccccccctaagactactcggaaacaggcctccgtcgactcaggtattgtccagtag

SEQ ID NO: 114246 - DNA, 6561 bp, Artificial Sequence
  Description of Artificial Sequence: Synthetic coding sequence
atggctggcgagcggacccgacgctttaccaggagcctgctgcgcccaggtcaggccgctgagctgagacattcagctgcttcagctgccgccgtggctgtgagtagtcggcaacaacaacgccaagagaagccacggctcctggaacctcttgattacgagacagtcatcgaagagctcgagaaaacgtaccgaaacgacccactgcaggacttgctctttttcccaagtgatgatttttccgccgcgacagtctcgtgggacatccggactctgtattccaccgttcctgaagacgcagaacacaaggctgagaatttgttggtgaaagaggcgtgcaaattctattcgtcacagtggcatgtggttaactacaagtacgaacagtatagtggagatatccgtcagttgccccgcgctgagtacaagcctgagaagctcccgtcgcactcattcgagatcgatcacgaggatgcagataaggatgaagacaccacatcccactctagcagtaaaggcggggggggcgcaggaggcaccggtgtttttaagagtggttggctgtacaaaggtaactttaacagcactgtgaacaacaccgtaacggtgcgttctttcaagaagaggtacttccagctgacacagctgcccgacaactcctacatcatgaacttttataaggacgagaaaatttctaaagaacccaaaggttgcattttcctggactcctgtaccggagtggtgcagaataatcggctgcgaaagtatgcattcgagctgaagatgaacgatctgacatacttcgtgttggctgcagaaacagagtccgacatggacgaatggatacacacactgaatcgaattctgcagattagcccagagggccctctgcagggaagacgctccacagaactgacagacctgggccttgatagcctggataattctgtgacctgcgagtgcacccctgaggaaactgacagcagtgagaataatctgcacgctgatttcgcaaaatatctcactgagacagaggatacagtcaagactaccaggaacatggagcgtctcaatctcttctcccttgatccagacatcgacactcttaaactacagaaaaaagacttgctggagccagagagcgtaatcaagcctttcgaggagaaggccgcaaagcggattatgatcatctgcaaggccctaaactccaacctgcaagggtgcgttacagaaaacgagaacgatcccatcaccaacatcgaaccctttttcgtgtccgtggccctctatgatctgcgagacagtcgtaagatctctgctgactttcacgtggacctgaaccacgccgcagtacgccagatgctgctcggagcaagcgtcgcactggaaaatggaaatatcgataccatcacaccgcggcagagcgaggaacctcatatcaaaggattacccgaggagtggctgaagttccctaaacaggcagtgttttctgtcagcaaccctcactcagagattgtgctggtggcaaaaattgaaaaagtgctgatgggtaacatcgcatctggggccgagccatacataaagaatcccgacagtaacaagtacgctcagaagatccttaagtctaacagacaattttgcagcaaactgggaaaatacagaatgccctttgcttgggccgtcagatctgtcttcaaggacaatcagggaaacgtcgatcgggacagcagatttagccctcttttccgccaggaatctagtaagatctctacagaagacttagtaaagttagtcagcgattataggagggcagataggatatcaaagatgcaaaccattccgggcagtctggacattgccgtcgacaacgtgccgttagagcacccaaactgcgtcacaagttccttcatccctgtgaagccttttaatatgatggcccagacggagccaactgtggaagtggaggagttcgtatatgattcaacaaagtattgccgcccctatagggtgtataaaaatcagatttatatttatccaaagcacctcaaatacgacagtcagaagtgctttaataaagcccggaacatcacagtgtgtattgagttcaagaacagtgatgaggagtcagccaagcctctcaagtgcatttacggaaaacccgggggccccctgtttacatccgcagcctacactgccgtgctgcaccatagccaaaatcctgattttagcgatgaggtcaagatcgaacttcctacgcagctgcatgaaaagcaccacatcctgttctctttttaccatgtaacttgcgatatcaacgccaaggctaacgcgaagaagaaagaggctctggagactagcgtgggttacgcctggctcccactgatgaagcacgaccagatagctagccaggaatacaacattcctatcgctactagtctaccaccaaactacttgtcattccaagacagtgcctcaggcaaacatggtgggtccgatatcaagtgggtggatggcgggaaacccctgtttaaggtgagtacctttgtggtatcaacagttaatactcaagatccacacgtgaatgccttctttcaagaatgtcaaaagagggagaaggatatgagtcaatcaccaacctcaaactttattcggagctgtaaaaatctgctaaatgtcgagaagattcacgccattatgagtttccttccaattatcctcaatcaattgttcaaagtccttgtgcaaaacgaggaagatgagataaccactacagtgactagagttttaaccgatatagtcgccaaatgtcatgaagaacagctggaccacagtgtccagtcctatataaagttcgtttttaaaacgcgtgcatgcaaagagaggaccgtccacgaagagctggcgaaaaatgtaaccggattactgaaaagcaatgattcaactacggtcaaacacgtgctcaagcactcatggttttttttcgcgattattctaaagagcatggctcagcatttaattgacactaacaaaatccagctacccaggccacagcgattccccgagagctaccagaacgagctggacaacctagtgatggtcctctccgatcatgtgatatggaaatacaaagatgctctggaagaaacaagacgggctaaccatagtgtagcccgctttctgaaacggtgtttcacatttatggacagagggtatgtctttaagatggtgaacaactacatcagcatgttctcctctggggacctgaagacactgtgtcagtataagtttgatttcctgcaagaagtgtgtcagcatgaacacttcattccattgtgcttgccaatcaggtccgcgaacatccctgatcccctgactcccagcgagtcgactcaggaattacacgcttcggatatgccagaatactcagtgacaaacgaattctgcaggaaacattttctcattggaatccttctgcgggaagtggggttcgcattacaggaggatcaggacgtgcgtcatttagctcttgcagtcctgaaaaacctcatggctaagcatagttttgatgacaggtacagggagccacggaagcaggctcagattgcatccctgtacatgcccctctatgggatgctactggacaacatgccccgaatttacctcaaagacctctaccctttcacagtaaacacatcaaatcaaggatccagggacgacctaagcacgaatggcggctttcagtctcaaaccgccataaagcacgccaattcagtggacacctcctttagcaaggacgtccttaacagtatcgcagcattcagcagcattgccatctcaaccgttaaccatgctgacagcagagccagtcttgcaagcctggattccaatccttctactaacgaaaaatctagtgaaaaaactgacaactgtgagaaaatcccccgaccgctctccctgatcggatcaacacttagattcgacaaattagaccaggcagagacccggtctttactgatgtgtttccttcacattatgaagaccatttcttacgagacgctgatagcctactggcagcgggcaccatcccccgaagtgtctgattttttcagcatcctggacgtatgtctgcagaacttccgttatcttggcaaaagaaacataattcgaaagatcgcagccgccttcaaattcgtgcagagtacccagaataatggtactctcaaagggtcgaatcctagttgtcagactagtggtttactgtcacagtggatgcactcaacttcatcacatgaaggtcataagcaacaccgcagccagacgctgcccattatccggggtaaaaacgcactctctaatcctaaattgctgcaaatgctcgataacactatgacatccaactctaatgagattgacatcgtgcaccacgtggacactgaagccaacatcgctactgaagtctgccttactattttagacctgttgagtctctttacacaaacacaccagcgacaacttcagcagtgtgactgccaaaacagcctcatgaaacgcgtcttcgatacctatatgctgttttttcaagtcaaccagtctgccacggccttgaagcatgtgtttgcatcactgcgcctctttgtgtgcaaatttccctcggccttttttcagggccccgccgatctttgcgggagtttctgctatgaggtcctcaaatgttgcaaccatcgatctagatccacccaaaccgaagctagcgcccttctgtactttttcatgagaaaaaacttcgagttcaataaacagaaatcaatcgtgcggtcgcacctgcagttgataaaggcggtcagccagttgatcgccgacgctggcatcggaggcagtcgttttcagcactccctcgcgataacaaataacttcgcgaatggggataagcagatgaaaaattcgaacttccccgccgaggtgaaagatctgacgaagcgtatacgaacggtgctcatggcgacagcccaaatgaaggagcatgaaaaagaccctgagatgctggtcgacctgcagtattcattggcaaatagctatgcctccactcccgaactgagacggacttggctggaaagtatggcaaaaattcatgcaagaaatggtgacctgagtgaagctgccatgtgttatatccacattgccgccctcatagcagagtatttgaaacgcaagggctattggaaagttgagaagatttgcaccgcatcacttcttagcgaagatacacacccctgcgatagcaacagtctcctaactacgccgagcgggggttctatgttttccatgggctggccggccttccttagcatcacaccgaatatcaaagaggagggagcaatgaaagaggactctgggatgcaggacactccctataacgaaaatatcttagtggagcagctgtacatgtgcgtagaatttctgtggaagtcggagaggtatgagctcattgccgacgtcaacaaacccataatcgccgtcttcgaaaagcagagggactttaagaaactgtcagatctctattacgatattcatagaagttacctcaaggtggccgaggtagtcaacagcgagaagcgcctttttggccgatattaccgtgtcgccttttacggccagggattttttgaagaagaagagggaaaagaatacatttataaagagcccaagcttaccggtctgagcgaaatctcccagcggctgttgaagctgtatgcggacaaattcggagcggacaatgtaaaaatcatccaggatagcaacaaagtcaatcctaaggacctcgaccctaaatatgcctatattcaggttacatatgtgacaccattctttgaggagaaagaaatcgaagaccggaaaaccgattttgaaatgcaccataacattaaccgtttcgtgtttgaaaccccatttaccctgtctgggaagaaacatggcggtgtggccgagcagtgtaaaagaaggactatcctgactacatctcacttgtttccgtacgtcaaaaaacgtattcaggtcatcagccaaagtagcaccgagctcaaccctatcgaagtggctatcgatgaaatgtccaaaaaggtgtctgaactcaatcaactgtgtaccatggaggaggtggacatgattaggctgcagttgaagttgcaggggtccgtgagcgttaaggttaacgctgggcctatggcgtacgcccgcgccttcctcgaggagactaatgccaagaaatatcctgataaccaggtaaaactcctgaaggaaattttcagacagtttgcggatgcatgtgggcaggccctggatgtgaatgagcggctgatcaaggaggaccagctggagtatcaagaggaacttcgctcccactataaggacatgctctcagaactcagcaccgttatgaacgagcagatcacaggacgggatgacttgagtaagcgtggggtcgaccaaacatgcacgcgcgtgatttcaaaggccacaccagcgctccccactgttagcatctcatccagcgctgaggtttag

SEQ ID NO: 114247 - DNA, 2103 bp, Artificial Sequence
  Description of Artificial Sequence: Synthetic coding sequence
atgacaagtaacagtaatgagatagatattgtccaccacgttgacaccgaagctaacattgctacagaggtctgcctaaccatccttgatctcctttctctgttcactcagactcaccagagacaactgcagcaatgcgattgtcaaaactcacttatgaagcgagtgttcgacacctacatgctgtttttccaagtcaatcaaagcgccacagctctgaagcatgtttttgcgagcctgagactgtttgtttgcaaattcccatccgccttcttccaaggccccgcggacctctgtggtagtttctgctacgaggtcctcaaatgctgcaatcatcgcagccgatctactcagaccgaggcctctgccttgctttattttttcatgcggaaaaattttgagtttaataaacagaagtccatcgtaagatcccacttgcaattaatcaaggccgtgtctcagcttatcgcggatgcaggaatcggaggctcgcggttccagcatagtcttgccatcaccaataatttcgcaaacggagataaacagatgaaaaactccaattttcctgctgaggttaaggatctgactaaaaggattcgtacagttctcatggcaaccgctcagatgaaggagcatgagaaggatccagagatgttggtggacctgcaatattctcttgccaactcgtatgcctccacaccagagctgagacgtacatggctggaaagcatggcaaagatccatgcacgtaacggggacctgtctgaagctgccatgtgctacatacacattgccgctctgatcgcagaatatttaaagagaaaaggcatgttcagcatgggctggcccgccttcctgtctatcacaccaaatattaaggaggagggcgcgatgaaggaagattccggcatgcaagataccccttacaacgagaatattctggtggagcagctgtacatgtgtgtagagtttctgtggaaaagtgaacgttatgaattaattgctgacgttaacaagcctatcatcgctgtgtttgagaagcagagagacttcaaaaaattgtctgatttatactacgatatccatcggtcatacctgaaggtggctgaggttgtgaactccgagaagcggttgttcgggagatactatagagtggcgttctacgggcagggcgtcggattttttgaggaggaggaagggaaagagtacatatacaaggagccaaagctgaccggactctcagagatatcacaaaggctgctcaagctctacgccgataaatttggagccgacaacgtcaagataatacaggactccaataaggtgaatcccaaagatctggacccaaaatatgcatacatccaagtaacgtacgtgacaccgtttttcgaagaaaaggagatcgaggatagaaagactgacttcgagatgcaccacaatattaacagatttgttttcgagacgccttttacactctcaggcaagaaacacggcggcgtggccgagcagtgtaagcgccgcacaattctgacaacaagtcacctgttcccatacgtgaaaaagaggattcaggtcatcagtcagtcttctactgagcttaatcctattgaagtggcaatcgatgagatgtctaagaaggtgagtgaacttaaccagctttgcacaatggaagaagttgatatgatcaggcttcagttgaagctgcagggttcagtaagtgtgaaggtgaatgctgggcctatggcgtacgcacgtgcatttctcgaagagaccaatgcgaaaaaatatccagataaccaagtgaaactgctcaaggagattttccgacagttcgcggacgcctgcgggcaggcactagacgtcaatgagcggcttatcaaggaggaccagttggaatatcaggaggagctgcgctctcattacaaagacatgctcagcgagctatctacagtcatgaatgagcagctgtgtcgcggcccatgcttatatagcttttgtagtagtgtgagctccatttcccttagcacggttagcaaatcagactacggccaagggagacctgttaaagcacggtctggacctaaccttcatagttccaactag

SEQ ID NO: 114248 - DNA, 6543 bp, Artificial Sequence
  Description of Artificial Sequence: Synthetic coding sequence
atgtcctttcgaggcaaagtcttcaagcgcgaaccttccgaattttggaagaaacgtagaaccgtgcgtagagtgaatcaggaggagatccacagattttcctcacaggagaagcctagattacttgaaccgctggattacgagacagtgatcgaagaactcgagaaaacctatcgcaatgatccattacaggaccttttgttcttcccatcggatgattttagtgccgccacagtgagttgggatattcgaaccctgtactcaacagtgcctgaagacgccgagcacaaggccgagaaccttctggtaaaggaagcctgcaagttctatagttcacaatggcatgtggtcaactacaagtatgagcaatacagcggagatatcagacagctgcccagagcagaatacaaaccagagaaactgccaagtcatagttttgaaattgaccatgaggacgcagataaggacgaggacactactagccactcctcttcaaagggaggggggggggctggagggacaggcgtctttaaatccgggtggctatacaagggaaattttaattccaccgtgaataataccgttaccgtgagaagcttcaagaagcgctacttccagcttacccaactgccagacaacagttacataatgaacttctataaggacgaaaagatttctaaagaaccaaagggctgtatttttctggattcatgcaccggagtcgtccagaacaataggctccgtaagtatgcgttcgaactgaaaatgaacgatctgacctatttcgtcctggccgcggagactgaaagcgatatggacgagtggatacacacccttaataggatccttcagatttctcctgagggacccctacaagggcgccgatcgactgaactcaccgacctgggactggactctcttgacaacagcgtcacgtgtgagtgcacccctgaggaaacagattcgagcgaaaataacctacacgccgatttcgcaaagtacctgacagaaacagaggacaccgtaaagaccacacgcaacatggagcggttgaatctgttttccctcgatcctgatattgacacactgaagttgcagaagaaagacctgctcgagccagaaagcgtcattaaaccttttgaggagaaagctgctaagcgcatcatgatcatatgcaaggcactcaattcaaacctgcagggatgtgtgaccgagaatgaaaacgaccccattactaacatcgaaccctttttcgtgtccgtagcactgtacgacctacgcgattcacgaaagatttccgcagatttccacgtggatctgaaccacgcggctgtaaggcagatgttgctgggcgcaagcgtggccctcgaaaacggcaacattgacaccatcacaccaagacagagtgaggagcctcatattaagggattgcccgaagagtggctcaagttccctaagcaggccgtcttctctgtttcaaatcctcactcagagatcgtcttagtggctaaaatcgagaaggtgctgatgggaaatatcgcctccggcgctgaaccctacatcaagaacccggacagtaacaagtacgctcagaagattcttaagtccaatcgccaattttgctctaagctgggaaagtatcgcatgcccttcgcctgggcggtgagatctgtttttaaagacaaccaggggaatgtagatcgtgattctcgcttcagtccactcttcagacaagagagctccaaaatctcaacggaggacctggtgaaactggtgtctgactatcggagagctgaccggattagcaagatgcagacaattcctggatctttggacatcgctgttgacaacgtgcccctggagcaccccaactgtgttaccagtagcttcattcccgttaagcctttcaacatgatggcacagacggaaccaaccgtagaagtagaggagttcgtttatgattccacgaagtattgtaggccataccgggtgtacaaaaaccaaatttatatttacccgaagcatctcaagtatgatagccaaaagtgttttaacaaagctaggaatattactgtgtgcatagaattcaaaaactccgacgaggaatccgcaaaaccacttaagtgtatctatgggaaaccagggggccccttattcacctccgctgcttacacggctgtcttgcaccactcccagaacccagacttttctgatgaggtgaagatcgaattgccaacacagctccacgagaaacatcacatcctcttttctttctaccatgtgacctgtgatattaatgccaaagcaaacgctaagaagaaggaagcccttgagaccagcgtagggtatgcctggctgcctctcatgaaacacgatcagatagctagtcaggagtataatatcccgatcgccaccagtctcccgccaaactatctatcctttcaggattcagcttctgggaagcacggcggcagtgacatcaagtgggtcgatggtggaaagccactgttcaaggtgtctactttcgttgtgagcacggtgaatacacaagatccacacgtgaatgcctttttccaggagtgtcagaaacgcgagaaggacatgtcgcagtcccctaccagtaacttcattagaagctgtaagaatttattgaatgtggagaagattcacgcgattatgagctttctccccattattctgaatcagctgttcaaggtcctggtacaaaacgaagaggatgagataacgacgacagttacaagagtgttgacggacattgtggctaaatgtcatgaagagcagcttgaccacagcgttcagtcctatatcaagttcgtgttcaaaacccgggcctgcaaggaaagaaccgtgcacgaagagctggctaaaaatgtaactggtctcctcaaatccaatgattcaacaacagtcaagcacgtgctcaagcattcctggttctttttcgccatcatcctgaaatcaatggctcagcacctgatcgacacaaataagatccaattgccccgcccacagaggtttccagagtcatatcagaatgaactcgacaacctcgtaatggtcttatctgatcacgtgatctggaagtacaaggacgcccttgaggagacacggagggctaatcactcggtcgctaggttcttaaagcggtgcttcacattcatggacaggggttatgtctttaagatggttaacaattacatttcaatgttctcttctggcgatctgaagactctgtgtcagtataaattcgacttcctgcaggaagtgtgtcagcatgaacactttattcccttatgcctccccatccgctctgccaacatccctgaccctcttaccccttccgagtcaacccaggagctgcacgcttctgatatgcccgaatattccgtgaccaacgaattctgtagaaagcactttcttattggtatcctgctgagagaagtggggtttgccctacaggaagaccaggatgtccggcacctcgctctcgctgtgttaaagaatttgatggcaaaacactccttcgatgataggtatcgcgaacctaggaagcaagcgcaaatcgcttcactgtatatgcctctgtacggaatgttattggataatatgccgaggatctatctgaaagacttgtatcccttcacagtaaacaccagcaaccagggctctagagacgatctttcaaccaatggagggttccagtcccaaacagccattaaacatgccaactctgtagacacatcctttagcaaggacgtgctgaattcgatcgctgccttttcctcaattgccatcagtactgttaatcatgcggactcccgggcttcgctcgcgtccctcgacagcaatcctagcactaacgaaaaaagttccgaaaaaactgataactgcgaaaaaattcctagacctctgagcctcattgggagcaccctgagattcgataagttggatcaagccgagaccagatcccttctcatgtgttttttgcacatcatgaagaccatctcgtacgaaacattaatagcatactggcaaagagcaccgtcaccggaagtatcagatttcttttccattctcgacgtgtgcctgcaaaactttcggtatctcggtaagagaaacattatcaggaagattgccgccgctttcaagttcgtgcagagtactcagaacaatggtactcttaaaggctctaacccaagttgtcagacgtctggcctcctgtcacaatggatgcactccacgtccagccacgaaggtcacaagcagcataggtctcagacgttgccaattattcggggtaaaaacgccttaagtaaccccaagctgttacagatgctggataacactatgacctccaatagtaacgagattgatatcgtccatcatgtggacacggaggccaatatcgcgaccgaagtctgtctaactatcctggacctgctgtcattatttacacaaactcaccagcggcagctccagcaatgcgattgtcagaacagtctcatgaagagggtgtttgatacttatatgctcttttttcaggtgaaccaatctgctacagccttaaaacacgtatttgccagtctaaggcttttcgtgtgcaagtttccgagtgcctttttccagggcccagccgacctgtgcggctctttctgctatgaggtcctgaagtgctgcaatcaccggtcacgatctacccagacagaagcaagtgcactcctgtacttcttcatgcgcaagaactttgaattcaataagcagaaatccatcgtgagaagtcatcttcagcttattaaggccgtgtctcagctcatcgctgacgcaggtattggtggttcacggttccagcattctttagctattacaaacaattttgcgaacggcgacaagcagatgaaaaacagcaactttcctgccgaggtcaaagacctgacaaaacgaatccggacagttctcatggccacagcgcagatgaaggagcacgagaaagatcctgagatgctagtggaccttcagtacagtcttgccaacagttatgcttcgacaccggagctccgtagaacgtggctggaatctatggccaagatacatgcccgcaacggagatttatccgaagcggccatgtgttatatacacatcgccgcactgatcgcagagtatttgaaaagaaagggttactggaaggtcgagaagatctgcactgcatccctgctctccgaagacacccacccatgtgattctaatagtcttttgaccactcccagcgggggcagcatgttctccatgggctggccagcatttctcagtatcacccccaatataaaagaggagggagctatgaaagaagactcgggcatgcaggatactccttataatgagaatatcctagtggagcagctttatatgtgcgtcgagtttctctggaagtctgagcggtacgagctgatcgctgacgtcaataagccaatcattgcagtgttcgaaaagcagagggacttcaaaaaactgagcgacctgtactatgatatacaccgatcctatctaaaggtggcggaggttgtgaattcagagaaacgcctgtttggtcgctattaccgggtcgcattctatgggcaggggttctttgaggaagaagagggaaaggagtacatttataaagagccaaaactcacaggcctgagtgagatttcgcagcgactgctgaagctgtatgcggataagtttggagccgacaacgttaaaataatacaggattctaataaggtcaatcctaaagatctggacccaaagtacgcctatatccaggtaacatatgtgacaccctttttcgaagagaaggagatcgaggacaggaaaactgacttcgaaatgcaccacaatattaacaggtttgtgtttgaaaccccttttaccctatccggaaagaagcacggcggcgttgccgagcagtgcaaacgccgcacgatcctgacaacctctcatctcttcccctacgtgaagaagcgtattcaggttatctcccagtctagcaccgagctgaatcctattgaggtggcaatcgatgaaatgagcaagaaggtatctgagctgaaccagctgtgcactatggaggaggttgatatgatccggctgcaactcaaacttcaggggagcgtgagcgtcaaggtgaacgccggcccaatggcctacgctcgggccttcctcgaagagaccaatgcaaaaaaataccctgataaccaggtgaagttgctcaaggaaatcttcagacaattcgccgacgcctgcggccaagcattagatgtaaacgaaagactgataaaggaagaccagttggagtaccaagaggagctgcggtctcactacaaagacatgttgtctgaattgagcacagtgatgaatgagcagattacaggaagggacgacttgagcaagcggggcgtggaccagacatgcaccagggtgatttcgaaagccactcccgctctccccaccgtgagtatatcgtcatcagccgaagtgtag

SEQ ID NO: 114249 - DNA, 5493 bp, Artificial Sequence
  Description of Artificial Sequence: Synthetic coding sequence
atggcgccttggcgcaaagctgacaaggagaggcatggagttgccatctacaactttcaagggtcaggcgctccacagctgagtttgcagatcggagacgtcgtccgaatccaggaaacctgtggtgactggtatcgcggttatctgatcaaacataaaatgctgcagggaatcttcccgaaatcctttatacacattaaggaggtaaccgttgaaaaacgtcgcaacactgagaatattattcccgcagaaatcccactggcccaagaagtgaccaccacactctgggagtgggggtcaatatggaagcaactgtacgttgcctcgaagaaggaaaggttcctgcaagttcaatctatgatgtacgatctgatggagtggcgttctcaactgttgtcgggcaccctcccaaaggacgaactcaaggaactcaaacagaaggtgacgagcaaaatagattatggcaacaagatcctggaactagacttgatcgtaagagacgaagatgggaacatcctcgatccggacaacacctccgtaatatccttgtttcacgctcatgaggaggctacagataagatcactgaacggataaaggaagagatgagcaaggaccagccggattatgcgatgtattccaggatatcttctagcccaacccacagtctatacgtgttcgtgagaaattttgtgtgccgtattggggaagatgcagagctttttatgtcgctctacgatcccaacaagcagaccgttatttccgagaattacctggtgagatggggcagtagaggttttccaaaagaaatcgaaatgttaaataacctgaaagtggtgttcaccgatctgggtaacaaggacctgaatcgggacaagatttaccttatttgccagattgtgcgtgtgggcaaaatggatttgaaggacaccggcgcaaaaaaatgcacacaaggactgaggcgtcccttcggcgtggcagtgatggacatcaccgacattataaagggtaaagcggaaagcgatgaagagaagcagcactttattccttttcacccggttactgcggaaaacgacttccttcacagtcttctgggaaaggtaatcgcctcaaagggggactccggcggccaaggattgtgggttactatgaagatgctggtcggagacattattcaaatcagaaaggactatcctcacctcgtggacaggacaacagttgtggcacgcaagttgggctttcccgaaatcattatgcccggggacgtgaggaacgacatctacatcacattgctgcagggagattttgacaaatacaacaagacaacccagcgcaatgttgaggtcattatgtgtgtgtgcgcagaggacggtaaaaccctgcctaacgctatttgtgttggagctggagataagcctatgaacgagtacagaagcgtcgtgtattatcaggttaagcagccccgctggatggagacagtgaaggtcgcagtcccaattgaggatatgcagcgtatacatcttcgcttcatgtttaggcatagatcaagtttagagagcaaggacaagggggagaagaacttcgcgatgtcatacgtgaagctgatgaaagaggatggcacaaccctacatgatggatttcacgacctggttgtgctgaagggtgacagtaaaaaaatggaagatgcatccgcataccttacactgcccagctacaggcatcacgtggaaaacaagggtgcaaccctctcaagatcgtcttctagcgtaggtgggctgtctgtttcctcaagagacgtgtttagcatatcaactctggtatgctccaccaaactcacgcagaatgtggggctgctgggccttcttaaatggcggatgaagcctcagttattacaggagaatctggaaaagttaaagatcgtggatggagaggaggtggtgaagttcctgcaggatacccttgatgctctgttcaatattatgatggaacactcacagtccgacgagtacgacatcctggtgtttgacgcactcatttacataatcggcctgattgctgatcggaaatttcagcacttcaacactgtcctcgaggcctatatacaacaacactttagcgccacactggcctataagaaattaatgaccgtgttgaagacttatctagataccagttctcgtggggaacagtgtgaacctattctgcgcaccctcaaggccctagagtatgtgttcaagttcatagtgcgatctcgtacactttttagccagttgtacgagggaaaagagcagatggagttcgaggagtccatgcggcggcttttcgaaagtatcaataatctgatgaagagccaatataagactaccatcttactccaggtcgctgccctgaagtacattccctcagtgctgcacgatgtggagatggtgtttgatgctaagctcttatcccaactcctgtacgaattttacacgtgtatacccccagtcaaactgcagaagcagaaggtgcaaagtatgaatgaaatcgtccagagcaatctgtttaaaaaacaagaatgtagggatattttgctgccagttattacgaaagagctgaaggaactgcttgagcaaaaggacgacatgcagcaccaggtgctagaaaggaagtactgcgtggaactcctgaattctattctggaggtcctctcctaccaagatgccgcctttacctatcaccatattcaagaaataatggttcaactcttgagaacagtgaataggactgtgattactatgggccgggaccatattctcattagtcactttgtggcctgtatgacagctatcctgaaccagatgggcgatcagcattacagcttttacatcgagactttccagacaagcagtgaactggtggacttcctcatggagacctttatcatgttcaaggatctgattggtaagaacgtgtaccctggtgattggatggcgatgagtatggttcagaatcgggtgtttctgcgggccatcaacaaattcgctgagaccatgaatcagaagtttctagagcatacaaacttcgaattccaattgtggaacaactatttccatttggcagtcgcctttatcacccaagattcactgcagttggaacagttcagccacgcaaagtataacaagatcctgaacaaatacggcgatatgcgcaggcttattggatttagtatccgcgacatgtggtataagctcggccaaaacaagatctgttttatacccgggatggtgggcccgatcctcgaaatgaccctcatccccgaggcagaactccggaaggcaaccatcccgatcttcttcgatatgatgctttgcgaatatcagcgctcaggagacttcaaaaagttcgaaaacgaaattattttgaaattggaccatgaggtagagggaggcaggggcgacgaacaatacatgcagctgctcgagagcatcttgatggaatgtgccgcagagcacccaaccatcgcaaaatctgttgagaattttgtgaacctagtcaagggactcctggagaagctgttggactataggggagttatgacggatgaatctaaagacaaccgaatgagctgtaccgtgaatcttttgaacttttataaagataataatcgggaggaaatgtacatcaggtacctctataagctcagagatctccacctggactgtgataattataccgaagccgcctacacgctgcttctgcatacctggctacttaagtggagcgatgaacagtgcgcaagccaggtcatgcaaacaggacagcaacacccgcagactcatcgtcagctgaaggagacactgtacgagactattatagggtatttcgacaagggaaagatgtgggaagaggccatcagcctgtgcaaagagctcgccgagcagtacgaaatggagatttttgactatgagctgctgtcacagaacctcatacagcaggccaaattctacgagtctataatgaagatcctcagacccaaacccgattactttgccgtgggctactacggccagggcttcccctctttcctgagaaacaaagttttcatatatcgcggcaaggagtatgagcgaagggaggacttccagatgcagctgatgacccagttccctaatgctgagaaaatgaacaccaccagtgcgcccggagacgatgtgaaaaacgccccaggacagtacatccagtgttttacggtccaaccggtcctagatgaacatccgaggtttaagaataagcccgtgcccgatcagatcatcaacttttacaaatcgaactatgtgcagcgattccattattcgaggcccgtccggagggggaccgtagaccccgaaaatgagtttgccagtatgtggatagaaaggacttccttcgtgacggcgtacaagctgccaggcatcctccgctggttcgaggttgttcacatgtcgcagacaacgatctctccgctggaaaatgccattgagacgatgtccaccgctaacgaaaagatactgatgatgatcaaccagtatcagagcgatgaaaccctgcccattaaccctctctcaatgctcttaaatggtatcgtggaccccgccgttatggggggcttcgcgaaatacgaaaaggctttttttaccgaagaatatgtgcgagatcaccctgaagatcaagacaaacttactcacttaaaggatcttatcgcatggcaaatcccattcctgggcgctggcattaagattcacgagaaacgggtttcggacaatcttaggccctttcatgatcgaatggaggagtgcttcaagaatctgaagatgaaggttgagaaggagtacggggtaagagaaatgccggactttgatgataggagagtcggcaggccaagaagcatgctcagatcctaccgccagatgagcatcatatcgctcgctagtatgaacagcgactgctccactcccagcaagcctacaagcgagtccttcgaccttgaactggcatctccaaaaaccccacgcgtagaacaagaagaaccaatatctcccggctctacattgcccgaagtgaaacttagacggtctaaaaagaggacgaagcgctctagcgtggttttcgctgatgaaaaggcagctgccgaatcagatctgaaacggctatcacggaagcacgagttcatgtcagataccaacctttccgaacacgccgctatccctctgaaagctagcgtattgagccaaatgtcttttgcatcccagagcatgcctacaattcctgccttggcattatctgttgcaggcattcctggcttagatgaggccaacacatccccacggctaagtcagacttttttgcagctgtctgacggagataagaagaccttgacgagaaagaaggtcaatcagtttttcaagaccatgctcgcctctaagagcgcagaagaaggtaaacagattcccgactccctgagcaccgacctgtag

SEQ ID NO: 114250 - DNA, 1011 bp, Artificial Sequence
  Description of Artificial Sequence: Synthetic coding sequence
atgtgtgtgtgcgctgaggacggtaagaccctgcccgtcgcagtgccaatcgaggacatgcagcgaatccacctgcgttttatgttccgtcacagaagctctctggaatccaaggacaagggtgagaaaaatttcgcaatgtcttacgtaaaattaatgaaagaggacggaacaacattacatgatggcttccacgacttagtggtcttgaaaggcgactccaagaagatggaggatgccagcgcatacctaactctcccttcttatagacatcacgttgagaataaaggggccactctgagtaggtcatccagctccgtgggaggactgtccgttagctcacgcgatgtcttctctatctcaactctggtgtgctccaccaagctgacacagaacgtgggcctcctcgggttgctcaaatggcggatgaagccccagttggaggagtctatgaggcgcctattcgaaagcatcaacaatctgatgaagagccagtataagacgaccatcctcctgcaggtcgcagcactgaaatacattccatcggtgctgcatgacgtggagatggtgtttgacgcaaaactgctcagccagcttttatatgaattttatacatgcattccaccagtgaagcttcaaaagcagaaggtccagagcatgaacgagatcgtgcaatctaatttgttcaagaaacaagagtgcagggatatcttactgccagtcatcactaaagagcttaaagaacttttggaacagaaggacgacatgcagcaccaagtgctggagaggaagtactgcgtcgaattgcttaattctattctcgaggtcctctcctatcaagatgccgcttttacctatcaccacattcaggaaatcatggtgcagcttctgcgcactgttaaccgaactgtcatcaccatgggccgcgaccatatcctcattggggcgtgttgcaattgcggctttccctctagtacacctcactcactaattcagtggctttggggctag

SEQ ID NO: 114251 - DNA, 2676 bp, Artificial Sequence
  Description of Artificial Sequence: Synthetic coding sequence
atgaccgctatcctaaaccagatgggcgatcagcactactcattctatattgaaacatttcaaacttcaagcgaattagttgattttttgatggagaccttcataatgttcaaggatctgatcgggaaaaacgtgtaccccggcgactggatggccatgagcatggtgcaaaaccgggtgttcttgagagccataaataaatttgccgagacaatgaaccagaagtttctggagcacaccaactttgagttccaattatggaacaattacttccacctggccgtggcctttatcacacaggatagcctgcagttggagcaattttcacacgctaaatacaacaagatcttaaataaatacggagacatgcgacgcttgattgggttctcgattcgcgatatgtggtacaaactggggcagaataagatctgctttatcccgggaatggtgggccccattctcgagatgacactgattcccgaggctgagctgcgtaaggctactatccctatattctttgacatgatgctgtgcgaatatcagcgatctggcgactttaaaaaatttgagaatgaaattattctgaagctagaccatgaagtggaaggggggaggggcgatgagcagtacatgcaactattagagagcattttgatggagtgcgccgccgagcatccgacaatcgcaaaatccgtggaaaattttgtgaatctggtgaagggtttgcttgagaagctgctggactatcgtggtgtcatgactgatgaatcgaaggataaccgtatgagttgtactgtgaatctgctcaatttctataaggacaacaaccgtgaggagatgtacatccggtacctgtacaaactgagggatctacatctcgattgtgataactatactgaggctgcttacacgcttcttttgcacacttggttgcttaagtggtccgacgagcagtgtgcctcccaggtaatgcaaaccggacagcagcatccgcagacccatcggcagcttaaggagactctgtacgaaaccattatcgggtatttcgataaaggtaagatgtgggaggaggccattagcctttgtaaggaactggccgagcagtatgaaatggaaattttcgactacgagttgttgtcccagaatctgatccaacaagcgaagttctacgagagcataatgaaaattctgcgaccgaagcccgactattttgcggtgggctattacggacagggatttcccagttttttgcgaaacaaggtctttatctaccgagggaaggagtatgaacgaagagaagacttccagatgcagctgatgacccagttcccaaatgccgagaagatgaacacgacttcagcccctggagatgacgtgaaaaatgcgcccgggcagtacatccagtgtttcaccgtgcagcctgtgcttgatgagcatccccgattcaagaacaagcccgtacctgaccagatcatcaacttctataagagcaactacgtacagaggttccattattctaggccagtgcgtagggggacagtggaccccgagaacgagttcgccagcatgtggatcgaacgtacttcctttgtcaccgcatacaaactaccaggcattttgcgttggttcgaagtcgtccatatgtcccagactacgatctcacccttggagaacgccattgaaacgatgtcgaccgccaacgaaaaaatcctgatgatgattaatcaataccagtccgatgagacgctccccatcaaccctctgtccatgctactaaatgggatcgtcgacccagccgtcatgggtgggttcgcaaaatatgaaaaagcctttttcacagaggagtacgtgcgcgatcaccccgaggaccaggacaaattaactcatctcaaagatctaattgcttggcaaataccttttctgggcgcagggattaaaatacacgaaaagagagtgtctgacaacttgagaccctttcatgatcggatggaagaatgcttcaagaacttgaagatgaaggtggaaaaggaatatggggttagggaaatgcccgacttcgatgataggcgggtgggccgcccacgctctatgctgagatcgtatcgtcagatgagcattatcagtctggcctcaatgaactcagattgctctacccctagtaaacccacatctgagtctttcgacttggagcttgccagccccaaaaccccgagggtagagcaggaagagcctatctcaccaggttctactctgcctgaggtaaagttacgcagatcaaagaagcggaccaagcgatccagcgtggtcttcgctgacgagaaagcagccgcagagagcgacctgaaacgcttgagcagaaagcatgagtttatgtctgataccaacctttcagagcatgcagcgatcccactgaaagccagtgttttgagtcaaatgagcttcgccagtcaatccatgcccaccatccccgcactagcgctgagcgtggccggtatcccaggactggatgaggccaacacatccccacggctgagccagaccttcttacagctgagcgacggggacaaaaaaactctcactcgaaagaaagttaaccagtttttcaagaccatgctcgcttcgaagtctgccgaggagggcaagcagatccctgacagtttatccacggacctctag

SEQ ID NO: 114252 - DNA, 6093 bp, Artificial Sequence
  Description of Artificial Sequence: Synthetic coding sequence
atgtggaccccaacagaggaggaaaagtatggcgtggtcatatgctccttccgcggctccgtgccccagggcctggtgttagagattggtgagaccgttcaaatactggaaaaatgcgaggggtggtacagaggtgtctccacaaaaaagcctaacgtcaaaggaatctttcctgccaattatatacatctaaagaaagcgattgtgtcgaaccgcgggcagtacgagacggttgtcccgctcgaggacagcatcgtaacggaggtaaccgcaaccctccaggagtgggcgtctctttggaaacagttgtacgtaaagcacaaggttgaccttttttacaagctgcgtcacgtaatgaacgaattaattgaccttcgaaggcaacttctgtcgggccatttgacgcaagaccaggtccgggaagtgaaacgccatattaccgtgaggctcgactggggaaacgaacacctcggcctcgacctagttccacgaaaagattttgaggtggtggatagcgaccagatttccgtgagtgatctgtataagatgcaccttagctcacgccaaagtgtgcagcagagtacttctcaagtcgacacaatgcggccaaggcacggcgagacctgccgcatgccagtgccacaccactttttcttatcattgaaaagttttacttataatacaattggcgaagacacagacgtatttttttctctatatgacatgagagaggggaagcagatctcagagcggttccttgtgcgcctgaataaaaatggaggaccccgcaaccccgagaagatagaacggatgtgtgccctgttcacggacctgtcaagcaaagacatgaagagggatctctatatcgtcgcacacgtcattaggatcggacgcatgctgcttaatgatagcaagaagggtcctccacatcttcattaccgtaggccatacgggtgcgctgtgttatctatcctcgatgtgctgcagtcactcacagaagtgaaagaagagaaagattttgtgttaaaggtctacacatgcaacaatgagagcgagtggtctcagatccacgagaacataattcggaagagcagcgccaagtatagtgcgccctcagccagtcatggcttaatcatcagcctccagctgctgcgaggcgatatggaacagattcgcagagaaaaccctatgatctttaaccgaggattggccattacacggaaactggggtttccagatgtgattatgccaggggacatccgaaatgatctgtacctcactctggagaagggagacttcgagaggggcggtaaaagcgtgcagaagaatatagaagtaaccatgtatgtgctctatgccgatggcgaaatcctgaaggactgcatatcgctgggatccggagagcctaatcgcagctcctatcacagctttgtcctataccatagtaatagccccaggtggggcgagatcataaagctgccaatccccatagaccggttccgcgggtcccatctccgcttcgagtttagacactgtagcacgaaggacaaaggcgagaaaaaactctttgggttcgccttcagcactctcatgcgggatgacgggacgaccctgtctgatgacattcacgaactgtacgtctacaagtgcgacgagaattccacctttaacaaccacgcgctttacttgggtctcccctgttgtaaagaggactataatggctgcccgaacattccatcttctctgatatttcagaggagtaccaaggagtcttttttcatcagcacccagctgagttcaaccaagctgacccaaaacgtggacttgctggccctccttaagtggaaagcattccctgataggatcatggacgtactgggcagactgcggcatgtgtcaggtgaagagattgtgaagtttcttcaggacatccttgatacattattcgtcatcctggatgacaacacagagaaatacggactgctggtattccaaagtctcgtgttcatcatcaatctgttgcgcgacattaaatactttcacttccggcctgttatggatacctatatccaaaagcattttgccggggccttggcatataaagagttaattcggtgtctgaaatggtatatggattgctcagccgagctcatcaggcaagaccacatccaggaggccatgcgggccttggagtatctctttaaatttatcgtccagtcccggattctatacagcagggccacctgcggcatggaggaagaacagtttcgctcctccatccaggagctgtttcagtccatcagatttgtgttgagcctggacagtagaaactccgaaaccctgctcttcactcaggccgccctgctgaacagcttccccactatttttgatgaactcctacagatgtttacagtacaggaggtcgccgagtttgtacggggcacactgggctctatgcctagcacagtccacattgggcagagcatggacgtcgttaaactgcaatccatcgctaggactgtggactctcgcctgttctcattctctgagtcgaggaggatcctgctgccggtggtgctacaccacatccatctccatctgagacagcaaaaagaattgctgatctgtagtggcattttaggtagtatcttcagcatcgtgaagacaagttctctggaggctgatgtgatggaggaagttgaaatgatggtagagtcactcctagatgtacttttgcagactcttttgactattatgtcgaagtcccatgcccaggaagcagttagaggccagcgatgtcctcagtgtactgctgagatcactggtgagtacgtaagctgtctgctctcgcttttgcgtcaaatgtgtgatacacattttcagcacttgctggataatttccagagtaaggatgagctcaaggaatttctgctgaaaattttctgtgtcttccgcaatcttatgaagatgtccgtgtttccccgggattggatggtaatgaggctcttaacctcaaacattatcgtgaccacagttcaatacctaagctcagcattgcataagaacttcacggagactgatttcgatttcaaagtatggaattcatacttcagcctcgcagtgctatttatcaatcagccatcgctgcagctggagatcattacctccgcgaagagaaagaaaatcttggataagtatggggacatgcgagtgatgatggcctatgagctgttcagcatgtggcagaatctcggcgaacataagatccactttattcccggaatgataggccccttccttggagtgacactggttccgcaaccagaggttagaaatatcatgattccgatctttcatgatatgatggactgggagcagaggaaaaatgggaactttaagcaggtggaagccgaactcattgataaactggattcaatggtgagcgagggcaaaggggatgaatcctatagagagctcttcagtctgctgactcaattatttggcccatatcctagcctgctggagaaggttgagcaagaaacatggcgcgaaaccggtatatctttcgtcactagtgttactcggctaatggagcgcttgctggactaccgggattgcatgaaaggcgaagagaccgagaataaaaaaataggctgtactgtgaacctgatgaacttctataagtcggagattaataaagaggagatgtatatacgatacatccacaaattgtgtgacatgcatttgcaagcagaaaactataccgaggccgcctttacgctcctgctatattgcgagttactacaatgggaagacaggccactccgggagttcctgcactatcccagtcagactgagtggcagcggaaagaagggctctgccgtaaaatcatccactactttaacaagggtaagagctgggaatttggaatccctctctgcagagaactcgcctgccagtacgagagtctgtatgactatcaatctctgagctggatcagaaagatggaggctagttattatgacaacattatggagcagcagcgtctggagccagaattcttcagagtcgggttttacggacgcaaattcccattcttcctgcgcaataaggaatatgtgtgcaggggtcacgattacgaacggctggaggcattccagcagaggatgctctcagaatttccccaggccgtcgctatgcagcaccctaaccaccctgacgatgctatcctgcagtgcgatgcacagtatctgcaaatttatgctgtgaccccaatccctgattacgtggacgttctacagatggatagggtccctgacagggtgaaatccttttaccgtgtgaacaatgtacgtaaattccggtacgaccgtccttttcataagggccctaaagataaggaaaacgagttcaagtcactgtggatagagcggacaactctcaccctgacccactcacttccaggcattagtcggtggttcgaggtcgaacgaagggagctggtggaagtgtcaccacttgaaaacgccatccaggtcgtggaaaataagaaccaggagctgcgctcccttattagccaatatcaacacaaacaggtgcacggcaatatcaaccttctgagcatgtgtctcaacggggtgatagacgcggccgtgaatggcggaatcgcgcggtatcaggaggctttttttgataaggattacatcaacaagcatcctggcgacgcagagaagattacccagctgaaagaactcatgcaggaacaggtgcacgtgttgggtgtcggacttgcagtccacgagaaatttgttcaccccgaaatgcggcccctgcacaagaaactgatcgatcaatttcaaatgatgagggcttctctgtaccacgaattcccaggtttggacaagctgtcacccgcatgttcaggcacctcaactccccgaggcaatgtcctagcttcccactctccaatgtcgccggaatcgattaaaatgacccacaggcatagtcccatgaacctgatgggcaccggtcgccactccagttccagtctttcgagtcacgcgtccagcgaagcggggaacatggtgatgttgggcgatggtagcatgggcgatgcacccgaagatctgtaccatcatatgcaactggcctacccaaaccccaggtatcagggatcagtgacgaacgtttccgtgttgtcatcctcccaggctagtccctcgtcctcaagcctcagctctacccattcagccccttcccagatgataacgagcgccccatcctcagcccgggggtccccaagcctgccggacaaatatcgtcacgcaagagagatgatgctgctgcttcctacatatagagaccgccccagttctgctatgtaccccgctgccattctggaaaatgggcagccccccaatttccagagggcactgtttcagcaggtggtaggtgcgtgcaaaccctgtagcgatcccaacctgtctgtggccgagaagggtcactacagcctgcattttgacgcttttcatcatccacttggcgatactccacccgccctgcctgccaggactctgcgaaaatcaccacttcatccgatccccgcgtcacctaccagtccccagtctgggttggacggctctaactcaacacttagcgggtcggcgagctcgggagtctctagcctgagcgagtcaaacttcggtcatagtagcgaggccccacctaggaccgatacaatggacagcatgccgtcgcaggcttggaacgctgatgaagatctggaacctccatatctgcctgtgcattatagcctatcggagtctgctgtcttagactccattaaggcacagccatgccgttcacacagcgcgccaggttgcgtgataccacaggatccaatggacccaccagcacttccaccaaaaccgtatcatcctaggctgccggcacttgaacatgacgaaggcgttctactcagggaagagacagagcgaccccgaggactgcataggaaagctcccctacctcccgggtcagccaaagaagagcaggctcgaatggcctgggaacacggacgcggcgaacagtag

SEQ ID NO: 114253 - DNA, 1785 bp, Artificial Sequence
  Description of Artificial Sequence: Synthetic coding sequence
atgccaaagtggctggaagagaccgagaacaagaaaatcggttgcaccgtcaacctcatgaatttctacaaatctgaaatcaacaaagaggagatgtatattcggtatatccacaagctgtgtgatatgcatttacaggcagagaattatactgaagctgcatttaccttgcttctctactgcgagctgttacaatgggaggatagacccttgcgcgaatttctgcactatccctcccaaaccgaatggcagcggaaggagggactgtgtcggaaaataatacactacttcaacaaaggcaagtcctgggagttcggcatacccctgtgtcgggagctcgcctgccagtacgaaagtctatacgactaccagtccctaagttggatacgaaagatggaggcttcctattacgataatattatggagcagcagaggctggagccagagttctttcgggtgggcttctacggcagaaagtttcctttcttcttaaggaacaaggagtacgtgtgtaggggacatgattatgaaaggctggaggcctttcagcaacgcatgctgtctgagttccctcaggctgttgctatgcagcatccgaatcaccctgatgatgctattctacagtgcgatgctcaatatctccaaatctacgccgtgactccaatccctgactacgtcgatgtgctgcagatggatagagtgcctgatagagtgaagtcattttatagagtcaacaacgtgcggaaattcagatatgatcggcctttccacaaaggcccaaaagacaaggagaacgaattcaaatctctgtggatcgagagaaccaccctgaccctgacccacagcttgccaggcatttctcggtggttcgaggtggaaaggcgggagctggtggaagtgtccccattggaaaacgcaatccaggtggtcgagaacaagaaccaggagttaaggtctctcatatcacaatatcagcacaagcaggtgcacggtaatatcaatctgctcagtatgtgcttgaacggcgtgatcgacgcagccgtgaatggaggtatagcgagatatcaggaggctttttttgataaggactacattaacaaacacccgggcgacgcggagaagatcacacagctgaaagaacttatgcaggagcaggtccatgtccttggggtgggcttagccgtgcatgagaaattcgtgcaccctgagatgcgaccactacacaagaagctaattgatcaattccagatgatgcgtgcttcactttaccacgaattcccagggctggataagttaagtcctgcttgctcaggcacaagcacccccagaggcaatgtcctggcctcacactcacctatgagccccgagtccattaaaatgacacatcgacactctcctatgaacctaatgggaactggtagacacagctctagttcacttagctctcacgcctcctctgaggcgggcaatatggtgatgttgggtgatgggtccatgggcgacgcacccgaggatctttatcaccacatgcagctcgcctatcccaatccacgctatcagggaagtgtaacaaatgtctcagtgctgtcatctagccaggcctcaccctcaagcagttctttatcctcgactcatagcgccccctctcaaatgattaccagcgccccctccagcgcgaggggaagccccagccttcctgacaagtaccggcatgccagggagatgatgctgctgcttcctacttaccgcgacaggccgagcagcgccatgtacccggccgcctag

SEQ ID NO: 114254 - DNA, 5778 bp, Artificial Sequence
  Description of Artificial Sequence: Synthetic coding sequence
gtcatcgccagtttccgcgggacggtcccatacggcctgagtcttgagataggtgataccgtgcagatacttgagaagtgtgacgggtggtatagagggtttgctctgaagaacccaaatatcaaggggatcttcccatcatcctatgtgcatttaaagaatgcctgtgtcaaaaataaggggcaatttgagatggtcattcccacagaggactctgtgattaccgagatgacatctaccttgcgcgattggggcactatgtggaaacagttgtacgtcaggaatgaaggcgatctgttccatagactctggcatattatgaacgaaatacttgatcttaggaggcaggtgttagtggggcacctgacccatgatagaatgaaagacgtgaagcgacatatcactgcaaggctcgattggggcaacgaacagctaggcctcgatctggtaccacgaaaagagtacgctatggtggaccccgaagatatatccatcactgaactgtatcgtctcatggagcaccggcaccgcaagaaagacacacccgtccaggcatcctctcaccacctctttgtgcagatgaagtctctcatgtgttccaacctgggtgaagaactggaggtaatcttcagccttttcgactctaaggagaataggcctatatctgaaagattctttttgcggctcaacagaaacggactccctaaagctcccgacaagcccgaacgccactgctccctgttcgtggatctggggagctctgagcttagaaaagacatctacatcactgttcatattattcgcatcggccgcatgggggctggtgagaaaaagaacgcttgcagtgtccaatataggcgacccttcgggtgtgctgtcctgtcgatcgccgacttgctgaccggggagactaaagatgatttaatccttaaagtgtatatgtgtaacaccgagtctgaatggtatcagatccacgaaaacataatcaagaagctcaacgccaggtacaacctcactgggtcaaacgcagggttggctgtgagcctacagctgcttcacggtgacattgagcagattagaagggagtatagtagcgtattcagccacggcgtgagtatcacgaggaaattgggtttctcgaacattattatgcccggcgaaatgcgtaatgacctttacatcacgatagagcggggtgagttcgaaaaaggcggcaaatctgtggcccgcaatgtggaggtgacaatgtttattgtggattccagcggtcagacactaaaggatttcatttcttttggatctggcgagcctcccgccagtgagtaccactcttttgtgctttatcataataactccccaagatggagtgagctgcttaagctgcccattcctgtggataaattcaggggggcccatattagatttgaattccggcattgctccacgaaagagaagggcgagaagaaactttttggctttagcttcgtcccactaatgcaggaagacggacgaaccctgcccgatggaacacatgaactcatagtgcataagtgtgaggagaatacgaacttgcaggacaccaccaggtatctgaaactgccattctccaagggcattttcctcggcaataataaccaggcaatgaaagctacgaaagaatctttctgcatcacgtcattcctatgctcaacaaagctgacacaaaacggggatatgttggatctcctgaagtggcgcacccatcccgataagatcaccgggtgtcttagcaagcttaaggagattgacggatctgaaattgttaaattcctgcaggataccttggacactctgtttggaatattggacgagaattcacagaagtatggctctaaggtgttcgattcactggttcacattattaacctcctccaggattccaagttccaccactttaagcccgtgatggatacgtatatagaaagtcacttcgccggggccctggcctatcgggatttaattaaggttctcaagtggtacgtggacagaatcacggaggccgagcggcaggagcatatacaggaagttctgaaggcgcaggagtacattttcaaatatatcgtgcagtctcggcggcttttctccttggccaccggcggacagaacgaagaggagtttcgctgttgtatccaggaactgcttatgagcgttagatttttcctctcccaggagtccaaaggatctggagcattgagccaaagtcaagccgtgtttctcagctcctttcctgctgtctatagcgagctgctcaagctgtttgatgttcgtgaagttgccaatttagtgcaggatactctggggtctctgcccacgattctgcacgtggacgactccctccaggctattaaactccagtgcattggaaagaccgtagagtcacagttatataccaaccccgactcccgttacattctgctgcctgtggtacttcaccacctccacatccatctgcaggaacagaaagatctgatcatgtgtgctcgaatcctgagcaatgtgttttgtttgattaaaaagaattctagcgagaagtctgtcctggaagaaattgacgttatagtagcttcccttttagacatcttactcaggaccattctcgagataacgagtcggccacaaccctcttcaagtgctatgagattccaatttcaggacgtaactggggagttcgtggcgtgcctactgagcctgctgaggcagatgactgaccgccattaccagcagttgctggattcattcaacaccaaggaagaattgcgcgacttcctgctgcaaatcttcaccgtcttcaggatactgattaggcccgaaatgtttccaaaggattggaccgttatgagattggtagccaataatgtgatcatcaccaccgtgctgtacctaagcgacgctctgcggaagaatttcttaaacgagaactttgactataagatatgggattcatacttctacctggcggtaatcttcataaatcagttgtgcctccaattggaaatgttcacgccttctaagaagaagaaggtgctggaaaaatacggcgacatgagggtgaccatgggctgtgaaattttttccatgtggcagaatctcggcgaacacaaactacactttattccggccctgattggaccttttctggaggtgacccttatcccccagcctgatctccggaacgttatgatcccgatatttcacgacatgatggattgggagcagaggaggtccggtaattttaagcaggtggaagccaagcttattgacaaactagattcgctgatgtctgagggcaaaggggatgaaacctaccgcgagctttttaattccattattcccctgttcgggccttatccatctcttctgaagaaaatagaaagggagacgtggcgggaatccggagttagcttaattgcgaccgttactaggctcatggagcggttgctcgattaccgggactgcatgaagatgggagaggtagacggcaagaagatcgggtgcaccgtgtcactgttgaacttctataaaactgaacttaataaagaggaaatgtacatccggtacatccacaagctgtacgaccttcacctgaaagcacagaattttactgaggccgcatacaccttgttactttatgatgaattgctggaatggtccgatcggcctttgcgggagttcctgacgtaccccatgcaaaccgagtggcagaggaaggaacatctgcatcttactataatccagaattttgacaggggcaaatgctgggaaaacggcataatcctgtgccgtaagatagctgagcagtacgagtcgtattatgactacagaaacctgagcaaaatgcgtatgatggaagcctctctctacgataagattatggaccagcagcgtcttgaacccgagtttttcagggtgggattctatggcaagaaatttccattttttctgcgcaacaaggaattcgtgtgtcgcggtcacgactatgagcgcctggaagccttccagcagaggatgctgaacgagtttccccacgcgatagccatgcagcacgcaaaccaacccgatgaaactatatttcaagctgaggctcagtatctacaaatctacgctgtcacaccgataccagaatcgcaagaagttttgcagagggagggagtccctgataacattaagagtttctacaaagtgaaccacatctggaagttccgctacgatagaccctttcataagggcaccaaagacaaggagaatgagtttaagtcgttatgggtggagagaacaagtctgtatctggttcagagtcttcccggcatctcaaggtggttcgaagtcgaaaaaagggaagtcgtggagatgagtcccttagagaatgcaatcgaggtactggagaataagaaccaacagttgaaaacacttatttcccaatgtcagactcgccagatgcaaaatattaaccccttaacaatgtgtctcaacggagtgatcgacgctgccgtcaacgggggcgtatctcgctatcaggaggcctttttcgtgaaggaatacatcctaagccatcccgaggatggtgaaaagatagctcgcctcagggagcttatgctggagcaggcccagattctcgagtttgggctggcggtgcatgaaaaattcgtccctcaggacatgcgacctttgcacaagaagctagtggaccagttcttcgttatgaagagttctcttggaatccaggagttcagcgcatgcatgcaggcttccccagttcattttcctaatggcagcccccgtgtttgccggaattctgcacccgctagtgtgagtcctgacggaacaagggtcatacccaggagatcgccgctgtcatacccggctgttaaccgctattcaagctcatccctcagctcacaggcttctgccgaagtgagcaatatcacagggcagtccgaatcatctgacgaggtattcaacatgcagccaagtccatccacgtcatctctcagttctacgcacagcgcttccccgaatgtcacatcctcagccccatcatcagcacgggcttcacctttattgagtgataaacacaaacacagccgcgaaaattcctgtctgtcaccacgggagagaccttgcagcgcgatttatcccacccccgtggagccttctcagcggatgctgttcaaccacatcggcgacggtgccctgccaaggtccgatccgaacttgtccgcgccggaaaaagcctctcctgcgaggcataccacctccgtgtcacctagtcccgccggtagatcaccgctgaagggctccgtgcagtcatttacaccatccccagttgaataccactccccgggtctgatttcaaatagtccggtgttgtccggttcttactcatcgggcatctccagcctgtcaaggtgtagcaccagtgagaccagcgggttcgagaatcaggtgaacgagcaatcagctccactgcccgtccccgtgcccgtccccgttccgtcctacggaggtgaggagcctgtgaggaaggagtctaaaacccctccaccgtattccgtttatgagcggacgcttaggaggccagtgcctctgccacacagcctgagcatcccagtgactagcgaacccccagctttacctcccaaaccactcgcagctagatcatctcacctggagaacggcgctcgcaggacggatcccggtccccgccccaggcccttgcctcgaaaagtgtcccagctttag

SEQ ID NO: 114255 - DNA, 5865 bp, Artificial Sequence
  Description of Artificial Sequence: Synthetic coding sequence
gtcattgcctcctttcgggggactgtgccctacggactgagtctggaaattggcgacacagtacaaatactggagaagtgcgatggttggtatcgcggcttcgccctgaagaaccctaacatcaagggcattttcccaagcagttacgttcatctgaagaatgcatgcgtgaagaacaagggccaatttgaaatggtcattcctacagaagactccgtgataacagaaatgacatctacactccgggactggggtactatgtggaagcagctgtatgtgcgcaacgagggcgatttattccacaggttgtggcacattatgaatgagatcttagatctgcgcagacaagtgctggtgggccatctgacacatgaccggatgaaggacgtgaagagacacatcaccgctcggctcgactgggggaacgagcagctcggactcgacctagtgccgcggaaggagtacgccatggtggatcccgaggatatctcaatcacagaactttatcgcctaatggagcacaggcaccgaaagaaagacaccccagtgcaagcgtctagccaccatctgttcgttcagatgaaaagtttgatgtgctcaaacctgggcgaggagctggaggtcatcttctcactgtttgattccaaggagaacagaccgatatccgaaaggttcttcttacgcctgaacagaaatgggctgccaaaagctcctgataaacccgaacgccattgttccttgttcgtagatctcggaagtagcgaacttagaaaagacatttatatcactgtccacatcattcgcattggcagaatgggtgccggagagaaaaagaatgcatgctccgtccagtatcggagaccgtttggttgcgctgtcctaagcatcgctgatctcttgacaggggagacgaaggatgacctaatcctcaaggtgtatatgtgcaacacagagagcgagtggtaccagatccacgaaaatatcatcaagaagctcaacgctagatacaatttaaccggctccaatgccgggctggcagtgtctctgcagctcttacatggggatattgagcagatacggcgggagtactctagcgtgttctcacacggggtgtctattacaagaaagttgggcttctctaatatcatcatgcctggggagatgaggaatgatctgtatatcacgattgagcggggggagttcgagaagggcggaaagtctgtggctaggaatgtcgaggttaccatgtttatagtcgacagcagtgggcagacattgaaagacttcatcagttttgggtcgggggagcctcccgcgtccgaatatcactcatttgtactgtatcacaacaactctccaagatggagtgaactactaaagcttcccattcccgtggacaaatttcggggtgcccatattcggttcgagtttcgtcactgctctaccaaagagaagggcgaaaaaaaactgtttggattctcctttgtgcctctcatgcaggaggacggcagaaccctccccgacgggacacacgagctgatcgtacataaatgtgaggaaaatactaatttgcaagatacgaccaggtatctgaaattaccattcagtaaagggatcttccttgggaataataaccaggcaatgaaggccacaaaagagagcttttgcatcacaagcttcttgtgcagcacgaagctcacccaaaatggggatatgttggacctactgaagtggcggacacaccccgacaagatcaccggttgcctatcaaaactgaaagagattgacggctccgaaatcgtcaagttcttgcaggacacacttgatactctgttcgggatcctggatgagaacagccaaaaatatggctcgaaggtcttcgacagtctcgtgcatatcatcaatctgctccaagacagcaagttccaccattttaaaccagtcatggacacttatattgagagccacttcgccggagcgctggcatatagggatttgatcaaggtgctgaagtggtatgtggatcgaatcacggaggcagaacgacaggagcatatccaggaagtcttgaaggctcaggaatatatctttaaatatattgttcaatccagaagattattctcactggcgacgggaggccaaaatgaagaggagtttcgttgctgcatccaggagctcttaatgtctgtgagatttttcctgtctcaggagtccaagggctccggagcattaagccaatcccaggcagtattcctgtcctctttccccgcagtctactctgagcttcttaaattgttcgacgtcagagaggtcgccaatctagtgcaggatacactcggttctctccccaccattctgcatgttgatgactccctgcaggccatcaagctgcagtgcatcggaaaaactgtggaatctcagctgtatacaaatcctgacagccgttacatccttctgccggttgtgttacaccacctccacattcacctgcaggaacagaaggatttgataatgtgcgcaagaatactgagcaatgtgttctgccttatcaagaagaactcctcagaaaagtcagtacttgaggagatcgatgtcatcgtggcatccctgttagacatcctcctgcgcacgattcttgagatcacatctcgtccacaaccctctagctcagcgatgcgattccagttccaggacgtgaccggggagttcgtcgcttgcttgctaagccttctgcgacagatgaccgaccggcactaccagcagttactggactcctttaacactaaggaggagttgcgagatttcctgttacagattttcacggtcttcagaattctgatacggcccgagatgtttcccaaagactggacggtgatgcggctggtggctaataatgtcatcattacaaccgtcctttacctgagcgacgcccttcgtaagaacttcctgaacgagaattttgattataagatatgggactcgtacttctacctggctgtgatttttataaatcagctttgcctgcagctggagatgttcaccccatcaaaaaagaagaaagtcctggagaagtatggagacatgcgcgtgactatggggtgtgagatttttagcatgtggcagaatcttggtgagcacaagctgcacttcattcctgccctcataggcccattcttggaagtgacactcatcccacagccggatctgcgcaatgtgatgattcctatcttccacgacatgatggactgggagcaacgccgctctggcaacttcaagcaagtggaggctaagttaatcgataagcttgattccctaatgagcgagggcaagggggacgaaacatatcgcgaattgttcaattctatcctgttgaagaaaattgagagggagacttggcgtgaaagtggcgttagcctcattgccactgttacacgactgatggaacgacttctggactatcgcgattgcatgaaaatgggtgaggtggacgggaagaaaatcggctgcacagtgagcctcttaaatttctataaaactgagctgaacaaggaggagatgtacatacgctacattcacaagttatatgaccttcatttgaaggcacagaacttcacagaggctgcttacacactgctgctctatgacgagcttttggagtggtcagaccgccccctcagggagtttctcacataccccatgcagactgaatggcaacgcaaagagcacctgcacctcacaatcatacagaacttcgaccggggaaagtgttgggagaacgggattattctgtgccgtaaaatcgcagagcagtatgagtcctattatgattaccgcaatctgagtaagatgaggatgatggaggcgtccttgtatgacaaaatcatggatcagcagcgcctggagccagaattctttcgcgttgggttctatggaaagaagtttccattttttctgcggaataaagagtttgtgtgccggggccatgactatgagaggctcgaagcttttcagcagaggatgctgaacgaattcccacacgctattgcaatgcaacatgctaaccagcccgatgaaaccatctttcaggcagaggcccaatacttgcagatctacgctgtcacccctatacctgaaagtcaggaggtgctacagcgagaaggagttccagacaatataaagtcattctacaaggttaaccacatttggaaatttcgttacgaccgcccatttcataaaggcaccaaggataaggaaaacgaattcaagtcactctgggtggagaggacgtctctctaccttgttcaaagcctgccgggcatctccaggtggttcgaggtcgagaagagagaagttgtcgagatgtccccattagaaaacgctatcgaagtgctcgagaacaaaaatcagcagctcaaaaccctgattagccagtgtcagacccgtcaaatgcaaaatatcaacccactgactatgtgtcttaacggggttattgacgccgctgtgaatggcggcgtgagtcgctaccaagaggctttttttgtgaaggaatacattctttctcatcctgaagacggcgagaaaattgctaggctccgggagctcatgctcgagcaagcacagatattagaattcgggctagcagtgcatgagaagttcgtgccccaggacatgcggccactccataagaaactcgtggaccaattcttcgtgatgaagagctcactgggaatccaagaattttccgcctgcatgcaggccagtcccgtacacttccctaatggatctcctagagtgtgtcggaacagcgcgccagcaagcgttagccccgacggcacccgtgtgatccctcgccgaagtccactcagttaccccgcggtgaaccgatacagctcaagcagcctgtcttcccaggcctctgctgaggtatctaacatcacgggccagagcgaatcctccgatgaggtgttcaacatgcagcctagcccttccacctcctcactgagctctacccactccgcctcacccaatgtgaccagcagcgccccgtcgtcggccagagctagccccttactttcagacaaacacaaacactctcgtgagaatagctgtttgagtcctagagaacgaccttgcagtgcaatctatcccacccccgttgagccgagccagaggatgctatttaatcacatcggggatggagcactgccccgaagtgaccctaatctctcagctcccgaaaaagctgtaaatcccacgccctcaagctggtctctcgacagtgggaaagaggcaaagaacatgagcgactcaggcaaactcatttctccacctgtgcccccgcgccccacgcagaccgcatcccctgcaagacacaccacatcagtcagccctagtcctgccggcagaagtcccctgaagggatctgtccagagcttcacgcctagtcctgtggagtaccatagtcctgggctgatcagtaattcccccgtgctgtcgggtagctactccagcgggatttcctcactgtctagatgctccacttccgagacatccggctttgagaatcaggtcaacgagcagagtgctcccctacctgtgcctgtaccagtgcccgtgccctcatatggtggcgaagagcccgtcaggaaagagtccaagactccgcctccgtacagcgtttacgaaagaacgctcaggcggcccgttcccctccctcatagcctgtccatcccagtcacgagtgagccacccgcccttccacccaagccgctcgcagctcgaagttcgcatttggagaatggtgctcgcagaaccgacccaggccccaggcctcggccgctacctcgaaaggtgagccagctttag

SEQ ID NO: 114256 - DNA, 5928 bp, Artificial Sequence
  Description of Artificial Sequence: Synthetic coding sequence
atgtggattccgacggaacacgaaaaatacggtgtggtgattgcctcttttcggggcaccgtgccctacggattgagccttgagataggtgataccgtgcagattttggagaaatgcgacgggtggtaccgggggtttgctctgaagaatcctaacatcaagggtatttttccaagctcatatgtccatcttaaaaacgcgtgcgtcaagaacaaaggacaatttgagatggtcattcccaccgaagactctgtgattacagagatgacttctaccctgcgggactggggaacaatgtggaaacagttgtatgttaggaatgagggggatctctttcatagattgtggcatattatgaatgagatactcgatctgagacggcaggtcctggtaggacatctgactcacgatcgcatgaaagacgtgaagagacacatcaccgcccgcctggattggggaaatgagcagctgggcctcgacttagtgccaaggaaagagtatgcaatggtcgatcctgaagatatttctattacagagctgtaccggctaatggagcacagacaccgtaagaaagatacccccgttcaggccagcagccatcacctctttgttcaaatgaagtccctcatgtgctccaacctgggtgaggagcttgaagtgatcttttccctgtttgatagcaaggagaatcgaccaatctcggagcgattttttctgagactcaacaggaacggtctgcccaaggcacctgataaaccagagagacattgttctctctttgtcgatcttggatcttctgaactacggaaagacatttacattactgtgcatataataagaattggccgaatgggggccggtgaaaagaagaatgcttgctccgtgcagtatagacgcccatttggatgtgctgtgctgagtatcgcggatctgcttacaggcgaaacaaaggatgatctgatcctcaaagtgtacatgtgtaataccgagtccgagtggtaccagatccacgaaaacatcatcaaaaaacttaacgccagatataacctgacaggatcgaacgcaggacttgcggtttctttacagctcctgcacggagatattgaacaaattcgcagagaatactcaagtgtcttttcccacggggtttcaatcactaggaagctggggtttagtaatattatcatgcccggcgaaatgaggaatgacctttacattaccatagagcggggggaattcgagaagggcggcaagagcgtggctcgcaatgttgaagtgaccatgtttatcgtcgatagcagcggtcagaccctcaaggacttcatctcatttggctcaggggaaccgccggcatcagaataccatagttttgtattgtatcacaataattcaccccgatggagtgaattactgaagttacccatccctgttgacaagtttcggggcgcccacatccgtttcgagttccgccattgctcaaccaaggagaaaggagaaaaaaagttgttcggctttagctttgtccctctgatgcaagaagacgggagaactctgccagacggcactcatgagctgatagtgcataaatgtgaggagaatacgaatctgcaggacactactaggtacctgaagctgcctttcagtaagggcatctttctcgggaacaataatcaagccatgaaggccacaaaagaaagcttctgtatcacatcattcctgtgctcgaccaaacttacacaaaatggcgatatgttagatcttttgaagtggcggacccatcctgacaaaatcaccggctgcctgagcaaactgaaggaaattgatggttctgagatagtcaagttcctgcaggacactctggacaccctgtttggtatcctggacgagaactctcagaagtatgggtcaaaggtttttgatagccttgtacacattataaacttgctccaggacagcaagttccaccattttaagcccgttatggatacatacattgagtcccatttcgccggagcccttgcttaccgcgacctgatcaaagtgctgaagtggtatgtagatcgaataacggaggccgagcgacaagagcacattcaggaggtcctgaaggcccaagagtatatcttcaaatacatcgtgcagtctcggcgtctcttctccctggccacggggggacagaatgaggaagagttccgctgttgtattcaggagctgctgatgagcgttcggttctttttatctcaggaatccaaaggaagcggtgcgctgtcccagtcgcaagccgtgttcctctcaagcttcccggctgtctactccgagctgcttaagttgttcgacgtgagagaagtggccaatctagtgcaggacactctcggttcactgccgacgattctccatgtagacgactctttgcaagccattaagctgcagtgtatcggcaagactgtggaatcccagctttacacaaacccggatagcaggtacattctgctccctgtcgtgttacatcatttgcacatccatctgcaggagcaaaaggacctcataatgtgcgccaggatcttgtccaatgtcttttgcctgataaagaaaaattcatctgagaagtcggtgcttgaggaaattgatgtaattgtggcttctctgctcgatatcttgctgagaacgatactcgagatcacctccaggccacagccctcgagctcagccatgagatttcagtttcaggacgtgacaggtgaattcgtggcctgcctgctctctctgctgagacagatgaccgatagacattaccagcaactgttggactcattcaacacgaaggaggaattacgggacttcctgctgcagatttttactgttttccggattctgattcggccagaaatgtttcctaaagactggactgtgatgcggctggttgccaacaacgtgattattaccacagttttatatttatcagatgcgctgcgaaaaaatttcctgaatgagaacttcgactataagatctgggacagttacttctacttagcagtgattttcattaaccagctctgcctccagctcgagatgttcacaccttccaagaagaagaaggtgctggagaagtacggggacatgcgcgttacaatgggatgcgagatctttagtatgtggcagaatttgggagaacacaagctgcattttatacccgccctcattgggcccttcctcgaggtcactctaatacctcagccagatctgagaaacgtgatgatcccaatttttcacgacatgatggattgggagcagagacgtagtggaaatttcaaacaggtagaggcaaaacttatcgataagctcgactccctaatgagtgagggcaagggggatgaaacctacagagagctgtttaactctatcattccactcttcggaccataccccagccttcttaagaaaatcgagagggagacttggagggagtctggcgtttccctcattgccaccgtaaccagactcatggaacggctgcttgactatagggattgtatgaagatgggggaagtggatgggaaaaagataggttgtaccgtgtctttgcttaatttttacaagaccgagctcaataaggaagaaatgtacatacggtacatccacaaactgtacgatctgcacctgaaggctcagaatttcactgaagcagcctatacactgctgctgtatgacgaactgctggagtggtccgaccgcccactccgggagttcctgacttaccctatgcagacggaatggcagcgaaaggagcatctgcatctgaccatcattcagaacttcgatagggggaagtgttgggagaacggcataatcctgtgccggaaaatcgccgagcagtatgaatcttattatgactaccgcaatctgagcaagatgaggatgatggaggcttcattgtatgacaagattatggatcagcaacgcctggaaccagagtttttccgcgtgggcttctacggcaagaaattccctttctttttgaggaacaaagaattcgtctgtagaggccacgattatgagcggctggaggccttccaacagaggatgcttaatgagtttcctcacgctatagcgatgcaacatgccaatcagcccgacgaaacgatcttccaggctgaggcccagtatctgcagatatacgcagtcactcctatcccagaatctcaggaagtgctgcagcgggagggggtccctgataacatcaaatcattttacaaggtgaatcatatctggaagttcaggtatgaccgcccgtttcacaagggcaccaaggacaaggagaacgaatttaaatctttatgggtggaacggacgtccctctatcttgtgcagtcgctgcccggcatttcccgctggtttgaggtggaaaagcgcgaggtggtggagatgtctccgctcgagaacgcaatcgaagttctggaaaataaaaaccagcaactgaagacgctaataagccagtgtcagactagacagatgcagaatatcaaccctctgacaatgtgcctgaatggggtgatcgatgccgccgtgaatggcggggttagccgttatcaggaggccttctttgtgaaggaatacattctctcccatcccgaggacggcgaaaagatcgccagacttagagagcttatgctggagcaggcgcagattttagaatttggactagccgttcatgagaaattcgtccctcaggacatgcgacctttgcacaagaaactcgttgaccagttctttgttatgaaatcatccttagggatacaggaattttctgcatgcatgcaagctagtccagtccattttccgaatgggtctccacgggtgtgtcgtaatagtgcaccagctagtgtttctcccgacggcacgcgggttattcccagacgatccccactgagttatccagccgttaatagatacagttcaagttcactctcctctcaggcttcggcggaggtgtccaatatcactggacagtctgaatccagtgacgaagtatttaatatgcaaccctctccctcaactagcagcctgtcctctactcacagtgcttccccgaacgtcacgagtagtgcacccagctccgcacgtgcctctcctttgttgtcagataaacacaagcactcacgggagaattcctgcctcagtcctcgcgagagaccatgtagcgctatctaccctactcctgtcgagccaagccaacggatgttatttaaccacatcggcgacggggcccttccgaggtccgatccgaacttgtccgcaccagagaaagctgtcaacccaactcctagcagttggtcactcgattccgggaaggaggccaagaatatgtccgattccgggaaacttatttccccccctgtcccgcccagacccacacagaccgcctcgcctgctcgccatactacctctgtgtctccatctccagcggggaggagccccctaaagggctccgttcagagctttacacccagccccgtggagtaccattcgccaggtctcatctcaaattcgcctgtgctcagtgggagctactcttcaggcatcagcagcctgtcacggtgctcgactagcgagacctccggcttcgaaaaccaggttaatgaacagtctgccccattgccggtccctgtgccagtgccagtccctagctacggaggggaagaacccgtccgaaaagaatcgaagactcctcccccatattcagtgtacgagcgaacattgagacgccccgtgcccttaccacactcacttagcatccctgtgacaagtgaacccccggccttaccaccgaaaccccttgctgcacgttcttcccatttggaaaacggggcccgtagaactgaccctgggccaaggccaaggcctctgcccagaaaggtgtcacagctatag

SEQ ID NO: 114257 - DNA, 5901 bp, Artificial Sequence
  Description of Artificial Sequence: Synthetic coding sequence
atgtggattccaaccgagcacgagaagtacggcgtggtaattgcctcatttcggggcaccgtcccctacggtctgtctctggaaattggagacacagtgcagattctcgagaaatgcgatggatggtatcgcgggttcgctctgaaaaatcctaatattaaggggatcttcccttcaagttatgtgcatctaaaaaacgcgtgtgttaagaataagggacaattcgaaatggtaatccccacagaagactccgtgatcacagagatgacatctactcttcgagattggggtaccatgtggaagcagctgtacgtgcgaaacgagggcgacctgtttcataggttatggcacattatgaacgaaattctggatctgagacgccaggttttggtgggccacctcacacatgatagaatgaaggatgtgaagagacacatcacagcgcgcctagactgggggaacgagcaactgggactcgatcttgtccccaggaaggaatacgccatggttgatcccgaggacattagtattactgaactgtaccggttaatggagcaccgccaccgcaaaaaggatacccccgtacaggcctcatctcatcatctctttgtgcagatgaaatccttgatgtgttccaaccttggtgaagagctggaagtcatttttagtctgttcgacagcaaagagaaccggcctatctcggaaaggttttttttacgactaaacaggaatgggttgcctaaggccccagacaaaccggagcgtcactgcagtctctttgtggatctcggatcctccgagcttagaaaagacatctacataacagttcacatcatccgcatcggaaggatgggagctggcgagaaaaaaaacgcctgtagcgtccagtatcggcgtcctttcggttgcgccgtgctgagcatcgctgatctgctcacaggtgagacaaaggatgacctaatcctcaaagtgtatatgtgcaataccgaatcggagtggtaccaaatccacgagaatattataaagaagctcaatgctaggtataacctgacaggttctaacgctgggctggccgtatccctccagttactgcatggagatatcgagcaaattagacgagaatattcatccgtgtttagccatggagtctctatcacacgaaagctcgggttttccaatatcattatgccaggagagatgcgcaatgacctgtacatcaccattgagaggggcgaattcgaaaaaggggggaagagcgtcgctcgaaacgtggaagtaaccatgtttatagtggacagcagtggccagactctcaaggacttcatttctttcggctcgggagaaccaccagcctcagaataccatagcttcgtgttataccataacaatagcccccgttggagcgagttgctcaaactgcctatcccagttgacaagttcaggggagcgcacatcagattcgaatttcggcactgctccacaaaagagaagggcgaaaaaaagttgtttggtttttcctttgtgcccctgatgcaggaagacggccgcacgctacccgacggaactcatgaactgatcgtgcataagtgtgaggaaaacaccaacctacaggataccacacgttacctgaaactcccctttagcaaagggatttttcttgggaacaacaaccaagcaatgaaggcgaccaaggagtctttttgcataaccagctttttatgctccacaaagctgacccagaacggtgacatgctcgacctcttgaaatggcggactcaccccgacaaaatcacaggatgcttgtcaaagctgaaggagatcgacggctcggagatcgtgaaattcctccaagatacactggatacattattcgggattctggacgagaattcacaaaagtatggaagtaaagtcttcgactccctcgtgcatatcataaatttgctgcaggactcgaaatttcaccactttaaaccagtgatggacacctacattgagagtcacttcgccggcgcgctcgcttatcgcgatcttattaaagtgctgaagtggtatgtggaccgcattaccgaagccgagcgacaggagcacattcaggaagtgctgaaggctcaggagtatatcttcaagtacattgtccagtcacgccggttattctccctcgccaccggaggccagaatgaggaggaatttagatgctgcattcaagaactgttaatgtctgtcagattctttctgtcgcaagaatcgaagggcagcggggccctgtcacagtcacaagctgtgttcttatcatcgttcccagcagtgtatagcgagctcttgaagctctttgacgtgagagaggtagcaaacctcgtccaggatacacttggctcgctgcccaccatcctccatgtagacgatagtttgcaagctatcaagttgcagtgcatcggcaagactgttgagagtcagctgtacacaaacccagatagccgatatattctgttgcctgtggtgttgcaccacctgcacatccacctacaagagcagaaagacctcatcatgtgtgcgcggattcttagtaacgtcttttgcttaataaagaagaattcgtctgagaaatcagttctggaagaaatcgatgtgatcgtcgcaagcttgttagacatactgctcagaacaattctggagatcacctctcgtccccagcccagcagcagtgccatgcgcttccagtttcaggatgtgacgggtgagtttgtggcttgtttgctatccctgctgcgccagatgaccgatagacactatcagcaactgttggattcatttaacaccaaggaggaactgagagatttcctcctccaaattttcacagtgttcagaattctcattcgaccagaaatgtttcccaaggattggacagtgatgcggctggtcgccaataatgtgattatcacgacggtcctgtacctgtccgacgcgctgcgcaagaatttcctgaacgagaacttcgactataagatctgggattcatacttttatttggccgtaatcttcatcaatcagctgtgcctgcagctcgaaatgttcacgccgtccaagaaaaaaaaagtcctcgaaaaatacggtgatatgagagtaacaatgggttgcgagatcttcagcatgtggcagaacttaggcgagcacaaattgcacttcattcccgcactgataggaccctttttagaagtcacgctcatccctcaacccgacttgaggaacgtgatgattcccatatttcacgatatgatggactgggagcagcgccgatcagggaatttcaagcaggtggaggctaaactgattgacaaactggattcgctgatgagtgaagggaaaggggatgaaacttacagggaactgtttaattccatccttctgaaaaaaatagaacgggaaacttggcgcgaaagcggggtgagtctgattgcaaccgtgacgagattgatggagcgcttgctcgactacagggattgtatgaagatgggggaggtggatggcaaaaagattggttgcacggtgtcgttgctgaatttttataaaactgaattgaacaaagaggaaatgtacattcggtatattcataagctgtatgatcttcacttgaaggctcagaactttacagaggctgcttatacactcctgctttacgatgaactactagagtggtctgataggcccttacgggagtttctgacctatcccatgcagacagaatggcaaagaaaggaacatctgcatctgacgatcattcaaaactttgacagagggaaatgttgggagaatgggatcatcctatgtcgaaagattgctgagcagtacgagtcctactatgattacaggaacttgagtaagatgaggatgatggaagcttccctctacgacaagataatggaccaacagaggctcgagccagagttctttagagtaggcttctacggaaaaaaattccccttttttctgaggaataaggagttcgtgtgcagaggtcacgattacgaacgactagaagccttccagcagcggatgcttaacgagttcccccatgcaatcgctatgcagcatgcaaatcaacctgacgaaacaatctttcaggctgaggcccagtacctacagatctatgcagtaacccctattccggaaagccaggaggttctccagagagagggagtaccagataatatcaagagcttttataaggttaatcacatctggaagtttcgatatgatcgcccctttcacaagggcacgaaggacaaagagaacgagtttaaatccctctgggtggaacgaacatctctgtatctcgttcagtcattgcccggcatttctagatggtttgaggtcgagaaacgcgaggtagttgagatgagtccactcgaaaatgcgattgaggttctggaaaataagaaccagcagctgaaaacgctgatttcacagtgtcagacgcgccagatgcagaatatcaaccctttgaccatgtgtctcaatggtgtgattgatgccgccgtaaacggaggggtgagccgttatcaggaggcattctttgtgaaggaatacattttaagccaccctgaggacggagagaaaatcgcgcggctgcgcgaactaatgctggaacaggcccaaatcctcgagtttggcctggccgtccacgaaaaattcgttccgcaagacatgcgacctctgcacaagaagctagtagaccagtttttcgtgatgaaaagctcactgggcattcaggagttttctgcctgcatgcaggcttccccggttcactttccgaatggatccccccgggtctgccggaacagcgcacctgcctctgtctcccccgatggtaccagagtgatcccaaggcgctctcctctgtcatacccagctgtgaacaggtactcttctagctctctatcttctcaggccagcgcagaggtatccaacataaccggtcagtccgaaagcagtgacgaggttttcaacatgcagccttccccttctacatcttctttgagttccacccatagtgcctcgcccaacgtgacctcttccgcacccagctcagcaagggccagcccactgctgtctgacaagcataaacatagtagggaaaactcttgtctgagcccccgcgaaagaccatgttctgctatctaccccacaccagtcgaaccttcacagagaatgttgtttaatcatataggcgatggggccctgcccagatcagaccccaacctgtcagctcccgagaaagcggtgaaccctactccgagttcctggtcacttgactccgggaaggaggcaaagaacatgagcgactcgggaaagctaattagcccaccagtgccaccaaggccgacacaaacagcctctcctgcgcgacatacaacatcggtttctccctctcctgctgggagatctccactgaagggatcagttcagtcctttaccccttcccctgttgagtaccactcacctggacttatctccaactcaccagtcctttctggatcatacagtagcggaatctcgtctctgagccgctgcagcacatctgaaacaagtggctttgaaaaccaggtgaacgaacaaagtgccccactccctgtccccgtgccggttcccgtgccgtcttacggcggagaagaaccagtccgcaaagaaagtaaaacccccccgccttactccgtctatgagcggactctccggcggcccgtgcccctgcctcatagcctgtctattcccgtaactagcgaacccccagctctgcccccgaagccattggcagctagatcctcccacctcgaaaacggagcccgaagaaccgatccgggcccacgaccacggccactgcctaggaaggtatctcagctctag

SEQ ID NO: 114258 - DNA, 2550 bp, Artificial Sequence
  Description of Artificial Sequence: Synthetic coding sequence
atgaaaatgcacagcacggagagaatccctctgttcggcccttacccatcgctgctcaagaaaattgagcgggagacctggcgagagtcaggggtttccctgatagccacggtcaccaggcttatggaacgcttactggattaccgggactgtatgaaaatgggtgaagtcgatggcaagaagataggctgtaccgtgtccttactcaatttttacaaaacagaactgaataaagaggaaatgtatatcagatatatacataagctgtatgacctccatttgaaggctcagaacttcaccgaggctgcttataccctgctcttgtacgacgaacttctggagtggagtgatcgccctctgagagagtttctcacgtatcctatgcaaacggaatggcaaagaaaggaacatttgcatttgaccatcatccagaactttgatagaggcaaatgctgggagaacggcattatcttgtgccggaagattgcagagcagtacgaatcctattacgactataggaacctgtcaaaaatgcgcatgatggaagctagtctgtacgataagattatggaccagcagcgcctcgagcctgagttttttcgcgtcggcttctacggcaagaagtttccgttcttccttcgtaacaaagagttcgtctgccgaggtcatgattatgagaggctggaggctttccaacagagaatgctgaatgagttcccccatgctattgcaatgcagcatgccaaccaaccagacgaaacaatctttcaggcagaggcccaatatctgcaaatctatgccgtgactcccatccccgagagccaagaagtcctccagcgggagggtgtaccagataatataaagtccttttacaaagtaaaccatatctggaagttccggtatgaccggcccttccataaaggcacaaaagataaagaaaatgagttcaagtccctctgggtcgagagaacgagtctgtatttggtgcagagcctgcccggtattagcagatggttcgaagtggaaaaaagagaggtcgtggagatgtccccactggaaaatgctattgaggttctggagaacaagaaccaacagctgaaaactctcatttctcagtgtcagaccagacaaatgcaaaatatcaacccactgactatgtgtctgaatggggtgattgacgcggctgttaacggcggcgtgagcagatatcaggaggccttttttgtgaaggaatatatcctgagccaccccgaggacggcgagaagatcgctcggctccgggaactcatgctggagcaggcccagattctagaatttggcctggctgtccatgaaaaatttgtcccacaggacatgcgccctctccataagaagcttgtagaccagtttttcgtgatgaagagcagtctgggtatccaggagtttagcgcctgtatgcaggcctcccccgtccacttcccgaacggctcccctagagtgtgcagaaactccgcacccgctagtgtgtcacccgacggcacccgagtaataccacggcgatcaccactgagttaccccgcggtaaatcgctattcctctagctcactgagtagccaggcatccgctgaggtgtccaacatcaccggccaatcagagagttccgatgaagtctttaacatgcagccttcaccaagtacctcttcattgtcctcaacacacagcgcttcaccaaacgtcaccagcagcgccccgtctagtgcccgggcatctcccctgctgtcagacaaacacaaacacagcagagagaattcctgcctctccccaagggagcggccatgttctgccatttatcccactccagttgagcctagccagcggatgctgttcaaccatattggcgacggtgccctgcctcgcagcgacccaaatctgtctgcaccagagaaggctgtgaatccaactccttcttcctggagcctggattccggcaaagaggctaaaaatatgtccgatagcggcaagctcatatcaccacccgttcccccccgcccaactcagacggccagccctgcaaggcatacgacaagcgtgtctccctcaccggcaggccgtagccccttgaagggtagcgttcagagcttcacaccatctcccgtggagtaccatagcccagggctgatctctaatagtccagtgttaagcgggtcctattccagcggcatctcttctctgagccggtgcagcacctctgagacatcaggttttgaaaaccaggtcaatgagcaaagtgcacccttgccagttcctgtccctgtgcctgtgccctcttatggcggcgaagaacctgtgcgtaaggagagcaagacacccccaccttacagcgtttacgaaaggactctgcgccgtcccgtgcctcttccccactcactgagtattcccgtcacctcggagcctccggccctccctccaaagccattagcggccagatcttcccatcttgagaatggagccagacggactgacccagggccccggcctcgacccttgccacggaaagtgtcgcagctctag

SEQ ID NO: 114259 - DNA, 3318 bp, Artificial Sequence
  Description of Artificial Sequence: Synthetic coding sequence
tggatcccatctgagaagcagacctttttcacagtcatagcatccttccgcgggactgtgccatatgggctttccctggagatcggcgataccgtccagattctcgaaaagtgcgacggatggtaccgtggctttgctctgaaaaatccaaacatcaaaggcattttcccttcctcttatgtgcatctcaagaacgcgtgtgtaaaaaacaaaggccagtttgagatggtgatccccactgaggattctgtcatcacagaaatgacctctacgctgcgcgactggggcaccatgtggaagcagctttacgtccgtaacgagggagacctattccataggctttggcacattatgaatgaaattttagatctgagacgccaggttttagtcgggcatctcacccatgacagaatgaaagacgtcaaaagacatattaccgccaggcttgactggggcaatgagcagctcgggttggatcttgtacccagaaaagagtacgccatggtggatcctgaggatatttccattaccgagttataccgcctgatggaacaccggcaccgtaaaaaggataccccggtgcaggcttccagccatcacctgttcgttcagatgaaatcgctgatgtgttcaaatcttggcgaggaactcgaagtcatttttagcctcttcgactcaaaggagaacaggccgatctccgaaagattttttcttcggttgaatcggaacggcctgcctaaagcacccgacaaaccggagagacactgctccctgttcgtagacctgggcagctcagagcttcggaaagatatttatatcacagtgcacatcattcgaatcggtcggatgggcgccggggaaaagaagaacgcttgttccgtgcagtatcggaggccttttggttgtgctgtactgtctattgctgaccttctgacgggagagacgaaggatgatctcatactgaaggtgtacatgtgcaacactgaatcggagtggtaccagatccacgagaacattataaagaagctcaacgccagatataacttgaccgggtcaaatgctggcctggccgtgtctctacagcttctgcatggggacatcgaacagatacgccgtgagtattcctcggtattctcccatggagtttctatcacccgaaagttgggcttttctaacatcatcatgccaggcgaaatgcgaaacgacttatatattaccatcgaaagaggggagttcgagaaaggtggtaagtcagtggcccggaatgtcgaagtcaccatgtttatcgtggactcctctggacagactctgaaagacttcatcagctttggttccggcgagccacccgcctccgagtaccattcgttcgtgctttaccataacaatagtccgcgatggagcgaactgcttaagttgcctataccagtggataaatttcgaggtgctcatattaggttcgagtttcggcactgttctacaaaagagaagggggagaaaaaactgtttgggtttagtttcgtgccgctcatgcaggaggatgggcgcactctacccgatggaactcatgaactcatcgtgcacaagtgtgaagagaatacaaatcttcaagacacaactcggtatctgaagctgcccttttctaaagggatttttttaggcaacaacaaccaggcaatgaaggccaccaaggaaagcttttgcatcaccagctttctctgtagcacaaaactgacccagaatggtgatatgctcgacttgttaaagtggagaactcacccagacaaaatcacgggatgtctcagtaaactgaaggaaatcgatggatctgagatcgttaaattcctgcaggacacactcgacaccctgttcggcattctggacgaaaattcccagaaatacgggagtaaggttttcgattcgctggtccacattatcaatctcctacaagactctaagttccaccactttaagcccgtgatggacacctacatcgagagccacttcgccggggcactggcgtatagggatctgattaaggtgcttaaatggtacgtggatagaattaccgaagccgagcgccaggagcacatccaggaggtgctgaaggcccaggagtacatcttcaaatatatcgtacagtctcggcgactgttctcactcgctacaggcggccagaacgaggaagagtttcgatgttgtatacaggagctccttatgagcgtgagattctttctgagtcaggagtctaaggggtccggtgctctgagtcagagccaagcagtgttcctgtcatcattcccagccgtgtattctgaactgctcaaactattcgacgtgcgggaggttgccaacttggtccaggatacattaggaagtttacccaccattctgcacgtggatgattcactccaggcaattaagctgcaatgtatcggtaagaccgtagaaagtcagctgtacaccaatccagatagcagatatattctcctcccagtggtgttgcaccacttacacatacacttgcaggagcaaaaagacctgataatgtgtgcacggatcctgtccaatgtgttctgtttaatcaagaaaaattctagtgagaaatctgtgctggaggagattgacgtcatcgtggcatcactgttggacatccttttgcgtactatactagagatcacgagtaggccacagccctcctccagcgcgatgcgctttcagttccaggatgtgaccggcgaattcgtggcgtgcctgctgtccctgcttaggcaaatgacagaccgtcattatcaacaactgcttgattcatttaacacgaaggaggagctgcgtgactttctgctgcaaatttttacagttttccgcatcctgattcgaccagagatgtttccgaaagattggaccgtgatgcggcttgtagctaataatgttattattacaaccgtgctttacttatctgatgccttaagaaagaattttcttaacgaaaactttgactataaaatttgggactcttatttctatttggctgtgatttttataaaccagctgtgcctgcagctcgaaatgttcacccctagtaagaaaaaaaaggtccttgagaaatacggagatatgagggttacaatgggatgtgagatcttctccatgtggcagaatctgggggagcacaagctccatttcattcccgccttaagacaggagaacagactgaacctgggcggtggcgggtgctcagagccaagggcatgccattgcacaccagcctgggccactaagagggattgcgtgtcaaagaaaaaggagaagaagacatag

SEQ ID NO: 114260 - DNA, 6144 bp, Artificial Sequence
  Description of Artificial Sequence: Synthetic coding sequence
atggcagcctctgaaaggcgagcattcgcccacaagattaatagaaccgtagctgcagaggtgcgtaaacaagtctctagagaacgtagcggatctccacacagcagtcggcgatgcagtagctcactgggggtgccactaacagaagttgtcgagcctcttgatttcgaggacgtgctgctgtctcggccccccgacgctgagccaggccctcttcgcgacctcgtcgagtttcccgcagatgatctcgaattgctgctgcaacctcgagaatgcagaacaacagaacccggtatacctaaggacgaaaagcttgacgcacaagttagagccgccgtcgagatgtatattgaagattgggtcatagtccaccggcgttaccagtacctctcagccgcgtatagcccagtcactaccgacacgcaaagggaacggcagaagggattgcctcggcaggtgtttgaacaagatgccagtggtgacgaaagatctggccctgaggatagcaatgacagtagaaggggtagcggatcacctgaggacacgcctcgcagctctggtgccagctctatctttgatttgcggaacctcgcagccgacagtctgttaccaagcctgctcgagcgcgcagcacctgaagacgtcgaccgtcggaatgagactctccgcaggcagcacaggccccccgctcttctgacactgtacccagcacccgatgaggatgaggccgtcgagagatgtagtaggccagagccaccccgtgagcacttcggtcaacgcatattggtgaaatgtttatccctgaagtttgaaattgagatcgagcctatcttcggtatcctggcactgtatgatgtgagagagaagaaaaaaatatcggaaaacttttacttcgatctgaatagtgactctatgaaagggctgttgagagcccatggaacgcaccctgcaatttctacactggcaaggtccgccatatttagtgtgacctacccttcaccagacattttcctggtgatcaaacttgaaaaggtgctccagcaaggtgatattagcgagtgctgcgaaccgtacatggtgttaaaggaagttgacacggctaagaataaagagaagttggagaagttaagactggccgccgaacagttttgcactcggttggggcggtaccgcatgcctttcgcttggaccgccgtccatctagcaaatatagtcagctccgccgggcagctcgatagagattccgatagcgagggagaaagacgacccgcttggactgatcggcggagaagggggccccaggatcgggcgtccagcggcgatgatgcttgttccttcagtggctttaggcctgcaactctgacagtcacaaatttctttaaacaggaggcggaaagactctcagacgaggacctttttaaattcctcgctgacatgcggcgcccatcatcattgctcaggcgcctgcgccccgtgaccgcccaactgaaaattgacatctccccagctccagaaaacccccatttctgcctgtcaccagagctgcttcacatcaaaccttaccccgaccccagagggaggccaaccaaggaaatcctcgaatttcctgcacgcgaggtttatgctcctcatacaagctaccgcaatctgctttacgtctaccctcactctctcaattttagtagccgacaaggctctgtcaggaatcttgcagtgagggtgcagtatatgaccggagaagatccaagccaggcattgcccgtgatatttgggaaaagctcatgctccgaatttacacgagaggcgttcacacccgtcgtttatcacaataaaagcccggagttctatgaggaatttaaactgcatctgcccgcctgcgtcacagagaaccaccacctcctctttaccttctaccacgttagctgtcagccacgccccggcactgcactggaaacaccggtgggatttacctggattcctctgcttcaacacggcagattacgcacagggccattttgcctgcctgtctcagtcgaccaaccccccccttcttattcggtcctgacccccgacgtggcccttcctggcatgcgctgggttgacgggcacaaaggtgtgttcagtgtagagctaactgccgtgagcagcgtccatcctcaagatccttacctggacaagttttttacactcgtccatgtgctcgaagagggggccttcccatttcggctgaaagacacggtgttgagcgaggggaatgttgaacaggagctgagagcctccctcgcagctctcaggctggccagccccgagcctctcgtggcattctcacaccatgtgttagacaagctcgttagactggttataagaccccccattattagcgggcagatcgtgaacctgggccggggcgccttcgaggccatggcgcacgtggtgtcattggtgcatcggtccctggaggccgcacaggatgcacgcggtcattgcccccagctggccgcatacgtgcattacgcttttagactccctggaacagagccatcattgcctgatggggcgccacctgtcaccgtccaggccgccacgctggcccgaggatccggcagaccagcatcattatatctggccagatctaaaagcatttcaagcagcaatcctgacttggccgtggcgccaggcagcgtggacgacgaagttagcaggatactggcctcaaaactgctccatgaagagctggctctgcaatgggtcgtgtcttcttcagccgttagagaagcaattctgcagcacgcctggttctttttccaactaatggtgaagtccatggctctgcacctcctgctcggtcaaaggttggacactccacgcaaactgcgcttcccagggaggtttcttgacgatatcaccgccttagtgggttctgtggggcttgaggtgattacccgggtgcacaaggacgttgaactggctgagcatctgaacgccagcctggccttctttctgtctgatctcctatcactggtcgaccgtgggttcgtgttctccctggtacgagcacactataaacaagtagcaactcgcctccagagttctccgaatcccgccgctctgctgacactccgcatggagtttaccaggattctgtgttcccatgaacactacgtgacgctgaacctgccttgctgtccgttgagtcctcccgcgagtcccagcccatctgtctcctcaacaacgtcccagagctctaccttttcaagtcaggctcccgatcctaaggtcacgtccatgtttgagctatccgggccctttaggcaacaacactttctggctggccttctactgaccgagctggccttggccttagagcctgaagccgagggagccttcctcctgcataagaaggcaatttccgcggtgcattctctgctctgcggccacgacactgaccctcgttacgccgaggccacagtcaaggcgcgcgtagcagaactctatctgccactcctgagtatagcaagagacactctcccgaggctgcacgactttgctgaaggaccagggcagcgcagtcggctggcctccatgctggattcagacaccgagggggagggagacattgctgggactatcaatccgtctgtcgccatggctattgctggaggacctctagctccaggctctcgcgcaagcatctcccagggtcctcctactgcctcccgagccgggtgcgcactgtcggcggagtctagccgtactttgctagcatgcgtgctctgggtcttaaagaatacggaaccagcccttctgcagcgctgggccaccgatctgactcttcctcagctggggcgtctgctcgatctgctgtatctctgcctcgcagcgttcgagtacaaaggaaagaaggcgttcgaaaggattaatagcctaacatttaagaaaagtttggatatgaaagctaggctggaggaagcaatcttgggtacaataggtgcaaggcaggagatggttaggagaagccgggagcggtctcctttcggcaatcccgagaatgtaagatggaggaaatcagtaacacattggaaacagacaagcgaccgtgtggacaaaacaaaggacgagatggagcacgaagcgctcgttgagggcaacctggcaacagaagcttctctggttgttttagataccctggaaataatcgtgcaaaccgttatgttgtccgaggcgagggagtccgtgctcggcgccgttctaaaggtggtgctatactctttgggttcagcccagtccgcgctgttccttcaacacggactcgccacacaacgcgcactggtcagcaaattccctgaactgctgttcgaagaagatacggagctctgcgctgacttgtgtctgagactgcttcgccattgtgggagtaggatatctactattcgcactcatgcttcggcttctctttatctattgatgagacagaatttcgaaataggacataacttcgctagagtgaagatgcaggttacaatgtctttgtcaagcctggtaggtaccactcaaaatttcagtgaagagcatttgagacggagcctgaaaaccatcctcacttacgctgaagaggacatgggcctacgagactccacatttgcagaacaggtgcaggacctgatgtttaatctacacatgattctcacagacacagtcaaaatgaaagaacatcaggaagaccccgagatgctgattgatctcatgtatcggattgccagggggtatcaaggcagcccggatctgaggttaacatggttacaaaacatggctgggaaacatgctgaactgggcaaccacgccgaggccgctcagtgcatggtgcatgcagctgcactcgtagctgaatacctggccctcctagaagaccaccggcatctgcctgttggatgtgtgtcctttcagaacatttcctccaatgtcctggaggagtctgctatttccgatgatattctgtccccagacgaagagggtttctgcagcggaaaacatttcacagaattgggactcgtcggccttttggagcaggccgccggatacttcactatgggcggactgtacgaggccgttaatgaggtgtataagaacctgatccctatcctggaggcccatcgggattataagaagctagcggctgtgcatggcaaactgcaggaggcctttacgaagattatgcaccagtccagcggctgggagcgcgtctttggaacatactttcgtgtgggattttacggcgctcacttcggtgacctagatgaacaggagtttgtctacaaggagcctagcatcactaagctagcagagatttctcatagacttgaagaattttacacagagcggtttggagacgacgtggtcgagattattaaggattcaaatcccgtagacaagagtaagctcgactcacaaaaggcctacatacagatcacatacgtggaaccttattttgacacctatgagctgaaggaccgtgtgacatactttgatcgcaactacggactgcggacctttctattttgcaccccttttacaccagacggcagggcccatggcgaacttccagagcagcacaagaggaagaccttgctcagcaccgaccacgcgtttccctacatcaaaacccggattcgtgtatgccacagggaggagactgtcctgacccctgtcgaggtggccattgaggacatgcagaagaagaccagagaactggcttttgcgacagagcaggatcctcccgatgccaaaatgttacaaatggtactccagggttctgtgggcccgaccgtaaatcagggccccctggaagtggcccaggtgttcctcgccgagatacctgaggaccccaagctgtttcgccaccacaacaaactgcgtctgtgtttcaaagacttttgtaagaagtgtgaggatgctctccggaaaaataaggcactgataggacctgatcagaaagagtaccaccgagagttggagagaaattactgcaggttgagggaggccctgcagccattactaacacagcgcctgccccagttgatggcccccacacctcccgggctgaggaactcactcaatcgcgcctcttttcggaaagctgatctgtag

SEQ ID NO: 114261 - DNA, 4161 bp, Artificial Sequence
  Description of Artificial Sequence: Synthetic coding sequence
atgcgatgggtcgatggacataaaggggtgttctctgtagaactgaccgccgtgtcgagcgtgcacccccaagatccgtatttagacaagttctttacccttgtgcacgtccttgaggaaggcgccttccctttcagattaaaagacactgttctttctgaagggaatgtggaacaggagctgagggccagtctcgccgctctacgcctcgcctctccggagccattagttgctttttcccatcacgttctcgacaagcttgttcgtctggtgatccgtccccccatcattagtggacagatcgttaacctgggcagaggcgcatttgaagccatggcgcacgttgtttcactggttcaccgatctctggaagcagcgcaagacgcccgcgggcattgtccccagctggcggcatacgtgcattatgcatttaggctgccagggaccgaaccaagcctgccggacggtgccccacctgtgaccgtacaggcggcaaccctcgcccgcggtagcggacgccccgcctcgctctacttagcacggtccaagtctatcagtagcagcaaccccgacttggctgtggcacccggttccgtggatgacgaagtcagcaggatcctggcatccaaaggcattgatcgttctcacagctgggtgaatagcgcctatgcccccgggggatctaaagcagttctgcggagggcccctccttactgtggagcggacccacgccaactcttgcatgaagagcttgcccttcagtgggtggtgagtagcagcgccgtaagggaggccatcttgcaacatgcgtggttcttctttcagctaatggtgaagtccatggcactgcatctacttctcggacagagactggatacacctcgaaagctcagattcccgggccgctttctggacgatataacagctttagttggttctgttggcctggaggttatcaccagggtgcacaaggacgtggaactggccgaacatctcaacgcctccctagccttctttctatctgaccttctgagcttagttgaccggggattcgttttttcactggttcgagctcactacaagcaggtagctacacgactccagtcctccccaaacccagccgcactccttaccctccggatggaatttactaggattctttgcagccatgaacattacgttactctgaatctgccttgctgccctttaagccccccagccagccccagtcctagcgtcagctcgacgacgagccaaagcagcactttctcttctcaggcccccgatccgaaggtcacctctatgtttgagctgtccggacccttcaggcagcaacatttcctggctggcctgctgttgacggagctggctttggccctggagcctgaggcagagggggcgtttctcctgcataagaaggccattagcgccgtgcactcactgctctgtggtcatgacaccgatcctcgctacgcggaagccacagtcaaggctcgcgtggccgagctgtacctcccgctgctctctatcgcccgggacaccctgccacgccttcacgattttgctgagggaccaggccaacggtccaggttggcctctatgctagacagtgatacggaaggtgaaggtgatatcgccggcactatcaacccctccgtggccatggccatcgctggtggaccattggcaccaggctcaagagcgtcaatttctcagggccccccaaccgccagccgggccggttgtgccctcagcgcggagagctctagaacactgcttgcttgtgtcctgtgggtgttgaaaaataccgaaccagcattgctccagcgctgggccactgatttgaccctgcctcagctgggacggttacttgatctcctgtacctttgtctcgctgcattcgagtataaagggaaaaaggcctttgagcgtatcaactcactgaccttcaagaaaagcctagacatgaaagccagattggaagaagctattctcggcacgattggggcccgtcaagaaatggtgcgtaggtcacgagagcgttcccctttcggaaatcccgagaatgttcggtggcggaagtccgttacccactggaagcagacatccgatcgagtcgacaagacgaaagacgagatggaacacgaggcgctcgtggaggggaaccttgctaccgaggcctcactggttgtcctcgacacattggagattattgtccagacagtgatgctctccgaggcccgggagtccgtgctgggcgccgtcctgaaagttgttctgtatagtctcggcagtgcccaatccgcgttgtttctccagcatgggctcgctacccagagagcactggtatccaagttccccgaactcctctttgaggaggataccgaactatgcgctgatctctgtttacggttgcttagacattgcggttcaagaataagcactattcgcacgcatgctagtgcatctctgtaccttctgatgaggcagaattttgaaattggccacaattttgcacgagtaaaaatgcaagtcacaatgagcttaagtagccttgtgggtactacacagaatttctcggaggaacacttgaggaggtcactcaagacaatcttgacttacgctgaggaggacatgggcttgcgagacagtacttttgctgagcaagtccaggatctgatgtttaaccttcacatgatcctgaccgatactgtcaagatgaaagagcaccaggaggatcctgaaatgctgattgacctgatgtaccgaattgccaggggctatcaggggagccccgacctgcggctaacctggctccaaaatatggctgggaagcacgctgaattggggaatcacgccgaggctgcacaatgcatggtacacgccgccgccctggtcgccgagtatcttgccttattggaggaccatcggcacctgccagttggttgtgtgtctttccagaacatttcttctaatgttctagaggaaagtgcgatttcggacgatattctatcaccggatgaggaaggcttttgcagtgggaagcactttactgagctgggactggtgggattactggaacaggccgccggctactttaccatgggcggcctgtacgaggccgtgaatgaagtatataagaacctcatacctattctggaagcacatcgcgattataaaaagctagctgccgttcacggtaagctgcaagaggcctttacaaagatcatgcaccagagcagcggatgggaacgcgtgtttggaacctattttcgggttggcttctatggcgcccacttcggcgatttagatgaacaggagtttgtatataaggaacctagcataaccaagctcgcagagatatcccacagacttgaagaattttacacagagcgcttcggtgatgatgttgtggaaatcattaaggattctaaccctgttgataagtcgaagctggacagtcaaaaagcttacatacaaataacttatgtcgaaccgtacttcgacacttacgagctcaaagatagggttacatattttgacagaaactatggcctccggacatttttattctgtaccccttttacgccagacggtcgcgcccacggtgagctgccagagcagcacaagagaaagacactgctgtcaacagatcacgccttcccttatatcaagactcgcatacgcgtttgccacagagaggagaccgtgctgaccccggtggaagtagctatcgaggacatgcagaaaaaaacaagggagctggctttcgctacagagcaggacccccctgatgccaaaatgctgcaaatggtgctgcagggttcagtaggcccaactgtcaaccagggtcctctagaggttgcccaggtgtttctggctgagattccagaagatcccaaactgttcaggcaccataacaagctgcgcctttgcttcaaggacttctgcaagaagtgtgaggatgcactcagaaagaacaaggcactgatcgggcctgaccaaaaagagtaccaccgcgagctcgagcgcaactactgtagactgagagaggccctacagcctctgctaacccagcggctcccccaactgatggctcccaccccaccaggcctgagaaatagcttaaatcgtgcgagctttagaaaagcagacctctag

SEQ ID NO: 114262 - DNA, 5973 bp, Artificial Sequence
  Description of Artificial Sequence: Synthetic coding sequence
atggctacattacctagtgctgagaggagagcattcgcactcaaaatcaacaggtattcttcagcagagataaggaagcaatttacgttacccccgaacctcggacagtatcatcgtcagtccatttccacttctggcttcccctctctccagttaccccaattttatgatccagtggagccagtggactttgaagggctgttaatgacccacctcaatagcctagatgtgcagttagcgcaggaactaggagatttcacagacgatgacctggacgtggtcttcacgccaaaagagtgcagaacactccagccttcactaccagaggagggagtcgagctggatcctcacgtgagggattgcgtgcagacctatattcgggaatggctcattgtgaacagaaaaaaccagggcagtcccgagatctgcggattcaagaagacgggaagcagaaaggatttccataaaactctgcccaagcagacctttgagtctgaaactctggagtgctcagagcctgctgctcaagccgggcctcgccacctaaatgtgctctgtgatgttagcggtaaggggccagtgaccgcctgcgacttcgatctgcggtcacttcaacccgacaagaggctggaaaatctcctgcagcaggtgtccgctgaagatttcgagaaacagaatgaggaagcccgccgaactaaccgccaggccgagctttttgctctatacccctctgtggatgaagaggatgccgtggagatccgccccgtgccagaatgccccaaggaacacctgggaaatcgtattctggtgaaactgctcactcttaagttcgaaatagaaatcgaacctctctttgcatcaatcgcactttatgacgtgaaagagcggaaaaagatatcggagaatttccactgtgacctgaattcagaccaattcaagggtttcctccgtgctcatacgcccagtgtagctgccagcagccaggcacgaagtgctgttttttccgtcacatatcccagctccgacatatatctcgtggtgaagattgagaaggtgctgcagcaaggagagattggagattgtgccgagccttacacggtaatcaaagagagcgacggcgggaaatcaaaggagaaaatagagaagctgaagctgcaagcagagtctttctgtcagcggttgggaaagtatcgcatgccttttgcttgggcaccaatatccctcagtagcttcttcaacgtgtcaaccctggaaagggaggtcacagacgttgacagtgtggttggtaggtcctctgtcggagaaaggagaacgctcgctcagtccagacgcttgtccgaaagagcactgtccctagaggagaacggagtggggtctaattttaagacttcgacactgtctgtctcttccttcttcaaacaggaaggtgaccgcctatcagacgaagacctgttcaaatttctcgcggactataaacggagtagcagtttgcaaaggcgggtcaagagcatacctgggctgctccgccttgagatctccacagctccagaaatcattaactgctgtctgacgcccgaaatgttgccagtgaagccctttccagagaataggacgagaccccataaggaaattcttgaattccctacacgggaagtgtatgttccgcatactgtgtaccgaaacttactgtatgtatacccacagagactgaacttcgtgaacaagctcgcttcagcccggaatatcacgatcaagatccagtttatgtgtggggaggatgcaagtaacgccatgccagtgatattcgggaaatcctcaggccctgaatttctacaggaagtgtataccgctgtgacatatcataataagagtccagacttttacgaggaggtgaaaattaagctgccagctaaattaaccgtaaaccaccatctgttgttcacattttaccatattagctgtcagcaaaaacagggggcttcggtagagacacttctgggatactcatggctgccaattctactgaatgagagactgcagactggttcctactgccttcccgtcgccttagaaaagttgccacctaactattcgatgcacagtgccgagaaagttcccctccagaatcctcctattaagtgggcagagggccataagggagtctttaacatcgaagtgcaggcagtcagcagcgtgcacactcaagataaccatttggaaaagttttttactctctgccactccttagagtcccaagttacctttcctatacgagttttggatcaaaagatcagtgaaatggctctggaacacgaattaaagcttagtattatctgtttgaactcgtctaggcttgaacccttggtgctatttcttcatctggtgttagataagctgttccagttgtccgtacagcccatggtgattgctgggcagactgcgaacttctcacaatttgcttttgaatcagtggttgccattgctaatagcctgcataactccaaggacctgagcaaagaccagcacggaagaaactgcctattggcatcctacgtacattatgtttttaggttgccagaagtccagcgggatgtgccaaagtcaggcgcccccaccgccctgctggacccacggtcttaccacacctacggtaggactagtgctgccgccgtgtccagcaagctgctgcaggcgcgcgtgatgtctagctctaaccccgatttggctgggacacatagcgctgccgatgaagaggtaaagaacatcatgagctccaagcacttccatgaggagctggcactgcagatggtcgtgagtacaggtatggtcagagagactgtctttaagtatgcgtggttcttctttgagttgcttgttaagagtatggcgcagcacgtgcataatatggataagagagactcttttcgaaggaccagattttccgaccgattcatggacgacatcacaaccatagtgaacgtggttaccagtgaaattgccgcgctgctggtcaagccccagaaggagaatgaacaagccgaaaagatgaatatctctctggcattctttctttatgacttactgtcactcatggataggggattcgtgtttaacctgataaggcattattgcagtcagctcagtgctaaactgagtaacctgcctaccctcatttcaatgcgccttgaattccttaggatcctgtgtagccacgagcactatctaaacctcaatcttttctttatgaacgccgacacagcacctacttccccgtgcccttctatatcgagtcaaaatagtagttcatgcagctcatttcaggaccagaagatcgcaagcatgtttgatctcacgtccgagtaccgtcagcagcatttcctgacgggcttattattcactgagttagctgccgctcttgatgcggagggagaggggatatctaaggtgcaaaggaaggctgtgagcgccatccactccctcctaagttcacacgaccttgaccctaggtgcgtgaagcctgaggtgaaagtcaagattgctgctctctacctgcctctggtcgggatcattctagatgcactaccacagctctgtgactttaccgtagctgataccagaaggtaccggacgagcgggtctgacgaagagcaggaaggcgccggagctatcaaccagaatgtcgcactcgccattgcaggcaacaacttcaacttaaagaccagcggtatcgttctgagctccctgccctataagcagtataatatgttgaatgcagatactacacggaatctgatgatctgctttctttggatcatgaaaaacgccgatcaatctctgattaggaaatggattgcagatctcccctcgacccaattaaataggatcctcgatctgttgttcatttgtgtgctgtgctttgagtataaaggcaagcagtcaagtgataaagtgagcacacaggtcctgcagaagagccgtgacgtgaaagcaaggctggaagaggccctcctccggggtgagggcgcccgaggggaaatgatgaggcgccgtgcgcctggcaacgacagattcccagggcttaacgagaacttacgatggaagaaggaacagacgcactggaggcaggccaacgagaaactggacaaaactaaagcggaactggaccaggaggcgctcatctccggcaatctagccactgaagcccacctcattatactggacatgcaggagaatatcatccaggcatcctctgccctagactgtaaagattctctactcggcggagtcctgcgagtgctcgtgaattcactgaactgtgaccagagcaccacatacttgacgcactgtttcgcaactttaagggctttaatagccaagtttggggatttgctgtttgaggaagaagtggagcagtgctttgacttatgtcaccaagttttgcaccattgtagctcatctatggacgtgacgcgttcgcaggcttgcgcgacactgtatcttctgatgcgattctcctttggagcgacgtccaactttgcccgcgtcaaaatgcaagtcactatgtccctggcatccctcgtgggtcgagcccccgacttcaatgaggaacatctgcgccgaagccttcgcacaattctggcgtactcagaggaggatactgccatgcagatgacaccgtttccaacacaagtggaggaactgctctgtaacctgaactctattttgtacgacactgtgaagatgcgcgagttccaggaggaccctgagatgctcatggatctcatgtatcggatcgccaaatcttatcaggctagccccgaccttcgcctgacctggctgcagaatatggccgagaagcatactaagaaaaagtgttatactgaggccgcaatgtgtctcgtacacgccgccgccctggtggctgaatacctgagcatgctagaagaccatagttacttacccgttggcagcgtaagctttcaaaatatctcaagtaacgtcctcgaagaatctgtagtgtctgaggatactctgtcaccggatgaagacggagtatgtgccggacagtattttacggagtctggcctggttgggctgttggaacaagctgctgagctgttcagcacggggggcctttatgaaaccgtgaatgaagtatacaaattagtcatccctattctcgaggcccacagggaatttcgaaaactcacacttactcacagtaaacttcagcgtgccttcgacagtattgtcaataaagaccacaaaagaatgtttggtacctactttcgcgtgggtttcttcggcagcaaatttggcgatctggacgagcaggagtttgtttataaagagcccgcaataaccaagctgcccgagatctcccatagactggaggcgttctacggccaatgttttggagctgagttcgtggaagtgatcaaagatagcactcctgtggataagacgaaactggatccaaataaggcctacatacagattacctttgtagaaccttattttgatgagtatgaaatgaaggatcgggttacttacttcgagaaaaacttcaatctccgccggtttatgtataccacaccctttacacttgagggcagacctcgaggtgagctgcatgaacaatatagacgcaacacagtcctcaccacaatgcacgctttcccttatatcaagacgcgtatttctgtgattcagaaggaggaattcgtgctgacacctatagaggtggccatcgaagacatgaagaagaaaactttgcagctggccgtggccatcaatcaagaacctcccgatgccaagatgctgcagatggtgctacagggatcagtgggggccacagtgaaccaaggcccactggaagtcgcgcaagtcttcctcgctgaaatacctgcggacccaaaactgtaccgccatcacaataaattaaggctgtgttttaaggaatttataatgtag

SEQ ID NO: 114263 - DNA, 6096 bp, Artificial Sequence
  Description of Artificial Sequence: Synthetic coding sequence
atgacacacctcaactccttagacgtccagctggctcaagagctaggtgatttcactgacgatgatctcgatgtcgttttcacacctaaggagtgtcgtaccctccaaccatctctccccgaggagggcgtggagctggacccccacgtgcgcgactgtgtgcaaacgtacataagagagtggttgatcgtaaatagaaagaaccaaggcagtccggaaatctgcggtttcaaaaaaaccgggagccgaaaagactttcacaaaacactgccaaagcagactttcgagagcgaaaccttagaatgctcggagcctgcagcccaggccggaccccgccatctaaatgtgctgtgtgacgtgtccggtaaagggcctgtgaccgcttgcgactttgacctgagaagcctccaacccgataagcgtctagagaatttgctccagcaggtgagcgcagaagactttgaaaagcaaaacgaggaggctcggaggacgaatcgccaagctgaactgttcgcactctacccctctgtcgacgaagaggatgccgtcgagatccgacccgtgcctgaatgtcccaaggagcacctcgggaatcggattcttgttaagctgcttactcttaagtttgagattgagattgaacccctttttgcttccatcgccctgtatgatgtaaaggagcgcaaaaaaatcagcgaaaatttccattgcgatctgaactccgatcagttcaagggatttctcagggcacacaccccaagcgtggctgctagtagccaagcaagatctgctgtctttagcgtgacatatccctcgtccgacatctatttagtcgtgaagatcgaaaaagtgctccaacagggagagatcggagactgtgccgaaccttataccgtgattaaggagtcggatggcggcaagtcaaaagagaagatcgagaaactgaaactacaggctgagtctttctgtcagcgcctggggaagtatagaatgccatttgcgtgggcacccatcagtctgtcatcattcttcaacgtgtcaacgttagagagagaagttaccgatgtcgattcagtggttggcagaagctccgttggggaaaggcgcacactagctcaatcacgacgcttgagcgagcgggcactctctctggaggagaatggcgtaggctcaaattttaagaccagtaccctgtctgtgagttcgttttttaaacaggaaggcgaccgcctatctgatgaagatctgtttaagttccttgctgattacaaacggtctagtagtttgcaacgcagagtgaaatctattccagggctgttaagactggaaatcagcaccgcccccgagattatcaattgctgtttgaccccggagatgcttcctgtgaagccatttcccgaaaaccgcacaagaccacataaggaaatcctggaatttcccacgagggaagtgtatgtgccacatacagtttaccggaatctgctctacgtatacccacaaaggttaaactttgtcaacaaacttgcttctgctaggaacattaccataaaaattcagtttatgtgtggcgaggacgcttcaaacgccatgccggtgatttttggtaaatcttccggacccgagtttctccaggaggtgtacactgccgtaacatatcataacaagagtcctgatttttatgaggaagtgaaaattaagctaccagccaagctgaccgtcaaccatcacctcctgttcaccttctaccacatcagctgccagcaaaagcagggggcttcagtggagacccttcttggctacagctggctgcccatactactcaacgaaaggctccagacaggcagctactgtctgcctgtggcactggagaagctcccccctaattactccatgcacagtgcagagaaggttcctctccaaaatccccctattaagtgggcagaggggcataaaggggtgtttaatattgaggtccaggccgtgagttctgtccacacgcaggataaccacctggagaagttttttactctgtgccactcattggaaagccaagtgactttcccgattcgtgtgctggaccaaaagatcagcgagatggcattagaacacgagcttaaactctctatcatctgcctaaacagctctaggctggaacccctggtactcttcctccacctggtgctagacaagctcttccaactcagcgtacaacccatggtgatcgccgggcagaccgctaatttctctcagtttgcttttgagtcggtcgtcgctatcgctaactctctgcataattctaaagacctgtctaaagatcagcacggccgcaactgtctgctggcctcttacgttcactacgtgtttcgtctgcccgaggtccagcgcgatgtccccaaatctggggcccctacggccctcctcgatccacgttcttatcacacatacggacggacaagcgcagctgccgtcagcagcaagctcctccaagctcgggtgatgtcgagtagtaaccctgatttggctggaacccacagcgccgccgatgaggaggtgaaaaacatcatgtcctctaagatcgcggaccggaattgctcaaggatgagttattactgctctggctcaagcgatgccccttcaagcccagcagccccacgtcccgcctccaaaaagcacttccacgaggagctagctcttcagatggtggtgtctaccggaatggtccgtgaaacagtgtttaaatacgcctggtttttttttgagctcctggtgaagtccatggcgcagcacgtccataatatggataaacgagatagctttcggcggactaggttcagcgacagattcatggatgacatcaccactatcgtaaacgtcgtgacctcagagatagcagctttgctcgtgaaacctcaaaaggagaatgagcaggcggagaagatgaatatcagtttagcattttttctgtacgacctgctgagtcttatggatcggggatttgtgttcaacttgatccgacactactgcagccagctgtctgccaagctctctaatttgcccacattgatctcaatgcgactggagtttctgcgaatcctctgctctcacgaacactatctgaatctgaacctcttcttcatgaatgccgatactgcacccacttctccatgcccatctatatcaagccagaactcgtcctcctgttcctcatttcaggatcagaaaatcgccagtatgtttgatctgacgtctgaatatcggcagcagcattttctgaccgggctgttgttcacagaattggccgccgctctggacgcggagggggagggcatcagtaaggtgcaacggaaagccgtctcagcaatccatagtttgctgtccagccacgacctggaccctaggtgcgtgaagccagaagtgaaagtgaaaatcgccgccctatatcttccccttgtggggatcattcttgatgccctcccccaactgtgtgatttcacagtcgctgacaccaggcgataccgcacctcagggtcagatgaggagcaggagggagcgggtgcaattaaccagaatgtggctctggctatcgccggcaataattttaatctgaagacttcgggaatcgtgttatcctcccttccgtataaacagtacaatatgcttaacgcggatactacacgcaacctgatgatatgttttctttggattatgaaaaatgccgaccagagcttaattcgcaaatggattgccgacttgccgtctactcagctcaataggatcctcgatctgttattcatctgtgttttgtgcttcgagtataagggcaaacagtcctcggataaagtctcaacccaagtgctgcagaaatcaagggatgtgaaagccagactcgaggaagcactgcttaggggcgaaggagcccggggggagatgatgcgacgccgagcaccaggcaatgaccgctttcctggccttaatgagaacctccgttggaaaaaggaacagacccattggcgtcaggctaatgagaagctcgataagaccaaggccgaattggaccaggaggctctgatctcgggtaatctagctacagaggcacacttgattatacttgacatgcaggagaatattatccaggcatctagtgcactggactgcaaagatagcctcctaggaggagtgctgagagtgctggtgaactctctaaactgcgatcagtcaaccacatacctgacacattgtttcgccacactgagagcgctgatcgcgaaatttggtgatctcctgttcgaggaagaagttgagcagtgcttcgatctgtgccatcaggtgctgcatcattgtagcagctccatggacgtgacacgctctcaggcctgcgctaccttatacttgctgatgagattctcattcggcgcgacttctaatttcgcccgcgtcaaaatgcaggtcaccatgtcgttggcgtctctcgttgggagagccccagactttaatgaagaacatctgcggcggagcctgagaactatactggcttattcagaggaggatactgctatgcagatgacaccctttccgacacaggtggaagagcttctgtgtaacctaaatagtattttgtatgacacggtgaaaatgcgggaatttcaggaggacccagagatgctgatggatctcatgtatcgaatcgcgaagagctaccaggctagccccgacctgaggctaacatggctccaaaatatggccgagaagcatacgaagaaaaaatgttacacagaagcagctatgtgtctggtccacgcagctgcccttgtggcggagtatctgagcatgctggaggatcattcgtacctgcctgtggggagcgtgagttttcagaacatttctagcaatgtgttggaggagtccgtagtgtccgaagatacactgagcccggacgaggatggcgtgtgtgccggccagtactttactgagtccggactggtcggcttactggagcaagctgccgagctcttctcaaccggcggattatatgagacggtcaatgaagtctataagctcgtgatacctattctggaggcacatagggagtttcgaaagttgaccctcacacactccaagctacagcgtgcattcgacagcatcgttaacaaagatcataagagaatgttcgggacatatttccgggtgggattttttgggtccaaattcggagatcttgacgagcaagagtttgtgtataaggagccggccatcaccaaactcccagaaatctcgcacaggctggaggctttctacggccagtgttttggagctgagtttgttgaggtgataaaggattcaacgccagttgacaagaccaagttggacccaaacaaggcatatatccaaattacttttgtcgaaccgtatttcgatgaatacgaaatgaaagaccgcgtcacatactttgaaaagaatttcaacctgcggagatttatgtacacgactccttttactttggagggacgcccacgtggcgaactccacgaacagtacagacggaataccgtgctcacaaccatgcatgcgtttccatatatcaaaactcgaatctctgtcatacagaaggaagaattcgtcctcacacctatcgaggtggccattgaggatatgaagaagaaaaccctgcaattggccgttgcgattaaccaggaacccccagacgctaagatgctgcagatggtgcttcaggggagcgtgggtgctaccgtgaatcaaggaccgcttgaagtcgcccaggtctttctcgctgaaatccctgcggaccctaagctgtatcgccaccataacaagcttaggctctgcttcaaggagtttataatgcggtgtggggaggccgttgagaaaaacaagcgcttgattactgctgaccaaagggaatatcagcaggagctgaagaaaaattacaacaagctcaaggagaaccttagacccatgattgaacggaaaatccctgagttatacaaacccatattccgggtggagagtcaaaagagagatagtttccaccgttccagttttcgaaagtgtgaaacccaattaagccagggatcctag

SEQ ID NO: 114264 - DNA, 6300 bp, Artificial Sequence
  Description of Artificial Sequence: Synthetic coding sequence
atggccaccctcccgtccgccgaacgccgcgctttcgcacttaaaataaacaggtacagctccgctgagatcagaaaacagttcactttgccgccaaacctgggccagtatcacagacagtccattagcaccagcgggtttccaagcctccagttgcctcagttctatgacccagtggaaccggttgacttcgagggcctgttgatgactcatctcaattctctcgacgtgcaactggcgcaagaacttggggattttacagatgatgacctggatgtcgtgttcacacctaaagagtgcaggaccctgcagcctagcctgcctgaggaaggtgttgaactcgaccctcacgtcagagattgcgtccaaacttatatccgagagtggctgatagtgaacaggaagaaccagggctctccagagatatgcggctttaaaaagacagggtcacgcaaggattttcataagaccttaccgaaacagacattcgagagcgagacccttgaatgttccgaaccagcagcccaagcaggtccaaggcacctcaacgtactgtgcgatgtatcaggcaaggggccagtgaccgcgtgtgatttcgatctccgatcacttcagcctgataagagactggagaacctgttgcagcaggtgtccgccgaggactttgagaagcagaacgaagaagcacggcgaacaaaccggcaggccgaactatttgcactctacccctctgtagatgaggaggacgccgttgagatccgacccgtccccgaatgcccaaaagagcacctaggaaatcgaatcttggtgaaactgctaaccttaaagttcgagatcgagattgagcccttgtttgcaagtatcgctctatacgacgtaaaagaacggaaaaagatatccgagaatttccattgtgatctcaacagtgaccagttcaagggcttccttcgcgcccatactccatccgtggcagcctcgtcacaagccaggagcgcggtgttcagcgttacctatccaagttccgatatttatcttgtggtcaaaatagagaaagtgctacagcaaggcgaaattggtgactgtgcagagccatataccgtgatcaaagagtcagatggggggaaatctaaagagaaaatagaaaaactgaaactccaggccgagagcttctgccagaggctgggcaaatatcgcatgccgttcgcgtgggccccaataagcctttcctccttttttaacgtgtcaacactcgaaagggaagttaccgatgtggatagcgtggtcgggcggtccagcgtaggtgagagaagaactctcgcccagtcaagaagactatccgagcgggcgctgtccctagaagagaacggcgtgggctctaacttcaagacgtccacgctctctgtcagctccttcttcaagcaggagggcgataggttatccgatgaggacctttttaagttcctggcagactacaaaaggtcttcatcattgcagaggcgggtgaaatcaatcccaggcctcctaagacttgaaattagtactgctcccgagataatcaattgttgcctaaccccggaaatgctccccgtgaaacccttcccggagaataggactcggcctcataaggagatcctcgagtttcccacacgggaagtatacgtcccacacacagtgtaccgcaatctgctctacgtttaccctcagcggctgaactttgtgaataagttggcttcagcccgcaacataaccatcaagatccagttcatgtgcggtgaggacgctagcaacgctatgcctgttatcttcggaaaaagctcagggcctgagtttttgcaagaggtgtacactgcagtaacttaccataacaaatccccagacttttatgaggaagttaaaatcaagttacctgctaagctgacagtcaatcaccatttgctctttacattttaccacatctcttgccagcagaaacaaggggcttccgttgaaaccttactgggttactcatggctaccgatcttgctgaacgaaaggcttcagacagggagttactgcctgccagtggctctggaaaagctgccccctaattattctatgcatagcgcagaaaaagtgcctctccagaacccccccataaaatgggccgagggtcacaagggcgtctttaatatcgaagtgcaagcagtatcctcagtccatacccaggacaaccacttggagaagttcttcaccctgtgtcattctctcgagagccaggtaaccttccctattcgcgttcttgaccaaaagatttcagagatggctctggagcacgaattgaaactgagcatcatttgtttgaactcatcccgtctggagccactggttctctttcttcacctggtattggacaagttgttccaactaagcgtccaacccatggtgatcgcaggacagacagcaaacttctcccagtttgcctttgagtccgtggtcgccattgctaattctctgcacaacagtaaagacctgtcaaaggatcagcacggccggaactgtttgttagcatcatacgtccactacgtgttccgactgccagaagttcagcgggatgtgcccaagtccggagcacctaccgctctgctcgatcctcgaagctaccatacttacggaaggacttcagccgctgccgtttcgtcaaagttgcttcaagctagggtaatgtcttcatctaacccagacctggctggcacacattcggccgccgatgaggaagtgaaaaacataatgtcctcaaagattgcagatagaaactgctcccgaatgagctactattgctcgggttcatctgacgctccttctagtcctgcagccccccggcccgcttccaagaagcatttccacgaggaactggccctgcagatggtagtaagcactggaatggttcgggaaaccgtgttcaaatatgcgtggtttttctttgaattgctggtgaagtccatggcgcaacatgtacataatatggacaaacgggactcatttcgcagaaccaggttcagcgacaggttcatggacgatattactactatagtgaacgtcgtaactagtgaaatcgccgctttgttggtgaaaccccagaaagagaatgaacaggccgaaaagatgaacatcagcctggcctttttcttgtatgatctgctctcactcatggatcgcggcttcgtattcaacctgattagacattattgctcacaactttccgccaagttatctaacctgcccacccttatctccatgagactcgagttcctaaggatcctgtgcagccatgagcattatctgaaccttaacttgttttttatgaatgccgacacagcgcctacttcgccctgtcctagtatttccagtcagaacagttcttcatgttcctcatttcaggatcaaaagatcgccagcatgttcgacctgacttcagagtaccggcagcagcacttcttgacgggcttgcttttcactgaattggccgccgccctggacgctgagggagaaggaatttcgaaagtccagcgcaaggccgtgtccgctatccactcgttactgagttctcatgatctcgatccgcgttgtgtaaagcctgaagtaaaagtcaagatcgcagctctgtatctgccgcttgtcggtatcatcctggacgccctgcctcagctgtgtgattttactgttgccgacaccagacggtatcggacatccggtagcgatgaggagcaggaaggcgccggggctattaatcagaacgtcgcccttgctatcgctggtaacaacttcaacttgaaaacttcaggtatagtgctgtcgtctcttccatacaaacagtataatatgctcaacgccgacacgactaggaatctgatgatttgctttctatggattatgaagaacgctgaccagtcgctcattagaaagtggattgcagaccttcctagtacgcagctaaataggattctggacttactgttcatctgtgtcttatgctttgagtataagggcaagcagtcatcggacaaggtgtccactcaggtgttgcagaaatctcgggatgtgaaagctaggctagaagaggcattactgaggggcgagggagcgagaggagaaatgatgcggagacgtgcccccggcaatgatcggtttcctggactcaacgaaaacctccgttggaagaaagagcagacacattggcgacaggccaacgaaaagctggataagactaaagcagaactcgaccaagaggctttgataagtggcaatctggccaccgaagcccacctcataatcctcgatatgcaggagaatattatccaggcgagttctgcactagactgtaaggatagcctgttgggaggcgtgcttagggtgttggtcaattcattgaactgtgaccagagcactacttacctcacccattgctttgctacactccgtgcacttatcgctaaattcggcgatctgcttttcgaggaggaggtggaacagtgcttcgatttgtgtcatcaggtgcttcaccactgctcgtcttctatggatgtgactaggtcacaggcttgcgctactttatacctcctaatgagattctcttttggagccacctccaactttgcccgcgtgaaaatgcaggtgaccatgtcgctggcttccctagtgggccgtgcaccagactttaacgaggagcacctgcggcggtctctgcggaccattctggcctacagtgaagaggacacagccatgcaaatgactccgttccctactcaagtagaggaactcctctgtaacttaaacagtattctctatgacaccgtgaagatgcgtgagttccaagaagaccctgagatgctgatggatctgatgtatcggattgcaaagtcctaccaggcttcacccgacctgaggcttacctggcttcagaacatggctgagaagcacactaagaaaaagtgctataccgaggccgcaatgtgtctggtacatgctgcagcactcgttgccgagtacttgagcatgcttgaagaccactcatacctgcctgttggctctgtgagcttccagaatatatcttctaacgtgctcgaagagtccgtcgtctccgaggatactctctctccagatgaggacggcgtttgcgcaggacagtactttaccgagagcggtttggtggggcttctagagcaagcagccgagctgtttagtacgggtggcctctatgaaacggtgaatgaggtttacaagctcgtgatccccatcctcgaggcccatcgagagttccgcaaactgacgctcacccattccaagctccaacgagctttcgactctatagtcaataaggaccacaaaagaatgtttgggacatactttcgggtggggttcttcgggtctaagttcggagacctggacgaacaggagttcgtctacaaggagcccgctataactaagttgccagagatttcccaccgcttggaggcgttctacgggcaatgcttcggggcagaattcgttgaggtcatcaaagacagcacaccagtggacaaaacaaagctggatccgaataaggcctatatacaaatcacgttcgtggagccatacttcgatgagtacgagatgaaggacagagttacatatttcgaaaagaactttaatttgagacgcttcatgtatacgacccccttcacactggaagggaggcctcgaggagagttgcacgaacaatatcgccgcaacactgtactcacaaccatgcacgcctttccgtatatcaaaacaaggatatctgttattcagaaggaagagttcgtgctcacccctattgaggtagccattgaggatatgaaaaagaaaactttacagcttgcggttgccattaatcaggagcctcctgacgctaaaatgctgcagatggttttgcagggcagcgtaggcgccactgttaatcaaggacctctcgaagtggcccaggttttcctggccgaaattccagctgaccccaagttgtataggcatcataataagctgcgtttatgctttaaagagtttatcatgagatgtggagaggccgtagagaaaaataaaaggctcattaccgctgaccagcgtgaatatcagcaggaactcaaaaagaactacaataagcttaaagagaacctgcggccaatgattgagcgcaaaatccctgagctgtacaaaccaatattcagagtggagtcacagaaaagggatagttttcaccgaagttctttccgtaagtgtgagacacagttgtcccagggatcttag

SEQ ID NO: 114265 - DNA, 6000 bp, Artificial Sequence
  Description of Artificial Sequence: Synthetic coding sequence
atgacccacttgaactccttagacgtccagcttgcccaagaactcggcgactttaccgatgatgatctcgacgtggtttttacgcctaaagagtgtcggacgctgcagccatccctccctgaggagggcgtggaacttgatccacatgttagagactgtgtgcaaacatacattcgggaatggctcattgtgaacagaaaaaatcaggggagtcccgagatttgtggtttcaaaaagaccgggtctcgcaaagacttccataaaacactgcctaaacagacattcgaatcagaaactctcgaatgctctgaacctgcagcccaagccggtcccaggcacctgaacgtgctttgcgatgtcagtggaaaggggcctgtcacagcatgcgattttgacctaagaagcctccaacctgacaaacgactggagaacctactccagcaggtctcagctgaggactttgaaaagcaaaacgaggaggctagaagaaccaatcgtcaagccgagctgtttgccctctacccttccgtcgacgaagaggatgctgtggagattcgacccgtgcccgagtgtcccaaagagcatctgggaaatcgcatcctggtgaaactgttgacattgaaatttgaaatcgaaattgaaccacttttcgcatcaatcgcactatatgacgtgaaggagcggaaaaagatatcggaaaacttccattgtgacttgaactctgaccaattcaagggtttcctgcgggcacataccccatcagtagcggcgtccagccaggccagatcagcagtctttagcgtcacgtatccaagctccgatatctatctggtagtgaaaatcgaaaaagttcttcagcagggggaaattggcgattgcgccgagccctacaccgtgatcaaagaatcagatggggggaaatcaaaagaaaagattgaaaaactgaaactgcaggcagagtcgttttgccagcgcctgggtaaatataggatgccttttgcgtgggcccccatatctttgtcctctttcttcaacgtgtctaccttggagcgcgaggttaccgacgttgacagtgtggttggtaggtcatcggtcggcgaacgccgtaccctggcccagtccaggcggctcagcgagagagccctgagtttggaagagaacggagtcggaagcaattttaaaaccagtactctgagcgtctcctccttcttcaagcaggaaggtgacaggctgtccgatgaagatctgtttaagttcttggctgattacaagcgatctagctcactacagcggcgggtgaaatctatcccgggcttactgcgtctagagataagcaccgcccccgaaattatcaactgttgtcttacaccggaaatgttgccggtgaaacccttcccggagaatcgaactaggccgcataaggagatcttggagtttcctacccgagaggtctatgtcccacacactgtgtatcggaacctgctttatgtgtatccgcagcggttaaacttcgtgaacaaattagcatcggcacggaacataacaattaagatccagttcatgtgcggagaagacgcaagcaatgctatgccagtgatctttggtaagtcttctggcccagaattccttcaggaggtgtatacggcggtcacgtatcacaacaagtcaccagatttttacgaagaagttaaaatcaagttgcctgccaagctgaccgtgaatcatcacttgttgtttacattctatcatattagctgtcagcagaagcagggcgcatccgtggagactttactgggatatagttggcttcccatcctgctcaatgagaggctccagacaggcagctattgcttgccggtcgccctcgaaaaattgccccccaactacagcatgcactccgcggagaaagtaccactgcagaatcccccgataaagtgggctgaaggtcataaaggcgttttcaatattgaggtgcaggctgtttctagcgttcatacccaggacaatcacctcgagaagtttttcactctctgccatagcctcgagagccaagtgaccttcccaatcagagtgcttgatcagaaaatttcagaaatggccctggagcatgagctcaagctgtcaatcatttgccttaatagctcccgacttgagcccctggtgctcttcctgcaccttgtcctcgacaaacttttccagctgtctgtacagccgatggtgatcgccggtcaaactgccaacttttcccaattcgctttcgaatcagtggtggcaatcgcaaactccctgcacaatagcaaggatttgtctaaagatcaacatggcagaaattgtctgttagcatcctatgtgcactacgtgttccggttgcctgaggtacagcgcgacgtgccaaaatctggtgctcctacagcattgctggatccgcgttcctaccatacgtatggtcgcacctcggcggcagccgtttcctccaagcttctgcaggcacgcgtaatgagctctagtaaccccgacctggccggaactcattctgccgcagacgaagaggtgaaaaacattatgagttcaaagcatttccacgaggagctggctctgcagatggtagtctctaccgggatggtaagggaaaccgtttttaaatatgcctggttcttttttgagctgcttgtaaaaagcatggctcagcacgtccacaatatggataaacgggacagcttccgaaggacaaggttcagtgacaggtttatggacgacattactactatagtcaacgtcgttacttctgaaattgcggctctgctggttaagcctcagaaagagaatgagcaggctgagaagatgaacattagcctggctttcttcctgtacgatctgttgagcctaatggacagaggttttgtgttcaacttgatcagacactattgttcacagctaagcgctaagttatccaacctgcccacgctgatctcgatgcgcctggagtttctcaggattttatgttcacacgagcattatttgaacctcaatcttttctttatgaacgcagataccgcacccactagtccatgccccagcatctcttcccaaaactctagctcctgcagcagtttccaggatcagaaaattgcctcaatgttcgatttgacttcagagtacaggcagcaacatttcctgaccggcctactcttcaccgagctcgccgctgcgctcgacgcagagggagagggaatttctaaggtacagcggaaagcggttagtgctatacacagcctgcttagttcccatgacctagatccaagatgcgtcaaacccgaagtaaaggtaaaaatcgccgcactatacctgcctcttgtgggcattattttagatgcactgccgcaactgtgtgacttcaccgtcgccgatacacgcaggtatcgtacctctgggagtgacgaggaacaggagggagcaggagcaataaatcagaacgtcgcactcgctatcgctggtaacaattttaacctgaagacatctggcatcgtcctgtcttcactcccctacaagcagtacaacatgctgaacgccgatactacacgcaacctgatgatctgttttctatggattatgaaaaacgccgaccagtccctcatccgcaaatggattgctgacctgcctagcacccaactaaataggatcttggatctcctattcatttgcgtgctatgcttcgaatataagggtaagcagagtagcgacaaagtaagtacacaggtactgcaaaagtctcgcgacgtgaaggcaaggctcgaagaagccctgttgagaggggaaggtgctagaggcgagatgatgcggcgccgtgcccctgggaatgatagattcccaggtttgaatgagaacttgcggtggaagaaggaacagacgcattggcggcaggctaatgaaaaactggataaaacgaaggccgagttggaccaagaagcactcattagcggaaacctggccaccgaagcccaccttatcatcctcgatatgcaggagaacattattcaggcctcatcagcgctggattgtaaagatagccttctggggggcgtgctaagggtgctggtgaacagtctgaactgcgatcagtctaccacctatctgacccactgcttcgccaccctgcgagcgctgattgctaagttcggggacctgctgttcgaagaggaggtcgagcagtgcttcgatctctgtcatcaggtcctgcaccattgctcttcttcgatggatgtgactaggagccaggcttgcgccacgctgtacctgttaatgcgatttagcttcggtgctacatccaatttcgctagagtgaagatgcaggtgactatgtctctggctagcctcgttggccgcgcccccgactttaatgaggaacatctgaggcgttccctgcgcacaattctggcctatagtgaggaggacaccgcaatgcagatgacccccttcccaactcaggttgaggaacttctgtgcaatctgaattccatcctgtacgacacggtgaagatgcgggaatttcaggaagacccggagatgctgatggatcttatgtaccggatcgccaagtcgtaccaagccagccccgatcttagactgacatggctgcaaaatatggcagagaagcacactaaaaaaaagtgttacactgaggcagccatgtgccttgtccatgcagctgcattggttgctgaatatctctctatgttggaagatcatagttatcttccagtgggtagcgtatctttccagaatatttcgtctaatgtgctcgaggaatcggttgtttcggaggacacgttgagccccgacgaggatggcgtctgcgccggtcagtacttcacagagagcggcttggtggggctcctggagcaggcggcagaattgttctcaactggggggctgtacgagaccgtaaacgaggtgtataagctggtgattcctattttggaggcacatcgcgagtttagaaagctcactctgacacactcgaaactccagcgcgccttcgactcaatcgtgaataaagaccacaagcggatgtttgggacatatttccgtgtcggattttttggatcaaagttcggtgatctggacgagcaggagttcgtgtacaaagaacccgctattacaaagcttccagaaatctcccaccgcctagaagctttctacgggcagtgcttcggcgccgaatttgtggaggtcataaaggactccaccccagtggataaaacaaagctcgatccgaacaaagcctatatccaaatcacgtttgtcgagccatattttgatgagtacgaaatgaaggatcgagtgacctatttcgagaagaatttcaaccttcgtcgcttcatgtacaccaccccattcactctggaaggaagacctcggggcgaactgcacgagcagtatagacgcaacactgtcctgaccacaatgcacgcattcccctacattaagactcgaatttctgtcatccagaaagaggagttcgtcctgaccccaatcgaggtggcgattgaggatatgaaaaagaaaactctgcaactggccgtggctatcaatcaagaacctcccgacgcgaagatgctgcaaatggtcctgcagggaagcgtgggcgccactgtgaaccaaggtcccctggaagtcgcacaggtgttcttggccgaaatccctgcagatcctaagctttataggcatcataataaattgaggctctgcttcaaagagttcatcatgcggtgcggcgaggcagtggagaagaataaacggttaattactgcagatcagcgcgagtatcagcaagagcttaaaaagaactacaacaagctgaaagaaaatctccggccaatgatcgagcgcaagatccctgagttgtacaaacctatttttcgagtggaaagtcagaagcgggacagcttccacagaagctccttccgcaaatgcgagactcagctgtcccaggggagctag

SEQ ID NO: 114266 - DNA, 1182 bp, Artificial Sequence
  Description of Artificial Sequence: Synthetic coding sequence
atgaagagaacccgcgatgaggtggatgcaactctgcagatcgccaaactgaacgctgccgagttgctgccagccgtgcactgcctcggtttcggacccggggccagtggagcggccgcaggcgacttttgccttctggagctggagcctactctatgtcagcagctggaagatggtcattctcttgtaattcggggtgacaaggatgaacaagcagtgctttgttccaaggataaaacctacgatctcaagatagccgacacatccaacatgctactgtttatccctggatgtaaaacccccgaccagctgaaaaaggaggattcgcactgcaacataatacatacagagattttcggtttctcaaacaattactgggaactcagacggagacgacccaagttaaaaaagctgaaaaagctcctgatggagaacccatacgaagggccggattcgcaaaaggagaaggattcaaacagctccaaatatactacggaagacttgcttgaccaaatccaggcaagcgaggaggagattatgacccagctgcaggtgctgaatgcatgtaaaattgggggttactggcggattctggagtttgattacgagatgaagctcctgaatcacgtaacacagctcgtggattccgaatcctggagctttggtaaggtacccctaaatacttgcctgcaagagctcggccctcttgaacctgaggaaatgattgagcactgtttgaagtgctatggtaagaaatatgtggatgagggtgaagtgtactttgaactggacgctgacaagatatgtcgggcggccgctaggatgctgttgcagaacgccgtgaagttcaatctggcggagttccaggaggtctggcagcaatctgttccggaaggcatggtgaccagtctggatcaactgaaggggctagcactggtggacaggcattcacgcccggagatcatcttcctccttaaggtggatgatctgccagaggacaaccaggagcgatttaacagtctcttttccctgcgcgagaaatggaccgaagaggacattgctccatacattcaggatctgtgcggcgaaaaacagacaatcggcgcactgctgacaaagtatagtcactcaagcatgcaaaacggtgtgaaagtgtataacagtcggcggcctatctcatag

SEQ ID NO: 114267 - DNA, 342 bp, Artificial Sequence
  Description of Artificial Sequence: Synthetic coding sequence
atgtctgcttctgtggttagtgttatcagcaggtttctggaggagtacttgagctctacccctcaacgactgaaattgctggatgcctacctgttgtatatcctactgaccggcgcgctccagttcggctactgtctgcttgtgggaacttttccgtttaacagctttctgtcagggttcatctcctgcgtggggtccttcattcttgcagtttgtctgaggatccagattaatccgcagaataaagctgattttcaggggattagcccggagagggccttcgccgatttcctctttgcctctacgatactgcatctggtagtgatgaacttcgtgggctag

SEQ ID NO: 114268 - DNA, 285 bp, Artificial Sequence
  Description of Artificial Sequence: Synthetic coding sequence
atgcggactctagccatcttggcagcaatactcctcgtggcattacaagcacaggccgaacccctacaggcccgtgcggatgaggtggcagctgcccctgaacagatcgcagcagatattcccgaagtcgtcgtatccctggcatgggatgaaagtttggctccaaagcatccaggttctcgcaaaaatatggcatgctattgtcgcatcccggcctgtattgcgggtgaaaggcgatacggcacatgcatttatcaaggcaggctatgggccttttgctgttag

SEQ ID NO: 114269 - DNA, 285 bp, Artificial Sequence
  Description of Artificial Sequence: Synthetic coding sequence
atgagaacactcgccatcttggctgccatcttactcgtggcactgcaagcacaggctgagccactgcaggcacgcgccgatgaagtagctgcggcacccgagcagatcgcggctgatatccccgaagttgtggtgagtctggcatgggacgagagtcttgcgccaaaacacccggggtctcgcaagaatatggcgtgctattgcaggataccagcatgtatcgccggtgaacgccgctatggcacctgcatctatcaaggaagattgtgggccttctgctgctag

SEQ ID NO: 114270 - DNA, 294 bp, Artificial Sequence
  Description of Artificial Sequence: Synthetic coding sequence
atgcggataatagctctcttggccgcgattttgctggttgcacttcaggtccgtgccgggccattacaggctcggggtgacgaagctcctgggcaagagcagagaggacccgaggaccaggatatcagtattagcttcgcatgggacaagagctctgcactgcaagtgtccggaagcacgcgagggatggtctgtagctgccggttggtattctgtagaagaactgaattaagagtcggaaattgtcttatagggggcgtctctttcacctactgctgtacaagagtcgattag

SEQ ID NO: 114271 - DNA, 285 bp, Artificial Sequence
  Description of Artificial Sequence: Synthetic coding sequence
atgcggaccatcgccatcctggccgccattctgttggtggcattacaggcccaggccgaaagtctgcaggaacgggcagatgaggctaccacccaaaagcagtcgggggaagataatcaggaccttgccattagctttgctggaaacgggctgagcgctctgcgaacatctggctcacaagcaagggccacctgttattgccgcaccggccggtgcgccacaagagagagtctgagtggcgtgtgtgagatcagtggcagactttatcggctgtgttgccgttag

SEQ ID NO: 114272 - DNA, 303 bp, Artificial Sequence
  Description of Artificial Sequence: Synthetic coding sequence
atgcgaacgcttactattttaactgccgtgctactcgtggctctccaggcaaaggccgagcccctccaggcggaggacgatcctttgcaagcgaaggcttatgaggccgacgcccaggagcagaggggcgccaatgatcaagacttcgccgtgtcttttgcagaggatgccagttcctcgctgagagccctgggctctacaagggcattcacatgccactgtcgtcggagttgctacagtactgagtactcctatggaacttgcactgtgatgggcattaaccataggttctgctgcctgtag

SEQ ID NO: 114273 - DNA, 207 bp, Artificial Sequence
  Description of Artificial Sequence: Synthetic coding sequence
atgagaacaagctacctactgctgttcactctgtgtcttctgcttagtgagatggcttctggcggtaattttcttactggtttgggccatagatcagaccactacaattgcgttagttccggcggtcagtgtttgtactcagcatgtccaatctttactaaaatccagggcacatgttacagggggaaagcaaagtgctgtaagtag

SEQ ID NO: 114274 - DNA, 372 bp, Artificial Sequence
  Description of Artificial Sequence: Synthetic coding sequence
atgaagttactccttctggccctgccaatgctcgtcctgcttccacaggtcatccctgcctactccggggagaaaaaatgttggaaccgcagcggacactgtcgtaaacagtgtaaagatggtgaggcggtcaaagacacctgtaagaacctcagggcatgctgcatccccagtaacgaggaccaccgacgggtgcccgccaccagccccacccctttgtcagattcaactccgggcataattgatgatattctgacggtccggttcactacggactacttcgaggtgagcagtaaaaaggacatggtcgaagagagtgaagccggccggggcactgaaacatccctgccaaatgtccaccattcctcatag

SEQ ID NO: 114275 - DNA, 1002 bp, Artificial Sequence
  Description of Artificial Sequence: Synthetic coding sequence
atgtcttggattaaggaaggagaattaagcttgtgggagagattttgtgcaaatatcatcaaggctggccctatgccaaagcatatcgccttcatcatggatggaaatagacgatacgctaagaaatgtcaggtcgaacgacaggaggggcattcccagggctttaacaaactcgcagaaactctccgttggtgccttaaccttggaatcttagaggttacggtgtatgcgtttagcatcgaaaatttcaagagatctaagtcagaagttgacggtctcatggatctggcaaggcaaaaatttagtagactgatggaagaaaaagagaagctccaaaagcacggcgtctgtattagggttttaggggacttgcacctcttgccgcttgacctgcaggagctgattgcccaagccgttcaggccaccaagaattacaacaaatgttttctaaacgtctgctttgcctatacttccaggcacgaaatctctaatgcagtcagagaaatggcctggggcgtagaacagggcctgctggacccatccgatatcagtgagtcactgctagataagtgtctgtacaccaatagaagccctcaccctgacatcctgatacgtacttccggagaagtccgactgtctgatttcctgctatggcagacttctcattcctgtcttgtctttcagcctgtgctgtggccagagtacactttctggaacctgtttgaagccatcctccagtttcagatgaaccacagtgtcctccagaaggccagagacatgtacgccgaagagaggaaacggcagcagctggaaagagaccaggcaactgtgaccgagcagttgctgcgggaagggctccaggcatccggcgatgctcaactccgccgtacccggttacacaagctgtcagcacgaagagaagagagggtgcaggggttcctccaggccctcgaactaaaaagggccgactggcttgctaggctcggcacagccagcgcttag

SEQ ID NO: 114276 - DNA, 1005 bp, Artificial Sequence
  Description of Artificial Sequence: Synthetic coding sequence
atgtcttggatcaaggaaggcgaattgtcactgtgggaacgattctgtgctaatatcattaaggccgggccgatgccaaaacatatcgcttttatcatggatggtaaccggcggtacgccaaaaaatgccaggtggagcgtcaggaggggcacagccaagggttcaacaaactggccgaaaccctgaggtggtgtcttaacctgggtatactcgaggtaacagtctatgctttctctatcgaaaattttaagcggtctaaatctgaagtggacggcttgatggatctcgccaggcagaaattttcgcgactgatggaggagaaagagaaactgcagaaacacggggtctgtattcgggtactgggggatctgcacctgctccctctagacctccaggagctgattgcacaggccgtgcaggccacaaagaattacaataagtgtttcctgaacgtatgcttcgcctacacatcgaggcacgagatatcaaacgcagtcagggaaatggcctggggcgtggagcagggcttgctcgacccttcagatatttcagaatcgctgctggacaaatgtctctacaccaacaggtctccccaccctgatatcctgataaggacatctggcgaagtcagactgtcagattttctgctgtggcagacctcacacagttgcctagtcttccagcccgtcctgtggccggaatacaccttctggaacttgttcgaggctattctgcaatttcagatgaaccacagcgtgctacagcaaaaggccagagatatgtacgcagaagagcgaaaacggcagcaactggagcgagaccaagcgaccgtaacagagcagctgctaagggaaggtctccaagcctctggcgacgcccagctccgtaggactagattgcataaattatccgcccgccgagaagagcgcgtgcaggggttcctgcaggccctcgaactgaaaagagccgactggttggctcgcctcgggacagcttccgcctag

SEQ ID NO: 114277 - DNA, 516 bp, Artificial Sequence
  Description of Artificial Sequence: Synthetic coding sequence
atggacttagctagacagaagttctcccgactgatggaagaaaaggagaagctgcagaaacacggagtgtgcattcgggtgttgggggacctccacctgctccctcttgatctgcaggaactgattgcacaggcagtgcaagcaacaaagaattataataacgatatttccgagtccctgcttgataaatgcctgtacaccaaccgctctccgcatccagacattctcatccgcacatctggagaagtgcggttgagtgattttctgctgtggcagcagaaagcgcgggacatgtatgccgaggagcggaagagacagcagctggaacgggatcaagccactgtgactgagcagctcttgagagaaggcttacaggcctccggggatgcacaactccggagaaccagactacacaagcttagtgcccgacgtgaagagcgcgtgcagggattcctgcaggccctggagctgaaaagagccgattggttggcccgcctcgggacagccagtgcttag

SEQ ID NO: 114278 - DNA, 501 bp, Artificial Sequence
  Description of Artificial Sequence: Synthetic coding sequence
atggatggcaacaggcgttatgctaaaaaatgtcaggtggagcgccaggaggggcacagccaggggttcaataaactggcggagacgttacgatggtgccttaatctcgggatcttagaggtgactgtgtacgccttctccatcgaaaattttaagcggagtaagtctgaggtggacggtttgatggatctggcaagacagaaattttccagacttatggaggagaaagagaaactgcagaaacatggcgtgtgtatccgcgtcttgggcgatttgcacctcctccctctggacctgcaggagcttatagcccaggctgttcaggccaccaaaaactacaacaaatgtttcctcaacgtgtgtttcgcgtacacaagcagacatgaaatttcaaatgcagtgcgtgagatggcatggggtgtggaacagggactcctggacccgtcccgggaccgctttcatcacattgggcaggcctccctagagttgctgacctcctag

SEQ ID NO: 114279 - DNA, 546 bp, Artificial Sequence
  Description of Artificial Sequence: Synthetic coding sequence
atggaggagaaggagaagttacagaagcacggtgtttgcattagggtcctgggagacttacatctcctgcccctggaccttcaagaactaattgctcaggctgtacaggccacgaagaactacaacaaatgtttcctcaatgtctgtttcgcttacaccagtcgacatgagattagtaacgccgtgcgggaaatggcttggggcgtggaacagggcctccttgatcctagtgacatctcggagtcccttctggataaatgtttgtatacaaacagaagtccccacccagatatcctcatccggacttccggggaagttcgcttaagtgatttcctgctctggcaaacaagccattcatgcctagtttttcagccagttctatggcctgagtatactttttggaacttattcgaggcaatcctgcagttccagatgaatcactctgtgctccagcacccagggagcctgcttacaaaggcctggaaaaagcctttccagcaagatggggagctatacgggaactgtagcagccctaaatccagctag

SEQ ID NO: 114280 - DNA, 669 bp, Artificial Sequence
  Description of Artificial Sequence: Synthetic coding sequence
atgtcttggatcaaagaaggggaactctcactgtgggagaggttctgtgccaatatcatcaaagccggccccatgccaaaacatatcgcattcataatggacggtaacaggcgttatgccaagaagtgtcaggtggagcggcaagagggtcacagccagggatttaataaacttgctgagactctcagatggtgcctgaacctgggcattctggaagtcacagtatacgcgttcagtatcgaaaacttcaaacgcagcaagtctgaagtggatggcctcatggacctcgctagacagaagttcagccgtcttatggaggagaaagagaagttacagaagcacggcgtctgcatcagggtactgggggatcttcatttgctacccctagacctgcaggagctgatcgcccaagctgtgcaagccactaagaactataacaaatgcttcctgaacgtatgtttcgcctacacttcgcgccacgagataagtaatgctgtccgagagatggcctggggggttgagcagggtctgctagacccacgctatccagacgacattagcgagtccctcctggataagtgtctgtacacaaacaggtcgccacatcctgacatcctgataaggactagcggcgaagtcaggctcagcgatttcctgctatggcagtag

SEQ ID NO: 114281 - DNA, 369 bp, Artificial Sequence
  Description of Artificial Sequence: Synthetic coding sequence
atgagctggattaaggaaggtgagttgagcctgtgggagagattctgtgctaacatcatcaaggccggaccaatgcctaaacatattgccttcatcatggacggaaataggagatacgcgaaaaagtgccaggttgagaggcaggaaggccatagtcagggtttcaataaactcgctgaaactctgagatggtgtctcaatctggggatcttggaagtgaccgtgtatgctttctcgatcgagaattttaagaggtccaagtctgaggtcgacggcctgatggacttggcacgtcagaaatttagcaggctgatggaggagaaggaaaagctgcagaaacatggcgtgtgtatcagagttctggggtag

SEQ ID NO: 114282 - DNA, 216 bp, Artificial Sequence
  Description of Artificial Sequence: Synthetic coding sequence
atgagttggattaaggagggggagctgagcctgtgggagagattctgcgccaatatcattaaggctgggccaatgccaaagcatatagcctttattatggatgggaacagacgctacgctaaaaaatgtcaggtggaacggcaggagggccattctcagggttttaataaacttgcggaaacactgcggtggtgtctcaatttgggtatactctag

SEQ ID NO: 114283 - DNA, 258 bp, Artificial Sequence
  Description of Artificial Sequence: Synthetic coding sequence
atgtcatggattaaagagggggaactatctctctgggagcgcttttgtgcaaatattatcaaggctggcccgatgcctaagcacatcgccttcatcatggatgggaatcgccgctatgctaagaagtgccaggtggaacggcaggaaggtcactctcaagggttcaacaaactggctgagaccctcaggtggtgtctcaacctcggcattcttgaggttacagtgtacgccttttcgattgagaactttaagcgctag

SEQ ID NO: 114284 - DNA, 885 bp, Artificial Sequence
  Description of Artificial Sequence: Synthetic coding sequence
atgagctggatcaaggagggggagctatcactctgggaacgcttttgcgccaatatcattaaggccggacccatgcctaaacatatcgcgtttatcatggacggcaacagacggtacgctaaaaaatgtcaggtggagcggcaagagggccactcccagggatttaataagctcgcagagacgctgcggtggtgtctcaatctaggtatcctcgaagttacagtgtacgcattcagtatcgagaactttaagcgcagtaaatctgaggtggatgggctaatggatctcgcccgtcagaaattctcgagactaatggaagagaaatgcttcctgaacgtctgctttgcgtatacctcacggcacgaaatctcgaatgctgtgcgggagatggcctggggagttgagcaggggctgctcgatcccagtgacatttctgaatccctgctggacaagtgtctgtacactaaccggtcccctcatcctgatatcctgatccgcaccagcggtgaagtcaggttatccgatttcctgctgtggcagactagtcatagctgcctcgttttccagccagttctgtggccagagtatactttttggaatcttttcgaagccatcctgcagtttcagatgaatcactcagtactccagaaagcccgtgatatgtacgccgaagagaggaaacggcagcagttagagcgagatcaggccacggtaactgagcaacttttaagagagggtctacaagcctcaggagacgcgcaattgcggaggaccagattgcataaactgtcagcgcggcgagaggagcgtgtgcaagggttcttacaagctctcgagcttaaacgagctgattggctggccagactgggtacagcttccgcctag

SEQ ID NO: 114285 - DNA, 183 bp, Artificial Sequence
  Description of Artificial Sequence: Synthetic coding sequence
atgtcttggatcaaagaaggtgagctgagcctgtgggagaggttttgcgccaatattatcaaggcaggcccaatgccgaagcacatcgcttttataatggatggaaacagaagatatgccaagaaatgtcaggtcgaaaggcaggaagggcacagccagggcttcaacaaactggctgagtag

SEQ ID NO: 114286 - DNA, 396 bp, Artificial Sequence
  Description of Artificial Sequence: Synthetic coding sequence
atgagttggattaaggagggtgagctgtcactgtgggagcggttctgtgcgaatattataaaagcaggtccaatgcccaaacacatcgccttcattatggacggcaacaggcggtatgctaaaaaatgccaagtcgaacgacaagaggggcatagtcagggctttaacaaattggcagaaacactgaggtggtgcttgaatcttgggatacttgaagtaaccgtctacgcatttagcatagagaactttaaacgctccaagagtgaggtggacgggcttatggacctggcacgccagaagttcagccgtttaatggaggaaaaagagaagttgcagaaacacggagtgtgtataagggtgcttggcgatctgcatctccttccactcgacctgtag

SEQ ID NO: 114287 - DNA, 501 bp, Artificial Sequence
  Description of Artificial Sequence: Synthetic coding sequence
atgagctggattaaggaaggcgaattgtcgctgtgggaaaggttttgcgccaatattatcaaagctggcccgatgcctaaacacatagccttcataatggacggaaaccggagatacgctaagaagtgtcaagtcgagaggcaggaaggtcattcccaaggtttcaacaagctggccgaaacgctgaggtggtgtctgaacttgggaatcctggaagttaccgtgtacgccttttctatcgagaactttaagcggtcaaagtccgaagtggatggcttaatggacctggccaggcagaaattctctaggttgatggaagagaaagaaaaattgcagaagcacggagtctgtattcgcgtcctgggagatcttcatctgctgccactcgacctgcaggaattgatagctcaagcagtgcaagccactaagaattataataagtgttttctaaatgtatgcttcgcatacacctcacggcacgagataagtaacgcagtgtag

SEQ ID NO: 114288 - DNA, 909 bp, Artificial Sequence
  Description of Artificial Sequence: Synthetic coding sequence
atggtgtggaaacggctcggggctctggttatgtttcccctgcaaatgatttatcttgtggtgaaggccgccgtcggcctggtcctgcccgctaagctccgcgacttgagtcgagagaatgtgttgattaccggcggcggcagaggtattggccgtcagctggcccgagaatttgctgaacgtggtgcacgcaagatcgtcctgtgggggcggacagagaagtgtctgaaagagaccacggaagagatccgtcagatgggaacagagtgccattattttatctgtgacgtggggaatcgggaggaggtgtaccaaacggcgaaggcagtgcgggagaaggtgggggatatcaccatcctggtcaataacgccgctgtcgtgcatggaaagagcctgatggattccgacgatgatgccctgttaaaatctcaacatattaacacacttggtcagttttggactactaaggcgtttctgccaagaatgctggagctgcagaacgggcatatcgtttgtctgaattccgtgttagccctgagcgccattcctggtgcgatcgattactgcacatctaaggcttctgcgtttgccttcatggagagccttacattggggcttctagattgtcccggtgtaagtgccaccacagtgctcccttttcacacaagtactgagatgtttcaaggcatgagagtgcggttccctaacctgttcccacctctgaagccagagaccgtggcaagacggacagtcgaagccgtgcaactaaaccaggccctgctgctgttaccctggactatgcatgcacttgtgatcctaaagagtatactgccacaagctgcccttgaggagattcacaaattcagcggcacttatacctgcatgaatacctttaaggggcgtacatag

SEQ ID NO: 114289 - DNA, 444 bp, Artificial Sequence
  Description of Artificial Sequence: Synthetic coding sequence
atggggaccgaatgccactattttatttgtgacgttggcaaccgtgaagaggtttatcagacagctaaggctgtgagggagaaggtgggagatatcacgatcctggtgaacaacgctgccgtcgtgcatggtaagagtttgatggacagcgacgatgatgctctgctgaaatctcagcacattaatacactggggcagttttggaccactaaggcctttctcccccggatgctggaattgcagaatggccacattgtgtgtctcaattccgtgttagcactgtctgccatccccggggctatcgattattgcacatccaaggcttctgcattcgccttcatggagtcactcacactcggactgctcgactgccctggcgtttccgctaccacagtcctcccattccacacctctacagaaatgttccagggcatgagagtgtag

SEQ ID NO: 114290 - DNA, 423 bp, Artificial Sequence
  Description of Artificial Sequence: Synthetic coding sequence
atggctagttccggtatgacaagacgagatccgctagccaacaaggtcgctctcgtgactgccagtaccgacgggatcggttttgctattgcgagacgactcgcccaggacggcgcccatgtggtcgtttcctcccgtaagcagcagaatgtggaccaagcagtggccaccctccaaggggaaggattatccgtgaccggcactgtgtgccatgtgggaaaagccgaagatcgggaacgactcgtcgcaactctctggatggataaggaaaaagaagagagtatgaaggaaactttgcgtatcagaagattgggcgagcccgaagattgcgccggtatcgtctccttcctttgctccgaagacgcttcatatattactggcgagactgtcgtggtcggcggcggaacccctagcagattgtag

SEQ ID NO: 114291 - DNA, 837 bp, Artificial Sequence
  Description of Artificial Sequence: Synthetic coding sequence
atgcataaagccggtctgctaggcctgtgtgctcgcgcttggaactccgttaggatggcttcatccggaatgactagaagggatcctcttgccaacaaggtggcactggttacagcttcaacagatggtatcggcttcgctatcgctcggaggctggcccaggatggagcacatgttgtggttagttccaggaaacagcaaaatgtagatcaagccgtcgcaaccctccagggagaaggtctctctgtgactggcactgtttgtcatgtggggaaagcagaggatagagagagactggtcgccacagccgttaaactgcatggggggattgatatcctggtgtctaatgcggcagtcaaccctttttttggtagcattatggacgtgactgaagaggtttgggataaaactctggatattaatgtgaaagctcctgccctcatgactaaggccgtggtgcccgaaatggaaaaaaggggtggaggttccgtcgtaattgtgagcagtattgcggcttttagtccatctcccggattttctccatacaatgtgagtaagaccgcgctgctgggcctgaccaagactctcgccattgaactggccccaagaaacatccgggtcaactgtctcgcccccggcctaattaagacaagtttctcacggatgctgtggatggacaaggagaaggaagagagcatgaaggagactctcagaatccgacggctgggtgaaccagaagactgcgccgggattgtgtcctttctgtgttcagaggacgcctcctacatcaccggggagacagttgttgtcggcggcggcactcctagccggctgtag

SEQ ID NO: 114292 - DNA, 513 bp, Artificial Sequence
  Description of Artificial Sequence: Synthetic coding sequence
atggcaagttccggcatgactcggcgcgacccactggcaaacaaggttgccttagtcactgcgtctactgatggcatcggattcgcgatcgctcggcgactggcccaggacggcgcacatgtggtcgtgtcctctaggaaacagcaaaacgtagaccaggccgtggccacactgcagggtgaggggctctccgtaacaggtacggtatgtcacgtcggtaaagccgaagaccgtgaacgactggttgctaccgcagtgaagctgcatggagggatagacatattggtctccaatgcggcagtaaatccttttttcgggagtattatggacgtgacagaggaggtgtgggacaagaggagattgagcggagatcgcgtatttcactcaagcctgcaaagtatcagcagtttagacggtcaggggaagcgaggcaaacatgagcggaatcctgccgataagaaggtcaggcgagcgcgagggctgtgctggcaccgtgtttttcccgttctctag

SEQ ID NO: 114293 - DNA, 546 bp, Artificial Sequence
  Description of Artificial Sequence: Synthetic coding sequence
atggccagtagcggaatgacccggagggatccattggcaaataaggtggccctagtgactgcctctactgatggaataggttttgctatagcacggaggctcgcccaggacggagctcacgtcgtagtgtcgtccagaaagcagcaaaacgtagaccaggccgtggccactttgcagggcgaggggctgtccgtgactggcacggtgtgccatgtgggaaaagcggaagacagagagcgattggttgctaccacactggacatcaatgtcaaagcccctgccctgatgactaaggcagtagttccagaaatggaaaaacgcggaggcggtagcgtggtgattgtaagttcgatagccgcttttagccctagcccgctctggatggataaagagaaggaagagagcatgaaggaaacactgcggatccggcggctgggagaacccgaagattgcgcgggcatcgtgtcgtttttgtgtagtgaggacgctagctacataacaggagaaactgttgtcgtgggggggggtacgccatcgaggctgtag

SEQ ID NO: 114294 - DNA, 477 bp, Artificial Sequence
  Description of Artificial Sequence: Synthetic coding sequence
atgcataaagctggattgctcgggctgtgtgcccgcgcgtggaacagtgtcagaatggcttccagcgggatgactcggagagatcctctggctaacaaagtagctctggtgactgccagcacggacgggattggtttcgcaatcgccagacgcctggctcaggacggcgcccatgtggtggtctcctcacggaagcaacagaacgtggaccaggccgtggcaactttacagggagaggggctgagtgtgacaggaaccgtctgtcatgttgggaaagctgaggatcgggagcgactggtggctaccctgtggatggacaaggagaaggaagagtcgatgaaggagactctcaggatcaggcgacttggagaacccgaagactgcgcagggatcgtgtcctttctctgcagcgaggacgcatcctacattacgggagaaacagtggtcgtgggcggcggcacaccaagtcggctttag

SEQ ID NO: 114295 - DNA, 579 bp, Artificial Sequence
  Description of Artificial Sequence: Synthetic coding sequence
atgcacaaagcaggactgctggggctctgcgctcgggcctggaactcagttcggatggcctcctccggcatgactcgccgagaccccttggccaataaagtcgccttagtgaccgcaagtacggatgggattggatttgccattgcccggaggttggctcaggacggggctcatgtggtggtctccagccgaaagcagcagaacgtggaccaagccgtcgctactctgcagggtgagggactatccgtgacggggacggtttgtcacgtaggcaaggctgaagaccgcgagaggttggttgccacggccgttaaacttcacggcgggatcgacatcctggtcagtaatgcagctgtgaatcctttcttcggtagcattatggacgtaactgaggaggtatgggataaactgtggatggataaagagaaagaagagtccatgaaggagacccttcgcatcagacgcctgggggagcccgaagactgcgcaggtattgtgtccttcctttgttccgaggatgcttcctatataacgggcgagacagtggtcgtagggggggggaccccttctagattatag

SEQ ID NO: 114296 - DNA, 681 bp, Artificial Sequence
  Description of Artificial Sequence: Synthetic coding sequence
atggcatccagcggcatgacgcggcgcgatccactggccaacaaggtcgccctggtcacggcctcgacagatggaattggcttcgcaatagcccggcggctcgcccaggacggggcccacgtggtagtatcgtcccggaagcagcagaatgttgaccaggccgttgcaacgctacagggggaagggctctccgtgaccggcaccgtgtgtcatgtgggaaaggccgaggacagagagcgactggtggccaccacccttgacattaatgtcaaggcacccgcactgatgacgaaagcagtcgttcccgaaatggagaagcggggtggcggatccgtggtgatcgtgtccagcatcgccgctttctccccgagccccggattctccccttataacgtgtcaaagacggccctcttaggtctcacaaagaccctagccatagagttagctccccggaatattcgcgtcaactgtcttgctcccgggctcatcaaaacctccttctccagaatgctctggatggacaaagagaaggaagagtcaatgaaagaaaccctgaggattagacggctgggggaaccagaggactgcgccgggattgtcagttttctgtgcagcgaagatgcctcctacatcaccggggagaccgtggtggtgggtggcggcacgccgagccggttatag

SEQ ID NO: 114297 - DNA, 567 bp, Artificial Sequence
  Description of Artificial Sequence: Synthetic coding sequence
atgcacaaagcaggcctacttggattgtgcgcgcgtgcatggaatagcgtccgaatggctagttctggaatgactagacgagatcccctggctaacaaggtggccctggtgaccgcatccactgatggtatcggctttgcgatagccagaaggctagcgcaggacggggcacatgtagtggtaagctcccgaaagcaacagaatgtggatcaagcagtagctacactgcagggcgaaggactctctgtaaccggcactgtttgccatgtgggaaaagccgaagaccgcgagcggttggttgctactgcggtgaagctacacggcggtatagatattttggtctctaacgctgccgtgaacccattttttgggagcataatggacgtgacagaggaggtttgggataaacgtaggctgtctggagatagggtatttcatagctcactgcagtctatctcatccctggacggccaaggcaaaaggggcaagcacgagagaaaccctgctgacaagaaggtgcgcagagctcgagggctctgctggcatagagtattccccgtgttgtag

SEQ ID NO: 114298 - DNA, 600 bp, Artificial Sequence
  Description of Artificial Sequence: Synthetic coding sequence
atgcacaaagcgggtctactgggcctgtgtgcacgcgcttggaactcagtacgaatggcttctagcggcatgacccggagagaccctttagccaacaaagtcgccctggtcactgcctcaaccgatggaatcgggttcgcaatcgctcggaggctggcccaggacggagcccatgtggtggttagttcgcgtaagcagcagaatgttgaccaggccgtggccacccttcagggggagggcctctccgtcacaggtactgtgtgtcacgtgggtaaagccgaagacagagagcgtcttgtcgctaccacactagatatcaacgtgaaagctcctgcgctgatgactaaggctgtcgtgccagagatggagaagcggggagggggctcagtcgtaatagtcagctctattgctgccttctcaccatcacccctgtggatggacaaggaaaaagaggagtccatgaaggagactcttcggattcggcgcctgggagagcccgaggactgcgctgggattgtcagctttttatgttcagaggatgccagctatattactggcgaaacagtggtcgtgggcgggggaacacccagccggctttag

SEQ ID NO: 114299 - DNA, 1374 bp, Artificial Sequence
  Description of Artificial Sequence: Synthetic coding sequence
atgcggtcagccgccgttctggccctgcttctctgtgctgggcaagtcacagccctgcccgtgaactcacctatgaataagggcgacacggaagttatgaagtgcatcgtggaggtaatcagtgataccttatccaaaccttctcctatgcccgtgagccaggaatgcttcgagaccctccgcggcgacgagaggatcctcagtatcctgcggcaccagaatctcttaaaggagctccaggacctggccctgcaaggcgccaaggaaagggcgcaccagcagaaaaagcactctggtttcgaagacgaactctctgaagtactggagaaccaatcctcgcaggctgagctgaaagaagccgtcgaggagcctagtagtaaggacgttatggaaaagagggaggacagcaaagaagcagagaagtccggagaagctacagatggggccaggccccaggctttgcccgagcctatgcaggaatcaaaggcagaaggcaacaaccaagctcccggagaggaagaggaggaggaagaggaggctacaaacacacacccacctgctagccttccaagccagaagtatcccggaccacaagccgaaggagacagcgagggtctctcacagggactcgtagaccgcgaaaagggattgtctgccgagccgggctggcaggctaagcgggaggaggaagaagaggaggaagaggaagctgaggctggagaggaggccgtgccagaagaagagggccctactgtggtattaaacccacacccatccctggggtataaagaaatccgcaagggggaatctcgatctgaggcactagccgtggatggcgccgggaagcctggggctgaggaggctcaggacccagagggcaagggcgagcaagaacacagtcagcagaaagaggaggaagaggagatggccgtcgtgcctcaaggcctgtttcggggaggcaagagcggcgagcttgaacaagaagaggagcgtctatcgaaggagtgggaggatagcaaaaggtggtctaaaatggaccagctggccaaagagttgaccgctgagaaacgacttgaggggcaggaggaagaggaagacaaccgagactccagcatgaagctgtcattccgagcccgcgcttatggatttagagggccaggacctcaactgcgccgcgggtggaggcccagcagccgggaggacagtctcgaggctgggttgcctcttcaggtgaggggatacccggaagagaagaaagaggaggaaggttctgcaaacaggagacctgaagatcaggagttggagagcctaagtgcgatagaggccgaattggagaaagtcgcacatcagctgcaagccttacgtagaggctag

SEQ ID NO: 114300 - DNA, 1128 bp, Artificial Sequence
  Description of Artificial Sequence: Synthetic coding sequence
atgaactgggagctgctgctttggctgctagttttgtgtgccctactgctgctcttggtccagctgctgcgcttcctccgcgccgatggggacctcacactcctttgggctgaatggcaaggccggcgaccagagtgggagctgacagacatggttgtgtgggtgacaggggcaagctccggcattggcgaagagctggcctaccagctgagcaaactcggtgtctccctggtgttgtccgccaggagagtccatgaactagagcgcgttaaaagaagatgcctggaaaacggaaacttaaaagagaaggacattctagtgctgccgctagacctgacagatacaggcagccacgaggcagccaccaaggccgtgctccaggagtttggacggatagatatccttgttaataatggcggcatgtctcagcgcagcctctgcatggatacatccttagatgtgtacagaaaactaatcgaacttaattatcttggcacggtctcactgaccaagtgcgtgttaccccatatgatcgaacgcaaacaggggaaaattgttacagtcaacagtatccttggcattatctcagtccccctgtcaatcggctactgcgccagcaagcatgctttgcggggcttctttaatggtttgagaaccgagctggctacatacccgggaatcatcgtcagcaatatctgtccggggcccgttcagtccaacattgtggagaactcccttgccggggaagtgaccaagacaattggcaacaacggcgatcagagtcataaaatgaccaccagtcggtgcgtgcgactgatgctaattagcatggccaatgatctgaaggaggtctggattagcgaacagccgttcctcctcgtgacatatctgtggcagtacatgccaacctgggcatggtggattaccaggtggggacgcaagggcctgagaaccctccgcgtcgtatggatgcagaccctgctcatcttgaaaagccttcgccaaaacatgacagagaagtctacttgtaccttccaggctactgggggccgcaatgggaaacatgagaacagtaatttgctaatgcttctgaataaccagcgtctgatttgtgatttcaccttttag

SEQ ID NO: 114301 - DNA, 870 bp, Artificial Sequence
  Description of Artificial Sequence: Synthetic coding sequence
atggtcgtgtgggtcactggagcttcttctgggattggggaggagttagcgtatcagctcagcaagttgggagtcagcctggtgttgtcagcaaggcgcgtgcacgaattagagcgagtgaagagaaggtgccttgagaacggaaatctgaaggaaaaagacatattggtgctcccattggacctcaccgacacgggaagccacgaggccgctaccaaggctgtcctgcaggaatttggaaggatcgacatcctggtgaacaatggtggtatgtctcagcgcagtttgtgcatggacaccagcctagatgtttacagaaaattaattgagctgaattatctgggtactgtctcgctgactaagtgcgtgctgccacatatgattgagcggaagcaggggaagatcgtcaccgtgaacagcatcctcggcataatcagtgtgcccctgtctataggctattgcgcgtcaaagcatgcgttgcgtggtttcttcaatgggctgagaacagaactcgccacatatccaggaatcattgtttccaatatatgtcccgggcccgttcagtctaacatcgtggagaacagcctcgctggagaggtgacgaagactatcgggaacaatggcgaccagtcccacaagatgactaccagccgctgtgtacggttgatgttgatctcgatggcaaacgatcttaaggaggtgtggatctccgaacagcccttcctgcttgttacatatttatggcagtatatgcccacatgggcgtggtggattaccaacaaaatgggaaagaaacgcatcgagaactttaagagcggcgtagacgctgacagttcgtactttaagatattcaagaccaagcacgattag

SEQ ID NO: 114302 - DNA, 1020 bp, Artificial Sequence
  Description of Artificial Sequence: Synthetic coding sequence
atgaactgggaactgctgttatggcttctggtgttgtgtgctctcctgttgctcttagtgcagctgctgcgattcctgcgtgcggatggtgacctgaccctcctttgggctgagtggcaaggacgcagaccagagtgggagctgacagacatggtggtatgggtgactggggcctcatccggcatcggagaagagcttgcctaccaactctctaagctgggggtcagcttggtattgtctgcccgcagagttcacgagttagagcgcgtcaagaggcgttgcctcgagaatgggaatctgaaagagaaagatatcctcgttctgccgctggaccttaccgacacagggtcccacgaagcagcaacaaaggcagtcttgcaagaattcgggagaattgacatcttagtgaataatggtgggatgagccagagatcactttgtatggacacctccttggacgtgtatcgtaaactgatcgagctgaattatctgggaacggtttccctgacaaagtgtgtgctgccccatatgatagagcggaagcagggcaaaattgttactgtcaatagcattctagggatcatctctgtacccctgtctatcgggtattgcgcttcaaaacacgccttgagaggcttcttcaatggactcaggacagaattggccacctatccagggatcatcgtgagtaatatctgtccaggtcccgtccaatctaacatcgtagagaactcgcttgccggtgaggtgaccaagaccattgggaataacggagatcagagccataaaatgactaccagccggtgcgtaagactgatgctgatttctatggcaaacgacctcaaggaggtttggatttccgagcagccattcctcctcgtgacatatctctggcagtatatgcctacatgggcatggtggatcactaataagatggggaagaaaagaatagagaattttaagagtggagtggatgcagactctagttattttaagatattcaagactaagcatgattag

SEQ ID NO: 114303 - DNA, 186 bp, Artificial Sequence
  Description of Artificial Sequence: Synthetic coding sequence
atgaattgggaactcctgttgtggttacttgtactctgtgcgttgctgctccttctggttcagctgctgcggttcctgagggccgatggagatctgacactgctctgggcagagtggcagggtaggagacctgagtgggagctgacagatatggtggtgtgggtcactggagcaagctccggatag

SEQ ID NO: 114304 - DNA, 960 bp, Artificial Sequence
  Description of Artificial Sequence: Synthetic coding sequence
atgctcttttgggtgctgggcttgttgatcctctgtggcttcctgtggacaagaaaaggaaagctcaagatcgaggatattacagataaatacatcttcatcacgggatgcgactcaggcttcggtaacctggccgcccgaacattcgataagaaagggtttcatgtgattgccgcctgtttaaccgaaagcggtagtacagctctgaaagctgaaacatcagagcgcctgcgcaccgtgctgttggatgtcacagaccccgagaatgttaaacgaacagcccagtgggtgaagaatcaggttggcgaaaagggcctatggggcctcatcaataatgccggcgtgccaggtgtactagcccctacagactggttgaccttggaagactaccgggagcctattgaggttaacctgtttgggctcatttccgtgaccctgaacatgctccccctggtgaaaaaggcccaaggacgggttattaacgtgtcttcagtcggcgggcgcctggccatcgtcggaggaggatatactcccagtaagtacgccgttgagggattcaatgacagcctgcggcgagacatgaaagcttttggtgttcatgtctcatgcatcgaaccaggcttatttaaaactaacctcgccgatccggtgaaagtgattgaaaaaaaattggcaatatgggagcagctttctcctgacatcaagcagcagtatggagagggatatatcgagaagtcgctggacaaactaaaaggaaacaagtcttatgtcaacatggatctttctcccgtggttgagtgcatggatcacgcacttacctctttgttcccaaagactcactacgccgcggggaaggacgccaagatattttggataccattgtcccacatgcctgccgccctgcaggactttctcctcctgaagcaaaaagccgaattagccaaccccaaagcagtgtag

SEQ ID NO: 114305 - DNA, 960 bp, Artificial Sequence
  Description of Artificial Sequence: Synthetic coding sequence
atgctgttctgggtactaggcttgttgatactctgtggcttcctttggacccgtaaaggtaagctaaaaatcgaagatattactgataagtacatttttatcaccgggtgtgactccggcttcgggaatcttgctgcgaggacatttgacaaaaagggcttccatgtgatcgctgcttgtctgaccgaaagcgggagtaccgctctgaaggctgaaacaagcgaaagactgagaactgtattgctcgatgtgaccgaccccgagaacgtaaagaggactgctcagtgggtcaaaaatcaggtgggggagaagggattgtggggtctcatcaataacgccggagtacctggagtcctggccccaactgattggttgaccttggaagactaccgtgaaccgatcgaagtgaacctatttggcctgatcagtgtcacgctcaatatgctgccgctagtgaaaaaggcccaagggagagtgatcaacgttagcagtgtcggcggccgcttagccattgtgggtggaggatatactcctagtaagtacgcggtcgagggattcaacgattcactccgcagagacatgaaagcctttggtgtgcatgtgagttgcatagagcccggcctgtttaagactaacctcgccgatcctgttaaagtcatcgaaaagaaattggccatctgggagcagctgagcccggacatcaagcagcagtacggtgagggttacatagaaaagagcttagataagctaaagggcaacaagtcgtacgtaaatatggacctatcccctgttgtcgaatgtatggatcacgctctgacctcactcttcccaaaaacacattatgcggccggcaaggatgcaaaaatcttttggatacccctcagccacatgcctgccgcgctgcaggacttcctgcttctgaaacagaaagcagaactcgctaacccaaaagccgtctag

SEQ ID NO: 114306 - DNA, 960 bp, Artificial Sequence
  Description of Artificial Sequence: Synthetic coding sequence
atgctgttttgggtccttggactattgattttatgcggcttcctttggacgagaaaagggaagctcaagatcgaggatatcacagacaaatatatcttcatcactggatgtgattcaggcttcggtaacctggccgcccgcactttcgataaaaagggcttccacgtgatcgctgcatgcctcaccgagagcggcagcacagcgttaaaggctgaaacctctgagcgactgcgaactgtcctgctggatgtcaccgaccccgaaaacgtcaaaagaaccgcccaatgggtcaaaaaccaggtaggagagaaaggcctatgggggttgatcaacaacgctggcgttcccggggtgctggccccaacagattggctgaccctcgaagattaccgcgaaccaattgaggtaaatctatttgggctcatcagtgtcactcttaacatgctgccactcgtgaagaaggcccaggggagggtgataaacgtcagtagcgtcgggggaaggcttgccattgtcggcggaggctatacacctagcaagtacgcagttgagggcttcaatgattcactgaggcgggacatgaaagcctttggcgtgcatgtctcttgcattgagccagggctttttaagactaaccttgcagatccagtcaaggtcattgagaagaagctggctatctgggagcaattaagccctgacattaagcaacagtacggtgagggatacattgagaagagcctggacaaacttaaagggaacaaaagctacgtgaatatggatctttcgcctgtagtggagtgtatggatcatgcactaaccagcctcttccctaaaactcattatgctgctgggaaagatgccaagatcttctggattccgctttctcatatgcccgctgcattacaggactttctgttgctaaaacagaaggccgagcttgctaaccccaaggccgtgtag

SEQ ID NO: 114307 - DNA, 519 bp, Artificial Sequence
  Description of Artificial Sequence: Synthetic coding sequence
atgttgcccctggttaagaaggcccaaggtcgtgtgatcaatgtaagctccgtggggggaagactggctatcgtcgggggcggatacacaccgagcaaatatgccgtggaaggttttaacgactctctacggagagacatgaaggccttcggggttcacgtgtcttgtatcgaaccaggactctttaaaactaaccttgcagatccagtgaaggtgatcgaaaagaagctggctatctgggagcagttatctcccgacatcaaacaacagtacggagagggttacatagaaaagtctctggacaaactgaaagggaacaagagctatgttaacatggaccttagccctgtagtcgaatgtatggatcatgccttgacttccctcttcccgaaaactcactatgccgcagggaaagacgcgaaaatcttctggatacctctttcacacatgcctgcagctctacaggactttcttctactcaagcaaaaggccgagctcgccaatcctaaggccgtgtag

SEQ ID NO: 114308 - DNA, 960 bp, Artificial Sequence
  Description of Artificial Sequence: Synthetic coding sequence
atgttgttttgggtgctgggactgttaattctatgcggctttctatggactcggaagggaaaattaaaaatagaagacataacagacaagtacatattcattaccggctgtgactctggtttcggaaacttggcagcccgtacattcgataaaaagggcttccacgtgatcgctgcatgcctcacagaatctggcagtactgcactgaaagccgagacttcagagcggctgaggacagtgcttctcgacgtaacagatcccgagaatgtgaagcgcaccgcccagtgggtcaagaatcaggtcggcgagaaggggctgtggggcctgattaacaatgctggcgtgccgggcgttctggctcctacggactggcttactctggaagactatagggaacccattgaagtgaacctgttcggtctcatctctgtgactctcaacatgctgccactggtgaagaaggctcagggcagggtgatcaacgtgtctagcgtcggtggccgtctcgcaatcgttggcggcgggtatacaccttctaaatacgctgtcgaaggattcaacgatagcttgcgccgggacatgaaagcctttggggtgcacgtgtcctgtatcgagccaggactgtttaaaaccaatctggcagacccggttaaggttattgagaagaagctggccatttgggaacagctctctcccgacataaaacagcagtatggagaaggctacattgaaaagagcctggataaattaaagggaaacaagagctatgtgaacatggatctgtctcctgttgtcgagtgcatggaccacgccctgacatctctctttccaaagacacactacgctgccggcaaagatgcaaaaattttctggatacctctcagtcacatgcctgctgctttgcaggacttcttactgttgaaacagaaggctgaactcgcaaacccaaaggccgtgtag

SEQ ID NO: 114309 - DNA, 1140 bp, Artificial Sequence
  Description of Artificial Sequence: Synthetic coding sequence
atgccagaaggacgctcacactgcgcctgttctattaccagtctcacactcctggtcagcctcacccgcgtgacactggatatcctgcagaaattggatcctcctcagcctgctcattggcgacaccacctgctggtactgtacaagaaaggggtctacctgagtcatactggaggaaagatgctattttgggtgctgggtctactcatcctctgcggattcttgtggacccgtaaaggaaagctgaagattgaggacattacagacaaatacatattcatcacaggatgcgatagtgggtttgggaacctggcagccagaacctttgataaaaaaggatttcacgtcatcgccgcctgcctcactgagtctggcagcaccgctctgaaagccgagacctctgaacgcctcagaaccgttctcctggacgtaactgaccccgaaaatgtcaagaggacggcccagtgggttaagaatcaggtaggagagaagggcttatggggcctaattaacaacgccggtgtcccaggcgtgctggcccccacagactggctaacactggaagactatagggaacccatcgaggtcaacctgtttggcttgatttctgttaccctgaatatgctcccactggtcaagaaagcccaggggagggttataaacgtgagttccgtgggaggcagactagcaattgtgggagggggctatacaccttccaagtatgccgtggaggggttcaacgactctctgcggcgggatatgaaggcttttggggtccacgttagttgcattgagccagggctgttcaaaacaaacttggctgatcctgttaaagtgatcgagaagaagctcgctatttgggagcagctgtctcccgatatcaagcagcagtatggagaaggctacattgagaaatctctcgacaaattgaagggcaacaaatcatatgtcaatatggatttgagtcctgttgtggagtgtatggatcacgctctgacaagcctttttccaaagactcactacgctgctggtaaggacgcgaagatcttttggatcccactgtcgcacatgcctgcagcccttcaggattttctgctccttaagcagaaagccgaactggccaatcctaaagccgtttag

SEQ ID NO: 114310 - DNA, 960 bp, Artificial Sequence
  Description of Artificial Sequence: Synthetic coding sequence
atgctgttttgggtgctgggacttctgatcctctgtggctttctctggacccggaagggcaagctgaagatcgaggatatcacagacaagtatatatttatcaccgggtgcgactctggctttggaaatctggcagcccggactttcgacaagaaggggttccatgtgattgccgcatgcctaaccgagagcggatctacagccctgaaagctgaaacctccgaacggttgcgcaccgtgctgctggacgtaaccgatcctgagaacgtcaagagaaccgcacagtgggttaagaaccaagtaggagagaaaggtctctggggactgatcaataatgccggcgtgcctggggtcctagctcctaccgattggctgaccttggaagattatagagagccaatagaagtgaatttgttcggattgataagcgttacactgaatatgctcccgctcgtgaagaaagcccaggggagagtcattaacgtgagctccgtggggggacggcttgcaatcgtgggaggaggctatactccttccaagtatgccgtggagggatttaacgactcgcttagaagggacatgaaagccttcggcgtccacgtgtcgtgcattgagcccgggctgtttaaaactaatctggccgatcctgtcaaagtaattgagaagaagctggctatatgggaacagttgtcccctgacattaagcagcaatacggcgagggttatatcgagaagtctctggataaactcaaaggcaacaagagctacgtgaacatggatctcagtcctgtcgtcgagtgtatggaccacgcgcttacctccctcttccctaagacccactacgccgccggtaaggacgccaagattttctggatacccctgtctcacatgcccgccgccttgcaggattttctgctgctgaagcagaaggctgagctcgctaaccctaaagcagtctag

SEQ ID NO: 114311 - DNA, 201 bp, Artificial Sequence
  Description of Artificial Sequence: Synthetic coding sequence
atgctgttctgggtgttgggactgctcatcctttgtggcttcttgtggactagaaaaggcaaacttaagatcgaggatataacagataaatacattttcattaccggatgtgattccggctttggaaatctcgccgcgcggactttcgataagaaaggtttccatgtgattgccgcttgcctgacggagagtggatcttag

SEQ ID NO: 114312 - DNA, 486 bp, Artificial Sequence
  Description of Artificial Sequence: Synthetic coding sequence
  Description of Combined DNA/RNA Molecule: Synthetic coding sequence
atgggattgccacaacctgggctctggctgaaacgactttgggttctcctggaagtggccgtgcacgtggttgtagggaaggttctcctgatcttatttcctgaccgtgtcaaaagaaacattttggcgatgggcgaaaagacaggcatgacccgcaatccccacttttcacacgacaactggatcccgactttcttttccacacaatatttctggtttgtccttaaagtgcggtggcagcgtctggaggacacaaccgagctcggtgggttggctcctaattgccctgtggtcagactaagtggccaaaggtgcaacatttgggagtttatgcagggcaatcgtccgctggtacttaattttgggtcctgcaccugaccttcattcatgttcaaattcgatcagttcaaacgcctgatcgaagacttttcttctattgccgactttctggtgatatatatcgaagaggcccatgccagcggctag

SEQ ID NO: 114313 - DNA, 750 bp, Artificial Sequence
  Description of Artificial Sequence: Synthetic coding sequence
  Description of Combined DNA/RNA Molecule: Synthetic coding sequence
atgggcctgccacagcctggactgtggctcaaacggctatgggtgctcctggaagtggcagtgcatgtagtagtaggaaaagtcctattgatcttattcccagaccgcgttaagcggaacatcctggctatgggcgagaagaccgggatgacccgaaatccacacttcagccacgacaactggatcccaacttttttctccacgcagtatttttggtttgtgttaaaggttcggtggcaaaggctcgaagacaccaccgaattgggggggctggcccctaattgcccagtggtccggttgagcggccagcggtgtaacatttgggaattcatgcagggcaaccgcccgctggtcttaaacttcgggtcttgcacaugaccgtcattcatgttcaagttcgaccaatttaaaagattaattgaagatttctccagcatcgcagacttcctggttatctatatcgaagaggcacatgcgtctgacggctgggcttttaaaaacaacatggatatccgaaatcatcaaaacctccaggatcgcctgcaggcagcccaccttctcctggcccgctcccctcagtgtcccgttgtggtggacactatgcagaaccagtccagccagctctacgccgcccttcctgagaggctatatattattcaagaagggcgcattctctataagggaaaatcaggtccctggaattacaaccccgaagaggtgagagcagtgctggagaagctacacagctag

SEQ ID NO: 114314 - DNA, 606 bp, Artificial Sequence
  Description of Artificial Sequence: Synthetic coding sequence
atggggctcccccaaccagggctgtggctgaagcgactttgggtgcttctcgaggtcgctgtgcacgtcgtggtcggtaaagtgctgttgattctgttcccagacagagtgaagagaaatattttggcgatgggggagaaaacgggtatgacccgcaatccccattttagccacgacaactggatcccaactttcttcagcactcaatacttttggtttgtgttgaaagttagatggcagcgattggaggatacaacagaactgggcggcctcgcccccaactgccccgtagttcgtctcagcggacagcgatgcaacatctgggaattcatgcaagatggctgggccttcaaaaacaacatggacattaggaaccaccagaacctgcaggatagactgcaggccgcacacctgctgctcgcccgatcacctcaatgccctgtcgtggtggacacgatgcagaaccagtcatcacagctctatgctgccctgccggaacgactttatatcatacaggaaggtcgtatactgtacaaagggaaatcaggcccttggaactataacccagaagaggtcagagctgtgctggagaagctccactcatag

SEQ ID NO: 114315 - DNA, 363 bp, Artificial Sequence
  Description of Artificial Sequence: Synthetic coding sequence
atgttcaaattcgaccagttcaagagactgatcgaggattttagctctatcgctgactttctcgtcatctatatcgaagaggcccacgcctcggacggctgggctttcaagaacaatatggatattcgaaatcatcagaacctgcaagatcgcctacaagccgcgcatctattacttgcacgaagtccccaatgtccagtggtggtggacactatgcagaatcagagctcacaattgtatgccgcattgcccgaacgcttatacatcatacaggagggccgcattctgtacaagggaaaaagtggcccttggaactacaaccctgaggaagtgagggctgtgctcgagaaactgcactcctag

SEQ ID NO: 114316 - DNA, 558 bp, Artificial Sequence
  Description of Artificial Sequence: Synthetic coding sequence
  Description of Combined DNA/RNA Molecule: Synthetic coding sequence
atggggttgccgcaacctgggttgtggctgaaacgactgtgggtgctgctggaggttgctgtccacgtagttgtgggcaaggtgcttctgatcttgtttcctgatagggtgaagagaaatattctcgcaatgggagagaagaccggcaacaggccattggtcttaaattttgggtcatgcactugaccttcgttcatgttcaagttcgatcagttcaaaagactgatcgaggatttcagttcaatagctgatttcctcgtgatctatatcgaagaggcccacgcgtctgacggttgggcctttaaaaacaacatggatatccggaatcatcaaaacctccaggaccggctgcaggctgcccaccttctactggcccgcagtccccaatgtcccgtcgtggtggacaccatgcaaaatcagtcctcccagctgtacgccgcattgcctgaacgtctgtatatcattcaggaaggccgcattctgtacaagggcaaaagcggcccatggaactacaaccccgaagaagtccgggcggtattggagaagcttcactcgtag

SEQ ID NO: 114317 - DNA, 342 bp, Artificial Sequence
  Description of Artificial Sequence: Synthetic coding sequence
atgggcttaccacagcccggattgtggctgaagcgcctatgggtacttttggaagtggccgtgcatgtcgtggtaggcaaggtgctgttgatcctgttccccgatcgcgtgaaaagaaacattcttgctatgggggaaaaaacgggtatgacgcgtaatcctcatttttcacacgacaattggatcccgaccttcttcagcacacagtacttctggttcgtgctgaaagtccgttggcagcgactggaggacactaccgaactgggcgggctggcacccaactgtcctgtggtgaggctctctggacagcggtgcaatatttgggagttcatgcaaggctag

SEQ ID NO: 114318 - DNA, 270 bp, Artificial Sequence
  Description of Artificial Sequence: Synthetic coding sequence
atggggatcctgtctgtggaccttcttataacactccagatacttcctgtgtttttttctaactgcctatttcttgcgctgtacgactctgtgatcctgctgaaacacgtggtccttctgctgtcgcgatcaaaaagcacgaggggtgaatggcgcaggatgcttacctcggaaggcctgcgctgtgtgtggaaatcctttttactggatgcctataagcagctgaactgtccgccttcgggtttctccaaggatggccatatactgtag

SEQ ID NO: 114319 - DNA, 399 bp, Artificial Sequence
  Description of Artificial Sequence: Synthetic coding sequence
atgggcatcctgagtgtagacctgctcatcactctacaaatcctgcccgtttttttctcaaactgtctctttctcgcactgtacgattccgttattcttctcaaacacgtcgttcttctcctcagcagatcgaaaagcacgaggggagaatggcgccggatgctcacctcagaagggttaaggtgcgtttggaagtcctttcttctcgatgcgtataaacaggtgaaactcggtgaggatgcccccaacagcagcgtggtccatgtgagttctacagaaggcggggacaactctggcaacgggacccaggagaaaatcgccgaaggagctacatgtcacctcctcgattttgcctctccagaacgacccctggttgtgaattttgggtccgccacgtag

SEQ ID NO: 114320 - DNA, 822 bp, Artificial Sequence
  Description of Artificial Sequence: Synthetic coding sequence
  Description of Combined DNA/RNA Molecule: Synthetic coding sequence
atgggcattctttccgtcgatctgcttatcacactgcagatcctgccagtgtttttctcaaactgcctctttttagctctctatgactcagtgattctcctcaagcacgtcgttcttttgctgtccaggtccaaatccacaagaggagaatggcgcaggatgctaacgtctgaagggctcagatgcgtctggaagtcattcctccttgatgcatacaagcaggtcaagctcggagaggacgcccctaactcttccgtagttcacgtcagctcaacggagggcggtgataactctgggaatggaacgcaggagaagatcgcagagggcgcaacgtgccatctgttggatttcgcttctcccgaacggccattggtggtgaacttcggcagtgcgacaugacccccattcacctctcaactgcctgcgttccgaaaactcgttgaagagttctctagtgtagcagatttcttattggtgtatattgacgaggcgcatccatctgacgggtgggccatcccgggagacagttccctgtcctttgaagtgaaaaagcaccaaaaccaagaggaccggtgcgccgccgcacagcagctgctggaacgtttttctctccctccgcagtgccgcgtcgtggctgatcggatggacaacaatgccaacatagcctatggcgtggctttcgagagggtttgcattgtccagcggcaaaagatcgcttacttagggggcaaagggcccttttcctacaacctgcaggaagtacggcattggctggagaaaaatttttcaaagaggugaaagaaaacacggctggctggttag

SEQ ID NO: 114321 - DNA, 21 bp, Artificial Sequence
  Description of Artificial Sequence: Synthetic coding sequence
atgggcatcctgtcagtgtag

SEQ ID NO: 114322 - DNA, 21 bp, Artificial Sequence
  Description of Artificial Sequence: Synthetic coding sequence
atggggatccttagcgtgtag

SEQ ID NO: 114323 - DNA, 168 bp, Artificial Sequence
  Description of Artificial Sequence: Synthetic coding sequence
atggggatcttatcagtggatctactgattaccttgcagatcctccctgtgttttttagcaattgccttttcttggctttgtacgactcagtcattcttcttaaacatgtcgtgctgctattgtcccgatccaagagtaccagaggcgagtggaggaggatgctttag

SEQ ID NO: 114324 - DNA, 930 bp, Artificial Sequence
  Description of Artificial Sequence: Synthetic coding sequence
  Description of Combined DNA/RNA Molecule: Synthetic coding sequence
atgggaattctgtcagtagatctgttaattacactgcaaatcttaccagtgtttttttctaattgtttgttcctggccctttatgatagcgtaattctgctgaaacatgttgtgctgttactcagcagatccaagagcacaaggggggaatggcggcgaatgctgaccagcgagggcctccgatgcgtgtggaagtcctttctactggatgcatacaaacaattaaactgcccaccctcaggattttcaaaagacgggcacatcctaugactggtttatgaggcttataagagcagactcctggtgtactcacacttggacctgtggatggttaaactcggcgaggacgctccgaacagctcggtggtgcatgtgtcatccaccgagggcggggataatagtggtaacggaactcaagaaaaaatagccgagggtgctacatgccacctgctggattttgcaagtcctgagcgcccccttgttgtgaacttcggatcagcgaccugacccccctttactagtcagctaccagctttccgtaagctggtagaagaattctcctccgtggcagatttcctgcttgtgtacatcgatgaggcccatccgagtgacggttgggcaattccaggagacagcagcctgtccttcgaagtaaagaagcatcaaaaccaagaggatcggtgtgcagctgcccagcaactgcttgagcgattctcactgccgccccagtgcagggtggtagccgaccgcatggacaacaacgcgaacattgcctatggcgtggcttttgagagggtgtgtatagtgcagagacaaaagatagcatacctgggcggaaaaggtccattttcttacaacctccaggaggtgagacactggctcgaaaagaatttttccaaacggugaaagaaaaccaggttggcggggtag

SEQ ID NO: 114325 - DNA, 822 bp, Artificial Sequence
  Description of Artificial Sequence: Synthetic coding sequence
  Description of Combined DNA/RNA Molecule: Synthetic coding sequence
atgggtatcctgtctgttgatcttctgatcacattgcagatactgccagtgttcttttcaaattgtttgtttctggctttatacgacagtgtaatcctactgaagcacgtggtgctcctgttatcccgctctaaatcgacaaggggcgaatggcgcagaatgctgacctccgaaggcctgcgttgtgtttggaagtcatttctgctggatgcttacaaacaggtgaagctgggggaggatgcgcctaactcttctgtggtccacgtatcatccacagaaggtggcgataatagcggaaacggcacacaggaaaaaatcgccgagggtgccacctgtcacctgctagacttcgcatcccccgaaaggccactggtcgttaacttcgggtcggctactugaccaccctttacaagtcagctgcccgcgttccggaaactggtggaagaattcagctcagttgcagacttcctgctggtctacatcgacgaagcacatccctcagatggatgggctattccgggagactcatctctgtcctttgaggtcaagaaacaccagaaccaggaggacagatgtgccgctgcccagcaactgcttgagcgattctcacttccaccccaatgtagagtagttgcagatagaatggacaataatgctaacatcgcctacggagtggcgtttgaaagagtgtgtattgtacagcgacaaaagatagcatacctcggaggcaagggccccttttcttataaccttcaggaggtgagacactggctggaaaagaactttagcaagcggugaaaaaagacacgccttgcaggctag

SEQ ID NO: 114326 - DNA, 915 bp, Artificial Sequence
  Description of Artificial Sequence: Synthetic coding sequence
  Description of Combined DNA/RNA Molecule: Synthetic coding sequence
atgcctcgccaggcgacctctcggctggtcgtgggcgagggcgaaggtagccagggagcctctggaccggccgctactatgctgcgctccctgcttcttcattcactccggttgtgtgcccagactgcgtcctgtctcgttttgttcccccggtttcttggaaccgcgtttatgctctggctcctggattttttgtgcattcgaaagcactttcttggccggcgccggcggggacagcctgagccagaggtggaactgaatagcgagggcgaagaggtcccacccgatgacccccccatttgtgttagtgatgacaatcgcctgtgtactctggctagcctcaaggctgtgtggcatgggcagaagcttgacttctttaaacaagcccacgaagggggacctgcccccaacagtgaggtggtcttgcctgacggtttccaaagccagcatatccttgactacgcccaaggcaatcgccccctggttttgaatttcggctcttgcactugacccccgttcatggccaggatgtcagcattccagcgcctcgtaacaaagtatcaaagggatgtggacttcttgatcatttatatcgaagaggcccatccaagcgatggatgggtgacaactgattcaccatacatcatcccacagcatagatcattagaggacagagtttccgctgccagggtgctgcaacagggtgctccggggtgtgccctcgtattagacaccatggccaattcctcgtcctccgcatacggcgcttatttcgagcgactctacgtcatacagagcgggactattatgtatcagggcgggagggggccagatggatatcaggtgtctgagctcagaacctggctggaacgttatgatgagcagttgcacggggcccggcctcgaagggtttag

SEQ ID NO: 114327 - DNA, 1026 bp, Artificial Sequence
  Description of Artificial Sequence: Synthetic coding sequence
atgtccgcctctgctccggcagccgaaggggaggggactcctacacaaccggcttccgagaaggaaccagagatgccaggtccacgggaagaatctgaggaggaggaggacgaggatgacgaggaggaggaggaagaagagaagggtaaaggtcaaaaactttgcgagattgagcggattcatttcttcctgtcaaaaaagaagactgatgagttgcggaacctgcataaactactgtataataggcctggcacagtgtcatcactgaagaaaaatgtgggtcagttcagcggattccccttcgagaaggggtctgtgcagtacaagaaaaaagaggaaatgctgaagaagttcagaaacgcaatgctgaagagcatctgcgaagtcctggacctggagcgctcaggtgtcaattcagagctcgttaagcgtatactgaactttctgatgcatcctaagccgtctgggaaacctctgcccaaaagcaaaaaaacatgcagtaagggatctaaaaaggagaggaactctagcgggatggctaggaaggctaagaggacgaaatgtccagagattctttcagacgagtcgtcctcagatgaggatgaaaagaaaaacaaagaggagagttcggatgatgaagataaagaatccgaagaggagccgcccaaaaagactgctaaaagagagaagcctaagcagaaggcgacatctaagtcaaagaagtcggtgaagtctgccaatgtcaaaaaagctgactccagcactacgaagaagaaccagaattcaagcaaaaaggaatctgaaagcgaagacagtagtgacgatgagccactgataaagaaactgaaaaaaccacccacagatgaggaattaaaggagaccatcaagaaactgctggcatcggccaacctggaggaagttacaatgaagcagatttgtaaaaaagtttacgaaaattaccctacctacgacctaaccgagcgcaaggactttatcaaaaccaccgtcaaagagctgatttcttag

SEQ ID NO: 114328 - DNA, 1128 bp, Artificial Sequence
  Description of Artificial Sequence: Synthetic coding sequence
atgagcgcttctgcccccgcagccgagggcgaggggacacctacccagcctgcttcagagaaggagcccgagatgcccgggcctagggaagaaagtgaggaggaagaagatgaggacgatgaagaagaggaggaggaggagaaagaaaagagtctgatcgtggagggcaagcgggaaaagaaaaaggtggagcgtttaactatgcaggtatcctctctgcaaagagagccctttactatcgcacagggaaaggggcaaaagttgtgtgagattgagaggatccacttcttcctttcgaaaaagaaaacagacgaactgagaaacctccacaagctgctgtacaatcgtcccggcactgttagttcactaaaaaagaacgtgggacaatttagtgggtttccctttgaaaagggctctgtccaatataaaaaaaaggaagagatgctaaaaaagttccgaaacgcaatgttgaagtcaatttgtgaggttttggacctggagaggagcggggtcaacagcgaactcgttaagcgaatcctgaacttcctgatgcacccaaagccatccggaaagccactgcccaagtcaaagaagacctgtagcaagggcagtaaaaaagagcggaatagcagcgggatggctcggaaagctaagcgaactaagtgtcccgagatcctgtcagacgagtcatcatccgacgaggatgagaagaagaataaggaggaaagtagcgacgatgaagacaaggaaagtgaggaggagccccctaaaaaaacggccaagcgcgaaaaaccaaaacagaaagccacctccaaatctaagaagagcgtgaagagcgccaacgttaagaaggccgattcctccaccacaaagaagaaccaaaacagttctaaaaaggagagcgagtccgaggattctagcgacgatgaacccctgataaagaaactcaagaagcctcccacagacgaggaactgaaagagacaattaagaaactgctggcttcagcgaacctcgaggaagtgacgatgaaacagatctgcaagaaagtgtacgagaattacccaacatacgacctaaccgagcggaaggactttataaagacaacagtcaaggaactgatctcttag

SEQ ID NO: 114329 - DNA, 1101 bp, Artificial Sequence
  Description of Artificial Sequence: Synthetic coding sequence
atgtcagccgctaatccagaaacccccaacagcaccatctcccgggaagccagcacgcagagcagtagcgcagccgcttcccagggttgggttctgccagaaggtaagattgttccgaataccgtgttcgtcggaggaatcgatgctcggatggatgaaacagaaattggaagctgcttcggcaggtatggttctgtgaaagaggtgaaaatcattacgaatagaacaggcgtgtcgaaggggtacggcttcgttagctttgtcaatgacgtcgatgtgcagaaaatagtgggaagtcagatccatttccacggcaagaaactgaaacttggcccagccatacgtaagcagaagctgtgtgcccgtcacgtccaacccagaccattagtggtcaatcctccaccgccgccacaattccagaacgtttggagaaacccaaatacggagacatacctgcagccacagatcactccgaatccagtgacacaacacgtccaggcatactctgcttacccacactcacccggacaggtgattacaggctgccaactgctggtatataattatcaagaataccctacctaccctgactctgcctttcaggtgactactggataccagctccctgtgtacaactatcagccatttcctgcttacccgtcaagccctttccaagttaccgccgggtaccaacttcctgtttacaactaccaggcattccccgcttaccctagctcaccttttcaagtcaccacgggataccagcttccagtatacaattaccaggctttccctgcatacccatcatcaccctttcaggtgaccactggctatcagctgcctgtgtataattatcaggcttttccagcatatcccagctctcccttccaagttaccaccgggtatcaattgcctgtatataactatcaggcttttcccgcttaccctaactccgccgtgcaggttaccaccggctatcaattccacgtgtacaactaccagatgcccccacagtgccctgtcggcgaacagcggcgcaacctttggacagaggcctataagtggtggtatctggtctgtttaatccagcgacgtgattag

SEQ ID NO: 114330 - DNA, 1605 bp, Artificial Sequence
  Description of Artificial Sequence: Synthetic coding sequence
atgtcagccgcgaatcctgagacacccaattcaacgattagcagagaggcaagcacacagagtagctccgccgctgcttcccagggctgggtcctgcccgaggggaagattgtccccaacaccgttttcgtgggcggcattgacgctagaatggacgagactgagattggctcttgttttggccgctatgggagcgttaaggaggtgaagatcataaccaatcggactggcgtcagtaaaggctatgggttcgtgagcttcgtcaatgacgttgatgtgcagaaaattgtgggctctcagatccacttccacggtaagaagctaaagcttgggccagcaatacgcaagcagaaactctgtgcacgccacgtgcagccaaggcctctcgtggtgaatcctcccccaccaccacagtttcagaatgtgtggagaaatcctaataccgagacctatttgcagccgcagatcacaccaaacccagtaacccaacatgtgcaggcttactctgcctatccccacagtcccgggcaggtcatcactgggtgtcaactccttgtgtacaattatcaggagtaccctacatacccggattccgccttccaggtgacaactgggtaccagctcccagtgtataactatcagccgtttccagcctatccaaggagcccctttcaggtcaccgccgggtaccaattgcccgtgtacaattatcaggcattcccagcctatcctaattctcctttccaagtggccaccggctatcaattccctgtgtacaattaccagcctttccccgcctacccctctagcccatttcaagttacggccggctaccagcttccagtctataattatcaagccttcccagcctatccaaacagcccttttcaagtggcaaccgggtaccaatttccagtctataactatcaggcttttcctgcatatcctaattcaccagtgcaggtgacaacaggctatcaacttcctgtttataactaccaagcttttccagcatatcctagtagcccatttcaggtaacgacaggataccagctgcccgtctataattaccaagccttcccggcctaccccagcagcccctttcaggtgaccaccgggtatcagctgcctgtttataactatcaggcgtttcccgcttacccaagttctccatttcaggttactacaggctatcagctgcccgtgtataactaccaggcttttccggcctatccaagctcaccttttcaggtgaccaccggatatcagttgcccgtgtacaactatcaagcctttcctgcttacccgtcttctccattccaggtgacaaccggctatcagctcccagtgtacaactatcaggctttcccggcttacccctcttcgcctttccaggtgacaacaggatatcagctacccgtctataattatcaagcttttcccgcctatcccaacagtgctgtacaggtgacgactggctatcagttccacgtatacaattatcaaatgccgcctcagtgccctgtgggcgagcagaggcggaatctgtggaccgaggcctacaagtggtggtacctggtgtgtctgatacaaaggcgagattag

SEQ ID NO: 114331 - DNA, 1821 bp, Artificial Sequence
  Description of Artificial Sequence: Synthetic coding sequence
atgtctgccgccaatccagaaacacctaattctacaattagtcgcgaggcttcgactcaaagttcttctgccgctgcgagccagggttgggtgctccctgaaggcaaaattgtccctaatacggtgttcgtaggaggaatcgacgcccgcatggacgagacggagatcggctcatgctttggtcgatacggttcagtgaaggaggtaaagatcataaccaaccggaccggtgtttccaaaggctatgggtttgtgtccttcgtcaacgacgtggatgtgcagaagatcgtgggatcccagatccatttccatggtaagaagctgaaactaggtcctgcaatccggaaacagaagttatgcgcaagacatgtgcaacctcggccacttgtagtcaacccacctcccccaccacagttccaaaatgtttggaggaatccaaacacggaaacctacctgcagccccaaatcacaccaaaccctgtaacccagcacgtgcaggcctacagcgcctatcctcactcccccggacaggtgatcacgggatgccagttgctcgtctataattaccaggagtacccgacatatcctgactctgcttttcaagtgactactggctaccagcttccggtatataactaccagccctttccggcatacccccgctcaccctttcaggttactgccggctatcagcttcctgtttacaactatcaggcctttcctgcttaccccaactcgccgtttcaggtcgctactggataccaattccctgtgtataactaccagccatttccagcttacccaagctctccttttcaggtcactgctggatatcagctccctgtttacaactaccaggcttttccggcgtaccccaactcccccttccaagtcgccaccgggtatcaattcccggtttacaactaccaaccgttccccgcctatcctagtagccctttccaggttacagccggctaccagctgcctgtgtataattaccaggcgttccccgcctaccctaacagcccttttcaagttgctactggatatcagtttcctgtgtataattatcaggcattccctgcttatcctaactctcctgtgcaggttactactggataccagcttccagtctacaattaccaagcctttcccgcctaccccaatagtcctgtacaggtgaccacaggatatcagctccccgtctataactatcaggcttttcccgcttacccaagctcaccattccaggtgactaccgggtatcagcttccagtgtacaactaccaggcatttccagcctatcccagcagtccattccaagtaacaacgggctatcagctgcccgtctacaattatcaggcttttcccgcctatccttcatcaccttttcaggttacaactggttatcagctccccgtttataactaccaggctttcccagcatacccttcttcgcctttccaggtaacaacaggttaccaattgcctgtgtacaattaccaagcatttccggcttacccgagttcacctttccaggtgaccaccggataccagctcccagtgtacaactaccaagcctttcctgcctatcccagctctccctttcaagtgaccacggggtatcagctaccagtctacaattaccaggcatttccagcttaccccaacagcgccgtgcaggtgacaacgggttatcagttccatgtttataactaccaaatgccaccacagtgtcctgtcggggagcaacggcgcaacctttggaccgaagcttataagtggtggtacctcgtttgcctcatccagcgccgagactag

SEQ ID NO: 114332 - DNA, 1461 bp, Artificial Sequence
  Description of Artificial Sequence: Synthetic coding sequence
atgagcgccgccaatcctgaaacacctaattctacaattagtcgggaggcctccacccagtcctcgagcgccgcagctagccaaggttgggtgctgcctgagggcaaaattgtgcctaacaccgtattcgtgggtggcatagacgctaggatggatgaaacagagataggcagttgctttggcagatacgggtctgttaaagaagtaaagattataactaatcgcaccggcgtcagcaagggctatgggttcgtgagcttcgtgaatgacgtagacgtgcaaaagattgtcgggtcccaaatccactttcatggaaagaaacttaagcttgggcccgctatacggaagcagaaactgtgtgccaggcacgtgcaaccacggccccttgtggtaaatcctccccctcccccgcagtttcagaacgtgtggaggaacccgaataccgaaacgtacttacagccacagatcacaccgaacccagttactcagcacgtgcaagcttactccgcttaccctcactcaccaggacaagtgataaccggctgccagcttcttgtgtacaactatcaggagtaccccacgtacccagacagcgctttccaggtgactaccgggtatcagttaccagtctataactaccagcccttccctgcctaccctaggtccccttttcaagtgactgcaggctaccagttgccagtttacaactaccaggccttccctgcataccctaatagccccttccaggttgccactgggtatcagttcccggtctataactatcagccttttcctgcgtacccgtcttcaccattccaagtgactgcgggctaccagctgcccgtttacaactatcaagcgtttccggcctaccctaactctcccttccaagtggccacaggatatcagttccccgtgtacaattatcagcccttcccggcctatccatccagtccctttcaggtgacagccggctatcaacttccagtctataactaccaagccttccctgcctatcccaacagcccctttcaagtcgctacaggctaccagtttcccgtatacaattatcaggccttcccagcctaccctaattcaccagttcaggtgaccaccggatatcagctgcccgtatataactaccaggccttccccgcctaccccaattccccctttcaggttgccactggttaccagttccctgtgtataattatcaggctttcccagcctacccgaacagcccagtacaagttactactgggtaccagctccctgtttacaactatcaggctttccccgcttaccccaacagtgccgtacaggtgactaccggctaccagtttcacgtgtacaattatcagatgcctccacagtgcccagtcggagagcagcgacgaaacctgtggaccgaggcctataagtggtggtatctggtatgtctgatccagcgtcgggactag

SEQ ID NO: 114333 - DNA, 1677 bp, Artificial Sequence
  Description of Artificial Sequence: Synthetic coding sequence
atgagcgctgcaaatccagaaacaccaaacagcaccatctctcgtgaggcttcaacccagtcctccagtgctgcagcttcccagggatgggtgcttcccgaaggtaaaattgtgccaaacactgtatttgtcggcggaattgacgctcgcatggatgagacagagatcgggagctgtttcggtcgctatggctccgtgaaggaggtgaagatcattaccaatcgcaccggtgttagcaaaggttatggctttgtgtcatttgtcaacgacgtggacgtacaaaagatcgtgggaagccagattcacttccacggcaaaaagctgaagttggggccggcaattcgtaagcagaaattatgcgcccgtcacgtgcaaccccgacctctcgtggtgaatccgccaccgccaccacagttccagaacgtatggcgaaatcctaataccgagacttacctccagccccagattaccccaaaccctgtcacccagcatgtgcaggcttacagcgcctacccacattcccccgggcaggtgattacgggttgtcagctcctggtgtacaactatcaagaataccccacatatccagacagcgccttccaggtgaccacgggttaccagctgcctgtgtataactaccagcccttccccgcgtaccctaggtcaccctttcaggttaccgctggttaccagctgccagtctataactatcaggccttccccgcataccctaactctccgttccaagtggccacgggttaccagtttccagtgtataattaccagcctttccctgcctatccgtcttccccctttcaggttactgcaggttatcaactgccggtgtataattaccaagccttccccgcctatccgaacagtccctttcaggtagccacgggttaccaattccccgtgtacaactatcaggcattccccgcttacccaaacagcccagtccaggtgaccacgggctatcagcttcccgtgtataactatcaggcctttccggcctatcccaattccccggttcaagtgaccacgggctaccagttgcccgtttataattaccaggccttcccggcttacccttcatcacccttccaagtcaccaccgggtaccagctgcctgtgtacaattatcaggccttccctgcataccctagtagcccctttcaggttacaacagggtatcagctgcctgtctacaactaccaggcattcccagcatatccgtcatctccttttcaagtgacaactggatatcaactccccgtgtataactatcaggcattcccggcttatccctccagcccctttcaggtcactaccgggtaccagctgccggtatataattatcaggcattcccggcctatcccagtagcccgttccaggtaaccacaggttaccagctgccagtctacaattaccaggcttttcccgcctatcccagttctccgttccaggtgacaacagggtaccagttgccggtctacaattatcaggccttccccgcgtatcccaacagcgctgtgcaggtcacaaccggataccaatttcatgtgtataattatcagatgcccccacagtgcccggtgggcgaacagaggcgcaacctgtggaccgaggcttacaagtggtggtatctggtttgtcttatccaacgcagggactag

SEQ ID NO: 114334 - DNA, 1086 bp, Artificial Sequence
  Description of Artificial Sequence: Synthetic coding sequence
atgagcgccgccaacccggaaactcccaactcaaccatatcgagggaagcaagcacacagtcaagctcagccgcagcaagccagggttgggtcttgccggagggtaagatcgtcccgaacacagtatttgtgggcggtatcgacgctaggatggacgagaccgagatcggctcttgttttgggcgctatgggtctgtaaaggaagtcaaaatcatcacaaacagaacaggggtgtcgaaaggctacggcttcgtcagcttcgtgaacgacgtggacgtacaaaaaattgtcggatcccagatccacttccacggcaagaagctgaagctgggccctgcaatccgcaagcagaagctgtgtgcaaggcacgtacagccgcgcccattagtagtaaatcccccccctcctccacagttccagaatgtgtggaggaatcccaacaccgaaacatatttgcagcctcaaatcacccccaaccccgtcacccaacatgtccaggcatacagtgcatatcctcacagccctgggcaggtgatcaccggttgccagcttttagtgtacaattaccaggagtacccaacctaccccgactcagcctttcaggttactaccggataccaactgcctgtgtataactatcaaccctttccagcataccctagatccccatttcaagtcactgccgggtaccagctgcccgtgtacaattatcaggcattccctgcctatccaaattcaccattccaagtcgccacgggataccagtttcctgtgtataactaccaacccttccctgcataccccagttcaccatttcaggttacagccgggtaccagctgcccgtgtataattatcaagccttcccagcgtacccaaactccccgtttcaggtggccactggttatcaatttcccgtctacaactaccaagcctttcctgcataccctaacagccctttccaggttgcaacggggtaccagtttccagtatataattatcaggctttccctgcctaccccaactcaccggtgcaagtcactaccggataccaacttcccgtgtacaattatcagatgcctccatag

SEQ ID NO: 114335 - DNA, 1965 bp, Artificial Sequence
  Description of Artificial Sequence: Synthetic coding sequence
atgagtgccgccaatcccgagacaccaaacagcaccatcagtcgagaggcctctactcagagctcctccgccgccgccagccagggctgggtgctgccagaaggtaagatcgtcccgaacacagtattcgtggggggaatcgacgcacggatggacgaaaccgaaatcgggtcgtgttttggccggtacgggtccgtgaaagaggtgaagattatcactaatcggactggggtgtcaaagggttatggctttgtgagctttgttaacgacgtggatgtccaaaagattgttggcagtcagattcacttccacggcaagaaactaaagttgggccctgctatcaggaagcagaagctgtgcgctagacatgttcagccacgacctcttgtggttaacccaccccctcctccccagttccaaaatgtgtggcggaacccaaacacggaaacttacctgcagccacaaattactccgaacccggtcacccagcacgtgcaggcctactcagcttaccctcattcaccggggcaagtgatcactggctgtcagttgctcgtctacaattaccaggagtaccccacgtacccagactccgcctttcaggtcacaacaggataccagctgcccgtgtataattaccaaccctttccggcctaccccaggtccccctttcaggtaactgctggctatcagctgccggtgtacaactaccaagcattcccagcctatccaaattcaccatttcaggtggccaccggataccagttccccgtgtataattaccagccatttcccgcctacccatcatctccattccaggtgactgctggatatcagttgccagtctataactaccaagccttcccagcctatccgaacagtccattccaggtggccactggctaccaattcccagtgtacaattatcagccctttcctgcctacccctcatcacccttccaggtcacagccgggtaccagctgcccgtttataattatcaggcctttccagcataccctaactccccattccaggtggccaccggttaccagtttcctgtgtacaattatcaggcttttccggcctatcctaattctcctgttcaggtgacaacaggttatcagctccctgtgtataactatcagcctttccccgcctatcccagatcaccattccaggttactgcaggctatcagctccctgtgtataactaccaggctttccccgcatatccaaacagccccttccaggtggccactggatatcagtttccagtatacaactatcaggctttcccagcgtaccccaactctccagttcaggtgacaacgggttaccagcttccggtgtataactaccaggcgttcccagcataccctagttcgccgttccaggtgaccaccgggtatcaactgccggtatacaattatcaggcgttccctgcttacccttcgtcaccatttcaggtcactaccgggtaccagctgccagtttataattatcaggctttccccgcatatcccagctcgcctttccaggtgacgacaggttatcaattgcctgtgtacaactatcaggcattccccgcttatcctagttcacctttccaggtgaccactggatatcagctgccagtgtataactaccaagctttcccagcttacccgtcatcccctttccaggttaccacaggttatcaattaccagtttataactaccaggccttcccagcgtatccaagcagccctttccaggtcactacaggctaccagctcccagtctataactaccaggcattcccagcctaccctaacagtgccgtgcaggtcactacaggctaccagttccatgtgtataactatcagatgcctccccagtgcccggtgggggagcagaggaggaacctttggactgaagcctacaaatggtggtatctggtctgcttgatacagcgcagggattag

SEQ ID NO: 114336 - DNA, 1605 bp, Artificial Sequence
  Description of Artificial Sequence: Synthetic coding sequence
atgtctgcggctaatcccgagacccctaactccaccattagccgcgaggcatccactcagtcaagtagtgctgccgcttctcagggctgggtgttgccagaggggaaaatcgtccctaacactgtttttgtgggcgggatcgatgcacgaatggatgagactgagattgggagctgtttcggtcgctatggaagtgtgaaggaagtgaaaatcatcaccaacagaaccggcgtgtccaaaggttacgggttcgtgtctttcgtgaacgatgtcgacgtccagaaaattgtgggatcacagatccactttcacggtaagaagctcaagctcggcccagctatcaggaaacaaaaattgtgtgctcggcacgtgcagccacgcccactggtggtgaacccccctcctccaccacagttccaaaacgtgtggcggaatcccaacaccgaaacttatctccagcctcagatcacccctaacccagttacacagcacgtgcaggcgtactccgcttaccctcatagccccggccaggtcattacaggatgccagctgctagtctataactaccaggaataccctacctatcctgattcagcctttcaggtgactacaggctatcagctcccggtgtataactaccagcccttccctgcgtatcccagatccccgtttcaggtcacagcaggttaccagcttccagtttataattatcaggctttccctgcttatcctaactctcccttccaggtcgctactgggtaccagttcccagtttacaactatcagcccttcccagcctatcctagctccccatttcaggttaccgcgggctaccagctcccggtgtacaattatcaggcatttccggcataccccaactcgccatttcaggtagctacagggtatcagttcccagtatacaactaccaagccttccccgcttaccccaacagcccagtgcaggtgacgaccggttaccagctccccgtgtataattaccaggcctttccggcttatccttcaagtccttttcaggtgactaccggataccagctgcccgtctacaactatcaggcatttcctgcgtaccccagctctcccttccaggtgactactggctaccagctgccagtctataattaccaggccttccccgcttacccatcaagcccattccaggtgaccactgggtaccagttgccagtttacaactaccaggcatttcccgcctacccctcatctcccttccaagtgacgactggctaccaactgcctgtctacaattaccaggccttcccagcttatccatcatctccatttcaggttactacaggatatcagttaccagtgtataactaccaggccttcccagcctacccatctagcccattccaggtgactaccgggtatcagctgccagtttataactaccaagccttcccagcataccctaactcagcagttcaggtgactaccggctaccagttccatgtttataattaccagatgcccccccaatgtcccgtgggggaacagcggcgtaacctctggactgaagcatataaatggtggtatttggtgtgtttaattcagagacgcgattag

SEQ ID NO: 114337 - DNA, 1317 bp, Artificial Sequence
  Description of Artificial Sequence: Synthetic coding sequence
atgtccgccgcaaatcctgagacacctaactccacgatcagcagagaggcatcaacccagagctcaagcgctgcggcttcccagggctgggtacttccggaaggtaaaatcgtgcctaacaccgtttttgtgggaggtatagatgcgaggatggacgaaactgaaattgggtcctgctttggccggtacgggagcgtgaaagaagtgaaaatcatcaccaacagaaccggagtctctaaaggatacggttttgtgagcttcgtgaacgacgtggacgtccagaagatagtcggctctcagattcacttccacggtaagaaactaaaattggggccagcaatccgcaaacagaagttatgtgcccgccatgtgcaacctcggccactcgtagtcaatcctcctccccctccacagtttcagaacgtgtggagaaaccccaacacagaaacatatttgcagccgcagattacaccaaaccccgttacacaacacgtgcaggcttattccgcttacccgcacagcccagggcaggtcattaccggatgccagctcctggtgtataactatcaggaatacccaacttatcccgactcagccttccaagtcaccactggctatcaacttccagtttataactaccagccttttccagcttacccgaggagtcccttccaagtcaccgcggggtaccaacttcccgtttacaattaccaggcctttcccgcctaccccaacagtcccttccaggttgcaacggggtaccagttcccagtctataactaccaggctttccccgcttatcccaattccccttttcaggttgccacgggctaccagtttccagtctacaattatcaggcctttcccgcttatcctaactcaccatttcaggtggctaccgggtatcagtttccggtgtacaattatcaagccttccctgcataccctaattctcccgtgcaggttacaaccggttaccagctccccgtctacaactaccaggccttcccagcgtaccctaattccccatttcaggtggcaaccgggtatcagtttccagtttataactaccaggcctttcctgcctatcctaacagccccgtgcaggtcactacaggctaccagctacctgtgtataactaccaagccttccctgcctatcccaactccgccgtccaggtgactacagggtatcagtttcacgtctacaattatcagatgcccccgcagtgtcctgtcggggaacagcgcagaaacctctggactgaggcctacaagtggtggtatctggtgtgtctcatccagcgccgggattag

SEQ ID NO: 114338 - DNA, 1173 bp, Artificial Sequence
  Description of Artificial Sequence: Synthetic coding sequence
atgtcagctgccaatcccgaaacccccaattctaccatctcgcgggaggcttcaacccaatcttcctccgctgctgcctcccagggctgggtcctcccagaggggaaaatcgtccccaataccgtatttgtggggggaatcgacgctaggatggatgagaccgaaatagggagttgtttcggacggtatggatccgtgaaagaggtgaaaatcatcacaaaccgtactggcgtcagcaaaggttatggcttcgttagcttcgtcaacgacgtagatgtccaaaaaattgtgggctcacaaatccactttcacggtaagaaactcaaattgggccctgctattcggaaacagaagctgtgtgccagacatgtacagccgaggccactggtcgttaaccccccacccccacctcaatttcagaacgtgtggcgaaatcctaatacagaaacctatctccagccacagataaccccaaacccggtaacacagcacgtgcaggcctattccgcctaccctcattcccccggccaggtgatcactggttgccaactgctcgtctataattatcaggaatatcctacataccctgattccgccttccaggttacaaccggctatcaactgcctgtgtacaattatcagccatttccggcctatccacggtctccctttcaggtcaccgctggctaccaactgcccgtgtacaactaccaagcatttcccgcctatcccaactccccatttcaggtggcaacaggttaccagttccccgtatataactatcaaccatttccagcttatccttcttctccattccaggtcacggcggggtaccagctgccagtctacaactaccaagcatttccagcttacccgaacagcccctttcaggtcgcgactgggtaccagtttccagtatacaactatcaggcctttccggcatacccaaatagtcctgtgcaggtcacaactggatatcaactgccggtgtataattaccaggcgttccctgcttatccaaactccgctgtgcaagtgactaccggatatcaatttcacgtgtacaattaccaaatgccaccgcaatgccccgtgggggagcagaggcgcaacctatggaccgaggcctacaaatggtggtaccttgtgtgtctaatccagcgccgggactag

SEQ ID NO: 114339 - DNA, 1746 bp, Artificial Sequence
  Description of Artificial Sequence: Synthetic coding sequence
atgatggatgagactgagatcggatcttgttttggaaggtacgggtccgtgaaggaagtcaaaatcatcactaaccgcaccggggttagtaagggctacggcttcgtgtcatttgtaaatgatgtagacgttcagaaaattgttggcagtcaaatccatttccatggcaaaaaactgaagctaggccccgccatccgcaaacaaaaactgtgtgcccgacacgtccagccccggccattggtcgtcaatccccctccccctccacagttccagaatgtttggcggaatccaaatacagagacttatctgcaaccccaaatcactccaaatccggtgacacagcacgttcaggcctactccgcttatccccatagtccaggacaggtgattactggctgccagctccttgtgtacaattatcaggagtatcctacgtacccggatagtgccttccaagtcactaccggttatcagctgccggtctataattatcagccattccctgcatacccaaggtcaccctttcaggtaaccgccggatatcagctcccagtttataactatcaggccttcccagcctaccctaactccccctttcaggtggcgactggctaccaattccccgtatataactaccagcctttccccgcttatccatctagccccttccaggtgacggcaggataccagctccctgtgtacaactatcaagcctttcctgcctatcctaattccccttttcaggtggcaacaggttaccagttccccgtatacaactatcaggcttttccagcatacccaaacagccccttccaggtggctacgggatatcaatttcctgtctataattatcaggcgtttcccgcctaccccaatagtcccgttcaggtgaccaccggctaccagctgcccgtgtacaactatcaacccttcccagcgtaccccagatcccccttccaagttacagccggatatcagctgcccgtctacaattaccaggcattccctgcttaccccaattcccctttccaggtagcaacaggatatcagttccctgtctacaattatcaagctttcccggcatacccgaattctcctgtacaagtgactaccgggtatcaactaccagtctataattatcaggcttttccagcttacccctcttcacctttccaggtgacaactggctaccagctgccagtatacaattatcaggctttccctgcatatccctcgagtccctttcaggttaccaccgggtatcaactaccggtgtataactaccaggcgttcccagcatatcctagttcccctttccaggtcacaaccgggtatcaattacccgtctacaactaccaggcattccccgcttacccctcatcaccttttcaagtcaccaccggttaccagctgccagtttacaattaccaggcattccctgcatacccatcttcccccttccaggtgacaactggataccagttgcctgtgtataattatcaggcctttcctgcctatccttcttcccccttccaagtgaccacagggtaccagctaccagtctataactaccaggctttccctgcttatcccaacagcgcggtgcaggtgacgaccggataccagttccatgtgtacaactatcaaatgccccctcagtgtcctgtgggtgagcagaggcggaacctgtggaccgaggcttataagtggtggtaccttgtatgcctgatccagagaagagactag

SEQ ID NO: 114340 - DNA, 1014 bp, Artificial Sequence
  Description of Artificial Sequence: Synthetic coding sequence
atgagtgctgccaaccccgaaactccgaactccacgattagtagggaggcctcaacccagtcctcttctgccgctgcatctcagggttgggtgcttcccgaaggaaaaattgtgcctaataccgtctttgtcggaggaattgacgctagaatggatgaaactgaaatcgggagctgttttggacgttatggatcagtcaaagaagtgaaaataatcacaaacagaacgggtgtatctaagggttatggcttcgtttcctttgtaaatgatgtagacgtgcagaaaatagtgggctcccagatccatttccatggaaagaagttaaagcttggccccgccattagaaaacaaaagctgtgcgcccggcacgtgcagccccgtcccctggtggtaaacccccccccgccaccccagttccagaacgtatggcgaaatcctaatacggagacatatctgcagccacagatcacgccaaatcctgtgactcagcatgtgcaagcctactccgcataccctcacagtcctggtcaagtgattaccggctgtcagctactcgtgtataactaccaggagtacccaacttacccggactccgcgttccaagtcacaactggttatcagctcccggtatataattatcagccttttccggcttaccctcggtcaccttttcaagtgaccgccggctaccagctgccagtgtacaactaccaggccttcccggcctaccctaatagtccatttcaggtggccactggctaccagtttcctgtctacaattaccaggctttcccggcgtacccaaattccccggttcaggtgacaacagggtaccagctccctgtgtacaattaccaggcgttccctgcctacccaaattccccttttcaggtggccacaggataccagttccctgtgtataattaccaggccttccccgcgtacccaaattcccctgtgcaagtgacgaccggttaccaacttccagtgtacaactatcaaatgcccccgtag

SEQ ID NO: 114341 - DNA, 1101 bp, Artificial Sequence
  Description of Artificial Sequence: Synthetic coding sequence
atgagcgccgcaaaccctgagactccaaactcaacaatatctcgtgaggcctccacacagtcctcatcggccgccgcaagtcagggatgggtcctgccggagggaaaaattgttcccaacactgtgttcgtgggaggcatcgatgctcgaatggacgagacagagattggctcttgtttcgggcggtacggatccgtcaaagaggttaaaatcataaccaatcgaaccggcgtgagcaagggctacgggtttgtgtcctttgttaatgacgtcgacgttcaaaagatagtgggttcccagatccatttccatggaaagaagctgaaactgggtcccgccatcagaaagcagaagctatgcgctagacacgtccaaccccggcctctggtcgtaaaccccccacctccccctcagttccagaatgtgtggcgaaatcccaacaccgagacatatctgcagccacagataactcctaaccccgttactcagcacgtgcaggcttatagcgcctaccctcactctcctggccaggtgatcaccggctgccagctcctcgtctataattatcaggagtatccaacatacccagacagtgccttccaggtcaccaccggatatcagttacctgtatacaactatcaaccattccccgcgtatccacggtccccctttcaggtgaccgccggctaccagctgccggtgtacaactaccaagcattcccagcgtaccctaactcccctgtgcaggtgaccacaggataccagctcccagtatacaactatcaggccttccccgcctatcctaacagtcccgtacaggtaaccacaggctaccagctccctgtgtacaactaccaggcgtttcccgcatatcccaacagcccagtccaggtaactaccggctaccaactgccagtctacaattatcaggcttttcccgcctacccgaactccgccgtccaggtcaccaccgggtatcagtttcacgtgtataattaccagatgcctcctcagtgcccggttggagaacaaaggcgaaatttgtggactgaggcttataagtggtggtatctggtgtgcctgatccagcggcgggactag

SEQ ID NO: 114342 - DNA, 1317 bp, Artificial Sequence
  Description of Artificial Sequence: Synthetic coding sequence
atgtccgcggccaatcccgagacaccaaactccaccattagccgcgaagcatccacccaatcatcttcagccgcggcctcccaagggtgggtactgcccgagggcaagatagtccccaataccgtcttcgtgggtggcattgatgcacggatggatgagaccgagattggttcctgctttggccgatacggaagcgtgaaagaagtgaaaattatcaccaatcgaactggcgtgtccaaaggatacgggttcgtttcattcgtgaacgacgtcgacgtacagaagatcgtaggatctcagatacactttcacggtaaaaaactgaagctcgggcctgctattcgtaagcagaagttatgcgcccgccacgtacagccacggccactagttgtgaacccccccccgccgcctcaatttcagaatgtatggcgcaaccctaatacagagacctacctacagccccagatcacacccaatccggtcacgcagcacgtccaagcctattctgcttaccctcattcaccaggacaagtcattactgggtgccagctcctggtgtataactaccaggaataccctacttatcctgattctgcatttcaggttaccaccggataccaacttcccgtttataactatcaaccatttcccgcctatcctcgatccccattccaggtcactgcggggtaccagctgcccgtttacaattaccaggcctttcccgcctacccaaactctcctttccaagtagcaacaggataccagtttccagtgtacaactaccaggcgttcccagcttatcccaattcccccgtgcaggtgaccactggctatcagctgcccgtttataactaccaggcctttcccgcctacccaaacagcccctttcaggtggcaacaggctatcagtttcccgtgtacaactatcaagcattccctgcttatcccaacagtcctgtgcaggtgacaacaggctaccagcttcccgtctacaactaccaagcttttccggcttatccaaatagcccattccaggttgccacaggctaccagttccccgtctacaattaccaagccttcccagcgtatccaaatagtcccgtgcaggtgacgacaggctaccagctcccagtgtacaattatcaggccttccccgcctatcccaacagtgctgtgcaggtgacaacaggctatcaattccacgtgtacaactatcaaatgcccccacaatgtcctgtcggggaacagaggcgcaacctttggaccgaggcctataaatggtggtacctcgtgtgtcttattcagcgcagagattag

SEQ ID NO: 114343 - DNA, 1086 bp, Artificial Sequence
  Description of Artificial Sequence: Synthetic coding sequence
atgtcggctgctaatcctgaaacccctaacagcaccataagcagagaggcctcaacacagagtagttccgccgcagcctcccaggggtgggtgttacccgagggaaagatcgtgccaaatactgtttttgttgggggaattgacgcccgaatggacgaaacagaaatcggttcctgcttcggacgatatggttctgtaaaggaagtaaaaattataaccaataggacaggagtgagcaaggggtacggattcgtctccttcgtgaacgacgtggacgtgcagaagattgtggggtcacagattcacttccatggtaaaaaactcaaacttggacccgcgataaggaagcagaaactatgcgcccgccatgtacaaccccgaccccttgtggtaaacccccctcctccgccccagtttcagaacgtctggagaaaccccaatacggagacctacctgcagccccagatcacaccaaacccggtgacccagcacgttcaggcttactctgcttatccccacagccccggccaggtgataacagggtgtcagctactggtgtataattatcaggaataccctacctaccccgattccgcatttcaggtgaccactggctatcagctgccagtgtacaactaccaacctttcccagcctatcctcgttccccattccaggtaaccgccgggtatcagctgcccgtttacaactatcaagcctttcctgcatatcctaacagtccctttcaggtggcaactggataccagtttcccgtgtacaattatcaagcgtttcctgcatacccaaactcccccgtccaggtgaccacggggtaccagcttcccgtgtacaattatcaggcgtttccggcataccctaattcgccatttcaggtggctactgggtatcaatttcctgtatataattatcaggcctttccagcgtatcctaatagccctgttcaggttaccacagggtaccagttgcctgtttataactaccaggcctttcccgcataccccaactctcctgtccaggtcacaacggggtatcagctcccggtgtacaactaccagatgccgccatag

SEQ ID NO: 114344 - DNA, 1173 bp, Artificial Sequence
  Description of Artificial Sequence: Synthetic coding sequence
atgtccgctgcaaatccagagaccccaaactccacaatatcccgtgaagcaagtactcagtcaagctccgccgctgcttcccaagggtgggtgctcccagaagggaaaattgtaccaaatacggttttcgtcggagggatagacgcccgaatggatgaaacggaaatcggtagctgcttcggccgctatgggtccgtgaaggaagtgaagattattacaaaccgcacaggcgtgtctaaagggtacggttttgtgtcgtttgtcaatgacgtcgatgttcagaaaattgtgggcagccagattcacttccacgggaagaaattaaaattgggtcctgcaatcaggaagcagaagctgtgtgctcgacatgtgcaaccgcggccacttgtcgtgaatccccctccccccccccagttccaaaacgtgtggcgcaacccaaacactgaaacatacctacagcctcagatcaccccaaacccagtcacacagcatgtccaggcatactccgcctatccccattccccaggccaggtcattactggatgtcagctcctggtgtacaactaccaggaataccctacatatcccgattctgcattccaggtgacaacgggataccagcttccagtctacaattaccagcccttccctgcctatcctcgttctccattccaagtgacagcaggttaccagctgccagtctataactaccaggcctttcccgcctacccaaattcaccctttcaggttgcaaccggttatcaatttcccgtgtataattaccaggcttttccagcctatcccaattctcccgtgcaggtaaccacaggataccagctaccagtttacaactatcaggcgtttcccgcctaccccaactccccatttcaggtcgccactggctatcagttccctgtttacaactatcaagccttccccgcctatcctaatagtccagtgcaggtaacgaccggatatcagctgcctgtttataattaccaggctttccctgcatacccaaacagcgctgtgcaagtgactacagggtaccaattccacgtatataactatcagatgccgccccaatgccctgtaggggaacagcgtaggaacctgtggacagaggcctacaaatggtggtaccttgtgtgtctgatccagcggcgtgactag

SEQ ID NO: 114345 - DNA, 948 bp, Artificial Sequence
  Description of Artificial Sequence: Synthetic coding sequence
atggcagcacccagttgtggaggtgaccggaaggccagactgactccctccctgccccatgagtccactgccaatcctgagacccccaattccaccatctccagagaggcctcaactcagtccagctccgccgcaacttcccaagggtatattctacctgagggcaagattatgcccaacacagtgtttgtaggcggaatcgatgttaggatggacgagacggagataagatccttttttgctcggtatggttcagtcaaggaagttaagattattaccgatagaactggtgtctccaaaggatatggtttcgtgagcttcttcaatgacgtcgatgtgcagaagattgtagaatcccaaatcaactttcacggtaagaaactgaagttgggtccggccattagaaagcagaacctgtgcgcctaccatgtgcaacctaggccactggtgttcaatcacccgccgccaccgcagttccaaaatgtttggacaaatccaaacaccgaaacttatatgcagcccactacgaccatgaaccccattacacagtacgtgcaggcctatcccacgtacccgaactctcccgtgcaggttatcacagggtaccagctgccagtttacaattaccagatgccgccgcagtggcctgttggggaacaacgaagctacgtggtacctccagcctatagcgccgtgaactaccactgcaatgaagtggaccccggcgccgaagtcgtacccaatgagtgttctgtgcatgaggcgacccccccctctggaaacgggccacaaaagaagagcgtggatcgctccattcaaactgtggtgtcgtgtctgtttaatccagagaaccgcttgcggaatagtgtggtcactcaggacgattatttcaaggacaagcgggtgcatcattttcgtcgaagcagagcaatgttgaagagcgtgtag

SEQ ID NO: 114346 - DNA, 888 bp, Artificial Sequence
  Description of Artificial Sequence: Synthetic coding sequence
atgtcgacagctaatcctgaaaccccgaacagcacaatctctcgggaggcttccacacagtccagcagcgctgcaacatctcaaggttacatcttgcctgaaggcaaaattatgcccaatacggtgttcgtggggggcatcgacgtccggatggatgagacagagataagatctttctttgcccggtatggttcagtcaaggaagttaagattatcaccgaccggacgggggtgtctaagggttatggcttcgtttctttttttaatgatgtggacgtgcagaagatagtagaatctcagattaatttccatgggaagaagctcaaacttggccccgccattaggaaacaaaacctgtgcgcttaccacgtccagccacggcctctggtgttcaatcacccaccaccaccgcagtttcagaatgtgtggacgaacccgaacaccgaaacatacatgcagcccactaccaccatgaatcccatcactcagtacgtccaggcatacccaacatatcctaactctccagtgcaggttattaccggttatcagctgcccgtgtacaactatcagatgccacctcagtggcccgtcggggaacagcggtcttacgtggtaccaccagcatatagtgctgtgaattatcattgtaacgaagtagacccaggcgcggaagtggtgcctaacgagtgtagtgtgcacgaggcgacccctcctagtgggaatgggccacagaagaagtccgttgacagaagtatccagaccgttgttagttgcctgttcaaccctgagaacagattacgcaactctgtagtcacccaggatgattactttaaggacaaacgggtgcaccattttaggcgcagtagggctatgctgaaatctgtgtag

SEQ ID NO: 114347 - DNA, 2286 bp, Artificial Sequence
  Description of Artificial Sequence: Synthetic coding sequence
atgaactggagatttgtagaactcctgtattttctctttatttgggggcgaatctctgtacaaccaagccatcaagagcctgcggggaccgaccagcacgtgagcaaagagtttgactggttaatatcagacaggggtcccttccatcacagcaggtcttacttaagctttgtggaacggcaccgccagggctttactacacgctataaaatctaccgtgaatttgcaaggtggaaggtccgaaatacagccatcgagcggcgggaccttgtcaggcatccagtgcctctgatgcccgaatttcagcgctccatcagactgctgggaagaagaccaacgacccagcagttcattgatactatcataaaaaagtacgggacccacttgctcatcagcgccacactgggaggggaagaagcactgaccatgtatatggacaaaagtcggcttgatcgcaaatctggtaatgctactcaatctgtcgaagcccttcaccagctggccagctcttactttgttgacagagacggcacaatgcgtagactgcacgaaatccaaatcagtaccggcgctattaaggtgaccgagacccgcactggacccttagggtgcaacagttatgacaatctcgattccgtgagttcggttcttctacagtccaccgagtccaaactgcatcttcaaggccttcaaattatttttcctcagtatttacaggagaaatttgtccagtctgcactaagctacattatgtgtaacggagaaggggagtacttgtgtcaaaattcgcagtgcaggtgccaatgcgctgaggaattcccccagtgcaactgtcccataaccgatattcagatcatggaatatacattagctaatatggctaagagttgggcggaggcttataaagatcttgagaattcagatgagttcaaaagcttcatgaaacggctaccttccaaccattttctgacaattggctctatccaccaacactggggcaacgattgggacctccagaatcgctacaagctgctgcagagcgcaactgaggcccaacgccagaagattcagaggacagcccgcaaactcttcgggctaagtgttcgctgccgacacaaccctaaccatcagcttcccagggaaagaactatacaacagtggctagctagagtgcagagcctgctatattgtaatgaaaatggtttctggggcacattcctcgagtcgcagcggtcttgtgtgtgccatggatccactaccctctgtcaacgccccataccttgcgtgatcggtggaaataactcctgcgcaatgtgctcactggctaatatcagtctgtgtggaagctgcaacaaagggtataagctctatcgcggacgctgcgagccccagaacgttgactctgagagaagcgagcagtttatctcctttgagaccgatttagattttcaagatctggaactgaagtacttattgcagaaaatggatagccgtctgtacgttcacacaacattcatctccaatgaaatccggctggatacattctttgacccccggtggcgcaaaagaatgtccctgacgctgaaatctaacaaaaatagaatggattttatccacatggtgatcgggatgagtatgcgcatttgccagatgcgcaactcgtcccttgaccctatgttctttgtttatgtaaatcctttttctgggagtcactccgagggatggaatatgccctttggggagttcggatacccccggtgggaaaaaattagactccagaatagtcaatgctataactggacccttttgctcggaaataggtggaagacgttcttcgagactgtgcatatttatttacgctctcgcacgagactgccaacactactcaggaacgagactgggcagggtccagtggacctctcagacccctccaaacgccagttctatatcaaaattagcgacgtacaagtgttcggttactctcttaggttcaatgccgacttgctgcgtagcgctgttcagcaggtgaaccagagttacacacaaggcggccagttctattcttctagcagcgtgatgttacttctgttggacattagggacagaatcaacaggctggccccccccgtggccccaggaaaacctcagcttgacttgtttagctgcatgctgaaacacaggttgaaactcaccaacagcgaaataatacgggtaaaccacgccctggacctgtataacactgaaattcttaagcagagcgatcagatgactgctaaactctgttag

SEQ ID NO: 114348 - DNA, 963 bp, Artificial Sequence
  Description of Artificial Sequence: Synthetic coding sequence
atgaactggaggtttgtggagctactgtattttctgtttatttggggccgcatttctgttcaaccgtcacatcaggagcctgccggcactgatcagcacgtcagcaaggaattcgactggctgatcagtgatagggggcctttccaccacagtaggagttatctctccttcgtggagagacaccggcagggttttaccactcgatacaagatctacagagaattcgcacgctggaaggtcaggaatacggcaatagagcgaagggatctggttcggcaccccgtccccttgatgcccgaattccagcgctcaatccggctgctcggccgtcgccctactactcagcagttcattgatacaatcataaaaaagtatggaactcacttgctcatctctgctactctcggcggtgaggaagcccttactatgtacatggacaagagtcgcctggatcgcaaatccggaaacgctacacagtccgtcgaagcattgcatcagttagcttcctcatactttgtggaccgcgatgggacgatgcggcggttacacgagattcagatctctacaggggctattaaagtgaccgaaacacgcactggtcctctcgggtgcaactcatatgacaatctcgatagcgttagcagtgtcctcttgcaatccactgaatctaagctgcacctgcagggactccaaatcattttcccacagtacttgcaggagaagttcgtgcagagcgcgctttcatatattatgtgtaatggagagggagagtacctgtgccagaactctcagtgtagatgtcagtgtgcagaggagttccctcagtgcaattgtcccataacagatatccagatcatggaatacaccctggccaacatggcaaagtcctgggccgaagcctacaaggaccttgaaaactccggcagagaaagccactcagtgcctctgcacgaatggccctag

SEQ ID NO: 114349 - DNA, 2286 bp, Artificial Sequence
  Description of Artificial Sequence: Synthetic coding sequence
atgaactggagattcgtagaattgctatatttcttgttcatttggggtcggatttccgttcaaccaagtcaccaggagcctgctggtacagatcagcacgtgagcaaagagttcgactggttaatttcagacagaggccctttccatcacagccgaagctatctttcattcgtcgaacgtcatcgccaggggtttacaacgaggtataagatttaccgtgagttcgccaggtggaaagtaagaaataccgctattgagcgccgagacttggtccgtcatcccgtgccactcatgccagaatttcagcgatccatcagactgctgggtaggaggcctaccactcaacagtttatcgacaccatcataaagaagtacggtactcatttactgatatcagcgacattaggtggcgaggaagcgttaacaatgtatatggataagtccaggctggacaggaagtccggaaacgccacccagagcgtggaggctctgcatcaactggcctcctcctacttcgtggatagagacggtaccatgcgcagattacacgaaatccagataagcacgggggccattaaagtgacagaaactcgtacgggaccccttgggtgcaacagttatgacaacttggactccgtatcatctgtgctgcttcagagcaccgaatctaaactgcacttgcaaggcctgcagattatatttccccagtatcttcaggagaagttcgtccagagcgccctttcatatattatgtgtaatggcgaaggcgagtatctgtgtcagaacagccaatgcaggtgccagtgcgccgaagagttcccccagtgcaattgtccaattacagacattcagattatggagtacaccctggcaaacatggcaaagtcctgggcggaggcttataaggacctggaaaacagcgatgaatttaagagttttatgaagaggctcccttctaatcattttctaacaatcggcagcattcatcagcattgggggaacgattgggatctgcagaaccgatataagctgctgcagagcgccaccgaagctcagcggcagaaaattcagaggaccgcgcgaaaacttttcgggttaagtgttcggtgccgtcacaatccaaatcaccagctgccaagagaacgcacaatccagcagtggctggccagggtccagagcctgctctactgtaatgagaacggcttctggggcacatttcttgaatcgcagcgctcctgcgtctgccacggaagcactactctttgccagaggcctataccatgcgtcatcggaggaaacaattcttgtgccatgtgttccctcgcaaacattagtttgtgcggatcatgtaacaagggctataaattgtaccgcggccgatgcgaaccccaaaatgtagatagtgagcgttcagaacagttcatcagtttcgaaacagatctggacttccaggatctggagcttaaatatctgcttcaaaagatggatagccgcctatacgtccacacaacatttatttctaatgaaattcggctggacacattttttgaccctcggtggcggaagcgaatgtccctgacactaaagtctaacaaaaaccggatggatttcatccacatggtcatcggaatgagcatgaggatctgtcagatgcgcaattctagtttggatcccatgttcttcgtgtatgttaatcccttctcaggtagccacagtgagggctggaatatgcctttcggagaatttgggtatcccagatgggaaaagataagactgcagaactcccagtgctataattggaccctgctgctaggcaatcgatggaaaactttcttcgagacggtccacatatatctgagaagtagaacacgactacccaccttactgcggaacgagactgggcagggacccgtggacttaagtgatccaagcaagagacagttctatatcaaaataagcgacgtgcaagtgttcgggtacagcctaaggttcaatgctgacctactccggagcgctgtacagcaggtcaatcagtcgtacacccaaggaggacaattttatagtagttcttcagtaatgctgctcctgctggacatcagagaccggattaatcggctggcacctcccgttgctcctggaaaaccacagctggatctgttctcatgcatgcttaaacaccgcctcaagcttactaacagcgagattatcagagtgaaccacgcacttgacctctacaacacagagattcttaagcagtctgaccagatgaccgcaaaactgtgctag

SEQ ID NO: 114350 - DNA, 1404 bp, Artificial Sequence
  Description of Artificial Sequence: Synthetic coding sequence
atgaagcggattaaagtacccgattataaggaccgatcagttttcggcgtgcccctgactgtaaacgtccagcgcacaggacagccactaccacagtcaattcaacaggccatgcgttatcttcgaaaccactgtctggaccaggtgggtctgtttaggaagtcgggcgtcaagtcacgaatccaggccctgcggcagatgaatgagggggccatcgactgtgtgaactacgagggtcagagcgcttacgatgtggcggatatgctgaagcaatacttccgggatcttcccgagcccctgatgaccaataaactcagcgaaacattcttacagatatatcagtacgtgcccaaggaccaaagactgcaggccattaaggctgctatcatgctcctgccagatgagaatagggaagtgttgcaaaccctgttatatttcctgtcagacgtgaccgcagcagttaaggagaaccagatgacacccactaatctagctgtgtgcctggcccctagtctcttccacttgaatacacttaagagggaaaattccagtccgcgcgtgatgcagcggaagcagagcttgggcaagcccgatcagaaagatctcaacgaaaatctagcagctacgcaggggctggcccacatgatagctgagtgtaaaaaattattccaggttcctgaagaaatgtcccgctgtcgcaactcatatactgaacaggagcttaagccgcttacccttgaggctctgggccacctgggcaatgacgattctgcagattaccagcatttcttacaggactgcgtggacggattgttcaaagaagtcaaggaaaaattcaaaggttgggtgagctatagcacatcggagcaagccgaactgtcctacaaaaaagtgtccgagggcccaccactgcgactgtggaggagtgtgatcgaagtcccagcggttcccgaagaaattctgaaacgccttcttaaggaacagcatttatgggatgtagacctgctggacagcaaagttatcgagatcctcgatagccaaacagagatttaccagtacgtgcaaaattctatggctccacacccagctcgggactatgtggtacttcggacatggcgcacaaatttgcccaaaggagcctgtgcactcctactcaccagcgtagatcacgaccgcgctcccgtggtcggcgtccgcgtcaacgtactgctgtctcgttatttgatagagccatgcggcccagggaagtccaagctaacatatatgtgtagagtcgatctgcgcggccacatgcctgagtggtacaccaagtctttcggacatttgtgtgctgcggaggtagtgaagatccgcgacagcttctccaaccaaaataccgagacaaaggacaccaaatcacgttag

SEQ ID NO: 114351 - DNA, 3378 bp, Artificial Sequence
  Description of Artificial Sequence: Synthetic coding sequence
atgggggaccctaaagcgcacgtcatggcaaggccattacgggcacccctgcgaaggtctttttccgaccacatcagggattccactgctagggccctcgacgtgatctggaaaaacacgagggacaggcggctggctgagatcgaggctaaagaagcttgtgattggcttagggctacgggcttcccccagtatgcccagctctatgaggactttctctttccaatagatatcagtctggtgaagcgggagcatgacttccttgaccgagacgctatcgaagctctgtgccggcggctaaacacactaaacaaatgcgccgtgatgaaactggaaatcagtcctcatcgcaagaggagtgatgattccgacgaggatgaaccatgtgcgatttccgggaagtggacattccagagggacagcaaacggtggtccaggcttgaagaatttgacgtgttctcacctaagcaggatcttgtccctggctctcccgacgattcgcatcccaaggatgggccctcccctggtggtaccctgatggatctctccgagcggcaggaggtatcctccgtgagatctcttagctccacgggatccttgccgtctcacgcccctccttctgaggatgctgccaccccccggaccaactctgttataagcgtttgttccagcagtaaccttgcggggaacgacgacagttttgggtcgctgccctcccctaaagaactcagttccttctcattctcaatgaaaggacatgagaaaaccgctaagagcaagacccgatcattgctcaaaagaatggagtcacttaagctgaagagcagccaccacagcaagcataaggccccatccaagttaggcttaatcatatcaggacctatattgcaggaagggatggacgaggaaaaattgaagcagctcaactgcgtggaaataagtgctctcaatgggaaccgcatcaatgtccctatggtgcgaaagcggtccgtgtctaacagcacgcagacctcttcgtcttctagtcaatcggagacctccagtgctgtgtctaccccaagcccagtcacaaggacaagatccctgtcagcctgcaacaaacgggttgggatgtacctggaaggcttcgatccgttcaatcagtccaccttcaacaacgtcgtcgagcaaaattttaaaaacagagagtcttaccccgaggatactgtgttttatataccggaggatcacaagcccggaacattccctaaggcacttacgaatggctctttctccccaagcggtaataacggatctgtgaactggcgaaccggcagtttccacgggcccggccatatctctctccgccgcgagaattcctcagatagcccgaaggagctgaaacgtcggaactcatccagttctatgtcctcacgactgtcaatttatgacaacgtccccgggtctattctgtatagtagcagtggcgacctggctgatctcgaaaatgaagatatcttccccgagttggatgacatcttgtaccacgttaagggcatgcagcgtattgttaaccagtggtctgagaagttttccgacgagggtgattctgattctgcccttgactctgtgagtccttgtccaagctctcctaagcaaatacatttagatgtggacaacgacaggacaaccccctccgacttggacagcacaggcaattctcttaacgagcctgaggaacccagcgaaattccggagagaagggattcaggcgttggggcctctctgacaagaagtaacagacatagactccgctggcactcattccagtcttcgcacagacctagcctaaacagtgtgagcctccagatcaactgtcaaagcgtagcacagatgaacctcttacagaagtattctcttctgaagctgactgcactcttggaaaagtacacaccttctaacaagcacgggttttcctgggctgtgccaaaattcatgaagaggattaaagtgcccgactacaaagaccggtccgtgttcggcgtgccactaactgtgaacgtgcaaagaacgggtcaacctctacctcagtccatccaacaggctatgcgctatctgcggaaccattgtcttgaccaggtgggcctgtttcgaaagtctggggtcaagtcacgcatccaggccctgcggcagatgaacgaaggcgcaatcgactgtgtcaactatgagggccagagcgcatatgatgtggctgacatgttgaagcagtacttcagggacctccctgaaccactgatgacgaacaaactaagcgagacatttttgcagatttatcagtacgtgccaaaggaccaaagactccaggccattaaagctgctatcatgcttctccctgatgagaatcgggaggtgttgcaaactctcctttattttttatccgatgtgacagcggctgtgaaagaaaaccagatgactcctactaatctggcagtgtgcctggctccttccctcttccaccttaatactctcaagcgtgagaattcaagtcccagggtgatgcaacgcaaacagtcgctcggtaaacccgaccagaaagatctcaatgaaaatctggctgctacccaagggcttgctcatatgatcgccgagtgcaagaagctgttccaggttccggaggaaatgagccgatgtagaaatagctatacagagcaagaactgaagccactgaccctggaggcactggggcacttgggcaatgatgatagtgctgattaccagcacttcctgcaggactgtgtcgacggactctttaaggaagtcaaagaaaagttcaaagggtgggtgtcctactccacttccgagcaggctgagctgtcctataagaaagttagcgaagggccacccctccggctctggcgctcagttattgaagtgccggccgtgcctgaagaaatactcaaacgccttctgaaagaacagcacctgtgggatgttgatctcttggacagcaaagtcattgaaattttagatagtcagaccgagatctaccagtatgtgcagaactctatggcaccccatcctgcgcgcgactacgtcgtcctgcgcacctggaggacgaatctcccaaaaggcgcatgcgccctgttacttacatccgttgaccacgaccgtgccccggtagttggagttagggtgaacgttctcctgtcacgctatctgatcgaaccttgtggtcccggcaaatcaaagctaacctatatgtgcagggtggacctgaggggccatatgcctgagtggtatactaagagttttgggcacttgtgcgctgctgaggtggttaagatccgcgattctttcagtaatcagaacacggagacgaaagataccaagtctaggtag

SEQ ID NO: 114352 - DNA, 3054 bp, Artificial Sequence
  Description of Artificial Sequence: Synthetic coding sequence
atgaagttagagatctcaccccacaggaagcgatcagatgattctgacgaagatgagccatgcgccatctcaggaaagtggacctttcagagagatagtaagcgctggagcagactggaggagtttgacgtcttcagtccaaagcaagatctcgtgccagggtcacctgatgattcccacccgaaggatggcccctcccccggcgggaccctcatggatctgagtgaaaggcaggaagtctcctccgttagatctctaagttcaactggaagtctgccatcccatgctccgcccagcgaggacgctgccactccaaggactaactccgtcatatcagtgtgttcgtcaagcaacttagctggtaacgacgactctttcggcagcctcccttcgccaaaagagctgtcttcattctcgttctccatgaagggtcatgagaagaccgccaaaagcaagactagatccctcctcaagaggatggaatccctcaaactcaaaagcagtcatcactccaagcacaaggccccatctaaactaggtctgataatatctgggcctatccttcaggagggtatggatgaagaaaaactgaagcagctcaactgtgtcgagatcagtgcgctaaacgggaaccgaatcaatgtaccaatggtgcgcaagcgcagcgtatcgaacagtacccaaactagttctagtagtagtcagtcagaaacttccagtgccgtgtctactccctctccagtcacgaggacgcggtcactcagcgcctgcaacaagcgagtgggaatgtacttagaaggtttcgatcctttcaatcagtcaacttttaataacgtggtcgaacagaattttaagaacagagaatcctaccccgaagacacagtcttctacatccctgaggatcacaagcccggaacgttccccaaagctctaaccaacggctctttcagtccctcgggcaacaatgggtctgtgaattggcgaactggctccttccacgggcctggtcatatctcactccggcgagaaaacagctccgatagtcctaaagagctaaaaaggcggaattccagcagctctatgagcagcagactcagtatctacgacaatgtgcctggttctatcctgtattcatcctcaggtgatctcgctgatctggagaacgaggacatattccctgagttggatgacatcctgtatcacgttaagggcatgcagcgcatcgtgaaccaatggagcgaaaagttttctgacgagggggactcagacagcgccctcgattcagtttccccctgcccctcttcgccaaagcaaatacacctggatgtggataacgatagaacaacgccatctgatctggattcaaccgggaactctctaaatgagccagaagagccatctgaaatcccagagagacgagactcaggggttggtgcttcgctgactaggagcaataggcatagacttcgctggcattcgttccagtcgtcccaccgaccatctctgaacagcgtgtcgttgcagatcaattgccagtctgtggcccaaatgaacctgctccagaaatactctcttttgaagcttacagccctcctcgaaaaatataccccctccaacaaacatggcttttcttgggctgtaccaaaatttatgaagagaattaaagtacctgactacaaggataggagcgtcttcggagtccctctcacagtcaacgtgcagagaacagggcagcccctcccccagtccatacagcaggctatgcggtacctcaggaaccattgccttgatcaggtaggactgtttcggaagagtggcgtcaagagccggattcaggcacttaggcagatgaacgagggggctatcgattgtgtgaactatgaaggccagtcagcctacgatgtggcagacatgctgaagcagtattttcgggatctgcccgagcccctcatgacaaacaaactgagtgaaacttttcttcagatctaccagtacgtgcctaaggaccagcgcctgcaggccattaaggccgctattatgctgctccccgatgaaaacagggaggtgcttcagacactcctctatttcttaagcgacgtgacagcagccgtcaaagagaaccaaatgacgcccacaaacctggcagtatgccttgccccatcccttttccacctgaatacactcaagcgggaaaatagctctcctcgcgttatgcagcggaagcaaagccttggcaagcctgaccagaaggacttaaacgagaacttagccgccacgcaggggctggcccacatgatcgcagaatgcaagaaactcttccaggtgcccgaggaaatgagcaggtgtcggaacagttacacagaacaagagcttaagccattgactctggaggccctaggacacttaggaaacgatgactcagccgattaccagcactttctacaggattgtgtcgacggactctttaaagaggtgaaggagaagtttaaaggctgggtaagttatagcacctccgaacaagcagagctctcctacaagaaagtcagtgaggggccgccgcttcggctgtggaggagcgtgattgaggtgcccgccgtgccggaagagatcttaaagcgtttattgaaagaacagcacctatgggatgttgatctgctggacagtaaggtgattgaaatattggactctcagaccgaaatttaccagtacgtccagaattcgatggcaccacatccagctagagactatgtcgtcctgcgtacctggcgaaccaatcttcccaaaggagcatgcgcccttctcctgacttcagtcgatcacgaccgggctcctgtcgtgggcgttcgggtgaatgtcctgctttcgagatatctgatcgagccatgcggccctgggaaatccaagcttacttacatgtgcagggtagacttgcgcgggcacatgccagagtggtacactaagagcttcggacatctctgcgctgctgaggtcgtcaagatcagggactcattctcgaatcagaacactgagaccaaggacaccaagtctaggtag

SEQ ID NO: 114353 - DNA, 972 bp, Artificial Sequence
  Description of Artificial Sequence: Synthetic coding sequence
atgggtaatagcgcctccaggtcagatttcgagtgggtttacacagatcagcctcacactcaaagacggaaggagatccttgcgaaatatccagctataaaggcattgatgcgcccagacccaaggttgaagtgggcagtgctagtgctggtgctggtccaaatgctcgcctgttggcttgtgaggggtcttgcctggagatggctcctgttctgggcatacgcattcgggggctgcgtcaaccactcacttaccctagctattcacgacatttcacataacgccgcattcgggacaggacgcgcagccagaaatcgctggctggctgtgttcgcaaacctgccagtcggcgtgccctatgcggcatcctttaagaaatatcatgtagatcatcaccgatatctaggcggagacgggctagacgtcgatgtcccgacacgtcttgaaggctggttcttttgcacaccagccagaaaactgctctggctcgtgctgcagccattcttctactccttacggccactgtgcgtgcacccaaaggctgtaacacggatggaggtgctcaacacactggtccagctggccgccgatttagccatctttgcactctggggacttaagcccgttgtttatctgctggcgtccagttttctcggactgggactgcaccccatctctggccattttgtcgccgagcactacatgtttctcaaggggcacgagacctactcctactacggccccctaaattggattacttttaacgtcggttatcacgttgagcaccacgattttcctagcattcctggctacaacctgcccctcgttcgtaagatcgcccctgaatactacgaccacctcccacaacaccactcctgggtcaaggtgttgtgggattttgtgtttgaggattcgcttggtccttacgccagagtgaagcgggtatatagacttgcaaaggacggactctag

SEQ ID NO: 114354 - DNA, 2214 bp, Artificial Sequence
  Description of Artificial Sequence: Synthetic coding sequence
atgcagccccgcagggcccaggcaccgggagcccaactcctgcccgccctggccttacttctgctgctgctaggtgcgggaccaagggggagctcactcgcgaatccggtgcccgcggcacctctgtccgcgcctggaccgtgcgccgctcagccatgcaggaacggcggagtatgcacatctcgtccggagcctgacccccagcatccagcgccggctggcgagcctggctattcatgtacctgtcccgcggggatttctggagccaattgccaactggtggctgatccatgcgcttctaatccgtgccaccacggaaattgtagttccagctcctcctctagtagcgatggctacttgtgcatctgtaatgaaggctacgagggcccaaattgcgaacaggcacttccctcactgcccgccacaggatggactgaatccatggccccgcgccagcttcagccagttccagcgacccaggagccagataaaatcctgcctcggagccaggccaccgtgactctgcccacctggcagcccaagaccgggcagaaagttgtggaaatgaaatgggatcaggtagaggttattccagacatcgcctgtggcaacgcctcttccaattcttccgcaggagggaggctagtgtcgttcgaggtcccccagaataccagcgtgaagatccggcaggacgccactgcttcactgattctgctgtggaaggtcacagctactggctttcaacagtgttctctgattgacgggcgctccgtcactcccctgcaggcaagtggcgggcttgtgctgttggaggagatgctggccctcgggaacaaccatttcatcggatttgtcaacgactcagtcaccaagagcatcgtagcactgcggctcacactcgtggttaaagtgtcaacatgcgtgccaggcgaatcccatgccaacgacctcgagtgttccggcaaagggaaatgtactacaaaacccagtgaggcaactttcagctgcacttgtgaagaacagtatgttggcacattttgcgaagagtacgacgcatgccagagaaagccatgccaaaataacgctagctgcatcgacgctaacgagaagcaggacgggagtaacttcacatgtgtctgtttaccgggatatactggtgaactctgtcagtcaaagattgattactgtattctggacccttgccgtaacggcgctacctgtatttcttcactgagcggattcacctgtcagtgccctgagggatatttcggtagtgcatgtgaggaaaaagttgacccttgtgccagctccccatgtcagaacaatggaacttgctacgtggacggagtccatttcacctgtaattgttcgcccggctttacaggcccaacgtgtgctcagctcatagatttttgtgccctgagtccatgtgcacacgggacctgcaggagtgtgggcacctcctacaagtgcctgtgtgaccctggctaccatggcctgtattgtgaggaggagtacaacgagtgcctgtccgctccatgcctgaacgccgctacctgtcgagacctggtgaatggatatgaatgcgtgtgtctggcagagtacaaagggacacactgcgagttgtataaggatccctgcgctaacgtgtcgtgcctcaatggcgccacttgtgacagtgatggactaaatggaacgtgcatctgcgcacctggattcacaggggaagagtgcgatatagacatcaacgaatgcgactcaaacccgtgtcaccacggtggtagctgcctcgaccaacccaatgggtataactgccactgccctcatggctgggtgggcgccaattgtgaaatccacctccagtggaagagcgggcatatggcagagtctttaaccaacatgcctcgccattccctctacataattatcggagctctgtgcgtggccttcatacttatgcttatcatcctgatcgtcggcatttgccgcatctcacgaatcgagtaccagggttcaagtaggcctgcttacgaggaattttataattgtcgctcaatcgactccgaatttagcaatgccattgcctctatacggcatgccaggtttggcaagaagagtcgcccagccatgtacgatgtgtctcccattgcgtacgaagactattctcccgacgacaagcccctagtgaccctcatcaagacaaaggatctgtag

SEQ ID NO: 114355 - DNA, 1368 bp, Artificial Sequence
  Description of Artificial Sequence: Synthetic coding sequence
atgttggctctgggtaataatcatttcatcggatttgtgaacgatagtgtgacaaagtccatcgtggccctgaggctgaccctggtcgttaaagtatccacctgtgtcccaggagagtcacacgccaatgatctggaatgctcaggcaagggaaaatgcacaaccaagcctagtgaagctaccttctcatgtacttgcgaggagcagtatgttggcacattctgcgaggagtacgatgcttgtcaaagaaagccatgccagaataacgcatcttgtatcgatgccaatgagaagcaggatgggagtaatttcacttgtgtgtgcttgcctggttatacaggagaactttgtcaatctaagatcgattactgcattttggacccctgtcggaatggtgccacatgcatcagtagtctgagcggatttacctgccagtgtcctgagggatattttggctcagcctgtgaggagaaggtcgatccatgtgcttctagcccctgtcaaaacaatggcacctgctgctcccctggattcacaggccctacttgtgcacagttgatcgacttctgcgccttgtcgccctgtgctcacgggacttgtaggtctgtaggaacatcctataaatgcctgtgcgaccctgggtaccatggcttgtattgcgaggaggaatataacgagtgcctgtccgctccatgtcttaacgctgcgacctgcagagatttggtcaacgggtatgagtgtgtctgcttggctgaatataagggcacccactgtgaattgtacaaggatccatgtgcaaatgtatcctgcctgaatggggctacctgtgattcagatggactgaacggtacctgcatctgtgccccaggctttactggggaggagtgcgatatcgacattaatgaatgtgactcaaacccctgccatcacggaggtagctgtttggatcaacccaacgggtacaattgccactgccctcatggatgggtcggcgccaattgcgagattcatttgcagtggaagtcaggacacatggcggagagcctcaccaacatgcctcgtcactccttgtacatcattatcggggccctctgcgtggctttcatcctaatgctgatcatcttaatcgtagggatttgccggatttctcggattgagtaccagggctcttctaggccagcttatgaggagttctataattgcaggtccattgactcagaattttcaaatgctattgcctcgatccgccatgcacgctttggaaagaaaagccgccccgccatgtacgatgtctctccgatcgcttacgaagactattctcccgatgacaagcccctagtgacacttattaaaacaaaggatctctag

SEQ ID NO: 114356 - DNA, 933 bp, Artificial Sequence
  Description of Artificial Sequence: Synthetic coding sequence
atgacggccacagaggcacttctcagagtactgctgctcctactggcctttgggcatagtacttacggagctgagtgctttcctgcatgcaacccccagaatggcttttgcgaggatgataatgtgtgcagatgccagcccgggtggcagggtcccctttgtgaccagtgtgttaccagtcccgggtgcctccacgggctgtgcggggaacctggtcaatgcatctgtactgatggctgggacggggagttatgcgatagagatgtgcgcgcttgtagtagcgccccctgcgcgaacaacagaacctgtgttagcttagacgatggcttgtacgaatgttcttgcgcccctgggtactcaggaaaggactgccagaagaaggacggaccctgtgtcatcaatggatccccctgccagcacggcggaacctgcgttgatgacgagggccgcgcaagccatgcgagttgtctctgccctcctgggttcagcggcaatttctgtgaaattgtcgccaatagctgcacccctaatccctgcgaaaacgatggggtgtgtaccgatattggcggcgattttcgttgtcggtgccctgcaggctttatcgacaaaacatgcagtcgtcccgtcacaaactgcgccagctccccctgccagaacggaggcacctgcctgcagcacacccaggggcaggccatctgttttactattttaggtgtgcttacaagtttagtggtgcttgggactgtcggtatcgtgttccttaacaagtgcgagacatgggtcagcaacctgaggtacaaccacatgcttaggaagaagaagaacctgttgctgcagtataatagcggagaggatttggccgttaatatcattttcccagagaaaatcgatatgacaaccttctctaaggaagccggagatgaggaaatttag

SEQ ID NO: 114357 - DNA, 1152 bp, Artificial Sequence
  Description of Artificial Sequence: Synthetic coding sequence
atgaccgcgacagaggctttgttgagagtcctcctgctcctcctagctttcggccattctacatatggagctgagtgtttccccgcgtgtaatccccagaatggcttctgtgaagatgataacgtctgcagatgccagccaggatggcaggggcccttgtgcgatcaatgtgttacaagccctggctgcctccatgggctttgcggcgaacccggtcagtgcatctgcactgacggttgggatggagaactttgtgaccgtgacgtccgggcttgttcatccgcgccttgcgcgaacaataggacatgcgtcagcctggacgacggcttgtacgaatgtagttgtgctcccggctacagcggaaaagactgccaaaaaaaggatggcccatgcgtgatcaacggctcaccttgtcaacacgggggcacttgcgtggacgatgaaggccgggcgagccacgctagctgcctgtgccccccaggattctccggcaacttctgcgagatagtggccaacagctgcaccccaaacccctgtgaaaacgacggggtttgtacggacattgggggtgacttccgttgcaggtgccccgccggattcatcgataaaacgtgttcacgcccagtcacgaactgtgctagctccccttgtcaaaacgggggtacatgcctccagcacactcaggtttcttacgagtgtctatgtaagcccgagttcaccggcctgacttgtgttaaaaaacgcgcgctcagcccccagcaggtgacaagattaccgagcggatatggcctcgcatatcgtctaacacccggtgtgcacgaactgcctgtgcagcagcctgagcatcggatattaaaagtaagtatgaaggagcttaacaaaaaaacaccactcctgaccgagggccaggctatatgctttacaattctcggagtcctgaccagcctcgtcgtcctgggcactgtgggaattgttttcttgaataagtgtgagacgtgggtgtcaaacctccggtataaccacatgttgcgtaagaaaaagaaccttcttttacagtacaattcgggggaagatctagcggtaaatataatctttccggaaaaaatcgatatgaccacctttagtaaagaagccggcgacgaagagatctag

SEQ ID NO: 114358 - DNA, 294 bp, Artificial Sequence
  Description of Artificial Sequence: Synthetic coding sequence
atgaccgcgacagaggccctgctccgggtgctcctactcctgctggcctttggccactcaacctacggggctgagtgctttccagcctgcaatccacagaatggcttctgtgaagacgataacgtttgcaggtgtcagcccggctggcagggccccctgtgtgaccagtgcgtcaccagcccagggtgtctacacggcttgtgtggggaaccgggacagtgcatttgcacagacgggtgggacggggaactatgcgatcgggatgtccgggcttgctccagcgccccctgctag

SEQ ID NO: 114359 - DNA, 3612 bp, Artificial Sequence
  Description of Artificial Sequence: Synthetic coding sequence
atggcggcctgtggcagagtaagacggatgttcagactgtccgccgctctgcatcttttgttgctattcgcagccggtgccgaaaagttgccaggacagggggtacatagccaggggcaagggccaggggctaatttcgtgagttttgtgggccaggctgggggaggcggacccgcagggcagcaactgccacagctgccacagtccagtcagttacagcagcagcaacagcagcagcagcagcaacagcagccccaaccgccccagcctccgttccccgcaggggggccccctgctcgccgggggggagcgggtgcaggcggcggttggaagctggcagaggaggagagttgcagagaagatgtgacacgagtctgccccaaacatacctggtcaaataatttagcagtcctggagtgtctgcaagacgtgagggagcctgagaacgagatcagctctgattgcaatcacctgctgtggaactacaagctaaatcttacaactgaccctaagtttgagagcgtggcaagagaagtctgcaagtcaaccattaccgaaattaaggagtgcgctgacgagcccgtggggaagggatacatggtgtcatgcctggtagaccatagaggcaacatcactgaataccagtgccatcagtatataacgaagatgactgcaatcattttctcggactatcggctgatttgtggcttcatggatgattgtaagaacgacataaacattctgaaatgcggctccatacggttgggcgagaaagatgcccatagtcagggagaagtcgtctcatgtctggagaagggtctcgtgaaggaggctgaagaacgcgagccaaagattcaggtttctgaactgtgtaaaaaggccatactgcgcgtggcggagctgtcttccgacgatttccatttggatcgacacctctacttcgcctgcagggacgatagagagcgcttttgtgaaaatactcaggcaggggaaggtcgggtctataaatgcctgttcaatcataagttcgaggagtccatgtcagaaaaatgcagggaagccctgacaacccggcagaagctgattgcgcaagattataaggttagttacagtcttgctaaaagctgtaaatccgacctgaagaagtatcgttgtaatgtggagaacttacctcgctcaagagaggcccggctatcttacctgctgatgtgtcttgaaagtgccgtgcaccgaggcaggcaggttagctccgagtgccagggcgaaatgttagactatcggaggatgttaatggaggatttctccctgagtccagagattatactgtcttgccgtggggagattgaacaccattgttccggcctccataggaaggggcgtactcttcattgcctgatgaaggtggtcaggggagagaaaggcaatctcggaatgaactgccaacaggcactgcaaactctgattcaagagactgaccctggcgctgactacagaattgatcgggccctcaatgaggcttgcgagtcagtgattcagacggcttgcaaacatattcgcagcggagatcccatgatcctgtcgtgcctgatggagcacctgtacactgaaaaaatggtggaggattgcgaacaccgcctgctggagctgcagtacttcatatcaagagactggaagctagatcccgtgttataccgcaagtgccaaggtgacgcatctcggctctgtcacacccacggctggaacgaaacctcagaatttatgccgcagggggctgttttcagttgtctgtatcgacatgcttatcgcactgaagagcaagggcgtcggctgagccgcgagtgccgggccgaagtacaaaggattctgcaccaaagagcaatggatgtgaaactggatcctgccctgcaagacaagtgcctgatagacctaggcaagtggtgtagcgagaagacagaaaccggacaggagctggagtgtctgcaggatcaccttgacgatttggtggtggaatgtagggacattgtggggaacctcacggaactggaatcagaggatattcaaattgaggctctcctaatgagagcttgcgagccgattatccagaacttctgccacgatgtcgccgataatcagattgattcgggagatcttatggagtgccttattcagaacaagcatcagaaggacatgaacgaaaaatgcgcaattggcgtgacccactttcagttagttcagatgaaggatttccggttctcttacaagtttaagatggcatgcaaagaagatgttctgaagctctgccccaacattaaaaaaaaagtggatgtggtgatttgcttgagtacgactgttcgaaatgacacccttcaagaggctaaggagcatcgtgtcagtcttaaatgccgtaggcagttgagggttgaggagctggaaatgaccgaggatattagattagaacctgatctgtacgaagcctgtaaaagtgatatcaaaaacttctgttctgccgttcaatacggaaatgcccagattatcgagtgcctgaaggagaataaaaaacagctgtctaccaggtgtcaccaaaaggtctttaaactgcaggaaacagagatgatggacccggagttggattacacactgatgagagtctgtaagcagatgattaaaaggttttgtccagaggctgactcgaagaccatgttgcaatgcctgaaacaaaacaaaaacagcgaactgatggatccaaagtgtaagcagatgatcaccaaacgccagattacgcaaaacactgattaccgactcaacccaatgttaaggaaagcatgtaaagccgatatccctaagttctgtcatggcattcttacaaaggccaaggatgacagcgaactcgagggacaggtgatctcctgtcttaaactcagatatgcagaccagcggctttccagtgattgtgaggaccaaatcagaatcattatacaggagtccgcgctggactaccggctcgacccccaactgcagctccattgctccgatgaaatatcatccttgtgcgcagaggaggccgcggcacaggaacaaaccggccaggtggaagaatgcctgaaagtgaacttgctgaagatcaaaaccgaactctgtaaaaaagaagtgctgaatatgcttaaagagagcaaggctgacatcttcgtggacccggtcctccataccgcctgtgcccttgatatcaaacaccactgcgcagccatcactccaggcagaggacgacagatgagctgtcttatggaggcgttggaagataaacgtgtgagactccagccggagtgcaaaaagcgactgaacgacagaatcgaaatgtggtcgtatgcagcgaaagttgcccctgcagacggcttctctgacctggcaatgcaggtcatgaccagtccaagcaagaactacattctgagtgtcatatctgggtctatatgcattctgttcctgattggcctgatgtgtgggaggattaccaaacgagtgacccgcgaactcaaggataggctgcagtatagatctgaaacaatggcttataaaggtcttgtctggagtcaggacgtgacgggcagccccgcttag

SEQ ID NO: 114360 - DNA, 1764 bp, Artificial Sequence
  Description of Artificial Sequence: Synthetic coding sequence
atggtgtctcctcgcatgtctggactgctttcgcagacggtcattttggctctaatctttcttccccagacacggcctgctggggtgtttgagctacagatacacagctttggaccaggacctggtcctggcgcccccaggtccccttgtagcgcaaggcttccttgccgtctgttcttccgcgtctgcctgaagcctggtctctccgaagaagctgccgagagcccatgtgcattgggagccgcactatccgcccgaggcccagtgtacactgagcagcccggggccccagccccagacctgccattgccggatggcctactgcaggtgcctttccgcgatgcttggccaggcactttcagctttatcatcgaaacatggcgagaggagcttggagatcagattggcggacctgcctggagcctactcgccagggtggccggccggcggcgtctggccgctggcgggccatgggccagagatattcagagagccggagcttgggagctgaggttctcttaccgggctagatgtgaaccccctgccgtgggaaccgcgtgcaccaggctgtgccgtccccgctctgcaccttctcgctgcgggccgggattacgcccatgtgctcctttggaagacgagtgtgaggccccattagtgtgtcgcgcagggtgtagcccagagcatgggttctgtgaacagcccggcgaatgtcggtgcctcgaagggtggactggaccactttgtaccgtgcctgtgtcgaccagctcctgtctgtctccccgcggaccatcttctgccactactgggtgcctggtccccggaccagggccgtgtgacggaaatccatgtgctaatggtggctcctgctctgagacacctcgatcattcgagtgtacctgcccaagagggttttatggcctgaggtgcgaggtgtcaggcgtgacctgtgccgacggcccgtgctttaacggaggactatgcgtaggaggcgccgatcccgattcagcgtacatttgtcattgcccccccggctttcagggctccaattgtgagaagcgtgtggatcgatgctccctgcagccgtgccggaacgggggactctgtctggatttgggacacgcgctgcgctgcagatgtcgcgccggatttgccgggcctcgctgcgagcacgacctcgatgactgcgctgggagggcatgtgccaacggaggtacctgtgtggaaggtggaggagcacacagatgcagctgcgccctaggcttcggcggacgggactgccgggaaagggcagacccctgcgccgcacgcccctgtgcccacggtgggcgatgttatgcccactttagcggactggtttgcgcatgtgcccccggctatatgggggcaaggtgtgaattccctgtccacccggatggggcgtctgccctcccagccgccccccctgggttgaggcctggcgatcctcagaggtatttacttcctccagccctggggttgctcgtcgcagcaggcgtggctggagccgctttgcttctggtacacgtgcggagacggggacactctcaagatgcaggctctagactcctcgctgggacccccgaaccttctgtgcacgctcttccagatgcactgaacaacctgcgaactcaggaaggctccggcgacgggccctctagctctgttgattggaacagacccgaagatgtggaccctcagggaatatacgtgatatccgctcctagcatatatgcacgtgaagcatag

SEQ ID NO: 114361 - DNA, 2058 bp, Artificial Sequence
  Description of Artificial Sequence: Synthetic coding sequence
atggccgccgcctcgcgctcagcgagcggttgggccctactcttgttggtggcactttggcagcagagggcagccggaagtggcgtatttcagctgcagctccaggaatttatcaatgagagaggcgtacttgcctcgggtagaccctgcgagccgggctgcaggacgtttttccgagtgtgcctaaagcacttccaggctgtcgtatctccgggcccttgtactttcgggactgtgtcaactcctgttctgggcacaaatagtttcgctgtgcgcgacgattcaagcgggggcggacgtaatccgctccagctgccattcaactttacctggcccggaacatttagtctgattatcgaagcttggcacgctcctggcgacgacctccggcccgaggccctgcctcccgatgctttgataagtaagatcgcaatacaggggtcactggcggtcggccagaactggttactggacgaacagacttccaccctgaccagattgagatattcttacagagttatatgttctgacaattattatggagacaactgcagccgcctgtgcaagaagagaaatgatcacttcggacactatgtgtgtcagcctgatggcaacctcagttgtctacccgggtggacaggtgaatactgccagcagccaatttgcctctctgggtgccatgagcaaaacggctactgtagcaagccggcagagtgtctttgtagacccgggtggcaaggtcgtttatgtaatgaatgtatcccccacaacggctgtaggcatgggacatgcagcacgccttggcagtgtacttgcgacgaggggtgggggggcctgttctgtgaccaagaccttaactattgcactcatcacagcccgtgcaagaatggggctacatgttctaattccggacagcgatcttacacatgtacctgtcgccccgggtacacaggagtcgactgcgaacttgaactgtctgagtgtgacagcaatccctgccgcaatggaggctcctgcaaggatcaggaggacggatatcactgcctatgcccgcctggctattacgggctgcattgtgaacatagtacacttagctgtgccgattcaccttgtttcaacggaggctcctgtcgcgagcggaatcaaggcgccaactacgcatgtgagtgtccgcctaatttcaccggcagcaattgtgaaaagaaggtggacaggtgcacttccaacccctgcgccaatggaggacagtgtctgaaccggggcccttcacgcatgtgtaggtgtcgtccgggtttcaccggtacctactgcgaactgcacgtgtcagactgtgcgcggaacccttgcgcccacggcggaacttgtcacgacctggagaacggtctgatgtgcacctgtcctgctggcttttctggacgccggtgcgaagttcgtacatctattgatgcctgcgcctctagcccatgttttaatcgggctacatgttacaccgatctttccaccgatacatttgtctgtaattgtccttatggatttgtggggtcacgctgcgagtttcccgttggccttcccccttcttttccatgggtggccgtgtccctcggggtggggttagccgtgcttttggtgctgctgggaatggttgccgtcgctgtgcgccaactccgcctgcgcagaccggatgacggctctagagaggctatgaacaatttgagcgacttccagaaggataacttgatcccagccgctcagctgaagaatacaaaccagaaaaaagagctggaagtggattgcggtctggacaagtccaactgcgggaaacaacagaaccatacactcgattacaatctggcgcctggcccgctggggcgagggacgatgcccggtaagttccctcacagcgacaagtccctgggggaaaaagccccgctacggctgcattcggagaagccagagtgcagaatttctgcaatttgctctcctagagacagcatgtaccagtccgtctgccttattagcgaagaacggaacgagtgtgtgattgcaaccgaagtctag

SEQ ID NO: 114362 - DNA, 2223 bp, Artificial Sequence
  Description of Artificial Sequence: Synthetic coding sequence
atggcttcacatctgaggccgcctagcccgctcctggtccgagtgtacaagagcgggccacgggtccgcaggaaacttgagtcctatttccagtctagtaaaagtagcggcgggggtgagtgcacagtctcgacccaggaacacgaggcgcctgggacgttccgagtcgagttctcagagagggcagcaaaagaacgagtgctcaagaagggagagcaccagatcttagtggacgagaaaccagttccaatctttctcgtgccgaccgagaatagcatcaagaaaaacacacgacctcaaatcagtagcctcacacagagccaggcggagacgcctagcggggacatgcatcagcacgaggggcatatccctaacgcagttgattcttgcctgcagaaaatatttctaacagtgacagctgacctgaattgtaatctgttttccaaggagcagcgtgcatatatcacaaccctatgtccatctattcgcaaaatggaaggtcatgatgggatcgaaaaggtctgcggagatttccaggatattgagcgaatccatcaattcctgtcagaacagttcctcgagtctgaacagaagcagcagttcagtccatcgatgacagagcgcaagccgctgagccaacaggagagggatagttgtatctctccgtctgaaccagaaactaaagccgaacaaaagtccaattatttcgaggtcccactaccatacttcgagtactttaaatatatatgccccgataagataaattctattgagaagagatttggtgtgaacatcgagatccaggaatccagtcccaacatggtttgcctcgacttcactagtagcagatctggcgatctcgaagcggccagagagtctttcgcaagtgagttccagaagaacacagaaccactaaagcaggagtgtgtaagcctggcggactccaaacaggccaacaagtttaaacaggaattgaaccaccaattcacaaaacttctgattaaagaaaagggcggagagcttaccctgctgggaactcaggatgacatcagcgcagccaaacagaagattagtgaagccttcgtaaagatcccagtgaagctgtttgctgctaattacatgatgaacgtgattgaggtggactccgctcactacaaattattagagacagagctgttacaggaaatttctgagatcgaaaagcgttacgatatctgtagcaaagtcagcgagaagggccagaagacatgcattttattcgagagcaaggatcgccaggtggatctaagtgtacatgcgtatgcttcattcatagacgccttccaacatgctagctgtcagctaatgagggaggttttgctgcttaaatccttaggtaaagaaaggaagcacctccaccagacaaagttcgctgacgattttaggaagcgccatccaaatgtgcacttcgtacttaatcaggagagtatgacactgacaggcctcccgaaccatttagctaaagcaaagcagtacgttttgaaaggtggcgggatgagttcactggccggaaaaaagctaaaagaagggcacgagactcccatggatattgacagtgacgattccaaagccgccagccctccgctcaagggctctgtgtctagtgaagctagcgagctggataagaaagaaaagggaatctgtgtcatctgcatggacacaatctctaacaagaaggtcctgccgaagtgcaaacacgagttttgcgccccgtgtataaacaaagccatgtcctacaagcctatctgtcctacctgccagacatcttacggcatccagaagggcaaccagcctgaggggagcatggttttcacagttagcagagatagcttgccaggatatgagtcgttcgggactattgtcatcacttactccatgaaggctggcatccagactgaggaacatcctaatcccggaaaacgctaccccgggatccagagaactgcctacctgccggacaataaggagggtcgaaaagtgctcaaactgctctatagagcattcgatcagaagctcatttttactgttggctattcccgcgtcctgggagtgtccgacgtcatcacctggaacgatattcaccacaagacctccagattcggggggcccgagatgtacggctacccagatccatcttatctgaagagggtgaaagaggaactgaaggccaagggtatcgaatag

SEQ ID NO: 114363 - DNA, 1863 bp, Artificial Sequence
  Description of Artificial Sequence: Synthetic coding sequence
atgtcgagaccaggccatggaggcctgatgcctgtaaacgggctcgggtttcctccccaaaacgtcgcacgagtcgttgtatgggaatggctcaatgagcattctaggtggcgaccgtatactgcgacagtttgccaccatattgagaatgtgctgaaggaggatgcccgcgggagcgtggttctgggtcaggtagatgcccagctagtgccttatatcattgatctacagtcgatgcaccaattccggcaggacacgggcaccatgcgccctgtgcgtaggaatttctacgatccgtcatcagctccaggcaagggaatcgtgtgggagtgggaaaacgatggaggcgcctggacagcctacgacatggatatttgcatcacaatccagaacgcctatgagaagcaacatccatggctagacctatcttccctggggttctgttacttgatctacttcaattccatgtctcaaatgaataggcagaccaggagacgccgtcgccttagaagacgcctggatctggcatacccactgaccgtaggaagcattccgaaaagtcagtcctggcctgtcggagcatcttcaggccagccttgttcatgtcagcagtgtctgctggtcaatagcacccgggccgctagcaacgctatcctggccagtcaaaggaggaaggccccaccagccccgccgttgcctccacctccgccccctggaggaccccccggagccctagctgtaaggcccagcgccacctttaccggtgcggctttatgggccgcaccagcagcaggaccagcggagccagccccaccccccggcgcgccgcctcgcagcccaggtgccccgggaggcgcccggactccaggacagaataatctgaataggccaggcccccagcggaccacctctgtctcagcccgtgcttctattcctcccggcgtcccagctctgccagtgaaaaatctgaatggcacaggcccagtacatcccgccctggccggtatgaccggaatcttgctttgcgccgcaggcttacccgtatgtttgaccagagcccctaagccaatccttcatccgccccccgtgtctaagtcagatgttaaacctgtgccgggggtccctggggtttgcagaaaaaccaaaaaaaagcacctcaagaagagtaaaaaccccgaagacgtggtccggagatacatgcagaaagtcaaaaaccccccagatgaggactgtactatctgtatggaacgtctcgtcacagcttctgggtacgagggcgtgttgagacataaaggggttcgccccgagctcgtgggccgactgggacggtgtggccatatgtaccatttgctgtgtttggttgcaatgtactcgaatggcaacaaggacgggtccctgcagtgcccaacctgcaaggcaatttatggagaaaaaacaggcactcagcctcctggtaagatggagttccatctgattccccattccctgcctgggtttcccgatactcagaccatccgcatcgtgtacgacatcccaaccggcattcaggggccggaacacccgaaccctggcaaaaagtttacagcacgcggcttccctcgccactgctatctgccaaacaatgagaagggaaggaaggtgctaagactgctaatcacagcttgggagcggagactaatctttactataggaactagcaataccaccggcgaatccgacacggtggtttggaatgagatccatcacaagaccgagttcgggagcaacctgaccggacacgggtatcctgacgcctcatacctcgacaatgtgctggcagagctcactgcccaaggggtcagcgaggcagcagccaaggcatag

SEQ ID NO: 114364 - DNA, 1044 bp, Artificial Sequence
  Description of Artificial Sequence: Synthetic coding sequence
atgtccttcgtcctgtcaagaatggccgcctgtgggggcacatgtaagaataaagtaaccgtatccaagccagtgtgggacttcctttccaaagagacacccgcacgacttgctagactgagggaggaacaccgggtatcaattctgatcgacggcgaaacctctgacatttatgttctgcagttatccccccaggggccaccccccgcgcctccgaatggtctatacttggccagaaaagccctgaaagggctcctgaaagaggcagagaaggaactaaaaaaggctcagaggcagggcgagctcatgggctgtctggcactgggcggcggcggcgagcatccagagatgcatagggctggcccaccccccctcagggcagcccccttgcttccgcccggagccagaggactgcccccaccacctcctcctctcccaccccccctgcccccccgcctcagagaggaggctgaagagcaggaatccacatgtcctatctgcctcggagagatacaaaacgccaagaccctggagaaatgccggcatagcttttgcgaaggctgtattactcgggccctgcaagtaaagaaagcatgtccgatgtgcgggaggttctacggccagctggtcgggaatcagccacaaaatggacgtatgctcgtctccaaggatgccactctcctgcttccatcatacgagaagtatgggacaatcgtgattcaatatgtgttccctcccggggtgcaaggtgccgagcatccaaaccccggcgtgcgatatcctgggacaacaagagtcgcttacctccctgactgtcccgaaggtaataaagtactgaccctgttccgtaaagcttttgaccagcgactaacttttacgattggaacctcaatgaccaccggacggcctaacgttatcacctggaacgacatacaccataagacgagctgcactggcgggccccaattgtttggataccccgaccccacctatctgacacgggttcaagaggagttgcgagccaaaggcatcacagacgactag

SEQ ID NO: 114365 - DNA, 1044 bp, Artificial Sequence
  Description of Artificial Sequence: Synthetic coding sequence
atgtctttcgtattgagcagaatggctgcttgtggcggaacctgtaagaataaagttactgtgtcgaaacccgtgtgggactttctttccaaggagactcccgcacggttagcaaggctgcgcgaagagcaccgtgtgtcaattctgattgacggcgagactagtgatatatacgttctccagctctcaccccaaggacccccccccgctccccctaacggcttatacctcgcaagaaaggccttaaagggtctactgaaggaggctgagaaagaattgaaaaaggcgcagcggcagggagagctgatggggtgtctggccctaggaggcggcggtgagcatccagagatgcaccgcgccggtcccccaccgttaagagccgcaccattgcttccccccggagctagaggtttgcccccccccccacctcccctcccccctccactgccgccccggcttcgggaggaagcagaagaacaagaatccacgtgcccaatatgtttgggtgagattcaaaacgccaagacactcgaaaagtgtcgtcattcattctgtgagggctgtatcactcgggccctacaggtgaagaaggcctgtcccatgtgtggacgattttacggacagttggttggaaaccaaccacagaacggccggatgttggtgagcaaggatgccacgctgctactcccatcctacgaaaaatatggtacaattgtaatacagtacgtgtttcccccaggtgtgcagggtgcagagcaccccaacccgggagtgcgatacccgggaacaacacgcgtggcttacctgccagactgccccgagggaaacaaggtgctgacactgtttcggaaggccttcgatcagaggctaactttcaccattggcacgagcatgactactggacgaccaaatgtaataacctggaatgacattcaccataagaccagctgcacaggtggaccacaactgttcgggtacccagaccctacctatcttacgcgagtgcaagaggagctacgggccaagggtatcaccgatgattag

SEQ ID NO: 114366 - DNA, 1044 bp, Artificial Sequence
  Description of Artificial Sequence: Synthetic coding sequence
atgtcattcgttctcagtcgtatggcagcttgtggaggcacctgcaagaacaaggtgactgtatccaaaccagtatgggacttcctgagtaaggagactcctgcgcgcctggctcgattgcgtgaggagcatcgagtgtctatactcattgatggagagacctcagatatctacgtgctgcagttgagcccccaaggcccacctcctgcgcctcctaatggactatacctggccaggaaggctctgaaaggactgttaaaagaggctgagaaggagttgaagaaagcacagcgacagggtgagttaatggggtgtctggcgctaggaggcggaggagaacatcctgagatgcaccgagccggaccaccacccctgcgggccgccccactgcttccaccaggagcaaggggcttaccacctccacccccgccattaccgcccccacttcccccaaggctgcgggaagaggccgaagagcaggagagcacctgccccatctgcttaggcgagatccagaacgccaagacgctcgagaagtgtaggcattcgttttgcgagggttgcattacaagggccctccaagttaaaaaagcttgtccaatgtgtggacgcttctacggccagcttgtcggtaatcagccgcagaatggaaggatgctggtatctaaggacgccacactgcttcttccttcttacgagaagtatggcactattgtgatccagtacgtcttcccaccaggagtgcaaggggctgaacatcccaatccaggcgtgcggtatccaggtactacccgggttgcttatttacctgattgccccgagggcaacaaggtgcttaccctgtttagaaaggccttcgaccagcgactgacatttaccattgggacttccatgacgaccggccgacctaacgtcattacctggaacgacattcaccataaaaccagctgtactgggggtccacagctcttcggatacccagaccccacttacctcacgcgtgtccaggaagagctaagagctaaagggatcactgacgattag

SEQ ID NO: 114367 - DNA, 615 bp, Artificial Sequence
  Description of Artificial Sequence: Synthetic coding sequence
atgcccatcctgagcagttccggctccaagatggccgcctgcggagggacctgcaaaaataaggtcacagtgagcaagcctgtatgggattttctgtccaaggaaacaccggcccgcctggcacggcttagggaggaacatagagtaagtatcctgatcgacggcgagaccagcgacatctacgtgctgcaactgagcccccaaggacccccacccgctccaccaaatggcttgtacttagcccgcaaggcactcaaaggacttctgaaggaggctgaaaaagaactaaagaaagcgcaacgccagggagagctcatgggatgtctggctctgggaggaggtggagaacaccctgagatgcatagagctgggccaccgcccctacgagcagccccactgttgccacccggggctcgtgggctccccccccccccccctccactgcctcctccactccccccccgccttcgcgaagaggccgaggaacaagagtcaacctgtcctatctgccttggagaaattcaaaacgcaaagaccttggaaaagtgccgccatagcttctgtgaagggtgtattacacgggccttgcaggtgaagaaggcatgtcccatgtag

SEQ ID NO: 114368 - DNA, 24 bp, Artificial Sequence
  Description of Artificial Sequence: Synthetic coding sequence
atgccaatattgagctcttcctag

SEQ ID NO: 114369 - DNA, 1053 bp, Artificial Sequence
  Description of Artificial Sequence: Synthetic coding sequence
atgcccatactctcctcgtcgggatctaaaatggctgcgtgcggcggcacctgtaagaataaggtgacagtctccaaaccagtttgggatttcctgagcaaggagacacctgctagactggctaggctgcgtgaggagcaccgcgtgtctattctcatcgatggcgaaaccagtgacatatacgtgctgcagctctcacctcaaggtccaccaccggcccctccaaacggcctgtacctcgccaggaaggcccttaagggcctgttaaaagaggccgaaaaagagttaaagaaggcgcagaggcagggagagttgatgggttgtctagcgctggggggtggcggggaacatcctgagatgcatcgtgcaggccccccacctctgcgggcagccccactgctgccccccggagcacggggtctgccccccccaccaccccctctccctcctcctctgcctcccagattacgagaagaggccgaagagcaggaaagtacttgccccatttgcctgggcgaaattcagaacgccaagactttagagaagtgccgccactcgttctgcgaggggtgcatcacgcgggctctgcaggtgaaaaaggcctgtccaatgtgtggaagattttacggccaactagttggtaaccaacctcaaaacgggcgtatgctggtctctaaggatgcaaccctgctacttccttcctatgagaagtatggcaccattgttatccagtacgtgtttccacctggggtgcaaggtgccgagcaccctaaccccggggtgcggtatccaggaaccacccgcgtggcttatctgcccgactgtcctgaggggaacaaggttctgacgttgttccggaaagcttttgatcagcgactgacctttacaatcggaacaagtatgactactggccggcccaacgtgataacatggaatgatatccatcacaagacatcctgtacaggcggaccccagcttttcgggtacccagacccaacctatctgacccgcgtgcaggaggagctaagggcaaaaggcatcaccgacgattag

SEQ ID NO: 114370 - DNA, 150 bp, Artificial Sequence
  Description of Artificial Sequence: Synthetic coding sequence
atgagcttcgtcctgagccggatggctgcctgcggcggaacgtgcaaaaacaaagtgaccgtctcaaaaccagtctgggacttcctcagcaaagagactccagcaaggcttgcaagactacgcgaagagcatagagtgtcaatcctgtag

SEQ ID NO: 114371 - DNA, 2136 bp, Artificial Sequence
  Description of Artificial Sequence: Synthetic coding sequence
atgctggacggtccactcttttccgaggggcctgactctcctcgcgaactgcaggatgaagagtcaggtagctgtctctgggtgcagaagtcaaagctgctggtgatcgaggttaagacaattagttgtcactatagcaggcgcgctccatctaggcagcctatggatttccaggcaagccattgggcccgggggtttcaaaaccgcacctgtggccccagacctggaagtccccagccccctcccagaaggccttgggcttcgagagtcttgcaggaggccacgaactggagggccggccccctggccgaggttagggcgcgggagcaggaaaaacgtaaagcagccagtcaggagcgggaagccaaggaaacagagagaaagcggaggaaagcgggaggcgcaaggcgaagccctccaggtcgccctaggcctgagccgcgtaatgcccctagggttgcccagctggcagggctgcctgcaccgcttcgcccagaaagactcgcaccagtgggccgcgccccccggcctagcgcccagcctcagtctgatccagggtcggcttgggctgggccctgggggggtcggaggccaggccctccaagttacgaggcacatctcctcctcagagggtcagccggaactgccccaaggagacgctgggaccgaccccccccatatgtggcccccccatcttacgaggggcctcacagaaccctaggcaccaagcggggacccggtaatagccaagttcccacatcctcagccccagcagcaacccctgcccggacggacggcggaagaaccaaaaaaaggctcgacccaagaatatatcgcgacgtgcttggagcttggggcctgaggcaaggacagggccttctgggggggagccctggttgtggagccgcaagagcgaggcctgaaccgggaaagggtgtggttgaaaaatctttggggctcgccgccgcggacctgaattcaggatccgactcccatccacaggcaaaagcaaccggcagcgcaggtacagaaatcgctcccgccggctccgccaccgctgcaccttgtgctcctcacccagccccaagaagtcggcatcatctgaagggatcacgcgaagggaaagagggggaacagatctggtttccaaagtgttggattccctcccctaagaagcagcccccccgccattcccagacactgcctcggccttgggctccaggaggcactggctggcgtgaaagtctcggcctaggagagggcgctgggcccgaaactttagaggggtggaaagccactcggcgagcacatactctgcctcgcagcagtcaaggactgagcaggggagagggcgtgttcgtgattgacgcaacgtgtgttgtgataaggagccagtacgtgcctacacccaggacacaacaggtgcagctcttgccctctggggtgacaagagttgttggagattcaccctcacagagcaagcctggcaaagaggagggtgaaggagccactgtgtttccctcaccttgtcaaaagcgcctgtcatcttcacggctgctccaccagccagggggcggaaggggaggtgaagctgagggcgggcgccctggcgacagcactctagaagagcgcacatttaggattctgggcttgcccgcgccagaggtgaatctgagggatgcacccacccagccaggtagtcctgaacaccaggccttggggccggctgcgagcggcgcgcaaggccgcgccgaagggtccgaagttgctgtggttcagaggcgggcaggccgaggctgggccaggactccgggaccttatgcaggggccttaagagaagccgtgtcccggattcggaggcacactgcccctgacagtgatactgatgaggcagaggaactgagcgtgcattcaggaagtagtgatggatctgacactgaggcgccaggtgcttcatggcggaacgaaaggaccctccctgaggtgggcaattcctcgcccgaggaagacggtaaaaccgcggaactgagtgattccgtgggcgaaatactcgatgtcatctcacagaccgaagaagtactgttcggagtgagagacatccgcggaactcaacaagggaacagaaagcgccagtag

SEQ ID NO: 114372 - DNA, 852 bp, Artificial Sequence
  Description of Artificial Sequence: Synthetic coding sequence
atgggcatttggacttccggcactgatatattcctctcattgtgggaaatctatgtcagccctcgaagcccaggatggatggattttattcagcatcttggagtctgttgcttagttgctctgatttctgtgggcctgctgtccgttgcggcttgttggttcctgccctctataatcgcggcagcagcgtcctggatcattacttgtgtgctattgtgctgctccaagcacgccagatgtttcatcttgctggtgtttttgagctgcggcctccgagaaggccgtaatgccctgatcgctgccggaactgggattgtgattttaggacacgtggaaaacatttttcacaactttaaggggctactggacggcatgacttgtaacctgagagccaagtctttcagcatccatttcccgcttctgaaaaagtacatcgaggcaatccagtggatatacgggttggccacaccattatctgtattcgacgacctcgtgtcctggaaccaaaccctcgccgtatccctcttcagtccttcgcacgtgctggaggcccagctaaatgattccaagggcgaggtgctgtcggtactataccaaatggctaccaccacagaggtcttgagctctcttggccagaaactgctggccttcgctggtttgtctctcgtgctgctcggaactggcctatttatgaagcgctttctgggaccatgtggctggaaatacgagaacatctatattaccagacagtttgtgcaattcgatgagagagaacgacaccagcagagaccttgtgtgcttccccttaacaaagaagaaaggcggaaattcattagcgggtttcagagttag

SEQ ID NO: 114373 - DNA, 1401 bp, Artificial Sequence
  Description of Artificial Sequence: Synthetic coding sequence
atgctgaagtggccaattcctggccaagtggccctctttcaaatcctccgatgccggggcaatagccgcaggaccacagtgacgtctctgaccgtcagccaggttggacaaaacttcacgtttgtattgactgacatcgactctaagcaacgctttgggttttgccgtctctctagtggggccaagtcctgcttttgcatcctcagctacctaccatggttcgaagtattctacaaactactgaacatcctggcagactacacaaccaaacggcaagagaaccagtggaatgagcttctggaaaccctccacaagctgcccatacctgacccgggggtgtccgtgcatctgagtgtacatagttactttactgtcccagatacgagagaacttcccagtatccccgaaaatagaaaccttactgaatatttcgtcgccgttgacgtgaataatatgctgcatctctacgcgagcatgctgtatgagcgtcgcattttgatcatctgctccaaactttctacgctgacagcgtgtatacacggaagcgctgccatgctgtatcctatgtactggcagcatgtctatattcccgtactgccgccacatttgctcgattattgctgtgctccgatgccctatctgataggcattcatctctctcttatggaaaaagtgaggaacatggcgttagacgacgtagtaattctcaacgttgacactaatactctcgaaactcctttcgatgatttacaatccctcccaaacgacgttattagttcccttaagaataggcttaagaaggtgagtactaccactggggatggggttgcccgagcgttcttaaaagcacaggctgctttctttgggagctataggaacgcacttaaaatcgagcctgaggagcccattacattttgcgaggaagcctttgtcagccattaccggagtggcgccatgaggcagttcttacagaatgctacccaattacaattattcaaacagttcattgacggaagactggatctcctgaattccggggagggattctccgacgtgttcgaagaagagatcaatatgggcgagtatgctggcagcgacaagctttaccaccagtggcttagcaccgtgcgcaagggcagtggggcaatactgaacactgtgaaaacaaaggctaatccggcgatgaagacagtttacaagttcgctaaggatcatgctaaaatgggcattaaggaggtgaagaatcgattgaaacagaaggatattgcagagaacggttgtgcacctacacctgaagagcaactcccaaagacagctccttctcctctggtggaagcgaaggacccaaagctccgggaggaccgcaggccaattacggtgcacttcggacaagcactgtag

SEQ ID NO: 114374 - DNA, 1680 bp, Artificial Sequence
  Description of Artificial Sequence: Synthetic coding sequence
atgggcagccgtataaagcagaaccctgaaacaaccttcgaagtctacgtggaggtagcctaccccaggacaggcgggacgctctccgacccagaggtacagcggcaattccccgaggattacagcgatcaagaagtcctgcagactctgaccaaattttgttttccattctacgtggacagcctgacagtcagtcaggtgggacagaacttcacatttgtgctgacagacattgacagcaaacaaagattcggcttctgccgtctcagctctggcgctaaatcatgcttttgtatcctctcatatctcccatggttcgaagtgttttacaaactgctgaacattttagccgactacacaactaaaagacaggagaaccagtggaatgagttgctggaaacattacacaagttgccaattcctgaccccggagtttctgttcatcttagcgtgcactcatattttacagtccccgacactagggaactgccaagcatcccagaaaatcggaacctgacagagtatttcgttgcagttgatgtgaacaacatgctacacctatatgcttcaatgttgtatgaacgcaggattcttataatttgttctaaactaagcacattaacagcctgtattcatgggtccgctgcaatgctttaccccatgtattggcaacatgtctatattccagtgttacctcctcatttactggattactgttgtgccccgatgccttaccttatcggaatacacctgtcactcatggagaaggtcagaaacatggccctagacgacgtggtgattttgaacgtagacactaacactttggaaactccatttgacgacctgcaatctctcccaaatgatgtcattagcagcctgaagaaccggctgaaaaaggtatcaacaacaactggagacggcgtagccagggccttccttaaggcccaggctgctttttttggatcgtatcggaatgccctgaaaatcgagccagaagagcctattactttctgcgaggaggcatttgtgtcccattaccggtcgggggccatgcgacaattccttcagaatgctacacaactgcagttgttcaagcagttcatagatggcagattggacctgctgaatagcggcgaagggttctccgatgtattcgaggaagaaatcaatatgggtgaatacgccggaagcgataagctttatcaccagtggttgtcaacagttcgaaagggctcgggggctatcctcaacacggtgaaaaccaaagccaaccccgccatgaaaacagtatacaaattcgccaaagaccacgcgaagatgggaatcaaagaggtgaagaacagactcaagcaaaaagacatcgccgagaacgggtgtgcccctacaccagaggagcagctcccaaagacagctccctcccctcttgtcgaggcaaaggaccctaagctacgggaagacaggaggcctatcactgtgcacttcgggcaagtccgccccccacggcctcatgtggtcaagcgtcccaagagcaatatagccgtggaaggcaggcgcacatctgtgcctagtcccgaacagaacaccatagcaactccagccacgttacacattctacagaagagcattacccattttgctgccaaattcccaacacgtggttggacatccagctctcattag

SEQ ID NO: 114375 - DNA, 3030 bp, Artificial Sequence
  Description of Artificial Sequence: Synthetic coding sequence
atggggagccgcatcaagcaaaacccagagaccacatttgaggtgtacgtggaagtagcttaccctcgcaccggaggaactttgagcgatcccgaagtacagcgacagttccccgaagattacagcgatcaggaagtgctccagactttgacaaagttttgctttccattctacgtagattccctgactgtgtcccaggtaggtcagaacttcactttcgtgctgacagacatcgactcaaagcaaagattcggattttgccgcctgtcgtctggggctaaatcgtgtttttgcattctttcatatttgccatggtttgaggtcttctacaaattactgaacatcctagctgactacaccacgaagcggcaggagaatcagtggaacgagctgctggagactctgcacaaactcccaatcccagacccaggcgtcagcgtccatctcagtgtccacagctactttacggtgccagacactcgggagttgcccagcatcccagagaaccggaatttaacagaatatttcgtagcggttgatgttaacaatatgttgcacctttatgccagcatgctttacgagcgccgcatactgattatttgttctaagttgtcaaccttaaccgcatgcatacatgggtccgccgccatgctgtaccctatgtattggcaacacgtttacatccccgtgctgccaccccaccttctcgactattgttgcgctcctatgccttatctgattggaattcatctttcacttatggagaaggttaggaacatggcgctggacgacgtggtgatactgaatgtcgatacaaacacgttggagacaccctttgatgatctgcagtccttgcccaatgatgtcatcagcagcttgaaaaacagattgaagaaggtgtccaccaccactggcgacggggtagcccgcgccttcttaaaagcgcaagccgctttcttcggcagctatcgtaatgcactcaagatcgagcctgaggaacccatcacattctgtgaggaggctttcgtgtcccactatcggtcaggagccatgaggcagtttctgcagaacgccacacaactccaacttttcaagcagttcatcgacggacgcctcgatttactgaactctggagagggcttcagcgatgtgttcgaggaggagatcaatatgggagagtacgcgggatccgacaagttgtaccatcagtggctatccacagttcggaaaggcagtggggcaattcttaatacggtcaagaccaaggccaacccagccatgaagaccgtgtacaaatttgctaaggaccacgccaagatgggcataaaggaagtcaaaaacagactgaaacagaaagatatagccgaaaatggctgcgcacctacccctgaggagcagctgcctaaaactgccccatcacctctggtggaagccaaggatcccaagctccgggaagaccgaaggcccattactgtccatttcggacaggtgaggccaccaaggccccatgtcgtgaaacgccccaaaagcaatatagccgtcgaaggcagaaggacctcagtgccgagtccagaacagccccaaccgtatcgcactttacgggagagtgattctgccgagggggacgaagccgaatcccccgagcaacaggtaagaaaatctaccggacctgtgcctgccccgcccgaccgagccgcctctatcgatctgctggaagatgtgttttcaaatctcgacatggaggctgccctgcagcccttaggacaagcaaaaagcctggaagatctcagggcgccaaaagacctccgagagcagcctgggaccttcgactaccagcggctcgacctgggaggcagcgagaggagccggggcgtgaccgtggctctgaagctcacacacccatataacaaactgtggtccctggggcaggacgacatggctattcctagtaagcctccagccgcctccccagagaagccgtccgccctgctgggaaactcactggccctgccaaggcgcccccagaatagggatagtatcctcaacccctccgacaaagaggaggtcccgacacccacattgggctcgattacgatccctcggccccagggccgcaagacaccagagctaggaattgtgcctcctcccccgattcctagacctgccaaactgcaggctgcaggtgctgccctaggggatgtgtccgagcgcctccaaacagaccgcgatcgtcgtgcagccctttcacctggcctcctaccgggagtggtcccccaggggcccacagaattgctacaaccattgtctccaggacctggcgccgccggcaccagcagcgacgccctcttggctctcttggaccctctgagtaccgcttggtcaggtagtacacttccctcaagaccggctacacccaatgtggccactcctttcaccccccaattttcattcccacctgccggaacccccactcccttccctcagcccccattgaacccattcgttccaagcatgcccgcagccccacctacactgcccctcgtatccactcctgccggtccttttggtgccccgcctgcatcgctaggacccgcatttgcctcggggttgcttctctcctccgcgggcttttgcgcacctcaccgttcccaacctaatctcagcgccctgagcatgccaaacttatttgggcagatgccaatgggaacccatactagtccgctccagcccttgggcccccctgccgtcgcgccttctagaatacgcaccctacccctagcaaggagctcagccagggccgctgagaccaaacagggccttgcactccgacctggagacccccctctgttgccaccacgaccgccccagggcctcgagccaaccctccaaccttccgctccgcagcaagctcgcgatccctttgaggatctgctccaaaagactaaacaggatgtctcccctagcccagccctggcaccggctccggattcagttgagcagctgcggaagcagtgggagaccttcgagtag

SEQ ID NO: 114376 - DNA, 1590 bp, Artificial Sequence
  Description of Artificial Sequence: Synthetic coding sequence
atgctgaagtggcccattcccggtcaggttgctctcttccaggaagtcctgcagacccttaccaagttctgttttccgttctacgtggacagcctgacagtttcacaagtgggtcagaacttcacgttcgtccttactgacatcgacagcaaacaaagattcgggttctgccggctctcctctggggcaaaaagctgcttctgtatcctttcttacctgccgtggtttgaggtattctataagctgcttaacattctcgctgattacacgaccaagcggcaagaaaatcagtggaacgaattattggaaactctgcataagctgcctatccccgacccaggagtcagcgtccatctgtctgtccattcatatttcaccgtacccgatacaagggagcttccaagcatccccgagaacagaaacctgaccgagtattttgtggcagttgatgtgaataatatgctccatctgtatgccagcatgctgtacgagaggagaatcctgatcatctgtagcaaactcagtaccctgaccgcttgtatccacggctctgcagcgatgctttaccccatgtactggcaacacgtctacatcccagtattgccaccccatctactcgactattgttgtgcccctatgccctatttaatcggtatacatttgtccctgatggaaaaggtgaggaacatggctctagacgatgttgtgatcctcaacgtagatacaaatactctggagactccgttcgacgatctccagtcattgccaaacgatgttatttccagtctgaagaaccgcctgaagaaggtaagcaccactaccggtgatggcgtcgctagggcctttttaaaggcacaggccgccttctttggttcctatcgaaacgccctgaagatcgagccagaggagcccataacgttttgtgaagaggcattcgtgtctcactatagaagcggcgctatgcgccagttcctccagaacgctacccagctccagctgtttaagcagttcattgacgggaggctagatctactgaactccggcgaggggttcagtgatgttttcgaagaggagatcaatatgggagaatatgccgggtccgataaactttaccaccaatggctgagcacggttcgcaagggctccggtgctatacttaataccgtgaaaacaaaggctaaccctgccatgaaaacagtttacaagttcgctaaggatcatgccaaaatgggtataaaagaggtgaaaaataggttgaaacagaaggatatagccgagaacggttgtgctcccacgcccgaagagcagctgcctaaaacggccccatctcccttggtggaggccaaggatccgaagctgagagaagacagacgccctattactgttcatttcgggcaagtgcgccccccgcgaccacatgttgtgaaacgtcctaaatctaacattgctgtggaaggtcgcagaacaagtgtgccctctccagagcaaaacactattgccacaccagccactctccacatattgcagaagtccattacacactttgctgccaagtttccaacaaggggctggacctcttccagccactag

SEQ ID NO: 114377 - DNA, 3063 bp, Artificial Sequence
  Description of Artificial Sequence: Synthetic coding sequence
atgcggcgcccgggcgatcatggcctgcaggaccaggaagtgctacagacactgactaagttctgcttcccattttacgtagatagtctgaccgtttctcaggtcggtcagaacttcacctttgtgttaactgatatcgactcgaagcaaaggtttggtttttgtcgcctgtcttccggggccaaaagctgtttctgcattctgtcatacttgccatggtttgaggtgttctacaagcttctcaatatcctcgctgattacaccaccaagagacaggagaatcagtggaacgaacttctcgaaacccttcacaagctcccaatccccgacccaggtgtcagtgtgcatcttagtgttcactcttattttaccgtcccggacacgcgtgagctccccagtatacccgagaacagaaatctgactgaatattttgttgcagttgacgtcaacaacatgcttcacctgtacgcctccatgctgtacgaaaggcgcatcttgatcatctgcagtaagctttccactctgactgcttgcatacacgggagtgcagccatgctctatccgatgtattggcagcacgtctacattccagtgcttcctccacatctgctggactactgctgtgcccccatgccctatctgattggcatccacctctccctgatggagaaggttaggaatatggccctggacgacgtggtaatcctgaacgttgacacaaacaccctagaaaccccgtttgacgacttgcaatctctccctaatgacgtgatttccagcctcaagaatcgtctgaagaaggtcagcactacaacaggcgatggagtggccagagccttccttaaagcccaggcagccttctttggaagctacaggaatgccttaaagatcgagcctgaagaaccgattaccttctgcgaggaggctttcgtttctcactaccgaagcggcgctatgcggcaattcctgcaaaacgccacacaattgcagcttttcaagcagttcatcgatgggcggctggatctgctgaattcaggcgagggcttctccgacgttttcgaagaggagattaacatgggggagtacgcaggttcagacaagctataccatcagtggctctcaacggttcggaaagggagtggtgccatcctcaacacagtgaaaacaaaggccaaccctgcaatgaagactgtgtataaatttgccaaggatcatgcaaaaatgggaatcaaagaggtgaaaaataggctcaaacagaaggacatagcggaaaacgggtgcgccccaacccctgaagaacagcttccaaagacagcccccagcccacttgtggaggcaaaggaccctaagcttagagaggacaggcgccccatcacagtgcattttgggcaggtacggccaccgcggcctcacgtggtgaaacgcccaaaaagtaatattgccgtggaggggcgccggacttctgtaccgtctccagaacacctcgtgaaacccctgcgccactacgccgtgttccttagcgaggactcaagcgacgatgagtgtcagcgggaggagggccccagctctgggttcacagaatcatttttcttctccgcccccttcgagtggccccagccctaccgcaccctgcgtgagtctgactctgccgagggggacgaggccgagagtcccgagcagcaggtccggaagagcaccggaccagttcctgccccccctgatcgggctgcaagtatcgatctccttgaggacgttttcagtaatttagacatggaagccgctctgcagcccctgggccaggcaaaaagcctcgaagacctcagggcccccaaggatcttcgggagcagccaggaaccttcgattaccaacggctcgacttgggcggcagtgaacgctctcgaggcgttacggttgctctcaaacttacccatccgtataacaagctttggagcctcggccaagatgatatggcaattcctagcaaacccccagccgcctcacctgagaaaccctcggctctgcttgggaatagcctcgccttacctcggagacctcagaatcgcgattctattctgaatcccagtgataaagaagaagtgccgaccccaacgctggggagtatcaccatacctaggccccagggcaggaagacccccgaactgggcattgttccccccccacccattcccagacctgccaaattgcaggccgcgggcgctgccctcggcgacgttagcgagagacttcagacagaccgggaccgtcgggcagccttatccccaggcctgctgcctggagtggtcccgcaaggtcccacagagctgctgcaacccttgtcacctggacccggagccgctggtacgtcctctgatgccttgcttgcccttctggatcctcttagcacagcttggtccggctccacattgccgtcccggccagccacacctaatgtggctactccatttacaccacaatttagcttcccacccgccggcacccctactcctttccctcagcctcccctaaaccctttcgtcccgagtatgcctgcagcaccaccgactctgcctctggtatctacccccgctgggccttttggagccccacctgcgtctcttggtccagcttttgcaagcggtctcttgctgtcatctgccggcttctgtgcgccacacaggtcccagcccaatctcagcgctttgagcatgcccaatctcttcgggcaaatgccaatggggactcatactagcccgctacagcccctcggcccaccagcggtggcacctagtcggattcgtaccctgcccctggcccggtcttccgccagggccgctgagactaaacagggactggcactgaggccaggtgatccacctctgctgcccccgagacccccccagggcttggaacctacactgcaaccgagcgctccacagcaagcaagagacccctttgaggacctcctgcaaaagaccaaacaagatgtctctccttcacccgcactggcccccgccccagacagcgtggagcagttgaggaagcagtgggagacattcgaatag

SEQ ID NO: 114378 - DNA, 2385 bp, Artificial Sequence
  Description of Artificial Sequence: Synthetic coding sequence
atgttgtatcctatgtattggcagcatgtgtacatccccgtcttgcctccacaccttctggactactgctgtgccccgatgccctacctgattggtatccacctctcgctcatggaaaaagtgaggaacatggccctggatgatgttgtcatcttgaatgtggacacaaacacacttgaaactccattcgatgatctgcagagtttacctaacgacgtggaggaacctattacattttgcgaagaggctttcgtcagtcactaccggagcggggcgatgcggcagttccttcaaaacgccacccaattacaactcttcaaacagtttatagacgggcgacttgatctcctcaactccggagagggtttttcggatgtgtttgaagaggaaatcaacatgggtgagtacgcagggtccgacaagctctaccaccagtggttgtcaacggttcgcaaaggctccggtgctatactgaatacagtgaagactaaggctaatccggcgatgaaaacagtgtataagttcgccaaggaccatgccaagatgggcatcaaggaagtgaagaatagactcaagcagaaagacatcgccgaaaacggctgtgccccgaccccggaagaacaactgccaaaaaccgcccccagccctttggtggaggccaaggatcccaaactgcgagaagaccgtcggcccattacagtccacttcggccaagtgagacctccgagaccccacgttgtgaaacggccgaagtccaacatcgctgtcgagggtcgccgaaccagcgtgcccagcccggagcacttagtgaagccattgcgtcactacgcagtctttctgagcgaagacagtagcgatgacgaatgtcagagagaagaaggcccctcgtcaggttttacagagagtttcttcttcagtgctccgtttgagtggccccaaccttaccgaacactcagggaatcagactccgctgaaggtgatgaggcagaatctcccgagcagcaagttaggaaaagcactggacctgtcccggcgcctcctgaccgggcagcttccatcgatctcctcgaagacgtgttctcaaacctcgacatggaagcagccctccagcccttaggacaggctaaaagcctcgaggatcttagggcgccgaaagatctcagagaacaacctggcactttcgactatcagcgtctggatctgggcgggtccgagagatcgcgaggggtgaccgtcgccctgaaattgacccatccttataataagctatggagtctcggccaggatgatatggccatcccatcaaagcccccagccgcttccccggagaagccatctgctctcttggggaattccctagcgctgccaaggcggccccagaatagagactcgattctgaatcctagcgacaaggaggaggtccccaccccaacgcttggctcaatcacaatccccaggccccagggccgaaaaaccccagagctggggattgtgcccccacccccaataccgcgaccagccaagcttcaagcagccggggctgccctgggcgacgtttccgaaagactccaaaccgaccgcgatcgcagggccgccctcagccctgggttgttgcctggagttgtgccacagggacccactgagctcctgcagcccctgtccccaggaccgggcgcagccggaaccagctctgatgcactgctggccctgctcgaccctctcagtaccgcctggagtggcagcacccttcctagccgccccgcaaccccaaatgtggctactcctttcacgccacagttcagctttccacctgccgggacccctacgccgttcccacagcctccactgaatcccttcgttccctccatgcctgcggcaccacctacactgccgctcgtttctaccccggcagggccattcggagctccacctgccagcctaggccccgcattcgcatcgggcttgctcctaagctccgcaggattttgcgcgccgcatcggtctcagcctaatctttccgctctctccatgcctaatctgtttggacagatgccaatgggtacccacaccagcccattgcagcctttgggcccccctgcagttgccccctcacggataagaacactcccgctggctaggagttctgccagagcagcagaaacgaagcaaggtttagccttgcgacctggcgacccacccctcctcccccctaggcctccccaggggcttgagccgaccctgcagcctagcgccccccaacaggcccgagatccgtttgaagatctgctgcagaaaacgaagcaggatgtttcaccatcgcccgccctggcacctgccccagactcagtggaacaactgaggaagcagtgggagacattcgaatag

SEQ ID NO: 114379 - DNA, 1191 bp, Artificial Sequence
  Description of Artificial Sequence: Synthetic coding sequence
atggcagccgcccccagggaggagaaaagatggccccagccagtcttctcgaacccagtggtgctgtggaagtttcccgaagactttggcgaccaggaaatactgcagagtgttccaaagttctgttttccatttgacgtggagcgcgtctcccagaaccaagttggtcagcatttcacattcgtgctgacggacatagagagcaagcaacgcttcggtttttgtcgcctcacgagcggaggcaccatatgcctttgcatcctctcctatcttccttggttcgaagtgtattacaagctcctaaatacactcgctgactacctggccaaggagttggaaaatgacctaaacgaaaccctgagatctctgtacaatcacccggtgcccaaagccaatactcctgtcaatctaagtgtgcactcttattttatcgctcctgatgttaccgggctgcctaccatacctgagtccaggaacctgactgagtacttcgtggccgtggacgtgaacaacatgttgcagttgtatgcgtctatgcttcacgagcgcaggattgtaatcatctcctccaaactcagtactctgacagcgtgcatccacggttcagccgccctcctttaccctatgtattggcagcacatttatattcctgtgcttcccccccaccttttggactattgttgcgctcctatgccttatttaatcggtattcactcaagcctcatcgagcgggtgaaaaataagtctctggaggacgtggtaatgttaaatgtcgatactaacacactggagagtcctttttctgatcttaacaacttaccttctgatgtcgtctccgcactaaagaacaagctgaaaaaacagtcaacggccaccggtgacggcgtagcaagagcgttcctgagagcccaagccgcccttttcggatcctatagagatgccctgaggtacaaacccggtgagcccatcactttctgcgaagagtctttcgtgaagcaccggtcttctgtcatgaagcagtttctagagaccgcaattaatctacagctctttaaacaatttatcgacggaaggcttgcaaagctgaacgcgggacgtggatttagcgatgtctttgaagaggagattacaagtggtggtttctgcggcgggaaggacaagctccagtatgactatcccttttcccaatag

SEQ ID NO: 114380 - DNA, 1281 bp, Artificial Sequence
  Description of Artificial Sequence: Synthetic coding sequence
atggactgtcggaccaaagccaatcccgatagaacgttcgatctcgtgttgaaagtgaagtgccatgccagcgagaacgaagacccggttgtgctttggaaatttcccgaagactttggagaccaggagattctacagtccgttccgaagttctgtttcccatttgatgtggaacgggtctcccagaaccaggtggggcagcattttacctttgtgttgaccgatattgaaagtaagcagaggtttgggttctgtcgactgacctcgggtggcactatttgtctgtgtattctgagctacttgccgtggttcgaagtgtactataaacttttaaacaccttggcggattatctggctaaggagctggagaatgatttgaatgagactctgcgtagcctctacaatcatcctgtgccaaaggcaaacacccctgtgaacttgtccgttaatcaggagatctttatcgcatgcgaacaggtgcttaaggaccagcctgcactcgttccacactcctatttcatcgctcccgatgttaccggtctaccaacaatccccgagagtagaaatctcaccgaatactttgtggccgtggacgtgaataatatgctgcaattgtatgcctctatgttacacgagcgcaggatcgtgataatttccagcaaactgtcaactctgacggcatgtatccatggctccgctgcccttctgtatcctatgtattggcagcacatttatattcccgtgctgccccctcacttactggactattgttgtgcacccatgccctacctgattggcatccattcatcgctgattgagagagtaaaaaataagagccttgaagacgttgtcatgctgaacgtggacactaacacgctggagtcccctttctccgatctcaataacctgccaagcgatgtggtgagcgctctgaagaacaagttaaagaaacaatccacggctactggagacggcgtggctcgggccttccttagagcccaagccgcgctgttcggtagctaccgcgatgctttaagatataaaccaggcgagccaattactttctgtgaagagtcattcgtcaagcaccggagtagcgtgatgaagcagttcttggagacggcgattaatctccaactgtttaagcaatttatcgatggccgtctggccaagctaaacgcgggcaggggcttctccgatgtctttgaggaagagataacctcagggggtttttgcggaggcaaagataaactccagtatgactatccctttagtcagtag

SEQ ID NO: 114381 - DNA, 1191 bp, Artificial Sequence
  Description of Artificial Sequence: Synthetic coding sequence
atggctgccgctcctcgggaggagaagagatggcctcagccggtctttagtaatcctgtcgttttgtggaaatttcccgaggatttcggagatcaagagattctccagtcagtgccaaaattctgtttcccctttgatgtagaacgagtgagccaaaaccaggtgggccagcacttcacatttgtccttacggatatcgagtcaaaacaacgattcggcttctgccgtttaacatcgggtggcacaatctgtctgtgcatcctttcatacttgccatggttcgaagtttactacaagttactcaacaccctggccgactatttggctaaggaactcgagaacgaccttaacgagaccctccgatccctgtataatcaccccgtccccaaagccaacacccctgtaaacctcagcgtacacagttactttattgctcctgatgtgacaggacttcccaccatccccgagtctcgcaatcttactgagtattttgtcgctgtcgatgtgaacaatatgttacaactctacgcatctatgcttcacgaaaggagaatcgtcattatctctagcaaattgtccacgctgacggcctgtattcacggcagcgccgccctgctgtacccaatgtactggcagcacatctatatcccggttctcccacctcacctccttgactactgttgtgcccccatgccgtatctcatcggcatccacagctcactaatcgaacgcgttaagaataaatctcttgaggacgtcgtaatgctgaatgtggatacaaatacccttgaatctccttttagcgacctgaacaacttgccgtccgatgtcgtctccgccctaaagaataagcttaagaaacagtccacagccactggcgatggggtggctagggcatttctcagagcccaagctgccctgtttgggtcctacagagacgctctgcgctataagcccggcgaacccattaccttctgcgaagagtctttcgtcaaacaccgatcctcggtgatgaaacagttcctggagacagcaattaatttgcagctgtttaaacagttcatcgacggtaggctcgccaaattgaacgccgggcgcggcttcagcgatgtcttcgaagaggaaattacctcaggggggttctgcggaggaaaggacaaacttcagtatgactacccgttcagccagtag

SEQ ID NO: 114382 - DNA, 2268 bp, Artificial Sequence
  Description of Artificial Sequence: Synthetic coding sequence
attgagacgaagacgcgagccaaccctgaccggacctttgaccttgtcctgaaggtgaagtgccatgccagcgagaacgaggatcccgtagttttgtggaaatttcctgaagattttggggatcaggaaatcctgcagagtgttcctaaattctgcttccctttcgacgtggagcgggtgagccagaatcaagtgggccagcactttacatttgtcctaaccgacatcgagtcaaaacagcgatttggtttctgtcgacttacttccggtggcacgatttgcctgtgtattttgtcctatctgccctggtttgaagtctactacaagctcctcaacacgctagctgactaccttgctaaagagctcgagaacgacttaaacgaaaccctaaggagtctgtacaatcaccccgtgccaaaggctaatacgcccgttaatttgtcagttcactcttactttattgcccccgatgtcactggcttacctaccatccccgaatcgcgaaacctcactgagtacttcgtggctgtcgacgtgaataatatgttacagctttatgccagcatgctacacgaaagaaggatcgtcattatctcttccaaactctctactcttacagcttgcatccatggatccgctgccctactttacccgatgtactggcagcatatttatattccggtccttccccctcacctactcgactattgctgtgctcctatgccgtatctcatcgggatccactcctctctgattgaaagggtaaaaaacaaatcattagaagatgtcgtgatgttgaacgtcgacaccaatactctggaatcaccgttctctgacttgaacaacctcccaagcgacgtagtgtccgcactgaagaataaactgaaaaaacaaagtacagctaccggcgacggcgtcgcacgcgctttcctgcgggcccaggcggccctctttggttcttaccgcgatgccctgagatacaagccaggtgagcctatcactttttgcgaagagtctttcgtaaagcatagatcctctgtcatgaagcagttcctcgagactgcaatcaacttgcagttattcaagcagttcatcgatggccgcctcgctaaactgaatgccggccgtggcttttccgacgtgttcgaagaggagatcacaagtggggggttctgtggcggcaacccacggtcgtatcagcagtgggtgcatactgtgaaaaagggcggcgctctgtttaataccgcaatgacaaaagcaacccccgccgtgcggacggcatacaagttcgccaaaaaccatgccaagttaggtctcaaggaggtcaagtccaaacttaaacataaggagaacgaggaggattatggcacatgcagcagctccgttcagtataccccggtctacaagctgcacaatgaaaagggcggaaacagcgagaaacgcaaattagcacaggccaggttgaagcgtcccttaaagagcttggacggtgccctttacgacgacgaggatgatgatgacatagagcgagctagcaagttgagtagtgaagatggggaggaggcttctgcctacctgtatgagtccgatgactcagtggaaacccgcgtgaaaacgccctacagcggagaaatggacctactgggtgagatactcgacacgctgagtacccactcatccgaccaagggaaactggcagccgctaaaagcttagatttttttaggagcatggacgatatcgactacaaaccaacaaataagtcaaacgcgccttctgaaaacaacctggctttcctgtgcgggggatccggagaccaggctgagtggaatctgggacaagacgacagcgccctgcacggcaaacacctgcctccatccccccgcaagcgagtgtccagttcaggactgaccgatagcttgtttattctgaaggaggaaaactccaataagcatcttggtgccgacaatgttagcgatccaacaagcgggctggactttcagctaacgagtcccgaggtttcccagacagacaagggcaaaacagagaaacgggaaacacttagccaaataagcgatgaccttctcatcccagggttgggcagacacagttcaactttcgtcccatgggagaaagagggtaaagaggctaaggagaccagcgaggacatcggcctactgcacgaggttgtgagcttgtgtcatatgaccagcgacttccagcagagtctcaatatctccgacaagaatactaacggtaaccagacctag

SEQ ID NO: 114383 - DNA, 2328 bp, Artificial Sequence
  Description of Artificial Sequence: Synthetic coding sequence
atagagactaagacacgggccaatcctgatcggaccttcgatctagtgctgaaggtaaagtgccacgcatcagagaacgaagatccagtagtgctctggaaattccccgaggattttggagaccaggagattctgcaatcagtgcctaagttctgcttcccatttgacgtcgaacgcgtgtcccagaatcaggtgggtcagcacttcacttttgtcctgactgacatagagtccaagcagagatttggattttgtagactgacaagcggcggcacaatctgcttgtgtatcctgtcatacctgccctggtttgaggtgtactataagctgctaaatacacttgccgactatttggctaaagagctggaaaatgatcttaacgagactctccgatccttatataaccatcctgtgcctaaggccaatacaccagttaatttgtccgttaaccaagagatcttcatagcttgtgaacaggtgttaaaggatcagcctgccctcgtccctcattcttattttattgcacccgacgtgactggtctgcccaccatccctgagtctcgcaacctgacagaatatttcgtggcggttgacgtaaacaacatgctgcaactatatgcgtccatgctacatgaaagacggatcgtgattatttcaagcaagctatcaaccctgaccgcctgcatacacggttctgccgctctgctgtatccaatgtattggcagcatatctacatccccgtactcccgcctcacctcctggattactgctgcgctcctatgccctacttgatcggtatacactcatccctgattgagcgcgttaaaaataagagcctcgaagacgtcgtaatgctgaacgtcgataccaatacgctggaaagccccttctccgatctcaacaacctaccatctgacgttgtgtctgccctcaaaaacaaactgaaaaagcagtccacggctacaggcgatggcgtggcaagagccttcctgcgcgcacaggccgccctgtttgggtcctacagggacgccttgagatataagcctggagaacctattacgttttgcgaggagagcttcgtgaagcatcgctcatcagtgatgaagcagtttctggaaactgctattaatctgcagttatttaagcaattcattgacggcagactggcgaagttgaacgcgggcagggggttctctgacgtgttcgaagaggaaattacatctgggggtttttgcggtggtaaccccaggtcctaccagcagtgggtgcataccgtcaaaaagggaggcgctttattcaatacggcaatgacgaaagctacaccagccgtgaggacagcctacaagttcgccaaaaaccatgccaaactgggcctaaaggaggttaagtccaaactcaagcacaaggagaacgaggaggattacggaacatgtagctcatcagtgcagtataccccagtctataaactacacaacgagaaagggggaaattctgagaagaggaagctggcacaagcccgcttgaagagacctctaaaatctttggatggcgccctctacgacgacgaggatgacgacgacatcgagcgcgctagcaaactttctagcgaggatggagaggaggcatcagcctacctgtacgagtcagacgatagcgttgaaactagagtgaaaacaccctatagtggtgaaatggacctgcttggggaaatactcgacacattgtccacacacagttcagatcagggcaagttagcagctgccaaaagtctggatttttttcgctcaatggacgacatcgactacaagccgacgaacaaaagtaatgccccgagcgagaataatctcgcctttctgtgtggcggctctggagatcaggcagagtggaatctgggacaagacgattctgctctccatggcaagcacttacctccatcacctagaaagcgagtttccagctccgggctgacagacagtcttttcatcctgaaagaggagaatagcaataagcatctcggggcagacaatgtgagcgacccaaccagcggccttgactttcagcttacctctccggaagtgtcccaaacagacaaaggaaaaaccgaaaaacgggagacactcagtcagatctcagacgaccttttgatacccggtctgggcagacatagcagcacttttgtgccttgggagaaggaggggaaggaggctaaagagactagcgaagacatcgggctgcttcacgaggtcgtgtcgctgtgccatatgacgagcgatttccagcagtcgctgaatatcagcgacaagaataccaatggtaaccagacctag

SEQ ID NO: 114384 - DNA, 1248 bp, Artificial Sequence
  Description of Artificial Sequence: Synthetic coding sequence
gtgaagcatcgctccagtgtgatgaagcagttcctggagaccgcgatcaatctccagctgtttaaacagttcatagacgggaggttggctaagctgaacgccgggcgcggattttctgacgtgttcgaagaagagataacgtcaggtggattctgtggtggaaatccacggagctaccagcagtgggtccataccgtgaagaagggcggggctttgttcaatactgccatgacaaaggcaactcccgcagtaaggaccgcttataagtttgctaaaaatcacgccaagctcgggctcaaggaggttaagtccaaactgaagcacaaagagaatgaggaggattacggcacctgcagttcttcagtgcagtacacccctgtttacaagctacataatgagaaggggggaaactcggagaagcgaaagctcgctcaggccaggctgaaacgtccattgaaatcactagacggagccctctatgatgacgaagatgatgacgatatcgagagagccagtaaactgtcatcagaggacggagaagaggcttctgcctacttgtatgaatcagacgattctgtggagacacgggtaaagacaccatattccggagagatggacctgctgggcgagatattagatacactaagcacccactcctctgatcagggaaagctggccgccgccaaatctctggacttttttagatctatggatgatatagattacaagccgacgaataagtccaatgccccatctgagaataacctggcttttctgtgcggcggatccggggaccaggctgagtggaacctgggtcaagacgactctgccctgcatggaaagcatctcccacccagcccacgcaagcgcgtctccagctccggcctgacagattctctgtttatattaaaagaggaaaactccaataaacatttaggagcagataatgtgagcgatcctacgagcgggctggactttcagctcacatcccccgaggtctctcagactgacaaggggaagaccgaaaaaagagagactctgagtcaaatctcggacgatctgttgattcccggactgggaagacactcatccactttcgtcccctgggagaaggagggtaaggaggccaaagaaacgagcgaggacattggcctactccacgaagtggtttcattatgccatatgaccagtgacttccaacagtctctgaacatttcagataagaacacaaatggcaatcagacctag

SEQ ID NO: 114385 - DNA, 2406 bp, Artificial Sequence
  Description of Artificial Sequence: Synthetic coding sequence
atggagtcccgagccgagggcggtagccctgctgtgttcgactggttctttgaagcagcttgcccagcctctctgcaggaggacccgccaatcctccgccagtttcctcctgatttccgtgaccaggaagcaatgcaaatggtgcccaagttttgctttcctttcgacgtcgagcgggagcccccttcccccgcagtccagcacttcacttttgctttgaccgatctggcagggaatagaagattcggcttctgtagactcagggccgggacgcaaagctgtctctgcatactgagtcatctgccctggtttgaagtgttttataaactgctgaacactgtcggagacttgctggctcaggatcaggtcaccgaggcagaggaactcctgcagaatttgttccagcaaagcttgtccggcccacaggccagtgtcgggctggagcttggaagcggggtcaccgtatcttcaggtcaagggataccacctccgacccgtggcaacagcaaacccctgtcttgcttcgtggcaccggacagcgggcggctccccagcataccagagaaccgaaatcttaccgaactcgtggttgcagtgacggacgaaaatatagtggggctgtttgccgctctgcttgcagaacgccgagtgttgttgacggcaagcaagctgagcactctgactagctgcgtacatgcttcatgtgccctgctataccctatgcggtgggagcacgttcttatccccactctccctccccacttactggattactgttgcgcccctatgccttatctgatcggagtccacgcaagccttgccgaaagagtgcgcgagaaagcccttgaagacgtagtggtacttaacgtcgatgcaaacacactcgagaccacattcaacgatgtccaggctctgcctcctgatgttgtaagtcttctacggttgagactgcggaaagtggcgcttgcacctggggaaggcgtgagtaggctgtttctgaaagcccaggcccttctttttggcggttatcgggacgccttagtttgctcccccggccagccagtgacctttagcgaggaggttttcctagctcagaagcctggagcgccactgcaggcctttcatcggagggccgtgcatctgcaacttttcaagcaattcatcgaggcgaggctggagaaactgaacaaaggtgaggggtttagcgatcagttcgaacaagagatcaccggctgcggggcctcaagcggcgccttacgcagctaccaactgtgggcagataatctgaaaaaggggggtggagccctgttgcactctgtgaaggcaaagacccagcctgccgtgaaaaacatgtatcgttccgctaaatctggactcaaaggggtgcagtccctgctcatgtacaaagatggagacagcgtgcttcagcgggggggctcattgagggctcctgcactgccttcacggtctgaccggttgcaacagaggttaccaataactcaacactttggcaagaacaggcccttaaggccatcacgacgccggcagttggaggaaggtacatctgagcctccaggtgcgggcacgccgccactgagccctgaggacgagggctgcccttgggctgaagaagccctcgactccagtttcctggggtcaggcgaagagctggacctcctttctgaaatcttggactcgctaagtatgggcgctaaaagcgctggatctctccggcccagccaaagtttagactgctgtcacaggggggatctagatagctgttttagcctccccaacataccaaggtggcagcctgacgacaagaagcttcctgagcccgagccccagccactgagcctgcctagcctccagaacgcttcctcactggacgcaacctcctcatctaaagatagccggtctcagttaatcccctccgagagcgaccaggaagtcacctccccaagccaaagctccaccgcctcggccgatcccagtatatggggtgatccaaagcctagcccgctgacagagccactgattttgcacctgactccctctcacaaagcagcggaggattcaactgctcaggagaaccccaccccatggttatcaaccgccccgaccgagccaagccctccagagtccccccagatcctggcaccaacaaaacccaactttgatatcgcctggacgagccaaccgctggacccttcctcagatccatcatcattggaggaccccagggctaggccgcccaaagctctcctggctgagagggcccatctccagccccgggaagaaccaggtgccctcaactcccccgccacccccaccagtaattgtcagaaatcccagccatcgagtagacctcgggttgccgatttgaagaaatgttttgaggggtag

SEQ ID NO: 114386 - DNA, 2274 bp, Artificial Sequence
  Description of Artificial Sequence: Synthetic coding sequence
atgcaaatggtgccaaagttctgtttcccattcgatgtggaacgtgaaccaccctcaccagcagtccaacatttcacattcgcacttaccgatctggctggcaatagacgttttgggttctgccgtttgcgcgccggaacccagagctgtctgtgtattctgtctcacctgccgtggttcgaggtcttctataaactcctgaataccgtgggtgatctgctggctcaggaccaggtgacagaagccgaggagctgctacagaatctttttcagcagagcttgagcggtcctcaggcctcggtcggactggagcttggtagcggcgtgactgtcagcagcggccaaggcattccccctccgaccagggggaacagcaaacctctttcttgctttgttgcccccgatagtggccgcctcccgagtatccccgagaacaggaatcttacagaattagtggtggctgtgactgacgagaatatcgtgggcctcttcgccgcactgctggcagagaggcgtgtgctcctcaccgcatcaaagcttagcactctcacatcatgcgttcacgcttcctgcgcgcttctctacccaatgagatgggagcatgtgctcatcccgaccctacccccacacctgctggactactgttgtgctcctatgccttatcttatcggtgtccacgcgtcattggctgagagggttcgggagaaagcactggaggacgtggtggtactaaacgttgatgctaatacactagagacaactttcaatgacgtacaggcactgccaccagacgtcgtgtcccttctgcgtctgaggcttcgcaaggtggcgttagctccaggtgaaggagtgtcaaggctgtttcttaaagcccaggccctccttttcggcgggtatcgtgatgctttggtgtgtagcccgggacagcctgttaccttcagtgaagaagtattcctggcacagaaacccggtgccccactgcaggcattccaccgacgtgccgtgcatctccaactgttcaagcagtttatcgaggctcgactggagaaacttaacaagggagaggggttctctgatcagttcgaacaggagatcaccgggtgtggtgccagcagcggggccctgagaagttaccagctttgggctgacaacttgaaaaaaggtggtggcgctctactgcattctgtcaaagctaagacgcagcccgctgtgaaaaacatgtatcggtctgccaagagcggcctaaaaggagtgcagagcctgttgatgtacaaggacggcgactccgttctgcaaaggggtgggtccctgagggcccccgcactgccctctagatctgatcgcttgcagcaaagactacccatcacgcagcattttggtaagaatcggcccctccggcctagccggaggaggcaactggaggaagggaccagtgagccccccggtgccggtacgcctcccctgtcacctgaagacgagggatgtccctgggccgaggaggccttagacagttcctttctgggctctggtgaagagttggacttgctctcagagattttggacagtctgagcatgggtgctaagtcagcaggttctctccgccccagtcagtctctggactgttgccaccggggggatctggactcttgcttctccctgccaaacataccacgatggcaaccagatgacaagaaacttcctgaaccagagccccaaccattgagcctccctagcctacagaacgccagctcactcgatgctacttcatccagcaaggatagtaggagtcagctgattccttccgagtcagaccaggaggtgacctccccgtctcaaagctctactgccagtgccgatccctccatttggggagaccccaagccgtctccactgacagagccgctcatcctccatctgacaccttcccataaagcagctgaggatagcacggcccaggaaaaccccactccttggttgtctactgctcctacagaaccatcccctcccgagagtccccagatcttagcacctactaagcctaacttcgatatcgcctggacaagccaacccctagatccttcaagtgacccttcctccctcgaggaccctcgagccaggcctcccaaggccctgctggcggaacgcgcccacttgcagccgagagaggagcctggagccctgaatagccctgctacgccaacatccaactgccagaagtcacagccaagctcccgcccgcgagtggcagacctgaagaaatgcttcgaaggatag

SEQ ID NO: 114387 - DNA, 2193 bp, Artificial Sequence
  Description of Artificial Sequence: Synthetic coding sequence
atgctgttcaattctgtgctacgacaacctcagctgggcgttctaagaaatggctggtcttctcagtatcccttacagtcattgctgactggttatcagtgcagtggaaacgacgagcacacttcctacggcgagacaggcgtccctgttcctcccttcggctgcacattctccagtgctcccaatatggagcacgtgctggccgtggccaatgaggaggggttcgtgcgcctgtataatactgaatcccaatcgttccgcaaaaagtgcttcaaggaatggatggcccactggaatgctgtgttcgatttggcgtgggtacctggggaactgaaactcgttaccgcagcgggtgatcagacggctaaattttgggatgtgaaagctggcgaactgattggaacatgtaagggacatcagtgttctctcaaatcagtagctttctctaagtttgagaaagctgtcttttgtacaggtggcagagacgggaatatcatggtttgggacaccaggtgtaacaagaaagatggtttctaccgtcaggtgaaccagatcagtggcgctcacaatacctcagacaagcagactccttcaaaacccaaaaaaaagcagaattctaaaggtctggcccctagcgtggacttccagcaatctgtaaccgtcgtactgtttcaggatgaaaacaccctggtgtctgccggagcagtcgacgggattattaaggtatgggacttgcgcaagaactacactgcttacagacaagagcctattgcttccaagtcctttctgtatcccggctcaagtaccaggaaactggggtactccagcctaattttagattccaccgggtccaccctgttcgccaattgcacagatgacaacatttacatgttcaatatgactggcttgaaaacatcaccagtcgccatattcaacgggcatcaaaattctactttttatgtgaagagttccctgtcccctgacgaccaattcttggtatcggggtcttcagacgaagccgcttacatttggaaagtctccacaccatggcaacctccaacagtgctgctggggcactcacaggaggtcacatcggtgtgttggtgcccatcagacttcacaaaaatcgccacatgttcagatgacaatacactcaagatctggcgattgaatcgcggcctcgaggaaaagcctgggggggacaagttgtccacagtgggctgggctagtcagaaaaagaaagaaagtaggcctgggctcgtcacagtgacttccagtcagtcaacacccgcgaaggcccccagggctaagtgtaatcctagtaacagcagtccttcaagtgctgcatgcgccccatcttgcgccggtgatttgcccctcccaagtaatacgcccacattcagtatcaagacgagcccagcaaaggccaggtcccccatcaacagacgcgggtcagtgagctctgtgtcacctaagccaccttctagttttaaaatgtccatcagaaattgggtaacaaggactccatcaagcagccctcccataaccccccccgccagcgagacaaaaattatgagcccccggaaagcattaattcccgttagccagaaaagttcacaggccgaagcatgttccgagagtagaaatagagtgaagcgtcgactggactcaagttgcttggagagcgtgaagcagaagtgtgtgaagtcatgcaactgtgtcacggagctcgatggccaggtcgagaacctccatctggatctttgttgcctggccggcaaccaggaggacctgtcaaaggacagcttaggccccactaagtcatcgaaaatagagggcgctggtacttctatatccgagccgcccagccccattagcccctatgcaagcgagtcatgcggaacattgcctcttcccctcagaccgtgcggagaaggatcagaaatggtgggcaaggagaactcaagcccggagaataagaattggctccttgccatggctgccaaacgtaaagccgaaaacccaagtccacgttccccctcaagtcagactcctaactccagaaggcagtcaggaaagaagctgccctcaccggtgaccatcacccctagctccatgagaaaaatctgtacgtattttcatcgaaagagtcaggaagatttctgcgggcccgagcactccactgagctgtag

SEQ ID NO: 114388 - DNA, 1230 bp, Artificial Sequence
  Description of Artificial Sequence: Synthetic coding sequence
atgctatttaatagtgtactgagacagccgcagctgggcgtgttacgcaacggctggtcatcacaatacccactccagtctctgcttactgggtatcagtgttccggcaatgacgaacacacctcatacggagagacaggcgttccggtgcccccctttgggtgtacatttagctcagatgacaacaccctgaagatctggcggctcaatcgcggtctggaggagaagccaggaggcgataagttgagcaccgttggttgggcgagtcagaaaaagaaagaatccagaccgggccttgtcacggtgacttcttctcagtctaccccagcaaaggccccacgcgcgaaatgcaacccgagcaatagctccccctcatccgccgcttgtgcccctagttgtgccggtgatctcccgcttccctctaatactccgacctttagtattaaaacgtcaccggccaaggcccgttctcctattaaccgccgagggtccgtcagcagtgtgtcacctaaaccaccctcctcgttcaaaatgtcgatcagaaactgggtgacacgcaccccttcctcctctccacccattaccccccctgctagcgagaccaagataatgtcacccaggaaggccttaatccctgtttcacagaagagttcccaagccgaggcttgtagtgaatccaggaacagggtgaagcgccgactggatagtagctgcctggagagtgtgaagcagaagtgtgtgaaatcatgtaactgcgtgacagagcttgacggtcaggtagagaatctgcacctggacctctgttgtctcgccggcaatcaagaggaccttagtaaggactcgctgggcccaacaaagtcatcaaagatagaaggcgcaggaacctcaatttccgagcctcctagccccatttcgccttacgcctccgaatcttgcggtaccttgccgctccctctccggccgtgcggggaaggatctgagatggtgggcaaggagaacagtagtcccgaaaacaagaactggcttctggccatggccgccaaaagaaaagctgagaaccccagtccccgctccccttcttcgcagacaccgaactctcgacgccagtccggcaagaagcttccaagccctgtgaccattactccaagctccatgagaaaaatctgcacatacttccaccgcaaaagccaggaagacttttgcggccccgagcattccacagagctgtag

SEQ ID NO: 114389 - DNA, 2067 bp, Artificial Sequence
  Description of Artificial Sequence: Synthetic coding sequence
atgctcttcaattccgtgctcagacagcctcagctcggagtcttgcggaatgctcccaacatggaacatgtgcttgccgtggcaaatgaagagggattcgtgaggttatataatacagaatcacagtccttcagaaagaagtgttttaaagaatggatggcccactggaacgctgtatttgacctggcatgggttcctggtgaattaaagctggtcaccgcagctggcgatcagaccgcaaagttctgggacgtgaaggcaggagaactcattgggacgtgcaaggggcaccagtgcagcctgaaaagcgtggctttcagcaaattcgaaaaagctgttttttgcaccggcggccgcgatgggaacatcatggtgtgggataccagatgcaacaagaaggatggattctaccggcaggtgaatcagatttcgggtgcacataatacctccgataaacaaaccccgtctaaacctaaaaagaagcagaattctaagggccttgcccccagtgtcgattttcagcaaagcgtgacggtcgtactcttccaggacgagaatacgctggtgtctgcgggcgctgtagacgggataatcaaggtctgggacctacgcaagaactacacagcgtatcggcaggaacctatcgcttccaagagctttctctatccaggaagctcgacccgaaaactggggtattcttccctgatactggactcgactggctccaccctcttcgccaactgcacagacgataatatctatatgttcaatatgacaggtctgaaaacctctcccgtcgccatctttaatggccaccagaacagtaccttttacgtaaagagcagcctcagccctgacgaccagtttctggtgtcgggaagtagcgacgaggctgcctacatttggaaagtaagtaccccatggcaaccccctacggtcctgttggggcactcccaggaggtaacttcggtttgttggtgtcccagtgactttacgaagatcgccacttgtagtgatgacaacactcttaaaatttggcgcctgaatcgcggacttgaagagaaacctggcggtgacaagctctccacggtcggctgggcatcacaaaaaaaaaaggaatcccgtccagggctggttactgtgacatcttctcagagtacccccgccaaggcccctcgagctaaatgtaacccatcgaacagcagcccttcatctgccgcatgcgccccctcttgtgccggcgacctcccacttccatctaatactcccactttctccataaagacttctcccgctaaagctcggtcccctatcaacaggcgcggatcagtcagcagcgtgtctcccaaaccaccttcaagctttaaaatgagcatccgtaactgggtgactaggaccccttcatcgagcccccccatcaccccccctgcctccgagacgaagataatgagtcctagaaaggccttaatccccgttagtcaaaagtctagccaggccgaggcttgctctgaatctcgaaatagagtgaaacgccgtcttgactccagctgtcttgaaagcgtcaagcaaaagtgtgttaagtcatgcaactgtgtcactgagcttgacggtcaagttgaaaacctgcatctggacctctgctgcctggctgggaaccaagaagacctgtcaaaggactcactgggcccgactaagtcatctaagattgagggcgccggtacatcaatctccgagccaccatcgccaattagcccatacgccagtgaatcctgcggcactctgcccctgccactgagaccttgtggggagggaagcgagatggtgggtaaggaaaactcatccccagagaacaagaattggctgctggctatggctgcaaagcgtaaagccgagaatccttctcccagaagcccatcgtcacagacgccaaactcacggcgacagtctggaaaaaagctgccatcaccagtgacaattactccctcaagcatgaggaaaatctgtacatattttcataggaagagtcaagaggatttttgtggacctgagcactcgaccgagctctag

SEQ ID NO: 114390 - DNA, 1494 bp, Artificial Sequence
  Description of Artificial Sequence: Synthetic coding sequence
atgaagataagcatcctgctaatgttcctgtggggcctgagttgcgcactcccggttacacgatatcagaataacgagtccgaagactccgaggagtggaaaggccacctcgctcaggcccccacaccccctctggccaacgaagacccaagtgatagcacccaaagtgaggaagggcttggatcagatgatcatcagtacatatatagattggccggcgggtttagccgttcaacaggaaaggggggtgatgataaggacgacgatgaagatgatagcggagacgacacctttggggacgatgattcagggccagggcccaaggaccgccaggaaggcggcaactcccgcctcggttcggatgaggattcagacgatactatacaagccagtgaagagtcagcacctcagggccaggactcggcgcaggatacgacgtccgaatcacgcgagctagataacgaagatcgcgtggatagcaaacccgaggggggggattcaacccaggagtcagagtccgaagaacattgggttgggggcggaagcgacggcgaaagctcccacggagacggatcagaactggatgatgaaggtatgcagtcggacgaccctgaatctattcgaagtgagagagggaacagccgcatgaacagtgcagggatgaagagtaaggagtctggagagaactccgagcaggctaacacacaagatagcggaggcagccaactgcttgagcacccttcacgcaagatcttcaggaaatcccgtatctccgaggaggatgatcggagcgaactggatgacaacaataccatggaagaggtcaagtccgacagcactgaaaattcaaactcaagggacaccggactctctcagccccgccgagactcaaaaggtgacagtcaggaggattcaaaggagaatctctcgcaagaggaaagccagaatgtggacggaccatcctccgagtcctcccaggaagccaacttgtctagccaggagaatagctccgagtcccaggaggaggtggtttctgagagcaggggagataatcccgacccaacaaccagttacgtggaggatcaggaggattcagacagttcagaggaggattctagccatacactgagtcactccaagagcgaatccagggaggaacaggccgattcggagtcctcagaaagcctgaacttctccgaagagagtccagagagtcccgaggatgaaaactcaagcagccaagaaggattgcagtcacatagcagctctgccgaatcacagtcggaggaatctcacagcgaggaagacgacagcgacagtcaggattcatctcgctcaaaggaggactctaattctacagagagtaaatccagttcagaggaagatgggcagctgaagaacattgagattgaaagccggaaactcaccgtggacgcttaccacaacaagcctattggtgatcaggatgacaatgactgccaggacggatactag

SEQ ID NO: 114391 - DNA, 1542 bp, Artificial Sequence
  Description of Artificial Sequence: Synthetic coding sequence
atgaagatttccatcttgttgatgttcttatggggactgagttgcgctctgcctgtgactcgctaccagaataatgaatcagaggattccgaggaatggaagggccatctggctcaggcaccaacaccccctcttgagtcctcagagtcttcagaagggagcaaagtgagctctgaggaacaggctaacgaggacccctccgacagcactcaatctgaagagggacttggaagcgatgaccaccagtacatctatcggctagccggcgggttctctagaagcacagggaaggggggagacgacaaggatgatgatgaagatgattctggcgatgacacattcggagatgacgacagtggaccaggacccaaggatagacaggagggtggaaactcaagactgggaagcgatgaggacagtgacgacaccatacaagcaagtgaggagtccgccccacagggccaggactccgctcaagacactacctccgagagccgagaattggacaacgaagatagagtcgacagtaagcctgagggaggcgatagtacacaggaaagcgaatcagaggaacactgggtgggcggggggtcagatggagagtcctctcatggagacggcagtgagctggacgatgagggcatgcagtccgacgaccctgagagtatccgatctgaacgcggtaactccagaatgaacagtgccggaatgaagtccaaggaatcgggagagaattctgaacaagctaatacacaggatagtggcgggtcccaactgctggagcatccatcgcgaaagatcttccggaagtctagaatctctgaggaggatgatcggtccgagctggatgataacaatacaatggaggaggtgaagtccgactccacagagaacagtaactctagggacactggcttgtcccagcctcggagagattcaaagggagacagtcaggaggacagcaaggagaatttgtcacaggaagaaagtcagaacgtcgacgggcctagcagtgagtcaagccaggaagccaatttgagttcccaggaaaacagctctgaatcccaagaagaagtggtgtcagaatcccggggggacaatccggacccaactacttcctacgttgaggatcaggaagattcagatagctcagaagaagactcctctcacacattatctcactcgaagagtgaaagccgcgaggagcaggccgattccgagtctagcgaatctcttaacttctcagaggagtctcctgagtctcccgaagatgagaattcaagttctcaggaagggctgcagtcccactcctccagcgcagaatctcaatccgaggaatcgcactctgaggaggacgatagtgacagccaggattcttcacgcagcaaggaagacagtaacagtaccgagtctaagtcatcgagtgaggaggatgggcagctgaaaaatattgaaatcgaatctcggaagctgaccgttgacgcatatcacaacaagccaatcggcgaccaggatgataacgactgccaagacggttactag

SEQ ID NO: 114392 - DNA, 3906 bp, Artificial Sequence
  Description of Artificial Sequence: Synthetic coding sequence
atgaagattataacctacttctgtatttgggcggtggcctgggccatcccagtgcctcagtctaaacctctggaacgccacgttgagaaaagtatgaatttgcacctactggcaaggagtaatgtatctgtccaagatgagctgaacgcatcagggacaatcaaagagtctggagtgttagtgcacgaaggggaccggggccggcaggagaatacccaggacggccacaagggcgagggtaatgggagtaagtgggccgaggttggcggaaagagtttttcaacctactcaacgttagctaatgaggagggaaatatcgagggctggaacggggatacgggtaaggcggaaacttatggtcacgacggcatccacggcaaggaggagaatatcacggctaacggtattcaaggccaggttagtatcatcgacaacgcgggcgccacgaacaggagcaataccaacggcaatacagacaagaacactcagaacggcgacgtcggggacgctggacacaatgaggacgtggcagttgtgcaggaagacggcccccaagtggccggctctaacaactctactgataacgaagatgagatcattgagaactcatgtcgtaacgaggggaacacatccgagataaccccccagatcaacagtaaaagaaacggtacaaaggaagccgaagtgacccccggaacaggggaggacgcggggctcgacaactctgacgggtccccatccggcaacggcgccgatgaggacgaggatgagggcagcggtgatgatgaagatgaggaggcaggcaatggcaaagactccagtaacaatagcaagggtcaagagggccaggaccatggcaaagaggacgaccatgattcatctattgggcagaactctgattcgaaggagtactatgatccggaagggaaagaagacccccataatgaggttgacggagacaaaacaagcaagtcggaggagaattctgcaggcattccagaggacaacggctcgcagcggatcgaggacacacaaaagctcaaccaccgagaatctaaacgggttgagaaccggataacaaaggagtctgaaactcacgccgtgggtaaaagccaggacaaaggcatcgagatcaaggggccttcctccggcaataggaacattacaaaggaggtgggtaagggaaacgaaggaaaggaggacaagggccaacatggtatgatcctgggcaaagggaacgtgaagacacagggcgaggtggtgaatatcgagggcccagggcagaaaagtgagcccggcaataaagttggacacagcaacacaggttccgatagtaatagcgatggatacgatagttacgatttcgacgataagtctatgcaaggggacgaccccaatagttctgatgagagtaatggcaatgacgacgccaacagcgagtccgacaacaactcttctagccgcggggacgccagctacaactccgatgaaagcaaagacaacggtaatggttctgatagcaagggcgccgaggatgatgactctgactcaacctcggacacaaacaatagcgactccaatggaaatggcaacaacgggaatgatgacaacgataagtcagactccgggaagggcaaatccgatagcagtgatagtgactctagcgactcttcgaactcttcagattcatcagatagcagtgattctgactcatccgactctaactctagcagcgactctgacagctccgacagcgattctagtgactcttctgacagcgattccagcgactcttcaaactcctcagactccagtgacagttcagatagcagtgattcaagtgactctagcgattcaagcgacagcaaaagcgactcctccaagagtgagagcgatagttcagactcggactctaagagtgactcaagcgattctaattcttccgactcctcagacaattccgactcgtccgattcatcaaattccagcaactcatctgatagtagcgactcatcagactctagcgattcaagtagtagttcggattcctcaaatagctctgatagctccgactccagcgactcctcaaacagcagcgaaagtagtgacagtagcgacagctctgactccgacagcagtgatagcagcgattcctctaacagtaatagctccgattcagatagtagcaattcctctgatagctcggacagcagtaattcatctgactcatcagacagcagtgactcttccaactctagtgacagttctgactcctcagatagctcaaacagttccgacagctccgacagctccgattccagtgactcctctgatagcagcaacagttctgattccaacgactcctctaacagttccgatagctccgacagttccaattcttccgatagttcaaacagcagcgacagttctgactctagtgatagcagcgattctgatagttctaacagctccgatagctccaattcctctgattcctctgacagttctaactcgtcggactcaagtgactcctctgactcatctgacgggagcgattctgattcctccaacaggtcagacagtagtaactctagtgatagtagtgatagctctgactccagcaactcttctgactcttccgactcttctgacagcaacgagagcagcaactctagcgacagctctgactcatccaacagcagtgattctgacagttcggatagctccaactcttccgattccagtgatagtagcaactcctctgactcctcggagtcttctaattcatcggataattctaatagcagcgactcctcgaacagttctgactcttctgacagctccgattcttctaacagcagtgactctagtaattcttccgactctagtaatagcagtgactcttccgactccaacagttctgactcttcagacagttccaactccagtgactcctctgactcgtcggatagcagtgactcatctgacagctctgatagttcaaatagtagcgactccagtgatagctctgattccagcgattcatccaatagcagcgactcctctaactcttccgactcctctaactccagtgactcatccgattcctccgactcgtccgatagttcagactcctcagactccagcgactcctccgacagcagcaattcttccgatagtagcgactcttcagacagctctgactcctcagacagtagtgacagcagcgattcctctgactctagtgaaagtagcgattcatccgactcctctaattcctccgactcttccgacagcagcgacagtagcgacagcagtgattcttctgactcatctgacagcagtgattcatccgattcgtccaattcctctgactctagtgattctagcgactcttccgactcatctgattcaagtaattcctctgactcatctgacagtagcgagtcctccgactcttctgattcatccgacagcagtgattctagtgattcaagtgattccagcgattcctccgatagctcggactcctctaatagtagtgattcttcagatagttctgactctagcgactcttctgactccagcgacagctctgactcaagcgattcctcagatagctccgactcatccgactcttctgactcctccgacagctcagactcctctgactcgtcagactcatctgacagcaatgaatctagcgattcttccgacagctccgacagttcagacagcagcaattcctccgactcctctgactcttccgattccagcgacagcacctccgattccaatgacgagagcgacagccaatcaaaatctgggaatggaaataataacggttccgattcagacagtgattctgagggctcggactctaaccatagcaccagcgacgactag

SEQ ID NO: 114393 - DNA, 3906 bp, Artificial Sequence
  Description of Artificial Sequence: Synthetic coding sequence
atgaaaatcatcacatacttctgtatctgggctgtggcctgggcaatccccgtgccccaatcaaaacctctggagaggcatgttgagaaaagcatgaacctgcacctgcttgctaggagtaatgtgtccgtgcaggacgagctcaatgcctctggaacaatcaaagagagcggcgtgcttgtgcacgagggggacaggggcagacaggagaacactcaggatggccacaagggcgagggcaatggcagcaaatgggcggaggtgggtggtaaatcattcagtacttacagcactctcgcaaatgaggaagggaacattgaaggctggaatggcgataccggcaaagcagaaacttatggtcacgacggcatccacggaaaggaagagaatattaccgccaatgggatccagggccaggttagtatcattgacaacgctggcgccactaatcggtctaacacaaacggcaataccgataaaaacacccagaatggcgacgtcggagacgccgggcataacgaagatgtggccgtggtccaggaagatggtccccaggtagcaggcagtaacaattctaccgataatgaggacgaaattattgagaactcctgccgcaatgagggaaatacttctgagatcacccctcagatcaattccaaaaggaatgggaccaaagaggctgaggttacccccgggactggagaggacgcaggcctggacaattccgatggaagtcccagcggtaacggcgccgacgaagacgaagacgagggctctggagacgacgaggacgaggaggcggggaacggaaaggatagcagcaataacagtaagggccaagaagggcaggatcatggtaaggaagatgaccacgatagtagcataggacagaacagcgatagtaaagaatactacgatcctgaagggaaggaggatccacacaacgaggtggatggcgacaaaactagtaagagtgaggagaattcagcaggcattcccgaggacaacgggagccagcgcatcgaagatacacaaaagctaaatcatagggagtcaaagagagtggaaaaccgcattactaaggaatctgaaacacacgcagtggggaaaagtcaggataaaggaatcgaaattaaaggtccaagcagcgggaaccgcaacatcacgaaagaggtgggtaagggaaacgagggcaaggaggacaagggtcagcacggaatgattctcggaaagggaaatgtaaagacacagggggaggtggtgaatatcgaaggacccggacagaagagtgagcctgggaacaaggttggtcacagcaatactggctctgattctaactctgatggatacgatagctatgactttgacgataagagtatgcagggggatgacccaaattcttctgacgagagcaacggcaacgatgatgcaaattctgaaagcgataacaacagcagctcacggggtgatgccagttataactccgacgagtcaaaggacaacgggaacggttccgatagcaaaggagcagaagacgatgattctgattccaccagcgatacgaataacagtgacagcaatggcaacggaaataatggtaacgatgacaacgataagtccgattcgggaaaagggaaatctgacagctctgattcggactcctcagacagtagcaacagcagtgacagttcagacagcagtgattcagacagcagcgacagtaattcctcctccgacagtgactcctctgattctgatagctccgattcttctgattcagacagctctgatagctctaacagcagtgactccagcgattcttccgacagctctgactcatccgatagtagtgattcctcagactccaagagcgactccagcaagtccgagtcagacagtagcgactctgatagcaagtctgactctagcgacagtaactctagcgattcctctgacaactcagactccagcgactcaagtaatagcagtaattccagcgactcgtctgatagcagtgattcatccgactcttcgtcctcgtcagactccagtaactcctcagatagcagtgattccagcgattcgtccaacagctcagagtccagcgacagtagtgattcctctgactccgacagcagtgatagttctgactcgagcaacagtaactcatccgattctgatagctcaaattcttccgatagtagcgattcctcaaactcatcagactcatcagactcctccgattcctccaatagctctgattccagtgactcaagcgattcctctaattcttcagactcatctgattcaagtgactcgagtgacagctctgatagctcaaacagttcagattccaacgattcatcaaacagctcagattcttccgactcaagcaacagcagcgacagcagcaattcctctgactcatccgactcttccgactcttccgactcagactccagcaacagttccgactcgtccaactcgtcagactcatcagacagtagtaactctagcgactcgtctgatagctcagactcctcagatggctccgactcggacagcagcaatcggtcagattcatccaactctagcgactcttccgacagtagcgacagttccaattcctcagactctagcgactcttcagacagcaatgaatcaagcaatagctctgattcgtctgatagttctaactcttccgacagcgattcaagtgacagctccaattcttctgattcttcagactcatccaattcaagtgactcttcagaatcgagcaactcatccgataattcaaatagcagcgattcaagcaactcctcagacagctccgacagtagcgatagtagcaactcatctgacagcagcaattcttcagattcatccaacagctctgattcatcagacagcaactcttcagactcaagtgactcgtcaaatagtagtgatagctctgatagcagcgactcctccgattcgtctgactcctcagatagctcaaattcctccgatagctctgattcctccgacagctcagattcctctaacagctctgacagttcaaactcatctgatagcagcaacagctcagacagctccgatagttccgattctagcgatagttccgactcgagtgactctagtgattccagtgactcttccaactcctcagatagtagtgactctagtgactcttcagatagctcggactcctccgacagctctgatagttccgacagcagtgagagtagcgattcctctgatagttccaatagttccgactctagcgattcctctgactccagcgactcctcagactcatctgactctagtgacagcagcgacagcagcgatagcagcaactctagcgactccagcgactcatctgactcctcggattcctccgattccagcaattcttccgactccagtgactcatccgagtcatctgatagcagcgactccagcgactcctcagactctagcgattcctccgactcttccgattcctccgacagctcagattcttcaaacagctcggacagctcggattcaagcgattcttcagatagcagcgatagttcagattcatccgacagctcagatagcagcgacagcagtgactccagtgactcctcggactccagtgactcctccgacagctcagacagtagtgacagcagcgacagcaatgaaagctccgactctagcgacagttctgatagttctgactcttctaatagcagcgacagtagtgattcatctgattcctctgactccacaagtgattcgaacgatgaatccgacagccagtctaaatcaggcaatggtaacaacaacggaagcgacagtgactcagatagtgaaggttcagattccaatcacagtacctccgacgattag

SEQ ID NO: 114394 - DNA, 783 bp, Artificial Sequence
  Description of Artificial Sequence: Synthetic coding sequence
atggcaacaccaccaaagagaagctgtccaagtttttctgcctccagcgaaggaacccgcataaagaagatctccatcgagggcaatatcgccgccgggaaaagcaccttcgtcaatatcctgaagcagctgtgcgaggattgggaggtggtgccggaacccgtggctagatggtgtaacgttcagagcacacaggacgaattcgaggaactgaccatgtctcagaaaaacgggggcaacgtgctgcagatgatgtacgagaagcccgagcgctggtcattcaccttccaaacttacgcttgcctctctcgcattagagcacagctggctagtctgaatggcaagttgaaagacgcagagaagcccgtcttgtttttcgagcgcagtgtgtactctgataggtacatcttcgcttccaacctatatgagagtgaatgcatgaatgagactgaatggaccatttaccaggactggcacgactggatgaacaatcagtttggacagagtttggaattggatggcattatctacctccaggccactccggagacctgtctgcatcggatctacctcagaggtcggaatgaagaacaaggaattccgctcgagtacctggaaaagctccactacaaacacgaatcctggctgctgcatcgcaccctaaagactaatttcgattacctgcaggaagtgcctattctgaccctggatgtcaacgaggacttcaaagataaatacgaatcactggtggagaaagtgaaggagtttcttagcactctgtag

SEQ ID NO: 114395 - DNA, 48 bp, Artificial Sequence
  Description of Artificial Sequence: Synthetic coding sequence
atggccacaccgccaaagcgatcctgtccttccttttctgcgtcttag

SEQ ID NO: 114396 - DNA, 834 bp, Artificial Sequence
  Description of Artificial Sequence: Synthetic coding sequence
atggccgccggccgcctgtttttaagtcgcctccgcgcaccctttagtagcatggccaagagtccccttgaaggggtatcatcttcccgcggcctccacgcgggacgcggtcctagaagactctcgatcgagggcaacattgccgtgggtaagagcacgttcgtgaaactactaaccaaaacctaccccgaatggcacgttgctaccgaaccggtcgccacctggcaaaacatccaggctgctggcacccaaaaagcctgcacggctcagtcccttggcaatttactagacatgatgtatcgcgagccagcccggtggtcttataccttccagacctttagttttctgagccgtttgaaggtgcaactggagccctttccagagaaactgctgcaggcccggaagcccgtgcagatttttgagcgcagcgtatacagtgacaggtacatttttgccaagaaccttttcgagaacggaagtctttccgacattgaatggcatatttatcaggactggcacagctttctgctgtgggaatttgcatcaagaatcactctacacggctttatctacctccaagcctctccgcaggtatgtctgaaaaggctataccaacgggcacgcgaggaagagaagggaattgagctggcgtatctggaacagttgcacggacagcatgaagcctggcttatccataaaacaacaaaactccacttcgaggcattgatgaacatccccgtactggtcttggacgtgaacgatgacttctccgaggaggtcaccaagcaagaagatctgatgcgggaagtaaatacgtttgtgaagaatctttag

SEQ ID NO: 114397 - DNA, 720 bp, Artificial Sequence
  Description of Artificial Sequence: Synthetic coding sequence
atggccgctggaagactgttcctgtccagactgcgcgctcccttcagctctatggctaagtcacccctggaaggtgttagcagttctaggggcctgcacgcaggtcgcggaccgcggagactgtccatcgagggaaacatcgcatgcactgcacagagccttggcaatctgttagatatgatgtatagggaacctgcacggtggtcatatacctttcagacattttcattcctcagtcggctgaaggtgcagctggaaccatttccagagaagctgcttcaagccagaaaacctgttcagatattcgagagatcggtttactcagataggtacatcttcgcaaaaaatctctttgagaacggcagtctgagcgacatagagtggcatatctatcaggactggcatagctttttactgtgggaattcgcttcaaggattaccttacatggtttcatctacctgcaggccagcccacaggtatgtctcaaacgcctgtatcagcgagccagagaagaagagaaagggatcgagcttgcttacctcgaacaactccacggtcagcatgaggcctggctcattcacaagaccactaaactccactttgaagctctgatgaatataccagtgctcgttcttgatgtgaatgacgacttttccgaggaagtgacgaagcaggaagaccttatgagagaagtcaatacatttgtaaaaaacttgtag

SEQ ID NO: 114398 - DNA, 570 bp, Artificial Sequence
  Description of Artificial Sequence: Synthetic coding sequence
atggctgcgggcagactattcctgtccagattaagggccccctttagtagcatggccaagagccctctggagggtgttagttcgtctaggggcctgcacgctggaagaggtcctcgccggctaagcatcgagggaaacattgctgtgggaaagagcactttcgtgaaattgctgaccaaaacttaccctgaatggcacgtggctaccgagccagtcgctacctggcaaaacatacaggcagcaggcacccagaaagcctgcacagctcagtcactcgggaaccttctggatatgatgtatagagagccagcccgctggtcctacacctttcagaccttcagtttcctgagccggttaaaagtgcaattggagcctttcccggaaaagcttctgcaggcacgtaaacccgtgcagatctttgagcgttctgtgtactccgatcgcctgcactttgaggctctcatgaacatccccgttctggtgctcgacgtgaacgatgatttcagcgaggaggttacaaagcaggaggacctcatgcgggaggtgaacacgttcgttaaaaacttatag

SEQ ID NO: 114399 - DNA, 768 bp, Artificial Sequence
  Description of Artificial Sequence: Synthetic coding sequence
atggccgccgggaggctgttcctcagtcggctgcgagctccattcagttctatggccaagtcgcctctcgagggggttagctcaagccgcggtctacacgcgggcagagggccgagaaggctcagtatagaaggcaacattgggaatatactgaagcagatccggatgcgcgcccctatccaggagacagcttgtaccgcacagagcctcggaaacctgcttgacatgatgtacagggagcctgctcgctggtcttacacattccaaacattcagttttctctctcgcctgaaggtgcaacttgaacctttcccggagaaactgttgcaggctcggaagcctgtccagattttcgaacggagtgtttattctgataggtatatttttgcaaaaaatctttttgaaaatggaagcctgtcggacatagaatggcacatataccaggactggcattcattcctcctgtgggaattcgctagccggatcacactccatgggttcatctaccttcaggcgagcccgcaggtgtgcctgaagcgcctgtaccaaagggccagagaggaggaaaaggggattgagctggcatacttagagcagctgcacggccaacacgaagcctggctgattcataaaacaaccaagctccatttcgaagctctgatgaatatccccgttctcgtcttagatgtcaacgacgatttctctgaagaggtcacaaaacaagaggatctgatgagagaggtaaacaccttcgtgaagaatttatag

SEQ ID NO: 114400 - DNA, 1416 bp, Artificial Sequence
  Description of Artificial Sequence: Synthetic coding sequence
atggccaaaaaggtcgcggtcatcggcgccggcgtttccggcttgatttcactgaagtgttgtgtggacgagggattggaacccacatgcttcgaacgtactgaagacatcggaggcgtttggcggttcaaggagaacgtggaagacgggagagcatccatttaccagagcgtcgtgactaacacctctaaggaaatgagctgtttcagcgatttccctatgccagaagacttccctaacttcttacacaacagtaaactgctggagtatttccgcattttcgctaagaagtttgacctgctgaagtatatccagttccaaaccacagtcctttctgtacgcaagtgccctgactttagctcatctggacaatggaaagtagttacccagagtaatgggaaggagcagtcagccgttttcgacgcagtgatggtgtgcagtggacaccatattcttcctcacataccactgaagtccttccctgggatggagcggtttaagggccagtacttccacagccggcaatataagcatccagatgggttcgagggtaaacggattctcgttatcggcatgggcaattctggctccgacatcgccgtggagctgagcaagaatgcagctcaagtgttcattagcaccagacacggcacctgggttatgtcaaggattagtgaggatgggtacccctgggattccgttttccacacccgattcaggagcatgctgcggaacgtccttcccagaacggcggttaagtggatgattgagcaacagatgaacagatggttcaatcacgaaaactatgggcttgaacctcagaataagtatatcatgaaagagccagtgcttaatgacgacgttccatcccggctcctgtgcggagcaatcaaggtgaaaagcacagttaaagagttgaccgagactagcgcgatattcgaggacgggaccgtggaggagaacattgatgtgatcatattcgccactggatattctttctctttcccctttttggaagatagtttagtgaaggtcgaaaataacatggtttctctgtacaagtacatcttcccagctcacttagacaaatcaacactggcctgtataggcctaattcaaccactggggagtatctttccaaccgctgagctccaagccagatgggtcactcgggtgttcaaaggcctctgtagtctgccctccgagcgcaccatgatgatggatataattaaaagaaacgaaaaacggattgacctattcggggaatcacagtcgcagacacttcagaccaattacgtcgattatctggacgaactcgcactcgagatcggagcgaagcccgatttctgcagcctgttgtttaaagaccctaagttagccgtaaggctgtactttggtccatgtaacagctattag

SEQ ID NO: 114401 - DNA, 969 bp, Artificial Sequence
  Description of Artificial Sequence: Synthetic coding sequence
atggagggcagtttggaaagagaggcaccagccggagcacttgccgccgtgttaaagcactcttcaacccttccccctgagagtacacaagtcagaggctatgacttcaataggggtgttaactatcgagcactgctagaggccttcggcactaccggttttcaagccacgaattttggccgggcagtacagcaagtaaatgctatgatagagaagaagctggaaccgctctcccaagatgaggaccaacacgctgaccttacgcaaagccgccggcccctcacttcgtgcaccatcttcctggggtatacttctaacctcatttcaagcggaattagggagacgataaggtatttggttcagcacaatatggtggacgttcttgttactactgcaggcggggtggaagaggacctcatcaagtgcttggccccgacctatctgggggagttctccctgcgcggaaaggaactgcgcgagaatgggattaatcgcatcgggaatctcctggttccaaatgaaaactactgcaagttcgaggactggctgatgcccatcctggatcagatggtcatggaacagaataccgagggcgtgaagtggacaccctcaaagatgatcgcgcgactgggtaaggaaatcaacaaccctgagagcgtatactactgggctcaaaagaaccacattcccgtcttctctcctgccctaactgacggttccttaggagacatgattttttttcacagttacaagaacccgggcctggtgctcgatattgtggaggctcaggaatttgatgggtctgacagcggggcccgcccagatgaggccgtgtcctgggggaaaatccgcgttgatgcccagccagtgaaggtgtacgctgacgcctcccttgttttcccattgctggtggcagaaacatttgctcagaagatggatgccttcatgcatgaaaagaatgaggattag

SEQ ID NO: 114402 - DNA, 984 bp, Artificial Sequence
  Description of Artificial Sequence: Synthetic coding sequence
atgcctattatcccggcattctgggaggccgaagccggcggctcaagggaagaagagttcgaaacaagtctggcaaacatgattgaaaaaaaactggaaccgcttagccaggatgaggatcagcacgccgacctgacacaatcaagaagacccctcaccagctgcaccattttccttgggtacactagcaatctcatctcttcaggcattcgtgaaacaatccgatacctagttcagcataatatggtggatgtactggtgacaaccgctggaggcgtggaggaggatctgatcaagtgcctcgcccctacctacctgggggaattctccctccgcggtaaggaattaagggaaaatggaattaaccgaatcgggaatctgctcgtccctaacgaaaattattgcaaatttgaagattggcttatgccgattttagaccagatggtgatggaacagaatacagaaggcgtgaagtggacccccagcaagatgattgctcgcttgggcaaggagattaacaaccccgagagtgtttactactgggcccaaaagaatcacatacctgtattctcacctgcactcaccgatggtagcttaggagacatgatcttttttcatagctacaaaaatccggggctggtactcgacatcgtggaggaccttcgcctcattaacacccaggcaatctttgctaagtgcaccggcatgatcatcctcgggggcggtgttgtgaaacaccacattgccaatgccaatctgatgagaaatggcgctgattatgcagtgtacatcaataccgcccaggaattcgatgggtccgattccggcgcaaggcccgatgaggcagtttcatggggtaaaatcagagtggacgcgcagcctgtaaaagtctacgccgatgccagccttgtttttcctctgttagtggctgaaacgttcgcccagaagatggacgcctttatgcacgagaaaaatgaggactag

SEQ ID NO: 114403 - DNA, 462 bp, Artificial Sequence
  Description of Artificial Sequence: Synthetic coding sequence
atgcctcagctgtgcacccgggcgagctctagcgagattccaggaagactcctcacaacacttcagtcagcccagggccagaaattcctccacttcgctaagagcgatagctttctcgacgacatatttgccgcttggatggcccagcgcctcaagacccacctcctaactgaaacgtggcagcgcaagagacaggagctcccgagtaactgctctcttccgtaccacgtttacaatatcaaagcaatcaaactaagcagacactcttacttttccagctaccaagaccacgcgaagtggtgtatcagtcagaagggtaccaaaaaccgatggacctgtatcggcgatctcaacaggtctccacatcaggcttttagatcaggggggtttatatgcacccaaaattggcagatctatcaggccttccaaggtcttgtgctatactatgagtcttgcaagtag

SEQ ID NO: 114404 - DNA, 1086 bp, Artificial Sequence
  Description of Artificial Sequence: Synthetic coding sequence
atgaaacagaaaatgatggccagattgttgcgaacatctttcgccctcctttttctcggtctcttcggcgtgcttggggctgcaacaatcagctgccgaaacgaggaaggcaaagccgtggattggtttaccttctacaaactcccgaaaagacagaataaggaaagtggtgaaaccggccttgagtacttatacctggacagtaccacccgcagttggagaaagagtgaacaactgatgaatgacaccaagagtgtgctcggacgcaccttgcagcaactgtatgaggcatacgccagcaagtctaacaacacagcctatttgatttacaacgatggggtgccaaagcctgtaaattattctcggaagtatggccacactaagggcctgctgctctggaatagagtgcagggtttctggctgatacactccattccccagttccctcccatcccagaagaaggctacgattatccccctaccggccgacggaatggacagagcggtatttgcattacatttaaatataaccagtatgaggccatcgatagccagctgctcgtctgtaatccaaacgtttacagttgcagtataccagccactttccaccaggaacttattcacatgccccagttgtgcactagggcgtcgtctagcgagatcccaggaagacttttgaccacgctgcaatccgctcaaggacaaaaattcctgcactttgcaaaaagcgactcgttcctcgatgatatctttgccgcctggatggcccagagactgaagacacacctattgacagaaacctggcagcggaagagacaagaactgccttcaaactgcagtctaccatatcatgtctataatataaaagcaattaaactgtcacgccatagttatttttcttcttatcaggaccatgccaaatggtgcatatcacagaagggcaccaaaaataggtggacatgtattggggacctgaatagatcccctcatcaggccttccgaagtggaggattcatctgtacacagaactggcagatataccaggcatttcagggcttagttctgtactacgagtcatgcaaatag

SEQ ID NO: 114405 - DNA, 1317 bp, Artificial Sequence
  Description of Artificial Sequence: Synthetic coding sequence
atggcgttaaggggcgtcagcgtgcggctcctgagccgggggcctggactgcacgtgttacgaacttgggtcagctccgctgcccaaacggagaaagggggtaggacgcagagccaactggctaaaagttcacgtccggaattcgattggcaggatcctcttgttctggaagaacaactgacaaccgatgagatcttgatccgggacacatttaggacctactgtcaggaaaggttaatgccgcggattttgcttgccaacaggaacgaagtgtttcacagagagatcatttcggagatgggggaactaggagtgcttggtcctacgatcaaaggatatggatgtgccggagtgtcatccgtggcctacggactgctggcacgggaactcgagagagtggattcaggctacagatccgcaatgagtgttcagtccagtctggttatgcaccctatctatgcgtatggctctgaggagcagcggcagaaatacctgccgcagctggcaaaaggcgagttactcggctgcttcgggttgactgagcccaactccgggtccgatccctcgagtatggagacgagggctcattataactccagcaacaagtcgtatactttgaatggcactaagacttggatcactaatagtccgatggccgacctgtttgtagtttgggctcgctgcgaagacggatgcattcggggctttttgcttgagaaaggcatgagaggtttgtccgctcctcgcatccagggtaagttttctttgagagcctcagcaaccggcatgatcatcatggatggcgtagaggtgcctgaagaaaacgtgttaccaggcgcttcttcgctgggcggtccatttggatgtctaaacaacgcccgatacggcattgcctggggagtcctcggcgcgtccgaattctgcctgcacactgcccgacagtacgctttagaccgaatgcagtttggggtgccacttgccagaaatcagctgatacaaaagaaactggccgacatgctgacagaaattactttgggcctacacgcctgcctgcagttgggacgccttaaagatcaggataaggctgcacccgagatggtatcactgttgaaacgaaacaattgcggcaaagctctggacattgcacgccaggcccgcgacatgctggggggtaacggcatctcagatgagtaccacgttatccggcatgccatgaacttagaagccgttaacacgtacgagggcacgcacgacatacacgcccttatcctgggcagggcaatcactggcattcaagctttcaccgcttctaagtag

SEQ ID NO: 114406 - DNA, 918 bp, Artificial Sequence
  Description of Artificial Sequence: Synthetic coding sequence
atgatcccacttctcctggctgcattgctgtgtgtcccggctggagctttgacatgctacggcgactcaggacagcccgtggattggttcgtagtgtacaagttgcctgctctccggggcagcggggaggccgcccaacgcgggctgcagtataagtatctggacgaatcctctggaggttggagggacggacgcgcactgatcaattccccagagggagcagtggggagaagcctgcaacctctttacagaagcaacacttctcaactcgctttcctcctgtacaatgaccagcctccacagccatccaaggcacaggattcctccatgcgaggccacaccaagggaaaacagttgacatacacttacccttgggtgtacaattaccagcttgaaggtattttcgctcaggagtttccagatctggagaatgtagtgaaaggccaccatgtgtctcaggaaccatggaactcaagcattactttaactagccaggctggcgcagtcttccagtcatttgcaaaattctccaagtttggcgatgacctttactccggctggctagcagctgccctgggaactaatttacaagtccagttttggcacaaaaccgttggtatactgcctagtaattgttccgatatctggcaagtgttgaatgtcaatcaaatcgcttttccggggcccgctgggcctagttttaacagtacggaagatcacagcaagtggtgtgtatcccctaagggcccatggacttgtgtgggggatatgaacaggaaccagggggaagagcagcgcggcggtggcaccctctgtgcacagttgccggctctctggaaggcgtttcagcctctggttaagaactatcagccatgcaacggcatggcaagaaagcccagccgggcatataagatctag

SEQ ID NO: 114407 - DNA, 909 bp, Artificial Sequence
  Description of Artificial Sequence: Synthetic coding sequence
atgcattaccctaccgcgttgcttttcctgattctggcgaatggggctcaagctttcagaatttgtgcctttaatgcccagcgccttacgctggcaaaagttgcacgggaacaggtgatggacactcttgtgcgtatattggccagatgtgacatcatggttctccaggaggtggttgactctagcggaagtgccattcctctgctgctgcgtgagctgaatcggttcgatggatcaggcccctattctaccctctcttcccctcagctagggcgtagtacctacatggagacctatgtgtacttctacagaagccacaagacacaagtgctgtctagctacgtgtacaacgacgaggatgacgttttcgctcgtgagcctttcgtggcgcaattttctctgccttcgaacgttctccccagcctggttttggttccactgcacacaaccccaaaggcagtggagaaagaactgaatgccctgtatgacgttttcttagaggtgagccagcattggcaaagcaaggatgtaatcctgctcggagacttcaatgctgactgcgcttccctgacaaagaagcgacttgataagcttgagctgaggacagaacctggtttccattgggtgatcgcagacggggaagatacaacggtccgagcctccactcactgcacatacgacagagtcgttctacatggagagaggtgtcgctcgctgctgcacacggccgctgcttttgacttccccacttcatttcagctgactgaagaagaagccctcaacataagcgatcattatcccgttgaagtagaactcaagttgtctcaggcacactcggttcagcctctttcgctcaccgtgttgttactgttgagcctgttgagtccccagttatgccccgccgcctag

SEQ ID NO: 114408 - DNA, 909 bp, Artificial Sequence
  Description of Artificial Sequence: Synthetic coding sequence
atgcactatccaaccgccctgctgttcttaattttggcaaacggagcccaggcctttcggatctgcgcttttaacgctcagagactcaccctggccaaagttgcgcgcgagcaggtgatggatactcttgtaaggattctagcgcggtgcgatattatggtgctccaggaggtcgttgactctagtggaagcgctattcccctgctcctcagggagctgaacagattcgatggaagtggcccctactccacactgagcagccctcaacttggacgaagcacttatatggagacttatgtgtacttctatcggagccataaaacccaggtactgtccagctatgtttacaacgatgaagacgatgtgttcgctagggagcctttcgttgcgcagttctctctgccatctaacgtcctaccctccctggtgctggttcccctgcacactaccccgaaggccgtcgaaaaagaattaaacgctttgtacgatgtgttcctggaggtatctcagcattggcagtcgaaggatgtcatactgctaggggacttcaacgccgactgtgcatccctgacaaagaaaaggctggataaacttgagttacgaaccgaaccaggcttccattgggtgattgcagacggcgaagacactacagttcgggctagcacccactgtacatacgatcgggtcgtgttacatggcgaaaggtgcagatctctgctccacaccgctgctgccttcgatttccccacctctttccagctcacagaagaggaagctctgaacatttccgatcactatccagtcgaggttgagttgaagctgtcccaagcgcactctgtgcagcctctgtcactgaccgtgctcctcctgctgagcttgctctcccctcagctctgccctgccgcctag

SEQ ID NO: 114409 - DNA, 909 bp, Artificial Sequence
  Description of Artificial Sequence: Synthetic coding sequence
atgcattatcctaccgcactgttattcttaatcctggctaatggggcccaggcgttccggatctgtgcgttcaacgcacagcgactgacactagcgaaagtggcccgggagcaggtcatggataccctggtcaggatcctcgctcgttgtgacattatggtgctccaagaggtcgtggacagtagcggatccgcaattcccctactgcttagggagttgaataggtttgatggtagcggcccttatagcacgctgtcctccccgcagttgggcaggtctacatatatggagacctacgtctacttctaccggagtcacaaaactcaggtgctttcctcatacgtgtacaacgacgaggatgacgtctttgctcgagagcctttcgtggctcaattcagtctgccatcaaacgtgttgccatccttagtgctggtccccctgcacacaacgccaaaggcagtggaaaaggaacttaatgcgctctatgacgtattcctagaagtgagccagcactggcagagcaaggacgtgatcctgttgggtgacttcaacgcagattgcgcctcactgaccaagaaacggctggacaaactggagttaagaaccgagcctggattccactgggtgattgccgatggggaggatacgaccgttcgggctagcacccactgtacatatgatcgggtggtgctgcatggggaaagatgccgttcactgctacatacagccgccgcctttgattttccaactagctttcagctgacagaagaagaagcattgaacatttccgaccactatcctgtggaggtggaattaaagctgtcccaggcacactctgtgcaaccgctctccctaactgtgttgctgctcctgtctcttctgtctccccagctgtgtccagccgcctag

SEQ ID NO: 114410 - DNA, 909 bp, Artificial Sequence
  Description of Artificial Sequence: Synthetic coding sequence
atgcactacccaactgccctgctgtttctgatattggccaacggagcgcaagcattcagaatctgtgcttttaacgcccagcgattaaccctcgccaaggtggcaagagaacaggttatggatacattggtgaggatcctcgcccgttgcgatatcatggttttgcaggaggtggtcgatagttcaggctccgcaattcctctgctgctgagggagcttaatcgtttcgacggtagcgggccatatagtactctgagcagtcctcagctcggacgatctacctacatggagacttacgtgtatttttaccgctcccacaaaacccaggtgctgagtagttacgtttataacgacgaggatgacgtctttgcgagggaaccgtttgtcgcccaatttagcctaccaagcaacgtcctcccatcactggttttggtgcccctgcatacaactcctaaagcagtggaaaaggagctgaacgccctctatgatgtcttcttggaggtgagtcaacactggcagagtaaagatgtcattctattgggcgacttcaacgccgactgcgctagtctgacaaagaagaggttggacaaactggagttacgaaccgaacccggctttcactgggttatcgctgatggggaggacaccaccgtgagagccagcacacactgcacttacgatagggtagttttacacggagagaggtgccgttccttgctgcacaccgccgctgctttcgacttccctacatcattccagctaaccgaagaagaggctcttaatatctcagatcactatcccgtcgaggtggaactgaagctttcacaggcccattccgtgcagcccttaagcctcacagtattgctactgctgagcctgctaagcccacagctgtgccccgccgcctag

SEQ ID NO: 114411 - DNA, 909 bp, Artificial Sequence
  Description of Artificial Sequence: Synthetic coding sequence
atgcactatcctactgcactcttgtttctcatcttagcaaatggggcacaggcatttcgcatttgtgcgttcaacgctcagagactgactcttgccaaggtggcgagggaacaggtgatggacacccttgtgaggattcttgcccgatgcgacattatggtcctccaggaagtggtggatagcagcggcagtgctattcctttgctcctgcgggaactcaatcggtttgacggaagcgggccctattcgacccttagttcacctcagcttgggcggtctacgtatatggagacctacgtttatttttatcggtcccacaagactcaggtactttcttcctatgtctacaacgatgaagacgatgtattcgcccgtgaacctttcgttgctcaatttagcctcccaagtaatgtcctgcctagtctggttttagtcccgcttcatactacccccaaggccgtggaaaaggagcttaacgctttgtacgatgtgttcctcgaggtgtctcaacactggcagtctaaagatgtaatactgcttggcgattttaacgctgattgtgcctctctgactaaaaaaaggctggataagctggagcttcgcacagagccgggatttcactgggtgatcgccgatggagaggataccaccgtgagagcttcgacccattgcacatacgatcgcgtcgtgctgcacggtgagagatgtagaagtcttctgcacactgccgccgcgtttgactttccaactagttttcagctgacagaggaggaggctctgaatatctccgatcactatccagttgaagtggagctgaagctctcccaggcccactctgttcagcctttgtccctaaccgtgttgctcttactgtctctcctcagcccccagctctgccctgctgcatag

SEQ ID NO: 114412 - DNA, 909 bp, Artificial Sequence
  Description of Artificial Sequence: Synthetic coding sequence
atgcattaccccacagctctgctgttccttatacttgccaacggcgcccaggcattccgaatttgcgctttcaatgctcagcgtctgaccctggcgaaggtggcgcgagagcaggtaatggacacccttgtgcgcattctcgctaggtgcgacattatggtgttgcaggaggtagtggattccagcggctccgcgattcccctgcttctgcgggagctgaaccgcttcgacgggtctgggccttacagcacactctctagccctcaactcggccgaagtacatatatggagacatatgtgtatttctacagatcccataagactcaggtgctatcttcttatgtgtacaacgacgaggacgacgtgttcgccagggaaccattcgtggcccagttttcattgcctagtaacgttcttccatcactcgtgctggtccctcttcatacaaccccgaaggctgttgagaaggagcttaacgcactgtatgacgtctttctggaggtctcacaacactggcaatcaaaagacgtgattcttttaggggattttaatgcagactgtgcttcactgaccaagaaacgcctcgacaagctcgaactgagaaccgagcccggatttcattgggtgatagcagatggggaagacacaaccgtaagagcctcaacccactgcacctacgaccgcgtcgtcctccacggggagcgatgccgttccctcctgcacaccgctgccgcctttgacttcccaacctctttccagctgaccgaagaggaggccctcaacatttccgaccattatcccgtggaagtggaactcaaactctctcaggcacattcagtgcagcctctatctctgaccgttttactgctgctctcgctgttgagtcctcagttatgtccagccgcctag

SEQ ID NO: 114413 - DNA, 315 bp, Artificial Sequence
  Description of Artificial Sequence: Synthetic coding sequence
atgcactatccgaccgccctgcttttcctgatccttgctaacggggcgcaggcgttcagaatttgcgccttcaacgcccagcgcctgacactggccaaggtcgccagagaacaggtaatggacactctggtgcggattctggcacgctgcgacatcatggtactccaggaagtcgtggactccagtgggagcgccatccctttgttgctcagagaattgaaccggtttgatggatcaggcccatacagcaccctcagctctccacagctcggccgatccacctatatggagacctacgtgtatttttatagatag

SEQ ID NO: 114414 - DNA, 81 bp, Artificial Sequence
  Description of Artificial Sequence: Synthetic coding sequence
atgcactacccgactgcactattgtttctgatcctggcgaacggcgcacaggcttttagaatctgtgctttcaatgcttag

SEQ ID NO: 114415 - DNA, 627 bp, Artificial Sequence
  Description of Artificial Sequence: Synthetic coding sequence
atgcattacccaaccgccctgttgtttctgatcctcgccaatggagcccaggcatttcggatctgcgcttttaacgcacagaggctgaccctagctaaggtcgcaagggagcaggtaatggataccctggtgaggatccttgcaagatgcgatattatggttctccaggaggtggtggactcatccggatccgccattccccttcttttaagggaactgaatcgctttgatgggtccggcccgtactcaaccctgtcatctcctcagctcgggcggagtacctatatggagacttatgtgtatttctacagatcacacaagacacaggtcttgtcatcatacgtttacaatgatgaagatgatgttttcgctcgggagccttttgtcgcccagttcagtctcccaagcaacgtgctccctagcctggtgttggtgcctctccacactaccccaaaagcagtggaaaaggaactgaacgctctgtacgacgtatttctggaggtctctcagcattggcaaagtaaggacgttattctgttgggggacttcaacgccgattgtgccagccttacaaagaagcgcctcgacaaactcgaattgcgtaccgaacctggtttccattggtag

SEQ ID NO: 114416 - DNA, 918 bp, Artificial Sequence
  Description of Artificial Sequence: Synthetic coding sequence
atgtctagggaactcgccccgctactgctcctgctactgagtatccactctgccctggctatgaggatttgcagctttaatgttcgtagctttggagagtcgaaacaagaagacaaaaatgctatggacgtgatagtgaaggtgataaagagatgcgatatcatccttgttatggagataaaggactcgaacaacagaatatgccccatcctgatggaaaagctgaaccgaaattcaaggcgcggcattacatataattacgtgatcagctccagattaggcagaaatacttataaagagcagtacgcctttctctacaaggagaagctagtgtccgtgaagcggagctatcattatcacgattatcaggatggtgatgctgacgtgttctcacgggagccctttgtagtctggtttcagagccctcataccgcagttaaagattttgtaattatccccctgcacaccacgcccgaaacgagtgttaaagagatcgatgaactagttgaagtctacaccgacgtgaaacacagatggaaggcggaaaacttcatattcatgggagacttcaacgcggggtgcagttatgtccctaagaaagcctggaagaacatccgcctgcgcacggatcctaggttcgtgtggcttataggtgaccaggaggacacaacggttaagaagtcgacaaattgcgcatatgatcggatcgtcctccggggtcaagagatcgtatccagtgtagttcctaagtccaactcggtctttgacttccaaaaagcttacaaacttaccgaagaggaagctctcgacgtcagcgatcactttccagtagagtttaagctgcagagctcacgagccttcaccaactccaaaaagagcgtaacattacgcaaaaagacaaaatctaaacgatcatag

SEQ ID NO: 114417 - DNA, 918 bp, Artificial Sequence
  Description of Artificial Sequence: Synthetic coding sequence
atgtcgcgcgaactggcgcccttgcttctgcttctgttgtccatccacagcgctctggcaatgagaatttgcagctttaacgttcgctctttcggtgagtctaaacaggaggacaagaacgccatggatgtcattgttaaagtaatcaaaagatgtgacattatcctggttatggaaatcaaggatagcaataacagaatctgtccaatcctaatggaaaagctgaaccgcaactctcggcggggaatcacctacaactatgtgattagctcacgtctcggacggaatacgtataaagagcagtacgcctttctatataaggagaagcttgtgtctgtgaagcgaagctatcactatcacgactaccaagacggagacgcggacgtcttcagcagagaacctttcgtagtttggttccagagtccccacaccgccgttaaagattttgtgatcattccactacatactactccagagaccagtgtgaaggaaatcgacgagctggtggaggtatacacagacgtgaagcatagatggaaggccgagaacttcatcttcatgggagactttaatgcaggctgttcttatgtgcccaagaaggcatggaagaacatcagactccgaactgacccaagatttgtctggttgattggggaccaggaagatacaaccgtgaagaagtctaccaattgtgcttacgacagaatagtcctgcgggggcaggagattgttagctctgtagtgcccaagtccaactccgtctttgacttccagaaagcgtacaagctgactgaggaagaggcgctcgacgtctccgaccattttcccgtggagttcaaattacaatcaagccgtgcgttcacaaactccaagaagagcgttaccctacggaagaaaactaagagtaagcggtcctag

SEQ ID NO: 114418 - DNA, 867 bp, Artificial Sequence
  Description of Artificial Sequence: Synthetic coding sequence
atgtcaagagagttagcccctctgctgttactactcctgagcatccatagcgcacttgctatgcggatctgttcgttcaatgtcagatcttttggcgaaagtaagcaggaggataaaaacgcgatggacgtaatagttaaagttatcaaaaggtgcgacatcattcttgttatggaaatcaaggacagcaataaccgaatctgcccaatattgatggaaaagttgaacaggaacagtcgaaggggcatcacctataactatgtgatctctagccgactgggcaggaatacatacaaggagcagtatgcctttctctataaagaaaaactggtgtcagtaaagcgttcataccactatcacgattaccaggacggagacgccgacgtgttcagtcgcgagccgttcgtagtgtggttccagtctccgcacactgccgtcaaagattttgtcattataccccttcacaccacccctgaaacaagcgtgaaggagatagatgagctcgttgaagtttatacagacgttaagcacaggtggaaggcggagaacttcatttttatgggcgattttaatgcggggtgctcttacgttccaaagaaggcgtggaagaacatcaggctgcgaactgatcctaggttcgtatggttaataggtgatcaagaggacaccacagtgaaaaaaagcacaaattgtgcttatgatcgtatagtcttaaggggccaggagatcgtcagctccgtggtgcctaaatcaaattctgtattcgattttcagaaggcgtacaaacttaccgaagaagaagtgcggctgccatcctgcctgtctatgcccttgtcttggaaagacgaactggcgtgggcaacttag

SEQ ID NO: 114419 - DNA, 303 bp, Artificial Sequence
  Description of Artificial Sequence: Synthetic coding sequence
atgagcagagagctcgcgccactgttactgctcctgctgtcaatccattccgcactcgccatgaggatttgctcattcaacgtgcgatcatttggggaatcaaagcaggaggataaaaacgccatggatgtgatcgtgaaggtgattaaacgttgtgatatcattttagttatggagatcaaggactctaataatcgaatatgtcctatccttatggagaaattaaatcgtaattcccggcgaggtattacgtacaattatgtgatttctagcagactcgggagaaacacctataaagaatag

SEQ ID NO: 114420 - DNA, 828 bp, Artificial Sequence
  Description of Artificial Sequence: Synthetic coding sequence
atgagcagagaactcgcccccctgctcctcctgctgctgtcaatccacagcgcgctggccatgcggatttgttctttcaacgtgcggtctttcggcgagtccaagcaagaggataagaacgccatggacgtgatcgtcaaggtgatcaaacgctgtgacatcatcctggtgatggaaataaaggactcaaacaatcgaatatgccctattttaatggaaaaattgaatcgagagaagttggtctccgtgaagagatcctatcattaccacgactaccaggacggggatgccgatgtgttctcacgagagcctttcgttgtgtggttccagtctccacataccgccgttaaggattttgtaattatacccctccatacaacaccggagacttccgtgaaagaaattgacgagctggtggaggtgtacaccgacgtgaagcaccggtggaaagctgagaattttatcttcatgggagatttcaacgctggctgctcctacgtccctaaaaaggcatggaagaacatccggctccggactgacccacggtttgtgtggctcattggtgatcaggaagacactaccgttaagaagtccacgaattgcgcctacgaccgaatcgtgctccgggggcaggagatagtttcctccgttgtacccaaatccaatagtgtcttcgactttcaaaaagcttacaagctcaccgaagaggaagccctggacgtttccgatcacttccccgtggagttcaaactgcagagctcccgtgcattcaccaactccaaaaagtcggttactttgcggaagaagaccaagagcaagcggagttag

SEQ ID NO: 114421 - DNA, 753 bp, Artificial Sequence
  Description of Artificial Sequence: Synthetic coding sequence
atgaccccactgtgtccccgacccgctctctgctaccattttctgacatcactcctccgttctgccatgcagaacgcccgaacagcggagggcagaagccgtggtaccctccgggctcgtccagcccccagaccagccgcacagcacggcataccacgaccgctgagctccgctggccggttgtctcaaggatgccgaggagcatccacagtcggagccgctgggtggaagggagagcttcccaaggctggggggtcaccagccccgggccccgagaccccagctattagccccagcaaacgagcccggccagccgaagtaggagggatgcaactgaggtttgcgcggttgagcgagcatgctaccgccccaacccgaggttctgcccgggctgctgggtatgacctgtatagcgcttacgactatacaataccgccaatggagaaggctgtggtcaagactgatatccagattgcattgcccagtggctgctatggcagagtagccccgagatccgggttagctgccaaacattttatagatgtgggggcgggcgttattgatgaagactatcgcggaaatgtgggggtggtcctgttcaactttggaaaggagaaattcgaggttaagaaaggcgatcgcattgctcagctgatctgcgagagaatcttctaccccgaaatagaagaggtccaagccctggatgacacggagagaggctcgggtgggtttggttccactgggaagaattag

SEQ ID NO: 114422 - DNA, 759 bp, Artificial Sequence
  Description of Artificial Sequence: Synthetic coding sequence
atgacaccgctttgtccccggcccgctctttgctatcacttccttacatcactactgaggtcagccatgcaaaacgcccggggcgctagacaacgtgccgaggcagccgtgctgtccgggcccgggccaccactgggacgcgctgcgcagcatgggataccacgtccactcagctccgccgggcgcttatcacagggatgccggggggcaagtaccgtcggggcagctggatggaaaggggagctgcccaaagcaggcggatcaccagcgcctgggcctgagacccctgccatttcccccagcaaacgcgccaggccagctgaagttggcggcatgcagctgcgttttgcccgcctgtctgagcacgccactgcacctaccagaggaagcgccagggccgcgggttacgacttgtactccgcctatgactacactatacctccaatggagaaagccgtggtgaaaaccgatattcagatcgctttgcctagcgggtgttacgggagagtcgccccccgttcgggattggccgccaagcattttatcgatgttggcgctggagtgatcgatgaagactacagaggtaacgtgggcgtcgtgcttttcaatttcggtaaggagaaatttgaagtgaagaaaggagaccgaatcgcgcagctgatttgcgagcggattttctaccctgaaattgaggaagtccaggctctcgatgacaccgaaagaggaagcggtggttttggaagcacgggtaaaaactag

SEQ ID NO: 114423 - DNA, 495 bp, Artificial Sequence
  Description of Artificial Sequence: Synthetic coding sequence
atgccctgctccgaggaaacgcctgctattagcccctctaaaagagcgcggccggcagaagtcgggggaatgcagctcaggttcgcccgactgtcagaacacgcgacagctcccacccgtggcagtgctagggctgccggatatgacctgtactccgcttacgattatactattccccctatggagaaggccgtcgtgaaaactgatatccaaattgctcttcctagcggttgttatggtcgggtggcgccccgaagcggattagctgctaagcactttatagatgtaggggcaggcgtaattgacgaggattacaggggaaacgtcggcgtggtactattcaacttcgggaaagaaaagttcgaggttaaaaagggcgaccgaatcgcgcaactgatctgtgagaggatcttttaccccgaaatcgaggaagtgcaggctctggatgacaccgagcgcgggagcggcggctttggttcgaccggtaagaattag

SEQ ID NO: 114424 - DNA, 426 bp, Artificial Sequence
  Description of Artificial Sequence: Synthetic coding sequence
atgcaactccgctttgctagactgagtgagcacgccacggcccctactcggggcagcgccagggcagcaggatacgacttatatagtgcgtatgactatacaattccacccatggaaaaggccgtcgtcaaaacagatatccaaattgctctcccctctggctgttacggcagggttgccccaagatccggcctggccgccaagcacttcattgacgtgggtgcaggagtaatcgatgaggactaccgtggaaatgttggggtcgtgctgttcaactttggaaaggaaaagtttgaggttaaaaaaggagatcgcatcgcacagctgatttgcgaacgtattttctaccccgaaattgaggaggttcaagctctcgatgatacggagaggggctccggggggttcgggagcaccggaaaaaactag

SEQ ID NO: 114425 - DNA, 1056 bp, Artificial Sequence
  Description of Artificial Sequence: Synthetic coding sequence
atgccactgcgaaaacatcggcaacattttaagaagtatggcaactgctttaccgccggcgaggcagtggattggctgtacgacctgcttcggaacaactctaactttggacccgaggtgacccgtcagcagacaattcagctcctgaggaagtttctgaaaaatcatgtcatcgaggatatcaagggcagatggggttcagagaatgtcgacgacaacaatcaactcttccgattccctgctaccagccctcttaagactctccctaggcggaccccaaaacgccacggactgcaccttagccaggaaaacggagagaaaattaaacacgagattattaatgaagaccaggagaacgccatcgacaacagagagctgagccaggaggacgtggaagaagtctggagatacgtgattctgatatatctgcagactatactgggggtgccttcactcgaggaggtcatcaatccaaagcaggtgatccctcaatacatcatgtataatatggctaacactagcaagcgtggcgtggtgattctgcagaataaaagcgacgacctgccacattgggtgttgtctgccatgaaatgcttggcaaattggcccaggtctaatgacatgaataacccaacctatgtaggcttcgagcgcgatgtcttcagaacaattgcagactattttttggatctgcccgagccactgctgacttttgaatattacgaattattcgtaaacatactgggaaatttcaaagactttcggtcgtctatcccagtagtttgtggatatatcaccgtgtctgaccgctcttcgggaatccacaagatccaagatgatcctcagagcagcaaatttttgcatctaaacaatttaaactcttttaagagtaccgaatgcctcttgctgagtctgctgcacagggagaagaacaaggaggagtcagactcaactgagaggctgcagatctcgaaccccggctttcaggaaaggtgcgcaaagaaaatgcagttggtgaatctgcgaaatcgacgggcttgctgcaacctgatctag

SEQ ID NO: 114426 - DNA, 1584 bp, Artificial Sequence
  Description of Artificial Sequence: Synthetic coding sequence
atggagtcccagggcgtcccgccgggaccataccgtgctactaaactctggaatgaggtgactacctcttttagagctggaatgcctttaagaaaacatagacagcactttaagaagtacggcaattgttttaccgctggcgaagcagtggattggctatatgatctgctcagaaataactcaaattttgggcctgaggtcacaagacagcaaacaattcaattgctacgcaagttcctgaagaatcatgtgattgaggatatcaaagggcgctgggggtctgaaaatgtggacgacaacaatcagctcttccgattccctgccacctctcccctaaaaactctaccgaggcggtacccggagctgagaaagaacaacattgagaatttctccaaggataaagattctatttttaagcttcgcaacttatctcggaggacccctaaaaggcacggcctacatctgtcccaagaaaatggcgaaaagatcaaacacgaaatcatcaacgaggaccaggagaacgccatcgacaatagggagctgtcccaggaggatgtcgaggaggtttggaggtacgtcatcctgatctatttacagactattctgggggtcccatcattagaggaggtgatcaatccaaagcaggtcatcccacaatacattatgtacaacatggccaacactagcaaaaggggcgtcgttattttacaaaataagtccgatgacctaccacactgggtcttgtctgcaatgaagtgcctcgctaactggcccaggtcaaacgatatgaacaaccctacctacgttggatttgagagggacgtctttagaactattgccgactactttctggacctgccagagccactactcacttttgagtattacgaattattcgttaatatcctggggctgctgcagcctcatttggagcgggtcgcaattgacgctctacaactgtgttgcctcttgctaccaccccccaacaggcggaagctgcaattgctgatgcgtatgatctcccgcatgtcccagaatgtggacatgcccaaattgcacgatgccatgggtactcgaagcctgatgatccacacattctctagatgcgtgctgtgctgcgcagaagaggttgatctcgacgaactgctggctgggcgattggtgtctttcctgatggatcatcaccaggaaatactgcaggtgcctagttacctgcagaccgccgtggaaaagcacttagattatttaaaaaaaggccacatcgaaaacccaggcgatggcttgtttgcgcctctgcctacttacagctactgcaaacagatcagcgcacaggaattcgacgagcaaaaagtgtctacgtcacaggcagctattgctgagctgctggagaatatcatcaagaaccgctctttgccactgaaggagaaaagaaagaagctaaaacagttccaaaaagaatatcctctgatataccagaaacggttccctactaccgaatctgaggccgctttgttcggtgataagccgaccatcaagcagcccatgcttattctacggaaaccaaaattccgcagcctgcgctag

SEQ ID NO: 114427 - DNA, 2436 bp, Artificial Sequence
  Description of Artificial Sequence: Synthetic coding sequence
atggaaagccaaggagtgcctcccggcccttatagagctactaagctttggaacgaagtgaccaccagtttcagggccgggatgcccctccggaaacacagacagcacttcaagaagtacggaaattgctttactgcgggtgaagcggtggattggttgtacgatctgctccgaaataacagtaatttcggacccgaggttactagacagcagacaattcagcttctgcgtaaatttctgaagaaccacgtgatcgaagacataaagggcagatggggatcagaaaacgtggatgataataaccaactgttcagatttcccgcaacatcaccactcaagacgctgcccaggagatatcccgagctccgtaagaataatatagaaaatttctccaaagacaaggactcaattttcaaactccggaatctctcccggaggactccgaaaagacacggcctgcatctaagtcaggagaatggtgagaagattaaacatgaaattattaacgaggaccaggagaatgccatcgataacagggaactgagccaggaggatgtggaggaggtatggaggtacgttattctcatctaccttcagacaatccttggagtgccatcgctggaggaggtaatcaaccccaagcaggtgattccacagtatatcatgtataacatggcgaacacttctaaacggggcgttgtgattctgcagaataagagcgacgacctgccccattgggtcctgagcgccatgaaatgtctcgcaaactggcctagaagcaacgatatgaacaatcctacatacgtgggttttgagcgagatgtgttcaggaccatcgcagattacttcctagatctcccagagccactgctcacgtttgagtactacgaactctttgttaacatcctggttgtttgtggttacattacagtaagcgataggtctagcgggatccacaaaatacaggacgatccacaaagtagcaaattcctgcacttgaacaacctgaacagctttaagtctacagaatgccttcttctttcactgctccaccgtgagaaaaacaaagaggaaagtgactccacggagagactccaaatttccaaccccgggtttcaggagcgatgtgctaaaaaaatgcagcttgtgaatctcagaaaccgacgggtgagcgccaacgacataatggggggaagttgccataatctgatcggtttgtctaacatgcacgatctttcatcaaattccaagcctagatgttgttctctcgaaggcatagtggatgttccgggtaattccagcaaggaagcctcaagtgtcttccatcagtcgtttcctaacattgaaggccagaataacaagctgtttctggaatctaaacccaaacaagagtttctgttgaatttgcattctgaggaaaacattcaaaagcccttcagcgcaggctttaagaggacaagcactctgactgttcaggatcaggaagaactgtgcaacggaaaatgcaaaagcaagcaactgtgcaggtcccagagtctcttgttgcggtcatcgacccgccgaaattcttacattaacacacctgtcgccgaaattattatgaagcctaatgtgggtcagggctcaacatccgtccagaccgcaatggaaagcgagcttggagagagctccgccaccataaataagaggctctgcaaatcaacaatcgagctctccgagaattcactcctgccggcaagcagtatgctcaccggcacccagagcttgctgcaaccccatctcgaacgggtcgccatcgacgctctacagctgtgttgtttgctcttacccccacccaatcgaagaaagctccagctgctgatgagaatgatctctcgcatgagccagaacgttgatatgcctaagctccatgatgccatgggtacccgttcgctgatgatccacactttctcccgctgtgtcttgtgctgcgccgaggaagtggaccttgacgagctgttggcaggacggctggtcagcttccttatggatcatcaccaggagattctgcaggtgccatcatatctccagactgcggtggagaagcatctggattatctgaagaaaggacatattgaaaatccaggagatggcctctttgcgcctctgcctacatatagctattgcaagcagatctcagctcaggagttcgatgagcagaaagtcagcacaagtcaggcggccattgcagagctcctggagaatatcatcaagaatagatcactgcccttgaaggagaaaaggaagaaattgaaacagttccaaaaggagtatccactgatataccagaaacgttttcctaccacggagtccgaagctgccttgttcggggataagccaaccataaaacagcctatgcttatccttcggaagccaaaattccggagcttacgctag

SEQ ID NO: 114428 - DNA, 1590 bp, Artificial Sequence
  Description of Artificial Sequence: Synthetic coding sequence
atggaacatcgaatcgtcggcccaggcccatatagagcaaccagactttggaatgagactgttgaactcttccgagccaagatgccattaaggaaacaccggtgtcggttcaagagttacgaacactgtttcacagcagcggaagctgttgattggctccacgaactgctgaggtgttcacagaacttcggccctgaggtgaccaggaagcagaccgtccaactgttaaagaaattcctgaagaaccacgtgatcgaagatatcaaggggaagtggggcgaagaagactttgaggataaccggcacttgtaccgatttccaccgagctctccactgaaaccgtatccgaagaagcctcccaaccagaaggacgtgatcaagtttccagagtggaatgacttgccaccaggtacaagtcaagagaacattccggtgaggccagtagtgatgaattcggagatgtggtacaaaagacacagcatagccatcggcgaggtgcctgcatgccgattagtacatcgcaggcaacttactgaggccaacgttgaagagatctggaaatccatgacactgtcatatctccagaaaattctgggactggacagccttgaggaagtgctggatgtgaagctggtgaactcaaaattcatcatacacaatgtctactctgtgagtaaacagggtgtggttatcctggacgacaagtccaaggagttaccgcattgggtcctgtctgccatgaagtgtctcgcaaactggcctaattgttctgacctcaaacagccaatgtatttgggattcgagaaagatgtgtttaaaacaattgccgattactacgggcacctcaaagagcccctgcttactttccatctatttgacgctttcgtttcagttctgggactgctacagaaagagaaggtcgctgtagaggccttccagatttgttgccttctgctcccacctgagaatagacgaaagctgcagcttctgatgcggatgatggcccgaatctgcctgaacaaggaaatgcctccactgtgcgacggcttcggaacaaggaccctcatggttcagactttttctcgctgtatcctctgtagtaaggacgaggtggatctcgatgagcttctcgctgccagactggtcaccttcttaatggacaactatcaagaaatcctcaaggttcctctagcgcttcagacctctattgaagaacgcgtggcccacctgcgcagggtgcagatcaagtacccaggggccgatatggatattaccctaagcgcgccatctttctgcaggcaaatctcaccagaggagttcgaataccagagaagttatggttcacaggaacccctggctgctttgctggaggaggtgatcacagacgctaagttatcgaacaaagagaaaaaaaagaagctcaaacagtttcaaaaatcctaccccgaggtatatcaggagagatttcccacccctgagtctgccgccctgctgttcccggaaaagccaaagccaaagccgcagctactgatgtgggcccttaaaaaacccttccagcccttccagcgcacccgttcttttcgaatgtag

SEQ ID NO: 114429 - DNA, 1404 bp, Artificial Sequence
  Description of Artificial Sequence: Synthetic coding sequence
atggaacaccgaattgttgggccagggccctaccgggcaactcgcctgtggaatgaaactgtggagctgttccgtgcgaagatgccattgcgtaaacaccgttgcaggttcaagtcctacgagcactgttttactgcagcagaagcagtggactggctacatgagctgctgcgctgctcacagaacttcggacccgaggtcacccggaagcagactgtacaactgctgaaaaagttccttaaaaatcatgttatcgaagacattaaggggaaatggggggaagaggattttgaggacaacaggcacctgtacagattccccccttcaagccctcttaagccctatcccaaaaagccccccaatcagaaggacgtcattaaatttcctgagtggaatgatcttccccctggcactagccaggaaaatatcccagtgcggcccgttgtgatgaacagcgaaatgtggtataaaaggcactcaatagcaataggcgaggtgcccgcctgcaggctcgtacaccgcagacaacttacagaggccaacgtggaagaaatatggaaaagcatgacgctgtcatatcttcaaaaaatcctcggtcttgactctctggaagaggtcctggacgtaaaactggtgaatagtaagtttatcattcacaacgtgtactccgtctctaagcagggcgtggtcattctcgacgacaagagcaaggagttgccacactgggtgctgtccgccatgaagtgcttagccaattggcccaactgcagtgacctgaagcagccaatgtacctcggcttcgaaaaggatgtattcaaaacaattgctgactactatggccatctcaaggagcccttattaactttccatctgtttgatgcgttcgtatccgtgctcggcctgctgcagaaggaaaaggtggcggtggaggcgttccagatctgttgcttacttctgccacctgagaaccgcagaaagttacaattactaatgagaatgatggcgcgaatttgcctgaacaaagaaatgcctcccctatgcgatggctttggtacaagaacattaatggtgcagacgttcagcagatgcatattgtgtagcaaggacgaagtcgacctcgacgagctgctggctgccaggctcgtcactttcctcatggacaactaccaggaaatcctcaaagtgcccttagcactgcagacatccatcgaggagcgcgtggcgcacctccgccgcgtgcaattccaaaagtcttacccggaagtctatcaggagagattccccacacctgagtcggccgcactgttgtttcctgaaaagcctaaaccaaaaccacagctcttaatgtgggccctcaaaaaacctttccaacccttccagcgaacgcggtctttcaggatgtag

SEQ ID NO: 114430 - DNA, 1323 bp, Artificial Sequence
  Description of Artificial Sequence: Synthetic coding sequence
atgcctttgagaaagcatagatgccgcttcaagagctatgaacactgcttcaccgccgcagaggcggtcgactggctccacgagctgttgcgctgctctcaaaattttggccctgaggtaacacgaaagcagaccgtgcagctgctgaaaaaattcctgaagaaccacgttattgaggatatcaaggggaagtggggcgaagaggatttcgaggataacagacacctttatcgctttccaccgtccagcccgctgaaaccatatcccaaaaaaccgccgaaccagaaagacgtcattaagtttccagaatggaacgatctgcccccaggaactagtcaagagaatattccagtccgacctgtagtgatgaacagtgagatgtggtataaaagacactctatagcaatcggggaggtgccggcctgtagactcgttcataggaggcagctcaccgaagccaacgtggaagaaatctggaaatccatgacgctgtcatacctgcagaaaatcttgggactggatagtctggaagaggttctggacgtcaagcttgttaactccaaatttatcatccataacgtgtactccgtcagcaaacagggtgtagttattctggacgacaaaagcaaggaactccctcactgggtcctctccgctatgaagtgccttgcaaattggccgaactgttcagacttgaaacagccaatgtatctcggctttgagaaagatgtcttcaagacaattgccgattactacggacatctgaaggaacccctgctgaccttccaccttttcgacgctttcgtgagcgtgctgggtctcctgcagaaagaaaaagtggcagtggaggccttccagatatgttgcctgctcctcccgccagagaatcgtagaaaactacagctgctgatgagaatgatggctcggatctgtctgaataaggaaatgcctcccctctgcgacgggtttggaaccaggacactgatggtccagacgttcagccgctgcatcctttgcagcaaagacgaagtcgatctcgacgaattgttggccgctcgccttgtgacattccttatggataactaccaagagatacttaaagtgcccctagccctccagacatctatcgaagaaagggtagcccaccttagaagagtccagttccagaagtcctatccagaagtgtaccaggaacgctttccaacccccgagagtgccgccctcctatttccagagaaacctaaacccaaacctcaactgctgatgtgggcattgaaaaaacccttccagccattccagcggaccagatctttccggatgtag

SEQ ID NO: 114431 - DNA, 4746 bp, Artificial Sequence
  Description of Artificial Sequence: Synthetic coding sequence
atgaggaccaccaaagtgtataaactcgttatacataaaaaaggctttggtggatccgacgatgagttggttgtcaacccaaaggtgtttcctcacattaaattaggagacatcgtggaaattgcgcatcctaatgacgagtactccccgctcttactccaggtgaaaagtctaaaggaagatctgcagaaagaaacaatttcagtcgaccaaacagtcacgcaagtcttcagactgcggccataccaggacgtgtatgtgaatgtcgtagatcctaaagacgtgaccctcgatttagtggagttaactttcaaggatcagtatattggaagaggggacatgtggagactgaagaaaagcttggtgtccacctgtgcctatattacacaaaaggtggagtttgcagggatcagggcccaggccggcgagctgtgggttaagaacgagaaggtcatgtgcggctatatttcagaagatactcgtgtggtctttagatcaacttcagccatggtgtacatatttatccaaatgtcttgtgagatgtgggattttgatatctatggggatctatacttcgagaaagccgttaatggattcctggctgacctctttaccaaatggaaggaaaagaactgctctcatgaggtgaccgtcgtgctgttttcccggactttctacgatgccaagtctgttgacgaatttcccgagataaatcgcgcctccatcagacaggaccataagggtcgattctacgaggacttctacaaggttgtggtccagaatgaaagacgcgaggaatggacctccctgttagtcactatcaaaaagctgtttattcagtatcctgtgcttgtgaggctggaacaggccgagggctttccccagggggataatagcacctccgcacagggaaattatctggaagccattaacctcagtttcaatgtgttcgataagcattacatcaaccggaactttgacaggacaggtcaaatgtctgtggtcatcacgcctggcgtcggcgtgttcgaggtggataggttgcttatgatcttaaccaaacagcgaatgattgacaacgggatcggagtggacctcgtttgcatgggcgagcaacctctgcatgccgtcccactcttcaagctgcacaaccgcagcgcccctcgtgattcacgtctcggggacgattataatataccccattggattaaccattcattctacactagtaaatctcaactattctgcaatagcttcacccccagaatcaagttggccggtaagaagcccgcgtcagaaaaagccaagaatggcagggatacgtctttaggatccccaaaagagagcgaaaacgctctccctattcaggtagattacgacgcatacgacgcccaggtgttccgactccccggccctagtcgagcccaatgcctgactacttgccggtccgtgcgggagcgggagtcccatagcaggaaaagcgcttctagttgtgacgtgtcttcctctccctccctgccatcacgtacactgcctaccgaagaagttcggtcgcaggcaagcgacgacagctccctgggtaagagcgccaatatcttaatgatcccacacccacacctgcaccaatatgaggtttcgtcaagtttagggtatacaagcactcgagacgtgttggagaacatgatggaaccccctcagagggactcttctgcccctggcagattccatgttggatcagccgagtccatgctgcatgtgaggccaggtggttacacaccccagagggcattgatcaatcccttcgccccctccagaatgccaatgaaactgactagcaatcgacgtagatggatgcacaccttccccgttggacccagtggtgaggcaatccaaattcatcaccagacgcgacagaatatggctgagttacaggggagtgggcaaagagaccccacccactcatcagctgagctcctcgagttagcataccacgaagccgccggacggcacagcaactcaagacaacctggagatggcatgagtttcctgaatttctccggaactgaggagctgtctgtaggattgctttccaactctggagcgggtatgaacccacggacccagaataaagattctttggaagattccgtaagcacatccccagatcctatcctcacactgtccgcaccacccgtggtgcctgggttctgctgcaccgttggtgtggactggaaatcactgacaacccccgcatgtctcccactcacaaccgattatttccccgacaggcagggactgcaaaacgattacaccgagggctgctatgacctgctccctgaagccgatatcgatcggcgggacgaggacggtgtgcagatgactgcacagcaggtgtttgaggagttcatttgtcagagacttatgcaggggtaccagattattgttcagcccaagacccagaaacccaatcctgccgtgcctccaccactttcctccagccccctttatagccgcggattagtctctcggaatagacccgaggaggaagatcaatattggctatccatgggcaggacctttcacaaggtgacccttaaagacaaaatgattacagtcacgcgataccttcccaaatatccctacgagagtgctcaaatccattacacctactccctatgtccgagccacagcgattctgaatttgtctcctgctgggtggaattcagccacgagaggctggaggagtataagtggaattacctggaccagtacatttgttcagcgggctctgaagatttttccctgattgaatctctgaagttttggaggacaagatttctcctgttacccgcatgcgtgactgcaacaaagagaatcaccgagggggaagcccactgcgatatttatggtgatcgaccaagggctgacgaggatgagtggcagctgctcgacgggtttgtgaggttcgtggagggtctgaaccgtatcaggaggagacaccgaagcgatcgcatgatgcgtaagggaaccgcgatgaaaggtttacaaatgacgggaccaatttcaacgcacagtttagaatccactgctccacctgtggggaagaaaggcaccagcgcgctgtcagctctgcttgaaatggaagctagccagaagtgtctgggcgagcagcaggctgctgtccatgggggaaaatcgagtgcccagagcgctgagagcagctccgtggccatgaccccaacatatatggattctcctagaaaggtgtctgtggatcagaccgctacacctatgctggatggcacttctctgggcatttgcacagggcaatcgatggacaggggaaactctcagacattcggcaatagtcaaaatataggcgagcaagggtacagttccacgaatagctctgactcctcctcacagcaactcgtggcatcttcacttacctctagttctaccctgacggagattctcgaggccatgaaacaccccagcacaggagttcagctcctgtctgagcagaagggcttgagtccctattgttttatcagcgctgaggtcgtgcactggctcgtgaatcatgtagagggtattcaaacccaggctatggccatcgacataatgcaaaagatgcttgaagagcagctgatcacacacgccagcggcgaggcctggagaacattcatatatgggttttacttttacaagattgtgacagacaaggagcctgaccgtgtggcgatgcagcagcctgctaccacttggcataccgctggcgtggacgacttcgcctccttccagaggaaatggtttgaggttgcattcgtggccgaagaactcgtccacagcgagattccagccttcctgctgccttggctcccttcccggcctgccagctacgccagtagacacagcagcttcagcagatctttcggaggacggtcccaggccgccgcactcctcgctgccaccgtgcctgaacaacgaacagttacgcttgacgttgatgtgaacaatagaaccgacaggctggagtggtgctcgtgttattatcacggaaatttttcactgaatgccgcatttgagattaagctccattggatggccgtgactgccgctgtcctttttgagatggtccagggctggcatagaaaagcaacaagttgtggctttcttcttgtccccgttctagagggccccttcgccctgccatcgtacctgtacggggaccctttacgagcccaacttttcatccctttaaatatttcttgcttgttgaaagagggcagtgagcaccttttcgatagctttgaacccgaaacatattgggacagaatgcacctttttcaggaagctatcgcacaccggtttggtttcgttcaggacaaatactctgccagcgctttcaacttccctgccgagaacaagccccagtacattcacgtaaccggtactgttttcctgcagcttccatattccaagagaaaattctcaggacagcagcgaagacgcaggaatagcacatctagcaccaatcagaacatgttttgcgaagagcgtgttgggtataactgggcctataataccatgctgacgaagacctggcggagtagcgctaccggagatgaaaagtttgctgaccgccttctgaaagattttaccgatttctgcataaatagggataatagactcgtgactttctggaccagctgtctggagaagatgcacgcgtccgccccgtag

SEQ ID NO: 114432 - DNA, 3690 bp, Artificial Sequence
  Description of Artificial Sequence: Synthetic coding sequence
atgcgcactaccaaagtttacaagcttgtgatccacaaaaaggggtttggcggatcagacgatgagctcgttgtgaacccgaaggtatttcctcacatcaagctgggagatatcgttgagatagctcatcctaacgatgagtacagtcctctgttgctccaggtgaagtcccttaaggaggaccttcagaaagaaactatctccgtagatcaaactgttacccaggtgttcagactgagaccctaccaggatgtgtacgtcaatgttgtggaccctaaggacgtcaccctagacctcgtggagctcacgtttaaagaccaatatattggccgaggcgacatgtggcggctcaaaaaatccttggtctccacatgcgcatacataacccagaaagtcgagttcgccggtattagagcccaggccggagagctgtgggtcaaaaatgagaaggtcatgtgcggatacatatcagaagatacccgggtggtgtttaggagtactagcgccatggtctacatcttcatccagatgtcctgtgaaatgtgggactttgatatatacggggacctgtatttcgagaaagccgtgaacgggtttttggctgatctcttcactaagtggaaagaaaagaactgttcccatgaagtcaccgtggttctcttcagccggactttttacgacgctaagagcgtggacgaatttccagaaatcaacagagctagcattagacaggaccacaaaggtaggttctatgaggatttctacaaagtcgtggtgcaaaatgagcggagagaggagtggactagcctccttgtcacgattaagaaactctttatccagtatcctgtcctggtaaggctggagcaggccgaaggatttccccagggtgacaattctacctcagcccagggcaactatctggaggctatcaacctttccttcaatgttttcgacaagcactatattaaccggaacttcgatcgcacaggccaaatgtccgtcgtgattacaccaggggtgggagtgttcgaggttgatcgactgctgatgattttaacaaagcagaggatgatcgataacggcataggggtggatctcgtctgtatgggggagcagcccctgcatgcagtgccgttgtttaagttacacaatcgctccgcacctagggacagccgtttaggcgacgattacaacattcctcattggatcaaccattccttctatacctcaaagtctcaattattttgtaattctttcactccgcgtattaaattggctgggaagaaaccagccagcgagaaggccaagaatggacgcgatacttcactgggcagcccaaaggagtccgagaacgcactccccattcaggtggactacgacgcctacgacgcacaggtctttcgcctgcctggcccttctcgggctcagtgcctaacaacatgtcgatcagttcgcgaacgcgaaagccatagtcgcaagtccgcaagctcgtgtgatgtgtcctcttctccgagccttccctcccgtaccctgcctacagaggaggttcggtctcaggccagtgatgactcttccctcggtaagtcagcaaatattctaatgataccacatccccatctgcaccagtatgaagtgagttcaagcctggggtacaccagtactcgcgatgtgctcgaaaacatgatggaaccccctcagcgggatagctcagcaccagggcggtttcatgtaggttcagcggagagcatgctccacgtgcgaccaggaggatatactccccagagggcactgattaaccctttcgcaccaagtcgaatgcctatgaaactgacatcaaatcgtcggagatggatgcacacttttcccgtggggatgaatcccagaacacaaaataaagattcgctggaagatagcgtgtcaacaagtcccgaccctattttgactctgtctgccccaccagtggtcccgggattttgctgtacagtcggtgtggactggaagtcactgacgacgcccgcgtgtctccctctgacgacagactatttccccgacaggcagggcctgcagaacgattacactgagggctgttacgacctgctgcccgaagccgacatcgatcggcgggatgaggacggagtgcagatgacagcacagcaagtctttgaagagttcatttgtcagcggctgatgcaagggtaccagattatcgtacagccaaagactcagaagcccaatccagccgtacctcctccactttctagctcgcctctctattctagggggctagtgagccgaaatcgccccgaggaagaggatcagtattggcttagcatgggccggacgtttcacaaggtgacactgaaggataaaatgatcaccgtgacacgctatctgcctaaatatccgtacgaatctgcccagattcactacacctattcactttgtcccagccactctgactctgagtttgttagctgctgggtcgaattcagtcacgagcgattggaagaatacaaatggaactaccttgatcaatacatatgttccgcaggatcagaagacttctctttaattgaatcactgaagttttggcgtacacggttcttactgctccccgcctgtgtaacagcaactaaaagaatcactgaaggggaggcgcattgcgatatttacggcgaccgcccacgagctgatgaagacgagtggcagctcctggatggcttcgtgaggtttgtcgagggcctgaacagaatcagaagaaggcacaggagtgatcgcatgatgaggaagggaaccgcaatgaaagggctgcaaatgacgggtccaataagcacccacagtttagagtcaactgcaccgcctgtgggaaagaagggcacctctgcattgagcgccttgttggaaatggaggcatctcagaagtgccttggggagcagcaggccgccgtccacggggggaaaagcagcgcgcaaagtgccgagagctcctctgtggctatgacccccacctacatggacagtccacgtaaggacggcgccttctttatggagttcgtgcgaagcccccgcaccgcgagttctgcattctaccctcaggtgtccgtggatcaaacagcgactcctatgctagacggaactagtctggggatatgcaccgggcagtcaatggatagggggaacagtcagacattcggcaatagccagaacatcggagagcaggggtattcatcaacaaactcttctgacagttcttcacagcagctggtggcctcatcgctaaccagtagtagcacgttaacagagatcttagaggcgatgaaacacccttctaccggggtccaactgcttagcgagcagaaagggttgtccccttactgtttcatttcggccgaagtcgtccattggcttgtcaaccacgttgagggaattcagacccaagcaatggcaatcgacataatgcagtggccttgctcatccccccccccgcctggcacacagcaggagtggacaacaagccctgcaagttctgcttccggactgcggtggccgctgtggcagaaatcttcctgcacgctcaggttcctgccgttctcatgcccaggttgcctggccggccagccgcctatgcaggtaggcaccgctcccctggcagaggtgctagaggatggcgcgagaagacagcatttctag

SEQ ID NO: 114433 - DNA, 4512 bp, Artificial Sequence
  Description of Artificial Sequence: Synthetic coding sequence
atgaggaccactaaggtttacaagctggttattcacaaaaagggcttcggtggctctgacgacgaactggtcgtgaatcccaaggtgtttccccacatcaaactgggcgacatagtggagatcgctcaccccaatgacgagtatagccccctgttgctgcaggtaaaatcgttgaaggaagacctgcagaaagagactattagcgtagaccagaccgtgactcaagtttttcggctgcgtccctatcaggatgtgtatgtcaatgtcgtggatcccaaagatgtgacccttgatctggtggagctaacatttaaggatcagtacatcggacgtggcgatatgtggagactgaaaaaatcccttgtctcgacatgcgcttacattacacagaaggtcgagtttgccggaatccgtgctcaggcgggagagctgtgggtcaagaacgaaaaggtgatgtgcgggtatatttctgaggacaccagagttgtattccgaagcaccagcgccatggtgtacattttcattcaaatgagttgcgagatgtgggatttcgacatatacggagatctttatttcgagaaggccgtgaatggttttcttgccgacctgtttactaagtggaaggagaaaaattgctctcatgaagtgaccgtggtgctgttctcccgcaccttctatgatgctaaaagcgtggacgagttccccgaaattaatcgggcttctattcgccaagatcacaagggccgtttttacgaggatttttacaaggtggtggtacagaacgagagaagagaagaatggacaagccttctcgtgaccataaaaaagctgtttatccaatatcctgtactggtccgccttgagcaggcggagggcttcccgcaaggggataattccacatcagcccaagggaattatttggaagctatcaatttgtccttcaacgtgttcgataaacattatattaatcggaactttgaccgcactggccagatgtcggtggtgattacccctggcgtgggcgtgttcgaggtggacaggttacttatgatcctcactaaacagcgaatgatagacaatggcattggtgtcgacctggtttgcatgggcgaacagcccctccacgccgtccctctttttaagctccacaaccgctcagcccctcgtgactcacggctgggagatgattataatatcccccactggattaaccacagtttttatactagcaagtcccagcttttttgcaattcttttacaccacgcattaaactcgcaggtaaaaagccagcctcagagaaagccaaaaacggtagagacacttctctcggaagccccaaggagtcagaaaacgctctgccgattcaggttgactatgacgcctatgacgcccaagtgttcagattgcccggcccaagtagagcgcaatgcttgacaacatgtcggtccgtgcgggagcgcgagagtcattcccggaaatccgctagcagctgtgatgtctcctcttcaccttctctgcccagccggacactcccaaccgaggaggtgcgctctcaggcaagtgacgactcctcgctcggtaaaagcgcgaacattctgatgatcccacacccacacttacaccagtatgaagtatcaagtagcctgggttatacttcaactcgagacgtactggaaaatatgatggagccccctcagcgggacagctctgccccgggtcgattccatgtgggaagcgctgagagcatgctgcatgtgcgcccgggtggatacacgccacagcgcgctctcatcaaccctttcgcgcccagcaggatgcccatgaagctgaccagcaacagacgacgctggatgcatacatttcccgtcgagactagctgtttttatttaagcattggtatgaatcctcgcacccagaacaaagacagtttggaagatagcgtgtcaaccagtccagatcccatgccaggcttttgctgtaccgtgggcgttgactggaaatccctcactactccagcctgtctacccctgactacagactacttccccgatcgtcagggactccagaacgattataccgaaggttgctacgacctgttgccggaggccgatattgatcggcgggacgaagacggagtgcagatgaccgcccagcaagtgtttgaagaatttatttgtcagaggctgatgcagggctaccagattatcgtgcagccgaagacccagaagcccaaccctgccgttcctccacccctgtcctcttcaccgctctatagcaggggtctggtgtcccgtaatcgacctgaagaagaggatcagtattggttgagcatggggcgtaccttccataaagtcactctgaaagataaaatgattaccgtgacaaggtatctgcctaagtacccatatgagagtgcacaaattcattatacatactccttgtgcccatctcattccgatagtgagtttgttagttgctgggtcgagttctctcacgaacggctggaggagtacaagtggaattacctggatcagtacatctgttctgccggttctgaagacttcagcctgatcgagtccctaaagttttggcgcactcgattcctgcttttgccagcctgcgtgacagccactaaaaggataactgagggagaggcgcattgcgacatctacggtgacagacctagggctgatgaagacgagtggcagctcttagacgggttcgtacggtttgtggagggtctgaacagaatcagaaggcggcaccgctccgatcgcatgatgcggaaaggtactgccatgaaagggttacaaatgacgggccccatttcaacacactctctggagtccacggcccccccagtggggaaaaaaggcacgtctgccttaagcgcactgctggaaatggaagcgagccagaaatgtctgggcgaacaacaggccgccgtgcatgggggcaaaagttcggcccagtctgcagaaagctcttctgtggctatgacacctacctatatggactcaccccggaaggtaagcgtagaccagacagcgactccaatgttggacggtaccagtctcgggatatgcactggacagtcaatggatcgcggtaattctcagacctttggaaacagccaaaatattggcgaacagggatattctagtacaaactcctcagatagctcttcacaacagctggtggccagttcactgacctcctcgtcaacgttaaccgaaatcctcgaggcaatgaagcatccgtcgaccggagtccaattgttgtcagagcagaaaggactgagcccatactgtttcatcagcgccgaggtcgtacattggctggtgaaccatgtggagggcattcagactcaggctatggcgatcgatatcatgcagaagatgctggaggaacaactaattacgcacgcgtcaggggaagcttggaggacatttatatatggcttttatttctataagattgtcactgacaaagagccagacagagtcgcaatgcagcagccagcaaccacttggcatacagctggagtggatgatttcgccagctttcaaaggaaatggtttgaggtggccttcgttgccgaggagcttgtgcactcagaaatcccagcctttctcctgccatggctgccttcaaggcctgcttcttacgcatcccggcattcatcattctccagatcatttgggggacgatcacaggctgctgctctgctggccgccacggtgcctgagcaaaggaccgtcacactggacgtagatgtaaacaaccgcactgaccgcttggagtggtgttcttgttattaccatggaaatttcagcctcaacgctgcctttgaaatcaaactccactggatggccgttaccgccgcagttctgttcgaaatggtccagggatggcatagaaaggctacatcttgcggatttctgctggtcccagtgctggaaggccctttcgccctgccatcgtatctctatggggaccctctgagggctcagctgttcataccgcttaatatctcgtgtctgctgaaagaggggtcagagcatctgtttgattcatttgagcccgagacctactgggatcgcatgcacctgtttcaggaggccattgcccatcgctttggcttcgtccaagataagtactccgcttctgcttttaattttcccgctgagaataagccgcaatacatccacgtgacaggtacagttttcctgcaactgccctattctaagaggaaattttctggacagcagcggcgaaggcggaactctaccagtagcaccaatcagaatatgttttgcgaggagcgtgtcggatacaattgggcatataatacaatgctcaccaaaacatggaggtcttcagcaactggtgacgagaaatttgcagaccggttactgaaggattttacagacttctgcattaacagagacaatcgactggttacattctggaccagttgtcttgaaaagatgcacgcctcggccccctag

SEQ ID NO: 114434 - DNA, 1680 bp, Artificial Sequence
  Description of Artificial Sequence: Synthetic coding sequence
atgcgaaccacgaaggtctataaactagtcattcataaaaaggggtttggaggcagtgacgatgagctggtggtaaaccccaaagtattcccacatatcaagcttggggatatagttgaaatcgcccaccctaacgacgagtattcacccttgctcctgcaggtaaagagcttgaaggaagatctgcaaaaggagactatctccgtcgaccaaaccgtgacgcaggtgtttcgcctccgcccataccaagacgtgtatgtgaatgtggtggaccctaaagacgttaccctggatctggtcgagctgaccttcaaggaccagtacattggtcgcggagatatgtggagattaaaaaaatccttagtttctacatgtgcgtatattacccagaaggtggaatttgcaggcatccgagcacaagctggtgagctctgggtgaagaacgagaaggttatgtgtgggtatatttccgaggatactagagtggtcttcaggtcgacctcagcgatggtgtacatattcatccagatgtcatgtgagatgtgggacttcgatatctacggagacctctattttgaaaaagccgtgaatggttttctggccgatctgttcaccaaatggaaagagaagaactgctcccacgaagtcaccgtggtactgttctctcgcaccttttacgacgccaaatctgtcgatgagttcccggaaatcaatagagccagtattcgccaagatcataaagggagattttatgaagatttctacaaagtggtggtccaaaatgaacgaagagaagagtggacttctttgttagtgactatcaaaaagctgtttattcagtacccagtcttggtgcgcctcgaacaggcagaagggtttccccagggggacaattcgacatcagcccaaggcaattacctcgaggcgatcaatctatccttcaacgttttcgataaacactatatcaacaggaattttgaccggactggacaaatgtctgtcgttatcactccaggggtgggggtctttgaggtggatcgcttattgatgatccttactaagcagcgcatgatcgacaacggcattggtgttgacctggtctgtatgggcgaacaacccctccacgctgttcccctctttaaactgcacaatcgatccgctcctcgcgattccagattgggggacgattacaatatcccccattggataaaccattccttctatacttctaaaagccagcttttctgcaactcttttacccccaggatcaaactggctggcaagaagcctgcgtccgaaaaggctaagaatggccgggatacgtcactgggcagtccaaaggagtcggagaatgcactgcccattcaggtggattatgacgcctacgacgcacaggtgtttcgcctaccaggccctagtagagcccagtgtctgaccacatgtcgcagtgtacgggagcgcgaaagccattcccggaaaagtgccagctcctgtgatgttagcagtagtccctcactgccctctagaactctcccaacggaggaggtgcgctcacaggcatcggatgatagctccctgggtaaaagcgccaatatccttatgatacctcacccccatctccatcaatatgaggtgagcagttctctgggttacacgtccactcgcgaacatctaggatag

SEQ ID NO: 114435 - DNA, 4659 bp, Artificial Sequence
  Description of Artificial Sequence: Synthetic coding sequence
atgcggactactaaggtgtataaactggttattcacaagaagggattcggaggctccgatgatgaacttgttgtgaaccctaaagtcttcccccacattaagctgggcgacatcgtagagatcgctcacccaaatgacgagtattcacctctactcttgcaggtaaaaagcttgaaggaagatctccagaaagagactataagtgtggaccagactgtgacacaggtgttccggctgagaccttatcaagatgtctatgtgaatgtagttgatccaaaggacgtgacactggatctcgtagagcttactttcaaggatcagtacatcggccgcggagatatgtggcggcttaagaagtctctggtgagtacgtgtgcttacataacccagaaggtcgaatttgccggcattagggcacaggctggtgagctgtgggtgaaaaacgaaaaggttatgtgcggttacatttctgaggacactcgcgtggtgttccggtccaccagcgctatggtctacatctttatccagatgagttgcgagatgtgggactttgatatctacggtgacctgtactttgagaaagcggtcaacggtttcttggccgacctatttacaaaatggaaagagaaaaattgcagtcacgaggtgacggttgtcctattttctcggacgttttatgacgcaaagtccgtagacgagttcccagagattaacagggccagtatccgccaggaccacaagggtagattctacgaggacttttataaagtagtggtgcaaaacgagagacgcgaggaatggacctctctgctcgttacaattaagaagctgttcatccagtatccagtgcttgtaaggctggagcaagccgaggggttccctcagggtgataactcgacgtccgctcagggcaattaccttgaggcgattaacctgtctttcaatgtctttgataagcattacatcaaccggaacttcgatcggaccggccagatgtccgtcgtcatcaccccgggagttggcgtgttcgaagtggaccggctactaatgatcttgacaaaacagagaatgatagacaacgggatcggagtagatctggtttgcatgggcgagcagcctctgcacgccgttccactgtttaagcttcacaaccgttctgcacctagggattccaggctgggggatgattacaacattccccattggatcaaccattccttttatactagtaagagccaactcttttgcaattcctttacccctagaattaagcttgccggtaaaaagccggcaagcgaaaaggccaaaaacggcagagatacttccctggggagtcccaaggagagtgaaaatgccttgcctatccaagtggattacgacgcttatgacgcccaggtttttaggcttccagggccaagcagagcgcagtgtcttacaacttgcaggtcggtccgggaacgagagagtcactctagaaaatccgcctcatcctgcgatgtttcgtcctcaccctctttaccctcgagaaccctgccaaccgaagaggtgcgaagccaagcatccgacgatagctcccttggaaagtccgctaacattctgatgattcctcaccctcacttgcaccagtacgaagtctccagctcccttggctacaccagtactcgagacgtgctggagaacatgatggagcctccacagcgagactcgagcgctccaggtagatttcacgtcgggtccgccgaaagtatgctgcacgtgagacccgggggctacaccccccagcgggccttaataaatccatttgctccgagtcgtatgcccatgaaacttacctctaaccggcggaggtggatgcacacttttcccgtgggcccgagcggagaggctattcagatccaccatcaaaccagacagaacatggcagagttgcagggttcaggccagcgtgatcccactcactcatcggccgaactcttagaattagcttaccacgaggccgcggggcggcactctaactctaggcagccaggcgatgggatgtcctttcttaatttttccggcacagaggagctttctgtagggctactgagtaattccggagcaggcatgaatccacggacccagaataaggatagcctcgaggactctgtgtctacatccccagatccaatccttaccctgagcgcacctcctgttgtccccggtttctgctgtaccgttggggtggattggaagtcattgacaacacctgcttgtcttccgttgaccaccgactactttcctgacagacagggcttacaaaacgattacacagaggggtgttacgatctcctccctgaggccgacatagatcgccgcgacgaggatggggtgcagatgacagcccagcaggttttcgaagagttcatttgccagcggctgatgcagggctaccagatcatagtccaacccaagacccagaagccaaatccagcagtcccaccacccttgtcaagctctccactgtacagcaggggactcgtatctcggaataggcccgaggaggaagatcagtactggctttccatgggcagaacctttcacaaagttactctaaaagacaagatgatcacagtgaccagatacctgccgaaatacccttacgaatcagcccagatacattatacctactccctttgtccctcccacagtgactctgagttcgtgagctgctgggtggaattctcccacgagcgacttgaagagtacaaatggaattatctggatcagtatatatgctcagctgggagcgaagatttctcattgatagaatctctgaagttctggaggaccaggttcttgctccttcccgcctgtgttaccgcgaccaaacggatcactgagggagaagcacactgcgacatttacggagatcgcccaagggccgatgaggatgagtggcagttgctagacggctttgttcgcttcgtcgagggactcaatcgaattcggagacgccatagaagcgataggatgatgcgcaagggtacggccatgaagggtctgcagatgaccggtcctatatccacacactctttagaatcaaccgcaccaccggtgggcaagaaaggaacgtccgccctctctgctttgttagagatggaggcctctcagaagtgtctgggagaacagcaggcggcggtgcatggagggaagagtagtgcccaaagtgctgaatcaagctccgtagccatgactcccacctatatggattcccccaggaaagatggagcctttttcatggagttcgtccgtagcccaaggacggccagttccgctttttatccccaggtgagcgttgaccagaccgctacaccaatgctcgacggaacgtctctgggcatctgtaccggccagtcaatggaccgtggtaactcgcagacttttggaaacagtcagaatatcggcgaacaaggttactcatcaacaaactccagcgatagttcaagccaacaactagtggcctcgagcttgaccagctcctccacgctgactgaaatcctagaagctatgaagcatccctcaaccggagttcagcttctgtccgagcagaaaggactttctccttattgtttcatctctgccgaggtggtgcactggctggtaaatcacgtcgaaggcatccagacccaagcgatggcgatcgacattatgcagaagatgctcgaagaacagttgatcacacacgccagtggagaggcctggcgaaccttcatctacggcttctatttttacaaaattgtcacagacaaagagccagacagagttgcgatgcagcaaccagccactacttggcatacagccggagttgacgatttcgcctctttccagaggaagtggtttgaggtggctttcgttgcagaggagctggtacactcagaaataccggcattcctgctcccctggctgccaagcagaccagcaagctatgcatcccgacacagctcatttagtcggagcttcggcggacgttctcaggcggcagccctgcttgccgccaccgttcctgaacagagaaccgttaccttggacgtggacgtgaacaatcgaacagaccgactggaatggtgcagctgctattaccacgggaacttctctctaaatgctgcttttgagattaagctgcactggatggccgtcacagcagcggtcctgtttgagatggtccaggggtggcatcgcaaggcgacgagttgtgggtttctattagtaccagtgcttgagggccccttcgccctgcccagttatttgtacggagatcctttaagggctcagctctttatccctttaaatatctcatgcctcctgaaagaaggatctgaacatcttttcgattctttgggactttacaagatcaacatattgcctctgctgcttacctcccttctgagaacatctctgagcatcagcacattgcaggaacaatgcttctgttcatgtcctaccccctccgcttcctcccaggggtcatctggcggcggcggcacgccccctgctccacccactagaacatgtagtgctcggagcgggagcgctacgacaggccccaccaccccttgttctccaaaacatggggcgcccgccccccagggcatgaagtccctgttgattggatgctag

SEQ ID NO: 114436 - DNA, 4719 bp, Artificial Sequence
  Description of Artificial Sequence: Synthetic coding sequence
atgaggacaaccaaggtctacaagttggtgatccataagaaaggcttcggaggctcagatgatgaacttgtggtaaatccaaaagtgttccctcacataaagttaggagatattgtcgagattgcccatcctaatgatgaatattctcccctgctgctgcaagtaaagagtctgaaggaggatcttcaaaaagagacaatctctgttgaccagaccgtcacccaggtttttcgtctgcggccttatcaggatgtttacgtaaatgttgtggacccgaaggatgtaaccctggacttagttgaactgacttttaaggaccagtatatcgggcggggagacatgtggcgactgaagaaatctctggtcagcacatgtgcttacatcacccaaaaagtagagtttgctggaatcagggcgcaggcaggtgaactgtgggtgaagaatgagaaggtgatgtgtggatatatctccgaggacacccgggttgtctttaggagtacctctgctatggtttatatcttcatccagatgagctgcgagatgtgggattttgacatctatggtgacttgtacttcgaaaaggccgtcaacggcttcctcgctgacctgttcactaaatggaaagaaaagaactgttcacacgaggtgacggtggtgctctttagccgtacattctatgacgccaaatccgtcgatgagtttccggagatcaatagggctagcatacgacaagaccataagggaaggttttacgaagatttctacaaggtggttgtgcagaatgaacgaagggaggagtggacttccctgttagtgaccattaagaagctgttcatacagtatcctgtgctggtgcggttagagcaagctgagggatttccgcagggagacaattccacctcggcgcaggggaattacttggaagctattaatctatcgttcaatgtctttgataaacactacatcaatcgtaacttcgatagaaccggccagatgtcagtggtaataacccccggggtcggggtcttcgaggtggaccgactgctgatgattctgacaaaacaacggatgatcgacaacgggatcggcgtcgatctcgtctgcatgggcgaacagccactccacgcagtaccactcttcaagttgcataaccgatccgccccccgggactcaagactcggagatgactacaatatcccacactggataaaccactccttctatacttccaagagtcagctgttttgcaactcttttacaccacggattaagctggctggaaagaagcccgcctcagagaaagcaaagaatggaagagatacctctctgggctctcccaaagagtcggagaacgctcttcccatacaggtggattatgacgcgtatgatgcccaggtgttccggctccctgggcccagccgggcgcaatgcctcaccacgtgtaggtcagtgcgtgaacgggagagccactcaaggaagagtgcatctagctgcgatgtgtcatccagtccttctttaccttcccgcacactccctactgaggaggtgcggtctcaggcatccgacgattcttcactcgggaagtccgccaacatcctcatgataccccatccacacctccatcagtatgaagtgtcttcaagcctgggctatacctctacacgcgacgtcttggaaaacatgatggagccccctcaaagagactcttctgcacctggaaggttccacgttggcagcgcagagtcgatgctgcacgtgagacccggcgggtatacaccccagcgtgccctgatcaatccattcgcccctagcagaatgccaatgaaattaaccagcaaccgccgccgatggatgcacacctttcccgttggaccttctggagaggccattcaaatccatcaccagacccggcagaatatggctgagttgcaaggaagcgggcagcgggatcccactcacagttcggccgagctcctcgagctcgcttatcacgaggcggctggccgccacagcaattccagacagccaggagacggcatgagttttctcaacttcagcggaactgaggaattgtcagtcgggctgcttagtaattctggtgccggcatgaacccaaggactcagaacaaagattccctcgaagatagcgtctccacctcccccgacccgatgcccggattttgctgcactgttggcgtggactggaaatccctcacaactccggcttgtctgccgctgacgacggattattttcccgataggcaaggcttacaaaacgactacactgaaggttgctacgacttgctcccggaggccgatatcgaccggagggacgaggacggggtccagatgaccgcccagcaggtttttgaggagttcatatgtcagcgcttgatgcaaggatatcagatcatcgtccaacccaagactcagaagcccaacccagccgttccaccccccctgtccagctcaccactgtattctcgggggctagtgagtaggaatagaccagaggaggaggatcagtattggttatctatgggtcggacgttccataaggtgactttgaaggataaaatgatcaccgtgactcggtacctgccaaagtacccctacgagtccgcccaaattcattacacctacagtctatgtccaagccacagcgattccgaattcgtgtcatgctgggtcgaattttcccacgaacgattggaagagtataagtggaattacctggaccagtatatctgcagtgccgggagtgaggatttttccctgatcgagtcattgaaattttggcgaacaagatttctgctgctccctgcttgcgtaacagctacgaaaagaattacagagggggaagcccactgcgatatttatggagaccgacctcgcgcagatgaggacgaatggcaacttcttgacggttttgttagatttgtagagggattgaatcgaattcgaagaagacacagatccgatcggatgatgaggaagggaacggctatgaagggactgcagatgaccggacccatcagtactcacagtctggagagtactgcgccacctgtggggaaaaaaggcacttccgccctgtccgccttactggagatggaagcatctcaaaagtgcctgggagagcaacaggctgccgtgcatggcggcaaatcctccgcccagtctgccgagtcttcatctgtggctatgacaccgacctatatggattcaccaagaaaagtttcagttgatcagacagccactcccatgttagatggcaccagtctgggtatctgtaccgggcaaagcatggacaggggtaattcacagactttcgggaacagtcagaatatcggagaacagggatatagctccactaacagcagcgattcctccagccagcaactggtcgcctcttcgcttacgtcaagctccactctgaccgagatcctagaagcaatgaagcatccttccaccggcgtgcaactgctttccgaacagaagggcctgtccccctactgtttcatttccgccgaggtggtccattggctggttaatcatgtggaagggatacaaacccaggcaatggcaatcgatataatgcagaagatgctcgaagagcagttgattacccatgcatccggagaggcttggcgaacgtttatctatggcttctatttttacaagattgtcacagacaaagagccggaccgggtggcgatgcagcagccagccactacttggcacaccgccggggtggacgattttgccagctttcagagaaaatggttcgaggtcgcattcgtggccgaagagttggttcatagcgaaattccggcgttcctgctaccttggttacccagtaggccagcgagctacgcatctagacattcctccttcagcaggtccttcggcggcaggagccaagcggcagcattgctggctgcaacggttccagaacaacgtacagtgactctggacgtagacgttaacaatagaacggaccggcttgaatggtgctcttgctattaccatgggaacttcagcctgaatgcagccttcgagattaagctccactggatggccgtgactgccgcggtgttgttcgagatggtgcaagggtggcaccgaaaagccaccagctgcggattcctactggtgcctgttttggaaggccccttcgctcttccctcttacctctatggagatcctctccgagcacagctgtttataccattgaacataagctgcctgcttaaggagggatcggagcacttattcgatagcttcgaaccagaaacttattgggacaggatgcatctctttcaggaggccatcgcccacagattcggctttgtccaggacaagtatagcgcatccgcctttaattttcccgcagagaataagccacagtacatccacgtgaccggcacggtctttttgcagctcccttatagcaagcggaaatttagcggacagcagcggcgtcggcggaactccacatcctcaacaaatcagaatatgttctgcgaagagagggtcggttataactgggcatataatactatgttgaccaagacctggagatcatcagcaacaggggacgagaagttcgcagatcgacttctcaaagattttactgatttctgcatcaatagggataaccgtctcgtgactttctggacttcctgtctggaaaaaatgcacgccagtgccccctag

SEQ ID NO: 114437 - DNA, 4719 bp, Artificial Sequence
  Description of Artificial Sequence: Synthetic coding sequence
atgcgaactaccaaagtttataagctcgtgatccataagaagggttttggcggtagcgatgacgagcttgtcgtcaacccgaaagtgttcccacacatcaaactgggcgacatcgtcgagatcgcacacccaaacgacgaatacagcccccttctccttcaggtgaagagcctgaaggaagatctacagaaggagacaatctctgtggatcagacagtcactcaggttttcagactgaggccataccaggacgtgtacgtcaacgttgtggaccctaaggatgtcaccctggacctggtcgagctgacattcaaagatcagtacatcggccggggggacatgtggagactgaagaagtccctggtttcaacttgcgcgtatattactcaaaaagtcgagtttgctggcatcagagcacaggccggggagttgtgggtgaagaacgagaaggtcatgtgcggctacatttctgaggacacaagggtcgtttttaggagtacatccgcgatggtgtatattttcatccaaatgagctgtgaaatgtgggactttgacatttacggggacttgtactttgagaaagctgtgaatggcttcctggcagatctgtttactaagtggaaagaaaagaattgtagccacgaggtcacagtggttctcttctccagaacattttatgacgccaagtcggttgatgagtttcccgaaatcaacagagcaagcattcgccaggatcataagggtcgcttctacgaagatttctacaaagtggtggtacagaacgaaaggagagaggaatggacctctctgctggtgaccattaaaaagctgtttatccaatatcccgtcctcgttcgcttagagcaggccgaagggtttccacagggggataactccacatccgcacagggtaactacctcgaggccataaatttgtcgtttaatgttttcgataagcactacatcaacaggaacttcgacagaaccggccagatgtccgtcgtgataacccccggggtgggtgtgttcgaggtggataggcttctcatgattctgacgaagcaacggatgatcgacaacggaatcggagtcgatctggtctgcatgggcgagcaacctctgcacgccgtacccctgtttaaactccacaacagaagcgccccaagagattctcgactgggggatgattataatattccacattggatcaaccatagcttctacaccagtaagagtcagctcttttgtaactcctttactcctagaatcaagctcgctggaaaaaagcctgctagtgaaaaagcaaaaaacggccgggatacctccctcggctctccaaaggaaagtgagaacgcactgcctatacaggtggattacgatgcctatgatgcgcaggtgttccggctgcccggcccttcacgggctcagtgcctgactacgtgccgcagcgtcagagagagggaatcacactcccgaaaaagcgcttcttcatgcgacgtgtcaagtagtccatctcttccatcccggaccctaccgactgaggaggtgcgttcacaggcttccgatgacagctcattgggaaagagtgctaacatactgatgattccccatcctcacctccaccagtatgaagtaagctcaagcctgggatatacaagcactcgggacgtgctagaaaacatgatggaacctccacagcgagactcttctgctccgggcaggtttcatgtcggtagtgctgagtctatgctacatgtccgacctggaggatatacaccccagagagccctaatcaatccatttgcaccctccagaatgcctatgaagctgacttccaatagaagacgctggatgcacacattcccagtggggccgagtggagaagccattcagatccatcaccagactagacaaaacatggccgaactacagggcagcggacagagagatccaacgcacagctcggctgagttattagaactcgcttaccatgaggccgccggcagacactcaaacagcagacaaccaggcgatgggatgagctttctcaactttagtggaaccgaagagctgagtgttgggctcttaagtaactctggggctggtatgaatcctcgtactcagaacaaggactcattggaagactctgtaagcactagccctgatcctatgcctggattctgctgtaccgttggggtggattggaaatccctcactacaccggcctgtttaccccttactacagattatttcccagatcgccaaggattacaaaatgactacactgaaggttgctatgatctactcccagaggctgacattgaccgccgtgatgaggacggcgttcagatgaccgcacagcaagtgttcgaagaatttatttgtcaaaggctcatgcaggggtaccagattatcgtgcagcctaagacccaaaagcctaatcccgccgtaccccctcccctgagctctagtccgctctattctagggggctggtatcccgtaaccgacccgaggaagaagatcaatattggcttagcatggggcggacgtttcataaagtcacactaaaggataaaatgatcacagtgacaagatacttacctaagtacccctatgagtccgcacaaattcattatacatacagcctctgtccgtcgcatagcgacagtgagttcgtatcttgttgggtggaattttcacatgagaggctggaagaatacaaatggaactatctggaccagtatatttgcagcgcagggtcagaggacttttctctcatcgagagcctgaagttttggagaacccgtttccttttgcttccagcctgcgttaccgccactaaacggatcacagagggggaagctcactgtgatatctatggcgataggcccagggcggatgaagatgagtggcagcttctcgatggctttgtgaggtttgttgaaggtcttaacaggatcagaaggcgacatcgctctgaccgcatgatgcggaaggggactgctatgaagggcttacagatgaccgggcccatatctactcacagtcttgagtccaccgcccctccagtaggcaagaagggtacaagcgccctcagtgcgctgctcgagatggaggcaagccagaagtgcttgggtgagcaacaagctgcggtccacggaggaaaatccagcgcacagagcgccgaaagttccagcgtcgcaatgacaccaacctatatggatagtcccaggaaggtgtccgttgaccagacggccacgccaatgctcgacgggacaagcctcggcatctgcactggccagagcatggaccgtggaaattcacagacattcggcaacagccaaaacattggtgagcaaggatactcatctactaatagtagcgattcctccagtcagcagcttgttgcctcaagtctgaccagctcatccaccttgactgaaatcctggaggccatgaaacaccccagtaccggcgtgcagttattgtcagagcagaagggattgtctccctactgctttatcagtgctgaagttgtccattggctggttaaccatgtggaggggattcagacacaagccatggccattgatatcatgcagaagatgctagaagaacaattaatcactcacgctagcggggaggcatggagaaccttcatctatggattctatttttacaaaatagtcaccgacaaggaacccgatagggtggcaatgcaacagccagctacaacatggcatacagcaggggtggatgacttcgcctcctttcagaggaaatggtttgaagtggccttcgtggccgaagaacttgtccatagcgaaatccctgcttttctcttgccatggctgcctagccggcctgcctcttacgcatcgagacacagctcctttagtcgcagcttcggcggtcggagccaggctgccgcccttctggccgcaactgttccagaacaaaggacggttacattggacgtcgatgtgaataatagaaccgataggctggagtggtgttcctgttattaccatggcaatttctcattaaatgcagctttcgagatcaagctgcattggatggcagtcaccgccgccgttctttttgagatggtgcaaggttggcaccgcaaggcgaccagctgtgggttcctacttgttccagtgctggagggccccttcgccctccccagttacctatacggggatcctctgagagcccagttgtttatcccactgaatatcagctgtctattgaaggaagggagcgaacacctctttgattcgttcgagccggaaacctactgggacaggatgcatctcttccaggaagcaattgctcaccggttcggcttcgtgcaggacaaatatagcgctagcgcatttaacttccccgcggagaataagccacagtacatccacgtgaccggcacagtttttctgcaactgccgtattctaagaggaagttcagcggacaacaacgccggcgccgtaattccacatcctctacaaatcagaacatgttctgtgaggagagggtgggttacaactgggcctacaatacaatgttaaccaagacatggaggagcagcgccacgggggacgagaaattcgccgaccgcctgctgaaggatttcaccgatttctgcattaaccgcgacaatagattagtgactttttggaccagttgcctggaaaagatgcacgcaagcgctccctag

SEQ ID NO: 114438 - DNA, 138 bp, Artificial Sequence
  Description of Artificial Sequence: Synthetic coding sequence
atgagaacaactaaggtttataagctggtcatacacaaaaagggtttcggcggtagcgatgatgagcttgtggtgaaccccaaggtcttcccccacatcaaactgggagatatcgttgagattgctcacccgaattag

SEQ ID NO: 114439 - DNA, 4512 bp, Artificial Sequence
  Description of Artificial Sequence: Synthetic coding sequence
atgaggactactaaggtgtataagctggtcatccataagaaagggtttggaggttctgacgacgagctcgtggtgaacccaaaagtgtttccccacatcaagctgggggatattgtggagattgctcatcccaatgatgagtatagcccactgctgctccaagtcaaaagtcttaaggaggatttgcagaaagaaacaatctccgtggatcaaacagtgacacaggtgtttcgtctgaggccctatcaggacgtgtacgtaaacgtcgtggaccctaaagacgtgactctggaccttgtggaactcactttcaaggatcagtacattggcagaggggacatgtggcgactgaagaagtccctggtctctacttgcgcctatattacgcaaaaagtggaatttgccggaattcgcgctcaggccggcgagctgtgggttaaaaatgagaaagtgatgtgcggttacattagcgaagacacacgagttgtgttccgatctaccagcgccatggtttacatattcatccagatgtcatgcgaaatgtgggattttgatatttacggagacttgtacttcgaaaaagcagtgaatggtttcttggccgacctgttcacgaagtggaaggaaaagaattgttcacacgaagtcaccgttgtgttgttctcgagaacgttttacgatgcaaagtccgtggacgaatttccagaaataaaccgagcttctatcaggcaagatcataaaggtagattctacgaagatttttataaagttgttgtgcagaatgagcgccgcgaggagtggacatccctgttggtcaccatcaaaaagctgttcattcagtatcccgtgctggtgcggctcgaacaggccgagggcttcccacagggggataattctaccagtgcacaggggaattatctggaagctatcaacctgagttttaacgtgtttgacaaacattacatcaataggaactttgacaggaccggacaaatgtccgtggtgatcacccctggggtgggagtgtttgaagtagatcgtcttctaatgatccttacgaaacagaggatgattgataacggtatcggtgtagacctcgtttgtatgggtgagcaacccctccacgcggtccccctgttcaagctgcacaacagatcagccccaagggactcacgtttaggggatgattacaacataccccattggatcaatcacagcttctacacctcaaaaagtcagctcttctgcaatagtttcacacctaggattaaactggcgggaaagaagcctgcttccgaaaaggctaagaatggaagagataccagtctgggctcccctaaggagtctgagaacgcactgccaatacaggtggattatgatgcttatgatgctcaggtgttcaggctgcctgggcccagtagggcccagtgtctaacaacttgcagaagcgtgcgcgagcgggagagtcattcccgcaagagtgccagcagctgtgacgtgtcctcttccccatccctcccctcacggaccctgccgaccgaagaggtcagatcacaagcatcagacgattcctccttgggcaagtcggcaaatattttaatgattccccaccctcacctccaccagtatgaggtctcgagtagcctgggctacactagcactagggatgtgctcgagaatatgatggaaccaccacagagggactctagtgctcctggccggttccatgtggggtccgctgaaagtatgctgcacgttcggcccggaggatacactcctcaacgagcccttatcaacccctttgcacctagtaggatgccaatgaaactgacatccaataggagaaggtggatgcacacctttccagtgggcatgaatcctcgtacccagaataaagactcacttgaggactccgtctcaacctcgcctgacccaatcctcactctgagcgccccccccgtagtacctggattttgttgtaccgttggtgttgactggaaaagcttgaccactccagcttgcttacccctcacgacggactattttcctgataggcagggattacagaacgactataccgaaggatgctacgacctcctgcccgaggcagacatcgacagaagggatgaggacggcgtgcagatgactgcccagcaggtgttcgaggagtttatttgtcagcgcttgatgcagggttatcagatcatagtgcagcccaaaacacagaaacccaatcctgcggtgccaccgcctctgtcgtcttctccattgtactctaggggcctggtgtcacggaacaggccagaggaagaggaccagtactggttgagtatgggcaggacttttcataaggtgactcttaaggacaagatgattacagtgactaggtacctgcccaaatacccttacgagtccgcgcagatacactacacttatagtttgtgccccagccacagtgattcggagttcgttagctgctgggtggagtttagtcacgaaaggcttgaggaatataaatggaactatcttgaccagtatatctgtagcgctggctcagaagatttcagcctcatcgaatccctcaaattttggcgcacccgcttcctcttactaccggcctgcgtgactgctaccaaacgtatcaccgaaggagaggcacattgcgatatctatggcgaccggcctcgggccgatgaggacgaatggcagttgctggacggatttgttaggtttgtagagggtttgaaccgtatacgtcggcgacaccgaagtgaccggatgatgaggaagggcactgcgatgaagggactgcagatgaccggaccgatctcaactcatagccttgagtctaccgccccaccagtcggaaagaaaggtacgtctgcgctgtcagcactgctagagatggaggcttcacaaaagtgcttgggagagcagcaggctgctgtgcatgggggcaagtcctccgcccagagtgccgagagctcttccgtggcgatgacacccacatacatggattcgccacgaaaggtatcggtggaccagactgccacccctatgctggatgggacatcactgggaatttgcaccgggcaaagtatggatcgaggaaacagtcagacattcggtaactcccaaaatatcggtgagcagggatattcatccacaaattcttctgactcttcctcccagcagttggtggcctctagtctcactagcagctccacattgacagaaatcctggaggccatgaagcacccctccaccggcgtgcaactcctctccgaacaaaaagggctctccccctactgcttcatttcagcggaggtcgtgcactggctggttaaccatgtggagggcatccagacacaagcgatggccatcgacattatgcagaagatgctcgaagaacagcttataacccatgcttctggtgaagcttggagaaccttcatttacggtttttatttctacaagatcgtcacagacaaagaacctgaccgggttgccatgcagcagcctgccaccacttggcataccgccggggtggatgacttcgcatccttccaaaggaaatggttcgaggtggcgtttgtcgcagaggagctggtgcatagtgaaattcctgcttttctcctcccatggctaccgtcacggcccgccagctatgcctctcggcactcaagcttctcacgatctttcggtggtaggagccaggctgccgcactgctggccgcaactgtgccagaacagagaaccgttaccctcgacgttgacgtgaataatcgtaccgaccgattagaatggtgtagctgttattaccatggaaacttcagtctgaacgctgccttcgagatcaagctgcactggatggccgttacggccgccgtgctgttcgagatggtgcaggggtggcatcgcaaggccacttcatgcggatttcttctggtccctgtccttgaggggccttttgcgctgccctcctatttgtatggcgatccgttgcgcgcccagctgtttatccctctcaatatcagctgtttactcaaggagggctccgagcacttgttcgattccttcgaacccgaaacttattgggataggatgcaccttttccaagaggcaatcgcccatcgctttggatttgtgcaggacaaatactcagcatcggccttcaactttcccgccgaaaacaaaccacagtacatccacgtgaccggcacagtgttcctccagctgccctatagcaaaagaaaattctccgggcagcagcgacggaggcggaatagcacttccagcaccaaccaaaacatgttttgcgaggagcgtgtgggatacaactgggcttataacacaatgctcactaaaacctggaggagtagcgctacaggcgatgagaagttcgcagatagattactgaaggactttaccgatttctgtattaatcgggacaacagactggttaccttctggacctcttgcctggaaaagatgcatgcgtctgctccgtag

SEQ ID NO: 114440 - DNA, 1995 bp, Artificial Sequence
  Description of Artificial Sequence: Synthetic coding sequence
atgcgcactacaaaggtctataagctcgtgattcataagaagggcttcggaggaagcgacgacgaactggtagttaaccccaaagtgttcccccacatcaagctcggtgatatagtggagatcgcacatccgaacgacgagtactctccgctcctgctgcaggtgaagtcactcaaagaggatcttcagaaggaaacgatctcggtcgatcaaaccgtgactcaggtgtttcgtctgaggccatatcaggacgtttatgtgaacgtggtggaccccaaggttagtacctgcgcctatatcacgcaaaaggtagagtttgctggcataagggctcaagccggtgaactgtgggtcaaaaatgagaaggtcatgtgcggttacatctcagaagatactagggtcgtattccgctctactagcgccatggtctacatttttatccagatgtcttgcgagatgtgggattttgacatctacggcgacctttattttgaaaaggccgtcaatggctttctcgccgacctgtttaccaaatggaaggagaagaattgtagccacgaagttacagtggtattattctcccggaccttctatgacgctaaaagtgtggatgaattccccgagatcaatagggcgagcattcgccaggatcacaagggacgattttacgaagatttttataaagtggtcgtccagaatgagaggagagaggagtggaccagtctgcttgttactatcaagaaactgtttatccaatatccagtcctggtccgtcttgagcaagccgaaggtttcccacagggcgataacagcacatccgcccagggtaattaccttgaggccatcaaccttagttttaatgtgttcgataagcactatattaatagaaatttcgataggactgggcaaatgtcagtcgttatcactcccggcgtgggagtttttgaagtggacagactactgatgattctaacaaagcaaagaatgatcgataatggcatcggtgttgatctggtgtgtatgggggaacagccattgcatgccgtgcccttgtttaagctgcacaacaggtccgctccccgggatagtagactcggtgacgattataatatcccacactggattaatcactctttctatacttctaaaagccaactcttctgtaatagcttcacccctcgaatcaagcttgcaggcaagaagcccgcatcagaaaaagccaagaacggccgagacacatccttgggcagtccaaaggagtccgaaaacgccttacccattcaagtagactacgatgcttacgacgcacaggtattccgcctgccaggcccatccagagcacagtgccttaccacatgccggagtgtgcgagagcgagagagtcacagtcgcaagtccgcttcctcctgcgacgtgtctagcagcccctccctgcccagcagaactctgcctacagaagaggtgcggtcacaggcatctgacgactccagtctcggaaaatcagccaatattctgatgattccacacccccatctgcaccaatatgaagtgagtagctcactaggatatacgagcacgcgcgatgtgcttgagaatatgatggagcccccacagagggattcctcagctccaggaaggttccacgtcggcagtgcggaaagtatgttacatgtaaggcctggcgggtacaccccccaacgggccttaatcaatccttttgcgccctcccgcatgcccatgaaacttacctccaatcgaaggcggtggatgcatacctttcccgttggcatgaaccctagaactcaaaacaaggactcactcgaggattcagtgtctacctcccctgacccatctaagaggggacagctgaccggagagaggggtcgtcaaggtgtgtggggaggccagagtatgaggaaacaagaggaagcactgtgggaagtttcggggcctgaggttcacatccctttggggtatggtaaggctatgtggtag

SEQ ID NO: 114441 - DNA, 1263 bp, Artificial Sequence
  Description of Artificial Sequence: Synthetic coding sequence
atgaagcatcctagcaccggtgttcagctcctgagcgagcagaagggtctgtccccatactgtttcattagcgccgaagtggtacactggctggtgaaccacgtcgagggcatccagacccaggcaatggcgatagacattatgcagaagatgctggaggaacagctgatcacacatgcgagcggcgaggcctggaggacatttatctatggattctacttttacaagatagtgaccgataaagaaccagatcgagtggccatgcagcaaccagcaacaacatggcatactgcaggcgtcgatgatttcgcctcttttcagcggaaatggtttgaagtggcttttgttgctgaagaacttgtgcactcagagattccagctttcttactcccgtggctgccatcccgacctgcttcctatgcgtctcgacactccagctttagtcgaagcttcggcggcagaagccaggccgccgcactgttagcagctacagtccccgaacagcggaccgtcaccctggatgtcgatgtaaacaacaggaccgatcggctcgagtggtgttcctgctactaccacggcaacttttctctgaacgctgcctttgaaataaaactacactggatggctgtgactgcagcagtgcttttcgagatggtgcaggggtggcaccggaaggcaacctcttgcggattcctgctcgtccccgtccttgaaggcccatttgctctgccaagctatctctacggggatcccctcagggcccagttgttcatccccttgaatatatcctgcctgctcaaggaaggaagcgaacatctcttcgacagcttcgagccagagacctactgggaccgcatgcatctgtttcaggaagccattgcccatagattcggctttgtccaggataagtattctgcctccgccttcaattttccagcggagaataagccccagtacatacatgtgaccggaacagtatttctccagttaccttactctaagcgcaagtttagcggacagcagcgcagacgaagaaacagtactagttccaccaaccagaatatgttttgtgaggagcgcgtcgggtacaactgggcttataacacaatgctgacaaagacctggcgatcctctgccactggagacgaaaaatttgccgaccggttactaaaagactttaccgacttctgcattaaccgagataatcgactggtgaccttctggacctcgtgtctggagaagatgcacgcttccgccccgtag

SEQ ID NO: 114442 - DNA, 4785 bp, Artificial Sequence
  Description of Artificial Sequence: Synthetic coding sequence
atgaggaccacaaaggtttacaagcttgttatccataagaaagggttcggaggcagcgacgacgaattggtcgtcaatccaaaggtgttcccacacattaagctgggggacatcgtggaaattgcacaccccaacgacgaatactcacctctgctgcttcaagtgaagtctttgaaggaagacctgcagaaagagacaatctccgtggatcagaccgtaacacaggtctttaggctgaggccctatcaggatgtgtacgttaatgtggttgacccaaaggacgtcaccctcgacctagtcgagctgaccttcaaggatcaatacatcggtcggggcgatatgtggcggctcaagaaatcactggtttcaacttgcgcatacatcacacaaaaagtggagttcgcagggatacgtgctcaggccggagagctctgggttaagaatgagaaagtcatgtgtggatatatcagcgaggacacccgtgtagttttcaggtcaacttccgctatggtctatatatttattcagatgtcttgtgagatgtgggactttgacatctatggtgacctttatttcgaaaaagccgtgaacgggttcttagctgatttgtttacaaagtggaaagaaaaaaattgtagtcacgaagtaaccgttgtgctttttagtcggactttttacgatgctaagagcgtagacgaattccctgagattaatcgtgcaagtattaggcaggatcataagggtagattttatgaggacttttacaaagtcgttgtgcagaacgaaaggcgcgaggagtggactagcctgttggttaccattaaaaaactttttatacagtacccggtattagttcgcctggaacaggccgagggatttcctcaaggagacaactccacttccgctcaggggaactaccttgaagcaatcaacttgagcttcaacgttttcgataaacactacatcaacaggaatttcgatcgcacagggcagatgtccgtcgtgattacccccggagtcggtgtcttcgaggtggatcggctgcttatgattctcacaaagcagcgaatgatcgacaacgggattggtgtggatctggtgtgtatgggtgagcagccactgcatgccgtacccttgtttaagttacacaatagatccgcaccaagggacagtagacttggagacgattacaatatcccacactggatcaaccatagcttttatactagtaagtcccaactgttctgtaactccttcacaccccgaatcaaacttgccggcaagaagcccgcatctgagaaagctaaaaatggcagggatacatccttggggtcacccaaagagtctgagaacgctctccccatccaggtagactacgatgcttatgatgctcaagttttccgcttgccaggcccctcacgtgctcagtgtctcacgacctgtagatccgtacgcgaacgtgaatcgcactctagaaagtccgcctccagctgcgacgtgagttcatctccgtcccttccaagtcgcacccttcctacggaggaagtccggtctcaggccagcgacgacagttctcttgggaagagcgctaacatcctaatgatcccccatccccatcttcatcagtatgaagtttcgtcaagccttggatatacatccaccagggatgtgctggagaatatgatggaaccccctcagagagacagtagcgcacccggacggtttcacgtagggagtgctgaatctatgctgcatgtccgccccggtggatacacgccccagcgcgccttaatcaatccattcgcaccaagccgcatgcctatgaaactcacgtccaaccgcagaagatggatgcacactttcccagtcggaccaagcggcgaggctattcagattcaccatcagacacgccagaacatggctgaactccaagggtctgggcagcgggaccctacccactcctcagccgagttgctggaactggcttatcacgaagccgcaggacgccacagcaacagtcgtcagcctggcgacggtatgtctttcttgaactttagcggcactgaggagttgtcagtgggtctcctctcaaattctggggcgggaatgaacccccgcactcagaacaaagattctctcgaggactcagtgtcaaccagccccgacccaatgcctggcttttgttgcaccgtcggcgtagattggaaatcgctaactacccccgcctgtttgcctctaaccaccgattatttccctgaccgccaaggcttgcagaatgactatacagaagggtgttacgatctactgcctgaagctgatattgataggcgtgacgaagacggagtgcagatgacagcccaacaggtgtttgaggagtttatttgtcaacgcctgatgcagggctaccaaataatcgtgcagccaaaaacacagaaaccaaacccagccgtaccacctcccctgtcgtcatctcccctgtattccagaggtcttgtaagtcgaaatagacccgaagaggaggaccagtattggctatcgatggggcgtacatttcacaaggttacgctaaaggataaaatgattacagtgacaaggtaccttcctaagtacccatatgagagcgcccaaattcactatacatatagcctgtgcccctcccattccgactccgaattcgtgtcatgttgggttgagttcagtcatgagagactcgaggagtacaaatggaactacttggaccaatacatctgttctgctggctctgaggatttctctctgatcgagagcctcaaattttggaggacccgcttcttactcctgcccgcttgtgtgactgctacaaaaaggatcacggagggagaagctcactgcgatatctatggtgatcggcccagagccgatgaggacgagtggcagctcctcgatggatttgtgagatttgtggagggactgaaccgcatccgccggagacacaggtcagacaggatgatgaggaagggtaccgcgatgaagggacttcagatgacgggccccatttcaacccactcgctggagtctaccgctccaccagtgggcaagaaggggacctccgctctgagcgccctattggagatggaagcatcacagaagtgcttaggtgagcagcaggcagctgtccatggcgggaaaagcagtgctcagtctgcagaatcctcctcagtggctatgacgcctacatacatggattcaccacgtaaagatggcgcattcttcatggaattcgtgcgctcgccacgcaccgcctccagtgccttctacccacaggtgagcgtcgaccagactgcgacaccaatgctggacggtacaagccttggaatctgcaccggacagagcatggaccggggcaactctcagacattcggcaactctcagaatatcggcgagcagggatacagcagtactaattcatctgattctagctcccaacagctcgtggcatctagtctcacaagctcttctaccctgactgagattttggaggcaatgaaacatccctctacaggagtccaactactgtcagaacagaagggtctctcgccatactgcttcattagcgcagaggtcgtgcattggcttgtgaaccacgtagaggggatccagacacaggctatggctatcgatatcatgcagaaaatgctggaggagcaattgatcactcacgcctctggagaggcttggagaacatttatttatggattttacttctacaaaatagtaacagacaaagagccagatcgggttgccatgcaacagcccgcaaccacgtggcacaccgccggcgttgacgactttgcttccttccagcgcaaatggtttgaagttgcatttgtcgcagaggagcttgtgcatagtgaaatcccagcattcctgcttccgtggttaccatcccgcccagcatcctatgcctctagacactcctctttttcaagaagctttgggggacgatcccaagcagctgccttgctggccgccaccgtgccggagcagcgcaccgtgaccctcgatgtggatgtcaataaccgtacagatcgccttgaatggtgcagttgttactaccacggcaacttctcgctcaacgctgccttcgaaatcaagctgcactggatggccgtgactgctgccgtactgtttgagatggtccagggatggcaccggaaggctacatcttgcggctttctgctggtacccgtgttggaaggcccttttgcacttccctcgtacctctacggcgaccctctgcgcgctcagctttttattcctttgaacatttcgtgcctactgaaggaaggtagcgaacatctcttcgactcgttcgagccggagacatactgggatcgaatgcacctgttccaagaggctatagcccaccggttcggcttcgtccaggataagtactctgctagcgccttcaattttcctgcagagaataagccgcagtacatccatgtcacaggcacagtgttcctacaactgccttattccaaaagaaagttttctggccagcagcgacgccgcaggaatagcacctcctctactaaccagaatatgttctgtgaggaaagagtggggtacaactgggcctacaacaccatgctcactaagacctggaggagcagcgcaacaggagatgaaaagttcgcagacaggctgctaaaagatttcaccgacttttgcatcaatcgagacaacaggctagtgactttttggacttcatgtctggagaagatgcacgcttcagccccctag

SEQ ID NO: 114443 - DNA, 1536 bp, Artificial Sequence
  Description of Artificial Sequence: Synthetic coding sequence
atggctacggtgcaggaaaaagctgctgccctgaacttaagcgcactccatagccccgcccacaggccacccggatttagtgtggcccagaagccctttggggctacctacgtgtggagttcaattattaatacactgcagacccaggtcgaagttaaaaagcgcaggcatcgtctgaaaaggcacaacgactgcttcgtcggctctgaagctgtggatgttatcttctcacatttaattcagaataaatacttcggcgacgtagatatccctagggcgaaagtggtacgagtatgccaggcactcatggactacaaggtgttcgaagcagtccctaccaaagtttttggcaaggataagaagcccacgtttgaggattcctcttgtagcctgtaccggtttacaactattcccaatcaggattcgcagctaggaaaggaaaacaagttgtattcccccgctcgatacgctgacgctctgttcaaatcttccgatattcgtagcgccagtctggaagacttatgggagaatttaagccttaaaccagccaactctccccacgtcaatatatcagcgactctgtcaccccaggttatcaatgaggtctggcaggaggagacaattggcagactcctccagctggtagacctgcccctcctggattctcttctgaagcagcaggaagctgtcccaaagatcccacagcctaagagacagtcaaccatggtgaattcctctaattatcttgatcgaggaatcttgaaagcatatagcgatagccaggaagatgaatggctttccgcggctatcgactgcttagagtacttgcctgaccagatggtcgtggaaatctctcggtcattccccgagcagcctgaccgaacagaccttgtcaaagagctactgttcgacgcaattggacggtactattcgtccagggagcccctgttaaatcacctgagtgatgtccacaacggaatcgccgagctgctagtgaatgggaaaactgagatcgcactagaggccacccagctcctgcttaaactgttggactttcagaaccgggaagaattccggaggctactgtactttatggccgtggccgccaacccatctgagtttaagctgcaaaaggagtcggataaccgtatggtcgtcaagcggatttttagtaaggcaattgtggataataaaaacctgtccaaaggtaaaactgaccttttggtcctgtttttgatggaccaccagaaagacgtttttaagataccaggcaccttgcataagatcgtaagcgtgaaactgatggccatccagaacggtagggatcccaatcgcgatgccggctacatctattgccagcgtattgaccaacgtgactactcaaacaacaccgaaaaaacaactaaagatgagctgctgaatctccttaaaacgctcgacgaagactcaaaactgtcggctaaggagaaaaagaaacttctcgggcaattttacaaatgccaccccgacatcttcattgaacatttcggcgattag

SEQ ID NO: 114444 - DNA, 1509 bp, Artificial Sequence
  Description of Artificial Sequence: Synthetic coding sequence
atgcgaggcttatgtgaattctactggcaagagtttggaatcaagggattcagtgttgctcagaagcctttcggtgctacatacgtctggagcagcatcatcaatacgctacagacccaggtggaggttaagaaaaggcggcataggcttaagagacacaatgactgcttcgtcgggtccgaagcagtggatgtcatcttcagccatctcattcagaataaatacttcggcgatgtagacatcccaagggcaaaggtggtgagagtgtgtcaggccctcatggactacaaggttttcgaagcagtgccaactaaggtttttggcaaagataagaaacctacgttcgaggattcatcctgtagtttgtatagattcactactatccccaaccaggatagccaacttgggaaggagaataaattatattcccctgctcgctacgccgacgccttattcaagagcagcgatatcaggtccgcttctctggaggatttgtgggaaaatctgtcactgaagccggccaattcgccacatgtgaacatttccgcaacactgagtcctcaggtcattaatgaggtgtggcaggaggaaactataggtagactgctacagttggtcgatctgccgctgctagattctctactcaagcagcaagaggccgtgccgaagatacctcagcccaaaaggcagagcacaatggtgaattcaagcaattatctcgatcgcgggattctcaaagcgtactcggattcacaagaagacgagtggctctctgcagccatagattgcctagagtatctgcccgatcagatggtcgttgagatcagccggtctttcccagagcagccggataggactgatctggtcaaggagctgctcttcgatgcgattggacggtattactcatctcgtgagcccttactgaaccacctgtccgacgtgcataatgggatagcggaactgttggtgaacggcaagaccgaaatcgcactagaggccacccagctgctactgaagcttttggacttccagaacagagaggagttccgcagactgctgtactttatggcagtcgctgccaatccctccgaattcaaactgcaaaaggagtctgacaatcgaatggtggttaaaagaatattttccaaagccatagtggacaacaagaacctttcaaaaggaaagaccgatctgttagtgctcttcctgatggatcatcagaaagacgtttttaaaatacctggcacacttcacaaaatcgtctccgtgaagctcatggccattcagaatggtagagatcctaacagggatgccggatatatatattgtcaacggattgatcagcgggattatagcaataatactgagaaaaccactaaggacgaacttctgaaccttctgaagaccctcgacgaggacagcaagctatcagctaaggagaagaagaagctgttgggacaattttataagtgccaccctgacatcttcattgaacattttggagactag

SEQ ID NO: 114445 - DNA, 1230 bp, Artificial Sequence
  Description of Artificial Sequence: Synthetic coding sequence
atggaagaggggggcagtactgggtctgcgggaagcgactcttctacttcagggtccggtggtgcccagcagcgcgaactggaacgaatggctgaggtcttggtgaccggggaacaactgcgcctgaggctgcatgaggagaaggtgatcaaggacagacgccaccacctgaaaacgtatccgaactgctttgtggcgaaggagctgatagactggctcattgaacataaggaggcctcggatagagaaaccgccatcaagctcatgcagaagcttgctgataggggcattattcaccatgtgtgcgatgagcacaaggagttcaaggatgtcaaactcttctatcgctttagaaaagatgacggcaccttccctctggacaacgaggtcaaggcattcatgagaggccagaggttgtacgagaagctcatgtctcccgaaaacaccttgctgcagccacgggaagaggagggggtcaagtacgagcgcactttcatggctagcgaatttctggactggctggtacaggagggggaggctacaactaggaaggaagcagagcaattatgtcacaggctcatggaacatggaatcatccagcacgtgagcaacaagcacccattcgtagactccaaccttttatatcagtttcggatgaattttagaaggcgtcgcagactcatggaactccttaacgagaagtcccctagcagccaggagacacacgatagcccattttgcctccgaaagcagagccatgacaacagaaaaagcactagtttcatgtccgtgtcgccctccaaagaaatcaaaatagtgtctgctgtccgcagatctagcatgtcatcctgcgggtcttccggctacttcagcagttcccccaccctttctagcagcccacccgtgctatgtaatcctaagagcgttctaaagagacccgtaacaagtgaagaacttctgacacctggagctccctacgctcggaaaacatttactattgtaggagatgctgtagggtggggatttgtagtacgaggttctaagccttgtcatattcaggctgtagacccctccgggccagctgccgctgctgggatgaaggtctgccagtttgtagtgagtgtcaacgggcttaatgtccttcacgtggactatcggacggtaagcaacctcatccttaccgggccaagaaccatcgtaatggaagtgatggaagaattagagtgttag

SEQ ID NO: 114446 - DNA, 2877 bp, Artificial Sequence
  Description of Artificial Sequence: Synthetic coding sequence
atgaggacgcatacaagaggggcgcctagcgtgtttttcatatacctcctttgctttgtatcagcctatatcaccgacgagaatcctgaggtgatgatccccttcacaaatgctaactacgactcacatccgatgctgtacttctcgcgggcagaggtggcggagttacagttgagagccgctagctcacatgagcacattgctgcccggttgaccgaagccgttcacaccatgctgtccagtccactcgagtacctccctccctgggaccctaaagactattccgctcgctggaatgaaatttttggcaacaaccttggagcactggctatgttctgcgtgctctaccccgaaaatatcgaggctcgggacatggccaaggactacatggaaagaatggccgctcagccttcatggctcgtcaaagacgcaccctgggatgaagtgcccctggcacactctctggttggtttcgccacagcctacgatttcttgtacaactacctctccaagactcagcaggaaaagttcctggaggtgatagccaacgcaagtggctacatgtatgagaccagctaccgccgcgggtggggcttccagtatctgcataaccatcagccaacaaattgcatggctcttttgaccggctcactggtgctgatgaatcagggctacctgcaggaagcttacctttggactaaacaggtgttaacaatcatggaaaagtccctggttctcctgcgggaagtcactgatggctcactgtacgagggggtagcctatggctcctacaccacccgcagtctttttcagtatatgttcctggtgcagcgtcatttcaatattaatcactttggacacccctggctgaagcagcacttcgccttcatgtatagaaccattctgcccggcttccaacgcacggtagcaattgctgattcaaattataattggttttacggtcccgagagtcaactggtgttcctggacaagttcgtgatgaggaatggttccggaaattggctcgccgaccagatacgccgaaatcgcgttgtcgaaggccccggcacaccatccaagggtcagaggtggtgtacacttcatacagagttcctttggtacgatggcagcctgaagtccgtgccccctccggattttggaacccccaccctgcattacttcgaagactggggagttgtaacatacggatctgcgctcccggccgagatcaacagatcctttctgagttttaagagcggcaagctgggtggcagagcaatatatgatatcgtgcatcggaataagtataaggactggattaaaggatggagaaatttcaacgcgggccacgagcaccctgatcagaatagttttacctttgctcccaatggggtgcctttcatcacagaggccctctatggccccaagtacaccttttttaacaatgtgttgatgttcagtcctgcagtgtccaaatcctgcttcagcccttgggtgggccaggtgacagaagattgctcctctaagtggtccaaatacaaacatgatctcgcagcctcttgccagggtcgtgtcgtcgctgctgaggaaaagaatggagtggttttcatccggggcgaaggcgtcggcgcttataatcctcagctcaacctgaagaacgtccagcggaatctcattctgctccatccccagcttctcctgctcgttgatcaaatccacctaggcgaagagtcgcctctggagactgctgctagcttttttcacaatgtagatgtgcccttcgaagaaacagttgttgatggggtgcacggagcttttatcagacagcgcgatggcctatataagatgtactggatggacgataccggctacagtgagaaggccacatttgcttccgtcacttatccacgtgggtacccttataacgggaccaattatgtcaacgtgacaatgcatctgcggtctcccattacccgggcggcctatctgttcataggcccgagcatcgacgtgcagtcctttactgttcacggggatagccagcagctggacgtcttcatcgccacatcaaagcacgcgtatgctacatacctgtggactggtgaagccactggtcagtccgcatttgcccaagttattgcagaccgccacaagatactttttgacaggaactccgccataaaaagctccatagtccccgaggtcaaggactacgccgctattgttgagcagaatctgcagcactttaagcccgtctttcagttactagaaaagcagattctctcaagagttcgtaacaccgcaagcttccgaaagactgccgagagacttctccggttctctgataaacgtcagacggaggaggctatcgataggatattcgcaatctcccagcaacagcagcaacagtccaaatccaaaaaaaaccggagggccggaaagagatataagtttgttgatgccgtgccggacattttcgctcagatcgaagtgaacgagaaaaaaatcagacaaaaagcccaaattctggcacagaaagaattacccatagatgaggacgaagagatgaaagacctgctggatttcgccgacgttacctacgaaaaacataagaatggcgggctgatcaaggggagattcggccaggcaaggatggtgacaactacccacagccgggcacccagcttaagtgcctcctacacccgattgttcctaattctcaatatagctattttttttgtgatgctagccatgcagctgacttactttcagcgagcacaaagtctccacgggcagcgatgcctgtatgctgttctcctgatcgactcatgtatcttactctggctgtacagctcctgctcccagtcccagtgctag

SEQ ID NO: 114447 - DNA, 2877 bp, Artificial Sequence
  Description of Artificial Sequence: Synthetic coding sequence
atgcggacccatacacgcggagcgccctcggtcttcttcatctatctcctttgttttgtgagcgcctacattaccgatgagaatcctgaagtgatgatcccgttcacaaatgctaactacgacagccatcccatgctgtacttctctagagcagaggttgccgaacttcagctgagggcggcttcaagccacgagcacatcgcggcgcgccttaccgaagccgtgcacaccatgctctcgtcccctctcgaatacttgcccccctgggaccccaaggattactcggctcggtggaacgaaatattcggaaataatctgggcgcgctagccatgttctgcgtcctgtaccccgagaatatcgaggccagggatatggccaaagattacatggagagaatggccgcgcagccctcttggctggtgaaggacgccccttgggacgaggtgccgctggcacatagtctggtgggctttgcaaccgcctatgattttctatacaattatctttcgaagacccagcaagagaaattccttgaggtaatcgctaatgcatctggttatatgtacgaaacgtcgtaccgccgcggatggggcttccaatatcttcacaatcatcaaccgactaactgtatggctttgctgaccggtagccttgtgctaatgaatcagggctacctgcaagaggcgtatctttggactaaacaggtcctgaccatcatggaaaagagtctggtactactgcgagaggtcacagacggctccctctacgagggagtcgcttatggaagttacacaacgcgtagcttgtttcagtacatgtttctggtacagcgccattttaacattaaccatttcggacatccatggctgaagcagcatttcgccttcatgtaccgtaccattctcccaggattccagcgcaccgtggcgattgctgattctaattacaattggttttatggacctgagagccagctggtattcctcgacaagttcgtgatgaggaacggttccggcaactggttggctgatcagataagacgcaatagagtcgtggagggtccaggcacaccctctaaggggcagcggtggtgtacactgcacactgagttcctctggtacgatggatctctgaagagcgttccacctcccgattttggcacacccactctgcactacttcgaggactggggcgtcgtaacctacgggtcagcactccctgccgaaatcaaccgatccttcctatcattcaaaagtgggaagctggggggcagggctatttatgacatagtgcacagaaacaaatataaggattggataaaggggtggcggaattttaatgccggacatgagcacccagaccagaacagcttcaccttcgcccctaatggagtcccatttattacagaagccctgtacgggccaaagtacacgtttttcaataacgtgttgatgttctccccagccgtttcgaaaagttgcttcagcccttgggtgggtcaggtgacggaagactgcagcagcaaatggagcaagtacaaacatgatctcgccgcctcgtgtcagggacgagtggtggcagccgaagaaaaaaacggagtagtcttcatacgtggcgagggcgtgggagcttacaacccccagctgaatttgaaaaatgtacagaggaacttaattctcttgcacccccagctgctcctgctcgtcgatcaaattcatctgggtgaagagagtcctctggagacagccgcctcttttttccataatgtggacgtcccattcgaggagaccgttgtggatggtgtccatggagccttcatccgtcaacgtgatgggttatataaaatgtactggatggatgacaccggatatagcgaaaaggcaacgtttgcctccgtgacctatccgcgtggctatccatacaacgggacaaattacgtgaatgtaaccatgcacctgcggtctcctatcactcgagcagcctatctcttcatcggtccctccattgacgtgcaaagcttcacagtccacggggactcccagcagctcgatgttttcatcgctacttcaaaacacgcctacgccacatacctgtggactggagaggcaacggggcagagcgcgttcgctcaggtcatcgccgacaggcacaaaatcctgttcgatcggaattctgccatcaaatcttctatcgtccccgaggtcaaagactacgccgccatagtggagcaaaatctgcagcattttaagcctgtgtttcagcttctggagaagcagatcctttcacgggtgaggaataccgccagcttccgcaaaacagcagagaggttgctgcggtttagcgataaacgtcagaccgaggaagccatagacagaatattcgctatatcccagcagcaacagcagcagagtaaaagcaagaagaaccgccgtgccggcaagcggtataaatttgtggacgctgtaccggacatcttcgctcagatcgaagtcaatgaaaaaaaaatccgacagaaggcacagatattggctcaaaaggagctccccattgacgaagatgaggaaatgaaggatctgctggattttgcagatgtgacatacgaaaagcacaaaaacggcggcctcataaaagggcgttttggccaagccaggatggtgacgactacgcacagtagagcgccaagcttaagcgccagttacacccggcttttcctcatactaaacattgctatcttttttgtgatgctggcaatgcagttaacatatttccagagggcccagtcattgcatggccagaggtgtttatacgccgtgcttttgattgattcttgtatccttctgtggctttatagctcctgctcacagagtcaatgctag

SEQ ID NO: 114448 - DNA, 501 bp, Artificial Sequence
  Description of Artificial Sequence: Synthetic coding sequence
atgcgaacccacactcgcggtgctccaagcgtgtttttcatctaccttttgtgtttcgtgagcgcttacattaccgacgaaaatccagaagtgatgattcccttcacaaacgccaattatgatagccatcccatgttgtactttagtcgggctgaagtggccgagctgcaactcagggccgccagttcccatgagcatatagcagcccgattgaccgaggccgtccataccatgttgagctcccctttggaatacctcccaccttgggatcctaaggactacagcgccaggtggaatgagatctttggaaacaacttgggcgctcttgctatgttctgtgtgctctacccagagaacatcgaggcgagggacatggctaaagattacatggagcgtatggcagcacagcccagttggctggtgaaggacgccccctgggacgaggttcctctagcacacagcctcgtggggtttgcaacggcatacgactttctttactag

SEQ ID NO: 114449 - DNA, 2877 bp, Artificial Sequence
  Description of Artificial Sequence: Synthetic coding sequence
atgagaacccacactaggggcgctccatcagttttttttatctacctattgtgttttgtgtctgcctatatcacagacgagaaccccgaggtaatgattccatttaccaacgccaattatgacagtcaccccatgctgtatttttcaagggcagaagtggccgagctccagctcagggcagcatcatcccacgagcacattgccgctcggctgactgaagcggtacacacaatgctgtcttcgccattggaatatttgcctccctgggatccaaaggattactctgcacgctggaatgaaatttttggcaataatctgggagccctggccatgttctgtgttctgtaccccgaaaatattgaggcacgggacatggccaaggactatatggaaaggatggccgcacagccgagctggttggtcaaggatgcaccatgggacgaggtcccactggcccacagcctggtagggtttgccacggcatatgattttctttataattacctgtcgaaaactcaacaggagaaattcctggaagtgatagcgaacgcctccggatacatgtatgagacttcctatagacgcgggtggggcttccagtatctgcataatcatcagcctaccaactgtatggccctcctgactgggagtttggttctcatgaaccagggttacctacaggaggcatatctatggactaagcaggtgttgaccattatggaaaaaagccttgtgctgctgcgagaagtaactgatggatccttgtatgagggggtcgcctacggatcttatactacacgcagcctgttccagtacatgttcctggtgcagcgccactttaacatcaaccacttcggtcacccttggctgaagcaacactttgcctttatgtacagaaccattttaccgggcttccagcgcacggtggccatcgccgactccaattacaactggttctacgggcccgagtcccagctggtgtttctggataaattcgtgatgagaaacggttctgggaactggctggctgaccaaatcaggcggaacagggttgttgaagggccaggcacccccagcaagggccaaaggtggtgcacactccataccgagtttctgtggtacgatgggtctctgaagtccgtgccaccgcccgacttcggaactcccaccctacattacttcgaagactggggcgtggttacttacggttccgcccttccagcggagatcaaccgatcattccttagcttcaagtctggcaagctcggcggacgcgccatttatgatattgtacaccgaaacaagtataaagattggattaagggatggagaaactttaatgctggccacgagcatccagaccagaattcttttacgtttgcaccaaatggtgtcccctttataactgaggccctgtatggcccgaagtatacattctttaacaatgtgctcatgttctcccctgccgtctctaaaagctgtttttccccctgggtggggcaggtgacggaagattgtagctctaaatggtccaagtataagcacgacctggctgcaagctgtcagggcagagtggttgccgccgaagagaaaaacggtgtggtgtttattcgaggagagggggttggcgcctataatcctcaacttaacctcaagaacgtacaaagaaacttgatcctactgcaccctcagctgctcctcctggttgatcagattcaccttggcgaagagtctcctctggagacagccgccagttttttccacaacgtcgacgtgccttttgaggaaacggtggtagacggagtacatggagcattcattaggcaaagggatggattgtataaaatgtactggatggatgacacaggctactctgagaaagccacttttgcctctgtcacttatccccgggggtacccctataacggtaccaactacgtgaacgtcacaatgcatctgaggtcgcccattaccagggctgcatacctgttcataggcccctccattgatgttcagtccttcactgttcacggcgactctcagcagctagatgtctttatagcaacctcaaagcacgcctatgcaacatatctatggaccggggaggccaccggacagagtgcattcgcgcaggtaatcgctgacaggcataagatactgtttgatcggaactccgctattaagagttccattgtgcctgaggttaaggactatgcagccatcgtcgagcagaatttacagcattttaaacctgtgtttcagctcctggaaaagcagattctatcacgggtgcgcaacactgcttccttccgtaagacggcggagagactgctacgcttcagtgataaacggcagacagaggaagccatagatcgcatttttgctataagccagcagcaacagcagcagagtaaatcaaagaaaaatcgtcgagctggtaaaagatacaagttcgtagacgcagtgcctgacatttttgctcagattgaagtgaacgagaagaaaattaggcaaaaggcccagatcctcgctcagaaggaactcccgatagatgaagatgaggaaatgaaggacctgctagattttgcagatgtcacctacgagaaacataagaacggtggacttattaaagggaggttcggtcaggccaggatggtaaccactactcattccagggccccttccttgtcggcatcatacaccagactgtttctgattcttaatatcgccatattctttgttatgctggcaatgcagttgacctatttccagcgagcacagagcctacacggtcagagatgcttgtatgcggttttgttgatcgactcctgtatcctgctttggctgtattcctcatgttcacagtctcaatgctag

SEQ ID NO: 114450 - DNA, 2934 bp, Artificial Sequence
  Description of Artificial Sequence: Synthetic coding sequence
atgggctcctttgaagacggactagccgctctggaaatttggcggtccgacgctactatgcgcacacacaccaggggcgccccgtccgtatttttcatttaccttctgtgttttgtatccgcgtatataactgacgagaacccagaggtcatgatcccattcacaaatgccaattacgactctcacccaatgctatatttcagcagggcagaggttgccgagctgcaacttagagcagcttcctcacacgaacacattgcggcaagactgactgaagcggtccacactatgctaagctcccccttggaatatctccctccatgggatccaaaggactattctgccaggtggaacgagattttcgggaataatctcggtgcactggcaatgttctgtgtgttgtaccccgaaaacatcgaggcccgggatatggccaaggactatatggagcgaatggccgctcagccgtcctggttggtgaaggatgccccctgggacgaagtccccctagcccactcactagtcgggttcgcaactgcgtacgacttcctatataattatctaagcaagacgcagcaggaaaagttcttggaggtgattgctaatgccagcgggtacatgtacgagacctcctatcggcggggctggggattccaatacttacacaaccatcaaccaacaaactgcatggccttgctgacagggagccttgtcctgatgaatcaagggtacctgcaggaagcatacctgtggactaaacaggttttaaccattatggagaagtctctagtgctgttacgtgaggtgacagatgggtctctttacgaaggtgtggcatatggcagctacactactcgaagtctgttccaatacatgttcctagtacagcgccattttaatatcaatcatttcgggcacccttggttgaagcaacattttgcattcatgtaccgcaccattctccctggatttcagcggacagtggccattgccgattccaactacaattggttctatggcccagaatcacagctggtgttccttgacaagttcgtgatgaggaacggctctggtaactggctggccgaccaaattagacggaaccgtgtcgtagagggacccggaactccaagcaaggggcagagatggtgtaccctgcacaccgagttcctatggtacgacggatctctcaagtctgtccccccccccgactttgggactcccacattgcactactttgaggactggggagtggtaacttacggtagcgctctgccagctgaaatcaatcggagtttcctgtcgttcaagtctggcaagctgggcggcagagcaatctacgacattgttcatagaaataaatacaaagactggataaagggatggagaaatttcaatgcaggccacgagcatccagaccagaatagttttaccttcgcacctaatggggttcctttcattactgaagcactgtacggtcccaaatacaccttctttaataacgtgctgatgttttccccagccgtatccaagtcttgtttcagtccctgggtagggcaggtgacggaggactgctcaagcaaatggtctaagtataagcacgacctggctgcatcctgtcagggccgggtggttgctgcggaggagaagaacggggtagtgttcattagaggagagggtgtcggtgcatataatccacagctgaacctgaaaaacgtgcagcggaacctcattcttctacacccccagctgctactgctggtcgaccagatccacctgggagaggaaagtccactcgagaccgccgccagcttttttcacaatgtcgacgtgcccttcgaagaaactgtcgtggacggagtgcacggcgccttcatcagacaaagagatggactgtataagatgtactggatggatgatacagggtatagcgaaaaagccacctttgctagcgtcacgtatccaagaggctacccctacaatgggactaattacgtcaacgtgactatgcatcttcgtagtcccattacgcgtgcggcgtacctattcatcgggccgagtatcgacgttcagtcttttaccgttcacggtgactcccagcaactagatgtgtttatagctacctctaagcacgcctacgcaacttacttgtggaccggtgaagcaacggggcagagcgctttcgctcaagtcatcgccgaccgccacaagatcctattcgatcggaattccgctataaagtcaagcatcgtgcctgaggtgaaagattatgctgctattgtcgagcagaatctgcaacattttaagccagtattccagcttctggagaagcagattctaagtcgcgtcaggaatacggcatcatttcgcaagacagccgaaagactattgcgtttttctgacaagaggcagactgaggaagccatcgataggatcttcgccattagtcagcaacagcagcagcaaagcaaatctaaaaagaaccggagggctgggaagcggtacaagttcgtcgatgccgttcccgacatcttcgcccagattgaagtaaacgaaaaaaagatacgacaaaaagcccagatcttggcacaaaaggaattgccgattgacgaagatgaggagatgaaggatcttttggatttcgcggatgttacttatgagaaacacaaaaatggaggcttgattaaaggacgtttcggccaagctagaatggtaactactacccattcccgggccccgtctctcagcgcttcctataccaggctgtttctgatcctgaatatagcaatcttcttcgttatgttggccatgcagttaacgtactttcagcgtgctcagagtctgcacgggcagcgatgcctttatgcagtgctgttgatagattcttgtatcctgctgtggctttatagcagctgctcacagagccaatgctag

SEQ ID NO: 114451 - DNA, 570 bp, Artificial Sequence
  Description of Artificial Sequence: Synthetic coding sequence
atggcagcactcaagggcaggcaggtgtattgggcgacagcgggcaagatctctggatggacttggcctcatgcaccccgcaggccgcacgtcctgttacttaatggaatcggggtaggaggcgctttgggatccattgatgagctactctgtcaggctttgagcaatgggctcaatgtgccagaggggagcctcaccagcacctgcgcccagcagcccgacggccttatccatacagccaagtgggggcacgtccatagtctcagttcccactctccaggagcccccaatgcctgcggtgtgttgccaggaacaacggttgatgatggcgtccaccaggacttgcaaagggtactggcttgtgaacaggtttacgacctggagggcatgctggatgatgctcattcccacgaactcctggcagtcgtggctgcggtacaccatcacggggttagcaaggcccttcacaacggcactctcagcttcgttgaagccttcggtggtatccccccttgcaccgtccggattttccgcagatggttcggctgcctcggcgatctggagatctag

SEQ ID NO: 114452 - DNA, 3669 bp, Artificial Sequence
  Description of Artificial Sequence: Synthetic coding sequence
atgcctaaaggaggagcacccccatggatcatggcactgatgttcaccggccatctattgttcctggctctcttgatgtttgccttttccacttttgaggaatccgtgtctaattattcagaatgggccgttttcaccgatgatatcgaccagttcaagacccagaaagtacaagattttcggccaaaccagaagctgaagaagagcatgctgcacccttcattgtacttcgacgctggagagatccaggccatgagacagaaatcccgggcctcacatttgcacctgtttagagccatacggtcagctgttaccgtgatgctttccaatcctacttattaccttcccccacctaagcatgcagacttcgctgctaaatggaacgagatttacggtaacaatctccctccactcgcactgtattgtcttctttgcccagaggacaaggttgcttttgaatttgtgttggaatacatggaccgaatggtcggttataaggactggctagtggaaaacgctcccggtgatgaggttccaatcggtcactcactcacaggatttgccaccgcattcgatttcctttataatctactggacaatcatcgccgccagaaatatttggagaagatttgggttattacagaggagatgtatgaatacagtaaagttaggtcatggggtaaacagcttctgcataaccatcaggccactaatatgattgccctgttaactggggcacttgtgaccggcgtggataagggctccaaggcaaatatctggaagcaggcagtggtcgacgtgatggagaaaactatgtttttattgaaccacatagtggacggatccctagacgaaggcgttgcttacgggtcatataccgcgaagtccgtcacacagtacgtctttcttgctcagcgccatttcaatatcaacaacctcgataataattggctgaagatgcacttttggttttactacgccacactcctgcccggatttcagcgcaccgtgggtattgccgacagcaattacaattggttctatggccccgaaagccagctggtctttctggataagttcatattaaaaaacggagcaggcaattggctagcacagcaaatccgcaagcataggcctaaagacggtcctatggtcccaagcactgcacagcgatggagcacactgcacactgaatatatttggtacgaccctcagttgacgccccagccgcccgcagactacgggacagccaaaatccatacctttccgaattggggggttgtcacgtatggagcaggactacctaatacccagaccaacacttttgtttccttcaagagcggtaagctcggaggacgagcagtgtacgacatcgtgcattttcagccttactcctggattgacggatggaggtctttcaacccgggtcacgaacatcctgaccagaattcattcactttcgcccctaatggccaggtgttcgtgtctgaggcgctctacggccccaaactgtcccatttgaacaatgtcctggtgttcgcccccagcccttcctcccaatgtaataaaccttgggagggccagctgggcgagtgtgctcagtggctgaagtggacaggagaagaggtgggagacgccgcgggagagattatcacagcgagccagcacggggagatggtgttcgtgagcggggaggccgtcagcgcatattccagtgcaatgcgcctgaaatccgtgtaccgcgcattgctgctgttaaatagtcagacattgctggttgtggatcacatcgagaggcaggaggattcaccgatcaacagcgtctctgcgttttttcacaaccttgatatagatttcaaatacattccctataagtttatgaatcgctacaatggtgccatgatggacgtttgggatgctcattacaagatgttttggtttgatcatcacggtaacagcccaatggcgtccattcaagaggctgaacaggcggccgagttcaagaaacgctggacccagttcgttaatgtgacctttcagatggaacctacaatcacacgaatcgcatatgttttttacggaccatatatcaatgtatcttcatgtcgcttcatcgactcctctaatcctgggctgcagatcagtctgaatgtcaataacaccgaacatgtggtttccatcgtgaccgactaccacaacctgaaaacgcgatttaattatctgggctttggcgggttcgcttcggtggccgaccaggggcagattacccggttcggactgggtacccaggccattgtgaagcctgtcaggcatgacaggatcattttccccttcggcttcaagtttaatatcgcagttgggctgattctatgtatttccctcgtgatcctgaccttccaatggagattctacttgtcatttagaaagctgatgagatggatcttaattctggtgatcgcactctggttcattgaactcctagatgtgtggagtacttgttcccaaccaatctgcgccaaatggacacggacagaagccgaggggagcaaaaagagcctgtccagtgaaggccaccacatggatcttcctgatgtggtcattaccagcctcccagggtcaggagcggagatcctgaagcaactctttttcaattcatcagacttcctttatattagggtaccaacagcctacattgatatccccgagacagagctggaaatcgactcattcgtggatgcatgtgagtggaaggtgagtgatatccggagcggacactttagattgctccgtggctggcttcaatcactggttcaggacaccaagcttcatttacagaatatccacctccacgaaccgaaccggggaaaactcgctcaatattttgccatgaataaagacaaaaaacgcaaattcaagaggagggaatcattgccagaacagcgctctcagatgaagggagcgttcgacagagatgctgagtacatcagagccctgaggcggcacctggtgtattacccttccgcacgcccagtcctcagcctgagcagcgggtcatggacattgaaactgcattttttccaggaggtgctaggggcctccatgagagctttgtacattgttagggacccgcgggcttggatctatagcatgttgtataactccaagccctccctttattccctgaagaacgttcctgaacacctcgctaaactgtttaaaatagaagggggaaagggaaaatgtaatttaaactccggctacgcatttgaatatgagccgttaagaaaagaactgtcgaagagtaaaagtaacgccgtcagcttgctgagtcacctgtggctcgcaaataccgccgccgccctcagaatcaacactgacctattgcccacttcctatcaactagtaaagtttgaagacatcgtgcacttccctcagaagactacagagagaatcttcgccttcctggggatccccctttccccagcctccctcaatcagatcctctttgctaccagcaccaatctgttttatctcccctacgagggggagataagcccgaccaacaccaatgtgtggaagcagaatttgccaagggatgagatcaaactgatcgaaaacatctgttggacattaatggaccgtcttggatacccaaaatttatggactag

SEQ ID NO: 114453 - DNA, 3639 bp, Artificial Sequence
  Description of Artificial Sequence: Synthetic coding sequence
atggcccttatgttcacagggcatctcctgttcctcgctctgctgatgtttgctttctctacctttgaagagagtgtctcaaactatagcgaatgggctgtatttacggacgatatcgaccagtttaagacccaaaaggtgcaggatttccgtccaaaccagaaactgaagaaatcgatgttgcatccgtctctttactttgatgcaggcgagattcaggctatgcgccagaagtccagggcctctcatctgcatctgttccgggcgataagaagtgccgtaaccgtgatgttgagtaacccgacttactacctccctccgcctaaacatgccgatttcgccgctaagtggaacgagatctacggaaacaacttgccccctctcgcgctgtactgcctattgtgtcccgaggacaaagtggccttcgagtttgtgttggaatacatggacaggatggtcggctataaagattggctggtggaaaacgcgcccggggacgaagtgccaatcggccactctctaacagggttcgctaccgctttcgatttcctatacaacctactggataatcaccggagacagaagtatttggagaagatatgggtgatcaccgaagagatgtatgaatattccaaagtgaggagttgggggaagcagctgctgcataatcaccaggccacaaacatgattgctctattgaccggtgctctagtcacaggtgtagataagggcagcaaggccaacatatggaagcaggcagtggtcgatgtgatggaaaaaactatgtttctgctgaaccacatagtcgacgggagcctggacgaaggagttgcctacggatcttacaccgccaaaagcgtgacacaatacgtctttctggcccagaggcactttaatatcaacaaccttgacaacaattggcttaagatgcatttctggttctattatgctactctcctccctggattccagcgaacagtggggattgccgattctaactacaactggttctacggtcctgaatctcagcttgtgtttctggacaagttcatactcaaaaatggggctggcaattggctagcgcagcagatcagaaagcatagacctaaagacgggcctatggtgcctagcactgctcagaggtggtccacactccacacagagtatatatggtacgaccctcagctgaccccacagccccccgccgattatggaaccgccaaaattcacacgtttccaaattggggagtggtaacttacggcgcagggttaccaaacacacaaaccaatacattcgtgtccttcaaatcgggcaaactgggaggccgagcagtttatgacatcgtgcattttcaaccttactcttggattgatgggtggcgctcctttaaccctggccatgaacaccctgatcagaatagtttcactttcgcaccgaatggtcaagtctttgtgtcagaagccctctacggccccaaattaagtcatctgaataacgtactagtgttcgccccgtctccttctagccaatgtaataaaccttgggaaggccaactcggtgaatgtgcccagtggctgaaatggactggcgaggaagtgggggatgcagccggtgagatcattacagctagtcaacatggtgagatggtgttcgtctctggtgaggccgtcagcgcctattcatctgctatgcggctgaagtcggtctacagggccctcctgcttctaaattcgcaaaccttgttggtcgtggatcatatcgaaagacaggaagattctccaataaatagtgtgtctgcgttctttcataacctagatattgacttcaaatacatcccctataagttcatgaacaggtataacggagcaatgatggatgtgtgggatgctcattacaagatgttctggttcgaccaccatgggaattcccccatggcctctattcaggaggcggaacaagcagccgagttcaaaaagcggtggactcagtttgtgaatgtgacttttcagatggagcccactattacccgaatagcctatgtgttctacggaccttacattaacgtgagcagctgtcggttcatcgactccagcaatcctggactgcaaatttctctcaatgtaaataacacagaacacgtcgtttcaatcgtgacggactaccacaacctaaagactcggtttaattaccttggttttggggggtttgctagtgtggcagatcagggccaaattacacggttcggcctggggacgcaggcgatcgtcaagcccgtgaggcatgatcggataattttcccattcgggttcaagttcaatatagcggtgggtctgatcctttgtatctctctggtgattctgaccttccagtggcggttttacctgtcctttaggaagctcatgcgttggatcttaatcctcgtcatcgcactgtggttcatcgaactgctggatgtctggtccacgtgttcacaacctatctgcgcgaagtggactcggaccgaagctgagggcagcaagaaaagcctgagttctgagggacaccatatggacctccccgatgtcgtaataacctccttaccgggttctggcgccgagattttgaagcagctgttcttcaattccagcgatttcctgtacatcagggttccgaccgcatatatagatataccagaaacagagctggagatcgacagctttgtagatgcttgcgagtggaaggttagcgacattcggtcaggacacttccgtttgctacgagggtggctgcagtcgctagtgcaggacacgaagttgcacctgcaaaacattcacttgcacgagcccaatagaggtaagctggcacaatacttcgccatgaacaaagacaaaaagcgcaagtttaaacgtagggagtcactgccggagcagcgatcacagatgaagggcgcctttgatcgtgatgctgaatatatccgcgccctgcggcggcatttagtgtattacccatctgctcgcccagtgttgtcccttagtagcgggtcctggacactgaagctacattttttccaagaggtactgggcgccagcatgcgagctctgtacatcgtgcgcgaccctagagcttggatttattctatgctgtataattccaagcctagtctttactccttgaagaacgtgccagagcacttggcaaagctgtttaagattgaaggagggaaggggaagtgcaacctgaactcgggatacgcctttgagtacgaaccgctgagaaaagagctctctaagagcaaatcaaacgcggtttccctcctgagccatctgtggctggcaaacacggcggccgccctgcgtattaatacagatctcctgcccaccagctatcagctagtgaagtttgaagacattgtgcatttcccccaaaagacgactgaaagaattttcgcattcctgggcattcctctgagtcccgcaagcttgaaccaaatcctgttcgctacatcaacaaatctcttctatctaccctacgaaggggaaatctcacccactaataccaatgtgtggaaacagaacctcccaagggacgagattaaactcattgagaacatttgctggaccctgatggatcgcttaggatatccgaagttcatggactag

SEQ ID NO: 114454 - DNA, 606 bp, Artificial Sequence
  Description of Artificial Sequence: Synthetic coding sequence
atggacctaagtctgctgtgggtgctgctgccgctcgtgacaatggcctggggccagtacggagattacggatacccatatcagcagtaccacgattactccgacgacgggtgggtgaatctgaatagacagggcttctcttatcaatgtcctcaaggccaagtgatagttgccgttcggtcaattttcagcaagaaggaggggtctgaccgccaatggaattacgcctgcatgcctacaccacagagcctgggcgagcccactgagtgctggtgggaggagattaaccgagcaggaatggaatggtaccagacctgttcgaacaacggcctggtggctggctttcagtctcgttactttgaatcagtgcttgaccgcgaatggcagttctattgctgtcgttacagcaagcggtgcccctattcctgttggctgacaaccgaataccccggccactatggagaggagatggacatgatcagctataattatgactactacatcaggggagctacgactacattttccgcagttgagagagatcgtcagtggaagtttatcatgtgccgcatgacagaatacgattgcgagtttgcaaacgtttag

SEQ ID NO: 114455 - DNA, 333 bp, Artificial Sequence
  Description of Artificial Sequence: Synthetic coding sequence
atgcggtttatgacactgctgtttttaactgccctagcaggagctctcgtttgtgcatatgatccagaagctgcaagtgctcctgggtccggcaacccttgtcacgaagcttcagccgcacagaaggaaaacgctggcgaggatcctggcctggctcgccaagccccaaagcctagaaagcagcgttcctcactgctggagaagggccttgatggggcgaaaaaagccgttgggggactcggaaaactgggcaaagacgccgtggaggacctggaatccgtcgggaagggtgcagtccacgacgttaaggacgtgctggattccgtactttag

SEQ ID NO: 114456 - DNA, 1191 bp, Artificial Sequence
  Description of Artificial Sequence: Synthetic coding sequence
atggctctccttacaaatctgctgcccttgtgttgtctagcgctactggcactacccgctcagagctgcgggcctgggcgcggtcccgtcggtcggaggaggtacgccagaaaacaacttgttcccctcctgtataagcagttcgtgcccggcgtgcccgagagaaccctaggagcaagcggaccagctgagggccgggtggcccgtggttcagaacggtttagggatctggttccaaattataatccagacattatctttaaggatgaggaaaactctggggcagatcgcttgatgacagagaggtgtaaagagagggttaatgccctggctatcgccgtgatgaacatgtggcctggcgttcgcctgcgcgtaacagaagggtgggacgaggatggacatcacgcacaggattctcttcattacgaggggagagctttggacattactacaagtgacagagatcgtaataagtacggcctgcttgcacggttggccgttgaggctggctttgactgggtctactacgaatcacgtaaccatgtgcatgtaagtgtcaaagccgacaacagcctggccgtgcgtgctggaggatgttttccagggaatgccaccgtgcgcctgtggagcggcgagcgtaaaggactgcgcgagctgcataggggggactgggtgcttgccgctgacgcttcaggccgcgttgttccgacacctgtgttgctgtttctcgatagggacctacagagacgggcctcctttgttgccgtggagacagagtggccgccgagaaagttgcttctgactccatggcacctggtcttcgccgctcggggccctgcccccgcaccgggcgacttcgcccccgtattcgccagacggctaagggcgggtgactccgtgctggcccccgggggcgacgcgctgaggcctgcacgggtggcacgggtcgcaagggaagaagccgtgggggtctttgccccactgacagctcatggtactctgctcgtcaatgacgtgctcgccagctgttatgccgtgttagagtcccaccagtgggctcacagagcatttgctccacttcgtctcctgcacgcgctcggggctcttctgccaggaggagctgtgcagcctacggggatgcactggtattccagactgttgtacaggctggcggaggagctgctcggctag

SEQ ID NO: 114457 - DNA, 1413 bp, Artificial Sequence
  Description of Artificial Sequence: Synthetic coding sequence
atgagccaggcttacagttcctctcagagagtttcgagttacaggagaactttcggcggggctcccgggttccctttaggctccccgctcagtagtccagtttttccacgagctgggtttggctcaaaagggtcttcttcctctgttacaagtcgggtgtaccaggtctcccggaccagcgggggagctggaggccttgggtctctgcgcgcctcacggttaggtactactcgcacaccgtcctcctacggcgccggagagctcctggattttagtttggccgacgccgtcaatcaagaattcctgaccacacgtactaatgaaaaggtcgaacttcaagaactgaacgacagattcgcaaattacattgaaaaggtgcggttcctggagcagcagaacgcagctcttgctgccgaagtgaatagactgaaaggcagggaaccaacccgggtggcagagctgtacgaggaagagctgcgcgagctgcgtcgtcaggtggaggtgcttaccaatcagagggctcgagtggatgttgaaagggataacctgttggacgacctgcagcggctaaaagctaagcttcaggaagagattcagctcaaggaggaagccgagaataatttggccgcctttagggccgacgtcgatgcagccacattggcccggattgacctcgagcgtcgcattgagtcactaaacgaggaaatcgccttcttgaagaaggtgcacgaggaagagattcgggaactgcaggcacagctccaagaacagcaagttcaagtagaaatggacatgtccaagcccgacctcaccgcagccctcagggacatccgggctcagtacgaaactatcgctgccaagaatattagtgaggccgaggagtggtataaatccaaggtgtcagatttgactcaagccgcgaataagaacaatgacgccctgaggcaggcgaaacaggagatgatggagtaccggcaccagatccagagctatacgtgtgaaatcgacgctctcaagggcaccaatgatagtttgatgaggcagatgagagagctggaggataggtttgcctctgaggcaagcggctatcaggataacatcgcacgcctggaagaagagataaggcatctaaaggacgaaatggcacggcacctgagagagtatcaagacttattgaatgtgaagatggccctcgatgttgagattgccacatatcggaaactgctcgagggggaagagtcacgcatcaatttaccaatacagacctactccgcactgaacttcagagagacctcgccagaacaacgcggcagtgaggttcataccaaaaagaccgtgatgatcaagacaattgaaaccagagatggggaggtcgtctctgaagccacccagcagcaacacgaggtgctgtag

SEQ ID NO: 114458 - DNA, 2523 bp, Artificial Sequence
  Description of Artificial Sequence: Synthetic coding sequence
atggctctggctagcgcagcccccgggtctattttctgcaagcaattactctttagcctccttgtgctgaccctcctgtgcgacgcctgccagaaggtatacctacgggtgccaagtcatctgcaggccgagaccctcgttggtaaggtgaacctcgaagaatgtttgaagtcagctagcctgattaggtcctccgaccccgccttccgtatcctggaagatggctctatctacactacgcacgatttgattctgagcagtgagagaaagtccttctcgatctttctctctgatggccagagacgcgaacaacaagagatcaaagtagtgctgagcgcccgagagaacaagagtcctaaaaagcgccacaccaaagatactgccttaaaacgctcaaagaggcgttgggccccgatacctgcctccctgatggagaacagcctgggaccattcccacagcatgtgcagcagattcagagtgatgctgcccaaaattataccattttctattccatctctggtcctggcgtcgataaagagccgttcaatctgttctacattgagaaggacacaggagatatattttgcacacggtccatagatcgcgagaaatatgagcaattcgcgctttacggatatgccaccaccgctgacggctacgccccggaatacccactgcccctgattattaaaattgaagacgacaacgacaatgccccttattttgaacatcgtgtgacgatctttactgttcccgagaactgccgctcagggacttcggtggggaaggtgacggctacagacctcgatgaaccggacactctccataccagactgaaatataagatattgcaacagatccctgatcacccgaagcacttctctattcacccagacacaggagtgatcacaaccacaaccccctttctagaccgtgaaaagtgtgacacgtaccaactcattatggaggtgcgggacatgggaggccaaccctttggtctcttcaacacaggcacgatcactatctccttggaggatgaaaacgacaacccaccctcctttacagagacttcctatgtaacggaggtggaagagaaccggatcgatgtggagatcttgcggatgaaggtgcaggaccaggatctgcctaacacgccgcatagcaaagcagtttataaaatcctacagggaaacgaaaacggaaacttcataatctccacagatccgaacactaacgagggcgtcctctgtgtggtgaagccgttaaactatgaagtaaaccgtcaggtcatactccaggtgggcgtgatcaatgaggcgcagttctcaaaagccgcatcctctcagaccccgacaatgtgcactacaactgtgacagtgaaaatcatcgatagtgacgaggggccagagtgtcaccctcccgtgaaggtgatacaatcacaggatgggtttcccgccggacaggagctgctgggatacaaggcactggaccccgagattagctccggagagggattacgctatcaaaagcttggggatgaggataactggttcgaaattaatcaacacaccggagatttaagaacactcaaggtccttgaccgagagtcgaagttcgtaaagaacaatcagtataacatttcagtggtagccgtagacgccgtgggcagaagttgcaccgggactctcgtcgtccatctggacgattacaacgatcatgctccacagatcgataaagaagtgacgatctgtcaaaataacgaagacttcgccgtcctaaagccggtcgatcctgatggcccagagaatggccccccgtttcagttctttctcgacaatagtgcatctaagaattggaacatcgaggagaaggatgggaagaccgccatattaagacagagacagaatctcgactataactattatagtgttccaattcagataaaggatagacacgggctggtggcaactcacatgttgacagtcagagtgtgtgactgctctacgccctccgaatgcaggatgaaggataaatccactagagacgtgcgcccaaatgttatattggggcggtgggccattctcgctatggtattaggaagcgtactgttgctgtgtattctcttcacctgcttttgcgtcactgccaaaagaaccgtgaaaaaatgttttcccgaggacatcgctcagcagaatctcattgtgagcaatacggagggacctggggaggaggttactgaggccaacatccggctccccatgcagacttccaatatctgcgatacttctatgagcgtgggcaccgtgggaggccaggggataaagacccagcagtcttttgagatggtgaaaggaggctatactctggattcaaacaaaggcggcggtcaccagacccttgagagcgtgaagggcgtgggccaaggggataccggacgatatgcctatacggattggcaatctttcacacagcctagactgggcgaggaatcaatccgtggccacacactgattaagaactag

SEQ ID NO: 114459 - DNA, 2685 bp, Artificial Sequence
  Description of Artificial Sequence: Synthetic coding sequence
atggcactggcatctgctgcccccggtagcattttttgcaagcagctgctattctccctcttagtcctgactctgctctgtgatgcctgtcagaaggtgtatcttagggtgccaagtcaccttcaggctgagactttagtgggcaaggtgaacctcgaggagtgcctaaagtccgcctctctcatccgctctagcgaccctgctttccggatacttgaagatgggtccatatataccacacacgaccttattctgtcaagcgaaagaaagagcttttcaattttcttatctgacggtcagcgccgcgaacagcaggagataaaggtcgttttatctgcgcgagaaaacaaatctcctaagaagcggcacacaaaagacacagcactaaaacgtagcaagcggaggtgggcccctattccagcttctttgatggagaattcactgggcccattcccccagcacgtccagcaaattcaaagcgacgccgcccaaaattataccatcttctatagcatctcaggaccgggcgttgataaggagccatttaacctcttctatattgaaaaggatacgggagacatcttctgcacaagaagcatcgatcgggagaagtacgaacagttcgccctgtacggctacgctacaactgctgatggatacgcccctgaataccctctaccccttataattaaaattgaagatgataacgacaatgccccttatttcgaacatagagtcacaatctttaccgtcccagagaactgtcgctctggcacttcagtggggaaggtgaccgctacagatctcgatgaacctgacaccctgcatacgaggctgaagtacaagattttacaacaaatccctgatcacccgaagcacttcagcattcatcccgacaccggcgtgattaccacaactacaccattcctggacagagagaaatgtgacacctaccagcttataatggaagtgcgggatatgggcggccagccattcggcttgttcaacaccgggacaataactataagcttagaggatgagaacgacaatccaccttcttttaccgaaacttcctacgtaacagaggtcgaggagaaccggatcgacgttgaaatcctcagaatgaaggtgcaggaccaagacttgccaaacaccccacacagtaaggctgtgtataagatcctccaaggaaacgaaaacgggaatttcattatctccacagaccctaacaccaatgaaggtgtgctgtgcgtggtgaaacctttgaactacgaagtgaaccgacaggttatcctacaagttggcgtgatcaatgaggcacagttttctaaagctgcctcttctcagaccccaacaatgtgtaccactaccgtgacagtcaaaattatcgactcggacgagggcccggagtgtcacccaccagtgaaggttatccagtctcaggatgggtttccagccggacaggagctcctggggtataaggccctggaccccgagattagctccggtgaggggttacggtaccagaagctaggagacgaggacaactggtttgaaatcaatcagcacacaggcgacctgcgaaccctcaaggtgctggacagagaaagcaaattcgtgaagaataatcaatataatataagcgttgtcgccgtcgatgcggtcgggagaagctgcaccggcacactggtggtccaccttgacgactacaacgatcacgcacctcagatagacaaggaggtaactatttgccagaacaatgaggactttgccgtattaaagcccgttgatccagacggaccagaaaacggcccacctttccagttttttctggataattccgcctcaaaaaactggaacatcgaggagaaggacgggaagacagccatattgcggcaacgtcagaacttggactacaattactattccgtgcccattcaaattaaagacaggcatgggcttgtcgccacacatatgctgaccgttcgtgtctgtgactgctctacaccatcagaatgccggatgaaggataagtccactagagatgtgcggcctaacgtgattctgggaaggtgggctatattagcaatggtcttaggatcagtgctgctgctgtgtattttgttcacctgtttctgcgtgaccgctaagcgcaccgtcaaaaaatgcttcccagaagacatcgcccagcaaaatcttattgtgtccaataccgaggggcctggcgaagaagtgactgaggctaacattcggttaccaatgcaaacttctaacatctgcgacactagcatgtcagtgggaaccgttgggggtcaggggattaagacccagcagagtttcgagatggtcaagggaggttacaccctggattccaacaaaggcggggggcaccagacgctggagagcgtgaagggagtcgggcagggcgacacagggcggtatgcctacactgactggcaaagtttcacccagccacgtctgggggagaaggtctacctctgcgggcaggatgaagaacataaacactgcgaggactatgtgtgttcatacaactacgaggggaaaggctcattagcaggctccgtgggctgctgttctgaccgtcaggaggaggaaggtctggagttcttagaccacctagaaccaaagtttagaacacttgctaaaacgtgtatcaagaaatag

SEQ ID NO: 114460 - DNA, 2691 bp, Artificial Sequence
  Description of Artificial Sequence: Synthetic coding sequence
atggcagcagccgggcccaggaggtccgtgagaggtgctgtgtgtctgcacctgctgctcaccctggtcatattttcccgtgcaggggaggcatgtaaaaaagtgatattgaatgtaccctctaagctcgaagccgataagataatcgggagagttaatttagaggaatgttttagaagcgccgatttgattcggagctccgacccagatttcagggtgctgaatgatggtagcgtctacactgctcgcgcagtggctctctccgataagaaacgcagtttcacgatctggctgagtgacaagcggaaacagactcagaaggaggttaccgtccttctggagcaccagaaaaaagtttcaaagacccgacacacacgggaaacagtgctgaggagagctaaacggagatgggctcctattccttgcagtatgcaggaaaattctctcggacctttccccctctttttgcagcaggtggaatccgacgctgcacagaactacaccgtattctacagcatctcaggcagaggcgtcgacaaggaacccctcaatctgttctacatagaaagggacaccgggaatctcttttgcactaggcccgtcgatcgggaggagtacgacgtgttcgatctaatcgcttatgctagcaccgctgacggttatagcgccgacctgccattgccccttcccattcgagtggaggatgagaatgacaaccacccagtgttcacagaagcaatctacaactttgaagtattggagtcctctaggcctggcaccactgtcggcgtggtctgcgctactgatagggacgagccggacactatgcacactaggttaaagtattcgatcctgcagcagacaccaaggtcaccagggttgtttagtgtgcacccttctactggagtgattacaacggtgtctcattacttagacagagaggtggtggataagtatagtctcataatgaaagtacaagacatggatggacagtttttcgggctcatcggaacaagcacgtgcatcatcactgtgactgatagcaacgataatgcaccaacattccgccagaatgcatacgaagcctttgtagaagaaaacgccttcaatgtcgagattctgcggatccccatcgaagacaaagacctgatcaacactgcaaactggcgcgtgaacttcactattctgaagggcaatgagaacggtcacttcaagattagcactgacaaggagactaacgagggcgtcctgtcagttgtgaaacctctcaactacgaggagaaccgtcaggtgaatctggagattggggtgaataacgaggctccattcgcccgagacattcccagggtgacagcactgaatcgggctttagttactgtgcacgtgcgcgatctagatgaaggtcctgaatgcaccccagcagcacagtacgtgaggattaaagaaaacctggccgttgggagtaagattaacggttacaaagcatatgatcccgaaaaccggaatggcaacggcctcaggtacaaaaaattacatgaccccaaaggatggataacgattgacgagatttccggatcaatcatcacgtccaagatactcgacagagaggtcgagaccccaaagaatgaactctataatataaccgtgctcgccatagataaggatgacagatcctgcaccgggacccttgctgtcaacatcgaagacgtcaacgacaacccaccagagattctgcaggagtatgtcgtaatctgtaaaccaaaaatggggtacactgatatattagccgtggacccagatgagcccgtccacggggcaccattctattttagcctgccgaataccagccctgaaatttcgcgcttgtggagcctaacgaaggtgaatgacacagcagctcggctgagctatcagaaaaacgctggattccaagagtatacaattcctataactgtcaaggatcgcgcaggacaagccgctactaaattactccgcgttaacctgtgcgagtgcacccaccccacccagtgtcgggctactagccggagtacaggggtgatcctgggcaaatgggccatccttgccatactgctgggcatagcactcctcttttcagtactcctgactctggtatgtggcgtgttcggcgccaccaagggaaaaagattccccgaagatttggcacaacagaatctcataatatcaaacacagaggccccaggcgatgatcgggtgtgcagtgcaaacgggttcatgactcagactactaacaactcttcacaggggttctgcggcacaatggggagtggcatgaagaacggtgggcaagagacaattgagatgatgaagggaggaaatcaaactctcgagtcttgtcggggcgcagggcaccaccataccctggacagctgccgtggcggccatacagaggtggacaattgcaggtatacttattccgagtggcactcatttactcagccccgtttaggagagaagctgcatagatgtaatcaaaatgaggataggatgccctcacaggattacgttctgacgtacaactacgaggggaggggctcccccgcggggagcgtgggctgttgctccgaaaaacaggaagaggacggcctggatttcctcaacaatctggagcctaagttcatcacacttgccgaggcatgtaccaaacgctag

SEQ ID NO: 114461 - DNA, 2520 bp, Artificial Sequence
  Description of Artificial Sequence: Synthetic coding sequence
atggcggctgcaggccctcgtcgttctgtgcgcggtgcagtgtgcctgcacttacttctgacactggttatctttagtcgagccggcgaggcttgtaaaaaggtaattcttaacgttccatccaagttggaagccgacaaaatcattggccgagtgaacctggaagagtgctttagaagcgctgacctgattcggtcatcagatccagacttccgggttctgaatgacggctccgtgtacaccgcccgtgccgttgctctctctgacaagaagcggagtttcaccatttggttgtcagacaaacgtaagcaaacacagaaggaggtgactgtgcttcttgaacaccaaaagaaggtttcaaagactaggcacacccgagagacggttttgagaagagccaaaagacggtgggcccccatcccgtgtagcatgcaggaaaatagtctgggcccattcccccttttcctccagcaggtggagtcagacgcagcacaaaactacacggtgttttactccatctcgggcagaggagtcgataaagagccactcaatctcttctatatcgagcgggacacagggaacctcttctgcacacgccctgtggacagagaggagtatgatgtttttgacttaatcgcgtacgccagcaccgccgatggttacagtgccgacctgcctcttccgctgcccatacgtgtggaggatgaaaatgacaatcaccccgtgtttaccgaggccatatacaatttcgaagtgttggagagctctaggcctggcactaccgtcggagtcgtgtgcgcgacagaccgcgatgaaccagatacgatgcacacaagactaaagtactctattcttcagcaaactccaagatccccaggactgttcagtgtgcatcctagcacaggagttattacaacagttagccactacctagaccgtgaagtggtggacaaatattcactgattatgaaagtccaggacatggatggtcaattcttcgggctgatcgggacatctacgtgtatcattacagtgacggactcaaatgataatgccccaacattccggcaaaacgcgtacgaggcattcgtcgaggagaacgcctttaacgtggaaatacttcgaattccaattgaagacaaggatctgatcaacaccgccaactggcgcgttaacttcaccattctgaaggggaatgaaaacggccatttcaaaatcagtaccgacaaggagactaacgagggggttctgtccgtagtgaagccacttaattatgaagagaatcgacaggtgaacctggaaatcggagttaataatgaggcccctttcgccagagacattccaagggtgaccgctctcaatagggcattggttacagtccacgtgcgggatctggatgaggggccagaatgcacacctgcagcccagtatgtgagaatcaaggagaaccttgctgtggggtccaagattaacggctacaaagcatacgatccggaaaaccgaaacggaaacggcctgaggtacaagaagctccacgaccccaaaggctggatcactatcgacgagatatcaggatccataatcacaagcaagatattagaccgcgaggtggagacccctaaaaatgaattatataatatcacggtgttagctattgacaaggacgataggtcatgcacaggcaccctggcagtcaacatcgaagatgtaaacgacaatccacctgagattctacaagagtatgtcgtcatctgtaaaccaaaaatgggctatactgacatactggccgtcgaccccgacgaacctgtacacggggctcccttctacttctcactccccaatactagccctgaaatatctaggctgtggtctctcacaaaggtgaacgacaccgccgctcgtctgagctatcaaaagaacgccggtttccaggagtacactatccccattactgtgaaggaccgcgcgggacaggctgctaccaagctgctgcgcgtaaatttgtgtgagtgcacccacccaactcagtgtcgggccacaagcagatcgacgggcgtcatattgggaaaatgggcaatccttgcaatcttgctgggtattgccctattattctctgtgctcttgacactcgtatgcggtgtcttcggcgctaccaagggcaagaggttcccagaagacctagcacaacagaacctgatcatatcaaacaccgaggctccgggcgatgacagggtttgctccgcgaatgggttcatgacccaaaccaccaacaatagcagccagggcttctgtggaactatgggctctgggatgaaaaacggtggtcaagagacgatcgagatgatgaaaggtggaaaccagaccttggagagttgtaggggggcagggcatcatcacaccttggactcgtgccgcggggggcacactgaggtggataattgcagatacacttactcagagtggcactcctttacacagcctcggctgggggaggaaagtattcggggccacaccggatag

SEQ ID NO: 114462 - DNA, 3150 bp, Artificial Sequence
  Description of Artificial Sequence: Synthetic coding sequence
atggactggtccttctttcgggtcgtggccatgctgtttattttcttggtggtggtggaggtgaatagtgagttccgcatccaggttcgcgactataataccaagaatggcacaatcaagtggcattccatacggagacagaagagggagtggattaagtttgcagcggcatgcagggaaggcgaagataacagcaagcgcaaccccattgcaaaaattcactccgactgtgctgcaaatcagcaagtcacgtaccggatctctggcgtgggcatcgatcagccaccatatggaatattcgtaattaaccagaagaccggggagatcaacataacgtctattgtagaccgagaggtgacccccttcttcatcatttactgtcgggccctcaattctatgggccaggacctggagcgccccttagagctgcgtgttcgagttctcgacatcaatgacaatccccccgtgttttcaatggccacgtttgcaggacagatcgaagagaattctaatgctaatacacttgtcatgatcctgaatgccaccgatgctgacgagcctaacaatctgaattcaaagattgccttcaaaatcattcggcaggagccctccgactcacctatgttcattattaatcgaaacaccggagagatcaggacaatgaacaattttctggaccgggaacagtatgggcagtacgccctggcagtgcggggaagtgatcgggacggcggcgcagacggcatgtctgcagagtgtgagtgtaacattaaaatcctggatgtcaacgataacattccttatatggaacaatccagctataccatcgagatacaggagaacaccttgaactctaatctgctggagatccgcgtcatcgatctggacgaggaattctccgctaattggatggctgtgatttttttcatctccggcaacgagggaaactggtttgaaattgagatgaacgagcgcactaacgtgggcatattaaaagtcgtaaaaccacttgattatgaagctatgcagtcccttcagcttagcatcggggttcgaaacaaggctgaatttcatcacagcattatgagccagtataagctcaaagctagtgcaataagtgtaaccgtgctgaatgttatcgagggacctgtttttaggcctgggtcaaaaacatatgtagttaccggcaacatggggtccaacgataaagtgggggactttgtagccacagacctcgatacaggacggccaagcaccaccgttagatatgtgatggggaataatccggcggacctcctggccgtcgattctcgaacggggaagcttacactcaagaacaaagtgactaaggagcagtacaacatgctgggcggaaagtaccaaggcactattctaagcatcgacgacaaccttcaacggacctgcaccggaaccatcaacatcaacattcaatcttttggcaatgacgaccgcactaatacagagcctaataccaaaatcaccaccaatactggtcgacaggagtccacttcctccaccaactacgatacaagcacaaccagtacagatagtagccaagtctactctagtgagccaggcaatggtgcaaaggacctcttgagtgacaacgttcacttcggccccgctggaatcggcttgttgatcatgggctttctcgtccttggactggtcccatttctcatgatctgctgtgactgcggcggggccccacgaagcgccgcgggattcgaacccgttcctgagtgcagcgacggcgcaattcattcttgggcagtggaggggccacagcccgaaccaagagacattactactgtcattccacagatcccccctgacaacgccaacatcatcgaatgtatagacaactcgggtgtgtacaccaatgagtatggggggcgagagatgcaggacctcggtggaggagagcgaatgacgggttttgaactgacagagggtgtcaaaacaagtggaatgcccgaaatctgccaggagtactcggggactcttaggcggaatagcatgcgagagtgcagagagggtgggctcaacatgaacttcatggagtcatacttttgtcagaaagcatatgcatacgccgacgaggacgagggccggccttctaatgattgtctgctcatctatgatatagaaggggtgggcagcccagccggcagtgtgggatgctgtagcttcataggggaggacctcgatgactctttcctcgacacgctgggcccaaagttcaagaagttggctgatatttccctgggtaaggagtcctacccagatttggatcccagctggccgccccagtctacagagcctgtttgcctccctcaggagacagagcccgtggtctcaggtcatcctccgatttcaccacacttcggaacaaccactgtaatctcagagtcaacctacccttctggaccaggagttctgcatcctaaacccatactcgacccccttgggtacggtaatgtaacagttaccgagagctataccacctcggacacactgaaaccttcagtccacgtacacgacaacagaccagcgagcaatgtggttgtgactgaaagagtggtgggaccaatctcaggggctgacttgcacgggatgctggagatgcccgatttgagagatggctctaatgtgattgtcactgaaagagtcatcgctccctcctctagtcttcccacatcgctgaccatccatcacccccgtgagtcttccaacgtggtggtgaccgaacgagtgattcagcccacgtctgggatgatcggatctctcagtatgcatccagagctggcgaacgctcataatgtaatcgtaacggaacgagtggtttcaggcgccggagtaacaggaatcagtggtacgacgggaatcagcgggggcatcgggtcttctgggctcgttggcacaagcatgggtgctggaagtggagcccttagtggagcaggaatatctggaggcggaatcggcctgagctcactgggtgggaccgcatccatagggcacatgaggtcatcaagcgaccaccacttcaatcagacgatcggaagtgcctcaccaagtacagccagaagccgcataacaaagtacagcactgttcagtacagcaagtag

SEQ ID NO: 114463 - DNA, 3357 bp, Artificial Sequence
  Description of Artificial Sequence: Synthetic coding sequence
atggcgaggagccctgggagggcctatgcactcttactactgttgatatgttttaatgtggggtccgggctccatttacaggtcctgtccacgcgcaatgaaaacaaactcctcccaaagcaccctcacctagtgcgccaaaagcgggcttggatcaccgcccccgtcgctctccgggagggagaagatttgtccaaaaaaaaccctatcgccaaaatacacagcgaccttgcagaagaacgaggattgaagattacctataagtataccggcaaggggattaccgagcctcctttcgggattttcgtgttcaacaaagacactggtgagctgaatgttacctctatattggaccgggaggaaacacctttttttctgcttacaggctacgcactggatgcacggggcaacaacgttgagaagcctttggagctccggataaaagtgctcgatatcaatgacaatgaaccagtctttacccaggatgtgttcgtggggagcgtggaagaactgtctgctgcacataccctcgtgatgaagatcaatgccacagacgcagatgaacccaataccttgaattctaagatttcctaccgaatcgtctcgctggagcccgcttacccaccagtgttctatctgaataaggacaccggcgaaatatacactacatccgtgaccctggatcgcgaggagcatagttcttacacgcttaccgtggaggccagggatgggaacggggaggtgaccgataaacctgtgaagcaggctcaggtgcagatcagaatattggacgtgaatgacaacatacctgtagtggaaaacaaagtgctggagggtatggtcgaggaaaatcaggtgaatgtcgaggtgaccagaatcaaggtcttcgacgccgatgagatcggcagcgataattggttagcaaactttactttcgctagcgggaacgaggggggttattttcacatcgaaactgacgcacagaccaatgagggtattgtcacgttaataaaggaggtagactacgaagaaatgaaaaatctggatttttcggtaatcgtggccaacaaagcagctttccataaaagcatccggagtaaatataagcccactcccattccgatcaaggttaaggtcaagaatgtgaaggaagggatccatttcaaatctagcgtgatcagtatatacgtgtctgagagcatggacaggagttctaagggacagatcatcgggaactttcaggccttcgatgaagacaccggcctacccgcccatgcccgatacgtgaagttggaggatagggacaattggatctccgtggactccgttacatcggaaattaagctcgctaaattgcctgactttgagtctagatacgtccagaacgggacatacactgttaagatcgtagcgatttccgaggactacccaaggaaaacaattactggaactgtcctaatcaatgtggaggacatcaatgacaactgtccaacgctgatcgagcctgttcagacgatttgccatgacgctgaatacgtgaatgttacagcagaagacttggacgggcatccgaactcggggcccttttcttttagcgtgattgacaagcctccgggaatggccgagaaatggaaaatagccagacaagaatccacctctgttctcctccagcagagtgaaaaaaagctcggcagatctgaaattcaatttctgatctccgacaatcaaggattcagttgcccagaaaaacaagtgctgaccttgaccgtgtgtgaatgcctccatggttccggatgccgagaggcgcaacatgactcctacgtgggcctgggtcccgcagcaatcgcgctcatgatcttggcatttctacttctgctgctggttccgctgttgcttttgatgtgtcattgcgggaagggagctaaagggtttacaccaatccccggaacgatagaaatgctccacccctggaacaacgagggggctccgcctgaagacaaggtggtaccctcatttctgcctgtcgatcaaggaggcagcttggtgggacggaatggggtgggaggaatggccaaggaggcaaccatgaaaggtagtagctccgcatctatcgtgaagggccaacacgagatgtcagaaatggatggtagatgggaggaacatcgttcactcctcagcggaagagctactcagtttacaggagccacgggggctattatgactacagaaactaccaaaaccgcccgcgcaacgggagcctccagggatatggcgggcgcccaagctgccgccgtggccctgaacgaggagtttcttcggaattattttactgacaaggctgcttcctataccgaagaggacgaaaaccacacagctaaggattgcctgctggtgtattcccaggaggaaactgagtctcttaatgcctccattggctgctgttcatttattgaaggggagctggatgacaggtttctggacgacctgggtcttaagttcaaaacactggcagaagtatgcctgggacagaagattgatattaataaggagattgagcaaaggcagaaacctgctaccgagaccagcatgaacaccgctagtcacagcttgtgcgagcaaacaatggttaactctgagaatacttacagtagtgggtcctcatttcccgtcccaaagtctttgcaagaagcaaacgccgaaaaagtcactcaagagatcgtcaccgagcgcagcgtgagttcccgccaagcacagaaggtggcaaccccgctcccagaccccatggcaagtagaaatgttatcgctaccgaaacatcctacgtaacagggagcaccatgccacccactaccgtgatactgggtccgtcccaaccccaatctctgatagtgacagaacgagtctacgctcccgcttctactctggtggatcaaccctatgccaacgaaggcaccgtggttgtcacggagcgggtgatccaaccgcacgggggaggaagtaaccctttagaaggcactcaacacctgcaggatgtgccatatgtcatggtccgggagagggaaagctttctggccccgagtagtggcgtccagcccactttagctatgccgaacatcgcggtgggacagaatgtcactgtgacagaacgcgtactggctcccgcgagtacattgcagtcatcttaccagattcctaccgaaaattctatgacggcgcggaacacgactgtttctggcgctggcgtacctgggcctctgcccgacttcggccttgaggagagcggacactcgaacagcacgataacaacttcttctacacgggtcaccaagcactccaccgttcagcactcctattcttag

SEQ ID NO: 114464 - DNA, 3123 bp, Artificial Sequence
  Description of Artificial Sequence: Synthetic coding sequence
atggattggcttttcttccgtaacatatgcctgcttataatcctgatggttgtgatggaagtgaattccgaattcattgtcgaagtgaaagagttcgatatcgagaacggtaccactaaatggcagactgtgcgtaggcagaagcgggaatggattaaatttgcagcagcatgtcgtgagggcgaggacaactcgaaacggaatcccattgctaaaatccgaagcgactgcgaatccaaccagaaaatcacctatcgcataagcggggtaggcattgaccggccgccttacggggtctttacgatcaacccgcgcacgggtgagatcaacatcaccagtgtggtagatcgcgagatcacccccctttttctcatatactgccgggccctgaactccaggggggaagacctggagagacccctggagttgcgagtcaaggtgatggatattaatgataacgcccctgtgttttcgcagagcgtctacacagcctcgattgaagagaactccgacgcaaataccctggttgtaaaactctgcgctacagatgctgatgaggagaatcaccttaattcaaaaatcgcttacaaaatcgtttcacaggagccttctggcgcccctatgttcatattaaatcggtataccggggaagtttgcactatgtcctcatttctggatcgcgagcaacacagtatgtataacttggtagtacgcggctccgaccgagatggcgctgcggatggcctgtccagcgaatgcgactgccgcattaaggtgctcgacgtcaacgataatttccccacactcgagaaaacatcttactccgcctccatcgaggagaactgcttatcctccgaacttatcagactacaggccatcgatctggacgaagaaggtacagataattggctggcccagtacttgattctcagtggtaacgatggaaattggtttgacattcaaaccgatccacagaccaacgaggggatactaaaggtggtgaaaatgctggactatgagcaggccccaaacattcagctgtccattggcgtgaagaaccaagcagattttcattatagcgtggctagccagttccagatgcacccaacccccgtgaggatccaagtcgtggacgtgagagaagggccagccttccatcctagcaccatggccttctcagtgagagaggggataaaggggtcgagcttattaaactatgtgttgggcacttatacagcaatcgaccttgacaccggtaatccggcaacggacgtgcgatatataatcggccatgacgcaggatcatggctaaaaatcgactcacggaccggagagatccagtttagtcgtgagttcgataaaaaatcaaagtatataatcaatggaatttatactgctgagattctagccatcgacgacggtagcggcaagactgctactggcactatctgtatagaggtccctgacattaatgattactgtccaaacatctttcctgagagaaggacaatctgcattgactccccaagcgtgttgatctctgtcaacgaacacagttacggttcccctttcactttttgtgtagttgatgagccccccggaatagctgacatgtgggacgtccggtctaccaatgcaacttctgctatcctgactgctaagcaggtgctgtccccaggcttctacgagatacctatattggtgaaggatagttacaacagggcgtgtgaactggcccaaatggtacaactgtacgcgtgcgattgtgatgacaaccatatgtgtcttgattcaggcgctgccggcatctataccgaagatatcaccggagatacctacggacccgtgacagaggatcaggccggcgtgtcaaatgtgggcctcggccctgctgggatcggcatgatggttctggggatcttgttgctgatattggctcctctgcttctgctgctttgttgctgtaagcagcgtcagcccgagggactgggaacccgctttgcccctgtgcctgaggggggggagggagtgatgcagagctggaggatcgaaggcgcgcatcctgaagaccgagatgtgtccaacatttgcgcccccatgacagcttctaacacccaggatcggatggattccagcgagatatataccaacacgtacgctgctgggggaactgtggaaggcggcgtaagcggagtcgagctgaacacaggaatgggcacggctgtggggcttatggcagccggggctgcaggagcttctggtgcagcccggaagaggtcgtcaactatgggcaccctcagggattacgcagacgccgatatcaacatggccttcctcgattcctacttttctgaaaaagcatacgcatacgccgatgaagatgagggaaggccggctaacgactgccttttgatctacgatcacgaaggtgtcggttctcccgttggaagcattggttgctgctcctggattgtcgacgatctcgatgagtcctgcatggagactttggatcccaagttcaggacacttgcagaaatctgtctaaataccgagattgagcccttcccttcacaccaggcctgtattcccatttccactgatctgcctctgcttgggccaaactatttcgtcaacgaatcgtccgggctcactccctccgaagtggagttccaggaggaaatggcagcctccgagccagtagtgcacggcgacattattgtcacagaaacctatgggaatgccgatccgtgcgtgcagcccaccacaataattttcgaccctcaactcgcccctaatgttgtcgtaacagaggctgtgatggctcccgtatatgacatccaagggaacatctgtgtccctgctgagcttgccgactacaacaacgttatctacgccgaacgcgtgctagctagcccaggggtgcccgatatgagcaattcatcaaccactgagggctgtatgggcccagtgatgagcgggaatatcttagtaggtccagagattcaggtcatgcaaatgatgagcccggatctgcctatcgggcagaccgtggggtcgacttccccaatgacgagtaggcatagagtcacgaggtacagtaacattcactatacccagcagtag

SEQ ID NO: 114465 - DNA, 3180 bp, Artificial Sequence
  Description of Artificial Sequence: Synthetic coding sequence
atggattggctcttctttagaaatatatgcctcctcattatacttatggttgtgatggaagtgaacagtgaatttattgttgaagtcaaagagttcgatatcgaaaacggcactaccaagtggcagaccgttcgaaggcaaaaaagggaatggatcaagtttgctgcagcctgcagggagggggaggataactccaaacgcaatcctatcgccaaaattcggagtgattgtgagagtaaccagaagatcacgtaccgaatcagcggcgtggggatcgacagacccccgtacggagtctttaccatcaatccgcggacaggggagatcaacattacctcagttgtcgatcgagagatcacaccattgtttcttatctactgcagagcacttaatagtcggggggaagacttggaaaggccactggagttgcgagttaaagtaatggatataaacgacaacgcacccgtcttctcccaatcggtctataccgcctccattgaggagaattccgacgccaacaccttggtggtgaaactgtgtgcgacagacgcggatgaggaaaatcatctgaacagcaagatagcctacaaaattgtctcccaggaaccatccggcgctccaatgtttatccttaatcgatacactggggaagtttgtaccatgagcagttttcttgatcgggaacagcactccatgtacaatcttgtcgtccgtgggtcagaccgagacggggccgctgacggactctcgtcagaatgtgactgtaggattaaggtgttggacgtgaatgataactttcctacacttgagaagacctcttattctgctagtatcgaggagaactgcctatcctcggagttgattcgtttgcaggcgatcgatttagacgaagagggcacggataactggctggcgcagtatttgattctgtcaggaaacgacgggaactggtttgacatccaaaccgacccacagacgaatgagggtattctgaaggtcgtgaaaatgctggattatgaacaagctccaaacatccaactatccattggagttaagaatcaggcagacttccattactccgtagcttctcagttccagatgcacccaacccctgtgcggatccaggtcgtcgacgtaagagaagggcccgcttttcacccttccacaatggcttttagcgtccgggagggtattaaaggttccagtctgcttaattatgtgcttggaacctacactgcaatcgatctcgacacaggaaacccagccaccgacgtgcgttacatcatcgggcatgacgccggctcttggcttaaaatagattctagaactggagaaattcagttctcccgggaattcgataaaaagtccaagtacatcatcaatgggatctatactgcagagattctcgccatagacgatggaagcgggaaaacggccacgggcacaatctgcattgaggttccagacataaacgattactgccctaacattttccctgagcgcagaactatatgtattgattcacctagcgtcctgatctctgtcaatgaacactcgtacggctcaccctttacattctgtgtcgttgatgaaccaccggggatcgcagatatgtgggatgtaagatccacaaatgccacctcagcaattctgactgccaagcaagtgctctccccagggttttacgagattcccatccttgtgaaggattcctataatcgagcttgcgaactcgcccagatggttcagctgtacgcctgtgactgcgacgataaccacatgtgcctggactccggagcggcagggatatacaccgaggacatcaccggcgacacgtacggtccagtgactgaggatcaggcaggagtgtctaatgtgggactgggacctgctggcataggcatgatggtcctggggatccttctgcttatcctcgcccccctccttctgctgctatgttgttgcaaacagcggcagcccgaggggctcggcactagatttgctcccgtgcctgaaggcggagagggggtgatgcagtcctggaggatagagggcgcccatccagaggaccgcctgttctctgcctatgcactacccggcggcggcgggaccgcagacgggggtggctcagtgctcgggagatgtgctttgcaggccaccccagcccttctcaaccagcacccacccttctctgagatctataccaatacatacgcagccggcggtactgtggaaggtggggtgagcggcgtggagttaaatacaggcatgggcacagccgtggggttgatggctgccggtgcagccggagctagcggcgctgcccgaaagcgctcctctacaatggggacattacgcgattacgcagacgctgacataaacatggcttttctggacagctacttttctgagaaagcctacgcctacgctgacgaggacgaagggaggccagcaaacgactgcttgctaatatacgatcatgaaggggtgggcagtcctgtcggcagcattggctgctgttcttggatcgtggatgacctcgacgaaagctgcatggagactcttgatcctaaatttagaactctcgcagagatctgtctgaacaccgagatagagccttttccttcacatcaggcctgtattcccattagtaccgacttacccctgctgggcccgaactatttcgtgaatgagtcttctggtcttactcctagcgaagtagagttccaagaggagatggctgcctcggagcccgtcgtgcatggggacatcatcgttactgagacgtacggcaatgcggacccatgtgtgcagccaaccacgattatttttgacccacaactggccccaaacgtggtggtaacagaagccgtgatggcccccgtctatgacatccaaggaaatatatgtgttccagcagaacttgccgactacaacaacgtgatatatgccgagcgcgtcctggcgtcacctggtgtcccagacatgagtaattccagtactacagagggctgtatgggaccggtaatgtccggaaacatcctggtgggtccggagattcaggtaatgcagatgatgtctcccgatcttcctattggacagactgtgggcagcacatcccctatgacatcgagacacagggtcactaggtactcaaatatccattacactcagcagtag

SEQ ID NO: 114466 - DNA, 498 bp, Artificial Sequence
  Description of Artificial Sequence: Synthetic coding sequence
atggcctcaggggtccaggtcgccgatgaggtttgccggatcttctacgacatgaaagttcgaaaatgttcaacccccgaagaaattaagaagaggaaaaaggccgtgattttttgtctttcagccgataagaagtgcatcattgtggaggaagggaaagagattctcgtcggggatgtcggcgtgaccattacagaccccttcaagcattttgttggaatgctgccggagaaagattgccgctacgctctgtatgacgcaagcttcgagacaaaggaatcacgtaaggaagaattgatgttctttctgtgggcccccgagcttgcccctctgaagtcaaagatgatctacgccagttctaaggacgctattaagaagaagttccaggggattaagcatgagtgccaagcgaatgggcccgaggacttaaatagggcctgtatcgccgagaaattggggggtagcctgattgtggcttttgaaggctgtccagtctag

SEQ ID NO: 114467 - DNA, 447 bp, Artificial Sequence
  Description of Artificial Sequence: Synthetic coding sequence
atgaaagtgcgcaaatgctcaacccccgaggagatcaagaagagaaaaaaagcggttatattctgcctatccgcagacaagaaatgtatcattgtcgaagaggggaaggaaattctagtgggggatgtgggagtgaccatcaccgacccgttcaagcactttgtgggaatgctaccggagaaagactgtcgatacgccctgtacgatgcctcattcgaaacgaaagagagtagaaaggaggaactaatgttcttcttgtgggcaccggaactggcaccattaaagtctaagatgatctacgcctcctctaaggatgcgatcaagaaaaaatttcagggcatcaaacacgaatgtcaggccaatggcccagaagatctcaatagggcctgtattgccgaaaagctcggcggtagcctgatagtggctttcgaaggatgcccagtctag

SEQ ID NO: 114468 - DNA, 897 bp, Artificial Sequence
  Description of Artificial Sequence: Synthetic coding sequence
atgtctgacgcaaatttggatagctcaaagaagaactttctggaaggggaagtggacgatgaggagtctgtgatactcacgctcgtgccggtgaaggacgacgcaaatatggagcaaatggaaccgtcagtgtccagtactagcgatgtcaagttggaaaagcccaaaaagtacaacccaggccacctcctccagacaaatgaacagttcaccgcgccccagaaggcaaggtgcaagatacctgcattgcctcttccaacaattctgccgccaatcaataaggtttgcagggataccctgagggattggtgccagcaactgggactgtcgactaatggaaaaaagattgaagtctacctgagactacaccgccatgcttaccctgaacagcggcaggatatgcctgaaatgtctcaggagactcggctccagcggtgcagcagaaagcggaaggccgtgactaaaagggcgcggctccagcggagttacgaaatgaacgagcgtgccgaagagaccaataccgtggaagtgattacatccgctcctggggcaatgttggcaagctgggctaggattgcggcacgcgccgtccaacccaaggcactgaattcatgttcaatccctgtcagcgtggaggcttttctgatgcaagcatccggtgtgcgctggtgcgtggttcatggtcgcctgctaagcgccgacacaaaaggctgggttagactgcaattccatgctgggcaggcgtgggttcctactacccacagaaggatgatctcattgttcttactgcctgcctgtatcttcccctcgcccggcatcgaggataacatgctgtgtcctgattgcgccaaacgcaataagaaaatgatgaaaaggctgatgactgtggagaagtag

SEQ ID NO: 114469 - DNA, 480 bp, Artificial Sequence
  Description of Artificial Sequence: Synthetic coding sequence
atggacccttcccagtttaatcctacatacattcccgggtctcctcaaatgctgactgaggaaaactcccgcgacgatagcggagcctcccaaatcagttccgaaacgctcatcaagaacctgagcaacttgacaatcaatgcttcttccgagtccgttagcccactgtccgaggctctcctgagacgcgaaagcgttggagccgccgttctgagggagatcgaagacgaatggttatactcacgcagaggggttcgcacattactgtccgtgcagagagagaaaatggctaggctgcgttatatgttgctcgggggggtgagaacccacgagagaaggcctacaaacaaggagcccaagggtgtgaaaaaagagtcaagacctttcaagtgcccatgtagtttttgcgtgagcaatggctgggatcccagcgaaaacgcaaggattgggaaccaggacaccaagcctctccagccatag

SEQ ID NO: 114470 - DNA, 915 bp, Artificial Sequence
  Description of Artificial Sequence: Synthetic coding sequence
atgcttcggggatcagccagcagtacaagtatggagaaagcaaagggaaaggaatggacatccacagaaaaatcccgggaggaggaccagcaggctagtaatcagccaaattcaatcgccctcccgggaacaagcgccaaaagaactaaagaaaagatgagtattaagggctccaaagtgttatgtcctaaaaagaaggccgagcataccgacaatccacggccgcagaagaagatacccataccgcctctcccgtctaagctgccccccgtgaatctgattcatcgggatatcctcagagcctggtgtcagcagctgaagttgtcaagcaagggacagaagctggatgcctacaagaggctctgtgccttcgcttatcccaaccagaaggattttccgagcacggccaaagaagccaaaattcgaaagagtttacagaaaaaacttaaggtcgaaaagggtgagaccagtctgcaaagctccgagactcaccccccagaggttgcccttccacccgtgggggagccccctgcactagaaaactccaccgccctccttgaaggagtgaatactgtcgtcgtcaccacatccgctcctgaggcccttctggcctcatgggcccgcatctcagcacgcgctcgcacaccagaggcggttgaaagtcctcaggaggctagtggcgtgaggtggtgcgtagttcatggtaagtcactgcccgctgacaccgatggctgggttcacctgcagttccacgccggtcaggcctgggtacccgagaaacaagagggaagagtgtcggcccttttcctactgcctgcgagcaatttcccccccccgcacctggaagacaacatgctctgtcccaaatgcgttcaccgaaataaagtgctgataaagtccctgcagtgggagtag

SEQ ID NO: 114471 - DNA, 351 bp, Artificial Sequence
  Description of Artificial Sequence: Synthetic coding sequence
atggggacactgcccgcccgccgtcacattccaccttgggtgaaggtacccgaagacctgaaggatccagaggtgtttcaggtgcaaacccgactgcttaaagcaatcttcggacctgacggctcccggatcccatacattgaacaggtatccaaggctatgttggagttgaaagccctggaatcttctgacctgacagaggtggtggtgtacggtagttacctctataagttaaggaccaaatggatgctgcagagtatggctgaatggcatcgccaaaggcaggagcggggcatgctgaagttggccgaagctatgaacgcccttgagcttggaccctggatgaagtag

SEQ ID NO: 114472 - DNA, 1104 bp, Artificial Sequence
  Description of Artificial Sequence: Synthetic coding sequence
atgagcagtaccctggctaagatcgccgagatagaagccgagatggcccgcacgcagaaaaataaggccactgcccatcatctggggctcctgaaggcacggttggccaaactccggcgagagctgatcacaccaaagggcggtggggggggggggcctggtgaagggttcgatgttgcaaagaccggcgatgcccggatcggtttcgttgggttcccatctgtgggtaagagtacgttactttctaatctcgcaggggtgtactccgaggtcgccgcctatgagtttaccacactcactacagtccccggtgtgatacgctataaaggggctaagattcagctactggatctgcctggaataattgagggagccaaagacggaaagggcaggggccgacaagtgattgcagttgctagaacttgcaacctgattctgatcgtgttagatgttttaaagcccctcggtcacaaaaagattatcgaaaatgaactggagggctttgggattcgcctcaactccaagcctcctaatatcgggttcaaaaaaaaggataaagggggtattaacctcactgccacttgtccccagtccgagctggacgcggaaaccgttaagagcatcctcgcagagtacaaaatacataatgccgatgtaacactccgttccgacgctacggccgacgacctaatagatgtggttgagggaaaccgggtttacattccctgtatttatgtactgaataagatagatcagatcagtatagaagagcttgacattatctacaaagtgcctcactgcgtgccaatatctgcccaccataggtggaattttgacgacctcttggagaagatttgggattatttgaaactggttcgaatctacaccaagcccaaaggccagcttcccgactacacttcaccggtcgttctaccctattctagaacaactgtggaagacttttgtatgaaaattcacaagaatcttattaaggaattcaaatatgcgctggtctgggggctgagcgtcaaacacaatccgcagaaagtagggaaagatcacacactcgaagacgaagacgtgattcaaatcgtaaaaaaatag

SEQ ID NO: 114473 - DNA, 396 bp, Artificial Sequence
  Description of Artificial Sequence: Synthetic coding sequence
atggccgcagcggtagcaatggagacggacgacgccgggaataggttgagattccagctggagctggagtttgttcagtgccttgccaatcccaactatctgaatttcctcgctcaaaggggttatttcaaagacaaggccttcgtaaactacttaaagtatctcctgtattggaaagatcccgagtatgccaagtacctgaagtacccccagtgtctgcacatgcttgaattacttcagtatgaacacttccggaaggagttagtgaatgcgcagtgcgctaaattcattgacgaacaacaaattctgcattggcagcactactccaggaaacgcatgcgattgcaacaagcattagctgaacagcagcaacagaacaacacttctggtaagtag

SEQ ID NO: 114474 - DNA, 1032 bp, Artificial Sequence
  Description of Artificial Sequence: Synthetic coding sequence
atggggatcctcgagaagatttcagaaattgagaaagagatcgcgaggactcaaaagaataaagccacagagtatcacctggggctcctaaaggctaaattggccaaatatcgtgcacagttgctggagccttccaaatctgcctcttcaaaaggcgaaggctttgatgtcatgaagagtggagacgctcgggtcgcgctcatcggcttccctagcgtgggtaagtcgacctttctgtcattaatgactagtacggcgtcggaggccgctagttatgagttcacaacgctgacctgtattcctggtgtaatcgagtacaaaggagcaaacatccagcttttggatctgcccggcatcatagaaggagcagcccaggggaaaggacgagggcgccaagtcatcgctgtcgcccggacagccgatgtgattattatgatgctcgatgcaacgaagggggaggttcagaggtcgctgctcgagaaagaactggagtcagtcggaatacgcctgaacaaacacaaacctaatatctatttcaagcctaagaaagggggcgggatctcgtttaattcgacagtcacactcactcagtgttctgagaagcttgtccagctgattctgcatgagtacaaaatcttcaacgccgaagtcctttttagggaggactgcagtcccgacgagttcattgatgtcattgttggtaaccgcgtttacatgccatgcctctatgtctacaataagatcgaccagatcagcatggaggaagtggacagactcgcgcggaaacccaattccgtggtgatcagctgcggcatgaagctgaatctggattaccttttggaaatgctgtgggagtacctggccctcacctgcatctatactaagaagcggggccagaggcctgactttaccgatgccatcatactgagaaaaggcgccagtgtagagcatgtttgtcaccggatccaccggagcctggcttctcagtttaaagcgccagcaccatcaaccgttaggagcggttgggcttag

SEQ ID NO: 114475 - DNA, 2037 bp, Artificial Sequence
  Description of Artificial Sequence: Synthetic coding sequence
atggagctgaggtcctaccagtgggaggtaatcatgccagctcttgaggggaagaacatcataatctggctgcccacaggcgccggaaaaacacgcgcagccgcttacgtcgccaagaggcaccttgaaaccgtggatggggcgaaggtggtcgttctggtaaatagggtgcacctagttacccaacatggcgaagagtttaggcgcatgcttgatggtcggtggactgtgactaccctgagtggagatatgggacccagagcgggatttggccacctggcacgttgtcacgatctcctcatttgtacggccgagcttttacagatggccctcacatctcctgaggaggaagagcacgtggagctgacagtcttctcgctcatcgtggtggacgagtgccaccatacccacaaagacactgtttataatgtgatcatgtcccaatatcttgaactgaaactgcagcgggcccagccattgcctcaggtccttggtctgaccgcttcaccaggtaccggcggagcctctaagctcgacggagccattaaccatgtgttgcaactttgtgcaaacttggacacctggtgcataatgtccccccagaattgttgtccgcagctgcaggagcattcacagcagccttgcaagcagtataacctatgccatcgcaggagtcaggacccatttggtgacttgctaaagaaacttatggaccagattcatgatcatctggagatgcctgagctgagccgtaaattcggaacgcagatgtacgagcagcaagtcgtgaagttgtcagaagctgctgcgctagctggactgcaggagcagcgcgtctatgcacttcaccttagacggtataatgatgctcttttgatccatgacacagtcagggcagtggatgccctggcagcgttgcaggatttctatcatcgagaacacgtgaccaagactcagatcttgtgcgccgagagacggctgctggcactgtttgacgaccgcaagaacgagctcgctcaccttgccacccatggccctgaaaacccgaagcttgagatgttggagaagatcctgcagaggcaattcagttcttcaaactcaccgcgaggcataatattcacgcgaacacgacagagcgctcattctctgctactatggctacagcagcagcaggggcttcagacagtggatatcagggctcaactgctcattggagctgggaactcttcccagagcacacatatgacccagcgggaccagcaggaagtgatacaaaagtttcaagacggtaccctgaatcttctggtggcgacttccgtggccgaagaaggtctggatataccccattgcaatgtggtggtacgctacggtctgctgaccaatgagatcagcatggtgcaagcaaggggcagagcacgcgcggaccagagtgtgtatgcttttgtggccacagaaggctccagagagttaaagcgtgagcttatcaacgaggctctggagacgctgatggagcaagccgtcgcagcagttcaaaaaatggaccaggccgaatatcaggcaaaaatccgggacctgcagcaagcagcgttgaccaaaagggctgctcaggcagcgcagcgcgagaatcagcgacaacaatttccagtcgaacatgtgcagctgctatgcatcaactgtatggtggcagtaggacacggctctgaccttcgaaaggtggaaggcacgcaccacgttaacgttaatcctaacttcagcaattattacaacgtgtctagagatcccgtagtgataaacaaagtattcaaggattggaaacccggaggcgtaatctcctgccgcaactgtggcgaggtttggggtctgcagatgatttacaagtcagtgaaactgcctgtgcttaaggtgcgaagcatgttgttagagacgccacaggggcggatccaagctaaaaagtggtcacgcgtgccattcagtgtgcctgattttgactttttgcagcattgtgccgagaatctctcggacctgagcctagattag

SEQ ID NO: 114476 - DNA, 909 bp, Artificial Sequence
  Description of Artificial Sequence: Synthetic coding sequence
atggaactccggtcctaccagtgggaagttattatgcccgctctcgaaggcaagaatattattatctggctacccaccggagccggaaagactcgtgccgctgcttatgtcgctaaacggcacctcgaaaccgtggacggcgccaaggtcgtggtgctggttaatcgggtgcacctcgtcacgcagcacggggaagagttcaggcggatgctggacggccgatggactgtgaccactctgagcggcgacatggggcctcgggcgggttttggtcatttagcacgctgccacgatcttttaatttgcacagccgaacttctccagatggcacttactagcccggaagaggaggaacacgtcgaactcactgtcttctcattgatagttgtagatgagtgccatcacacacacaaggacacggtgtataatgtaatcatgtctcagtatctcgaattgaagctgcagcgggcccagcccctcccccaggttctcgggctgaccgccagcccgggcactggaggagcctccaagttagatggtgcaattaaccacgtcctccagctctgtgctaatctcgatacgtggtgcatcatgtccccccagaattgttgtccacaactgcaggagcacagtcagcagccttgcaagcagtataatctttgtcaccgccggtctcaggatccctttggagaccttctcaagaaactgatggaccaaatacacgaccatttggagatgcccgagttaagccggaagttcggtactcaaatgtatgagcaacaagtggtgaaactgtcggaggcagctgcgctggcgggtcttcaggaacagagagtgtatgcattgcatctgcgacgatataacgacgcccttctcatccatgacaccgtcagagcagtggatgcttag

SEQ ID NO: 114477 - DNA, 1464 bp, Artificial Sequence
  Description of Artificial Sequence: Synthetic coding sequence
atggaactgcggagttaccaatgggaggtcattatgcctgctttggagggtaaaaacattattatctggctgccaacaggcgccggcaaaacgcgggcggcagcctacgtggccaaaaggcacctggagacagtcgatggtgcaaaggtggtcgtactagtgaacagagtgcatttagtgacccaacacggcgaggaattccggcggatgctagacggcaggtggaccgtaactactctcagtggagacatgggaccaagagccggtttcggtcacctcgcaaggtgccatcatacacataaggatacagtctacaacgttatcatgagccagtaccttgaattgaaactccagcgggctcaaccactcccccaggtcctggggttgactgcctcaccaggtaccggcggtgcatctaagttggatggtgctatcaatcatgtcctgcagctgtgtgctaatctggatacatggtgcatcatgtctccacagaattgctgtccccagctccaggaacactcacaacagccctgcaaacagtacaacctctgccacaggagaagccaggatcctttcggagacctcctgaaaaagttgatggaccagatacatgatcacctggagatgccagaactctctcgaaagtttggtacccagatgtatgaacaacaggtggtgaagctgagcgaagcagccgccttggctggcttacaggaacagagggtatatgcactgcatctaagacggtacaatgacgccttactcatccatgataccgtacgggccgtggatgcactcgcggcgctccaggatttttatcacagggaacacgtcacaaaaacccagatcttgtgcgcggagcgcaggcttctagcactgttcgatgatcgaaagaatgagctggcacatctcgccactcacggccccgaaaatcctaagctggagatgctggaaaagattttacagcgacagttttcctcttctaacagtcccagaggaatcatatttactcggaccagacagtctgcccattctctgttactatggcttcaacagcaacaagggttgcagaccgtggacataagagctcaattactgataggcgcaggaaattccagccagagcacccacatgactcaacgcgaccagcaggaagtgattcagaagtttcaggatgggacattaaatctcctggtggcaaccagcgtcgccgaagagggtctggatatcccccactgcaacgtcgttgtgagatacggtctattgacgaatgagatctccatggttcaggctaggggcagggcacgcgccgatcagtctgtttacgctttcgtggcaacagagggaagccgcgagctcaagagagagcttataaacgaagccctagagactctgatggagcaggccgtggctgctgtgcaaaagatggaccaggctgaataccaagccaaagagcttctatag

SEQ ID NO: 114478 - DNA, 471 bp, Artificial Sequence
  Description of Artificial Sequence: Synthetic coding sequence
atggaactgcgatcctaccagtgggaggtgatcatgcccgcactggagggcaaaaatattattatctggctcccaactggagcagggaaaacgagggccgcagcttacgtggccaaaagacacctggaaactgttgacggggctaaagtggttgtcttggtgaatagagtgcatctggtgacccaacatggagaagaatttaggagaatgcttgatgggcggtggacggttacgacattgtcaggagacatggggcccagagcaggcttcggccacctcgcgcgctgccatgacttgctcatatgtaccgccgaactgctccagatggcgctgacatcccccgaggaagaagaacatgttgagctgaccgtctttagccttattgtggttgacgagtgccaccacacacacaaagataccgtgtacaatgtcattatgtcccagtatctggagttgaagttgcagcggtag

SEQ ID NO: 114479 - DNA, 2208 bp, Artificial Sequence
  Description of Artificial Sequence: Synthetic coding sequence
atggcaaaagagcgaggcctgatctcaccctcagatttcgcacagctgcaaaagtatatggagtattctacgaaaaaggtaagcgatgtcctcaagctgttcgaggatggggagatggcaaagtacgtacaaggagacgccatcggttatgaagggttccaacagtttctaaagatttatctggaggtagataacgtgccgagacatctctccctcgcactatttcagtcctttgagaccgggcattgtttgaacgagaccaatgtcacaaaggacgtggtttgtctgaacgatgttagctgctacttcagcctcctcgaaggagggcggccagaagacaaactcgaattcacattcaagttgtatgacactgaccggaacgggattctggacagctctgaagtggataagattattttgcagatgatgagggtggctgagtatttggattgggatgtgtccgagctgagacctattttgcaagagatgatgaaagagatcgactacgacggctcagggtctgtgtcccaggcggagtgggtgcgtgccggcgctactactgttcccctgctcgtcctacttgggctggagatgaccctgaaggacgatggccaacatatgtggaggcctaagcggttccctagacctgtatattgtaacctgtgtgaatcaagcatcgggctcggcaagcaaggactatcctgcaacctatgcaaatacaccgtacatgatcagtgtgccatgaaagccttgccctgcgaagtgtccacctacgccaaaagcagaaaggatatcggggtccaaagccatgtctgggttcgaggcggttgtgagtcaggaagatgtgacaggtgccaaaagaaaattcgaatctatcacagcttgaccggcctgcattgtgtgtggtgccatctggagattcacgacgactgtctgcaggccgtcggacacgaatgcgactgtgggctccttagagatcacattctgcctccttcctccatatacccctccgtcctggcgagtggaccagacaggaagaactccaagacctctcaaaaaaccatggacgacttgaacctctcgacctcagaagcccttcgaatcgaccccgttccaaacactcacccactcctggtttttgtcaaccctaaaagcgggggcaagcaaggccagagagttctgtggaagttccagtatatcctcaatcctaggcaagtgttcaatctgctgaaagatggcccagaaatcggactcagactgtttaaggatgtcccagacagccgcattttggtctgcggcggcgacgggactgtgggctggatcctggagacaattgacaaggccaatctgcccgtgttacccccagtggctgtcttgccgctcggcacaggcaacgacctcgccagatgcctcaggtggggcggagggtatgagggacagaacctcgcaaagattctgaaggatctagagatgagcaaggtggtgcacatggatcgctggagtgtcgaagtcataccacagcagacggaggagaagagtgaccctgtgcctttccagatcataaacaactattttagcataggtgtggatgcaagtattgcacacagatttcacatcatgagggaaaagtaccccgagaaatttaactcacggatgaaaaacaaactctggtattttgaattcgcgacatcggaaagcattttctcgacctgcaagaagctggaggagtcgttaactgttgaaatctgtggcaaaccactggacctctccaacctaagcctggaaggcattgcggtgctcaacatccccagtatgcacggtggatccaatctatggggtgataccagacggccacacggtgacatttacggtattaatcaggctttgggcgcaacagctaaagtgatcaccgaccctgacatcttaaaaacgtgtgtgccagatctctcagataaaagactagaggtcgtggggctcgaaggcgccattgaaatgggtcagatctataccaagttgaagaacgccgggagacgactggctaaatgttcagaaatcactttccacaccaccaagaccctgcccatgcagatcgatggcgagccttggatgcagacaccttgtaccatcaagatcacacataagaaccaaatgccaatgctgatgggtccacctccacgaagtactaatttttttggattcctgagttag

SEQ ID NO: 114480 - DNA, 2208 bp, Artificial Sequence
  Description of Artificial Sequence: Synthetic coding sequence
atggcaaaagaacgagggctcatttccccctccgacttcgcccagctgcagaagtacatggagtactctaccaagaaagtctctgacgtcctcaagctgtttgaagatggggagatggctaaatacgtgcagggagacgcaattgggtacgagggctttcaacagtttctaaagatctacttagaggtagacaatgtcccaagacatctgagcctggctcttttccagtcttttgaaactgggcactgcctgaacgaaacgaatgtgacaaaggatgtggtctgcctcaacgacgtttcctgttatttttccctgctcgaaggcggccgccctgaggataaattggagttcactttcaaattatacgataccgacagaaacggtatactcgacagcagtgaagtagacaagattatcctacagatgatgcgagtggccgaataccttgactgggacgtaagtgagctgagacctatcctccaagagatgatgaaagaaatagattacgacggatccgggtcagtatcgcaggctgagtgggtccgcgctggggccaccaccgtgccgcttctagtcctgctcggattagagatgaccctgaaggatgatggccagcacatgtggagaccaaaaaggtttcctcgtcccgtttactgtaatctgtgcgaaagttccattgggctgggcaagcaggggcttagttgtaatctgtgcaagtacaccgtccatgaccaatgcgcaatgaaagcccttccctgtgaggtgtctacttacgctaaatctcggaaggacataggagtacaatctcatgtgtgggttagaggggggtgtgagtctggaagatgcgatcgatgccaaaagaagataagaatctatcactcgctgaccggactgcactgcgtgtggtgtcatctggagatccacgacgactgcctccaggcggttggacacgaatgtgactgcggcttgctccgagatcacattctgccacccagcagcatttacccaagcgtcctagctagtggccctgacagaaagaactctaaaacgtctcagaaaactatggatgatttgaacctgtccacatccgaagccttgcgtatcgatcctgtacctaacacccaccccctcctggtgttcgtgaatccgaaatctggcggaaagcaaggccagagagtgctatggaaattccaatatattctcaatccccgacaggtgttcaacttgcttaaagatggccctgagattgggctgcgacttttcaaggatgtccccgattcccggatactcgtatgcggtggagatggtacagtgggttggatcttagagaccatcgataaagctaatctgccagttttgcctcctgtggcggtcttgcctcttggcacaggtaacgaccttgcacggtgcctgagatgggggggaggatatgaagggcagaatctggccaagatcctgaaggacctggagatgtcaaaggtggttcacatggatcgatggtctgtggaggttattcctcagcagacggaggagaaaagcgatcctgttcctttccagatcattaacaactacttttctatcggcgtggatgctagtatcgcccatcgcttccatattatgagagaaaagtatcccgagaaatttaatagccgcatgaagaacaaactgtggtatttcgagttcgctactagtgagagcatcttttctacttgcaagaaactggaagaatccctgaccgtggagatctgcgggaaacctttggatctgtctaacctcagccttgagggaattgctgtgctgaacattcctagtatgcacgggggtagtaatctgtggggagatactagaagaccccatggagacatctacggaataaaccaggccttaggggcgaccgccaaggtcatcactgatcctgacatccttaagacatgcgtgcctgacctctcagataagcgcctcgaagtcgtggggcttgagggagctattgaaatgggccagatatatacaaaattgaaaaatgctggacggagactcgccaagtgtagcgaaatcacctttcacaccacaaagaccctacccatgcagattgatggcgagccgtggatgcagacaccgtgtacaatcaagataacccataagaaccagatgcctatgttaatggggccgcctcccagaagcaccaacttttttgggtttctttcgtag

SEQ ID NO: 114481 - DNA, 744 bp, Artificial Sequence
  Description of Artificial Sequence: Synthetic coding sequence
atggctaaggaacgggggctgatctctccctccgatttcgcccagctgcagaagtatatggagtactctactaaaaaggtatcagatgttctgaaattgtttgaagatggagagatggcaaagtacgtgcaaggcgacgccatcggctacgaaggatttcagcagttccttaagatctacctagaggtggataatgtaccaaggcatttatcattggctctgttccagtccttcgaaaccggacactgcttgaatgagaccaatgtaaccaaagatgtggtgtgtcttaatgatgtgtcttgctactttagtctcttagaaggcggcagaccagaagataagcttgagttcacatttaagctgtacgacaccgaccgaaatggaatccttgactcttccgaagtcgacaagatcatcctgcagatgatgcgtgttgcagaataccttgactgggatgtctctgagctgcgaccaattcttcaagaaatgatgaaagagatcgactacgacggctccgggagcgtgagccaggcggaatgggtccgagccggggccactaccgtgcccctcctggtcctcctgggtcttgaaatgacactgaaggatgacgggcaacatatgtggcgtcccaagagattcccgagaccagtgtattgtaacctgtgcgagtcgagtatcggcctgggcaaacaaggtctgtcatgtaaccgtcctatcacatgcgtgggcgcaagacggctgtag

SEQ ID NO: 114482 - DNA, 351 bp, Artificial Sequence
  Description of Artificial Sequence: Synthetic coding sequence
atggctaaagagcggggcctgatttctccctctgattttgcacaactgcagaagtatatggagtattccacaaaaaaagtgtccgatgttctgaagctgttcgaggatggcgaaatggcaaagtacgtgcagggagacgctatcggttacgagggttttcagcagtttctcaagatttacctggaagtggacaatgtcccccgccatttaagcctcgcgctgttccagtcgtttgagaccggtcactgtctaaacgagactaacgtcactaaggacgtcgtctgtctaaacgatgtctcctgttatttcagtctgttggaaggcggtcggccggaggataagctcgagtag

SEQ ID NO: 114483 - DNA, 177 bp, Artificial Sequence
  Description of Artificial Sequence: Synthetic coding sequence
atggctaaggagcgtgggttaatcagcccatctgacttcgcccaactccagaaatacatggaatacagcacaaaaaaggtgtccgacgtactcaagttattcgaagatggggaaatggccaagtacgttcagggtgatgccataggctatgaaggcttccagcagtttctaaaatag

SEQ ID NO: 114484 - DNA, 66 bp, Artificial Sequence
  Description of Artificial Sequence: Synthetic coding sequence
atggctaaggagagggggcttatttctcctagtgattttgcccaactacagaagtacatggagtag

SEQ ID NO: 114485 - DNA, 444 bp, Artificial Sequence
  Description of Artificial Sequence: Synthetic coding sequence
atggctaaagagagaggcctgatttcccctagcgatttcgcccaacttcagaagtatatggaatattctaccaaaaaagtgagcgacgtactcaaattgtttgaggatggagagatggcaaaatacgttcagggggacgctattggctatgagggattccagcagtttctcaagatttacctcgaggtagataacgtgcctcggcacctttccctggctctgttccagagttttgagacgggacattgtcttaatgaaaccaacgtcaccaaggatgtggtctgtttgaacgatgtctcttgttacttctctctcctcgaaggcgggcgacctgaggataagttggaatttactttcaaactctatgacacggaccggaatggaatcctggattcttcagaggtcgataagattatcctgcagatgatgcgggtggctgagtag

SEQ ID NO: 114486 - DNA, 2208 bp, Artificial Sequence
  Description of Artificial Sequence: Synthetic coding sequence
atggcgaaggaacgtggccttatctcaccctctgatttcgctcagctgcagaaatatatggaatatagcaccaaaaaagtttccgacgtgttgaagttgttcgaggacggggagatggctaaatatgttcagggcgacgctattggatatgagggttttcaacagtttcttaagatctacctcgaagtcgacaatgtaccccgccacttatccctggctttgttccagagtttcgagacagggcattgtctgaacgagaccaatgttaccaaggacgtggtgtgcctcaacgatgtgagctgttatttctccctgctcgaagggggcagacccgaggataaactggaattcacattcaagctatacgatacagatagaaacggtatcttagattccagcgaggttgacaagatcatcctgcagatgatgcgcgtagcagagtatctggattgggatgtgtcagagctacgccccattctacaggaaatgatgaaggaaatcgattacgatggctcagggtctgtcagccaggctgagtgggtgcgcgccggtgcaaccaccgtgcctttactggtactgctgggactggaaatgaccctcaaggatgacggccaacatatgtggcgacccaagcgattcccaaggccggtgtactgtaacctttgcgaatctagcatcggtcttggtaaacaaggcctctcctgtaatctgtgcaaatatacggtacatgatcagtgcgcaatgaaagccctgccatgtgaggttagcacttatgctaagagtaggaaggacattggggtgcagtcccacgtgtgggttagaggcggctgcgagtccggccgatgtgatagatgccagaagaagatccgcatttatcacagtctgaccggcctccattgtgtctggtgccacctggaaatccatgacgattgcctgcaagctgtgggacacgagtgcgattgcggtttgctgagggatcatatacttccaccctcctcgatttacccatcagtcctggcctccgggccagaccgtaagaatagcaagacatcgcagaagaccatggatgatttgaacctttctactagtgaggccctacgaatcgatcctgtacccaatacccacccacttctggtcttcgtgaaccctaagtcaggcggtaaacaggggcagagggttctgtggaagtttcagtatatcttgaaccctcggcaggtcttcaatcttttaaaagacggcccggagattgggctgagattatttaaggatgtgccggacagccgcattctggtttgcgggggagacggaacagtagggtggatcctggagacaattgataaagcaaatctacctgtgctgccccccgtcgctgtactgccgctggggaccggaaatgacctcgccaggtgtctgagatggggcgggggatacgaagggcagaatctggccaagatcctcaaggatttggaaatgtctaaggtggtccatatggataggtggtccgtcgaagtaatccctcagcagaccgaggagaagagtgaccctgttcccttccagatcatcaacaattacttttcaattggtgtcgacgcatctatcgcccacagattccacataatgagagagaagtaccccgaaaagtttaacagccgcatgaaaaataagttgtggtactttgagttcgctacgtctgagtcaatcttctcaacgtgcaagaaactggaggagagcctgaccgtagagatctgtgggaaacctcttgatctatccaatttgagcctggaaggcatcgctgtgcttaatatcccgagcatgcatggggggtctaatctgtggggggacactaggcggccacacggggacatctatggcattaaccaggccttgggcgctacggctaaggttattacagacccagacatcctgaagacttgcgttcctgatctctccgataagcgccttgaggtggtcggcctagagggagccattgaaatgggtcagatttacacgaagcttaaaaatgcgggtcggcgcctcgccaagtgttccgagattaccttccacacaaccaaaaccctgcccatgcagattgacggggaaccctggatgcagaccccgtgtaccatcaagataacacacaaaaatcagatgcctatgctaatggggccaccgcctagatccactaatttttttgggttcctgtcctag

SEQ ID NO: 114487 - DNA, 402 bp, Artificial Sequence
  Description of Artificial Sequence: Synthetic coding sequence
atggcaaaggagagaggcttaattagtccctctgactttgctcagttgcaaaagtacatggaatactccacaaaaaaggtctccgatgtcctgaaactgttcgaggacggcgagatggctaagtacgtgcagggagatgctatagggtacgagggttttcaacagttcttgaagatctatctagaagttgataatgtcccccggcacttaagtttggctctattccagtcttttgaaactgggcattgtttaaatgaaaccaacgtgaccaaagatgtggtctgcttaaatgatgtcagctgttatttcagtttactggaaggcggtaggccggaggataaacttgagttcactttcaagctgtatgatacagaccggaacggtattcttgactcgagctag

SEQ ID NO: 114488 - DNA, 324 bp, Artificial Sequence
  Description of Artificial Sequence: Synthetic coding sequence
atggccaaagagaggggtctgatatccccaagtgatttcgcccaactgcagaaatatatggagtactccactaaaaaggtgtccgacgtcctcaagctgtttgaagatggagagatggcgaagtatgtccaaggcgacgctatcggatacgaaggatttcagcagttccttaagatttatttagaagtagacaacgtccccagacacttatccctggcactgttccaatcattcgaaaccggccactgtcttaatgaaactaatgtaacgaaggatgttgtttgcctgaacgatgtgagctgttacttttctctgctcgaatag

SEQ ID NO: 114489 - DNA, 135 bp, Artificial Sequence
  Description of Artificial Sequence: Synthetic coding sequence
atggcgaaggagcgtggattaatctcaccttccgattttgcccagctccaaaagtacatggaatactctacaaaaaaggtgtctgacgttctaaagctctttgaagatggggagatggcgaaatatgtacagtag

SEQ ID NO: 114490 - DNA, 135 bp, Artificial Sequence
  Description of Artificial Sequence: Synthetic coding sequence
atggcaaaggaacgcggcctgatttcacccagcgactttgcccagctccagaagtatatggaatacagcacaaaaaaggtgtccgacgtgctaaagttgtttgaagatggcgagatggctaagtacgtgcagtag

SEQ ID NO: 114491 - DNA, 402 bp, Artificial Sequence
  Description of Artificial Sequence: Synthetic coding sequence
atggccaaggagcggggcctcattagtcccagtgattttgcccaactccagaaatatatggaatacagcacaaagaaagtgagcgatgtgctcaagctattcgaagatggggagatggccaaatacgtgcagggagacgctatcggatacgaaggcttccaacaattcctgaagatatacctggaggttgacaatgtgccaagacacctgtcgcttgccttgtttcaatcttttgaaactggacactgtctgaacgaaactaacgtcacaaaggacgtagtgtgcctaaacgacgtatcttgctatttctcgctcctcgaaggcggcaggcccgaggacaagctggagtttacgtttaaactgtacgataccgatagaaacggtattcttgacagcagctag

SEQ ID NO: 114492 - DNA, 135 bp, Artificial Sequence
  Description of Artificial Sequence: Synthetic coding sequence
atggcgaaagaaagggggcttatctctcccagtgatttcgcgcagcttcagaagtacatggaatatagcaccaagaaggtgtccgatgtccttaaactttttgaggatggcgagatggccaaatacgtgcagtag

SEQ ID NO: 114493 - DNA, 2415 bp, Artificial Sequence
  Description of Artificial Sequence: Synthetic coding sequence
atgactaaccaggagaaatgggcccatttatccccttccgagttttcacagctacaaaaatatgcagagtacagcacgaagaaactgaaggacgttttagaggagttccatggcaacggggtgctagccaagtacaacccagagggcaagctggtcgtgctggggaacacaatagacttcgaggggtttaaactatttatgaaaacttttctggaggcagagttaccggatgactttacggcacacctgtttatgtcattctcaaataagttccctcactcctctcctatggttaaaagtaagcctgccctcctctctggaggtctacgtatgaacaagggcgccatcactccaccccggactacaagtcccgctaatacgtgtagccccgaggtgattcatcttaaggacatagtatgttacctctcactcctagaacgcgggcgtccagaggataagctagaattcatgttcaggctttatgatactgatggcaatggtttcctcgacagcagtgagctcgaaaatattatttctcaaatgatgcacgtcgccgaatatctcgaatgggacgtgacagagctgaatcccattctgcatgaaatgatggaggagatcgactacgaccatgacggaaccgtctccctcgaggagtggatacagggtggaatgaccactataccactgctagtcctcttaggcctcgagaataacgtcaaggacgacggacagcatgtgtggaggttgaaacatttcaacaaacccgcttattgtaacctgtgcctgaatatgctcattggcgtcgggaagcagggcctctgttgtagtttctgcaaatacacagtgcacgagcgttgcgtcgcacgagcccccccaagctgcatcaaaacttacgtcaaatcaaaacgcaacaccgacgtgatgcatcattactgggtcgaaggaaattgtcctaccaagtgtgacaagtgccacaaaaccgtgaagtgctaccagggtctaaccggactgcattgcgtatggtgtcaaataaccctgcataacaaatgcgcctcgcatttaaagcccgagtgtgactgtgggcccctgaaagatcatatactcccaccgaccaccatatgcccagtggtgcttcaaaccttaccaaccagcggcgttagtgtgccagaggagagacagtcaacggttaagaaagaaaagagcggttcccagcagcctaacaaggtaattgacaagaataagatgcagagagccaacagtgtgaccgtggatggacaaggattacaggtaacaccagtgcctggaacccaccccctcctggttttcgtgaaccctaagtccggaggcaagcagggagagcgtatctatagaaagtttcaatatctgttgaaccccaggcaggtctactctctgagcggcaacggaccaatgcccggcttgaacttctttcgggacgtgccggactttcgtgtgcttgcctgtgggggcgatggaacagttggctgggtcctggattgcatcgaaaaggctaacgtggggaagcatcctcctgtggctatactgccactcgggacaggtaatgacctggcccgatgtctgcgatggggcggtggctacgaaggcgagaacctgatgaaaatcctgaaagatatagagaacagcactgagattatgcttgatcggtggaaatttgaggttatacctaatgacaaagacgaaaagggtgacccggttccttactctatcattaacaactatttcagcataggagtggatgcttctatcgcacataggtttcatattatgagagaaaagcatccagagaagtttaactcccgcatgaagaataagttttggtatttcgagtttgggacctccgaaacattttctgccacttgcaaaaagctccacgagtcggtggagatcgagtgcgatggcgtccagatcgatctgatcaatatcagtctggagggcattgcgattctcaatatcccaagtatgcatggcggctcaaacctgtggggagagtctaaaaagaggcggtcacaccgaaggatagaaaagaaggggtcagacaagcgaacaacggtgactgatgcgaaggaactcaagttcgcctcccaagacttgtcagatcagttgttagaagtggtgggattagaaggtgcgatggaaatgggccagatctacaccgggctgaaatctgccggacggaggcttgcccaatgctcatgtgtcgttattcggacatccaaaagtctccccatgcagatagacggagagccatggatgcagaccccatgtactatcaaaattactcacaagaaccaggctccaatgctgatgggtccacctcccaagaccggacttttctgttccctggttaaacgcacccgtaacaggtctaaagagtag

SEQ ID NO: 114494 - DNA, 2415 bp, Artificial Sequence
  Description of Artificial Sequence: Synthetic coding sequence
atgacaaaccaggagaaatgggctcacctgagcccgagtgaattcagtcaacttcagaaatacgcagaatactccactaaaaagctgaaagatgtgctggaggaattccacggtaacggtgttcttgctaaatataaccccgagggcaaacaggacatcctgaatcagacgatagactttgagggttttaagctctttatgaagacctttctcgaggctgaactcccagatgacttcaccgcccatttgtttatgtcgtttagcaacaagttcccccactcttcacctatggtgaagagtaaaccagcgctgctgtccgggggcctaaggatgaataaaggggccataacgccccccaggactactagccccgccaatacatgcagcccagaggttattcacctgaaggatatagtatgctatctctctttattagaaaggggccgtcctgaagataagctggaatttatgtttcggttatacgatactgacggaaatggtttcctggacagcagcgagctggaaaacattatttcacagatgatgcacgtggccgagtacctagaatgggacgtgaccgagctgaaccccatccttcacgagatgatggaggagatcgattacgatcacgatggtaccgtttcactggaggagtggatccagggaggtatgacaacaatccccctgctggtattgctcggcctggagaacaatgtcaaagacgatgggcagcacgtgtggagattgaaacacttcaacaagcctgcatattgcaacctgtgtctcaatatgctgatcggggtggggaaacagggactctgttgttcattctgtaaatataccgtgcatgagcgctgtgtcgccagggcccccccaagctgcataaagacttacgttaaatccaagaggaataccgatgtgatgcaccactactgggtagaaggcaactgccccacgaaatgcgataagtgccataagacagttaaatgttaccagggccttacagggctacattgtgtctggtgtcagattaccctccacaataagtgcgctagccaccttaaacccgagtgtgattgcgggcccctcaaggaccacatccttccacctacaacaatttgccctgtcgtgctccagacgctgcccacctcaggagtgagcgtgcccgaggaacgccagtctaccgtgaagaaagaaaaatccgggtcccagcagccaaacaaagtaattgataagaataaaatgcagagggcaaatagcgtgacagtggatgggcaggggctccaggttactcctgttccagggacccaccccctcctggtgttcgtgaatcctaaatcaggaggtaaacaaggagagcgcatttatcgcaagtttcaatacctcttgaaccctcgtcaggtctacagtttatcaggcaatgggccgatgcccggcttgaactttttccgggacgtgcctgacttccgtgtgctcgcatgtggaggggacggcacagtgggatgggtgctggattgcattgagaaggctaacgtgggcaagcaccctcctgtggcaatcctcccattgggtactggaaatgacctagcgaggtgtctgcggtggggcgggggctacgagggggagaacctgatgaaaatcctcaaagacatagagaacagtactgagatcatgttggatcgctggaagtttgaggtgatacctaacgataaggatgagaagggagatccagtaccctacagtattattaacaactacttttctatcggggtggacgcaagcattgcacatcgctttcatatcatgcgggaaaagcacccggaaaaattcaatagccggatgaagaacaagttctggtattttgaatttggaacatcagaaaccttttctgccacctgcaagaaactccacgagtctgtggagattgaatgtgatggggtgcaaatcgatctgattaacatttccctggagggtatcgctattctaaatattcctagtatgcacggcggttctaacctgtggggagaaagtaagaagagacgttcccatcgacggattgagaaaaaaggcagcgataaacggacgacagtgacggatgcaaaggagctgaagttcgcatctcaggatctttcagatcagctactagaggtcgttggactagagggtgcgatggaaatgggccagatctacactggtctcaagtccgcaggcaggagattagctcagtgttcttgcgtggttattcggacttcaaagtccctgcctatgcagatcgacggagaaccatggatgcagacaccctgcactattaaaattactcacaagaaccaagccccgatgctcatgggaccaccaccaaagactggactattctgcagcttagtcaagaggacccgcaatcgctccaaggagtag

SEQ ID NO: 114495 - DNA, 2412 bp, Artificial Sequence
  Description of Artificial Sequence: Synthetic coding sequence
atgaccaatcaggagaaatgggctcacctctcgccttccgagttcagtcagctccaaaagtatgctgaatattctactaagaagctcaaggatgtcctcgaggagttccacggaaacggagtgctggctaaatacaatccagaggggaagcaggacatcttgaaccagacaattgattttgaggggtttaagctgtttatgaagaccttccttgaagctgaacttcctgatgatttcacggcacatttattcatgtctttttccaataaattccctcatagctctcccatggttaagtctaagccagcacttcttagcggaggcctccgaatgaacaaaggcgcgatcacaccacccaggactactagccccgctaacacctgcagcccggaggtcattcacctgaaagatattgtgtgctacctgtctcttctcgaacggggccgtccagaggataagttggagtttatgtttcgtctctacgacaccgatgggaacgggtttttggacagcagtgaacttgagaatatcatatcccagatgatgcacgtcgccgaataccttgagtgggacgttactgagctcaatcctatactgcacgagatgatggaggagattgattacgaccacgatggaaccgtgagtctggaggagtggatccagggaggcatgacaacaatccccttgctggtgctgctcggactggagaataacgtaaaagatgacggtcagcatgtctggagactgaagcactttaataaacccgcttactgtaatttatgtctcaacatgcttattggtgtcggcaaacagggcctgtgctgcagcttctgtaagtataccgtccacgagcgctgcgtggcccgcgcccctcccagctgcatcaaaacttatgtcaagagcaagcgtaatacggatgtaatgcaccattactgggtggaaggcaactgtccgacaaagtgtgacaaatgtcataaaactgtgaaatgctaccagggtctgactggcctccactgcgtgtggtgtcaaataactttacataataaatgtgcctcacatctaaagcccgaatgcgattgtggcccacttaaggaccatatcctcccccctaccaccatctgtcccgtagtcttgacgttacccacgtccggagttagtgtgcctgaggagaggcaatcgacggtgaagaaagagaaatccggcagccaacaaccgaataaggtcattgataaaaacaaaatgcagagagcgaattctgtgaccgtggatggccagggcctgcaggtgaccccagtgccagggacccatccacttctggtgttcgttaacccgaaatcaggcggcaaacagggggaacgcatctacagaaagttccaatacttactgaacccgcgacaggtgtattccctctctggtaacggtccgatgcctggcctgaatttttttcgtgacgttcccgacttccgggttctggcatgtggaggcgacggcacggtgggctgggtgctggattgcatcgagaaagctaatgtggggaagcacccgccagtcgctatcctcccattgggtaccggcaatgacctcgccagatgtctgcgctggggcgggggctatgaaggggaaaaccttatgaaaattctgaaggatattgaaaatagcactgaaattatgctcgatcggtggaaattcgaagtaatccccaatgataaagacgaaaagggcgacccagtgccttatagtatcatcaacaattatttcagtattggggtggatgccagtattgctcatcgattccacatcatgcgcgagaagcatcccgaaaagttcaacagcagaatgaaaaacaaattttggtacttcgagttcggaacatcagagactttttctgccacctgcaagaagctgcacgaaagcgtggagattgagtgtgacggggttcagatcgacctgatcaatatctcccttgaaggcattgcaattctcaatatcccgtcaatgcacggagggtcaaacctctggggcgagagcaaaaaaagaaggtcacatcgccggattgagaaaaaaggctcagataagagaacaacagtgacagacgcgaaagaactgaaatttgcttcccaggacctgagcgatcaactgctagaagtggtcggactggaaggcgctatggaaatggggcagatctacaccggtctgaagtccgccgggcggaggctggcacagtgttcctgcgtggtgattagaaccagtaagagcttgcccatgcagattgatggcgaaccttggatgcagaccccttgcacaattaagatcacgcataagaaccaggcacccatgcttatgggccctcctccaaaaacaggccttttttgctcgttagtcaaacgcactcgtaatcgcagcaaggagtag

SEQ ID NO: 114496 - DNA, 2415 bp, Artificial Sequence
  Description of Artificial Sequence: Synthetic coding sequence
atgacgaaccaagaaaagtgggctcatctgtctccctcagaatttagccagctgcagaaatacgctgaatattccaccaagaaactgaaggatgtcctggaggagttccatggaaatggagttttagccaagtataatcctgaagggaagcaggatattctgaatcagacaattgactttgagggattcaagttgtttatgaagacatttctggaggcagagttaccagacgattttactgcacacctgtttatgagtttcagcaataagttcccccactccagccccatggtgaagtcaaagcccgcactgctgagtgggggcttaaggatgaataagggcgccataacacctcctcgtaccactagcccggcaaatacatgctcacccgaagtgatacaccttaaagacattgtctgttacttgagtctgctcgagaggggcagacctgaagataaacttgagtttatgtttagactttatgataccgatgggaacggattcctggactcttctgaattggagaatatcatttctcaaatgatgcatgttgccgagtacctggagtgggatgtgaccgagcttaacccaatcctccacgaaatgatggaagagatagactacgaccacgacgggactgtgagtctggaggagtggatccagggcggaatgacaacaattcccctactggttctcctgggcttggagaacaatgtgaaagacgatggtcagcacgtgtggcgactgaagcatttcaacaaaccagcatactgcaacctgtgcctgaacatgctaatcggggtgggtaaacagggtctctgttgctcattctgtaagtacactgtgcatgaaagatgtgtggcgagggcacccccgagctgtataaaaacctatgtaaagagcaaaagaaatacagacgtgatgcaccattattgggtggaggggaattgtcccactaagtgtgacaagtgccataagacagtgaaatgttaccagggcctcacggggctccattgtgtatggtgtcagattacactgcacaacaaatgcgcttctcacctgaaacccgagtgtgattgcggacctctcaaagatcatatccttcctcctaccaccatctgccccgtggtgctgcagactctgccgacatcgggcgtaagtgtgccggaagaaagacagtccaccgtgaaaaaagaaaagagcgggtcccagcaacccaacaaagtcatcgataagaacaaaatgcagagggcaaactctgtgactgttgacggtcaaggcctacaggtgaccccagtacccggcacgcacccattactcgttttcgttaatccaaagtcgggcgggaagcagggggagaggatttataggaaatttcaatacttgctcaatcctaggcaggtctactctctgtcaggtaatggccccatgcctggcctcaattttttccgagatgtgccagatttccgggttcttgcatgcggaggagacggtacggttggttgggtcctcgactgcattgagaaagccaacgtggggaaacacccaccggtcgccattctccctttaggaactggcaacgacctggcacgttgcttgcggtgggggggtggttatgagggagaaaacctcatgaagatactgaaggatattgagaattcaacagagattatgctggacaggtggaaattcgaggtgatccccaacgacaaggatgaaaaaggagacccagtgccttacagcatcatcaataactacttctctatcggggtggatgccagcattgctcatcgcttccacattatgcgagaaaagcatcccgagaaatttaacagtcgcatgaagaacaagttctggtattttgagtttggcacatctgagacattctccgctacatgcaaaaagttgcacgagtcggtggagatagagtgcgacggggtacagatcgacttgatcaatatttccctggagggaattgctattctgaatatcccgagtatgcacggaggctccaacctctggggagagtccaagaaacgccggagtcaccgtaggatcgagaagaagggatccgataagaggacgacagtcacagacgccaaagaactcaagtttgccagccaggacctgtcagatcagttactggaggttgtcggtctggaaggggccatggagatgggccagatatacacaggactcaaaagtgccgggagaagactggcccagtgctcctgtgtggtgattaggacttccaaatcactccccatgcagatagacggggagccatggatgcagaccccatgtacaattaagattacccacaagaatcaggcccctatgttaatggggccacctcccaaaaccggcctgttttgcagcctggtcaaaaggactcgcaaccggtcgaaggaatag

SEQ ID NO: 114497 - DNA, 2322 bp, Artificial Sequence
  Description of Artificial Sequence: Synthetic coding sequence
atgacaaaccaggaaaagtgggcgcatttgtcaccaagcgaattcagtcaactgcagaagtacgctgaatacagtacgaaaaagctgaaagatgtgctggaagaattccatggaaacggggtgctggctaagtacaaccctgaaggtaaacaggacattctgaaccagacgatagacttcgaaggatttaagctgttcatgaagacctttctggaggccgaactgcccgacgacttcaccgcgcatctgttcatgagcttttcaaacaaattccctcactcatctcctatggtgaaaagcaagcctgctctcctgtcaggaggtctgcgtatgaacaagggcgctatcaccccccctagaaccacatctccggcaaatacctgtagtcctgaggtgattcatctcaaggacatcgtctgttatttaagtctgctcgaaaggggtaggcccgaggacaagctggagttcatgttccgcctttacgacactgacggcaatggctttctggattcatctgagctggaaaatattatatctcagatgatgcacgttgccgaatatcttgaatgggacgtcaccgagctcaacccaattctccatgaaatgatggaagaaatcgactatgaccacgacggaacagtgagcttggaggaatggatacagggaggcatgacaactatcccgttgcttgtcctgcttggcctcgaaaataatgttaaggatgacgggcagcatgtttggcgacttaagcactttaataaaccagcttattgcaatctgtgtctcaacatgcttatcggcgtgggcaaacaggggctctgttgcagcttctgtaagtatacagttcacgaacggtgtgtggcccgtgcccccccttcctgtataaagacctatgtgaaaagcaagaggaacacggatgtgatgcatcactattgggtcgagggcaactgtcctaccaagtgtgacaagtgccacaagaccgtgaaatgttatcaggggctgactggactgcactgcgtgtggtgccagatcaccctgcacaacaagtgcgcttcccatcttaaaccagagtgtgattgtggtccacttaaggaccacattcttcctcccactacgatttgtccagtggttctccaaacccttccaacctctggggtgtccgtgcccgaggagcggcaatccacagttaagaaagaaaaatctggcagtcaacagccaaataaggtgatcgacaagaataagatgcaaagagccaattccgttacagtagacggccagggactgcaggtgacgcctgttcccggcactcatccactactggtgttcgttaacccaaaatctggggggaaacagggagaacgaatttataggaaattccagtacttactcaaccctcgccaggtttattcattgagtggtaatggcccaatgcctggtctaaacttcttcagggatgtccctgacttcagagtactggcctgcgggggcgatggtacggtgggctgggttctagattgcatcgagaaggccaacgtggggaaacatcctcccgtggcgatcctccccttagggaccggcaacgacctggctagatgcttgcggtgggggggaggttacgaaggcgaaaatctgatgaagatcctgaaggacatcgaaaatagcacagagatcatgttagacaggtggaagttcgaggtaatcccaaatgataaagacgagaaaggggaccccgtcccatactctattataaacaattatttttccatcggagttgatgcctctatcgctcatcgcttccacatcatgagagagaagcatcctgagaagttcaatagtcgcatgaaaaataaattctggtacttcgagttcggtacatcagagaccttctcagcaacctgcaaaaagctgcacgagtctgtggaaatcgagtgtgacggcgttcagattgatttaatcaatatctcactcgaaggcatcgccattctcaatattcccagcatgcacggcggctcgaacctctggggtgagtcaaaaaaacgaagaagtcacaggcggatcgagaaaaagggatcagacaaacggacgactgtcacggatgctaaagagcttaaattcgcaagccaggatttatcggatcagctcttagaagtcgtgggcctcgaaggggccatggagatgggccagatatacactggactgaaaagcgccgggcggcgtctggcacagtgttcgtgtgttgttatccgcactagtaaaagcctgccgatgcagattgatggggagccgtggatgcagactccgtgcacagtctccaccgagtag

SEQ ID NO: 114498 - DNA, 2391 bp, Artificial Sequence
  Description of Artificial Sequence: Synthetic coding sequence
atgacgaaccaggaaaaatgggcgcatctgtcaccatccgaattctcccagcttcagaaatatgccgagtattctactaaaaagctcaaggacgtgcttgaggagttccatggtaatggcgttctcgctaagtataaccccgagggcaccatcgactttgaaggatttaagctgttcatgaagacattcctagaggccgagctgccggatgactttacggcccatctgttcatgtcattctctaacaagtttccccactcttctcccatggtgaaatcaaagcccgccctgctctcaggggggctccgcatgaacaagggcgccattactcccccacggactacaagtccagctaatacttgttccccggaggtgatccacctgaaagacatagtctgctatttgagcctccttgagcggggtagaccagaagacaaattggaattcatgtttaggttgtacgatacagatgggaatggcttcttagattcttccgagctcgagaatattattagccagatgatgcacgtagctgagtatctcgaatgggacgttaccgagcttaacccaatcctgcatgaaatgatggaggaaattgattacgaccatgatggaaccgtatcactggaggagtggatccagggtggaatgacaactatccccctccttgtgctgctgggtctagagaacaacgtcaaggacgacggccaacacgtgtggcgcctgaaacactttaataaacccgcatattgcaacttgtgtcttaacatgctgattggagttggcaaacagggtctgtgctgtagcttctgtaagtacacagttcacgaacgatgtgttgcccgcgccccccctagctgtataaagacttatgtcaagagcaagaggaataccgacgtgatgcatcactattgggtggaggggaactgccccaccaaatgcgataaatgccacaagaccgtcaagtgctaccaggggttaactggcctgcactgtgtatggtgtcagattacccttcacaacaagtgcgccagccacctgaagcctgaatgcgactgcggccctctgaaagatcacatcttaccacctaccaccatatgccctgtggtccttacactccctacctccggcgttagtgtgccagaggagaggcagtcaacagtgaaaaaggagaagtcagggtctcagcaacccaacaaggttattgacaaaaataagatgcagagagcgaatagcgttacagtcgatggacaggggctccaagtcacccctgtgcccgggacccatccactgttggtgttcgtcaatcctaagtccggaggcaaacagggggagagaatctacagaaaattccagtacctccttaacccccggcaagtgtactccctgtctggtaatggcccaatgcctgggctgaacttttttagagatgtgccggactttagggtgttggcctgtgggggagatgggacagtcgggtgggttctcgattgtatagagaaggcgaatgttggaaaacaccctcccgtcgctatacttcctctagggactggtaatgatctggcccggtgcctcagatggggggggggatacgagggcgaaaatcttatgaagatcctgaaggacatcgaaaattcaaccgagatcatgttagatcgatggaagtttgaggtaatcccgaacgataaggatgaaaagggtgaccccgtgccttactctataattaacaattacttcagcatcggagtcgatgcaagcatcgcccatcgttttcatattatgcgagagaaacatcctgagaaattcaattctcgcatgaagaataaattttggtacttcgagttcggcacttccgagactttttccgctacttgtaagaaactgcatgaatccgtcgaaatcgaatgcgacggcgtccaaattgacttgataaacatttcacttgaggggatagccattctgaacataccctcgatgcacgggggatccaatctgtggggtgagtctaagaaaaggaggagtcacagacggatcgaaaagaagggaagcgataagagaactacagtgactgacgccaaagagctaaaatttgcatcccaagatctctccgatcagctccttgaggttgtgggtctcgagggggccatggagatggggcagatctacaccggccttaagtcggccggcaggagattagcacagtgtagctgcgtagtcattaggacgtctaagtctctgccgatgcagattgacggagaaccctggatgcaaaccccatgtaccataaagattactcacaagaaccaagcccccatgctgatggggccaccaccaaaaacaggcctcttttgttctctggtgaaacgcacccggaatagatccaaggaatag

SEQ ID NO: 114499 - DNA, 228 bp, Artificial Sequence
  Description of Artificial Sequence: Synthetic coding sequence
atgaccaatcaggagaagtgggcccatcttagtccgtcagagttttcccagctgcagaaatacgctgagtactcgactaaaaaactgaaagacgtgctggaggagttccatgggaacggggtgttggccaaatacaatccagagggcaagcaggatattctgaatcagactatcgatttcgagggctttaagctgtttatgaagacctttctggaagcagagttgtag

SEQ ID NO: 114500 - DNA, 2358 bp, Artificial Sequence
  Description of Artificial Sequence: Synthetic coding sequence
atgacaaaccaagagaaatgggctcatctgtcaccgtctgaattcagtcaactgcaaaagtatgctgagtactcaacaaaaaaactgaaagatgtactggaggaattccacggcaatggagtgttggcaaagtacaatcctgaaggcacaatcgatttcgagggatttaagctgttcatgaagacctttctggaagcggagcttcccgatgacttcactgcccatctgtttatgtctttttccaacaaattcccgcacagcagtcccatggtgaaatccaagcccgctcttctgagtgggggactaaggatgaataaaggggcaatcacgccacctcgtaccacgtcgcccgccaacacctgttcccctgaagttattcacctgaaggacatagtgtgttacctatccctccttgagcggggccggcccgaggacaagctggaatttatgtttcggttgtacgacactgacggaaatggatttctggactcttcggaattagaaaacatcatatcccagatgatgcatgtagctgaatacctggaatgggacgtgactgaactgaaccctatcctgcacgaaatgatggaagagatcgactacgaccacgatggaaccgtgtctctggaggaatggattcagggcgggatgacgacaatcccgctcctcgtgctcctgggattggaaaacaacgtgaaggatgatggccagcatgtctggcgattaaaacatttcaataagcccgcgtactgtaatttgtgcctgaatatgctgattggcgtggggaagcaggggctttgttgtagcttttgcaagtatacagtccacgagcggtgcgtagccagagcccctccatcctgcatcaagacctacgtgaaatctaaacggaacaccgacgtaatgcaccactactgggttgagggaaattgccccactaaatgcgataagtgccacaaaactgttaagtgctaccaggggctgacaggacttcattgtgtgtggtgccagatcacactccataacaaatgtgccagtcacctgaagccggagtgtgattgcggccccctcaaagatcacattctgccccccactaccatatgtcccgtcgtgcttgagcgccaatcaaccgtgaagaaggaaaagtcgggatcccaacagcctaacaaggtcatagacaaaaacaagatgcagcgagcaaattccgttacggtggatggacaagggctgcaggttactcctgtgcccggaacgcatcctctgctggtcttcgtcaatcccaagtctgggggcaagcagggggaacgtatctataggaagtttcagtacctgctcaatcctcgccaggtctatagcctgtctggcaatggccccatgcctggcctgaacttctttagggacgtccctgacttccgcgtactggcatgcgggggcgatgggactgtcgggtgggtgctggattgtatagagaaagcaaacgtaggcaagcaccccccagtggcaatcctccccctgggaacaggcaatgacctggctcgatgcctgcggtggggaggggggtacgaaggagagaacctgatgaagattttaaaagacatcgaaaattccacggagatcatgctggacaggtggaaattcgaagtgatcccgaatgataaagacgagaaaggtgacccggtgccgtattctattataaataattacttctctattggcgttgacgcaagcatcgcccacaggttccacattatgagggagaaacaccctgagaagttcaatagcaggatgaaaaataagttctggtatttcgaatttgggacctccgagacgttcagcgctacatgcaagaagttacatgagtcggtggagattgaatgtgacggtgtccagatagacctgatcaatattagcctggagggcatcgccattctgaatatcccatccatgcacggcgggagtaatctctggggtgagagcaaaaaaagacggtcgcatcgacgtatcgagaagaagggcagcgacaagcgtactacggttactgatgcaaaggagctgaaatttgcgtcacaagatctttccgaccagcttctggaggtagtaggtctggagggggcaatggagatggggcaaatatacacagggctcaaatccgccgggaggcgactggcacaatgctcctgcgtggttattcgaacgagcaagtccctgccaatgcaaattgatggtgaaccctggatgcagactccttgcaccatcaaaattacccacaaaaaccaggcccccatgctgatggggcctcccccaaaaactgggctgttttgctcgctggtcaaacgtacaaggaaccggtcaaaggaatag

SEQ ID NO: 114501 - DNA, 3645 bp, Artificial Sequence
  Description of Artificial Sequence: Synthetic coding sequence
atggccgcagctgccggcgccccacctcccggacccccccagccaccaccgcctccaccacctgaagagtcttcggattctgagccagaagcggagccagggagcccacaaaagcttatccggaaggtttccacctcaggacagatccgccaaaagacgataatcaaggagggtatgttgaccaagcaaaataattccttccagcgatctaaaagaagatatttcaagctgcgcggccgcactctctactacgcaaagacggcgaaatcgatcatatttgacgaggtagacctgacggacgcttccgtagcagaatcctctacgaagaatgtcaacaactctttcaccgtcatcacgccttgccggaaactgatactttgtgccgacaaccgcaaagaaatggaggactggatcgcagccctgaagacagtccaaaatcgcgaacatttcgagcctacccagtacagtatggaccattttagtggcatgcacaactggtatgcatgtagccacgctcggccaacatattgtaacgtgtgcagagaagctctgagcggagtgacaagccacgggctgagctgtgaggtttgcaaattcaaggcccacaagcgatgcgctgtgcgggcaaccaataactgcaagtggacaacactagcctctattggcaaggacattattgaggatgccgatggaatagccatgccacaccagtggctggaagggaatttgcctgtttccgccaaatgcactgtgtgcgataagacttgtgggagcgtgctaaggcttcaagattggcgatgtctttggtgcaaggccatggttcacacgagttgcaaagaaagtctgctaacaaaatgcccgctgggtttgtgtaaagtgagtgttatcccccctaccgcgctgaatagtatcgattccgatgggttttggaaggccagctgtcccccatcttgtaccagccctctgctggtctttgtcaactcgaaatctggcgacaaccaaggcgtgaaatttttacgccggttcaagcaactgttgaatccggctcaggtgttcgatctgatgaatggtgggccgcatctcggcctaaggctcttccagaagtttgatacattcaggatactggtgtgtggcggtgatggtagtgtggggtgggtactgtccgaaattgattctttgaacctgcacaagcaatgccagctaggcgtgctgccgctcggaacggggaacgacctggctagagttcttggctggggaagtgcatgtgacgatgatacacaactgccccagatattagaaaagctggaacgagcctccaccaaaatgctcgaccggtggtcagtaatggcatacgaagctaaactgccacgacaggctagctcttccaccgtcaccgaagacttttccgaggacagcgaagttcagcagatcctgttctacgaagactcagtggcagcccatctcagcaagatcttgacttctgatcagcatagcgtggtgatttcctctgccaaggtgctgtgcgagacagtaaaggactttgtcgccagggtggggaaagcctatgagaagaccaccgaaagctctgaagagtccgaagtcatggccaaaaagtgtagtgtgcttaaggaaaagctggatagtctgttaaaaactctggacgacgagagccaggcttcatcaagcctccccaatccaccaccaacgattgctgaggaagccgaggatggagacggctctggttcgatttgtggttccacgggggatagacttgtggcctcagcgtgcccagctagaccccagatttttaggccacgggagcaattgatgctccgggcgaattctctgaagaaggccattagacaaattatagaacatactgaaaaggccgtcgatgaacagaacgcccaaacacaggagcaggagggcttcgtgctcggcttgtccgagtccgaggaaaagatggatcaccgcgtgtgccccccactatcacactcagagagctttggggtgcccaagggcagatcgcaaaggaaagtaagcaaatctccttgtgaaaagctcatttcaaaaggatcccttagcctcggcagctcagcttcattgcctccacagccaggctcccgggatgggcttcctgccctgaacacaaaaatcctgtaccctaatgtccgcgccggcatgtccgggtcgctgccaggagggtccgtcatatcacgcctcctgattaacgcagatcctttcaactctgaacccgaaaccctcgagtactacaccgagaaatgcgtgatgaacaactactttggcatcggcttagacgcaaagatatcccttgatttcaataataaaagggacgaacatccagaaaagtgtagaagcaggacaaaaaatatgatgtggtatggcgtgctgggcacaaaagaacttcttcaccgaacttacaagaacctagagcagaaagtgctgctggagtgtgatggtcggccaatccccctgccctccctccagggcatagctgtgcttaatatccctagctacgccggcggtaccaacttctggggtggtactaaagaggacgatacctttgccgccccaagtttcgatgacaagattctggaagtcgtggctgtatttggtagtatgcagatggcagtgagccgggtgatcagattacagcaccaccgtatagcccagtgtaggaccgtcaagatttctattctgggcgacgaaggggtacccgtgcaggtggatggagaggcatgggtgcagccaccagggtacatcagaatcgtgcacaagaacagggcacaaaccctcacacgcgatagagcttttgagagtaccctaaagtcatgggaagataagcagaagtgtgaacttcctaggcccccgtcatgcagcctgcacccagagatgctgtctgaagaggaagcaacccagatggaccagtttggacaggcggccggggtactgatccactccattcgcgaaattgctcagtcgcaccgagatatggagcaagaactggcccacgccgtcaatgcctctagcaagtccatggacagagtgtacggtaaacctcggacaacagaggggctaaactgctcgttcgtcctggagatggtgaataatttcagagctctccggagtgagacagaattgctcctgagcggtaagatggcactgcaactagacccaccccagaaagagcagctgggatcagccctggccgagatggaccgccaactgcgccgcctggctgatacaccctggctgtgtcagtccgccgaaccgggagacgaggagtcagtgatgttagatctggcgaagcgctcgcgcagcggcaagttcaggctagtaaccaaattcaaaaaagagaagaacaacaagaataaggaggcccacagtagtctcggggctcctgtacacctgtggggaaccgaagaggtggcggcctggctcgagcacttatccctgtgcgagtataaggatatttttacaagacacgacatcagggggagcgaactgctccacctggagcggagggacctcaaagacttaggtgtgacaaaggtaggacatatgaaaagaatactttgcgggattaaggaactgtcacggtctgccccagctgtcgaagcctag

SEQ ID NO: 114502 - DNA, 3513 bp, Artificial Sequence
  Description of Artificial Sequence: Synthetic coding sequence
atgaacatgtttctttattttcagaccatcataaaggaagggatgctgaccaagcagaataatagttttcagaggtctaaacgacgctatttcaagctgcgtgggaggacattatactacgcaaagaccgctaaatccattatcttcgatgaagtcgatcttactgacgcaagcgtcgcggaatcaagcacaaagaatgtaaataattcctttactgttattactccgtgtaggaagctaattctctgtgctgacaacaggaaggagatggaggactggatcgcggcgctgaaaacagttcaaaatcgcgagcattttgagcctacacagtatagcatggatcatttttccggcatgcacaactggtacgcctgtagtcacgctcggcccacttactgtaatgtatgcagggaggctctgtcaggggtgacctcccatggcctgtcctgtgaggtctgtaaatttaaggcccacaagcgctgcgccgtgagagccaccaacaattgcaagtggactacgttggcgtcgatcggcaaggacattatagaggatgcggatggtattgcaatgccccaccagtggttggaagggaacttgcccgtgtcggcaaaatgcacggtctgtgataaaacttgtggatccgtgctgcggcttcaggactggcgctgcctatggtgcaaagccatggtgcacacttcctgcaaggaatcgctccttacgaagtgccctttaggcctgtgcaaagttagtgtaatcccccctacggccttgaactctatcgattccgacggcttctggaaggcaagctgtccgccaagttgtacttctcccctgttagtatttgtaaacagcaagtccggcgataatcagggagtaaagttcctccggcgtttcaagcagctgttgaaccctgcccaggtgtttgatttgatgaatggcggaccccatttaggcttaagactgttccagaagtttgataccttccgcattttggtttgtggaggggatggctcagtcggctgggtgctgtctgagatcgacagtctcaacttacataaacagtgtcagctgggcgtgctccctctcggaactggtaacgacctggctcgtgtcctggggtggggctccgcttgtgacgacgatacccagttgccccaaatccttgagaagcttgaacgggcctcaactaaaatgttggaccgttggagcgtcatggcatacgaagcaaagctgcctaggcaagccagtagtagcaccgtaactgaggacttcagcgaggattccgaggtccagcaaatcctgttttacgaagattccgtggccgcacacctgtctaaaatcttgacgtcagaccagcatagtgtggttatttcctctgctaaggtcctgtgtgagacagtgaaagatttcgtggctcgagttggaaaggcgtatgagaagactactgaatcatctgaggagagtgaagtgatggctaaaaagtgctcagtactgaaagagaaactggattctttattgaagacgttggatgacgagtctcaggcaagctcctccctcccgaatccgcctcctaccatcgctgaagaggcagaggatggggatggctcaggctccatctgtggatccaccggggatcgtttggttgcgtccgcttgtcctgcacgccctcagatattcaggcctagagaacagcttatgcttcgcgccaattctctaaagaaggctatacggcaaattattgagcacacagaaaaagccgtggacgaacagaatgcccagactcaagagcaggaaggcttcgtcctgggactgagcgagtccgaagaaaagatggatcacagagtgtgtcctcccctgagtcattctgaaagtttcggcgttcccaaaggcagaagtcaaagaaaggtgagcaagtccccctgtgaaaagctgattagcaagggatcattgtctctggggtcctccgccagcctgccgccccagcccggcagtagagacgggttacccgcactgaacacaaaaatcctctatcctaatgtcagggccgggatgagtggaagtttgccgggcggctccgttatcagcaggcttctgattaatgccgatccattcaacagcgagcccgaaactttagaatattacaccgagaagtgcgtcatgaataattatttcggcatcggactggatgcaaaaatctctttagatttcaacaacaaacgcgacgaacacccagaaaagtgtcgttctcggacaaaaaacatgatgtggtacggggtgcttggcacaaaggaacttctgcaccggacttacaaaaatctagagcagaaggtgttactcgagtgtgatggaaggcccataccacttcctagcctccagggtatcgcagttttgaatattcctagttacgctgggggcaccaacttctggggaggcacaaaggaggatgacaccttcgcagctccttccttcgacgacaagatcttggaagttgtcgccgttttcggctccatgcagatggcagtttcaagggtgatcaggctccagcaccaccgtatcgcacagtgccgtacggttaaaatttccattttaggtgacgagggagtgcctgtgcaggtggatggtgaggcgtgggtgcagcccccaggctacattcgcattgtgcacaagaatcgagctcaaactctcactagagaccgggccttcgaatccaccctgaagagttgggaggacaagcagaaatgcgagttgcctcgtcccccatcttgctccctgcaccctgaaatgctaagcgaggaggaggcgacacagatggaccagtttgggcaagctgcgggagtgttgatccactcaatcagagagatcgcccagtcccatcgcgacatggaacaagagctggctcacgcagtgaacgccagcagtaaatcaatggatcgagtgtacggtaaaccgagaactacagaaggcctgaattgcagtttcgtgttggaaatggtgaataactttcgagcgctgcggtccgagactgagctcctactgtctggaaaaatggcactgcaattggatccccctcagaaagaacagcttggctccgcactcgcagaaatggaccgccagcttcggcgcctcgcagacacaccatggctgtgccaaagcgcggagcccggggacgaagagagtgtcatgttggatcttgctaaaaggagccggagcggaaagttccgactagtgaccaagttcaagaaggagaaaaacaacaaaaacaaggaagcacactcaagcctaggcgcaccagtgcatctgtggggcacggaggaagtggcagcctggcttgaacatctgtccctgtgcgagtataaagatatcttcacgcggcacgatatacgaggtagcgaactgttacacctggagagaagggacctgaaagatctgggagtgacaaaagttgggcatatgaagagaatcctgtgcggtatcaaagagctgtcccggtcagcccctgctgtggaagcttag

SEQ ID NO: 114503 - DNA, 1704 bp, Artificial Sequence
  Description of Artificial Sequence: Synthetic coding sequence
atggaggccgagagaaggcccgcccccggctcaccgagtgagggtctgttcgcggacggacatcttatcctctggacattatgctctgtactgctccccgtgttcatcaccttctggtgttcgctacagcgatcaaggcgccagctgcatcggcgcgacatttttcggaagtctaagcacggctggagagatacggacctgttttctcagcctacttattgttgcgtttgcgcccaacacatcttgcagggagccttctgcgattgctgcggactgagagtcgatgagggctgtctgagaaaggcagataaaagattccaatgcaaagaaattatgctgaagaatgatactaaagtgctggacgctatgccacatcactggatacgcggcaatgttcccctgtgctcttattgtatggtctgcaaacagcagtgtggatgtcaacctaaattatgcgattaccgatgcatctggtgccagaagactgtgcatgacgagtgtatgaaaaacagtctcaaaaacgaaaagtgcgactttggcgagtttaagaatctgattatccccccaagctatctgacttctatcaaccagatgcgcaaagacaagaaaacagactatgaagtgctagcctcgaagctaggcaagcagtggacccccctgattatattggctaactctaggagcgggacgaacatgggagaaggactgttaggtgaatttcgtatccttcttaatcccgtgcaggtcttcgacgtgaccaagacacctccaatcaaggccctgcagctctgtaccttgttaccatactactccgctcgcgtgctggtgtgcggaggagatgggaccgtgggttgggttctggatgccgtagacgacatgaagattaaaggccaagagaagtacattccacaagtcgccgttctgcctctgggtaccggcaacgacctgagtaacactttgggatggggcactggttacgccggcgagattccagtagcacaggtactcagaaatgtgatggaagccgacggtatcaagttggaccgctggaaggtgcaggttaccaataaagggtattacaatctgagaaaaccgaaagaattcaccatgaataactatttctccgtgggaccagacgcactcatggccctcaatttccatgctcaccgggagaaagccccctcccttttttcgagccggattctgaacaaggccgtttacctgttttatgggaccaaggactgcctggtgcaggagtgtaaagatctcaataagaaggtggagctcgagctcgacggagagcgagtggccttgccctccctggaggggatcatcgtgctaaacattggttactggggaggggggtgtcgattgtgggagggaatgggtgatgagacttatccattggcccggcacgacgacggactgttagaggttgtcggcgtctatggctcctttcactgtgcccaaattcaggtcaagctggcaaacccttttcggatcggtcaggctcacacagtcaggctgatccttaagtgttccatgatgccaatgcaggttgatggtgagccatgggctcaggggccatgcacagtgactataacccataaaactcacgcgatgatgttgtatttttccggggagcagaccgacgatgatatctccagtacaagtgatcaagaggacatcaaggctacagaatag

SEQ ID NO: 114504 - DNA, 2376 bp, Artificial Sequence
  Description of Artificial Sequence: Synthetic coding sequence
atgggagaggagaggtgggtgtcactgactccagaggagttcgaccagctgcaaaagtatagtgaatattcttctaaaaaaatcaaggacgctcttacggagttcaacgaaggggggagcctaaaacagtatgatccccatgagccaattagctacgacgtttttaaactgttcatgcgcgcctacctggaggtcgatctgcctcagcccttgagcacccacctgttcttagctttctcacaaaaaccaaggcatgaaacaagcgatcaccctactgaaggtgcttcaaacagtgaggccaatagcgctgataccaatatccagaatgctgataatgcgaccaaggccgacgaggcctgcgcccccgatactgagtctaacatggctgagaaacaggccccggcagaggatcaggtagctgccacgccattggagcctcctgttcctcgttctagttccagtgaatcaccggtcgtatatctcaaggatgtggtctgctatctctcactcctcgagactggacggccccaagacaagctagaattcatgtttagactgtatgacagtgatgagaatggcctgttagaccaagctgagatggattgcattgtcaatcaaatgctgcacatagcacagtacctagagtgggacccgaccgagttgcggccgatcctgaaagagatgctccaaggaatggactatgatcgggacggctttgtaagtttgcaggagtgggtgcatgggggaatgacgactattccacttctggttctcttgggaatggatgacagcggttccaaaggcgatgggagacatgcttggacaatgaaacattttaaaaaacccacctattgcaatttctgtcacataatgcttatgggggttaggaaacaaggcctatgctgcacctattgtaaatacactgtgcacgaaagatgtgtgtcacggaacattccaggttgcgtgaaaacgtacagcaaagccaagaggtccggtgaagtgatgcagcacgcttgggtcgaaggaaactcaagcgtgaagtgcgataggtgtcataagagcataaagtgttatcagagtgtaactgcaaggcactgtgtctggtgtaggatgacattccaccgtaagtgcgaactaagcactctctgcgacggaggtgaactgcgagatcacattctgttgcctacctccatctgcccgattactcgcgaccggcctggggaaaaaagcgacgggtgcgtcagcgctaagggcgaattagtgatgcagtacaaaattattcctacacccggcacgcatccactgctcgtgctcgtgaaccctaaatcaggggggagacagggggagcggatcctgcgaaagtttcactacctgctcaatccaaagcaggttttcaacttagataacggtggacccacacccgggctgaatttcttccgtgacactcctgatttccgcgtccttgcttgcgggggggatgggaccgtggggtggatactcgactgcattgacaaagccaacttcgctaagcacccccccgtggccgttctgcctcttggaactggaaatgacctcgcacggtgtctgcgttggggcggcgggtacgagggcggaagcctaacgaagattctgaaggacatcgaacagagtccattagtaatgctagatcgctggcaccttgaggtgataccaagagaggaggtagagaatggtgatcaggtcccatattctatcatgaacaactatttctctattggagtggacgccagtatagcacacaggttccacgtcatgagagaaaaacatccagagaagtttaattctcggatgaaaaataagctgtggtactttgaatttggcaccagtgaaaccttcgcggccacctgtaaaaagcttcacgaccacattgagcttgaatgtgatggtgtcggagttgatcttagcaacattttcctggaagggatagcgatccttaatatcccttcaatgtacggaggtaccaatctctggggcgagaataagaaaaatagagctgtgattcgcgagtcccgcaagggcgtaactgaccccaaggaactcaagttttgtgttcaagacctttcggatcaactgcttgaggtggtggggctcgagggagccatggaaatgggacagatatacacaggactgaagagtgccggacggcgcttagctcaatgcgcctcagtcaccatcagaactaacaaattattacccatgcaggtggacggcgagccctggatgcagccctgctgcacaatcaaaattactcataagaaccaagctcccatgatgatgggtcctcctcaaaaatcctcattcttcagcctcaggagaaagtcgcggagtaaggactag

SEQ ID NO: 114505 - DNA, 2301 bp, Artificial Sequence
  Description of Artificial Sequence: Synthetic coding sequence
atgggcgaggagcgttgggtcagcctgacccccgaggagttcgatcaactgcagaagtacagcgaatattcatccaaaaaaatcaaggacgctctgaccgagtttaacgagggagggtccctgaagcagtatgacccgcatgagcccataagctatgatgtatttaaactttttatgcgcgcatatctggaagtggacctccctcaaccactgagtacacatcttttcttagctttctcccagaagcctcggcacgaaacttcagatcatccaactgagggtgcatctaacagcgaagccaactccgcggatactaatatacaaaatgccgacaacgcaaccaaggctgacgaagcgtgtgcccctgacacagaaagtaacatggccgagaagcaggcccccgcggaagatcaagtggctgccactccattggaacctcccgtaccacgttctagttcttcagagagccctgtagtgtacctcaaggacgttgtgtgctatctctctctgttagaaacggggcgccctcaggataaactggaatttatgttcagactgtacgatagcgacgaaaatggcttgctggaccaagccgagatggattgcatcgttaatcagatgctgcacatcgcccaatacctggagtgggatccaaccgaacttcgacccattttgaaagagatgctgcaagggatggattacgatcgagatggctttgttagcctccaggaatgggtgcacggcgggatgaccactatcccattgctagtgctgctgggaatggacgatagcgggagcaagggcgatggaaggcacgcatggactatgaagcatttcaagaagcctacatattgtaacttttgtcacattatgctaatgggcgtccgaaagcagggactttgttgcacttattgcaagtacacagtccacgaaagatgtgttagccggaacatccccggatgcgtgaagacatacagtaaggcgaagcggagcggggaggttatgcaacacgcatgggtcgagggcaattctagtgtaaaatgcgacaggtgccataaatcaatcaaatgctatcagagcgtgaccgctaggcattgcgtgtggtgcaggatgacattccatcgaaaatgcgaactcagtactttgtgtgacggaggggaactcagggatcatatcctcctcccgacctcaatctgccccattacccgcgaccgcccaggggaaaagtcagacggatgcgtttccgctaagggcgagctggtaatgcaatacaagataatccctacccctggaacacatccattgttggtcttagttaatccaaagagcggtggtaggcagggcgaaaggctcaacttcttccgggacacccctgacttcagggtcttggcctgcggcggtgacggaaccgtgggatggattctagattgtatcgacaaggccaattttgctaaacaccctcccgtcgccgtgctccccctgggtaccggtaacgatctggccagatgcctgagatggggtggcggctacgagggggggtctttgactaagatattgaaggatattgagcagagtcccctggtgatgttagataggtggcacctggaagtcattccccgcgaggaagtcgaaaacggtgatcaggtgccttacagcataatgaacaactacttttcaataggggttgacgcatcgattgcccataggttccatgtcatgcgagagaagcatccagaaaagtttaactctagaatgaagaacaaactttggtatttcgagtttggcacctccgaaacctttgctgcaacctgtaagaaactgcacgaccacatcgagctggaatgcgacggcgtcggagtggatcttagcaatatatttctggaaggtatcgcaattctgaatatcccgagcatgtacggcggcaccaatctctggggggagaacaagaagaaccgggccgttatcagggagagccggaaaggtgtaactgatcccaaggagctgaaattctgtgtgcaggacttatcggatcagctgctcgaggtggtgggcctggagggagctatggagatgggccagatctacaccgggctgaaatccgcagggcgaagactggcccaatgtgcatcagtgacaatccgaaccaataaactgctgccaatgcaagtggatggagagccttggatgcagccctgttgtacaatcaaaataacccacaaaaaccaggcaccaatgatgatgggccctccgcagaagagctcttttttctccctgcggcgcaagtcccgatctaaagattag

SEQ ID NO: 114506 - DNA, 2259 bp, Artificial Sequence
  Description of Artificial Sequence: Synthetic coding sequence
atgggagaagagagatgggtctcacttacccccgaagaatttgatcagctacagaagtactcagaatattcatcaaagaagatcaaagacgcattgactgagtttaacgaggggggcagcttaaaacagtatgacccgcatgagccaatatcctacgatgtcttcaaattatttatgcgcgcatacttagaagttgatctgcctcagccactgtccactcaccttttcctggccttcagccagaagccacgtcacgagacaagcgaccaccctacagagggcgcctcaaatagtgaagccaattccgctgacacaaatatacagaatgcagataacgccactaaggccgatgaggcctgtgcgcctgatactgagtcgaatatggcggagaaacaggcccccgccgaagaccaggttgccgcaactcccctggagcctcctgttccccggagctcatcttctgaatctcctgtcgtttatctcaaggacgtggtgtgctatctgtcgctgcttgagactggtaggccacaggataagctcgaatttatgtttcgactgtacgactctgatgagaacgggctgctggatcaggccgaaatggactgcatcgtgaaccagatgcttcacatcgcacagtatttagaatgggaccccaccgagcttcgccccatcctgaaggagatgctccagggcatggactatgaccgcgacggttttgtgagcttacaggaatgggttcatggggggatgacgactattcccctccttgttctgctggggatggatgatagcgggtctaaaggcgatggtagacatgcctggaccatgaagcacttcaagaaaccaacctattgtaatttttgtcacatcatgctaatgggcgtgaggaaacaagggttatgttgtacctactgcaaatatacggtgcatgaaagatgtgtgagtcggaacattccaggctgtgttaagacctactcgaaggcgaaaaggtctggagaatttcaccgcaaatgtgagctctctacactgtgcgacgggggcgagttgcgggaccacattctgctgccaacctctatttgtccgatcacccgcgatcggcccggcgagaaatctgatggctgtgtctctgctaagggagagctcgtgatgcaatacaagattatccctactccaggaacccatccccttcttgtgttggtcaaccccaaaagcgggggtagacagggagagaggatactgaggaagttccactacttattaaaccctaaacaggtctttaatctcgataacggcgggcccacacctggtctcaacttcttccgagacacgccagactttcgggtgttagcttgtggtggagacggaacagtcgggtggatcttagattgcatcgacaaagcgaacttcgccaagcatccccccgtggcagtgctgcccttaggaacaggtaacgatttggccaggtgtctgagatggggaggagggtacgagggaggtagcctgactaagattctgaaagatatcgagcaatcaccactggtcatgcttgatcgttggcacctcgaggtgatcccacgggaagaagtggagaatggggatcaggtaccctatagcattatgaataattactttagcattggtgtggatgcatctatagcacatcgcttccacgttatgcgcgagaagcacccagagaagtttaactctaggatgaaaaataaactctggtactttgaattcggaacatccgaaacattcgccgcaacatgtaaaaaactccatgaccacatagagctggaatgcgacggggtaggagttgacctctccaacatcttcctggagggtatcgcaattctcaacatacccagcatgtacggcggtactaatctttggggagagaataaaaaaaacagggccgtgatccgcgagagccggaaaggcgtaaccgaccccaaggagctgaaattctgcgtgcaggatcttagcgaccagttgcttgaggtggttggccttgaaggggccatggagatgggacagatttacaccgggctcaaatctgccgggcgaaggcttgcccagtgcgccagcgtcacaatcaggaccaacaagcttctgccaatgcaggtggacggcgaaccatggatgcagccatgctgcactataaagatcactcataagaaccaagcccccatgatgatgggtccccctcaaaaatcaagcttctttagtctgaggcggaaaagcagatccaaggattag

SEQ ID NO: 114507 - DNA, 1818 bp, Artificial Sequence
  Description of Artificial Sequence: Synthetic coding sequence
agtttgaagatgggggaggagcggtgggtaagcctaactccagaggagtttgatcaactccaaaagtatagtgaatattcctcaaaaaaaatcaaggacgcccttacagaatttaacgagggaggctctctgaagcagtatgacccacatgaacctatttcctacgatgtctttaagctctttatgcgtgcatacttggaagtagacctgcctcagcctcttagcacgcatctgttcctggcctttagccaaaaaccccgccacgaaacctccgaccatccgacagaaggggcatctaacagcgaggccaactcagctgacacaaacatacaaaacgcggataacgcaacaaaggctgatgaagcatgtgccccggacacagagtctaatatggccgaaaagcaagcaccggcagaagatcaggttgcagctacgcccttagaaccacctgtgccgcggtcttccagcagcgagagcccagtagtgtatcttaaggacgtggtgtgttacctgtcacttttagagacggggcgaccccaggataaactggagtttatgttcagactgtacgatagtgacgagaacggactcttggatcaagcagaaatggattgtatagtaaatcaaatgctgcacatcgcgcaatatctggaatgggatccgaccgaacttagacctatccttaaggagatgcttcagggcatggattacgaccgtgacggctttgtgtcattacaggaatgggtgcatgggggcatgactactattcccttgctggtgctgctcggtatggatgacagcggttccaagggtgatgggcgtcacgcctggacgatgaaacattttaaaaaaccaacctactgcaatttctgccatatcatgctgatgggtgtgaggaaacaggggctgtgctgtacgtactgcaagtatactgtgcacgaaagatgcgtctccagaaatattcctggctgtgtgaaaacatactctaaggcaaagagatcaggggagttccatcggaaatgtgagctctccaccctttgcgatggcggtgagctgcgggatcacattcttctacctacatcaatttgtccaatcacccgggacaggccaggtgaaaaatccgacgggtgtgtgagcgcaaagggggaattagtgatgcaatacaaaatcattcccacccccggtacccacccattactagtgttagttaatccaaaatctggtggtaggcagggagagagaattctgcgaaagttccattacctcttaaaccctaaacaggtattcaacctcgataacggcgggcccactcctggattgaactttttcagggacactcctgattttcgggttctggcttgcggaggcgacgggaccgtcggctggattcttgactgcatcgacaaggctaactttgccaagcaccctccagttgcagtgctgccactggggaccggcaatgatctggccaggtgtctgcgttggggaggtggatatgaaggggggtcgcttaccaaaatcctgaaggatattgagcagtccccactcgtgatgctggacaggtggcatctcgaagttataccacgcgaagaggtggagaacggagaccaggttccttatagcatcatgaacaattacttctccattggcgttgatgccagcatagctcaccggttccacgtgatgcgtgagaagcatcccgaaaagtttaacagccgcatgaaaaataaactgtggtatttcgagttcggaacttctgaaacatttgccgcgacttgcaaaaaattacatgatcacatcgagctggagtggtgttag

SEQ ID NO: 114508 - DNA, 2199 bp, Artificial Sequence
  Description of Artificial Sequence: Synthetic coding sequence
atgggcgaagaacgctgggtcagtttaactccggaggaattcgaccagcttcagaaatatagtgagtattcttcgaaaaagataaaagacgcgctcacggaattcaacgaaggcggttcactcaagcagtacgatcctcatgagcccatctcttacgacgtctttaaactgttcatgcgcgcctatcttgaagttgatctcccacagcctctgtctacacatctgtttttagctttttctcagaagcctaggcatgaaacatccgaccacccaactgaaggggcgtctaacagcgaagcaaacagcgccgatacaaatatacagaatgccgacaatgctaccaaggccgatgaggcgtgcgctcccgataccgagtcgaacatggccgagaaacaggccccggccgaggaccaagtggctgctacgccattggaacctccagtgcccaggtcctcgagcagcgaatcccccgttgtttatttgaaggacgtggtgtgctacctaagcctcctagagactggacgtcctcaggacaaattagagtttatgttccgcctctatgatagtgacgagaatgggctgctggatcaggcggaaatggactgtattgtgaaccaaatgttgcacatcgcacagtacctggaatgggacccaaccgagctgcggcccattctaaaggagatgctacaggggatggattacgatcgtgatggattcgtgtccctgcaagaatgggtgcatggtggaatgacaaccatccctttgttagtgctgttaggtatggacgactccggcagcaagggtgacggcaggcatgcatggactatgaaacactttaaaaagccaacttattgcaacttctgtcacataatgctgatgggcgttcgaaagcagggactgtgttgcacttattgcaagtacaccgtgcacgaaaggtgcgtgagtcggaacatcccaggctgcgtcaagacttattccaaagcaaagcggtctggcgaattccatcggaaatgtgaactctccactttatgcgacggcggagaactgagggaccacattcttctgccaactagcatttgcccaattacccgttacaagatcattcctactcctgggacccaccccctgttggtcctcgttaatcccaagagtggcggccgacagggtgaaagaatactgcggaagtttcactacctgctgaaccccaaacaggtttttaacttagacaatggaggcccaaccccaggattaaacttctttagagacactccagatttccgagtcctggcttgcgggggtgacgggaccgtggggtggattctggactgcatcgataaagcaaacttcgccaaacaccccccggtggcagtgcttcccttaggaactggtaatgacttagcccggtgcctgcgatggggtggcgggtacgaggggggatctctcacaaagatattgaaggatattgaacagtccccccttgtgatgctggacagatggcacctggaggtgatcccacgtgaagaggtcgaaaatggggaccaagtgccttacagcataatgaacaactatttcagcattggtgtggacgcgtccattgctcaccgatttcacgtcatgcgcgaaaagcatcctgaaaagttcaactctcggatgaagaacaagttgtggtattttgaattcggaacatctgagacttttgccgccacatgtaagaaacttcatgaccacatcgagttagaatgcgacggggtcggggtggacctgagcaatatttttctggagggaattgccatcctgaatatacctagcatgtatggcggaaccaatctgtggggggagaacaagaagaatcgcgcggtgatcagagaatctcgcaagggcgtgactgatccgaaggaactgaagttttgtgtgcaggatctgtctgaccagctactggaagtggtgggtctcgagggggcgatggaaatggggcagatttacaccgggttaaagtcagctggacgaaggttagcccaatgcgcctctgtaactatccgcacaaacaagcttttgccaatgcaggttgacggtgaaccctggatgcagccttgctgcacaatcaagatcacccacaagaaccaggcacccatgatgatggggccaccccagaaatcttcgttcttctcactgcgtagaaagtcaagaagtaaggattag

SEQ ID NO: 114509 - DNA, 3198 bp, Artificial Sequence
  Description of Artificial Sequence: Synthetic coding sequence
atggatgccgcaggccgagggtgccaccttcttccactccccgccgctcgagggcctgcccgtgctcccgcagctgcagccgccgctgcggcgagcccacctggaccttgcagcggcgcagcatgtgcaccaagcgccgctgcgggggctggggccatgaatccatcttctagcgctggagaagagaaaggcgcaacaggggggtcgtcgtctagtgggtccggagccgggtcctgctgtctaggcgctgaaggtggcgccgatcctcggggagcggggtccgcagctgctgcaggggccgcagccttggatgaaccagctgctgctgggcagaaggagaaggatgaggccttggaagagaaactccggaatctgacctttcgaaagcaggtgtcatatcgcaaggctatcagccgcgccggattacagcacctagctcctgctcaccctctgtctttgcctgtagccaatgggcctgctaaggaacctcgcgctacactcgattggagcgaaaacgctgtaaatggagaacatctgtggcttgagacaaatgttagtggggacttatgctatctgggagaagagaattgccaggtccgcttcgcaaagtcagctctgcgcagaaagtgcgctgtctgtaaaattgtcgtgcataccgcctgcatcgaacagctcgaaaagatcaatttcaggtgtaagcctacatttcgtgagggggggagccgttcccctcgggagaatttcgtacggcaccactgggtccaccgcaggcggcaggagggtaaatgcaagcaatgtggtaaagggtttcagcagaaattctcctttcattccaaagaaatcgtggccatcagctgcagttggtgtaagcaggccttccataacaaggttacttgttttatgctgcaccacatcgaggaaccttgctccctaggtgcacacgccgccgtcatagttcctcccacctggatcataaaagttaagaagccccagaactctctcaaggccagcaatcgaaagaagaaaagaacttcattcaagcgaaaggcctctaaacggggcatggagcaggaaaacaagggccgacccttcgtgatcaagcccataagtagcccactcatgaagcctctactcgtgtttgtgaacccgaagtccggtggaaaccagggcacgaaggttctccagatgttcatgtggtacctgaatcctagacaggtctttgacctgtcccaggagggtcctaaggatgcactggagctttatcgaaaagtgcctaatctgcgcattctggcctgcggcggggacggtacagtgggatggatactcagcattttggacgaactgcagctgtcgccacagcctcccgtcggggtccttcccttgggaaccggcaatgatctggcccggaccctgaattggggaggggggtacaccgacgaaccggtgtccaagatcctttgtcaggtggaggatgggacagtggtccaattagatcgttggaacctgcacgtggaacgtaaccccgaccttcccccagaagagctcgaggacggcgtttgcaagctgcccctgaatgtcttcaataactatttctctttggggttcgatgctcatgtgacattagagtttcacgagagtcgcgaggccaatccagaaaaattcaattcacggtttcgcaataagatgttttacgcaggagctgccttcagtgacttcctacagagatctagccgcgacctatcgaagcatgtgaaggtggtttgcgacggcaccgatctcacaccaaagattcaggaacttaagtttcagtgtatcgtcttcttgaatatacccaggtactgtgcgggaacgatgccgtggggcaaccctggggatcaccacgattttgagcctcagcgtcatgatgacggctacatcgaggtcattggctttacaatggctagtctggcagccctgcaggtgggtggccacggcgaaaggcttcatcagtgccgggaggtgatgcttctgacatacaagtcaatcccaatgcaagttgacggggaaccctgtcgacttgctccggccatgattcggatttcgctcaggaatcaggccaatatggtgcagaaatctaagcggcggacctcgatgccgttgctcaacgaccctcagtctgtgcccgacagactgagaatacgcgtgaacaaaattagtctccaggattacgaaggattccactatgataaggagaagcttcgcgaggcaagtatttcggattggctcagaaccatcgccggggaattggtgcaatcctttggggctataccactcggcattctggtagtgagaggggattgtgaccttgaaacctgtcgtatgtacatagacaggttgcaggaagatctccagagcgttagtagcgggagccagagagttcactaccaggaccacgagactagctttcctcgcgccttgtctgcccaacgcctgagcccaaggtggtgctttctcgatgacagaagccaggagcatttgcacttcgtcatggaaatctcccaggacgagatattcatcctggatcctgatatggtggtgagtcaacccgcgggaacgcctcccggcatgccggatctagtggtagaacaggcgtccgggattagcgattggtggaatccagctctgagaaaacggatgctgagtgactccggcctgggaatgattgcaccttactacgaggattccgatctcaaggatctgtctcattccagagtattacagtcgcccgtaagctctgaggatcatgccatcctccaggcagtcatcgccggtgatctgatgaaattgatcgagtcatacaagaacggcggcagcctgctgatccaaggcccagaccattgttccctcttacattacgcagccaaaactgggaacggagaaatcgtgaagtacatcctcgatcacggtccaagcgaattactggacatggccgacagcgaaacaggagagaccgccctgcataaagcggcctgtcagaggaatcgagctgtgtgtcagctgctcgtggatgctggcgcgagtctcaggaaaaccgatagtaagggcaaaacaccacaggagcgcgcacagcaagcgggagatcctgacctggccgcatatttggaatcccggcagaactataaggttatcggtcatgaagatctagagacagcggtgtag

SEQ ID NO: 114510 - DNA, 3207 bp, Artificial Sequence
  Description of Artificial Sequence: Synthetic coding sequence
atggacgcagccggccggggatgtcacttgcttcccttgccagcagctcggggcccagccagagcccctgccgccgctgctgcggccgccgccagcccgcccgggccgtgctccggcgccgcctgcgctccatccgccgctgccggcgcaggcgctatgaacccctcttcttctgcaggagaagaaaagggggccacggggggatcttcatccagcggctccggcgccggcagctgttgtctgggcgccgaaggcggtgctgatccacggggcgctggaagcgccgctgccgctggggccgccgctctcgatgagccggccgcggcgggacagaaagaaaaggacgaggcgctagaggaaaagcttaggaacttaacttttaggaagcaggtgtcctatcggaaagccatatctagagcagggctgcagcacctggctccagcccaccctttatcactcccggtcgcgaatgggcctgcaaaagagcccagagccaccttggattggtccgagaatgcagtgaatggagagcacctgtggctcgagaccaacgtcagtggggatttgtgttatcttggggaggagaattgtcaggtacggttcgcgaaatccgccctgcgacggaaatgcgctgtgtgtaaaatcgtcgtgcacaccgcctgtattgagcagctagaaaaaattaactttcgctgtaaacccacatttagagaaggtggcagtcggtcacccagggaaaactttgtacgacatcactgggtacataggagaagacaagaggggaagtgcaagcagtgcgggaaaggattccaacagaaattctcatttcattctaaagagatagtagccatctcttgctcatggtgtaaacaggcgtttcacaataaagtgacatgcttcatgttgcaccacatcgaagagccgtgcagtttgggcgcccacgccgctgtgattgtcccccccacatggatcattaaagttaagaagccacagaacagcttgaaggcttcgaatcgcaagaaaaagagaacctccttcaagcgaaaggccagcaagcgggggatggaacaggagaataaaggtagacccttcgttatcaagcccatttcttcgcccctcatgaagcctctgcttgtgttcgtgaaccctaaatccggtggaaatcagggtacaaaggtcctgcagatgttcatgtggtatctgaatcctcgccaggtcttcgatctcagtcaggaggggcccaaggacgccctagaactgtaccgtaaggttccaaatctacggatactagcttgcggcggcgacggcactgttggttggattctgagcatactggatgaactgcagttgtctcctcagccaccagtcggagttctgccactggggacagggaatgacttagccaggaccctaaactgggggggcggatatacggacgagccagtgtctaaaatcctgtgccaagtggaggacgggaccgtggtgcaacttgataggtggaacctgcacgttgagcgaaaccccgaccttcccccagaagagttggaggatggcgtgtgcaaactcccattaaacgtctttaacaactacttttcactgggatttgacgcccacgtcaccttggagtttcacgagagccgcgaggctaaccctgaaaagttcaacagccggtttcgtaataaaatgttctacgcgggagccgccttcagcgattttctgcagcgcagttcaagggatctgagtaagcatgtcaaggtagtgtgtgacggcaccgatctgacgcctaaaatccaagaattgaagttccagtgcattgtcttcctgaatattccacgctattgcgccggcaccatgccttggggcaaccctggtgaccatcatgatttcgaaccacaacggcacgacgatggctacattgaggtcattgggttcacaatggcatctctcgctgccctgcaggtggggggacacggcgagaggctgcaccaatgtcgcgaagtgatgttgctaacctataagagcataccaatgcaggtggacggcgagccatgcagactcgctcccgccatgatccggatttccttgcgaaaccaagctaatatggtgcaaaagtctaaacgtagaacaagcatgcccctgctcaacgatattcatcaggttcagacagccgatttgagacgggtgtcagccccacctgggtcgtttactatcccccagtctgtcccggaccggctgagaatccgggtaaataaaataagcctacaagattatgagggattccactacgataaggagaagctgcgagaggcaagcattcctctcggcattctggtggtgaggggcgattgtgacctggagacttgtagaatgtatattgataggctgcaggaggacctgcagtccgtaagtagtgggagtcaaagggtgcactaccaggaccacgagactagtttcccgcgagcattaagcgcccaacgattgagcccgcgatggtgttttctggatgaccgaagccaggaacatttacactttgtcatggaaattagtcaggacgaaatcttcattctcgatcccgatatggtagtgtcgcagccagccggcactcctcctggcatgcctgatttggtggtggagcaagcttcaggcatatctgattggtggaacccagccttgagaaagcgaatgttgagcgattccggccttgggatgatagccccatactatgaggatagtgacctcaaagacctttctcacagccgtgtgttgcagtccccagttagctctgaagaccacgctatcctacaagccgtgatcgccggtgatctgatgaagctgatcgagagctacaagaatggtggatctctgctcattcagggccccgaccactgttctttacttcactatgcagccaagaccggcaacggagagattgtcaaatacattctagaccacggtccttcagagctcctggacatggccgacagtgaaaccggggagactgccctgcataaggcagcctgccaaagaaatagagctgtgtgccagctcctggtggatgctggcgcctccttacggaagacagattctaagggaaagactcctcaagaaagggcacagcaggcaggtgaccctgatctcgcagcttatcttgagtctaggcagaactataaagtgatcggacatgaggatcttgaaactgcggtctag

SEQ ID NO: 114511 - DNA, 2949 bp, Artificial Sequence
  Description of Artificial Sequence: Synthetic coding sequence
atgaacccttccagttctgccggagaagaaaagggggccaccgggggatcaagcagctccggatctggagccgggtcatgctgcctgggtgctgaggggggggctgatccacggggtgccggatcagcagctgctgccggggctgctgctttggacgagccagccgcagccggccagaaggaaaaggacgaagctctcgaagaaaaacttcgcaatctgacattcaggaaacaagtatcgtaccggaaagccattagcagggccggcctgcaacatttggcccctgctcaccctctttctctgcctgtggctaatgggcccgccaaagagccccgggccacactcgattggagcgagaacgcagtgaatggtgagcatctgtggttggaaaccaacgtgagcggcgatctgtgctatctgggggaagagaactgtcaggtacgtttcgctaagagcgcgctgcggcgtaaatgtgccgtttgcaaaatcgtagtgcatacagcctgcatcgagcagctggaaaagatcaattttcgctgcaagccaacctttagggaaggggggagcaggagcccccgcgaaaacttcgtgcgccaccattgggtgcaccgccgacggcaggaggggaaatgcaaacaatgtggaaagggattccagcagaaattcagcttccactctaaggagatcgttgctattagctgctcctggtgtaaacaggctttccacaacaaggtcacctgctttatgctgcaccacatagaggaaccctgtagtctcggagcccacgctgccgtgatcgttcctcccacctggatcattaaagtaaagaaacctcaaaactccttgaaagcttccaatagaaagaagaaacggacctccttcaagaggaaagcatctaaaaggggcatggaacaggagaataaaggcaggccattcgtgatcaagccgatctcttccccccttatgaaacctctgttggtctttgtgaatcccaaaagcggaggaaaccagggaacgaaagtacttcagatgtttatgtggtatctgaacccacggcaggtcttcgatctttcccaggaggggcccaaggacgcattggaattatacaggaaagtgccaaacctacgtattctcgcctgtggcggcgatggaaccgtcgggtggatccttagcattctcgatgagctccagttgtcaccacagccacctgtgggagtgcttccattggggacagggaatgatttagctcgcactctcaattggggaggtgggtacacagatgaaccggtatccaagattctgtgccaggtagaagatggaacagtcgtgcagctggatagatggaatctacatgttgagagaaatcctgaccttccgcctgaagaattggaggatggggtttgcaagctgccattgaacgtttttaacaattattttagcctgggcttcgacgcccatgtgacattggagttccacgagagtcgtgaggcaaatcccgaaaagttcaacagtcgatttcgtaataagatgttctatgcaggggctgcattttccgactttctgcagagatcctctagagacctcagcaagcatgtgaaagtcgtctgcgatggaactgaccttacacccaaaatccaggagcttaagttccagtgcatagtgtttctaaacatcccccggtactgtgccgggactatgccatgggggaatcctggcgaccaccacgatttcgaacctcagagacatgacgacggatacattgaagtgattggattcacgatggcctccctcgctgcgctgcaggtgggcggacacggcgagcgtctgcaccagtgccgagaagtcatgcttctgacgtataaatcaatcccaatgcaagtggacggtgagccttgtcggctggcaccagccatgatccgaatcagcttacgcaatcaggcaaatatggtccaaaagtctaaaaggcgcacttccatgcctctgctgaatgacccacagagcgtccctgatcggctacggattagggtgaacaagatctccttgcaggactacgagggattccattacgacaaggagaagctgagagaggccagcatctccgattggctgcgtacgattgcaggtgaactcgtccagtcctttggcgccatcccgcttgggattttggtcgtccgtggtgattgtgacctggagacttgtcgcatgtatatagaccgtttgcaagaggatctccagagcgtgtcatcggggagtcagcgcgtgcattatcaagatcacgaaacatcatttccgcgcgctttgagcgcccagcgacttagcccaaggtggtgcttcctggacgcaaccagtgcagataggttttataggatcgataggagtcaagagcacctgcattttgtgatggaaatttcccaggacgagatttttatcctggatcccgatatggtggtaagccagccagcaggcaccccacctgggatgccagatctagttgtggagcaggcctctggatcccctgtgtcatccgaagatcatgctattcttcaggctgtaatagcaggagacctcatgaagttgatcgaatcctacaagaacggcggtagtctgttaatacaaggacctgaccactgctctcttctacattatgccgccaaaactggcaatggagaaatcgtgaaatatattctggaccacggcccctctgaactactggacatggccgatagtgagacgggtgaaacagctctccataaggctgcttgccagcggaaccgagcggtctgtcagttgctggtcgacgcgggagcttctctgaggaagactgacagtaaaggtaagacacctcaggagcgggcacagcaagcaggtgacccggacctggctgcctatctcgaatccaggcagaactacaaagtgatcggtcacgaggacctggaaaccgccgtctag

SEQ ID NO: 114512 - DNA, 2829 bp, Artificial Sequence
  Description of Artificial Sequence: Synthetic coding sequence
atggctgctgccgctgagcccggggctcgagcctggctggggggcggatctccaagacctggctctcccgcatgtagtccagtgctcgggagcggagggcgggcccgaccaggacctggtcccgggcctggaccggagagagccggggtacgcgcacccggacccgcagcagcacctgggcactcatttagaaaggttacactgacaaagccgaccttctgccacttatgctcggattttatctggggcctcgccggcttcttgtgcgacgtctgtaacttcatgtctcacgagaaatgtctaaagcacgtgcgaatcccctgtacctccgtggccccgagcctggtgagggtgcccgtggctcactgcttcggtccccggggcctgcataagagaaaattctgcgctgtatgcaggaaagtcctcgaagcgccagctctgcactgcgaggtgtgcgagctccacttgcatcctgactgtgtgccctttgcttgcagcgattgtagacagtgtcatcaagatgggcatcaggaccatgatactcatcaccatcattggcgcgaaggcaaccttcctagcggggccaggtgtgaagtctgtcggaagacttgcgggtctagcgacgtccttgcaggcgtccgttgtgaatggtgtggagtccaggcccattcattatgttcggccgctctggctccagagtgtggatttggcaggctgagatccttagtcctgccgcctgcttgtgttcgattactgccggggggcttttctaaaacccagagcttcaggattgtagaggctgccgagccgggtgaaggcggggacggtgcggacggttccgctgccgtgggtccagggcgggaaacccaggccacacccgagtcgggtaagcagaccctgaagatttttgacggagatgacgcagttaggagatctcagttcagattggtgaccgtgtccaggctggccggcgcggaagaggtgctggaagcggcccttcgcgctcatcatattcctgaagaccccgggcacctggaactctgccggctacctcctagctctcaagcctgcgacgcttgggcgggggggaaggcggggtctgctgttatttccgaagagggacggagccccggctccggcgaggcaaccccggaggcatgggtcattagggccctacccagggcacaggaggtcctcaaaatttaccctggatggctcaaggtaggcgtcgcatacgttagcgtgagggtgacgccgaagagtactgcccggagcgttgtcctcgaggtgctaccccttctcggacgtcaggctgagtcacccgaatctttccaactggtggaagtggccatgggctgccggcatgttcagcgcactatgctcatggatgagcagccattactggatagactgcaggacattaggcagatgagtgtgcgtcaggtgagccaaacaaggttttatgtcgcagagagtcgcgatgttgctccccatgtgtcgctgtttgtggggggactcccaccgggcctctccccggaggagtactcatccctgctgcatgaggcgggcgcaaccaaggccaccgtcgtttccgtgagtcatatatatagctcccagggagccgtcgtcctagatgtcgcttgtttcgcagaggcagaacgcttatatatgctactcaaggatatggcggtccgcgggcggctcttgactgccctggtcttgcctgatttgcttcacgctaaactcccccctgactcatgtccccttttagtctttgtgaaccccaagtccggcggacttaaaggtcgtgacctcctatgttcgtttaggaaactcctcaatccacaccaagtttttgacttgaccaacggcggacctcttcctggattacatttgttctcacaagtcccctgttttagggtcctcgtttgtggcggggatggaaccgtaggctgggttcttggagccctagaggaaacacgctacagacttgcgtgtcctgaaccatccgttgctatacttccactcggcaccggaaacgacctcgggagagtgctacgatggggtgcgggctattccggagaggaccccttttcagtgttactcagcgtggatgaggcagatgcagtcctcatggacagatggaccatactgctggacgcgcacgaggccggaagcgctgagaacgatacagccgacgctgaacctcctaagattgtacagatgagcaattattgcggtataggcatcgatgccgagctcagtctggactttcatcaggcgagagaggaggaacctggcaaatttacctcacgtctccacaacaaaggggtgtacgtgcgggttggcctgcagaaaattagtcacagcaggtccctgcacaaacagatccggctccaggtagaacggcaggaggtcgagcttccctctatcgagggcctgatttttatcaacattccttcatgggggtctggagcagacctatggggctccgattccgacacacgcttcgagaagccccgaatggatgatggcctcctcgaagtggtcggtgtgacaggcgtagtgcacatgggacaggttcagggtggcctcaggtccggcattcgcattgcgcagggatcgtactttcgggtgactctactgaaggccactccggtacaggtagacggcgaaccatgggtccaggcaccaggtcatatgatcatctctgcagctggccccaaggtgcacatgctcagaaaggctaagcagaaaccacgccgcgcaggcactaccagagacgccagggctgatgctgctccggccccggagagcgatccacgctag

SEQ ID NO: 114513 - DNA, 1632 bp, Artificial Sequence
  Description of Artificial Sequence: Synthetic coding sequence
atgccagggatggtgctctttggtcgacgttgggcaatagcaagcgacgacctggtattccccgggttctttgaactggtagtccgggtgctctggtggattgggatcctcacattgtacctgatgcatcgcgggaaactcgattgtgctggcggggctctgcttagctcatacctaattgtccttatgattctcttagcggttgtgatatgcacagtcagcgcaattatgtgtgtgagcatgaggggtaccatttgcaacccagggccgaggaaaagcatgtcaaaactgctgtacattcgactggctctattctttccagaaatggtgtgggcctccctcggcgctgcatgggttgccgatggtgtgcagtgcgaccgaacggtcgtaaacggcatcattgccacggtggtcgtccgcacacaaatttggtgcccagcaactctgaggagggcgagcccttgtttcatctctaatcgcacaattagcggtaccacgaagtctctgcctcgctggtccgctatgccccagggggcaccgagttgtcggagcagaactaccgattatgacttggttggaggcgatcagttaaactgccacttcggctctatcctccacactaccggtctgcaatatagggacttcattcacgtctcctttcacgacaaggtgtatgagcttccgtttctcgtcgctctcgaccatcgaaaagaatctgtggtggtcgccgtgaggggcacgatgtcgctacaggatgtacttacggatcttagcgctgaatcagaggtcctcgacgtggagtgcgaagtacaagacagattggcacataaggggatttcccaagctgcccggtacgtgtaccaacggctcattaacgatggcatcctgagtcaggccttctctattgcccccgagtaccggctggtgattgtgggacatagtttaggcggcggtgcagcggcccttttggccaccatgctgcgcgcggcctacccgcaggttcgctgttatgcgtttagtcctccacgaggactgtggagtaaggctctgcaggagtactctcagtcttttatcgtgagccttgtgctgggcaaggatgttattccccgtttgagcgtaacaaacctggaggatctgaagaggcgtatcctgagggttgtggcccattgcaataaaccaaaatataaaattcttttgcacggtctctggtacgagctgttcggcggcaacccaaataatttaccaacggaacttgacggaggcgatcaggaggtccttacacaacctttactgggggaacagtcactgctgactcgttggtccccagcctactcctttagttcagattcccccctggattcttctcccaaatacccccctctatatccccccggtcggattattcatctgcaggaggagggagcatccggccggtttggatgctgttcagccgcacactactccgccaagtggtcacacgaggctgagttcagcaagatcctcatcggccctaagatgctgacagatcacatgcccgacattctcatgcgcgcactcgacagcgtcgtctcagaccgcgctgcttgcgtttcttgtcctgcccagggcgtcagctctgttgatgtcgcctag

SEQ ID NO: 114514 - DNA, 3129 bp, Artificial Sequence
  Description of Artificial Sequence: Synthetic coding sequence
atgcccggtattgtggtgttcaggaggagatggtctgtgggttccgacgacttggtacttcctgctatctttttgttcttgttacataccacgtggttcgtgattctgagtgtcgtgctatttggattggtctacaacccccatgaagcttgttctctgaatctggtggatcacggccggggctaccttgggatccttctctcgtgcatgatagcggagatggcaatcatttggcttagtatgaggggaggaatattgtataccgaacctcgggattcaatgcagtacgtcctgtatgtccgtctggcaatcctggtgatcgagttcatctatgctatagtggggattgtgtggctgacccagtattacacctcttgcaatgatctcacagccaagaatgttaccctcggcatggtagtgtgtaattgggtggtcattcttagtgtctgtatcaccgtgctctgtgtgtttgaccccacaggcagaacatttgtcaagctgcgtgcgaccaagaggcggcagcgcaatctccggacatataatctcaggcatcgcctagaggaaggccaagcaacttcctggagtcgacggctcaaggtgtttctctgctgcacacggactaaggacagtcaatcagatgcctacagcgagatcgcgtatctttttgcagaatttttcagggacttagacatcgtgccatccgatatcatcgctgggctagtgctgcttcgtcagcggcaaagggccaaacgtaatgccgtgctcgacgaggctaacaatgacatcctggcttttttgtccggaatgccagtgactaggaacactaaatacctcgacctcaaaaattctcaagaaatgttgcgctataaagaggtctgctactacatgctattcgcccttgctgcctacggctggcccatgtatttaatgaggaagcccgcatgcgggctgtgtcagctagccaggtcttgttcttgctgcctgtgcccagccagaccacgcttcgccccaggtgtgacaattgaagaggataattgttgtggctgcaatgctatcgcgataaggcgccatttcctggacgagaacatgactgccgtagacatagtttacacttcatgccacgatgccgtgtatgaaacccctttttatgtggccgtcgaccacgacaaaaaaaaagtagtaatcagcataagggggactctctctcccaaggatgctctgactgacctcacaggcgacgctgagcgcctgccagtagaaggccaccatggcacatggctgggtcacaagggcatggtcctttctgcagagtacattaagaaaaagctagaacaggagatggtcctgtcccaagccttcggacgggatctggggagggggactaagcactacggtctgatcgtagttggacattccctgggggctggcactgccgccattctgagctttctattaaggccgcagtaccctactctgaagtgttttgcatacagccctcctggcggtctactgtctgaggatgcaatggagtattcaaaggaatttgttacagccgtggtcctcggaaaagacctggtgcctaggattggtctgagtcagctcgaggggttccgcagacagttgctcgacgtgcttcagcggagcacaaagcctaaatggcggatcattgttggtgccacaaaatgcatcccaaagtctgagctgcctgaagaggttgaggttaccacactggcttccacccggttatggacgcacccttctgatctgaccatcgcactgtctgcctctacccccctttacccaccagggcggattattcatgtcgtgcataatcacccagccgaacagtgttgctgctgtgagcaggaagagcccacctatttcgccatctggggcgacaacaaggcatttaatgaggtgatcatcagcccagcaatgctgcatgaacacttaccttacgtagttatggaaggcctcaataaggtcttggagaattacaacaagggcaaaaccgcgttactttctgccgccaaggtgatggtctcacctacggaagttgatttgaccccggagctcatcttccaacagcagcccctccctaccggcccgcctatgcctacaggcctggccctcgagctgcccacagctgatcaccggaattcaagtgtgaggtcgaagtcacagagcgaaatgtccctagagggtttcagcgaaggcagattgctgtcccctgttgtggccgccgcggccaggcaggaccctgtggaattgcttctgttatcaacccaggaacggctcgccgccgaactgcaggcaagacgagccccccttgcgaccatggagagtctgagcgacaccgagagtctgtacagcttcgacagcaggaggtccagcggcttccgctcaattcgggggagtccaagtctccatgccgtgctcgaaagggacgagggacatctattctacattgaccctgctatccctgaggaaaacccaagcttgagcagtcgcacagaacttctcgctgccgactcactgtcgaagcattcccaggacacacagccgctggaggccgctttaggcagtgggggcgtcacaccggaacgccctcctagtgcagctgccaacgacgaggaggaggaagtgggggggggagggggaggaccggcttcacgaggggagttagccctccacaacggcaggctgggtgactcacccagtccacaggtcctggagttcgccgaattcattgatagtctgttcaacctagacagcaagtcttcctcttttcaagacctttattgcatggtcgttcctgaatcccctacatcagactacgctgagggtcctaagtctcccagccaacaagagatactgctgcgggcccagttcgagcccaatctggtccccaagccccctcggctgtttgcgggctctgcggaccccagttcaggtatatccctcagccccagctttcctttatcctcgtccggcgagctgatggacctcacacccaccggtcttagcagtcaggaatgtctcgctgcagacaaaatccgaacgtccactcccacaggtcatggcgcgtctccagccaaacaagacgagctggtcatcagtgcacgatag

SEQ ID NO: 114515 - DNA, 2019 bp, Artificial Sequence
  Description of Artificial Sequence: Synthetic coding sequence
atgcctggtatggtgctgtttggccggcgctgggccatcgcttccgatgatctcgtctttcccgggtttttcgagctggtcgtgagagtactctggtggatcggaattcttaccctgtatctcatgcaccgcggcaaactggactgtgctgggggggcactgttgtcttcatatctgatagtacttatgatcctcctggcagttgtcatctgcactgtcagcgccatcatgtgtgtatcaatgcgaggcacaatttgtaaccctggcccacggaagagcatgagcaaactgctgtatattcgccttgccttgtttttccccgagatggtgtgggcatccttaggcgccgcctgggtggctgacggcgtgcagtgcgaccgcaccgtcgtcaatggcattatcgccacagtcgtcgtgtcttggattatcatcgcagccacagtagtgtcaatcataatagtgttcgaccccctggggggcaaaatggccccttactcctccgctggaccctctcacctcgactctcatgactcttctcaactgttaaatggactcaaaactgcagccacttccgtgtgggagaccagaatcaaactcctatgttgttgcattgggaaagatgatcatactagggtcgctttttcatccactgccgagctttttagtacctacttctcagacacagacctcgtcccctctgacattgcagcaggcttggctctgttacaccagcaacaagacaacattcgcaataaccaggagccagcccaggttgtgtgtcacgctcctgggtcatcccaggaggcagatctggacgccgaactggagaactgccatcactacatgcagttcgctgcagccgcctacggctggccactttacatttacagaaaccccttaactgggttatgtcgcattgggggggactgctgtcggtcacggacaacagactacgacctggtgggaggggaccagttgaactgccactttggtagcattctgcacacaacgggtttgcaatatagagattttatccatgtctctttccacgacaaggtgtacgaactaccattcttggttgccttagatcacagaaaagaatccgttgttgttgccgtccgagggaccatgagcctgcaggacgtgcttactgatttgagcgccgagtcagaggtgctggatgtggagtgtgaggtgcaggataggctggcccacaaggggatctcacaagccgctcggtacgtttatcagagactgatcaatgacgggattttatctcaagcctttagcatcgccccggagtaccgcctcgtcatcgtaggccattcactgggcggtggtgctgctgccctgcttgctaccatgcttagggccgcctacccacaagtgagatgttatgcgttctccccccctagaggcttgtggtctaaggctcttcaggagtattctcagtcattcattgtatctcttgtgctgggcaaggatgtgattcctaggctaagcgttactaatctggaggatctcaaacgcagaatcctgagagttgtagcccactgcaacaagcccaagtacaagatactcctccacggactatggtacgagctgttcggtggtaatcctaataacctgccaacagaactcgacggcggggatcaggaggtgctaacccagcctctgctcggcgaacagtctctcctgactcggtggtcacccgcctacagcttcagcagcgattccccactggactcctctcccaaatatcccccactgtacccccccggtagaatcatccatctgcaggaagagggagcctccggaagatttggttgttgctctgccgctcattattcagccaaatggtcccatgaggcggagttcagcaagatcttgattggacccaagatgctaactgatcacatgccagatatcctcatgcgggcccttgacagtgtggtcagcgacagagctgcctgcgtgtcatgccctgctcaaggcgtgtcatcagtggacgtcgcatag

SEQ ID NO: 114516 - DNA, 663 bp, Artificial Sequence
  Description of Artificial Sequence: Synthetic coding sequence
atgtattgcgtgagccatcacgtttgccagcacgaaaggacacagatctggtgcccagcaaccctgcggagagccagtccatgcttcatctctaaccgtacaatttccggaactactaagagccttccacggtggtcagcaatgccgcaaggagccccatcctgtcggtcccggacaacagattacgatcttgtgggcggcgatcagctgaattgccacttcggctcgatcctgcataccaccggtcttcagtatcgcgacttcatccatgtctcgttccacgacaaagtgtacgaactcccatttctggtggccttagaccacaggaaggagtctgtggtcgtagcagtcagaggcacaatgtctctgcaagacgtgctaactgacctaagcgcagagagcgaagttctggatgttgagtgcgaggtccaggatcgactcgctcataaaggcatttcacaggctgcgaggtatgtttatcaaagacttattaatgacggcattctatcacaagcattcagcatcgctcctgaatatcgcctagttatagtgggccattcattgggcggaggagctgccgccttactggcgaccatgctgagagcggcctatcctcaagtgagatgttacgctttcagccctccgcgggggctgtggcgttag

SEQ ID NO: 114517 - DNA, 1140 bp, Artificial Sequence
  Description of Artificial Sequence: Synthetic coding sequence
atgtattgcgtgagccaccatgtgtgtcagcatgagtcctggatcatcatcgctgcgactgtggtgtcgataatcattgtgttcgatccattaggtgggaaaatggctccatattcatccgcgggaccgagtcatcttgatagtcatgactcctcccagctgctgaacggacttaaaacagctgctacatccgtctgggagactaggatcaaactcctatgctgctgcataggcaaggacgatcacactagggtagctttttccagtaccgctgaactgttcagcacctacttctctgacaccgacctcgtgcctagcgatatcgctgcaggcctggcacttttgcaccagcagcaggataacatcaggaacaaccaagaacctgcgcaggtagtatgtcatgctccaggcagctcacaggaagccgacctagatgccgaactcgagaattgtcaccactacatgcagttcgcggctgctgcctacggttggcctctctacatctaccgcaaccctctgactggcctctgtcgcattggcggggactgctgtagaagccggaccacagactatgacctggtggggggcgatcagctgaattgtcacttcggcagcattcttcataccacaggactgcagtaccgggacttcattcatgtgagttttcacgataaggtctacgaacttcctttccttgtcgctttggatcaccggaaagagtctgtcgtcgtcgctgtccgggggacaatgagtctccaggatgtgctgaccgatttgagtgccgaaagcgaagttctggatgttgagtgtgaggtgcaggataggctggcacataagggcattagtcaagcagccaggtatgtgtaccaacggcttatcaatgatggcattctgagtcaagcattttccatagctcccgagtaccgcctcgtcatagtaggtcactccttgggaggtggagccgcagctttactggccaccatgctgagggcagcctaccctcaacagtcatctgctggcatcttctctgagctccaccgggtgacacgcccaggcgaagggtgcgatagccaggctcaatgcgaccagcttggacgttctgaggaaaagaatcttgcatcaggacgggcgctccagtag

SEQ ID NO: 114518 - DNA, 804 bp, Artificial Sequence
  Description of Artificial Sequence: Synthetic coding sequence
atgccaggcatggtactgttcggaaggaggtgggccatagcaagcgacgatctggtcttccctggcttcttcgaattggtggttcgtgtcttatggtggattggtatcctcactctctatctcatgcatcgaggcaaactggattgcgctggcggagcgctgctgagctcttacttaattgtgctgatgatattgcttgccgtcgtgatttgcaccgttagcgcaattatgtgtgtctccatgcgcggaactatttgcaaccccgggcccagaaagtccatgtctaagttgctgtatatacgtcttgctctgttcttccccgagatggtgtgggcttccctgggagccgcctgggtggcagatggtgtgcagtgtgaccgcactgtcgtcaatgggattattgccaccgtggtcgtctcctggatcatcatcgctgctactgtcgtttcgattataatagtattcgatcctttgggggggaagatggccccatactcaagcgctggcccttctcatcttgacagtcacgactcctctcaactgcttaacggcctgaagactgcagcaacttcagtgtgggaaactcgcatcaaactactttgctgttgcatcggcaaggacgaccatactcgtgtcgcgttctctagtaccgctgagcttttttctacctacttctccgatacagacttggtgccaagcgatattgcggctggacttgcccttctgcaccagcaacaggacaacactcgcgccacaggcaattgtcccaggaatgatggtcttactctgctctccctgaactag

SEQ ID NO: 114519 - DNA, 1467 bp, Artificial Sequence
  Description of Artificial Sequence: Synthetic coding sequence
atgggagaccgggggagtagccgcaggagacgaacgggctcccgtccgtcatcccacggcggagggggcccagcagccgcagaagaggaagtcagggacgcagccgccgggcccgatgtcggtgcggccggagatgctcctgcccctgccccaaataaggacggggacgccggagttgggtcgggtcattgggagctcaggtgtcatcgccttcaagactccctctttagctcagatagcggattcagcaattacagagggatcttaaactggtgcgttgtgatgctgattctttctaacgccaggctgttcctggaaaacttaattaagtacggcattttggtggaccctatacaagtggtgagtttgtttctgaaggatccatactcatggcccgctccatgcctggtgatagccgctaatgtatttgcagtggccgccttccaggtggaaaagagacttgctgtgggggccctgacagaacaggccgggcttctcctgcatgtggctaacttagctacaatactgtgtttccctgccgcagttgtgctgttggtggaatctattactcccgttgggtccttactcgccctaatggcacatacaattctctttcttaaactgttttcttaccgagatgtgaacagctggtgccgtagggctcgcgctaaagcagcttctgctgggaagaaggcttcatctgcagcagccccccatacagtgtcctaccctgacaatctcacttacagagacctctattactttctgtttgcccccaccttgtgttatgagctgaactttcccagatctccccgaattaggaagaggttcctcttgcgacgaattcttgaaatgctcttttttacccagctgcaggttggactaatccagcagtggatggtgccgactattcaaaattccatgaagccttttaaggacatggattacagcaggatcatcgaaagattgctgaagctggctgtgcccaaccacttaatctggctgatttttttctactggctattccactcatgtctgaacgctgtcgctgagttaatgcagtttggagaccgggagttctatagagattggtggaactcagagtccgttacatatttttggcagaactggaacattcccgtgcacaagtggtgcatcaggcatttctacaaaccaatgctgagaaggggatctagcaaatggatggcccgtacaggcgtatttctagcgtcagcattctttcatgagtacctcgttagcgtgccgctccgaatgtttagactttgggcatttaccggcatgatggctcagattccccttgcctggtttgtgggtcgcttcttccaaggcaactatggaaacgctgccgtgtggctctcactcatcattggacagccgattgccgtgctgatgtatgttcatgactactacgtccttaattatgaagcgccagccgcggaggcatag

SEQ ID NO: 114520 - DNA, 282 bp, Artificial Sequence
  Description of Artificial Sequence: Synthetic coding sequence
atgaagctcttgatggtgctgatgctggctgccctgtcccagcattgctacgctggctccgggtgtccactgctggaaaacgttattagcaagaccataaatccacaggtctcaaagacagaatataaggagttactccaagagttcattgatgataatgcgacaacgaatgccattgacgagctgaaagagtgttttctgaaccagaccgatgagacactatccaatgtcgaggtgttcatgcagcttatctacgatagttcactgtgcgatctgttctag

SEQ ID NO: 114521 - DNA, 1038 bp, Artificial Sequence
  Description of Artificial Sequence: Synthetic coding sequence
atgaaaaccttaatcgcggcatatagcggcgtcctgaggggtgaaagacaagcagaagcagatcgctcccagcgatcccatgggggtcccgcactttcccgggaagggagtggtagatggggtgtggcctgttcagctatcctgatgtacatcttctgtacagactgctggctgatagccgtgttatacttcacctggctcgtctttgattggaatacgcccaaaaaagggggtcgccgttctcagtgggtacgcaattgggctgtctggcggtactttcgggactattttccaatacagctggtgaaaactcataatctgctgacaacgcgcaactacatctttggctatcacccacacggtatcatgggcctgggggctttctgtaactttagcactgaggcgactgaagtcagtaagaaattccccggtattcgcccatacctggctactcttgccggcaatttcagaatgcctgtgctgcgggaatacttgatgagcggaggcatctgcccagtaagtagggataccattgactacctgctgtccaagaacggcagcggcaatgcaattataatcgtggtgggcggggccgccgaaagcttgtctagcatgcctggtaaaaacgcggtgacgctgaggaatcgcaaggggtttgtcaagctggctctccgacatggagccgatctggtgccgatctattcttttggcgagaacgaagtgtataaacaggtcatttttgaggaaggcagctggggccgttgggtccagaagaaattccaaaaatatattggatttgccccctgcatatttcacggccgggggctattctctagcgatacatgggggctcgtgccttatagcaaaccaattaccactgtggtcggagagcctataaccattccaaaactggagcaccctactcagcaggatattgatttatatcacactatgtacatggaggccctggttaaactgttcgataagcacaagaccaagttcggcctcccagagaccgaagtgttggaagtgaactag

SEQ ID NO: 114522 - DNA, 3306 bp, Artificial Sequence
  Description of Artificial Sequence: Synthetic coding sequence
atggaacaacctggcgctgcagcgtcgggagctggtggtggtagtgaagagccaggaggcgggcggagtaacaaacggtccgctggcaatagagctgctaacgaagaggagactaagaacaaaccgaaattgaatattcagataaaaaccctggcggatgatgtacgagacaggatcacttcttttcgcaaatcaacagtgaaaaaggagaaacccttgatccaacatccgattgactcccaggttgctatgagtgagttcccagctgcccaaccactttacgacgaaagatcactgaatctgtcggaaaaagaggttctggatttattcgagaaaatgatggaagatatgaatcttaacgaagagaagaaggccccacttaggaacaaggatttcacaaccaaaagggaaatggtggtccaatatatcagtgcgaccgccaaaagcgggggcctgaaaaattctaagcacgagtgcacgctatcttcacaggagtatgtgcacgaactcaggtccggtatctccgacgaaaagttgctgaattgtcttgagtccctgcgggtgtctctaacatcaaatccggtcagttgggtgaacaattttggccacgaaggcttaggcttacttctcgatgaactggagaaactgctggacaaaaagcaacaagaaaatattgacaagaagaaccagtacaaattgattcaatgtctgaaggcgtttatgaacaataagtttgggctgcagagaattctcggcgacgagcggtccctgcttctgctcgctcgcgcaattgatccgaaacagcctaacatgatgacggagatcgtcaaaattttgtccgccatatgcatagtaggggaggaaaatatcctggataaactgttaggtgcgattactaccgcagccgagcgcaacaacagggagaggttctccccaatcgtcgaagggctcgagaatcaggaggctttgcaactacaggtagcctgtatgcaatttataaacgctctggtgacaagcccttatgaactggacttcagaattcatttgcgaaatgaatttctccggagtggtctgaagacaatgctgcccgacctgaaagaaaaagaaaacgatgaattagacattcagctgaaagtcttcgacgagaacaaagaagatgatctaaccgaactgtcgcatcgattaaacgacattagagccgaaatggacgatatgaacgaggtttaccacctgctgtacaacatgctcaaagatactgcggccgagaattactttctttcaatcctccagcacttcctcttaatcaggaatgattactacatccgcccccaatactacaaaataatcgaggagtgcgtgtcacagatcgtgcttcactgctccggcatggatcccgatttcaagtaccgccagagactggatattgatctgactcaccttattgatagctgcgtgaacaaggcaaaagttgaggagtctgaacagaaagccgccgaattcagtaaaaagtttgacgaagagtttactgctcggcaggaggctcaagccgagttgcagaaacgtgacgagaagatcaaggagctagaggccgagatacaacagctgcggactcaggctcaggttttgtcctccagcagtgggatccctggccctccagctgctcccccgctgcccggggtggggcccccccccccaccacctgctccacctcttcccggcggggcacctttaccaccccctccccctcctctgcctgggatgatggggattcctcccccaccacccccccctctgcttttcggcggaccccctccaccaccaccactgggaggagtgccacctcccccaggtatctcactgaatctcccctatggtatgaagcagaaaaaaatgtacaagcctgaggtgagtatgaagaggataaattggtctaaaattgaacctaccgagctgagcgaaaattgtttctggctgcgcgttaaagaggataaatttgaaaatcccgacctattcgcgaaactggcactgaatttcgcaacgcagatcaaggttcagaagaacgcagaggctctggaagaaaaaaagacagggcccacaaaaaagaaagtgaaggagcttaggatcctggatccaaagacagctcagaacctgagcatcttcctgggcagctatcgtatgccatacgaagatattcgaaatgttatcctggaagtaaacgaggatatgctatccgaagccctcattcagaacctcgttaagcacctgccggaacagaaaattctgaatgagctggccgagctcaagaacgaatatgacgatctgtgcgagcctgagcaattcggcgtggttatgtcctctgtcaagatgcttcagccaaggctgtccagtatcctgttcaagctgactttcgaggagcatataaacaacataaagccctctatcatcgctgtaacactagcctgcgaagaactgaaaaaatctgagtcctttaatcgacttttagagctggtgctactagttggcaactatatgaattccggaagccgtaatgcccaatctctgggattcaaaataaacttcctatgcaaaatacgcgacaccaagtctgcagaccagaaaacgactctgctgcattttatagccgatatctgcgaagagaagtatagggacatcctaaagtttcccgaagagttggagcacgttgaaagcgcaagcaaagtttcagcgcagatcctgaaaagcaatctggcaagtatggagcagcagattgtgcaccttgagagggacataaaaaagttcccacaagcagaaaatcagcatgacaagtttgtggagaagatgacctcttttacgaagacagcccgcgaacagtacgaaaaactaagtaccatgcataacaacatgatgaagctctacgaaaacctaggcgagtatttcatcttcgatagcaagacagtgtctatagaagagttttttggggacctgaataattttcgcacactgttcttagaggcggtcagggagaacaacaaaaggagagagatggaggaaaagacaagacgggctaaacttgcaaaggagaaggccgagcaggagaaactggagagacagaagaagaaaaagcaactgatagacatcaataaggagggagacgaaactggcgtgatggataacttgcttgaagcactgcagagcggcgctgcttttagagacagaaggaagaggatccctcgcaatcctgataaccgcagagtgcctctggaacgtagcaggtcgcgtcacaatggagccatctcaagcaaatag

SEQ ID NO: 114523 - DNA, 3291 bp, Artificial Sequence
  Description of Artificial Sequence: Synthetic coding sequence
atggagcagcctggcgcagcagccagcggagccggcggcggaagcgaggagcccggtggcggaagaagtaacaaacgaagtgcagggaatagggcagccaacgaggaagagaccaagaacaaacctaaactaaatattcagatcaaaacactcgccgatgatgttcgggatagaatcaccagctttaggaaaagtactgtcaaaaaagaaaaacccttgatccagcatccaatcgatagccaggtggcgatgtccgagttcccagccgcccagccactttacgacgaaaggtcactaaatctcagcgagaaggaggtgctggacctgttcgagaagatgatggaagacatgaacctgaatgaggagaagaaagccccattaaggaacaaggacttcactacgaagcgggagatggtcgtgcagtatatctccgcaacagccaagtctggaggcctgaaaaactccaagcatgaatgcacattaagttcccaggagtacgtccacgaattgcgatcaggaatatctgatgaaaaactcttaaattgcttggagtccctgcgggtatctctcacttcaaatcccgtcagctgggttaataatttcggacatgagggattgggactgctgctagacgagctcgagaaattgctagacaagaaacaacaagagaacatcgacaagaaaaatcaatacaagctgatccagtgcctgaaggcgttcatgaataacaagtttggactccagagaatcctgggagacgaacgcagcttgctgcttttggcccgcgctatcgaccctaagcagcccaacatgatgacagagatcgtcaagattctgagcgccatttgtatagtgggagaggaaaacattttagacaaactgctcggtgccattactaccgcggcggagcgaaacaatagggagaggttttcccctatagtggaaggcttagagaatcaagaggctcttcaactacaggtggcttgcatgcagtttatcaacgccctggttacttccccttacgaactggacttcagaatccatcttaggaatgagtttctcagaagcggcctgaaaacaatgctgcctgaccttaaggagaaggaaaatgatgagctcgatatacagctcaaggtttttgacgagaacaaggaggatgatctcaccgagctgagccaccgcttgaatgacattcgggccgaaatggacgacatgaacgaggtttaccacctgttatataacatgcttaaagacaccgccgccgagaactattttctgtcaatcctgcagcacttcctgctgattcggaatgattactatatacgtccccagtactataaaataatcgaggagtgcgtctctcaaatcgtgctccactgtagtgggatggaccccgacttcaaatacaggcagagactggatattgatctcacacatttgattgattcctgcgttaacaaagcgaaggttgaagagagtgagcagaaggcagccgaattctccaagaaattcgacgaggaattcacagctagacaagaagcacaggcggagcttcagaaaagagatgagaagattaaggagctggaggcagaaattcagcaactgcggacgcaagcccaggtgctcagctctagctctgggatccctggccctcctgccgcaccaccactccccggtgtgggccccccaccacctccaccggcccctcccctgccggggggcgcccctcttccacctcccccgcctcctctgcccggtatgatgggaatccctcctccgcctccaccacctctgctgtttgggggcccacctcctcctcccccactcggtggcgtgcctccaccacctggaatatcactcaacctgccctacgggatgaaacaaaaaaagatgtacaaaccagaagtgtctatgaagagaattaattggtcgaaaatcgaacctacagaattgagtgagaattgcttctggctccgagttaaagaagacaagttcgaaaaccccgacctgttcgctaaactcgctctgaactttgcaacacaaattaaggtgcagaagaatgccgaggccctggaggagaagaagacaggcccaacaaagaagaaagtcaaggaactgcggatcctggatccaaagacagcccagaatctatccatctttctggggagttaccgcatgccatacgaggacatacgtaacgtgatcctggaagtcaatgaggacatgctctccgaggccctcatacagaatctcgtgaagcacctgcccgagcagaagatattgaatgaactcgccgagcttaaaaatgaatacgatgatctatgtgaaccagagcagtttggcgtggtgatgtcatcggttaagatgctccagccgcgcttaagcagtatcctctttaaactcaccttcgaagagcatattaacaatattaagcctagcattatcgcagttacactggcttgcgaggagttgaagaagagtgagtcatttaatcgcctgctggagcttgtgctcctcgttggcaactatatgaacagtggaagccgaaatgcacaatctcttgggttcaagattaactttctgtgtaagatacgggacacaaagagcgcagatcagaaaacaacccttttgcattttattgccgatatatgcgaggagaaatatagggatatccttaaatttccagaggagcttgagcatgttgaatcagcttcaaaagtgagtgcgcagattctcaagtctaacctggccagtatggagcaacagatcgttcatctggaaagagacatcaagaaatttcctcaggccgaaaatcagcatgacaaattcgttgagaaaatgacgatctttaccaagacagcgagggaacagtacgagaagctgagtaccatgcataacaacatgatgaaattgtatgaaaacctcggcgagtactttatttttgattctaagacagtgagcattgaagagttctttggcgacctgaacaactttcgaaccctgttcctggaagcggtacgggaaaataacaagcggagagagatggaagaaaaaacacgccgcgcaaagctggctaaggaaaaagcagagcaagagaaactggaacggcaaaaaaagaaaaaacagcttatcgacatcaataaggaaggagatgaaacaggagtcatggataatctgctagaggccctacagtcaggggctgcgtttagggaccgacgcaagaggattccaaggaacccagtcgtgaaccatccctgcgccacccgggccaatcctcgctctgctacttag

SEQ ID NO: 114524 - DNA, 3291 bp, Artificial Sequence
  Description of Artificial Sequence: Synthetic coding sequence
atggaacagcccggggccgcagctagcggcgcaggcggaggaagtgaggagcccggaggtgggagaagtaacaagcggtcagccgggaatagagctgctaatgaagaagagacgaagaacaaacccaaacttaacatccagatcaaaaccctcgccgacgacgtgagagatagaattacatcttttcgcaaatctactgtgaagaaagagaaacccctgattcagcaccctatcgatagccaggtggcaatgagtgagttccccgccgctcagcccctgtacgacgagagaagtcttaacctgtccgagaaagaggttctggatttgtttgaaaaaatgatggaagacatgaacctaaatgaggaaaagaaggcccccctgcgaaataaagatttcacgaccaagcgggaaatggttgttcagtatatttccgccacagctaaatccggcgggctgaagaatagtaagcatgagtgtaccctaagctctcaggaatacgtccacgaactccgttctgggatctctgatgaaaagcttctgaactgtcttgaatcactgcgcgtcagcctaacgtcgaatcctgtgagctgggtaaacaactttggccatgaaggcttggggctgttgctcgacgaactggaaaaactgctcgacaaaaaacagcaggaaaatatagataaaaagaatcaatataagttgattcagtgtctgaaggcattcatgaataataagtttggccttcaaaggatcttaggtgacgagcgctctctgctgttactcgctagggcaattgatccaaagcagcccaatatgatgacagaaatcgtgaaaatcctgtcagccatttgtattgtgggggaggagaacattttggacaaattgcttggagcaataactaccgcagctgagaggaataacagggagagattttctccaatagtggaggggctcgagaaccaagaggccctgcaactgcaggtggcatgtatgcagtttattaacgctctggtcaccagtccctacgagcttgattttcgaatccatctccgaaacgagtttctgaggagtggcctgaagacaatgcttcccgacctgaaagagaaggagaatgatgaactggatattcagcttaaggtgtttgacgagaataaagaggacgacctcactgagctcagccatcggctgaacgatattcgagctgagatggacgatatgaacgaagtctatcacctactctacaatatgctcaaagataccgctgccgaaaattatttcctctccatcttgcaacacttcttgttgataaggaacgattactacattcgaccacagtactacaaaattatcgaagagtgcgtttctcagatcgtcttgcattgttccggcatggacccagacttcaaatacagacagcgcctcgatatagatctcacacatctcatcgactcttgcgtcaacaaggcgaaagtggaggaaagtgagcagaaagctgctgagttttccaagaaattcgacgaggaattcactgctaggcaagaggcccaggctgagctacagaagagagacgagaaaattaaagagctcgaggccgaaattcagcagctgcgaacacaggcgcaggtactgagctcatcctcgggcattccaggtccgccggccgcaccccccctgccaggtgtgggcccacctccaccaccacccgcaccccccctgcctggcggcgcccctctgccgccaccacctcccccccttcccggcatgatggggatccctccaccacctccaccaccactgctgtttggtggtcctcccccacctccccccctgggcggggtgcccccaccacccggcatctccttgaacttaccttatggaatgaagcagaaaaagatgtataagcccgaggtgtccatgaaaagaatcaattggtctaagatcgagcctaccgagctatccgagaactgcttctggcttagagttaaggaggataaattcgagaacccggatttgtttgcgaagcttgctctcaattttgccactcagatcaaggtacagaagaatgccgaagctctggaggaaaagaaaacagggcccactaaaaagaaggtcaaagaattgcgtatccttgaccctaagaccgcccagaacctgagtatcttccttgggtcttaccgtatgccttatgaggatatccgcaacgtcatcttggaggttaacgaggacatgctctccgaagcgctgatccagaatctcgtaaagcacctgccggaacagaagattttgaatgaattggccgaacttaaaaatgaatatgatgacctgtgcgagcctgagcaatttggagtggtgatgtcaagcgtgaagatgcttcagcctcgactttcttcaattctgtttaagctgacattcgaagagcacatcaacaatattaaaccaagcataattgccgtcacactggcatgcgaagaactgaaaaagtcagagtcctttaatagactcctggagctcgtgctgctcgtggggaactatatgaattctggaagccgaaacgcccagagtttaggcttcaagataaattttctgtgcaaaattcgcgataccaagtctgccgatcagaaaacaactctcctgcatttcatcgccgacatctgtgaagaaaagtaccgcgatatactgaaattcccagaggagcttgagcacgttgaaagcgcctccaaggtgtctgcccagattctgaagagtaatctcgcatcaatggagcagcagatcgtgcaccttgagagggatattaagaagtttccccaggctgagaaccagcacgacaagtttgtagagaagatgaccagctttacgaaaaccgctcgagaacagtacgaaaagctttccaccatgcacaacaatatgatgaaactttacgaaaatctgggcgagtattttatttttgactccaaaacggtcagtatcgaagaatttttcggagacttgaacaattttcgcaccctcttcctggaagctgttagggaaaacaacaaaagacgcgaaatggaagagaagactaggagggccaaactggccaaggagaaagcggagcaggaaaaattagagcggcaaaaaaagaagaagcagctgattgacatcaacaaagagggagatgagactggcgtaatggataatttactagaagcgctgcaaagtggcgccgcctttagagatcggcgcaaacggatccctaggaaccctgtggttaaccacccctgtgcaacccgggcaaatcctaggtccgcgacatag

SEQ ID NO: 114525 - DNA, 3294 bp, Artificial Sequence
  Description of Artificial Sequence: Synthetic coding sequence
atggaacagccgggtgcagcagccagcggcgcaggcggcgggtcggaggagcctggcggggggcggtctaataagcgatcagctggtaaccgggccgcaaacgaggaagaaacaaagaataaacccaagctgagggaccgaatcacctcttttagaaaatccaccgttaaaaaggagaaaccgctgatccagcaccccatcgattcccaagttgccatgagcgaattccccgctgcacagccgctctacgacgaacgcagcctgaacctgagcgagaaggaggtcctagatctgttcgaaaaaatgatggaggatatgaatctgaacgaggaaaagaaggcaccactgcgcaacaaagatttcactactaagcgggagatggtcgtccaatatatcagtgccacggctaagtcagtgattagtagccacatcaaggggggtctgaagaacagcaagcacgaatgtaccctgtcatcgcaagagtatgtccatgaacttcgctctgggatttccgacgagaaactgctgaactgcctggaatctttaagagtgtcactcacttctaaccctgtgagttgggtcaacaatttcgggcacgaaggcctcgggctcctccttgacgagctggaaaagctattggacaaaaagcagcaagaaaacatcgataaaaagaatcagtacaagctgattcagtgcctgaaagcgttcatgaataacaagtttggcttacaacgtattctgggggacgagcgcagccttctgctgctggcgcgggccatagaccccaaacaacctaatatgatgacagagatcgtaaaaattctgtccgcgatctgcatcgttggggaggaaaacatcttagataagttactcggtgccattactactgcagccgagaggaacaatcgggaacgctttagccccattgtagagggacttgaaaaccaggaggctctgcagctccaggtcgcctgcatgcaatttatcaatgcactggtgacatcaccatacgaactcgacttccgtattcaccttcggaatgaattcctccgaagtggccttaaaactatgttacccgatctgaaggagaaggaaaatgacgaactcgatatccagctcaaggtctttgatgaaaacaaagaggatgacctgacggaactgagccatcgtttaaacgacatacgcgctgagatggacgatatgaacgaggtgtaccatttgctttataatatgctaaaggacaccgccgctgagaattacttcctgtctatcctccagcattttcttctaattcggaatgattattacatccggccacagtattacaagattatagaagaatgcgtttcccagatcgtgctgcactgttcggggatggaccccgacttcaagtatcggcaaagacttgacatcgacctcacacacttgattgacagctgcgtgaataaagccaaagtcgaggagtccgagcagaaggctgctgaattttcaaaaaaatttgacgaggagttcaccgcgagacaggaagcgcaagccgagctccagaagcgggatgagaaaatcaaggagttggaagccgagatacagcaattgcggacccaggcccaggttttatcgagctcatccggaattccagggccgccagcagccccccctttgcctggcgtgggtcctccacccccccccccagcccctccactgccaggaggggcacctctgcctccccctcctccacccttgccaggcatgatgggcattcctccacctcccccaccccctctcctgttcggcggaccaccccccccgcctccattaggaggtgtcccccccccccctggtatctctctcaatcttccatacggaatgaaacagaaaaaaatgtataaaccagaggtgtcaatgaagagaatcaattggtctaagattgaacccaccgaactaagcgaaaactgtttttggctgagagtgaaggaagataaatttgaaaacccagacttgttcgccaaactggctttaaactttgcgacccagatcaaggtgcagaaaaatgccgaggctctcgaagaaaaaaaaaccggccctacaaagaagaaagtgaaagagctgcgcatcctcgatccaaagaccgcccagaaccttagcatatttctgggcagctaccgaatgccatacgaggacataagaaatgtaatcctggaggtcaacgaagacatgctcagcgaggcccttatccagaacttggttaaacacctgccagaacagaagattttaaatgaacttgccgagctgaaaaacgagtatgatgatctttgtgaaccagagcaattcggggtggtgatgagcagcgtgaaaatgttgcagcccagactatcgtccatactgttcaaacttactttcgaagagcatatcaacaatatcaagcctagtatcattgctgtgactctggcctgtgaagagcttaagaaatctgaatctttcaaccgcctgcttgagttggttctgctggtgggcaactatatgaactctggatctaggaacgcgcaatctcttggtttcaagatcaacttcctgtgtaagatcagagatacgaagagcgccgatcagaagacaacactgctgcactttatcgcagacatctgcgaagagaaatacagggatatcctgaagttcccagaagaactcgaacatgtggagagtgcaagcaaagttagtgcccagattttgaagtccaaccttgccagtatggaacagcagatcgtacacctggagcgggatatcaaaaaatttcctcaggctgagaaccagcatgacaaattcgtggagaaaatgaccatcttcactaagaccgccagggaacagtatgaaaaattatctacaatgcataataacatgatgaaactgtatgaaaatctgggggagtattttatctttgactctaagacagtctctatcgaggagttcttcggggatctgaataacttcaggacgctgtttctagaagccgtgagggaaaataacaagaggcgagagatggaggaaaaaaccagaagggccaaactggcgaaagaaaaggccgagcaggagaaactggaacggcagaagaagaagaagcagctcattgatatcaacaaggaaggtgacgagaccggcgtaatggataacttattggaagccctgcaaagtggcgccgccttcagagaccgtagaaaacgaattccccggaatcccgacaatcggcgggtgccgctggaacggtctaggagccgtcataatggggccattagttccaagtag

SEQ ID NO: 114526 - DNA, 3306 bp, Artificial Sequence
  Description of Artificial Sequence: Synthetic coding sequence
atggagcagccgggcgctgccgcatctggggctgggggcggaagcgaggaacctggggggggccgttcaaacaagcgttctgctggaaatcgcgcagctaacgaagaggaaaccaaaaacaaaccaaaactgaacattcaaataaagacattggccgacgatgtgcgcgatcgtattacgagtttcagaaagagcaccgtcaagaaggagaagcccctcattcaacatccaattgattcccaagtagccatgagcgagtttccagccgctcagccactctacgacgaacgtagccttaacctcagtgagaaagaggtgcttgacctcttcgaaaagatgatggaagatatgaatcttaatgaggagaagaaggccccactgcggaataaagactttactacgaagcgtgaaatggtcgtccagtacattagcgcaacggccaaaagcggcggcctgaaaaattcaaagcacgaatgcaccctgtctagccaggagtacgtgcacgaactgagatctggcatctcagacgaaaagcttttgaattgcctcgagtctctgagggtgtctcttacctctaaccccgtctcgtgggtaaacaacttcggacatgaggggttgggacttctgctcgacgaattggagaaactgctggacaagaagcagcaggagaacatcgacaagaagaatcagtacaagctgattcagtgtctcaaggcgtttatgaataacaaattcggcttgcagcggatactgggagacgaacgcagcctgctcctgcttgcccgcgccattgaccctaagcagccgaatatgatgaccgaaatagtgaagattctatccgcgatctgcatcgtcggtgaggaaaatattctcgacaagctcctaggagctattactactgcagccgagcgtaataacagggaacgattttcaccaattgtcgaaggtctagagaatcaggaagcccttcagctgcaggttgcgtgtatgcagtttattaacgctctggtaacatcgccttatgaattagacttccggatccacctgcgaaatgagttcctgagatccggcctcaagaccatgttgccagatctgaaagagaaggagaacgatgaactagacatacagctcaaggtcttcgacgaaaataaggaggacgatctgacagaactttcccacagactaaacgacattagggcagagatggatgacatgaacgaggtctaccacctattatataacatgctgaaggatacggccgccgagaactactttctgagtatcctgcagcatttcctgctcatcaggaatgactactacatacgtccacagtactacaaaattattgaggagtgcgtgagtcaaatcgtgctgcattgcagtggaatggatccggattttaagtatagacaacggctcgacatcgatctcactcacttaattgattcttgcgtcaacaaggcaaaggtggaagaatccgagcagaaagccgcggagttcagtaagaaatttgatgaggaatttaccgctcgccaggaggctcaggctgagctgcaaaagcgggatgagaaaatcaaggaactcgaagccgagatacagcagttacgtactcaagcccaagtcctttcttcgagctcaggcatccccggtccccctgcagcgcctccgctacctggagtgggcccacctcctcctccgcccgctccgcccctgcccggtggagctcctctccccccaccacccccgcccctgcctggaatgatgggtatcccccccccccctccaccaccccttctcttcggcggcccccctcctccccccccactaggcggcgtcccccccccacctgggatatcgctgaacctgccctatggtatgaagcagaagaaaatgtataaacccgaagtctcgatgaaaaggatcaattggtcgaagattgaacctacagaactgagtgaaaactgcttttggcttagagtgaaagaagacaaattcgaaaatcccgacttattcgccaagttggctttaaatttcgccacacagattaaggttcagaaaaatgccgaggccctcgaagagaagaaaaccggccctacaaaaaagaaagtgaaggaacttcgaattctggacccaaaaaccgcccaaaatctgagtatctttcttggcagttataggatgccttacgaagatattaggaacgtgatactggaggtgaatgaggacatgctgtctgaggcgctgattcagaacttagtaaaacacctgcctgagcaaaagatcctcaacgagctcgcagaactgaagaacgagtatgacgatctgtgtgagcccgaacagtttggagtagttatgagcagtgtcaagatgttgcagccccgcctaagttctatcctctttaagctcacatttgaggaacatattaataacattaaaccatctatcatcgcagtgactctggcatgcgaagagctcaaaaaatctgagtcattcaatagactcttagagttggtcctgttggtgggcaactacatgaatagcggctctaggaacgcacagtcgctgggattcaaaatcaactttctttgtaagatcagggacaccaaaagcgcggatcagaagacgacacttctgcacttcattgctgacatttgtgaggagaaatacagggacatcttgaagtttccagaggaactcgaacacgttgaaagcgcatctaaggtttctgctcagattctgaaatcaaatttggcatcgatggaacagcagattgtacatctcgagagagacatcaaaaaatttcctcaagccgagaatcagcatgataaatttgtggagaaaatgaccatctttaccaagacggctcgcgaacagtatgaaaaactgtccactatgcataacaatatgatgaaactgtatgagaacctcggcgagtatttcatattcgattccaagacagtgagtatcgaggaatttttcggggatcttaataattttagaaccctgttcctggaggccgtgcgggaaaacaacaaacgacgcgagatggaagaaaagacccggcgggctaaactcgcgaaggagaaagcggaacaggaaaagttggaaaggcagaagaagaagaaacagctgattgatatcaacaaagaaggcgatgagaccggcgtaatggacaacctattagaagctctgcagtccggagccgcattcagagatagacgcaagcgcattccgcggaatcccgataaccggcgcgtgcctctggaaaggtcgagatctcgtcacaacggagctatctcctcaaagtag

SEQ ID NO: 114527 - DNA, 3312 bp, Artificial Sequence
  Description of Artificial Sequence: Synthetic coding sequence
atggagcaacctggagccgccgcttccggcgctggcggcggcagcgaggagcccggaggaggccgatccaataaacggtcagctggaaatagggctgccaatgaagaagaaactaaaaacaaaccgaagcttaatattcagatcaagaccctggccgacgacgtgcgcgatagaattacttccttccggaagagtaccgtgaagaaagaaaaacccctgattcagcaccccatagactcccaagtggccatgtccgaattcccagctgcccagcctctgtatgacgaacgatcactcaatttgagtgaaaaggaagtccttgacctgttcgagaagatgatggaagatatgaacctgaatgaagagaaaaaagcacccctgcggaataaggactttaccactaaaagagagatggtggtgcagtatatcagcgctaccgccaaatccatcgtgggcagtaaggtcacaggcgggctgaaaaactctaagcatgaatgcaccctgtcaagtcaagagtacgtgcacgagttgagatctgggattagcgacgaaaaactattaaactgcctggagagtctccgggtctctctgacgagcaatcccgtgtcatgggtcaacaacttcgggcatgagggtctaggcttgctgcttgatgagctagaaaagctgctcgacaagaagcagcaggaaaatatcgataaaaagaatcagtataagctcattcagtgtctcaaggcctttatgaacaacaagtttggtctccaacgcattctgggtgacgaacgtagcctgctgctgttagccagagcaatcgaccccaagcagcctaatatgatgactgagatcgtgaaaatactgagcgccatctgcatcgtaggcgaggagaacatacttgataagttgctcggcgctattaccacagccgctgagcgaaacaatcgtgaacggttctcaccgatcgttgaaggtctcgagaatcaggaggcacttcagttgcaagtggcctgcatgcaattcatcaacgccttggttacaagcccatacgagttggattttcggatccatttgcggaacgagtttctcagaagcggtttgaagacgatgcttccagacctgaaggaaaaggagaatgatgaactcgatatccaactgaaggtattcgatgagaataaagaggatgacctgaccgagctttcccacagactcaatgatatccgagcggagatggacgacatgaatgaggtctaccacctgttgtataatatgctgaaagatactgcggctgagaattatttcctcagcatactgcagcactttctgctgattcgaaatgattactatatcagacctcagtattacaaaataattgaggagtgcgtgtctcagatcgtcttgcattgtagcggtatggacccagattttaaatatcgacagcggctggatatcgatctgactcatctcatcgactcctgtgtaaacaaggcgaaggtggaagaatccgagcagaaagctgccgaatttagcaagaagttcgatgaggaattcaccgcccgacaggaggcccaggccgaattacaaaagcgtgatgagaagattaaagaactcgaagccgagatccagcagctgcgtacccaggcccaagtcctgtccagtagttccgggatccccggacctcctgcagcacctcccctgcctggggttggtccaccaccacctccacctgccccacccctgcctggcggggccccactgcctccgcctccccccccactaccaggaatgatgggcattccaccacctcctcccccccctttgctgtttggtggtcctcctccaccccctccgctcggaggagtcccccccccacccggcatatcactgaacctcccatacggtatgaaacagaaaaagatgtacaaacccgaggtgagcatgaagaggatcaactggtctaagattgaaccaaccgaactgtcagagaactgcttttggctgcgcgtgaaagaagacaagttcgagaaccccgaccttttcgccaagcttgctcttaattttgctactcagataaaggtccagaagaatgctgaagcactagaggagaagaagaccgggccaacgaagaagaaggttaaagaactacgaatcttagaccctaagacagcacagaatttgtctatctttctggggagctataggatgccctacgaggatattaggaatgtgatcttggaggtgaacgaggacatgctgagtgaagctctgatccagaatctcgtgaaacaccttccagaacagaagatcctgaatgaattagccgagctgaagaacgaatatgacgatctttgtgagccagagcagtttggagttgtcatgtcctccgtcaaaatgctgcagccccgcctgtcatcgatactgttcaaactcacgtttgaagaacacattaacaacattaaaccttcgataatcgctgtaactcttgcctgtgaagaactgaagaaatccgaaagcttcaatagattgctggaactggtgctgctggtagggaattacatgaactctgggagccgcaacgctcagagtctggggttcaaaatcaatttcctgtgtaaaattagggacaccaagtcagccgaccagaagacaacactgctccatttcattgccgatatttgcgaagagaagtatcgcgacatactaaaatttcctgaagaactggaacatgtggagagtgcatccaaggttagcgcccagatattgaaatcaaacttggctagcatggagcagcagattgtgcacttagagagggatattaagaaattccctcaggccgagaatcaacacgataaattcgtggaaaagatgacaatcttcactaagacagcccgagaacaatatgaaaagctgtctacgatgcacaataacatgatgaaactatacgaaaatctgggggaatatttcatattcgactccaagacagtgagcatcgaggaattttttggtgacctcaacaactttcggaccctcttccttgaggccgtgcgtgaaaataacaaacgacgcgagatggaagagaaaactcgaagagcaaaactggctaaagagaaggccgaacaagagaaactggagcgccagaagaagaaaaagcagctgattgacattaacaaggaaggggacgaaaccggagtcatggacaaccttctggaagctctacagtctggagcagccttccgggaccgccgaaaaaggatcccacggaaccctgtcgtcaatcacccgtgtgcaacccgcgccaacccaaggagcgccacctag

SEQ ID NO: 114528 - DNA, 735 bp, Artificial Sequence
  Description of Artificial Sequence: Synthetic coding sequence
atggagcttttcctcgctggacgccgcgttctcgtgactggcgccgggaaagggatcggcagaggcacagttcaggcattgcacgccaccggggctagagtggtggccgtttcccgtacacaggctgacctggattctcttgtccgcgaatgccctgggatcgagcctgtatgtgttgatctgggagactgggaggctacggagagggcacttggctccgtggggccagttgacctactggttaacaatgccgcagtggcgttgctgcagccattcttggaggttaccaaggaagccttcgacaggtcgtttgaggtcaatttgagagcagtgatccaggtctcacagatcgtcgccaggggtctgattgcacgaggtgtgccgggcgcaatcgttaatgtatcttcccaatgctcccagagagcagtgaccaaccactcagtctattgcagtaccaaaggagccctggatatgctgactaaagtgatggcgttggagctgggcccacacaaaattagagtcaatgccgtgaacccaactgtcgtgatgacttccatgggccaggccacatggagcgacccccacaaggccaaaacaatgctgaaccgcattccccttggcaagttcgcagaggtggagcacgtcgtaaacgctattctttttctgctctctgaccgcagtggcatgacaaccggaagtaccctgccagtcgagggcgggttctgggcctgctag

SEQ ID NO: 114529 - DNA, 5769 bp, Artificial Sequence
  Description of Artificial Sequence: Synthetic coding sequence
atgaagtctcccgcgctgcaacccttgtccatggcgggactccagctgatgacgccagcttctagccccatggggcccttcttcgggctcccttggcagcaggaggcaatccatgacaacatctatactccacgaaagtaccaggtagagttattagaagcagctctggatcacaacactatagtttgtctgaacactggttctggcaagacatttatcgccgtacttctcacaaaagaattgagctaccaaattaggggcgattttagtcggaacgggaaacggaccgtgttcctggtcaactctgccaaccaggtagcccagcaggtgagtgctgtgaggacccattctgacctaaaagtgggggagtatagcaatcttgaagtaaacgcttcctggactaaagagcggtggaatcaagagttcactaagcatcaagtgctgattatgacatgttatgtggccctaaacgtcttaaaaaacgggtacctcagcctatccgatatcaacctgcttgtgttcgatgagtgccacctggccatcctggatcatccttatcgggagataatgaagttgtgcgagaactgtccgtcctgcccccgtattttgggactgaccgccagcatcctcaacggaaagtgtgatcccgaggagttggaggagaagattcagaagcttgagaagatcctgaagagcaatgctgaaaccgccaccgatctcgtggtcctggaccgatacacatcacaaccgtgcgagattgtggtagactgcggcccattcaccgatcgctccgggctctatgaaaggctcctgatggaactcgaggaggccctcaattttatcaatgactgtaacatcagcgtacactcaaaggaacgtgatagtaccctcatttccaaacagatcctgtcggactgccgagcggttctcgtggtcttggggccctggtgtgccgacaaggtggctgggatgatggtgagggaactgcaaaagtacatcaaacacgagcaggaggagcttcatcgtaaattcctgctattcacagacaccttcctgagaaaaatacatgctctctgtgaggaacatttttcccctgcatcgctggatcttaagtttgtgaccccaaaagtgataaagctgctcgagatcttgcggaagtacaaaccctacgaaaggcaacagttcgagtccgtggagtggtataacaacagaaaccaggataattacgtgtcatggagtgactccgaagacgatgatgaagatgaggaaatagaggaaaaggagaaacccgagacaaatttcccatcacccttcactaacatcctctgcgggataatctttgtggaacggaggtacactgccgtggtgttgaaccgccttatcaaggaagccggcaagcaggatccagaacttgcctacataagtagcaactttatcacagggcacggaattggcaagaatcagccccggaataaacagatggaggccgaatttagaaaacaggaagaggtgcttcgaaaattccgcgctcacgagacaaacctgctgatcgccacatctattgtggaggagggcgtcgatatccctaaatgcaacctcgtggtacgattcgaccttcctacagagtacagatcttacgtgcagtcaaagggacgtgcacgagcacccatcagtaattacatcatgttggcagacacagataagattaaaagtttcgaggaggacctgaagacatataaggcaatcgagaaaattctgagaaataaatgttcaaaaagcgttgacactggagaaaccgacatcgatcccgtcatggacgatgatgatgttttccccccctacgtgttaaggccagatgacggcgggcctcgggtaaccattaacaccgctatcggtcatatcaacagatattgcgctaggttgccctctgatccatttacacatttggccccaaagtgtagaactcgagaacttcctgacggaaccttttactcgacattgtaccttcctatcaatagcccactcagagcctccatcgtcggccccccgatgagttgcgtgagactggcagagagagtagttgctttgatatgctgcgagaaattgcacaagattggtgagctcgacgatcacctgatgccggtggggaaggagactgtaaaatatgaagaggagcttgatctgcatgatgaagaggaaacctccgtgcccgggcggcctgggtccacaaagcggagacagtgttaccccaaggctattcccgaatgcttacgcgacagttatccacgtcccgatcagccttgctatttgtacgtcattggtatggtgctgaccaccccattaccagatgaactgaattttcgaagacgcaaactgtacccacctgaggatacaacacgctgtttcggaattttgacagcgaaacccattcctcaaattcctcacttccctgtatacactaggagcggtgaggttacaatttccattgaactgaagaaatctgggtttatgctgagcctgcagatgcttgagctaattacgagactccatcagtacatcttttcccatatcctcagattggaaaagcccgcgctggaatttaagcccaccgacgcggatagcgcctattgtgttttgccgctgaatgtagtgaatgattcgtctaccttagacatcgattttaagtttatggaagatatcgagaaaagtgaggctcggattggcattccctcaactaagtataccaaggaaacaccattcgtgtttaagctcgaagattatcaggacgcagttattattcctaggtataggaatttcgatcagccacaccggttctacgtggctgatgtatatacagatctcacccccttgtccaaattcccttctcctgagtatgagacctttgccgaatattacaaaactaagtataatctagacctgacaaatcttaaccaacccctactggacgtggatcatacttcatctcggctcaacctacttactcctcgtcacctgaaccagaaaggcaaggccctgcctctgagtagcgcggaaaagcggaaggccaaatgggaatccctgcaaaacaagcagattttagttcccgagctctgcgccattcatcctatccccgcgtctttatggcgtaaagcagtctgcctcccgtccattctctatcggctccattgcctgctgaccgcagaagagctgcgcgcccagacggcctcggatgccggcgtgggcgtccgtagcttgccggctgactttcggtaccccaatttggatttcggttggaaaaagtccatcgattctaaaagctttatcagcattagtaattcctccagcgccgaaaacgacaactactgcaagcatagcacgatcgttcccgaaaatgcagcccatcagggagccaaccggacttccagcttggagaaccatgaccaaatgtcggtgaactgccggaccttgttaagtgagagcccagggaagctgcacgtggaggtcagtgccgatttgacagctatcaacggcctgagttacaatcagaacctggctaacgggagttacgatctagctaatagagacttctgtcagggaaaccaactgaactactacaagcaggaaatacccgtccaacccacgacgagctactcaattcaaaatttatacagttacgagaatcagccacagccatctgatgagtgtacactgctatcgaataagtacctggacgggaacgccaacaagtcgacaagtgacggttcgcctgtgatggcggtgatgccagggactaccgatactatacaagtcttgaaagggcgcatggacagtgagcaatccccaagcattgggtacagttccagaactctgggcccaaaccccggattgatcctgcaggctctgactctgtctaacgcctccgacgggtttaatctggagaggttagagatgctcggtgattccttcctcaagcacgctattacaacctatttattctgcacctatcccgacgctcacgagggaagactgagctacatgaggtcgaagaaagtgtctaactgcaacctgtaccgtctggggaagaaaaagggactgccatctaggatggtggtgagtatcttcgatccacccgtgaactggcttccacccggctatgtggtcaaccaggacaagtccaacactgacaagtgggagaaagacgagatgactaaagattgtatgctagcaaacgggaaattagatgaggattatgaggaagaagatgaagaggaggaatccctcatgtggagagcaccaaaggaagaggctgattatgaagacgattttctggagtatgaccaggaacatatcagattcatcgataacatgctcatgggttcaggtgcctttgtgaaaaaaataagcctctctcctttctctactactgactctgcctatgagtggaagatgcccaagaaaagtagtctgggaagcatgccattctctagcgattttgaggactttgactactcttcctgggatgcgatgtgttacctggacccctctaaggctgtggaggaggacgatttcgttgttggcttctggaatcccagtgaggaaaattgtggggttgatactgggaagcagtccattagttacgatctacatacagagcagtgtatcgcagacaaaagtatagccgattgcgtggaagctctgcttgggtgctacctcactagttgcggggagagggctgctcagctgttcctatgctccctgggtctgaaagttttgccagtcatcaagcgcaccgatcgagagaaagctctttgcccaacacgagagaacttcaattcccagcagaagaacctctcggtctcatgcgccgccgcctcagtggcgagtagccggagctcagttctgaaagacagcgagtacggttgtctcaagattcccccacgctgtatgttcgaccaccccgatgccgacaaaaccctgaatcacttgatatcaggcttcgagaactttgaaaagaagattaactaccgcttcaaaaacaaggcatatctgctgcaggcctttacccacgcaagctaccactataacactattacggactgctaccagagactagagttcctcggcgatgccatccttgactatctgattaccaagcacctttacgaggacccgcgtcagcattccccaggggtcctcacggatctacggtctgcgctggtgaataacactatctttgcttcgctggcagtgaagtatgactaccataagtacttcaaggcagtctccccagagctctttcacgtcattgacgattttgtgcagtttcagcttgagaaaaatgagatgcagggcatggattctgagttgcgacggagtgaagaagacgaggaaaaggaagaagatatcgaagtgccgaaagccatgggcgacatcttcgaatctctcgccggagctatttacatggattctggcatgagcctggaaactgtgtggcaggtttactaccccatgatgagacctctaatcgagaagttttctgctaatgtcccccggtctcccgtgagggaactcttagaaatggaacccgagactgccaagttctctcccgcggaacggacttacgacgggaaggtgagggtgacagtagaagtggttggcaagggcaaattcaagggcgttggaagatcataccggattgcaaaatccgctgccgcaagacgcgccctccggagcctaaaagctaatcagccccaggtcccaaattcttag

SEQ ID NO: 114530 - DNA, 5769 bp, Artificial Sequence
  Description of Artificial Sequence: Synthetic coding sequence
atgaagagtccggcccttcagccgctgagtatggcggggctgcagttgatgaccccagccagtagtcccatgggacctttctttggccttccctggcagcaggaggctatccatgataatatctacactccacggaaataccaggtagagctcctcgaggccgccctagaccataatactattgtctgcctcaataccgggtccggaaaaacatttattgccgttctcctcactaaggaactgagctatcagattcgtggggatttttctcgtaacggtaaaaggaccgttttcctggtaaatagcgctaaccaggtggctcaacaggtttccgccgtgcgcacacacagcgacctcaaggttggagagtatagcaatttggaagtcaacgcatcttggaccaaagagcgatggaatcaagagtttaccaaacaccaggtcttaatcatgacgtgctacgtggctcttaacgtcctaaaaaacggataccttagcttgtccgatataaacctgctcgtgtttgatgagtgccatttggcaatcttggaccatccctacagagagatcatgaagctgtgtgaaaattgcccatcctgtccacggatcctgggattgacagcgtccattctcaacgggaagtgtgatccggaagagcttgaggaaaagattcagaaattagaaaagatcctcaagtccaatgcagaaaccgcaactgacctggttgttctcgatcggtataccagtcaaccttgtgaaattgtggtggactgcggccccttcactgatcgctccggcttgtacgagcgactgctgatggaactcgaagaagccctgaatttcatcaacgactgtaacatcagcgtacacagtaaagagagggatagcactttgattagcaaacagatactaagcgattgcagggcagttcttgtcgttttaggtccctggtgcgccgacaaggtggctgggatgatggtgcgggagctgcagaaatatatcaaacatgagcaagaggaactgcacagaaagttccttctgttcacagacacctttctgcgaaagattcacgcattatgcgaggaacacttcagcccagccagcctcgacctgaaattcgtcacacccaaagtgataaaactgcttgaaatactgagaaagtataaaccctatgaaaggcagcagtttgagagtgtggaatggtacaacaatcgtaaccaagacaactatgtcagttggagcgactctgaagacgacgacgaagacgaggagatcgaggagaaggagaaacccgaaacgaacttcccaagtccttttacaaacattctatgcggcatcatatttgtggaaagacggtacactgctgtggtacttaacagactaatcaaggaggccggaaagcaagacccagagctggcctacataagtagcaatttcatcactggtcatgggatcggaaaaaaccagccaaggaacaaacaaatggaggctgaattcaggaaacaggaggaggtgctcaggaagttcagagctcacgagacgaacctgctgatagccaccagcatagtggaggaaggagtcgacatccctaaatgcaatctagttgttagatttgacctaccgaccgagtaccgaagttacgtgcagtctaaggggagagcccgggctcccatttctaactacatcatgttagctgacacggataagatcaaatcatttgaagaggatctcaagacttacaaggcaattgagaagatcctgagaaacaagtgctcaaaatccgtggacactggcgagactgatattgaccctgtcatggatgacgatgacgtgttcccaccatacgtgctccgaccggatgacggcggacccagagtgacaatcaacaccgcaatcggacatattaatagatactgcgcccggctcccctccgacccctttacgcacctggcacctaaatgccgtactagggaattgccagacggcactttctattcaaccctatatctgcctattaattctccactgcgggcatcaatagtgggtcctccgatgtcctgcgtgagattggctgaacgtgtggtggcactgatctgctgtgaaaagctccacaagatcggtgaactggacgatcacctcatgcccgtaggaaaggagaccgttaaatacgaagaggagcttgatctccacgacgaggaagagaccagtgtccctggcagaccagggtcgacaaagagacgacaatgctaccccaaagctatcccagagtgcctgcgtgattcttacccaaggccggaccaaccctgttatctgtacgtgataggtatggttttgacaactccactccccgatgagctcaacttccgtagacgcaagctctatcctcctgaggatacgacccgctgctttggcatcctcacggcaaagcccattccccagatccctcactttcctgtctacactaggagcggagaagtaaccatctcaatcgagctgaagaaaagcggtttcatgctgtcactacagatgcttgaactcatcacaagactgcaccagtacatcttctcccatatactacgtcttgaaaagccagcactggagttcaaacctaccgacgcagactccgcatactgcgtgttgcccctgaatgtcgtgaatgactcaagcactcttgacattgacttcaagttcatggaagatatagaaaaatcggaagccaggattggcattccgagcacaaaatatacaaaagaaacaccctttgtctttaagttggaagactaccaggacgccgtgatcattcccagataccgcaactttgaccagccccatcggttttacgtcgctgacgtgtatacggatttaacacctctaagtaaattcccatcccctgagtatgagacgttcgcagaatactataagaccaagtacaatctggatctcactaatttgaatcagcctctgctcgacgtggatcatacttcgtcaagactcaacctgctcacacccaggcacctcaaccagaagggcaaagcattgccactgtccagtgctgaaaagagaaaggccaaatgggagtcactgcaaaacaaacaaatcctagtgcccgagctttgtgctatccaccctattccagcctctctgtggagaaaggcagtatgcctgccatcaatcttgtatcgattgcattgcttgctcacagcagaggagctgcgagcccaaaccgcatctgacgctggcgtgggcgtacggtccctgcctgccgactttagataccccaacctggatttcggttggaagaaatccatagactctaagtcctttatctctatctcgaattcctcctctgctgaaaacgacaattactgcaaacactccacgattgttcctgagaatgcagctcatcagggagctaatcgaacttcatccctggagaaccacgatcagatgagtgttaactgtagaacacttctctcggagtctcctggcaaacttcatgtggaagtgtcagcggatctgactgctattaacggcctctcatataaccagaatctagcgaacgggagctatgatctcgcgaatagagacttctgccagggtaatcaactgaattactacaaacaagaaatccccgttcagccaaccacatcctactctatccagaacctttattcctacgagaatcaaccacagccttcagatgagtgcacactcctatctaacaaatatctcgacggaaacgcaaataagagcacctccgatggctctccagtcatggcagtgatgcccggtaccaccgacaccattcaggtgcttaaaggaaggatggattccgagcagagccctagtataggatattctagccgcacccttggccccaacccggggttaattttgcaggcactcactctttccaatgccagcgacggattcaacctcgagcgactggagatgctgggcgattcgttcttaaaacacgctatcacgacgtacctattttgtacttacccagatgctcatgaaggccggctgagctatatgagaagcaagaaagttagcaactgcaacctgtaccgactgggaaagaagaagggcttaccgtcccgaatggttgtgtctatctttgatccacctgtaaattggttgccacctggatacgtcgtcaaccaggataaatccaatacggataagtgggagaaggacgaaatgactaaggactgcatgctcgctaacgggaaattggacgaggactatgaagaagaggatgaggaagaggaatctctgatgtggagggcccccaaagaagaagccgactacgaagatgatttcctggagtacgatcaggaacacattcgtttcatcgacaatatgctgatgggctccggagcattcgtcaagaagatcagtttgtcacccttcagtactacagattccgcatacgagtggaagatgcctaagaaatcttccctcggtagtatgccattctctagtgatttcgaagacttcgattacagcagttgggatgctatgtgttacttggaccccagcaaagccgtggaagaggatgattttgtcgtaggattctggaatccttccgaagagaactgcggcgtggacaccggaaagcagtccatcagctatgacctgcacactgaacagtgcattgctgataagtctatagcggactgcgtggaggctctgctgggctgttacctcacatcttgtggcgagcgggctgctcagttgtttctctgttcactgggacttaaagtgcttcctgttatcaaacgcacggacagggagaaggccttgtgccctacgcgcgagaactttaattcacaacagaagaatctgtctgttagttgtgccgcagcatcagtggcgagtagccgtagctctgtgctgaaggattccgagtacgggtgtctcaagataccaccacgctgtatgttcgatcatcccgatgctgacaagacactcaaccacctgataagcggcttcgaaaatttcgagaagaagattaattatagattcaagaataaggcttatctgctgcaggcttttactcacgctagctaccactacaatactatcaccgactgttatcagagactggaattcctgggcgatgcaatcctggactatctgatcacaaaacacctgtatgaggatcccagacagcacagccccggtgtgcttaccgatctgagaagtgcactcgttaacaacactatcttcgccagcctggcagtaaaatacgactatcataagtatttcaaagccgtgtcaccagagctgttccatgttatcgacgacttcgtgcagtttcagctggagaagaacgaaatgcaaggaatggattccgagttacggcggagtgaggaagatgaggaaaaggaagaagacatagaggtccccaaggcgatgggggacatctttgagtcattggccggagccatatacatggattcgggcatgagccttgagaccgtttggcaagtctactacccgatgatgcggccgctgatagaaaagttttccgcaaatgtgccgcggagtcccgtccgtgaattgctggagatggaacccgagaccgccaagttcagtccagccgagaggacctacgacggcaaggtccgggtgacggtcgaggttgttggaaagggaaaattcaagggcgtcggccggagctataggattgccaagtcggcggcagcgcggagggccctccgaagtctgaaagccaatcagccacaggtgcccaattcttag

SEQ ID NO: 114531 - DNA, 5769 bp, Artificial Sequence
  Description of Artificial Sequence: Synthetic coding sequence
atgaagtctcctgccttgcagcctctgtccatggccggtttacagctaatgactcccgccagttcgccaatgggaccttttttcggcctaccatggcagcaagaggctatacacgacaacatctacacccctcggaaataccaggtcgaactgttggaggctgccctcgaccataacaccattgtgtgtttgaatacaggctccggaaagacattcatagctgtgctgctcaccaaggagctgagttatcagataagaggagacttctccaggaacgggaagaggaccgtgtttctggtgaactccgcaaatcaggttgcccagcaagtaagcgccgtacgaacgcacagcgacctgaaggtgggcgagtattcgaacctagaagtgaacgcctcctggacgaaagaacggtggaatcaggaatttaccaaacatcaagtcctgatcatgacatgctacgtggctctgaatgtactcaagaatgggtacctgtctttatccgacatcaaccttctggtcttcgatgagtgtcacttagcaatcttggaccatccttaccgcgagatcatgaaattgtgtgagaattgcccttcctgccccaggatcctgggcctcaccgcgtctattctgaatggcaagtgcgaccctgaagagctcgaagagaagatccagaagcttgagaagatcctcaaatccaatgctgagactgccactgacttggtggtactggataggtacacctcccagccctgtgagatcgtcgtcgactgcggcccattcactgaccgcagcggcctgtatgagagactgcttatggagcttgaggaggcactgaattttatcaacgattgtaacatttcagtgcacagcaaggaaagggactctaccctgattagtaaacagatcctcagtgactgcagagccgtcttggtggtcctaggaccctggtgcgccgacaaagtggccgggatgatggtgcgtgagctgcaaaagtatattaagcatgagcaggaagaactccaccggaagttcctgctgttcaccgacacatttctgagaaagattcacgccctgtgtgaagagcacttctcacctgcctcacttgacctcaagtttgtgacacctaaggtaattaaactcttggaaatattgagaaaatacaagccctacgaacggcagcagtttgaaagcgtggaatggtacaataaccgcaatcaagataactatgtctcttggtccgacagcgaagacgatgacgaggacgaggagattgaggaaaaagagaaaccagagactaattttccaagcccattcactaatatcctgtgcggcataattttcgtggagaggcgatataccgcagtggtcttgaaccgacttatcaaagaagctggcaaacaagaccctgagctggcatacatttcatcaaattttattactggccatgggatcggaaagaaccagccaagaaataagcagatggaagcagaatttagaaagcaggaagaggtattgagaaaattccgggcacacgaaaccaacttactgattgcaacaagcatagtcgaagaaggagtggatatccctaaatgcaaccttgtggttcggtttgatctgcccacagaatacaggtcctatgtgcaaagcaaaggccgtgctcgtgctcccatctctaactacattatgctagccgacaccgacaaaataaagtcttttgaagaagatttgaaaacttataaggccatcgagaagattcttcggaacaaatgctctaagtctgtggacacaggagagacggatatagacccagttatggatgacgatgacgtctttcccccttacgttctcaggccagatgacgggggcccacgcgtaaccattaacaccgcaataggccacatcaatcgatactgcgctaggttacccagtgacccatttacgcacttagccccaaagtgccgtacccgtgaactgcctgacggtacattctacagtactctgtacctgcctataaacagtccactccgtgcaagtatcgttggcccccctatgagctgcgtccggcttgccgaacgcgttgtggccctcatttgctgtgagaaacttcacaaaatcggagagttggatgatcacttgatgcccgttggcaaggaaacagttaagtacgaagaggagttagatctccacgatgaagaagagactagcgtaccgggacggcctggttccacaaaaaggcggcaatgctaccctaaggcaatccccgagtgtctgagggactcctacccacgacctgatcagccctgctacctctacgtcattggtatggttttaacaaccccgttgcccgacgagctcaattttagaaggcggaagctatatcccccagaagatacaacgaggtgctttgggatcctgaccgccaaaccaatccctcaaatcccacacttccccgtgtatactcggtccggagaagtgacaattagcatcgagctcaagaagagtgggtttatgctgtccttgcagatgttggagctcatcacgaggctgcaccagtacatcttttctcatatacttcgcctcgagaagccggcactggagtttaagcctactgacgccgactctgcgtactgcgtgctcccactgaacgttgtcaacgattccagcaccctagacattgacttcaagttcatggaggatattgagaagagcgaagcgcgcatagggataccttccactaagtatacaaaggagactcctttcgtattcaagctggaggattatcaggatgctgtgattatcccccggtaccggaacttcgatcagcctcaccgcttttacgttgcggatgtctatacagatttaacaccactttccaaattcccatcgccggaatatgagaccttcgcggaatattacaagaccaaatacaatctcgatcttaccaatttaaaccaacccctcctggacgtggatcacactagttcaaggctgaacttattgaccccaagacatctcaaccagaaggggaaagcacttcctctaagttccgccgaaaagagaaaagcaaaatgggagtcactacaaaacaagcagatcctagtgccagaattgtgcgcgatccaccctattccagccagcttatggagaaaggccgtctgcttaccttcaatcctgtaccggctccattgcttattgacggccgaggagctcagagcccagacggctagcgatgcgggagtgggggtgagaagccttcccgcagattttagataccccaatctagactttgggtggaaaaaaagcattgattccaagagcttcatcagcatctccaatagcagctctgccgaaaatgacaactactgcaaacactcaacaattgtgcctgagaacgcagcccaccagggcgctaaccgcacatcatccttggagaatcacgatcagatgtctgtaaattgcaggactcttctgagcgagtctccaggcaagttgcacgtggaggtctccgctgatctgaccgcaattaatggactatcatataatcagaatcttgcaaatggcagctacgaccttgccaatcgcgacttctgccaagggaaccaactcaactactacaaacaggaaatcccggtgcagccgaccaccagttactcgattcaaaatctttactcttacgagaaccaacctcaacccagcgacgagtgtaccctgctctccaataagtacctggatgggaacgcgaacaagagcacttcagacggtagcccagtgatggctgtgatgcctggtaccacagacacaattcaggtgctaaaaggccggatggattctgagcagagtccttccataggttatagtagcagaactctgggcccgaatcccggcctgattcttcaggcactgacgctgtccaacgcctccgacggatttaatcttgagcgtctggaaatgctgggagatagcttcctgaagcatgcaatcaccacatacctcttctgtacataccccgacgcccatgaggggcggctgtcatacatgaggagcaaaaaggtctctaattgcaatctgtatagactagggaagaagaaggggttgcccagccgaatggtggtctcaatcttcgaccctccagtgaattggctgccccctggctacgtcgtgaaccaggacaaatccaacaccgataaatgggagaaggacgagatgaccaaggattgcatgctggccaatggcaagcttgacgaggactatgaagaggaagacgaagaagaagaatcattgatgtggcgcgcaccaaaagaggaagcagattacgaggatgatttcttggagtatgaccaggagcacattcgctttattgataatatgctgatgggctctggcgcattcgtgaagaaaatctctttgagcccgttttcgaccacagactcggcctacgaatggaaaatgcctaagaagtcaagtctggggagtatgccattttcctcagattttgaagatttcgattactctagttgggatgctatgtgttatctggatcccagtaaagcagtagaagaggatgactttgtggtgggcttctggaatccaagcgaagagaactgcggagtcgacactggcaagcaatcaatttcctacgatctgcacaccgaacagtgtatcgcggataagagcattgcggattgcgtcgaggccctcctgggatgctatctgactagttgcggggaacgggcggcccagctgtttctatgcagcttaggtttaaaagtgcttcccgttatcaagcggactgacagggaaaaagctctgtgccctacccgagaaaattttaacagccaacaaaagaacctctccgtaagttgtgccgcggcaagcgttgcaagttcgcggtccagcgttctgaaggacagtgagtacggttgcctgaagatcccaccacgatgtatgttcgatcatccggatgctgataaaacacttaatcacctcattagcggtttcgaaaatttcgaaaagaagatcaactatcgcttcaagaataaggcttacctgctgcaggcattcactcacgcatcttatcattataacaccattactgattgttaccaacgcctggaatttctgggtgacgccatactggattacctgattacaaaacacctgtacgaggatccccgtcagcacagccctggggtgctcaccgatttgagatctgcacttgttaacaacacaatcttcgctagcctggcagtcaagtatgactatcacaaatactttaaagccgtttccccggaactattccatgtcattgacgatttcgtgcaattccagctcgaaaaaaacgagatgcaggggatggacagcgaactcaggaggtcagaagaagatgaagagaaggaagaggacatcgaagtgcctaaggcgatgggggacatcttcgagtccctagccggcgctatttacatggattctggaatgtctttggagacagtgtggcaggtctattatccaatgatgagaccactgatcgaaaaattcagtgccaacgttccccgcagtcctgtcagagagcttcttgaaatggagcccgagactgccaagttttcccctgctgagcgcacatacgatgggaaggtcagggtgactgtggaagtggtgggaaaagggaagtttaagggtgtcggtcgctcctaccggatcgctaaatctgccgcggcacgaagagcactgcggagcctgaaggccaaccaaccacaggtgccaaattcctag

SEQ ID NO: 114532 - DNA, 5769 bp, Artificial Sequence
  Description of Artificial Sequence: Synthetic coding sequence
atgaagtctcccgctctgcagcctctttccatggccgggctacagctcatgactcccgccagtagcccaatgggccctttctttggcctgccatggcaacaggaagctatacatgataacatatacacgccccgtaaataccaagtcgagttactggaagccgctctcgaccataacactatcgtgtgtctaaatactggaagcggaaagacattcatagccgtgctgttaactaaggagctgtcctaccagatccgaggggacttttcccgaaacggcaagaggactgtgtttctggtgaacagtgctaaccaagttgctcagcaagtgtccgcagtccggacgcattctgatttgaaggtgggagagtacagcaatctcgaagttaatgccagctggaccaaagagcggtggaaccaggaattcacgaagcaccaagttctaattatgacctgctacgtcgccctcaatgtgctcaagaacggatatctgtccttgtcagacatcaacctgcttgtattcgacgagtgccacttggcaattctcgaccacccgtatagggagatcatgaaactctgcgagaattgtccgagctgccctcgtattctgggactcacagccagtattctcaacgggaagtgtgatccggaggagctcgaagaaaaaatccagaagttggaaaaaatcctcaaaagtaatgctgagacggccactgacttggtggtgctggacaggtacacctctcagccttgtgaaatcgtcgttgattgtgggccatttactgatcgctccggcttgtacgagaggctcttgatggagttagaagaagcacttaatttcattaacgactgtaacattagcgtgcacagcaaagaaagggattctaccctgatttctaagcaaatactatccgattgccgggcagtgctggtagtcctgggcccatggtgcgccgataaggtggccggtatgatggtccgcgagttgcagaaatatatcaaacatgaacaggaggaacttcatagaaaattccttctgtttaccgacacatttttgaggaagatccacgccctgtgtgaagaacacttctcccctgcatctcttgatttgaagtttgttacccctaaagtgattaagttactggagatcctcagaaagtataagccttacgaaaggcaacaattcgagagcgttgagtggtacaataatcggaaccaagacaactacgtgtcatggagcgattctgaggatgatgatgaggacgaagagattgaggagaaagaaaaacctgagaccaatttcccctctccattcacaaacatcttgtgcggcatcattttcgtggaacggcgatataccgcagtggttcttaatcggctgatcaaggaggcggggaagcaggaccccgagttagcctacattagcagtaatttcattaccggacatggcattggcaaaaaccaacctcgcaataagcagatggaggccgagttcagaaagcaagaggaggtgctgaggaaattcagagcgcacgaaacaaacctgttaatcgccacatcaattgtggaagaaggggttgatataccgaagtgcaatctggtagtccgcttcgatctacccacagagtatcggtcatatgtccaatctaagggccgggctcgggcacctatctctaactatatcatgctagccgatacagataagatcaagtcctttgaagaggacctgaaaacatataaggccatcgaaaagattctgagaaacaaatgcagcaagtctgtagacaccggtgaaactgacattgacccagttatggatgacgacgatgtttttcctccatacgtcctcaggccagatgacggaggccctcgggtcaccatcaacactgccattggccacataaaccggtactgcgcccgcttgccttccgatccctttacacatctggccccgaagtgtcggactcgggagttgccagacgggaccttttatagcactttgtacctcccaatcaattccccactgagggcctccattgttggccctcctatgtcttgcgttcgattggccgaacgggttgtggcactgatttgctgcgaaaagctccacaaaattggagagcttgacgatcatctgatgcctgtcggcaaagagactgtaaagtatgaggaagagctcgacctacacgatgaggaagaaactagcgtgcccggtaggccaggatctacaaagcggaggcagtgctaccccaaagctatccccgaatgtctgcgagattcctacccgcgacctgaccaaccttgctatctttatgttataggcatggtgctgacaacccctctgccagacgaactcaacttcagaagacgtaagctgtaccccccagaagacacaaccagatgtttcgggattttgacggctaagcccatcccacagattccgcacttcccagtttacacgcggagcggagaggtgacaatctccatagaactaaaaaagagcggctttatgctatctctacagatgctggagctgatcactcgcttacaccaatacattttttcccatattctccgcctagaaaaacccgccctggagtttaagccaacggacgccgactccgcatattgtgtgctcccgttaaacgttgtgaatgatagcagcacactcgatatcgactttaaattcatggaggatattgaaaaaagcgaagctagaattgggatccccagcaccaagtatacaaaagagacacccttcgtatttaagctggaagattatcaggatgccgtgatcatcccccgttatcgaaactttgatcagccacaccggttctacgttgccgatgtttacactgatcttacgcctctgtcgaaatttccgagtcccgaatatgaaaccttcgccgaatactacaagaccaaatacaatttggatctgaccaaccttaaccagcccctgctcgatgtcgatcacacctcttcccggctcaatctcctgactcccagacatctgaaccagaagggcaaggcactccctctgagctccgcagaaaagcgtaaggccaaatgggagtctctgcagaacaagcaaattttagtaccagagctgtgtgcaattcaccccattcctgcatcactctggagaaaagctgtctgtctgccatctatcctctacaggttacattgtctgttgactgccgaggagctgagagcacagactgcttctgatgccggcgtgggtgtccggtctctacccgccgacttcaggtatcccaacctagatttcggctggaagaaatccattgatagcaaaagtttcataagcataagcaacagttcgtccgcagaaaacgataactattgtaaacacagtaccatcgtccccgagaatgctgcacaccagggggccaatcgcacatcttcacttgaaaaccacgaccagatgagtgttaattgccgcactctgctatccgaaagccccgggaaacttcacgttgaagtatccgctgatttgaccgccattaatggcctgtcttacaaccagaacctggccaatggcagctacgatctagccaaccgcgatttttgccaggggaaccagttaaattattacaaacaagaaatccccgttcagccgactacttcctattctatccagaacctgtactcctacgagaatcagccccagccctccgacgagtgtaccctgcttagtaacaagtacctcgacggtaacgccaataagtcaacatccgacggctcacctgtgatggccgtgatgccagggacaactgatacaatccaggtcttaaagggaagaatggactccgaacagagtccaagcataggctatagctcacggacgctgggaccgaatccaggactgattctccaggccctgacactgtcaaatgcatccgacggcttcaacctcgagcggctggagatgcttggggactccttccttaaacacgccatcaccacttatctcttttgtacctaccctgatgcacacgagggccggttaagctatatgcgttcgaagaaggttagcaactgcaacctttatagattgggaaagaaaaaaggactcccatcacggatggtcgtcagcatttttgaccctcctgtgaattggctgcctcccggctacgttgtgaatcaggataagtccaacactgacaagtgggaaaaagatgagatgacgaaggactgcatgctcgccaatgggaagctcgatgaagactacgaagaagaggatgaggaggaggaaagtttaatgtggcgagcgcctaaggaggaggctgattatgaggacgacttccttgagtacgaccaggaacatatccgattcattgataacatgcttatgggatctggggcttttgtgaagaagatctcactcagcccattctcaactaccgactccgcctacgagtggaaaatgcccaaaaagtcatctctggggtctatgccctttagttccgacttcgaggacttcgattatagcagctgggatgccatgtgctaccttgacccatcgaaggcagtggaggaagacgatttcgtggtcgggttttggaatccgagtgaggagaactgtggggtggatacagggaaacagtcgatcagctacgaccttcacactgaacagtgcatcgctgataaatctattgctgattgcgtcgaagcacttctaggctgttacctcacttcctgcggagagcgtgctgcgcaactgttcctgtgttccttaggattgaaggtcctgcctgtgattaaacgcaccgaccgggaaaaggcattatgccctacgcgtgagaattttaattcacagcagaaaaatctgagcgtctcttgtgccgcagcaagcgtcgcatcgtcccgtagtagcgtgttaaaagactcagaatatggatgcctcaagatcccccctcggtgtatgtttgatcatccagacgcagacaagactctgaatcacctcatatcggggttcgagaacttcgaaaagaagataaactacagatttaagaacaaggcgtacctgctacaggccttcacccatgcgtcctatcattataacaccattacagattgttaccagcggctggagttcttaggagacgctatcctggattatttgataacgaagcatctctatgaagatccgcggcaacatagccctggtgtgctgacggatttacgatccgctctggttaataacacaatattcgctagccttgcggtcaagtacgactaccacaaatatttcaaagctgtgtcccccgaattgtttcatgtcatagacgacttcgttcagtttcagcttgagaaaaatgagatgcagggcatggacagcgagctaaggcgatccgaagaagacgaagaaaaagaagaggatatagaagtcccaaaagccatgggcgatattttcgaatctctggccggggctatctacatggacagtggtatgagcctagaaaccgtatggcaagtctattaccccatgatgagacccctaatcgagaagttctctgctaatgtgcctaggagtcccgtcagagaactgctggagatggagccagagacggccaaattttctcccgcagaaagaacttacgacggaaaggtacgcgtcacggttgaggtggtcggcaaagggaagttcaagggtgtgggaagatcttaccgcattgctaaatctgcagctgcacggcgggcactgcggtcactgaaggccaatcagcctcaggttcccaactcctag

SEQ ID NO: 114533 - DNA, 213 bp, Artificial Sequence
  Description of Artificial Sequence: Synthetic coding sequence
atgaaatcaccagcactgcaaccgctttcaatggctggtctgcagctcatgacacccgcaagtagtccaatgggtccgttcttcggactcccttggcagcaagaagccatccatgataacatctacacccctagaaaataccaagtcgaactgctcgaagcggcactcgaccacaatacaatagtttgtctgaacaccggcagcggaaagtag

SEQ ID NO: 114534 - DNA, 213 bp, Artificial Sequence
  Description of Artificial Sequence: Synthetic coding sequence
atgaaaagccctgcattgcagccattatccatggctggactgcagttaatgacgcccgcgagctctcctatgggtccattcttcggactgccttggcagcaggaggccatacacgataacatatatactccacgaaaatatcaggtggaactcttagaagctgctctggaccataacactatcgtgtgcctcaacactggctctggtaagtag

SEQ ID NO: 114535 - DNA, 5490 bp, Artificial Sequence
  Description of Artificial Sequence: Synthetic coding sequence
atgaaaagccctgctctccagcccctttccatggctggactccagctcatgaccccggcctcttcacccatgggaccttttttcggtcttccctggcagcaggaagccatccacgataatatctacacccctaggaagtaccaggttgagctgcttgaggcggctctcgatcataataccatcgtctgcttgaacaccggctctggtaagacattcatcgccgtgcttctgactaaagagcttagttatcagattagaggagatttctcgcggaatgggaaaaggactgtgttcctcgtgaatagcgctaaccaggtggcccagcaggtcagtgctgtgagaacacactccgaccttaaagtgggagagtatagcaatcttgaagtcaatgcatcatggaccaaagaacgttggaatcaagaattcacaaaacaccaggtgttaatcatgacctgctacgtagcactgaacgtgctcaaaaatggctacctttctcttagtgatatcaatctcttagtgtttgacgagtgccatctggctatactggaccacccttatcgtgaaataatgaagctgtgcgagaattgcccttcctgccctcgcatcttaggtctgaccgcttccattctcaacgggaagtgcgatcctgaagagctcgaggagaagatccagaagttagagaaaatacttaagtctaacgccgagactgcaacggacctggtggtcctggacagatatacaagccagccatgcgagatagtggtggattgtggacccttcactgacaggtccggcctgtatgagagactactcatggagctggaggaagctttgaattttatcaatgattgcaacatctctgtgcattccaaagaaagggattctacactcatttcgaagcagatcctcagtgactgtagagctgtgctggtagtgctcggcccatggtgtgccgacaaggtcgctggcatgatggtgagagaactgcaaaagtacattaaacacgagcaggaggagctacaccggaagttcttgctcttcactgatacattcttacgcaagattcacgccctgtgcgaagaacacttcagccccgccagcctcgacttgaagttcgtgacccccaaggtgatcaaactgcttgagattctgcgcaaatacaagccttatgagaggcaacagtttgagagcgtggagtggtataacaatagaaatcaagataactacgtctcctggtctgacagtgaggacgatgacgaagatgaggagattgaggagaaggaaaagcccgagaccaactttccctccccatttactaacatcctgtgtggcattatcttcgttgagcgccggtacacagccgtggtgctcaatcggctgattaaggaggctggaaagcaggaccccgagcttgcttatatcagctctaatttcatcacaggacatggtatcggcaaaaaccagcctcgaaacaaacaaatggaggccgaatttcggaaacaggaagaagttctaagaaagttccgcgctcacgagacgaatctgttaatagcgacctcaattgttgaggagggcgttgatattcctaagtgtaaccttgtagtgagatttgatttgcccacagagtaccggtcatatgtgcagtcaaagggaagagctagagctcctatctcaaactacataatgctagctgatacagataaaatcaagtccttcgaagaggatctgaagacctataaggctatcgaaaagatcttgcgcaataagtgcagcaagtccgtggatactggggagaccgatattgatcctgttatggatgacgatgatgtatttcctccctatgtcttgcgcccagatgatggcgggccgagagtcaccatcaacaccgctattggtcacattaatcgatactgtgctaggctgcctagcgatccctttacacatctcgccccaaagtgtcgtacgcgtgagctccctgatggaactttttatagtaccctttatctgccaatcaattctcccctacgcgcttcaattgtggggcctcccatgagctgcgtcagattagctgagcgggtagtagctttaatctgttgcgaaaagctacacaagatcggcgagttagacgaccatctgatgccagtaggaaaggagactgttaagtatgaggaggagctcgacctccatgacgaggaggagacgagcgtccctggccgacccgggagtaccaagcgacgccagtgctatcctaaggcaatcccggagtgcctgcgagactcatatcctcgcccggaccaaccgtgctacctctacgttatcggaatggtactcactacccccctcccagatgaattgaattttcggcgaagaaaactttacccgcctgaggataccacacgctgtttcggaatccttaccgccaagccaattcctcagatcccacacttccctgtttatactagatcaggggaggtgacgatatctattgagctcaaaaaaagcggatttatgctgtctcttcaaatgctagagctgattactcgactgcatcagtacattttctcccatattctgaggcttgaaaagccagcgctggagttcaagcctaccgatgcagattccgcgtactgtgtgttgcccctcaacgtggtgaacgacagtagcacactggatatagacttcaaattcatggaggacatcgagaagagcgaggcccgtataggcatcccttccacaaaatacaccaaagagactccatttgttttcaaacttgaggactatcaggacgccgttataattccaagataccgcaactttgaccagcctcacagattttatgtagccgacgtctacaccgatctgacacctttgtctaagtttccatcccctgaatacgaaactttcgcggagtattataaaactaaatataacctcgatctgacgaaccttaatcagcctctgctggacgtggaccacacatccagccgcttgaacctcttgacaccccgtcacctgaatcagaaaggaaaggcactgcccttatcgagcgcagaaaagagaaaggcgaaatgggaatcactccagaacaagcagattttagtccccgagctctgtgcgatacaccctatcccagcatcactgtggagaaaggccgtgtgtttgccatcaattctctatcggctccactgtttgctgactgccgaagagctccgggcccagactgcctctgatgccggagtcggcgtgcgcagccttcctgcagattttagatacccgaatctagacttcgggtggaaaaaaagcatcgatagcaaatcctttatttctatttctaactcgagttcagcagaaaacgacaactactgtaaacacagtactatcgtgcctgagaacgcagcacatcagggggcaaacagaacatccagcctagagaaccatgatcagatgagcgtaaactgccgtactctgttaagtgaaagcccgggcaagctacacgtggaagtgagcgcagatcttaccgccattaatggtctgtcctacaaccaaaatctggccaacggctcatacgatttggctaacagggatttctgtcaaggtaatcagctcaattactacaaacaggagatccctgttcaaccaaccaccagttattccattcaaaacctgtacagctatgaaaaccagcctcaaccaagcgacgaatgcaccctactgtccaacaagtatctcgatgggaacgcgaataagagcacctctgacggatctcccgtgatggctgtgatgcccgggacaactgatactatccaggttctgaagggtaggatggacagtgagcagagcccaagtatcggatattcttctaggactctgggccctaacccagggctaatcttgcaagctctgacactgagtaacgcctcggacggatttaatctcgagagactagagatgcttggggatagtttcctgaagcacgcaatcactacctatctgttctgcacgtatcctgatgcccatgagggacgcttgtcttacatgcgcagtaaaaaagtgagtaattgcaacttgtacagactggggaagaaaaaaggccttccctcaaggatggtggtgagcatttttgacccgccagtaaattggcttcccccgggctacgtggtgaatcaggacaagtcgaacactgataagtgggagaaggacgagatgaccaaagactgcatgcttgccaacggcaagttggatgaggactacgaagaagaggatgaggaggaggaaagtctcatgtggcgagcccctaaagaagaagctgactacgaggatgatttccttgaatatgatcaggaacatatcagattcatagataatatgctgatgggtagcggtgctttcgtcaaaaaaatttcgctgagcccgtttagcactacagacagcgcttacgagtggaagatgcccaaaaaaagttccttgggatctatgcctttttcctcggactttgaagattttgactactcttcttgggatgcaatgtgttacctggacccttcaaaggccgtggaagaagatgacttcgtggtgggattttggaatccatccgaggaaaactgcggggtggacaccggcaaacagtccataagttatgacttgcataccgaacaatgcattgccgataagagcattgccgactgcgtggaagcactgctaggatgttaccttacatcttgcggcgagcgggccgcacagctgttcttgtgttcgctgggacttaaagttctgcctgttatcaagcgcaccgatagagagaaggccctgtgtcccacccgtgagaattttaacagtcagcagaaaaatctatccgttagctgtgctgcggcatccgtcgcctcctcacgaagttcagtgttgaaagactcagagtacggatgcctgaagatccccccgaggtgtatgtttgatcatcccgacgcagataagacgctcaaccatcttatctccggctttgaaaactttgagaaaaaaatcaattatcgctttaagaataaagcgtatctgcttcaggcgtttacccacgcttcatatcactataatacaattacagactgctatcagcgcctggagttcctcggtgatgcaattctcgactacctaatcacaaaacacttgtatgaagaccctagacaacacagccccggggtgttaaccgatctccgtagcgccctggtcaacaacacaattttcgcctcactggctgttaagtacgactaccataagtactttaaggctgtgagccccgagctcttccatgtgattgacgactttgtgcagttccaactggaaaaaaatgagatgcaaggaatggacagtgagaagtcattcctgcaaatgtaccccgtgccattgtgtgagaattgccttaaatggaatcagaagctcccgaacctcgcgcggctgcgcgagctcacaacagggaggagcgaaagtctctggaaatag

SEQ ID NO: 114536 - DNA, 2463 bp, Artificial Sequence
  Description of Artificial Sequence: Synthetic coding sequence
atgctcgcttgggaatctgatcacttcctgcggatcctagctgagaacgataactattgtaaacattccaccatagtccccgaaaacgccgcgcatcagggggcgaatcgtacaagcagtctggaaaatcacgatcaaatgtccgtgaactgccggaccctactctcagagtccccaggcaagctgcatgtcgaagttagtgcagacttgactgcgattaacgggctgagctataatcagaacctggccaacgggagttatgatcttgccaatcgtgacttctgtcaaggaaatcagcttaattactacaaacaggaaatcccagttcagcctacaacgtcctattcaatccagaatctgtacagctatgagaaccagccccagccttccgatgagtgtaccttgctgtctaataagtatctggacggtaacgccaataaatctacaagcgacgggtctcccgtgatggccgtcatgcctgggaccacggacaccatccaggtgctgaaagggagaatggattctgaacagagtccatctattggatactcctcacggaccctggggcccaaccccggcctgatactgcaagccctcaccctctccaatgcctcggacggcttcaatttggaaagactcgaaatgcttggcgattccttcctcaagcatgcaatcacgacatacctgttctgtacctacccggacgcccacgaagggcggctgagttatatgcgctctaaaaaggtaagtaactgtaacttatatcgcttgggaaagaagaaaggacttccttctagaatggtagtctccatttttgatcctcccgtgaactggctgcccccgggatacgttgtgaatcaagacaaatctaacacggacaaatgggagaaagatgagatgaccaaagactgtatgctcgccaacggcaagctggacgaggactatgaggaagaagatgaggaagaggagagtctgatgtggcgggcccccaaagaggaagcagattacgaagacgacttcctggagtatgatcaagagcatatcaggtttattgataatatgcttatgggatctggcgcctttgtaaagaagatatccctgtcacctttctcaaccaccgacagtgcatatgagtggaagatgcccaagaagagttcattggggtccatgcccttttctagcgatttcgaagacttcgactattcctcgtgggacgccatgtgctacctggaccccagcaaagctgtcgaagaggacgacttcgtagtaggcttttggaatcccagtgaagaaaactgtggggtggataccggcaaacagagcatcagctatgatctacataccgagcaatgcatagccgataagagcattgcagattgtgtggaggccctcctgggatgttatctgacaagttgcggtgagagggcagcacagctgttcctgtgcagcctggggctcaaagtgcttccagtcatcaaaaggactgacagggagaaggctctgtgccccaccagggagaatttcaattcgcagcaaaaaaacctatcggttagctgtgctgccgcaagtgtggcttcaagcagaagctctgtgctgaaagattccgaatatggttgtctgaagattccccctcgctgcatgtttgatcacccagatgccgataaaaccctgaatcatctgatttctggcttcgaaaatttcgagaagaaaatcaattacaggtttaagaataaggcgtatctgctccaggctttcacccacgcctcttaccattacaacacaatcacagattgctatcagaggcttgaatttctgggagatgcgatattagactacttgataactaaacatttatacgaagaccctcggcaacactccccaggcgtgttgaccgacctgagatctgccctggtcaacaatacaatcttcgcctcccttgcagttaaatatgattatcacaagtatttcaaggccgtgagtccagagctattccacgtcatagatgactttgtgcagttccaattagagaagaacgaaatgcaggggatggactcggagctacggaggagcgaggaggatgaggagaaggaagaggacattgaggtccctaaagccatgggtgatattttcgaatcactggccggagccatttacatggacagcggcatgtccctggaaacagtttggcaggtttactaccctatgatgcgcccactaatcgagaagttctctgccaatgtgcccagatccccggtacgagagctcctcgaaatggagcccgagaccgctaagttctcccctgccgaaaggacttacgatggcaaagttcgcgtgactgtggaagttgtgggcaaagggaagttcaaaggcgtaggacgctcgtatcggatagccaaatctgctgcagctaggcgtgccctgcgctctcttaaggccaatcaaccacaagtgcccaattcgtag

SEQ ID NO: 114537 - DNA, 801 bp, Artificial Sequence
  Description of Artificial Sequence: Synthetic coding sequence
atgatggccttgggggctgcgggggcaacaagggttttcgtggctatggtggcagccgctctgggaggtcaccccttgctgggggtttctgccaccctgaatagtgtgcttaacagcaacgctatcaagaatttacctccccccctgggaggcgctgccgggcaccccggttctgcagtctccgctgcaccagggatactttaccctggtggaaataagtaccaaacaattgataattatcagccatatccatgtgccgaggacgaggagtgcggcacagacgagtactgcgcaagcccaacacggggcggtgatgcaggcgtgcagatttgcctcgcctgtaggaaaaggcggaaaagatgtatgcgtcacgccatgtgttgcccgggtaactactgcaagaatggaatttgcgtcagctcggaccagaaccactttagaggcgaaattgaggaaacaataactgaatcatttggaaacgatcactctacacttgacggttacagtagaagaacgaccctgagctcaaagatgtatcacaccaaaggacaggagggctccgtctgcctcaggtctagtgattgcgctagcggcctctgttgtgctagacatttctggtccaagatttgtaaacccgtactgaaggagggccaggtgtgtactaaacatcggaggaaaggctcacatggattagagattttccagaggtgctactgtggcgagggtctgtcctgccgaatccaaaaagatcaccatcaggcatccaactcttcccgactgcatacatgccagcggcactag

SEQ ID NO: 114538 - DNA, 1689 bp, Artificial Sequence
  Description of Artificial Sequence: Synthetic coding sequence
atggatgctatgaagcggggcctgtgttgcgtgctgctgttatgtggtgccgtgttcgttagtccctcgcaggagattcacgccaggttccggagaggggccagaagctaccaggtgatttgccgcgatgagaagactcagatgatctaccagcaacatcaaagctggctccgaccagtcttgcgttctaaccgcgtcgaatattgttggtgcaattcaggaagagcacagtgtcatagtgtccccgtaaagagttgtagcgagcctcggtgtttcaacgggggcacttgccagcaggctttgtatttctctgattttgtgtgccagtgcccggaaggattcgcagggaaatgctgtgagatagacaccagagcgacgtgctatgaagatcagggcatctcatatcgcggcacttggtctactgccgagtccggggccgagtgcacaaactggaacagctccgctctggcccaaaagccttatagtggacggaggccagacgcaatccgactgggcctggggaaccacaactattgtcgaaaccccgatagagattctaaaccctggtgctacgtttttaaggccggtaagtattccagcgaattctgcagcacccccgcctgtagtgagggcaactctgactgctatttcgggaatggctctgcctaccgcggcactcattctttgacagagagcggagcttcatgtttgccctggaattctatgattctcattggcaaggtgtacacagctcaaaatccttccgcccaggccctaggtctgggcaagcataactactgccgcaacccagatggagacgcaaagccttggtgccatgtgctgaagaatcgacgactcacctgggaatactgtgatgtgcccagttgctcaacctgcggcttgaggcaatactcacagccccagtttcgaataaaaggcggactgtttgccgatatagccagtcatccatggcaggcggccatcttcgctaagcaccggcgctctcctggggagaggtttctgtgtggcgggatccttataagcagctgttggatactcagcgctgcccactgtttccaggagagatttcccccacaccatctgaccgtaattctggggcgtacctatcgggtggtccctggggaggaggagcagaaatttgaagtagagaaatacatagttcacaaagagtttgatgatgatacttacgacaatgacatcgcactcctccagttgaaaagcgactcgtcccggtgcgcccaggaatcgagcgtggtgagaacggtatgtttacctcccgccgacttacagctgccagattggaccgagtgcgagctatctggctacggcaagcacgaagctttgtccccattttattccgagcgcctgaaggaggcccacgtaagactgtacccttcatcccgctgcacatcacagcacctgctaaatcgcaccgtaacagacaatatgctgtgcgcaggcgatacccgctctggcggcccacaggcaaacctccacgacgcctgtcagggtgattccggcggtccgctcgtttgcttaaacgacggacgcatgacattggttgggatcatttcttggggcctaggctgcggccaaaaagacgtgccaggtgtgtatactaaagtgacgaattacctcgattggattcgggataatatgcgcccatag

SEQ ID NO: 114539 - DNA, 420 bp, Artificial Sequence
  Description of Artificial Sequence: Synthetic coding sequence
atggtggcagcggtgctcctggggctgagctggctctgttcaccactcggagccctcgttttggatttcaacaatattagaagctctgcggatctccatggcgctagaaaaggtagtcagtgcctgagcgatacagactgcaatacgcgtaaattctgcctccagcccagggatgagaagcccttttgtgccacatgccgcgggctgcggagaagatgtcagcgggacgcaatgtgctgccctgggactctttgcgtgaacgatgtctgcacaactatggaagatgctacgcccatcctggagagacagctcgatgagcaggatggcacccatgccgaggggaccaccggccatcccgtgcaggagaaccagcctaagaggaagccctccattaagaagtccagcagtatgttggactag

SEQ ID NO: 114540 - DNA, 1683 bp, Artificial Sequence
  Description of Artificial Sequence: Synthetic coding sequence
atgcgcgacctgcccttaacctctcttgctcttgtgctgtcagccctcggggccttactgggtaccgaagccctcagagcggaggagcctgcagtgggaacctctgggctgatcttccgggaagacctcgactggccacctgggtctcctcaggagcccctgtgccttgtggctctgggtggggattctaacggtagctcatctcccctgagggtggtgggggcccttagcgcttatgagcaagcttttcttggcgcagtacagagagcccggtggggacctcgcgacttagctacatttggagtctgcaacactggggatagacaggcagcactgccgtctctgagacgcttgggagcttggctcagagacccaggcggacagcgactcgtggtcttgcatctggaagaggtgacctgggagcccacaccatctctgcgatttcaggagccacccccaggcggcgccggccctccggaactcgccctactagtgctctatccaggcccaggccccgaggtgacagtgacgagggcaggcctccccggggcccagtccctgtgcccatctagggacacacggtacctcgtcctagcggtggatcgtccagccggagcctggcgcggttctggcctggccctgaccctgcaaccacgtggggaagattccagactatcaacagccagattgcaggcgttgttgttcggtgatgaccacaggtgttttacccggatgacacccgctttgctgctgctgccccgctccgagcccgcaccgctgccagcccacggccagctggacaccgttccattcccaccacctagaccgagcgcagaactcgaagaaagccccccatccgcggatccctttttggaaacccttacaagattagtgagagcacttcgagtgccacccgcaagagcaagtgctccccgactggccctcgatcccgatgccctcgctggtttcccccaggggctggtgaacctaagtgatcctgctgcattagaaaggcttcttgatggcgaggaacctcttctcctcctgcttcggccaactgccgctaccacgggtgatccagctccactgcatgaccccacttccgctccatgggcgacggcactggccagacgagtggccgccgagcttcaggctgcagcggcagagttaaggtcacttccgggtctgccacccgcaaccgccccactcctggccaggctgttagccctgtgtccgggcggccccggggggctcggcgacccactgagagcactactgctgttaaaggccttacagggtctgagggttgagtggagaggaagagatccccggggtcccggccgggcacaaaggtcggctggagcgacggcagcagacggtccttgcgccctgagggagctgtccgtggatcttagagctgagagaagcgtccttatccccgagacatatcaagcaaacaactgtcagggggtttgtggctggccccaatccgatcgcaatcctaggtatggcaaccacgtggttcttctgctgaagatgcaggtccgaggcgcagccctcgcccggccgccttgctgtgtccccaccgcttacgctggtaagcttctgatcagcctgtcggaagaacgaatatctgcccatcatgtgcctaacatggtggcgacagagtgtggttgtagatag

SEQ ID NO: 114541 - DNA, 600 bp, Artificial Sequence
  Description of Artificial Sequence: Synthetic coding sequence
atgggtgaagcttccccccccgcacctgcccggcgccatctattagtcctcctgcttctgctctcaactctggtcatccccagcgcagctgcaccaatacacgacgccgatgcccaggagtccagtctgggtctgacaggcctgcagagccttcttcagggatttagtaggcttttcctcaaaggaaacttactgagaggcatcgacagtctctttagtgctcccatggatttccgagggcttcccgggaattaccacaaagaagagaaccaggaacatcagctgggcaacaacaccttgtcctcacatcttcagattgacaaggtgccacggatggaagagaaagaggctctggtaccaatacagaaagcaactgactctttccacacagaactacaccctcgagttgccttctggattatcaagctgccacggcggcgttcacaccaggatgctcttgaagggggccactggctatcagaaaaacgccataggctgcaagctataagggatggattgcggaaagggacacacaaagacgttttagaggaagggaccgagagttcctcacattccagactgagtcctcgcaaaacctag

SEQ ID NO: 114542 - DNA, 1896 bp, Artificial Sequence
  Description of Artificial Sequence: Synthetic coding sequence
atggcccttaggaaagagttgctcaaaagtatatggtatgcatttaccgcgctggacgtggagaagtcagggaaagtgagcaaatcccaattaaaggtgttaagtcacaatctgtataccgttttacacatcccacacgaccccgttgcactcgaagaacattttcgagacgatgacgacggcccggtctctagccagggatatatgccctatctgaacaagtacattctggataaggtggaagagggtgcatttgtcaaggagcattttgacgagttgtgctggaccctcacagccaaaaagaactatcgggcggattctaatgggaacagtatgttaagcaaccaagacgcatttcgactgtggtgcttgtttaatttcttatccgaggataaatacccacttatcatggtgcctgatgaagtagagtacctcttgaagaaagtcctgtcatcgatgtcattagaggtgtcactgggcgaacttgaagaactgctggcccaggaagcccaggtcgcccagacaacaggcgggctctccgtgtggcagttcctggagctgttcaattccggaagatgcctgcgcggggttggcagggatacacttagcatggccattcacgaagtgtaccaagagctgatccaagatgtgctgaagcagggctacctgtggaaacgtggtcacctgcgacggaactgggcagaacgctggttccaattgcagccctcctgcctgtgctattttggaagcgaagagtgcaaggaaaagagaggaatcatcccgttggacgcgcactgctgtgtggaggtcctgcctgatagagacggtaaaaggtgtatgttctgcgtgaaaacagcaaatcgcacctacgagatgtccgcttctgacacacgacagcggcaagagtggactgcggccatccagatggctatacggctacaggccgagggaaagacaagcctccacaaagacctcaagcagaagcgcagggagcagcgagaacagcgcgaaaggcgacgcgccgcaaaagaggaagagctgttacgcttgcaacagctgcaggaagagaaagaaaggaaacttcaggagctcgagcttctgcaagaagcccagaggcaggctgagcgcctgctgcaggaagaagaggagagacggagaagccagcacagggagctgcagcaggcactggagggtcagctgcgagaggccgaacaggcccgcgcttcgatgcaggctgagatggaacttaaggaggaagaagctgcacgacagaggcagcgaataaaagaactggaggagatgcagcagaggctgcaggaggctttgcaactagaagtgaaggccaggcgagacgaggaatctgtgcgcatcgcccagacccgcctgttagaggaagaggaggagaagctgaagcagctgatgcagctgaaagaagaacaggaacgctatattgagagagcacagcaggagaaagaagaacttcaacaggaaatggctcagcaatctcgatcactgcagcaggcgcaacagcagcttgaggaggttcgccagaacagacagagagccgacgaggatgtggaggcggctcagcgcaaactccgccaggcatccacaaacgttaaacattggaacgtgcagatgaatcggctgatgcaccccatcgaaccgggcgacaaacgaccagtgacttctagcagtttctcaggtttccaacctcctctcttggctcatcgagactcttcactcaagcgtcttacaaggtgggggtctcagggtaacagaacgccaagtcccaattctaatgaacagcagaagagcttaaacggaggggacgaagcacccgcaccagcgtccacaccccaggaagataaactggacccagcgccagaaaattag

SEQ ID NO: 114543 - DNA, 555 bp, Artificial Sequence
  Description of Artificial Sequence: Synthetic coding sequence
atggccctccgcaaggagttgctcaagtcgatctggtatgcatttactgctctggatgtcgaaaaatctgggaaagtctcaaagtcccagcttaaagtgctctcacacaatctctatactgtcctgcacattccccatgaccccgtggccctggaggagcactttcgtgacgatgatgatggacccgttagctctcaagggtatatgccctacctgaacaagtatattcttgacaaagatgcctttcggctgtggtgtttgttcaatttcctgagcgaggataaataccccttgattatggtccctgatgaagtcgaatatctgctcaaaaaggttttgtcttccatgtctctcgaggtgtccctgggcgaattagaggaacttctggcacaagaggctcaagtagcccaaacgactggtggcctaagcgtgtggcagttccttgagctgttcaattccggccgctgtctacgaggcgtgggccgtgataccctctcaatggccatccacgaagtgtaccaggagctaattcaagacgtgctcaaacagggctag

SEQ ID NO: 114544 - DNA, 393 bp, Artificial Sequence
  Description of Artificial Sequence: Synthetic coding sequence
taacgggacgacgatgacggacctgtctcctcacagggttacatgccttacctgaacaagtacattcttgacaaagacgcctttcgtctatggtgtttattcaactttttgtctgaagacaaatatccattgatcatggtgcctgatgaggtggagtacctgctgaagaaggtcctgagcagcatgtctcttgaggtcagtctgggggagttggaggaactgctcgcacaggaagctcaagtggcccaaactacggggggcctctccgtgtggcaatttcttgaactttttaacagcgggagatgtctcagaggcgtgggcagagatacactgtccatggccatacacgaagtgtaccaggagttgattcaagacgttctcaaacagggatag

SEQ ID NO: 114545 - DNA, 1131 bp, Artificial Sequence
  Description of Artificial Sequence: Synthetic coding sequence
atgatctgcccgccacggccacctaaagtgctgggactccaggtacttcccgatagagacgggaaacgttgtatgttttgtgtcaaaactgcaaatcgcacatacgagatgagcgcttctgacacacgccagagacaggagtggactgcggcaattcagatggccattaggttgcaagccgaggggaaaactagcctgcacaaggatctcaaacagaagcgccgcgagcagcgggaacagcgggagaggcgtcgagctgcaaaggaggaagagcttcttcgtctccagcagcttcaagaggagaaagaaaggaaactgcaggagttagagcttttgcaggaagcccagcgtcaggctgaaaggttgctgcaagaggaggaagaaagacgccgatcccaacaccgcgagctgcaacaagctttggagggccagctgagagaagccgagcaggctcgagcgagtatgcaggctgagatggaactcaaggaggaggaagctgcgcgacaacgccaaagaattaaggaactggaagagatgcagcagaggctgcaggaggctttgcagttagaggtcaaggctcggcgggatgaggagagtgtgaggattgcccaaactcgcctgttagaagaggaagaggagaaactgaaacaactgatgcaactgaaggaggagcaggaacgttatatcgaaagggcccagcaggaaaaggaagagctgcagcaggaaatggcccagcaaagtcggtcgttgcagcaggcccagcagcagttggaggaggtgcggcagaatcgccagcgagccgacgaagacgtggaagctgcgcagagaaaactccggcaggcctcgacaaacgtcaagcattggaatgtgcaaatgaatcggctgatgcaccccattgagccaggggacaaacggcctgtgacctcaagcagctttagcgggttccaaccaccacttttggcccatcgcgattcgtcactgaagcgtcttactaggtggggctcccaaggcaaccggactccctcccccaactccaacgaacagcaaaagtccctaaacggcggcgacgaagcacctgctccggccagcacaccacaggaggacaaattggaccccgcccccgagaattag

SEQ ID NO: 114546 - DNA, 708 bp, Artificial Sequence
  Description of Artificial Sequence: Synthetic coding sequence
atgactcaggtgaccgaaaaaagtaccgaacacccagagaaaacgacgagtaccaccgagaaaaccactcgaacccctgaaaagcccaccctctactccgagaaaacaatctgcactaaaggcaagaatacacccgtgcccgaaaagccaaccgagaacttagggaacaccaccctaactaccgaaactattaaagccccagtcaaatccacggaaaatccggagaaaactgccgctgttaccaaaaccatcaagccatcagtgaaggtaacaggtgataaaagtctcactacgacttcgagtcacctgaacaaaacagaggtaacacaccaggtccccacaggctcatttacactcatcaccagtaggacaaagctgtcctccataacctccgaggcgactgggaacgaatcccatccatacctaaacaaagacggaagccaaaagggcatccacgccggtcagatgggggaaaacgattcattccccgcatgggctattgtgattgtagtgctggtcgccgtgatcctgttactagtcttccttggattgatatttctcgtgagctacatgatgagaacccgccgaaccttgacgcagaacacgcagtacaacgatgccgaggatgaaggaggccccaacagctaccccgtctacctcatggagcaacagaaccttgggatggggcagattccatccccgcgttag

SEQ ID NO: 114547 - DNA, 1524 bp, Artificial Sequence
  Description of Artificial Sequence: Synthetic coding sequence
cccctggccaacgagaagacaacccttagcccggccgagccgactgaaaacggtgagaggacaccctttacaaacgagaagacaaccccaagcagtgctgagccgactgagcacggagagcggacccccctggctaatgagattacaaccccgagtcgcgcagaaccgactgagcatggggaacggatagccaacgaaaaagctaccccttctcccgccaaacctactgaacacggagaaacaacagtgaatgaagatactacaccttcttccgccgaaccaactgagaacggagagaggacacctctagcgaatgagaataccacaacctctcccaccgaaagcactgaacacggagagcgaacggccaatgagaagactacaccatcacctgcggagcccacagaacacggagagcggaccccttctgcgaacgaaaaaaccatcccctcccccgccaaaccaaccgaacacgaagaaatgaccccctccgcgaatgagaatactactccatctccggtgaagccaacggagcatggcgagaagacgacgctggccaacgagaaaataactctgagtcctgaaggcccaaccgagcatggagccaagaccaccagcgccaacgaaaaaatcactccttcacttgccaaaccaaccgagcacggagaaaggactacatcgcccaacgacaaaatcacctcttccgccgcagaaagcacagagcaccgggaccgcgccacctcagccaacgtgatcacaccagcccctgcagagcccatcaagcacgccaagcgaacgacacttgctcatgagaagatgacccaagtcaccgagaaaagtactgagcatcctgagaaaactacttccaccaccgagaagacgacccgtactccggagaaacccaccctgtactcagaaaagaccatctgcacaaaaggcaagaatacaccagtccctgagaagccaacagagaatctcggtaataccactctgacgaccgaaactatcaaagcacctgtgaaatccacagagaatcctgaaaagaccgctgcggtgacgaaaaccattaagccatctgtcaaagtgaccggggataagagcctgacgacaacatcttcccatctgaataaaaccgaagtgacccatcaggtacccactggatcctttacgttgattaccagtcggacaaagctgagcagcatcacctccgaagccaccggcaatgaatcccacccatatttaaataaggacgggagtcaaaagggaattcatgccggccagatgggcgagaacgattcttttccagcttgggctatcgttatcgtggtgctggtggctgtcatcctactgctcgtcttcttaggactcattttcctggtgagctatatgatgcggacacggcgaactctgacccagaatactcagtataatgacgcagaagacgagggcggcccgaatagctaccccgtctacttgatggaacagcaaaatctgggcatggggcagatccccagtccaagatag

SEQ ID NO: 114548 - DNA, 1524 bp, Artificial Sequence
  Description of Artificial Sequence: Synthetic coding sequence
ccgttggcgaatgagaagacgacccttagtcctgccgaacccactgaaaacggggaacggaccccattcaccaacgagaagaccacacctagctctgccgagcctaccgaacatggtgagcgtactcccttagccaacgaaattaccaccccgagccgcgccgagcctaccgagcatggcgagcggattgccaatgagaaggctacaccttcacctgccaaaccgaccgaacatggggaaacaaccgtgaatgaagatactaccccttctagcgctgagccaaccgagaacggagaacgcactcctcttgccaatgagaatacaactacctcaccaactgaatcaaccgagcatggtgagaggaccgccaatgaaaaaaccacaccctctcccgctgagcctacggaacacggcgagaggacaccttctgcgaacgaaaaaaccatacccagccccgctaaaccgaccgagcatgaggagatgactccgtccgctaacgaaaatacgacacccagtcctgtcaagcctacagagcatggcgaaaaaaccactctcgcaaacgagaagataacactatccccagaaggccctaccgaacatggtgccaaaaccactagtgctaacgaaaaaatcactccttccctggccaagcctacggagcacggcgagaggacaaccagcccgaacgataagatcacgagtagcgctgctgagtctaccgaacatcgcgaccgcgctacatctgccaatgtcattacgccagctcctgccgagcctatcaagcacgccaagaggaccaccttggcacacgaaaaaatgacccaggtgacggagaagagcaccgagcacccagaaaagacaacatctactaccgaaaagacgactcggactcccgaaaaaccgacactgtattcagaaaaaactatctgtaccaaaggcaagaataccccagtgccagaaaaaccaaccgaaaatttaggaaacacaactctcacgactgaaaccatcaaggcccccgtaaaatctactgagaatcccgagaagacagccgcagtgaccaaaactataaagccatctgtgaaggtgacaggagataaaagcctgacaactacatcatcacacttgaacaaaacagaggtgacccaccaggttcccactggtagttttactctgattacaagtagaacgaagctgagctctattacaagtgaggccaccggcaacaagagccacccttacctgaacaaagacggatcccagaagggaattcatgctggtcagatgggggagaacgactcgttcccagcctgggcaatcgtcattgtggttctagtggcagtgattctgcttctggtgttcctgggcctgatctttctggtctcctatatgatgaggacccgtcggacactgactcagaatacccagtacaacgatgctgaagacgagggaggaccgaactcctaccctgtgtaccttatggaacagcagaatttggggatgggacagatcccaagtccaagatag

SEQ ID NO: 114549 - DNA, 1524 bp, Artificial Sequence
  Description of Artificial Sequence: Synthetic coding sequence
cctctggcaaacgaaaagaccactctgtctcctgccgagccaactgaaaatggcgagaggacaccttttacaaacgaaaagacaacaccatcttcagcggagccaaccgagcacggggagaggacacccttggccaacgagatcaccacaccttctcgtgctgagcctactgagcacggggagagaatcgctaacgaaaaggcaacccctagtcccgccaaacccaccgaacacggtgagactactgtcaatgaagataccacgcccagctcagcagaacccactgaaaatggcgagagaacgccgctggcaaacgaaaataccaccaccagcccgacagaatcaacagaacacggtgaaagaactgctaacgagaaaaccactccctctccagcggaacccaccgaacacggtgagcggactccgagtgcgaacgagaagacaatcccctctccagccaagcctacagagcacgaggaaatgacgccctctgccaacgaaaatacaacaccctcaccagttaagcccaccgagcacggcgaaaagaccacactcgccaatgagaaaattaccttgagtccggagggaccaacagagcatggcgccaagacaactagcgcgaacgaaaaaataacccccagcctggcgaagcctacagaacacggagagaggaccacctctccaaacgacaaaattacgtcctccgctgccgagagcacagagcaccgagacagagcaacaagcgccaatgtcattactcccgcaccggccgagcccataaagcacgcaaagagaacgacccttgcgcatgaaaagatgacacaagtgaccgaaaagtctacagagcaccccgaaaaaacaacctctacaacggagaaaaccacaaggactccagaaaaacctactctgtacagtgaaaagactatttgcaccaagggcaagaacacccccgtgccagagaagcccactgaaaatctgggcaacactacgctgactactgaaacaatcaaagccccagttaaaagtactgagaacccagagaaaaccgctgccgtcacaaaaactattaaaccaagcgttaaagtgactggagacaagagtttgacaacaacgagctcccacctaaataaaaccgaagtgacgcaccaggtgccaacaggtagttttacactgatcacatcccggacaaaactttcttctataacatccgaagctacgggcaacgagagccatccctaccttaataaggatgggtctcagaaaggaatccacgccggccaaatgggggaaaacgattcgtttccagcttgggcaatcgtaattgtggttttggtggcggtaattctgctactggtgttcctaggcctgatcttcttggtgtcatatatgatgcggacccgtagaacgcttacccagaacacccagtacaacgacgcagaggacgagggcggccccaactcataccccgtatatttgatggagcagcagaacctaggcatggggcagatcccctcccctcggtag

SEQ ID NO: 114550 - DNA, 1554 bp, Artificial Sequence
  Description of Artificial Sequence: Synthetic coding sequence
atggcacagccagtccactccctgtgctccgccttcggcctccagtgctgcttgctctttctgctggcctcttggggggctggtgcgacaacattccaggaatatcagaaaaccggcgagctgtctacaagcgaccatatttttccactgacccccggcctggtttacagcattcctttcgatcatatcgtcctgcactcgggccaacggccaccagaattgccgaagagcactgagattcatgagcaaaaaaggcactgcaacaccactcggcactctaaacctaccgataagccgacagggaactcgaaaacgattgaccataaaagctctactgataaccacgaagccccacctaccagtgaggagaattcctctaaccaaggtaaggatcctatgattagaaaccaacgctctgttgatcccgctgacagtaccaccacccacaaagagtctgcaggcaaaaagcacattacacccgcccctaagtccaagattaactgtaggaagagcacgaccggcaagagcacggtcacaagaaagtccgacaagaccggtcgtcccctggaaaaatcaatgtctacactagataagaccagcacctctagccacaaaaccactaccagtttccataacagtgggaactcccagacaaaacagaagtcaaccagttttccagagaaaattacagcggctagcaaaacaacatataagacaacaggcacccccgaggaatcagagaaaaccgaggattcacgaaccacagtggcctccgacaaattgctgacgaaaacaacaaagaacattcaggaaactatcagcgccaatgaacttactcaatccctggctgagcccaccgaacatggtggccgaacagcaaacgaaaataacactccatcgccagctgaacctaccgaaaatcgcgaacggactgccaatgagaacaagaagaccatttgcacaaaggggaaaaacactccagtcccggagaagccaacggagaatctgggaaatactacactcaccacagaaaccatcaaagctccagtcaagtcaaccgaaaatcccgagaagaccgcagctgtcacaaagacaattaagccatccgtgaaagttaccggtgataagagtctgacaaccacgtcctcccacctaaacaagaccgaagtcacccatcaagtgccaactggcagctttactctgattaccagtcgtacaaaactgagcagtattacatccgaggcaaccggcaatgaatctcacccttaccttaacaaggacgggagtcagaaaggcattcacgctgggcagatgggcgagaacgactcattccccgcctgggctattgttattgttgtgctggtagccgtgatcctccttctggtgttcctggggctgatattcctcgtctcctacatgatgcgcaccagaagaaccttgacccagaatacccagtacaacgatgctgaagacgagggcggccccaattcttatcctgtgtatcttatggagcagcagaacctaggcatgggacagatcccatcccccagatag

SEQ ID NO: 114551 - DNA, 1554 bp, Artificial Sequence
  Description of Artificial Sequence: Synthetic coding sequence
atggcccagcctgtgcactccctatgcagcgccttcgggctgcaatgctgtctcctttttctgttggccagctggggggctggtgcgacgacatttcaagagtatcagaagaccggggaactatctacaagcgatcatatcttccccctgactccagggctggtgtattccattccgttcgaccatatcgtcctgcacagtggccaaaggccacccgaattgccaaaaagtactgaaatacatgaacaaaaacgtcactgtaatacaacccggcacagcaaacccaccgataagcccacagggaacagtaagacaattgatcataaatcttctaccgacaaccacgaggcccctcccaccagtgaagagaacagctccaatcagggcaaagacccaatgatccgcaaccagcgcagcgtggaccccgcggacagtactacgacacacaaagagtcagctggcaaaaaacatatcaccccagcccctaaatccaagatcaactgtcggaagagtactacaggcaagtctacagttaccaggaaatccgacaagactggccgcccattagagaaaagcatgagtacgctggataagacttctacaagctctcacaaaacaacaaccagcttccacaactcagggaatagtcagacaaagcaaaaaagtacatcttttccagaaaaaattactgcggctagcaagactacttacaagactacaggcacccccgaggagtcagagaagacagaggatagccgaactaccgttgctagtgacaagctacttacgaagacaacaaaaaatatacaggagactatcagtgctaatgaacttactcagtcgttggcagaacccaccgagcacggtgggcgcacagctaacgaaaacaataccccctcacctgcagagcctactgagaaccgcgagcgcactgctaacgaaaacaaaaagacaatctgcacaaaaggcaagaacacccctgttcccgagaagccaaccgaaaatctgggcaacacaaccctgaccacagagaccattaaggcacctgttaagtccacagaaaatcctgagaagactgccgctgttaccaagacgatcaaaccatctgttaaagtgaccggcgataagtcactgacaaccacttctagtcacttgaacaagaccgaggtgacccaccaagtccccacaggctcctttaccctgattacttcgcggacaaaactaagctcgattacgagtgaagccactggtaatgagtcccacccttacctcaacaaagatggatctcagaaaggcattcacgccggccagatgggcgaaaacgactcctttcccgcttgggcaatcgttatagttgtgctggtcgccgtgattctgcttctagtgtttctgggcttgatatttctcgtgagttacatgatgcggacaagacggacgctgacacagaatacacagtacaacgacgcggaagacgaaggcggtcccaactcatatccagtctatctgatggaacagcagaatctgggtatgggccagatcccatctccccgttag

SEQ ID NO: 114552 - DNA, 1554 bp, Artificial Sequence
  Description of Artificial Sequence: Synthetic coding sequence
atggcccagccggtgcatagcctgtgcagcgctttcgggctgcagtgctgcctgctgtttctgctggccagttggggcgccggagcaaccactttccaggagtaccaaaaaaccggggaactgagcacgtctgatcatatctttccgctgactcccggtctggtgtattcaatcccatttgatcacatcgtgctgcattctggccaacgtcccccagaactgcctaagagcactgaaatccacgagcagaaacggcactgtaacacaacacggcacagcaagccaaccgacaagccaactggaaattccaagaccatcgatcacaaaagtagtactgacaatcacgaggcccctccgaccagcgaggaaaactcctctaaccaaggaaaagatccaatgatcagaaatcagagaagcgtggaccccgcggattccactactacacacaaggagtctgccggcaaaaaacatataactccagcccctaagtcaaagatcaattgtaggaagtctaccaccgggaagagcacagtgacacgtaagtctgataaaaccgggaggcctcttgagaagagcatgtcgacactggataaaacgagtacaagctcccacaagacaactacaagttttcacaactccggaaactcccagaccaaacagaagtcaactagttttccggaaaaaataacggctgcctccaaaactacctataaaactactggtacccctgaggagagcgagaaaactgaagattctcggactacggtggcctccgacaagttactaactaaaactacaaagaatatccaggagactatttccgcgaacgaactgacccagtctttggccgagccgactgagcatggaggtcgcacagctaacgaaaacaacactccctcccctgccgagcctactgaaaaccgcgaacgaaccgcgaatgagaataagaaaacaatatgtacaaagggcaagaatactcccgtgccagaaaaacccactgagaaccttggtaatacaaccttaaccacggaaacaatcaaagcaccagtgaagagcactgaaaatcccgaaaaaaccgcagcggtgaccaaaactattaagcctagcgtaaaagtgactggcgataagtcccttacaacaacaagttctcatctaaataaaactgaagtgacccaccaagttcccacgggtagcttcacactcatcaccagtaggactaagctgtcctcaattacttctgaagctaccggcaatgagagccacccatacctgaacaaggacggaagtcagaagggaatccacgccggtcaaatgggggaaaatgacagtttcccagcttgggccatagtgattgttgtgctggtggcagtgatcctcctcctggttttcctggggcttattttcctggtatcatatatgatgcggacccgtcggaccctgactcagaatactcagtacaatgatgctgaagatgaggggggtccaaatagttatcccgtttacctgatggagcagcagaatctggggatgggtcagattccaagcccccgctag

SEQ ID NO: 114553 - DNA, 4182 bp, Artificial Sequence
  Description of Artificial Sequence: Synthetic coding sequence
atggcacagcctgtgcactcactatgctccgcctttgggctgcagtgctgccttctgttcctcttggcttcatggggtgcaggcgctacaactttccaagagtatcagaaaactggtgagctaagcactagcgatcacatttttccccttacccctgggttggtctacagtatacctttcgatcacattgttctgcactctggccagagaccacctgaattacctaaaagtacagaaattcacgagcagaagaggcattgtaacacaacccgccactccaagccaacagataaaccgaccggaaattcaaaaaccatcgatcacaaaagctcgaccgacaatcatgaagctcctccaacctcagaggagaactctagcaaccaagggaaggaccccatgatccgaaatcagcggagcgtcgaccccgccgattccacaaccactcataaagagtctgctggaaaaaaacatatcaccccagcgcccaaaagcaagatcaattgtaggaaaagcacaacgggtaagtccacggtgacacgcaagagtgataagactggacgaccactggaaaaatccatgagtactctcgataaaacctccactagctctcacaaaaccactactagcttccacaactcggggaacagccagacaaaacaaaagtccacaagctttcccgagaagatcacagctgcatctaagaccacatataagacaactggaacacccgaagaatctgagaagactgaggattctcgcacaacggtcgcctccgacaagctcctcacaaagactactaagaatattcaggagactatctctgcaaacgaactaacccagagcctcgctgagccgaccgagcatgggggccgcaccgcaaacgagaacaacaccccttcaccagctgagcctactgaaaacagggaacgcaccgccaatgaaaacacaacactgtcacccgcggagcccactgagaacagagaaaggactgcaaacgagaacaccgctcccttccctgctggcccgaccgagaacagagaaatgacggcaaacgagaacacaacactgttccccgcagagcccacagagcacggcgaacggaccgccaacgaaaataccaccccctcgccagccgaaccgacagagcacggagagcgcaccgccaatgaaaacacgaccccctctcccgccgaacccaccgaacacggtgaaaggacaccgttcgctaatgacaagacaacgtcctcatcagctgaatccactgagcatggagagagaacgcctctagccaatgagaatactacgcccagtccagccgagccaacagaaaatcgggagaggactgccaacgagaatactaccccgagtccagccggccccacagaaaatagggagaccacagccaacgaaaaaacgactttatcaccagtggaacctaccgaaaaccgcgagacaacagcaaatgaaaaaacaacacccagccccgctgaacccactgagaatggacaaaggactccatttgccaacgaaaagactacgagctcgtctgccgagccaaccgaacatggtgagcgcacaccgttggccaatgagaacaccacaccctcccccgctgaacctacggagaaccgagaaaggactgctaacgaaaagactacaccttctcctgcggagcctactgaaaatggggataggactccgcttgccaacgaaaagaccacaccctctttagcagaaccaaccgagaatggacagagaactccgtttgcaaatgaaaagaccacttcatcttcagcagagcctaccgaacatgaagagcgcacgccgcttgccaacgagaacaccactcctagcccggcagagcccactgaaaacagagaaaggaccgctaatgaaaataccacccctagcccagccgggccaacagagaatagagagatgaccgctaacgagaaaaccacactctttcctgccgagccaaccgaaaaccgggaacgaacggctaatgagaaaactacgtccagtcccgcagagccgaccgagaacggccagaggacaccattcgctaacgagaagacgacgagctccagtgccgagcccacggagcatggcgaaagaaccccactagcaaatgaaaatacaacattgagccccgccgagccgacggagaatcgtgagagaacggcaaacgagaagaccaccccatttccagcagaacccactgagaaccgggagcggacagctaacgaaaacactacaccgagccctgctcagcccacagaaaatggcgatagaactccacttgccaatgaaaaaaccacaccttctctcgccgaacctaccgagaatggcaaacgcaccccttttgctaacgaaaaaaccacctcttcctcagccgagcccacggagcatgctgagcgcacacctctggctaacgagaataccacgagtagcccagccgagccaaccgagaaccgcgagcgtacagcaaacgagaagactacgcaattcccggcggagcctactgaaaaccgggaatctaccgcaaacgagaagaccactcctttccccgcagagcccacggaaaaccgcgagtggacagccaacgagaacacaacattatctcccgctgaaccgacagagcatgaagagatgacgccgctggccaatgagaagaccaccttgtcgccagctgaaccgactgagaatggtgagcgcaccccattcaccaacgaaaaaactaccccttctagtgccgagcccactgaacatggtgagcggacccctctggccaacgaaatcactaccccgtcaagggccgagcccaccgagcatggcgagagaatcgccaacgagaaagccaccccctctccagctaagcctactgaacatggtgaaaccactgtaaacgaagatacaacgccttcttccgccgaaccgacagagaacggtgaaaggacgcctctagcgaatgaaaacaccactaccagtccgaccgagtccacggaacacggagaacgcacggcaaatgagaagaccacgcctagccctgctgagcccaccgagcatggagagcggaccccaagtgccaatgaaaagactattccgtcccctgccaaacctacggaacatgaagaaatgaccccctctgccaatgaaaacaccaccccttccccggtcaagcctactgagcacggggaaaaaacaacacttgcaaacgagaagatcaccctcagccccgagggtccaaccgagcacggggccaagaccactagcgctaacgagaagatcaccccctccttagcaaaacctaccgaacacggagagcgcacaacaagcccgaatgacaagattacatcaagcgctgccgagtcaacagaacatagggaccgtgccaccagcgccaacgtaattactccagcaccagcggagcctatcaagcatgccaaaaggaccaccctagctcacgagaaaatgactcaagtgacagaaaaaagcacagagcaccccgaaaagaccacgtccaccaccgagaagactacacgaacccctgaaaagccaacgctttattcagagaagacaatctgcacaaaaggcaaaaatacacctgtgccagaaaaaccgaccgaaaacttgggcaatacaacgttgactactgagacgataaaagcccctgtgaaaagcacagagaacccggaaaaaacagctgccgtgaccaaaaccattaagcccagtgtgaaggtcacgggcgataagtctctgacaaccacatctagccatctgaacaagacggaggtcacccatcaagttcccaccggaagtttcaccctgataacatcccgaaccaagctttcatctatcactagtgaagcaaccggtaatgaatcccatccctaccttaacaaggacggcagtcagaaaggcatccacgctgggcagatgggtgaaaatgactctttcccagcatgggcgatcgtaatcgtagtgctggtggccgtgatcctacttcttgtctttctggggttaatctttctggttagctacatgatgagaactaggcgtacattaacacagaacacgcaatacaatgatgccgaggatgaagggggtcccaatagctatcccgtgtacctgatggagcagcagaatctggggatgggtcagatcccctcaccaagatag

SEQ ID NO: 114554 - DNA, 2670 bp, Artificial Sequence
  Description of Artificial Sequence: Synthetic coding sequence
atggcgcagcccgtgcacagtctttgctcggcctttgggctccagtgttgcttgttattcctccttgcttcatggggagcgggggctactacgttccaggagtatcagaagaccggggagctctccacaagtgaccacattttccccctgactccaggtctcgtctatagcatcccttttgaccacatagtgctgcactccgggcagaggccacctgaactcccaaagtctacagagatccacgagcagaagcgtcattgcaacactacccggcatagcaagcctactgataagcctaccggcaactcaaagactatcgaccataagagcagtactgacaaccatgaggctccccctacttcagaagagaactcatcaaatcaggggaaagacccaatgatccgcaaccagagaagcgttgatcctgctgactcaaccactacccacaaggaatccgccggcaagaagcacattacgcctgctccaaagagtaaaatcaattgccgaaaatcgacaaccggaaagagcaccgttaccaggaaaagcgacaagactggccgacccctggagaagtcaatgagtaccctagataagacctccaccagctcccacaaaacaaccacctccttccataattctgggaatagtcagactaaacaaaagtccacatctttcccagagaaaatcaccgccgcttccaaaaccacttacaaaactacaggcacccccgaggaatcggaaaagactgaagacagcagaaccactgtggcttccgataaactgctgaccaaaacaaccaagaacatacaggaaaccataagtgccaacgaattgactcaatctcttgccgaacccaccgagcacggaggccgaaccgccaatgaaaacaatactccgtcccccgctgaaccaaccgaaaatagggagcgaaccgcaaacgagaacacaaccctcagccccgccgagcctaccgaaaaccgggagcggactgctaatgagaataccgctcccttccccgctggcccaactgagaacagagaaatgaccgctaatgaaaacactaccctgttcccagccgaaccgactgagcacggggaaaggaccgctaatgagaacactaccccctccccagccgaaccaaccgagcatggggagcgcacagcaaatgagaacacgacaccttccccggccgagcccaccgagcacggggaaaggacaccttttgccaatgacaagacaacaagtagctcagcagaaagcaccgaacacggtgaaagaactccattagccaacgaaaataccaccccgtctcccgccgaacccacagagaaccgtgagcgaacagcaaatgaaaacactacacccagcccagctgggcctactgagaatcgggagacgaccgccaatgagaagactacactaagtcctgtggagccgaccgagaatcgcgaaacaaccgcaaatgaaaaaaccactccctctccagccgaacctacggagaatgggcagcgcacccctttcgccaatgagaagacgacaagcagtagcgctgaacccacagaacacggagaacgcactcccttagcgaatgagaacacgacccctagccctgctgaaccaactgaaaatcgcgaacgcactgcaaatgaaaagacaacccctagccccgccgagcccacagaaaatggagacaggaccccattggccaacgagaaaacaactccatcactcgctgaaccaaccgagaacgggcaacgtacccctttcgctaatgagaagacaacctcttccagtgcagagcccaccgaacacgaggaacgcaccccattagctaatgaaaatactacgccgagtccagctgagcccaccgagaaccgtgaaaggaccgcaaacgaaaatacgaccccaagtcccgcaggccccaccgagaatagggagatgacggcgaacgagaaaaccacactgttcccagccgaaccaaccgagaaccgcgaaaggaccgctaacgagaagacaaccagcagtcccgccgagcccaccgaaaatggacagagaaccccgtttgctaatgagaagacaacatcctcttctgcagagccgaccgagcacggggagaggacgccgctggctaacgagaataccaccctgtctccggcagggccgacagagaacagggagcgtaccgccaacgagaagacaactccttttccagctgaacctactgagaatagagagagaactgcaaatgagaacacaactccttccccagctcagcccactgagaatggagaccgaacccccctggccaacgagaaaacaactcccagcctggccgagcccaccgaaaatggcaagaggaccccctttgctaatgaaaagacgacctcttcgagcgcagagcctactgaacatgccgagcggacgcccctcgctaacgagaatactacaagttctcctgctgagcctaccgagaaccgagaacggactgctaacgaaaaaacaactcagtttccagctgagcccacggagaacagagagtctaccgcgaacgaaaagacaaccccatttcctgccgaaccgactgaaaatcgggaatggacggccaatgagaacacgacgctgtctcccgctgaaccaactgagcacgaagaaatgactccattggcctag

SEQ ID NO: 114555 - DNA, 1653 bp, Artificial Sequence
  Description of Artificial Sequence: Synthetic coding sequence
atggtgcctaaagccgactccggagcattcctgctgttattcctcttagttctaaccgttaccgaaccgttacggcctgaactgaggtgtaatcccgggcaatttgcctgcaggagcggtacaatccagtgtattccgctcccttggcagtgcgacgggtgggccacctgcgaggacgaatccgatgaagctaattgccctgaagtcacaggcgaggtcaggcctcaccacgggaaggaggctgtagatcccagacagggccgagctcgtggaggggatccgtcccacttccatgccgttaatgtagctcagcctgtcaggttttcttccttcctgggtaagtgtcccacggggtggcaccactatgaagggaccgccagttgctatagagtgtacttaagcggggagaattactgggatgctgcccagacctgccagcgcctgaatgggtccctggcaacatttagcacggaccaagaattgcgtttcgtcttggcacaagagtgggaccagcctgaacgatctttcggttggaaagaccagcggaagctctgggtgggctaccagtacgtgataactggacggaataggagcctggaggggagatgggaggtcgcttttaaaggatccagcgaagtgttcctgccccctgatcctatttttgcctccgctatgtcggaaaatgataatgttttttgcgcccagctccagtgcttccattttcctactcttcgacatcacgaccttcactcttggcatgcagagtcctgttacgaaaagtcttctttcctttgcaagcggtcgcagacctgcgtcgacattaaggataatgtcgttgacgagggtttttatttcacacccaaaggcgacgacccttgcctgagctgtacctgccacggcggcgaacccgagatgtgtgtagccgctctgtgcgaacggccccaagggtgccagcaatatcggaaggacccaaaggaatgttgcaagtttatgtgccttgaccccgatggcaactcactcttcgacagtatggcgtcaggaatgcgtctcgttgtgtcctgtatcagtagtttcctgatcctgtccctgcttttgttcatggttcacaggcttaggcaaaggcgccgcgagaggattgagagtcttattggtgccaacctgcatcatttcaacctggggagacgaatcccaggtttcgattacggtccagatggctttggcaccggactgacacctctgcatctgagtgatgacggagaaggggggactttccatttccatgatcccccacctccctatactgcatataagtatcctgacataggacagccggatgatccaccccctccctatgaagcttccatccatcctgattctgtgttctatgatcccgcggacgacgacgcatttgagccggtcgaagtgagcttgccagcccccggcgacggcggctccgaaggcgcactgttgcgccgactggagcagccactgccaacagctggcgcctcactcgctgacctagaggactcggcagactcttcctccgcgctgctggtccccccggaccccgctcagtccggtagcacccctgcagctgaggccctgcctggaggtgggcgccacagtcgatccagtctcaatacggtcgtttag

SEQ ID NO: 114556 - DNA, 984 bp, Artificial Sequence
  Description of Artificial Sequence: Synthetic coding sequence
atggtgcctaaagccgatagtggggcctttctgctcctttttctcctggttctcacagtgacagagcccctgcgccctgaactgcgatgcaatcctggccaatttgcttgtaggagtggcaccatccagtgcattccgctcccctggcagtgcgacggttgggctacctgtgaggacgagtctgacgaggcgaattgccctgaagtgactggcgaggtgcgaccacaccacgggaaggaggccgtcgatccacggcaaggacgcgctagggggggggatccttctcatttccatgctgtgaacgtcgctcagcctgtacgattttcttctttcctggggaagtgccccacaggttggcatcactatgaggggaccgcaagctgctacagagtatacctctcaggagaaaactactgggatgccgctcagacctgtcagagactgaatggttctctggcaacgttttcaactgatcaggagctccgttttgtactggcccaagagtgggaccagcccgagcggtccttcggctggaaagatcagaggaaactctgggtgggctaccagtatgtgataactgggagaaaccgcagcctggaaggtagatgggaggttgcttttaaggggtcctccgaagtatttcttcctcccgaccctatcttcgccagtgcaatgtccgaaaatgacaacgtgttttgcgcccaactccagtgctttcatttccccacacttcgacatcatgatctgcacagctggcacgccgaaagttgctacgaaaaaagctcatttctatgtaagcggtcccagacctgtgtggatattaaggacaacgtggtcgatgagggcttttacttcactcctaagggtgatgacccctgcctgtcctgtacctgccatgggggggaacccgaaatgtgcgtggccgcactgtgcgagcgcccccagggctgcagcccgctcagttgtacagcaagagccacctag

SEQ ID NO: 114557 - DNA, 1530 bp, Artificial Sequence
  Description of Artificial Sequence: Synthetic coding sequence
atggtccccaaagcagacagcggcgctttcctgcttcttttcctgttagtgcttactgttaccgagccacttaggcccgaggtaaccggggaggtgcggccccaccatggcaaagaggccgtggatccacggcaaggtcgagctcgagggggagaccctagtcacttccatgcggtcaacgtggcccagcccgtgaggttctcaagtttcttgggcaagtgccccacgggatggcaccattatgagggtactgcaagctgctaccgggtgtatctgtccggggagaactactgggacgctgcacagacgtgccaaaggttaaacggctcacttgctacctttagtaccgaccaggaactgcgattcgtgctggcccaggaatgggatcagcctgaacgtagtttcgggtggaaagatcagcgcaaattgtgggtagggtaccagtacgtgatcactggcaggaacaggagcctggaggggcgctgggaagtggcattcaaagggtctagtgaagtattcctacctccggatccaatcttcgcaagcgcaatgtccgagaatgataacgtgttttgtgcccagttacaatgtttccactttccaacactgcgtcaccatgatctgcactcttggcatgccgaatcttgctacgaaaaatcttcattcctgtgcaaaaggagccagacttgtgttgacatcaaagataacgtagtggatgaaggcttctacttcacaccaaagggcgatgacccctgccttagttgtacttgccacggcggagagcccgaaatgtgcgtcgctgccttgtgcgagaggcctcaggggtgccagcagtacaggaaggatcccaaggaatgttgtaaatttatgtgcctggaccctgatggaaattcattgtttgattccatggctagtggaatgaggctggttgtgtcctgcattagttctttcctgatattatctcttcttctgtttatggtccatcgcctccgccagcgccgacgagaacgtatagagtccctcattggtgcaaatctccaccacttcaatctggggaggcgaattcctgggtttgattatggcccggatgggtttggtaccgggttgacaccactgcacctgagcgatgacggggaagggggtacatttcactttcacgatccaccccccccctacacagcttataagtatcccgacataggccagccagatgatcctccccccccgtacgaggcttccatccatcccgactcagtcttttatgacccagcagacgacgatgccttcgagcccgttgaagttagcctacctgcccccggagacggagggtctgaaggagcattactgcgcagacttgagcaacccctcccgacagcgggcgcttctttagctgatttagaggattctgcggacagctcaagcgccctgctggtacccccagaccctgcccaaagcgggtcgacccccgccgcagaggcgctgcctggaggcggtcgccactcaaggagtagcctcaacacggtggtctag

SEQ ID NO: 114558 - DNA, 810 bp, Artificial Sequence
  Description of Artificial Sequence: Synthetic coding sequence
atggtgcctaaagcagactctggcgcctttcttctgttgttcctccttgtgttgaccgtgactgaaccactgaggcccgagctgcggtgtaacccgggacaatttgcttgcaggtctggaacaattcaatgcataccgctaccttggcaatgcgacggttgggccacgtgtgaggacgaatccgacgaggcaaactgccccgaggttaccggcgaagtaaggcctcaccacggaaaggaagctgtggatccacgacaggggcgggctcgtggcggcgacccgagccactttcacgctgtgaatgtagcacagcctgtgagattttcccggaaatgcccaacagggtggcaccactatgaaggaacagcatcctgttacagagtgtatctctctggagaaaactactgggacgctgctcagacctgtcagaggctgaacgggtccctcgccaccttctctaccgaccaagaacttagatttgtgctggcgcaggagtgggaccagcccgagcggtcgtttgggtggaaagatcagcgaaaattgtgggtgggctaccagtacgttattacgggccgcaatcgctccttggagggccgttgggaagtggcctttaaggactggggcgtttcagatacaatggtacaccgaagattgctctgcccttgcgttggcaccctccatacccaccttaagctgggagccaggttccgcagggtgcctgtgagactgggaggagctctttctaggcggtcaccacgcccaacacctgcttgcgagcccagattgggagcaaagactctgcaggtgtag

SEQ ID NO: 114559 - DNA, 663 bp, Artificial Sequence
  Description of Artificial Sequence: Synthetic coding sequence
atggagaggtatgccggggcactggaggaagtggctgatggcgcacgccagcaggaaagacactatcaactccttagcgccttgcagtcgctggtaaaggagctgccaagctccttccagcagcggctgagctatacaactctatctgacttggcattagccttgctggatgggactgtgttcgaaatcgtgcagggcctcctcgagatccagcatttgactgaaaaaagcttatataaccaacggctgcgccttcagaacgagcatagagtcctccggcaagccctgcggcagaagcatcaggaagcacaacaggcctgcagacctcataacttaccggtactgcaggcagcccagcaacgggagctggaggctgtggagcatagaatccgagaagaacagagagccatggatcagaagatcgtgcttgagctggacagaaaagtggcggatcagcaatccaccctggagaaggccggagttgcgggcttttacgtcactacaaacccacaggaattgatgttgcaaatgaacctgctcgagttaattagaaaactgcaacagaggggttgctgggccggtaaagccgctctggggctcggcggtccgtggcagttgccagccgcccagtgcgatcagaaggggtcacctgtgccgccctag

SEQ ID NO: 114560 - DNA, 663 bp, Artificial Sequence
  Description of Artificial Sequence: Synthetic coding sequence
atggagcgctatgcggccgccttggaagaagtggccgatggcgccagacagcaagagaggcactaccagttactaagtgcactgcagtccttggtgaaagaactgccttcttcctttcagcaacggctatcttataccacgttgagcgaccttgcccttgcattattggacggtaccgtgttcgaaattgttcaaggactcctggagattcagcaccttacagaaaaatccctgtacaatcagcggcttcgcttacagaacgagcacagggtgctaaggcaggcgctacgacaaaaacatcaagaggctcagcaggcctgccggccacataatctgcccgttgtccaggccgctcagcagcgggagctggaagctgtggagcataggattagagaggaacagagggctatggaccagaaaatcatcctggagttagatcgcaaggtggcagaccagcagtcgactctcgagaaggcaggagtggccggtttctatgtcacaaccaatcctcaagaattgatgctgcaaatgaatttgctggaactcatcaggaagcttcagcagcgagggtgcagagctggaaacgccgccctaggcttgggtggaccctggcagagccctgcagcccaatgtgatcagaagggatcccccgtaccgccatag

SEQ ID NO: 114561 - DNA, 2322 bp, Artificial Sequence
  Description of Artificial Sequence: Synthetic coding sequence
atggagaccgacgagagtccgtcccctcttccttgcgggcctgctggagaagccgtcatggaatctcgagcaaggccttttcaggcactgccgcgggagcagtcgccacctcctcctctgcagacttcatccggcgccgaggtcatggacgtgggatcaggcggagatggacagtccgaattacctgccgaggaccccttcaacttttatggcgcctccctgctatccaaaggttccttctcaaaagggcgcctgttgattgacccgaattgttccggccattcaccaaggaccgcgagacacgcgccggccgtccgcaagttcagcccggatttgaagcttttgaaagatgtgaaaatttcagtgagcttcacggaatcatgccggagtaaagataggaaagtgctatataccggggccgagagggatgtgcgagccgagtgcggcctgctactgtctcctgtttccggcgatgtgcacgcttgtcctttcggagggagcgtcggcgacggtgttggtatcgggggtgaaagtgccgataagaaggacgaagagaatgaactcgaccaagagaagcgtgtggagtacgccgtccttgatgagctcgaggactttacggacaatttagaactggatgaagagggagccggcggatttactgccaaggcgatagtccagcgcgaccgtgtggacgaggaggctctaaatttcccctatgaagatgatttcgacaacgatgtcgacgcactgctggaggagggcctgtgtgcaccaaagaaaagacggaccgaagaaaaatacggtggcgactcagaccatccctccgatggcgagaccagtgtgcagcctatgatgaccaagatcaaaactgtcctaaagtcgcggggcaggccacctacagagcccctgccagacggctggatcatgacctttcacaattccggagtccccgtgtacctccatagggaaagtagggtggtgacatggagcaggccttactttctcggcacgggatccattcgaaaacacgaccctccattatccagcatcccatgcctccattacaaaaagatgaaggataatgaggagagggagcagtcgagcgatctcacaccaagtggcgacgtatctcctgtgaagcctctgtcccggtctgctgagctagagtttccactggatgaacccgatagcatgggcgccgaccctggcccccccgacgaaaaggatccactcggagcagaagccgcgcctggcgcactagggcaggtaaaagccaaggtggaagtgtgtaaggatgaaagcgtggacctggaggagttcagatcctatctggaaaaaagattcgatttcgagcaggttacagttaaaaagttccgcacttgggcagagcggaggcagtttaacagagaaatgaaacgcaagcaggctgaaagcgagagaccaatcctgcccgctaatcaaaagctcattaccctctctgtccaagatgctccaaccaagaaggagtttgtgatcaatcctaatgggaaatcagaagtctgtattctgcacgagtatatgcaaagggtgctgaaagtccggccggtgtacaacttcttcgagtgtgagaacccctcggaacctttcggggcatcagtcaccattgatggggtgacgtacgggtctggtaccgcgagttcaaagaagctggccaaaaataaggcagcgcgggctactctggagattctcatcccagattttgtaaagcagactagtgaagagaaacccaaggatagtgaggagctggagtacttcaatcacatcagtattgaagatagtagggtatacgagctcacatctaaagctggcctgctgagtccctatcagatcttacatgaatgcctgaaaaggaaccacggaatgggggatacaagcatcaaattcgaagtggtgccaggcaagaaccagaaaagtgaatacgttatggcctgcggcaagcacaccgtgaggggttggtgtaagaacaaacgggtgggcaagcagttggcttcccaaaaaattctgcagctcctgcaccctcatgtgaagaactggggatctctgttaaggatgtatggtagggagagctcgaagatggtgaagcaggaaacctccgataaaagcgtaatcgaactgcagcagtatgctaaaaagaataaacctaatctgcatatcctcagtaaattgcaagaggagatgaaacgtttggctgaggaacgtgaggagacccgcaaaaaaccgaagatgagcatcgtggccagtgcccagcccggcggcgagcctctatgcaccgtcgacgtgtag

SEQ ID NO: 114562 - DNA, 2223 bp, Artificial Sequence
  Description of Artificial Sequence: Synthetic coding sequence
atggaaaccgacgagagtccgtcaccattaccatgcggaccagccggagaagccgtgatggagagcagagcacgaccctttcaggccttaccacgtgagcagagtcctcccccaccccttcagacaagttccggggcggaggtgatggatgtcggaagtgggggggatggccagtccgaactgcctgccgaggatccctttaatttttacggagcctctctcctctccaagggctccttcagcaaagggaggctgctgattgacccgaactgtagcggccactcaccccggactgccaggcacgcacctgccgtcaggaaattcagtcccgatctcaagctgctcaaggatgtaaagatcagcgtatccttcacagaaagttgtcgctccaaagatcgcaaggtactgtatacaggagctgaaagagacgtgagagccgagtgtggactgttgttgagtcccgtgagtggagatgtgcatgcatgtcctttcggcggctccgttggggacggtgtgggaattggaggcgaatccgccgataagaaggatgaggaaaatgagcttgatcaggaaaaacgggtagagtacgccgtcctcgatgagcttgaggattttacggacaacctggaactcgatgaagagggagccggagggtttactgccaaggccattgtgcagcgggaccgtgtggatgaagaggctctgaacttcccctacgaagatgacttcgacaacgatgtggacgcactcctggaggaaggtttatgtgcccctaagaagaggaggacagaggaaaaatacggcggcgattccgatcacccatctgatggcgagacaagcgtccagccaatgatgaccaaaatcaagaccgttcttaagtctaggggccgtcccccaacagaacccttgccagatgggtggatcatgacattccacaattctggtgtcccagtgtatttacaccgggaatctcgcgtggttacctggagtaggccgtacttcctgggtactggctctattcggaagcacgatcctcctctctcctccataccatgtcttcactacaaaaaaatgaaggataacgaggagcgggagcaaagttctgatcttactccaagtggcgacgtgtcgcccgtgaagcctctctctcgaagtgccgagctggaatttcccctcgatgagcctgacagcatgggcgcagatccaggcccccccgacgaaaaggacccactgggggcagaagccgcaccaggagcccttggccaggttaaggccaaagtggaggtgtgtaaagacgagagtgtggacctggaagaattcaggtcctaccttgaaaaacgctttgactttgaacaggtcactgtaaaaaagtttagaacttgggccgagagaaggcagtttaatagagaaatgaaacgaaagcaggcagaaagcgagaggccaatcctccccgcaaatcagaagctgattacgctgtctgtccaggacgcacccactaaaaaagagttcgtcattaacccaaacggaaaatccgaagtctgcatccttcacgagtacatgcagcgcgtactgaaagtcagacccgtgtataattttttcgagtgtgccagagcgaccctggaaatcctgattcctgatttcgttaaacaaacctcagaagagaagcccaaggattctgaagaactagagtacttcaaccatatttctatcgaggactctagagtatatgagctgaccagcaaggctgggctcttgtcaccataccagattctgcacgagtgcctgaagcgcaaccacggcatgggggacacttctattaaatttgaagttgtgccaggaaaaaaccaaaagagcgagtacgtcatggcctgcggtaagcacacagtccgaggatggtgtaaaaataagagagttggcaagcagctcgctagccaaaagattttacaactattacatccccacgtgaagaattggggctctctgctgcgcatgtacggcagggagtcatcaaagatggtcaagcaggagacgagcgacaaatctgttatcgaactgcagcagtatgctaagaagaacaagcctaacctgcatatcctcagtaaactgcaggaggaaatgaagcggctggctgaagaacgagaggagacccggaagaagcccaaaatgagtattgttgccagtgcccagccagggggagagccattatgcaccgtggatgtgtag

SEQ ID NO: 114563 - DNA, 2223 bp, Artificial Sequence
  Description of Artificial Sequence: Synthetic coding sequence
atggagaccgatgagtcaccaagtccccttccttgtggccctgcaggcgaagccgtgatggagtctagggcgcgcccattccaggcactgcccagagaacagtcaccaccgccccctctccagacatcctcaggggcagaggtcatggatgtggggtcgggcggcgacggccaatccgaacttcccgctgaggatcctttcaatttctacggtgctagtctactatcgaagggaagcttttcgaaggggcggctgctcattgatcctaattgcagcggccattcacccagaaccgcccggcatgccccggccgttcggaagtttagccctgacctaaaactgctgaaggacgtgaagatctccgtcagtttcactgagagttgtcgatctaaggatcgaaaggtgttatatactggcgcggaaagagatgtaagggccgagtgcgggctcctcctatcaccggtgtcgggggatgtacacgcttgtcctttcggaggctccgttggagatggtgtgggaatcggcggcgagagtgccgataaaaaagacgaggagaacgagcttgaccaggaaaaaagagtggagtacgcagtgctcgacgaattggaggacttcactgacaatctcgagttggacgaagagggtgctggaggctttaccgcaaaggccattgttcaaagagaccgtgtggacgaagaagctctcaattttccttatgaggacgacttcgacaacgacgttgacgctctccttgaggaggggctttgcgctcccaaaaaacggaggactgaggagaaatacgggggggattcagatcacccttctgatggcgaaacctccgtccaaccaatgatgacaaaaattaagaccgtgctcaaaagtaggggtaggcccccaacggagcccttgcccgatggatggattatgacctttcacaattctggcgtgcccgtgtacctgcaccgcgaaagccgcgtcgttacatggtcccggccttattttttgggcaccggaagcatcaggaaacacgacccaccactttctagcattccatgccttcactataaaaaaatgaaagataatgaagaaagggaacagtctagcgatctcacaccttctggggatgtcagccctgtgaaacccttaagcaggtccgccgagttagagtttccattggacgagcctgattccatgggagcggaccccggtcctccggacgagaaagaccctctcggtgcagaggcggctcccggggccctcgggcaggtgaaagcaaaggtcgaagtttgtaaggacgaatccgtagatctggaagagtttaggtcttacctggagaagaggtttgacttcgaacaagtaacggttaagaaatttcgcacctgggctgagcgaaggcagttcaatcgagagatgaagagaaagcaagccgagtctgaacgtcctattctgccagcaaatcaaaagctcataaccctgtctgtgcaagacgctccaaccaagaaggagttcgtcatcaaccctaacggcaaatccgaggtctgcattctgcacgagtatatgcagagagtcctcaaggttcggcccgtgtacaacttcttcgagtgtgctcgcgcaacgctggagatactgataccagatttcgtcaagcagacctccgaggaaaaacccaaggattccgaagagctcgaatactttaaccacatttcaatcgaggacagcagggtttatgaactaacgtccaaggctggccttctgagtccctatcagatccttcatgagtgcttgaagcgtaaccacggtatgggcgatacatcaatcaaattcgaagttgtgcccggtaagaaccagaaaagtgaatatgtgatggcctgtggaaaacacacagtgcgaggatggtgcaagaacaagcgagtgggaaagcagctggccagccaaaaaatattgcagctgctccaccctcatgtgaaaaattggggctcacttttgcgtatgtacgggcgagagtcttcaaagatggttaaacaggaaaccagcgataagagcgtgattgaattacagcagtatgccaagaaaaataaaccaaacctgcatattctctccaaactacaagaggaaatgaaaagacttgccgaggagcgagaggagacgagaaagaagccgaaaatgtccatcgttgcctcggcacagccaggaggggagccgctctgcacagtggatgtgtag

SEQ ID NO: 114564 - DNA, 378 bp, Artificial Sequence
  Description of Artificial Sequence: Synthetic coding sequence
atggaaacagacgagtctcctagtcccctgccatgcggtcctgctggcgaagccgtaatggagagccgcgcacgcccttttcaggcactccccagagagcagtctcccccccctcccctgcagactagctccggtgctgaagtaatggatgtggggtcagggggcgacggacagtctgaactgcctgctgaggatccctttaacttctatggcgcctcattgctgtctaaaggctctttctcgaaaggacggttacttattgaccctaactgtagtggccatagtccccggactgcccgccacgctcccgccgtcagaaagtttagccctgatctgaagctgctgaaagacgtaaagatttctgtgtccttcacctag

SEQ ID NO: 114565 - DNA, 564 bp, Artificial Sequence
  Description of Artificial Sequence: Synthetic coding sequence
atggtggggtctctgaattgtatcgttgccgtgagtcagaacatgggtatcggaaagaatggcgacctgccctggcccccactgagaaacgaatttcgctattttcagcgaatgaccaccacatcttcagtggaaggtaagcaaaatttagtaataatgggaaaaaagacatggttctcaataccagagaagaatcggcctttaaaggggaggatcaatctggtcttgtcacgtgagctaaaagaaccaccccagggtgcccattttctgagccgttcgctcgatgatgcacttaagcttaccgagcaacccgaactggctaacaaggtggacatggtctggatcgttggaggcagtagtgtgtacaaggaggccatgaaccatccaggccaccttaaactcttcgtgacccggattatgcaggacttcgagtccgacacttttttcccggaaattgatttggagaaatacaaactgttgcctgagtaccccggagtattgtctgatgtgcaggaagaaaagggtataaagtataaattcgaggtttacgagaagaacgattag

SEQ ID NO: 114566 - DNA, 564 bp, Artificial Sequence
  Description of Artificial Sequence: Synthetic coding sequence
atggttggctccctgaactgcatagttgccgtctcccagaacatgggaattgggaagaatggcgatctgccatggccccccttgcgcaacgagtttagatacttccagcggatgaccactaccagcagcgtcgaggggaaacagaatctggtaatcatgggaaaaaaaacttggttcagtattccagagaaaaaccggcctctcaagggtcgcatcaatctggtcctgtcgcgggaacttaaggagccaccacagggcgcccattttctttcccgaagcttagatgacgctctaaagttgacagaacagccagagctcgctaataaggtcgatatggtctggatcgtgggggggtcctctgtatacaaggaggcgatgaaccacccaggacacctgaaactatttgtgacacggataatgcaggacttcgagtcagatactttcttccccgaaattgacctcgagaagtataagcttttgccagaataccccggagttttaagcgacgtgcaagaagagaagggtattaaatacaagtttgaagtgtatgagaagaacgattag

SEQ ID NO: 114567 - DNA, 963 bp, Artificial Sequence
  Description of Artificial Sequence: Synthetic coding sequence
atggccgccgtccgtatgctccgcacctggagccgcaacgccgggaagcttatttgtgtacgttacttccagacctgtggcaacgttcacgttctgaagcccaactacgtctgctttttcggatatccctcatttaaatactctcatccacaccatttccttaaaacaactgccgcccttagggggcaggtggtccaattcaagctgtctgatatcggtgagggtatcagagaagtcacagtgaaggaatggtacgtaaaggagggtgacactgtgtcccagtttgactccatctgtgaagtccaaagtgataaggcatcagtgactattacctcacgctacgatggtgtcatcaagaagctgtactacaacctggatgatatcgcctacgtgggcaaacctctggtggatatcgaaactgaagccctgaaagatagtgaggaagatgtcgtggaaactcccgccgtgagccatgatgagcacacacaccaggaaattaaaggccggaagacactggcaacacccgccgtccggcgcctggcaatggaaaacaacatcaaactatcagaagtagtcggcagcgggaaggacggacggatcttgaaagaagatattttgaactatctcgagaaacaaaccggtgccatcctgccaccttctccgaaggtggagatcatgcctccgcccccaaagccaaaagatatgaccgttcctattctggtaagcaagccccctgtattcactggtaaagacaaaaccgaaccaatcaagggattccagaaggctatggtcaaaacaatgagcgccgccctgaagattccacattttggatactgcgacgaaatagacttgaccgaactggtcaaactgagggaggaattgaaacccattgcttttgctcggggcatcaagctgagttttatgcctttcttcttgaaatattatttcagttggaagtcttag

SEQ ID NO: 114568 - DNA, 1449 bp, Artificial Sequence
  Description of Artificial Sequence: Synthetic coding sequence
atggcggctgtgcgaatgctgcggacttggagtcgcaacgcagggaaactgatttgtgtgcggtactttcagacatgcggcaatgtacatgtgttaaagccgaactatgtttgctttttcggctatccctcttttaagtacagtcacccacatcacttcctgaagaccacggccgccttacggggtcaggtagtgcaatttaaactctccgatataggggagggtatcagggaggttacagtgaaggaatggtacgtgaaagagggcgacacggtgtctcaatttgactcaatttgtgaggtgcaaagtgataaggccagcgtcacaattacaagtaggtacgacggggtcataaagaagctctattataacctggatgatattgcatacgtaggcaagccactggtggatattgaaacggaagctctcaaggactccgaagaggatgtagtcgagacacctgcagtgtcacatgatgagcatactcaccaggaaatcaaggggcgcaaaacgctagctacaccggctgttcgtcggctcgccatggaaaataatataaagctgtcagaagtggtcggatctgggaaggatgggcggatcttaaaagaggacatcctcaattacctcgagaaacagaccggcgctattctccctcccagtcctaaggtcgagatcatgccccctccacccaagcccaaggatatgactgtgcctatactcgtgtcaaagcccccagtgtttactggaaaggacaagacggagccaattaagggattccagaaggcaatggtgaaaaccatgtctgcagccctgaagattcctcatttcggctattgcgatgagatagatttgacagaactcgtgaaattgagggaagaacttaagcctatagctttcgcaagaggaatcaaactctcatttatgccatttttcctgaaggctgcttcattggggctgctgcagtttccaattctgaatgcctctgtggacgaaaattgtcagaatataacgtataaggcctcacacaatattggcatcgctatggacaccgagcaggggttaattgtccccaacgtaaagaacgttcagatttgctctattttcgacattgccacagaactcaatcggctgcagaagctggggagcgtcagtcaactgtccaccaccgacctaactgggggcacctttaccttgtccaacatcggcagcattggcggtacattcgcaaaaccggtgattatgccaccagaggtcgcaattggggcacttggaagcatcaaggcaattcccaggttcaaccagaagggtgaggtgtacaaggctcaaatcatgaatgtatcctggagcgccgaccacagagtgatcgacggagccacgatgagccgcttcagcaacttgtggaaaagttacctcgaaaatcccgcctttatgctgctggatctcaagtag

SEQ ID NO: 114569 - DNA, 906 bp, Artificial Sequence
  Description of Artificial Sequence: Synthetic coding sequence
atggaaaacaacattaaactgtccgaggtggtcggatctggtaaggacggcaggatcctgaaggaagacatcctgaactatctagagaaacagaccggcgccatactacctccttctcccaaggttgagatcatgccacccccacccaagcccaaggatatgacagttcctatcctggtctcaaaacctcccgtttttaccggaaaagataagactgaaccgatcaagggatttcagaaggccatggttaaaacgatgtctgcagctctgaaaatccctcatttcggctactgcgatgaaatagatctgaccgaattggttaaactcagagaagagctgaagcccatcgcctttgctcgagggatcaagttgtcattcatgccattttttctgaaggcggcaagtttgggtttgcttcagttccccattctcaacgcaagtgtcgacgagaattgccagaacatcacctacaaggcaagccacaatataggtatagctatggacaccgagcagggactgattgtacctaatgtcaaaaacgttcagatttgctccatctttgacatcgctaccgagcttaatagactgcagaaactcggatcagtgtctcagctgagcacaaccgaccttaccggaggaactttcacgctgtcaaacattggttctatcggtggaaccttcgctaagccagtcataatgcctcctgaggttgccataggcgccttaggctctattaaggctatcccaagatttaaccagaaaggcgaggtgtataaagcacagattatgaacgtctcatggtccgccgatcacagggtgattgacggtgccaccatgagccgattttcaaacctttggaaaagctacctcgaaaaccccgcgttcatgttactggatttaaagtag

SEQ ID NO: 114570 - DNA, 5286 bp, Artificial Sequence
  Description of Artificial Sequence: Synthetic coding sequence
atgcagtttcagctaaccctgttcctccacctaggctggctatcttattcgaaggcccaggacgattgtaatcgcggggcttgtcacccaaccacaggcgacctgctagtcggacgcaacacgcagttgatggccagcagcacatgtggactctcccgggcccagaagtactgtatactcagctacctcgagggagagcagaagtgctttatctgtgactcacgctttccttacgacccatacgatcagcctaactcccacaccattgagaacgtcatcgtgagctttgagcctgacagggaaaagaagtggtggcaatccgaaaacgggctcgatcacgtgtcaatccggctcgacttagaagctctctttcgatttagccacctgatcctgacatttaaaaccttcaggccggctgcaatgctggtggagagatccaccgattacggccacaattggaaggtgtttaaatacttcgcaaaggactgtgctaccagcttcccgaatatcacctcaggccaggcccagggcgtcggtgacattgtgtgtgactcgaaatacagcgacattgaaccttctaccggcggagaagtggtcctcaaagtgctcgacccctcattcgagatagaaaatccatacagcccatatatccaggacttggtcaccctcactaatctgaggataaactttactaaactgcataccctcggcgatgctctacttggacggcgtcagaacgatagtctcgataaatattactatgccctatatgaaatgatcgtccgcggtagctgcttttgtaacggccacgcctcagagtgccggccaatgcagaaaatgaggggcgacgtcttttcccctcctggcatggttcatggacagtgcgtatgccagcataacaccgacggacccaattgcgagcgctgtaaagatttttttcaggatgcaccttggcgcccagctgccgatcttcaagacaatgcttgccgatcttgttcttgtaatagtcattccagcaggtgccacttcgacatgacaacgtaccttgcatccggcggcctcagcggaggcgtgtgcgaggattgccagcataacacagaggggcagcattgcgacagatgtcgcccgctgttctacagagatccgctgaagacgatctctgatccgtatgcctgcataccctgtgagtgtgatcctgacggaactatttccggcggcatttgtgtatcgcacagcgacccagccctcggcagcgttgcaggccagtgcctgtgcaaagagaacgtggagggcgccaagtgtgaccagtgtaaacctaatcattacggactctccgccacagatccactgggttgccagccatgtgactgcaaccctcttggttcattgcccttcttgacttgtgatgtcgacacaggacaatgtttgtgtctgtcctacgtcacaggagcccattgtgaggagtgcactgtggggtattggggcctgggcaaccatctccacggatgctcaccctgcgactgtgatattggtggcgcatactctaatgtgtgctcccccaaaaacggtcagtgcgaatgcagacctcatgtgactggccgctcgtgttctgaacccgcaccgggatacttctttgcacctctgaacttctacctctatgaagctgaagaggccaccaccctgcagggactggcgccactgggcagcgaaactttcggacagtccccagcagttcatgtcgtcttgggggagcctgtccctggaaatccagtaacgtggacaggtcccggctttgctagagtgctcccaggtgccggtctgcgattcgccgtcaacaacatcccttttccagtggattttaccattgccattcattatgaaacccagagtgccgctgattggactgtacagattgtagtgaaccctcctggtgggtcggagcattgtattccaaaaacactgcagtccaagccccaatcattcgctcttcctgcagcaaccagaataatgcttctacctacccctatctgcctagagcccgacgtccaatattcaattgacgtgtacttctctcagccactccagggtgagagccacgcccactcacatgtgctcgtggactctctcggcctgattccccagatcaattctctcgaaaacttctgtagcaagcaggacttagacgagtatcaacttcacaattgcgttgaaatcgcttctgcgatgggaccgcaggtgctcccaggagcctgcgagcgcctcatcatatccatgagtgccaagctgcatgacggcgccgtggcgtgtaagtgccacccccaggggagtgtcggctcaagttgctctaggcttgggggtcagtgtcaatgcaagcctttggtcgtgggaaggtgctgtgatcgttgcagcacaggcagctatgacctgggccatcatggatgtcacccctgtcactgtcacccgcagggatcaaaggatactgtgtgcgatcaggtcactggccaatgcccctgtcatggagaagtatctggaagacggtgcgatagatgcctggctggatatttcgggttccccagctgccatccttgcccttgtaatcgtttcgccgagctttgtgatcctgagactggctcgtgctttaattgcggcggcttcacgactggcagaaactgcgagagatgtatcgacggctattacggtaatccatcgagtgggcagccttgtagaccttgcttatgtcctgacgatcccagttccaaccaatacttcgcccacagctgttatcagaatctttggtctagtgacgtgatctgcaactgtctccagggctacacaggcactcagtgtggcgagtgttctactgggttttatggcaatccccggattagcggagccccctgccaaccatgtgcctgcaataataacatcgacgtgacagacccagagtcttgttcccgtgtcaccggagaatgcctgagatgtcttcacaatacacagggggcaaactgtcagctgtgtaaacccggacattacggttctgccctcaaccaaacctgcaggcggtgttcctgtcacgcatccggggtgtccccaatggaatgcccacccggagggggagcatgtctttgcgaccctgtaaccggcgcgtgtccgtgcctgcccaatgtcaccggcctggcctgcgaccgctgcgctgatggctattggaatttagttcctggtcgtgggtgtcaatcttgcgactgtgaccccaggacgagtcagtcgtcacactgcgatcagctgactggccaatgcccctgcaagttggggtacggggggaagaggtgtagtgaatgtcaagaaaattattacggcgacccccctggaagatgcattccatgcgactgcaaccgcgctggtactcagaagccaatctgtgaccctgacacaggcatgtgccgctgtagggagggcgttagtggccagcgctgcgatagatgtgcacggggccatagccaagaatttccaacatgcctgcagtgccatctgtgctttgatcagtgggaccacactatttcctcactctcaaaggctgtgcagggccttatgaggttggcagctaatatggaggacaaacgcgagactttacccgtgtgcgaagccgactttaaggacctgaggggaaacgtttccgagattgagcgcattctgaaacaccccgtgtttccttctggcaaattcctgaaggtgaaagactaccatgactcagtccgccgccagattatgcaactcaacgagcagcttaaggcagtgtatgagttccaagatctcaaagacaccatcgagcgcgccaaaaatgaggcagacctgctgctcgaggacctgcaggaagagatcgacctgcagtcttccgtactgaatgcttcgatcgcagattcttctgagaatataaagaagtattatcatatctcttcttctgctgaaaagaaaatcaatgagaccagctccaccataaatactagtgccaatacacgtaatgacctgctaaccatactggacactctgacctccaaaggcaatctcagcctggaacgcctgaagcagatcaagattccagacatacagatcctgaatgaaaaggtatgtggcgacccggggaacgtgccgtgcgtgccgttgccatgcggaggtgcactctgcacaggaaggaagggccacagaaagtgcaggggaccaggttgccatgggagtctcaccctgtctacaaacgctttgcagaaagctcaggaggccaagtctataatccgtaatttagataagcaggtaagaggcttaaagaaccagatcgagtcaataagcgagcaagcggaggtttcaaagaacaacgcccttcagctgagagaaaaattaggcaatattcgcaatcagtctgactctgaggaggagaatattaatttgttcatcaagaaagtgaagaattttctgttggaggagaacgtgcctcctgaggacatcgagaaagttgccaacggggtgctcgacatccacctgcctattccttctcagaacctgaccgacgagctggtgaaaatacagaaacacatgcaactatgtgaagattacagaaccgacgagaacaggctgaacgaggaggccgacggagcacagaaactcctggtgaaggctaaggccgccgagaaagccgcgaatatcttactcaacctcgataagacacttaaccagctccaacaggcccaaataacacagggaagagcaaattctaccattacccagctcaccgccaatataaccaagattaagaaaaacgtcttgcaggcagaaaaccagacaagggagatgaaatccgaactcgagctcgctaaacagagatctggcctagaggacggcctttcactcttgcaaacgaaacttcagcgacaccaggaccatgcagtgaatgccaaagtccaggccgaatccgcccagcaccaggcgggctccctggaaaaggaatttgtagagttaaaaaaacaatatgcaatcctgcagcgaaaaacgtctaccaccggactgaccaaagaaacacttggcaaggtcaaacagctgaaggacgcagccgaaaaactggctggagatactgaggcaaaaatcaggcggatcactgatctggagaggaagatccaggatttgaacttaagccggcaagccaaggccgatcagctgaggatcctggaagaccaggtggtcgctatcaagaacgagatagtggagcaggaaaagaaatacgcacgttgctatagttag

SEQ ID NO: 114571 - DNA, 1530 bp, Artificial Sequence
  Description of Artificial Sequence: Synthetic coding sequence
atgcagtcctggtctcgcgtgtattgttcgctagcaaagaggggccactttaaccgcatctcgcacggcctccagggcctttctgccgtgccactgcggacctatgccgatcagccaatcgacgctgacgtgaccgtgatcgggtctgggccaggggggtacgttgccgccatcaaagccgctcagctgggcttcaaaactgtatgtatcgagaaaaacgagacccttgggggtacatgtctgaatgtgggatgcattcccagcaaggctcttctcaacaactcacattactaccacatggcccacggaaaggacttcgcttcaagagggatcgagatgagtgaggtcagactcaacctggacaagatgatggagcagaagagcacggctgtgaaagctctgactggcgggatcgcccacctctttaagcagaataaagtcgtgcacgtgaacggctatggcaagattacaggcaagaatcaggtgacagccactaaagccgacgggggtacccaggtgattgatacgaagaatattctgattgcgacaggttctgaagtcactccgttcccaggcattaccattgacgaggacacaatagtgtccagtactggggcacttagtcttaaaaaggttcccgaaaagatggtggtgatcggggcaggcgtcattggtgttgaactgggatccgtgtggcagagactgggggccgatgtcacagctgtggaattcctggggcacgttggaggggtaggcattgacatggagatttcaaaaaattttcagagaattctgcagaaacaagggttcaaattcaaactcaatacaaaggtgaccggcgcgaccaaaaaatcagatgggaagatcgacgtcagcatcgaggccgcctctggagggaaagccgaagtgataacttgcgatgtgctgctggtctgcatcggaaggcgtccttttacaaagaatctgggtctcgaggagctcggcattgaattagacccacgaggtaggattccagttaatactcgctttcagaccaagatacccaatatctacgccattggtgatgtggtagccggtccaatgcttgctcataaagcggaagacgagggaatcatatgcgtcgagggcatggctgggggagccgttcatatagattacaactgtgtgccctccgttatttatacacacccggaggttgcctgggtcggaaaatcagaggaacaactaaaggaggaaggaattgagtacaaagtgggcaaattcccctttgccgctaatagccgcgctaagactaatgccgacacagatgggatggttaagatactcggtcagaagtccacagacagggtgttaggcgcccatatcttggggcccggcgcaggtgaaatggtgaacgaggctgcattggcattggagtatggggcaagctgtgaggacatcgcaagagtgtgtcatgcccacccaacactgtcagaagcattccgtgaagccaatctggccgcctccttcgggaaaagtattaacttctag

SEQ ID NO: 114572 - DNA, 1386 bp, Artificial Sequence
  Description of Artificial Sequence: Synthetic coding sequence
atgcagagctggagtcgcgtgtattgttcactcgccaaacgcgggcattttaatcgaatttcacacgggttgcagggtctgagcgccgttccccttagaacctatgcagaccagccaatagatgctgacgtcacagtgatcggttcaggccccggtggatatgtcgctgccattaaggccgctcaacttggcttcaaaaccgtttgtatcgaaaagaatgagactttggggggtacttgtcttaatgtgggatgcatcccctctaaggccttactcaacaacagtcactattatcatatggctcatggcaaagattttgcctctagggggattgagatgagcgaagtaagactcaaccttgacaaaatgatggaacagaagtccactgccgtcaaagctttgactggcggcattgcacacctgtttaaacagaataagatcgatgaggatactatagtgagttcgacgggagccctctcactgaagaaggtgccagaaaagatggtagtaatcggcgctggtgtaattggagtggaattaggctctgtgtggcaacggctcggcgctgacgtcaccgctgtagaattcctcggacatgttggaggcgttgggatcgacatggagataagtaaaaatttccagcggatattgcaaaaacaggggttcaagtttaagttgaacacaaaggtgaccggagcaaccaagaagagcgacgggaagattgatgttagcattgaggctgccagcggcggcaaggcggaggtgataacctgtgacgttctgttagtctgcatcgggcgtcggccttttacaaaaaacctggggctggaagaactggggattgagctggaccctcgcggccgcatacctgtgaacactaggtttcagacaaaaattcccaacatatacgcgatcggcgacgtcgttgctggaccaatgcttgcccacaaggccgaagacgaggggatcatctgcgtggagggcatggcgggcggcgccgtacatatcgactacaactgcgtaccatcggttatctacacacatcctgaagtcgcttgggtgggcaagtcagaggagcagctcaaagaagaagggattgagtataaggttgggaagttcccatttgcagctaatagtcgggcaaagacaaacgccgacacagatggcatggtgaagatacttgggcagaagagtaccgacagggtcctcggagcacacatcttgggaccaggcgccggggaaatggtgaatgaggcagctctggcactcgagtacggcgcaagttgtgaagacatcgccagggtctgccacgcacacccgactctgtccgaagcatttcgagaggctaatctagccgcctcattcggcaaatcaattaacttttag

SEQ ID NO: 114573 - DNA, 1461 bp, Artificial Sequence
  Description of Artificial Sequence: Synthetic coding sequence
atgcagtcgtggtcgagggtgtattgtagtcttgcaaagagaggtcactttaacaggattagccacggtctacaggggctcagtgccgtccccctgcgaacgtatgccgatcagcctattgacgctgacgtcactgtgatcggcagcgggcccggcggctacgtcgctgcaatcaaggcagcccagctggggttcaaagccctgctgaacaattcccactattaccacatggcccacggtaaggatttcgcctcccggggtattgagatgagcgaagtgagactgaacctggataagatgatggagcagaagtccaccgctgtgaaggctctgacggggggcatcgcccacttgttcaagcagaacaaggtggtccacgtgaacgggtatggcaagatcaccggcaaaaatcaggttactgctaccaaagcggacggcggaactcaggttatagacacaaaaaacatcctcatagccaccggttcagaagttacccccttccctggtatcacgatagatgaggataccattgtgagcagcaccggagccctgtcattgaagaaggtccctgagaaaatggtggtgattggagccggagtgatcggagtcgagctgggaagcgtgtggcagcgccttggcgctgacgtcaccgctgtcgagtttttaggacacgtcgggggcgttggcatagacatggagatcagcaaaaactttcagaggatactgcagaagcaggggtttaagttcaaacttaacacaaaggtcacaggtgcaacaaagaaatcggatgggaaaatcgatgtctccatagaggccgccagcggagggaaagctgaagtgattacttgcgatgtattgttagtgtgtattggcagacgaccattcacaaaaaacctggggctggaagagctcggaatcgagttagacccacggggccgaatcccagttaacactaggtttcagaccaagattcctaatatttacgccataggcgatgtagtcgcagggccaatgctggcccataaagccgaggatgaagggatcatttgtgtggaaggaatggctgggggggcagtgcatattgattacaactgcgtaccttccgtcatatatacccaccccgaggtggcatgggtggggaagtcagaggaacagctgaaagaggagggaattgaatataaggtcggtaaatttccgttcgcagcaaatagtcgcgccaaaaccaacgccgacacagacggtatggtgaagattttgggacagaagagtactgacagggttctcggagcacatattctgggcccaggcgccggcgaaatggtcaatgaggcggctctggccctggagtatggtgcctcgtgcgaagacatagcccgggtatgtcatgcccaccctacactttccgaggcttttagggaagctaacttggcggctagttttggaaaatccattaacttctag

SEQ ID NO: 114574 - DNA, 1233 bp, Artificial Sequence
  Description of Artificial Sequence: Synthetic coding sequence
atggcccacgggaaagattttgccagcagaggaattgaaatgtctgaggtgcgcctgaatctggacaaaatgatggaacagaaatccacagccgtgaaagcgctgaccggtgggatcgctcacctgttcaaacagaacaaggtcgtccatgtgaacggttacggcaaaattacagggaaaaaccaagtgacagccaccaaagcagacggcgggactcaggttatcgatactaagaacatcctgatcgccaccggaagtgaggttaccccttttccagggattacaattgatgaagataccattgtgagctccacaggcgcactgtcccttaaaaaggtgccagagaaaatggttgtgattggcgccggtgttatcggcgtcgagctgggttcggtgtggcaaagactgggcgctgatgtcactgcggttgagtttctgggccacgtaggcggagtgggaatcgatatggagatctctaaaaatttccaaagaattctgcagaagcagggattcaaatttaaactcaacaccaaagttaccggggcgactaagaagagcgatggtaaaatcgatgtctccatcgaggcggcttccggcggaaaggccgaggtgataacatgtgatgtgctgctcgtctgcattggtcggcgcccctttactaagaatctcgggctagaggaactgggaatagagctggacccccgggggaggattccggtgaacacacggtttcagacaaaaatccctaatatctatgctataggggacgtggtcgccggacccatgctcgcccacaaggctgaagatgagggcataatctgcgtcgaggggatggccgggggggcagtgcatatcgattacaactgcgtcccctcggtgatatacactcaccccgaggtggcatgggtcggaaagagcgaggaacagcttaaggaggaggggatcgagtataaggtagggaagtttcctttcgctgcgaattcaagggcaaaaactaacgccgacactgacggcatggtgaaaatcttggggcagaaaagtacagaccgcgttcttggggctcacatcctaggaccaggggctggcgaaatggtgaatgaagccgctttagctctcgaatacggcgctagctgtgaggacatcgctcgcgtgtgccatgcgcatccaactctatcagaagccttccgggaggccaatctggcggccagttttggaaaaagcattaacttttag

SEQ ID NO: 114575 - DNA, 1380 bp, Artificial Sequence
  Description of Artificial Sequence: Synthetic coding sequence
atgttgatttacgttgccgccattaaagctgctcagttggggtttaagacggtgtgtatcgagaagaatgagactctgggcggcacctgcctaaacgtgggatgtattccgagcaaggcgctgctcaacaattctcattattatcacatggcccacgggaaggacttcgcaagccggggtattgaaatgtctgaggtcaggctcaacctcgacaagatgatggaacagaaaagcaccgcagtaaaggccctgacgggaggcatcgctcatctattcaagcagaataaagtggtgcatgtcaacgggtacggtaagataaccggcaagaaccaggttacagccacgaaagccgacggcggtactcaggtaatcgacactaaaaacattctgatcgccaccggttccgaagtcactcccttccctgggataacaatcgacgaggacactatcgtctcttctacgggagcactatcacttaagaaggtcccagaaaagatggtggttatcggggctggagtgattggcgtggaactcggatcagtgtggcaacgactaggcgctgacgtgaccgctgtcgagtttctcggacacgtgggaggcgtcggtatcgatatggaaataagcaagaattttcagcgtatcctgcagaaacagggcttcaagttcaagctgaatacgaaggttactggcgccacaaagaaaagtgatgggaaaattgatgtttctatcgaggccgctagcggtggaaaagccgaggtgatcacttgtgacgtgttattagtgtgcattggtcgaagacccttcaccaaaaatctcggtttggaggagttaggcatcgaacttgacccccggggacggattccagtgaataccagattccagaccaagattcccaacatttatgcaattggagacgtcgtggccggcccaatgcttgcccataaggctgaggacgagggcataatctgcgttgagggaatggctgggggggcagttcacattgactacaactgtgtgccatcagtgatctacacacatcctgaagtggcatgggtggggaaatccgaggagcaactgaaagaggaaggaatcgaatacaaggttgggaaatttccgtttgcagccaattcccgggccaaaaccaacgcagataccgacgggatggtcaagatcctcggacagaaatctactgacagagtgctaggggcccatatcttagggccaggagccggagaaatggttaatgaagcagccctggccctagagtatggcgccagttgcgaagacattgcacgggtctgccacgctcaccccaccctgtccgaagctttccgcgaggcaaatcttgccgcatctttcggcaagtccatcaacttttag

SEQ ID NO: 114576 - DNA, 1944 bp, Artificial Sequence
  Description of Artificial Sequence: Synthetic coding sequence
atgtggagagtctgcgctcgccgggcacagaatgtcgctccctgggccggtctagaggcacggtggacagcgctgcaggaagtacctgggacaccgcgggtgaccagcagatccggaccggcgccggcgcgcaggaattcggtgactacaggctacggcggcgttcgcgctctttgtggttggacccccagctccggcgccaccccacgtaacaggttgttactccaactgctgggatcaccaggccggagatactactctctaccgccacaccagaaggtccccctgccatctctctctcccactatgcaggccggtacaatcgccagatgggagaaaaaggaaggtgataagattaacgagggcgatctgatcgcagaagttgaaacagacaaggctacagtaggcttcgagtccctggaagaatgctatatggctaaaatcctagtggcagagggtacaagggacgtacctataggagctatcatctgcatcacggtcggcaaacctgaggacatcgaagcctttaaaaactacactcttgactcttctgcggccccaacaccacaggcagcacccgctccaaccccagccgctaccgcaagtccacccactcctagcgctcaagcccctggatcatcctatccgccccatatgcaagtcttgttgcccgccttatctcccaccatgaccatgggcactgtgcaaaggtgggaaaagaaagtgggcgagaaactgagtgagggagatttgctggccgagatagaaactgacaaggcaacaataggcttcgaagtgcaggaagaaggctaccttgctaagatattggtaccggagggtactagggatgtccctttgggcacacccttgtgtatcatcgttgagaaggaagccgatatctcagcatttgctgactaccggcccactgaggtgaccgacttgaagccccaggtaccaccccctacccctcctcccgtggcagctgtccctcccacaccgcagcctctcgccccaaccccgagcgctccatgcccggcgaccccggcaggacccaagggtagagtgtttgtgtctcccctggccaagaaactggccgtcgaaaagggaatcgatctgacccaggttaagggtacgggccctgacggccggatcacaaagaaagacattgactcctttgtgcctagcaaagttgctccagctccagctgctgtcgtgcccccgacaggccccggcatggctccggtgcccaccggggttttcactgatatccctatctccaatattagacgtgtcatcgctcagcgtctgatgcaatcaaaacagacgataccccactattacctgtctatcgatgttaatatgggcgaagtgctgctcgtccgaaaagagttaaataagatccttgagggaaggtctaagatttccgtcaatgactttattattaaagcttctgctttggcctgtctgaaagtcccagaagccaattcctcatggatggatacggtgatcaggcaaaaccacgtggtcgacgtgtctgtggcggtgtcgacaccagctggcctaattaccccaatcgtgttcaatgcacatatcaaaggtgtggaaaccatcgccaacgacgtggtgagcctagccacgaaagcccgcgaagggaagctgcagccccatgagttccagggaggaactttcactatcagtaatctgggaatgtttggaatcaagaacttctccgcaattatcaatcctcctcaggcttgtatcctcgctattggagctagcgaggataaactggttccagcagataatgagaagggctttgacgtcgcatccatgatgagtgtgacgctgtcgtgcgatcaccgggtcgtggatggagccgttggtgcccagtggctagcagaatttcgaaagtatctcgaaaaacctatcacgatgctgttgtag

SEQ ID NO: 114577 - DNA, 678 bp, Artificial Sequence
  Description of Artificial Sequence: Synthetic coding sequence
atgtggcgcgtgtgcgcaaggagagcgcagaacgtcgccccttgggcaggtcttgaagcaaggtggactgctctgcaagaggtccccggaactccccgagtcactagtagaagcgggccagcccctgcaaggcgcaacagcgttaccaccgggtacggcggagtcagggcattgtgcggctggacacctagctccggtgctactccacggaatagattgctgctgcaacttctgggatctcccggccgaaggtattattctctcccaccccatcaaaaggtgcctttgccttccctttcacccactatgcaggcaggaaccatcgctcgatgggagaaaaaagaaggggacaaaatcaatgagggcgacctcattgccgaggtcgagactgataaagcaaccgtgggaaaacctgaggacattgaagctttcaagaactatacactagactcttccgccgctcctactcctcaagctgctccagctccaacaccggccgcaacagcatctccgccgaccccctctgcacaggctcccgggtcctcctaccccccacatatgcaggtgctgctgcccgcgctgagtccgacaatgaccatgggcacggtgcagcgctgggagaagaaagttggtgagaaattgtccgagggcgacttgttagctgagatgagcctatag

SEQ ID NO: 114578 - DNA, 1257 bp, Artificial Sequence
  Description of Artificial Sequence: Synthetic coding sequence
atgcaggccggcacaatcgccaggtgggaaaaaaaagagggtgacaagatcaacgaaggcgatttgttggcagagattgaaaccgacaaagccacaatcgggttcgaggtgcaggaggaaggttacttggccaagatcctagtgcccgagggaaccagagatgtccctctgggaacgcccctctgtattatcgtggagaaggaagcagacatctcagccttcgccgactacaggcctacagaagtcaccgatctgaagccacaagtcccacctcccacccctcctcccgtcgctgccgtgccaccaacaccccagccattggctcccacccctagcgccccctgtcccgccacgccagccgggccaaaggggcgggttttcgtctccccgcttgccaaaaagcttgccgtggaaaagggcatcgacctcactcaggtcaaggggactggccctgatgggcggattacaaagaaagatattgatagcttcgtgccctcgaaggtagccccagctccagctgcggtagtccctcctacagggcctggcatggcccccgttcccaccggcgtctttactgatattcctatttctaatataaggcgcgtcattgcccagcgactcatgcagtctaagcagacaatcccgcattattacctctctatcgacgtgaacatgggcgaagtcctgctcgttcgtaaggagctaaacaagatccttgagggtaggagcaagatctccgtcaacgatttcatcattaaagcatctgccctggcatgcctgaaggtccctgaagcgaatagctcatggatggacaccgtgattcggcagaaccacgtagtggacgtatccgtcgcggtctccacgcctgccgggttaatcacccccattgtattcaacgcccatattaagggagtggagacgatcgcaaatgatgtggtgagcctagccactaaagccagagaagggaaattacagcctcacgagtttcaaggcggaacattcaccattagcaatcttggaatgtttggaattaaaaatttttctgcgatcattaatcccccgcaagcctgcatcctcgccatcggggcgtctgaagacaagctcgtcccagccgataatgaaaagggctttgacgtggcaagcatgatgtctgtgacactgtcctgcgaccatcgtgtcgtcgacggggctgtgggagcccagtggctggcagaattcaggaaataccttgagaagcccataaccatgctgctctag

SEQ ID NO: 114579 - DNA, 1104 bp, Artificial Sequence
  Description of Artificial Sequence: Synthetic coding sequence
atgacctggctgcagagtaaaccacagcgcttacagaacctgtcccagagagagatgtcagggggacgcaaaacctccgtacaggtcccatccccagctaatggtgttattgaagcactgcttgtgcccgacggaggaaaagtagaaggaggcacgccactttttactctgcgcaagacaggggccgccccagcaaaagccaagccggccgaagcccctgcagccgctgctcctaaggccgaacctacggccgctgcagtgcctcctcccgctgctcctatccctacgcagatgccaccagtgcccagcccttcacagccacccagtggaaagcctgtgtccgctgtgaagcccacagttgcccccccgctggccgaacctggagcaggaaagggcctgcggtccgagcatcgagagaagatgaatcgcatgaggcagcgcatcgctcagcggctgaaagaggcacagaatacatgtgcgatgctgaccacgttcaacgagatcgatatgtcaaatatccaggaaatgcgagcaaggcataaagaggcattcttgaaaaaacataacctgaaactaggcttcatgtctgcattcgttaaggccagtgcgtttgcccttcaggagcagcccgtggtgaatgccgttatcgatgatacgacaaaggaggtggtctatagggattatatagacatctctgtggcagtcgccacgccgcgcgggctcgtggtgccagtcattaggaacgttgaagccatgaattttgctgatatcgaaagaacaatcactgagctgggcgagaaagctcgaaagaatgaactagctattgaggacatggacggcggcacatttaccatctcaaatgggggggtctttggttctttgtttgggacgcccatcattaaccctccacagtccgccatcttgggcatgcatggcatttttgacagacccgttgctattggcggaaaagtggaagttcgcccgatgatgtacgtggcactcacatatgatcatagactgatcgatggccgggaagcggtcacattcctgaggaagatcaaggctgccgttgaggacccgcgggttttgctgctggatctgtag

SEQ ID NO: 114580 - DNA, 1362 bp, Artificial Sequence
  Description of Artificial Sequence: Synthetic coding sequence
atgctctcccggtcacggtgcgtttccagagcctttagccggagtttgagtgccttccaaaaaggcaactgtccactcggacgccgcagccttccaggtgtcagtctgtgtcaggggccaggatacccgaatagccgcaaggtggtcatcaacaactcagtgtttagtgttcgcttttttagaacaactgcggtgtgtaaagacgacctggtcactgttaagaccccagccttcgcggaaagtgtcactgaaggagacgttcgctgggagaaagccgtgggtgacactgtagcagaggatgaagtggtgtgcgaaatagagactgacaagacctcagtgcaagtgccatcaccagccaacggtgttatcgaagctctcctagtccctgatggagggaaggtagaaggtggaaccccactgttcactcttagaaagactggggctgcccccgctaaggccaagccagcggaggctccggccgccgctgctcctaaggccgagcccacggcagccgcagtccctccacctgcagcccccattcccacccaaatgccaccagtgccaagtccttcacagccgccatccggaaaacctgtgtccgccgtgaagcctacggtagcacctcccctagccgaacccggtgcggggaaaggattgcgcagtgagcacagagaaaaaatgaacagaatgagacagagaatcgcccaacggctcaaagaggcacaaaatacttgcgctatgttgacgacattcaatgagatcgacatgtcgaatattcaggagatgcgcgctaggcacaaagaagctttcctcaaaaagcataacctaaagctcggctttatgagcgcttttgtcaaggcatcagccttcgctctgcaagaacagccagtggttaatgctgtcatcgacgacaccacaaaagaggttgtgtatcgggactacatcgatatttccgtcgccgtcgccactccaagggggttagtcgttccagtaatccgcaatgtagaagccatgaacttcgccgatattgagcgaaccattactgaactgggcgagaaagctagaaagaacgagctcgccatcgaagatatggacggaggtacatttactatatctaacggtggggtgtttggctccctctttgggactccaatcattaatcctcctcagtccgccatactgggaatgcatggcatcttcgacagaccagtggctattggtgggaaagtcgaggtgcggcccatgatgtatgtggccctgacctatgatcatcgtctcatcgacggacgagaggcagtgacctttctgcgtaaaataaaagccgcagtggaagaccctcgggtgttgctgcttgacctgtag

SEQ ID NO: 114581 - DNA, 282 bp, Artificial Sequence
  Description of Artificial Sequence: Synthetic coding sequence
atggacagattgcaaaccgctttactggtcgtcctggtgctgcttgccgtggcgctacaagccaccgaggccgggccatacggcgccaacatggaggatagcgtctgttgtcgtgactatgtccgttatcgtctcccgcttcgagtcgtgaaacacttctactggaccagtgactcttgccctcgtcccggggttgtgttactgacctttcgcgataaggagatctgcgccgatccgcgggtcccttgggtcaaaatgatcttaaacaagctgtcacagtag

SEQ ID NO: 114582 - DNA, 1560 bp, Artificial Sequence
  Description of Artificial Sequence: Synthetic coding sequence
atggcagctccaagtcgccttctaattcgcggcggacgtgttgtgaatgatgatttcagcgaagttgccgacgtgctagtcgaggacggcgttgtccgggccctgggtcatgacctgctgccccctgggggcgcccccgctggcctgcgcgttctggatgctgctggtaagctggtgctcccaggtgggatcgacacccacacacatatgcaattcccttttatgggtagtagaagtatcgatgatttccaccaaggcaccaaagccgctctgagtggtggaaccacgatgataatcgattttgcaatccctcaaaaaggagggtctttgattgaggcttttgagacctggcgcagttgggctgatcccaaggtgtgctgcgactactctctgcacgttgccgttacctggtggtctgatcaggttaaggaagagatgaagatattggtgcaggataaaggagtaaactcattcaaaatgtttatggcctataaggacctatatatggtaaccgacctggaactctatgaagcatttagtaggtgcaaggagattggggcgatcgcacaggtgcatgctgagaacggcgacctaatcgccgagggagctaagaaaatgctggccctgggaatcacaggccctgaggggcacgagctgtgtcgccctgaggcagttgaagccgaggccactctgagagcaatcactatagcctctgccgtgaactgcccattatatattgtgcacgtaatgtccaagtccgcagcgaaggttatcgctgacgcacgacgggatggcaaagtcgtctatggcgagccgattgccgccagcctcggtacagatggcactcactactggaataaggaatggcatcacgcggcccatcacgtgatgggtccacccttacgccccgaccccagcactccagacttcctgatgaacctactggcaaacgacgatttaacaaccacagggacagataattgtacattcaacacctgccagaaagccctgggtaaggatgattttacaaaaattcccaatggagtgaacggagtggaggatcgcatgtcagttatctgggagaagggagtccacagtgggaagatggacgaaaatcgttttgtcgctgtcacttctaccaatgccgcaaaaattttcaatctttatcctaggaagggcagaatcgctgtaggatccgatgctgatatagtgatctgggatcccaaaggcacccggacgatcagcgcaaagacgcatcatcaggcagtgaattttaatatctttgagggaatggtgtgccacggtgtcccgctggtaacaatcagcagagggaaggtggtgtacgaggcaggggtgtttagtgtgacagcgggcgatggcaaattcattccgcgaaagccctttgctgagtacatctacaaaaggattaagcaaagagatagaacttgcacccccacacccgtcgaacgggccccgtacaagggcgaggtcgcaactctaaaaagcagggtgaccaaagaggacgctaccgccggtacaaggaagcaggcacatccttag

SEQ ID NO: 114583 - DNA, 1719 bp, Artificial Sequence
  Description of Artificial Sequence: Synthetic coding sequence
atgtcctaccagggcaagaagaacattcctaggattacctcagacaggttgctgattaaaggcgggaagatcgtgaatgatgaccagtctttctacgccgatatatacatggaggacgggttgataaaacagattggggagaatcttattgtgcccggaggtgtgaagacaatcgaggcccatagccgcatggtaatcccgggggggatcgacgtacataccaggttccagatgcctgatcagggcatgactagcgcggatgatttcttccaaggaactaaggcggccttggccggcggcactacaatgatcattgatcatgtggtgcctgaaccgggaacttccctactggccgcttttgatcagtggcgcgagtgggcagacagtaagagttgctgcgattattctttgcacgtggatattagcgaatggcataaggggatccaggaagagatggaggcactcgtgaaggatcacggcgtaaactccttccttgtgtacatggcgttcaaagatagatttcagctgacagactgccagatttatgaggtcttaagtgttatccgcgacattggcgcaatcgctcaagttcatgccgaaaacggagacataatagcagaggagcagcagagaatcctcgacctggggatcaccgggcccgaaggccacgttctaagccgaccagaagaggttgaagctgaagccgtgaatagagccataaccatcgcaaaccaaactaattgtccactatatatcaccaaggtcatgtcaaaaagttcagccgaggtaatcgcgcaggcccgcaagaagggcaccgtcgtgtacggggaaccaatcactgccagcctgggcaccgacggttcacactactggtcaaaaaattgggcgaaggcggcagctttcgtgacttctcctcctttgtcccccgatcctaccacacctgatttcctgaattccttactctcctgcggcgatcttcaggtgactggttccgcccattgtacatttaacactgcgcagaaagccgtcggaaaagataattttacactgattcccgaaggcacgaacggcacagaggagagaatgtcggtcatttgggacaaggcagtggtgaccgggaaaatggatgagaaccagttcgttgccgtcacgagtaccaacgcggccaaggtgttcaacttataccctagaaaagggagaatcgcagtggggagcgatgctgacttagtgatttgggatcctgactcagtgaagactatttctgcaaagacacacaactcaagcctagaatataatatttttgagggaatggagtgtaggggtagccctttggtggtgattagccagggaaagatcgtcttagaggatgggacactgcacgtcacagagggaagcggcaggtatattccacgcaagccatttcctgattttgtatataagcggattaaagccaggtctagactggccgagctacgaggtgtgccacgcggcctctacgacggtccagtctgcgaagtgtcagtcacccccaagacagtcacgccggcctcctcagcaaagacaagccccgcgaagcagcaggctccgccagtgaggaacctgcaccagtcaggcttcagcttatctggagcccaaatagatgacaatattccccgcaggaccacccagcgtattgtcgctcctccaggtgggcgcgctaatattaccagtctgggatag

SEQ ID NO: 114584 - DNA, 1611 bp, Artificial Sequence
  Description of Artificial Sequence: Synthetic coding sequence
atggaggacgggttgatcaaacagattggggagaacctcattgtcccaggcggtgtgaaaacgatagaggcccattcccgtatggtgatcccgggaggcatcgatgtccacactaggtttcagatgcctgaccaaggaatgacctctgccgatgatttttttcaggggacaaaggcagcgctggcaggtggcactactatgattattgaccatgtggtgcctgaacccggcacctctctgcttgctgccttcgatcagtggcgtgaatgggcggattccaagtcctgttgtgactactcccttcacgtggacatttccgagtggcataagggaatacaggaggagatggaagccctggtgaaggaccatggcgtaaactctttcttggtgtatatggccttcaaggatagatttcaattgaccgattgccagatctacgaggtcctgtcagtcattcgggacatcggggcaatagctcaggttcacgccgagaacggcgatatcatcgcagaagaacagcaacgcatactcgacctgggcattaccggccctgagggccacgtgctgtcacgccccgaagaagtggaggccgaggctgtgaaccgagcaattactatcgcaaatcagaccaactgtcctctgtacataacaaaggtgatgtccaaaagcagtgctgaggtgattgctcaagctaggaagaaaggaacggtggtttatggggagccgatcaccgcatcattggggactgacgggtcccactactggagtaagaactgggccaaagccgcggcattcgtcacaagtcctcctttgtcacccgatccaaccacgcccgacttcttgaacagcctcctcagctgcggtgatttacaagtgactggaagtgcccattgtacttttaataccgcgcagaaagccgttggaaaggacaacttcaccttgatccctgaaggcacaaatgggactgaagagaggatgtcagtgatttgggataaagccgtcgtcaccgggaaaatggatgaaaatcagtttgtggccgtgacctctactaatgccgccaaagtgtttaacctgtatccacgtaagggccggattgcggtgggatctgatgcagatctggtaatttgggatccagattctgtgaagacaatcagcgcgaagacgcacaattcttcattagaatataacatctttgaaggcatggagtgtagaggatcacccctcgtagtgattagtcagggtaagatcgtattagaggacggcactctccatgtgacagagggatccggtcggtacattccacgcaaacccttcccggatttcgtttataagagaatcaaggcccgaagtcgtctcgccgagttaagaggagtcccaagagggttgtacgatggcccagtgtgcgaggtctcggtaacccccaaaacagtgactcccgcttcgagtgcaaaaactagccccgcgaagcagcaggctccccctgtacgaaatttacatcagagtggtttcagtctatccggcgctcagatcgacgacaatataccacgacgaactacacagaggatcgttgccccccccggtggtagggctaatatcaccagtctcggatag

SEQ ID NO: 114585 - DNA, 1719 bp, Artificial Sequence
  Description of Artificial Sequence: Synthetic coding sequence
atgagctaccagggcaaaaagaacatccccagaatcacatcggataggttacttatcaagggaggcaaaatcgtgaacgacgatcagagcttctacgcagacatctatatggaagatgggctaataaaacaaatcggtgagaaccttatcgtgcccggtggcgtgaaaactatcgaagcacactcccgaatggtgatccccggaggaatcgatgtccacacccggtttcaaatgccagaccagggcatgacatcggcagacgacttctttcaggggacaaaggccgcactggcaggtgggacaacgatgatcattgaccatgtggtgccggagccaggtacctccctacttgcagcattcgaccagtggcgggagtgggctgactccaaatcttgttgcgattattcgctacatgtagacatttcggaatggcacaaaggaattcaggaagaaatggaagccttggtgaaggaccatggagttaattcttttctagtgtatatggcgttcaaggatcggtttcagctgacagactgccagatctatgaagttctgtccgtgatccgcgatattggggcaatcgcacaagtgcatgccgaaaacggtgatatcatcgctgaggagcaacagcgaatcctcgaccttggtatcaccggacctgaggggcatgtgctgagcagaccagaggaggtagaggcggaggccgtaaatagagccattaccatcgcgaaccaaaccaactgtccattgtatattacaaaagttatgtcaaaatcgagtgctgaagtaatcgctcaggcaagaaaaaagggaacagtggtgtatggcgaacccatcacagcatccctcggcacagacggttctcactactggtccaagaattgggccaaggccgctgcatttgtgacatcaccccctctctctcccgaccctaccacacctgattttctgaactcccttctcagctgcggtgatcttcaggtgaccggaagcgctcattgtaccttcaacacagctcagaaggctgttgggaaagacaatttcactctcattcccgagggtacaaatggcaccgaggagcgtatgtccgtgatctgggataaggccgtagtcaccgggaaaatggacgaaaatcaatttgttgccgtgacctcgactaacgctgcaaaggtgtttaacctgtatccaagaaagggcagaattgcagttggatctgacgcggacctagtcatctgggacccggactctgtgaagaccatctccgccaaaacacataactcctctcttgagtataacatatttgaaggaatggaatgcagaggaagccctcttgtcgttattagccaggggaagattgttctggaggatgggaccttacacgtgactgaaggcagtggccggtatatacccagaaaaccctttccagactttgtttataaaagaattaaagcccggagccgactggcagaactcaggggtgtgccgcgcggcttgtacgatggacctgtgtgtgaggttagtgtgacacccaaaacagtcaccccagccagctcagctaagaccagtcccgctaagcaacaggcccctcccgtcaggaacctccaccagtcagggttcagtttatccggtgcacagatcgacgataacatcccgcgacgtacaacccaaagaattgtcgcgccaccgggaggcagagcaaatataacttccttgggttag

SEQ ID NO: 114586 - DNA, 1611 bp, Artificial Sequence
  Description of Artificial Sequence: Synthetic coding sequence
atggaggatggacttataaaacagataggggaaaatctcatcgtccctgggggggtcaaaaccattgaagctcactcgagaatggtgattcctggcgggattgacgtacacacgaggttccagatgccagatcaaggcatgacctcagcagatgacttctttcagggtacaaaggctgcccttgccggaggcaccaccatgattattgaccacgttgtacctgagccgggaacctctctcttagccgcctttgatcagtggcgagagtgggccgacagtaaaagttgttgcgattactccctgcacgttgacatatccgagtggcataaaggcattcaggaagaaatggaggctctcgtcaaagatcacggagtgaattcattcctcgtgtacatggccttcaaggaccggttccagctcacagactgccagatttacgaggtgctgtccgtcattagagatatcggggcaatcgcgcaggtgcatgctgaaaacggcgatattattgccgaagagcagcagcgaatcctcgatcttgggattacaggcccagaaggccacgtgctctcacggcccgaagaggtagaggcagaggctgtgaaccgagcaattactatcgcaaatcaaactaactgcccactctatataacaaaagttatgtcaaaatctagcgcagaagtcatcgctcaggctaggaagaagggaacagttgtctacggtgagccaatcactgcaagtctgggcaccgacggctcgcattattggtccaagaattgggccaaggcagccgcctttgtgaccagccctcctctttctcctgaccctaccaccccggatttcctaaattcattgctcagctgtggggacctgcaagtgactggctccgctcactgcactttcaacaccgcccagaaggctgtgggcaaagataacttcacattgattcccgaagggactaatggcaccgaggaacgaatgtcggtgatctgggataaagcagtggtaacgggaaagatggacgagaaccagtttgtcgctgtcacaagcacaaacgccgctaaagtgtttaacctatacccgcgtaaagggcggattgcagtcgggagtgacgctgatttggtgatctgggatcctgattcagtcaaaacaatatctgccaagacacacaactcatcactcgagtacaatatcttcgaaggaatggagtgccgcggatcccctctggtagtgatctcccagggaaagatcgtcttggaggatggcactcttcacgtcacagagggcagcgggaggtatataccaagaaaaccctttccggatttcgtatacaagcgcataaaggcaagatctaggcttgccgagctgagaggcgtcccacgcggattgtacgacggccctgtgtgcgaggtgtctgtcactcctaaaacggtcacgcccgcctcttccgctaagacatcacctgcgaagcaacaggccccacccgtgcgtaaccttcaccagagcggcttctctctttccggagcccagatagacgataacattccacgcaggactacacagaggatagtggcccctccaggtggaagagccaatatcacctcactgggctag

SEQ ID NO: 114587 - DNA, 597 bp, Artificial Sequence
  Description of Artificial Sequence: Synthetic coding sequence
atgtcagttatttgggataaggcggtcgtgaccggcaagatggatgagaatcaattcgtcgcggtcacctctaccaatgctgcaaaggtttttaatctgtatcctcgtaaaggcagaatcgccgtcggatctgatgccgaccttgtaatttgggatccagactcggtaaagaccatcttcgaaggcatggaatgtcggggtagccccctggtggttatctcccagggaaaaatagtgttggaggatggcactcttcacgttaccgaaggctctgggcggtacattccgcgaaaaccatttcctgactttgtttataaaaggatcaaggctagatcacgccttgccgagcttcgcggcgtccctagaggactctacgacggaccagtgtgcgaagtcagcgtgaccccaaagacagtaacccctgcatcctctgctaaaacaagccccgcgaaacagcaagcaccaccggttcgaaatttgcatcagtccggcttttctctgagtggggcacagatcgacgataatattcctaggaggactacacagcgcatcgtggctccaccgggggggagggcgaatataacatctcttgggtag

SEQ ID NO: 114588 - DNA, 2055 bp, Artificial Sequence
  Description of Artificial Sequence: Synthetic coding sequence
atggcctcaggccgccggggatgggattccagccacgaagacgatctgccggtctacctggcccggcctggtacaaccgaccaagtccctcgacagaaatacggcggcatgttctgcaatgtggaaggtgcctttgaatctaagacactcgactttgacgccctcagcgttggccagaggggggcaaagacccctaggagcgggcagggctccgataggggatctggcagtagacccggcattgaaggggacacaccacgaagagggcagggccgtgaagagtccagggagcccgctcccgcctcacccgcacctgcaggggtggagattaggtctgccactggcaaagaggtgctccagaatctggggccgaaggacaagagtgacagactcctgattaaaggcggaaggatcgtaaacgacgaccagtccttctatgcagatatctacatggaggatggtctcatcaaacagataggggacaatctcatcgtgcccgggggagtgaaaacaatagaggctaatggtaagatggtcattccaggcgggatcgacgtgcacactcatttccaaatgccgtataagggcatgaccactgtagacgacttcttccaaggaactaaggcggcactggcagggggtactacaatgatcatcgatcacgttgtgccagagccagagtcaagcctgactgaagcctatgagaagtggagggagtgggcagatgggaaatcttgttgtgactacgccctccatgtcgacatcactcattggaacgacagtgtcaaacaggaagtgcagaatctgatcaaggacaagggcgtaaatagcttcatggtctacatggcttacaaggacttatatcaagtgtcgaatactgaactctatgaaatctttacttgcttaggtgagcttggagccatcgcccaggtacacgctgaaaatggagatatcatcgcccaggagcagacaagaatgttagagatgggtattaccgggccagaggggcatgtattgtcccgaccagaagagctggaagcagaggccgtcttccgtgccattacaattgccagtcagaccaattgtcctttgtatgttactaaggtgatgagcaagagtgccgccgacctgattagccaggcacgcaagaaggggaacgttgtgttcggcgagcctattacagcctccctgggcatcgacgggacgcactattggtccaaaaattgggccaaagccgccgctttcgtaacctctccccctctctcccccgatccaaccacacccgattatatcaattctttgctggcatcaggggatctgcaactgtctgggagcgcacactgcaccttctcaaccgcgcagaaggccataggaaaagacaattttaccgcaatccctgaagggacaaacggcgtggaggagaggatgtcagtgatctgggacaaagctgtcgccactggcaaaatggatgaaaaccagtttgtagccgtcacttccactaacgctgcgaagatattcaacttatatccacgtaaaggaaggatctcagttggttctgactccgatttggtcatttgggacccggatgccgtcaaaatagtcagcgccaaaaatcatcaatcagccgcggaatataatattttcgaaggtatggaattgcgaggagctcccctcgtggtgatttgtcaaggcaagatcatgttggaagacggaaatctccatgtgactcagggtgcaggaaggttcatcccgtgtagtcctttctctgattatgtgtataagagaatcaaggcccggcggaagatggcagacttgcatgcagtgcccagaggcatgtacgatggacctgtgttcgaccttacgaccacacccaagggaggcacacccgcaggatctgcgaggggtagcccgacaaggcctaatcccccagtgcgcaatctgcaccagagcgggttctcactgtctggcacccaggtggatgagggagtgcggagcgcctcgaaacggatcgtggccccgccaggcggtaggtcgaacatcacatctctgtcttag

SEQ ID NO: 114589 - DNA, 1713 bp, Artificial Sequence
  Description of Artificial Sequence: Synthetic coding sequence
atgagctaccagggcaaaaagaatatcccaagaataacctctgaccggctgctgatcaagggaggaaggattgttaacgacgatcagagtttctatgctgatatttatatggaggacggattgatcaaacagattggcgataatctgattgtccccggcggcgtgaaaactatagaggcaaacggcaagatggtgatccccggtggcatagatgtccacacccacttccagatgccatataagggaatgaccacagtagatgatttttttcaggggacgaaggctgctctggcagggggaactactatgattattgatcacgtcgtgcctgagcccgagtccagcttaacagaggcctatgaaaagtggcgggaatgggcagatggcaaaagttgttgcgactatgcactccacgtcgatatcacgcactggaatgattctgtgaagcaggaggtgcagaatcttatcaaagacaagggtgtgaatagtttcatggtttacatggcttacaaagacctatatcaagtaagcaataccgaattgtacgagatattcacatgcttgggcgaactgggggctatcgcgcaggtccacgcggagaatggcgatattatcgctcaggaacagactcggatgctggagatgggaatcaccggccccgagggacatgtgctatcccggccagaagagctggaagccgaggccgtatttagagcgataactatcgcttctcagacgaactgccccttgtacgtcaccaaggtcatgagcaaatcagccgcagacttaatttcccaggctagaaagaaagggaatgtggttttcggggaacctattaccgccagcctcggcatcgatgggactcactattggtctaaaaactgggccaaagctgctgcgtttgtgacaagtccccctctcagccccgatccaacaactcccgactatatcaactctctcttagcgagcggagacttacagcttagcgggagcgcccactgtacattctcaaccgcccaaaaagcaatcggcaaggataattttaccgccatcccggagggcactaatggagtcgaggagagaatgagcgttatttgggataaggccgtggccaccgggaagatggatgagaaccagtttgtcgccgtgacaagcaccaatgcagcaaagatctttaatctatatcctcgaaaagggcgcatatcagtagggtccgatagcgacctcgtgatttgggaccccgacgcagtgaaaatcgtgagcgccaagaaccatcagagtgcagcagagtacaatatcttcgaaggcatggagctcaggggggccccgttagtggtcatatgtcaaggtaagatcatgctggaggatgggaaccttcacgtgacccaaggggctggaaggttcatcccctgctcccccttttctgactacgtctacaagcggataaaggctagaagaaagatggcagacttacatgccgtgccccgcggtatgtacgacgggcccgtattcgatttgacgactacaccgaaggggggtacccccgctggcagtgcgcgggggagtcctacccggccaaacccccccgtgcgcaacctgcaccagagtggttttagcctctcaggtacacaggtggacgaaggggtgcgcagtgccagtaaacgaatcgtggcaccacccggtggtcgctcaaacattacttctctgtcgtag

SEQ ID NO: 114590 - DNA, 279 bp, Artificial Sequence
  Description of Artificial Sequence: Synthetic coding sequence
atgtcataccagggcaaaaaaaacatacctagaataacaagcgacagactgttaattaagggaggccgcatcgtgaacgatgatcagtctttctacgcagacatctatatggaagatggccttatcaagcagatcggggataacctaattgttcctggaggagttaagacaatcgaggctaacggaaagatggtaattccaggcggcatcgatgttcatacccatttccaaatgccatataaaggcatgactactgtggacgatttctttcagggctag

SEQ ID NO: 114591 - DNA, 591 bp, Artificial Sequence
  Description of Artificial Sequence: Synthetic coding sequence
atggacgagaaccaattcgtggccgtgacgagcactaatgccgcgaagatctttaacctgtaccctaggaagggccgcataagcgtgggctctgatagcgaccttgtgatttgggatccagatgcagtcaagatcgtctctgcaaaaaaccatcaaagcgctgctgagtataacattttcgaagggatggagctgaggggggcgccactggtagtcatatgtcaggggaaaatcatgctggaagatggaaacctgcacgttacccagggagctggccgttttatcccctgttccccattttctgattatgtgtataaaagaatcaaggctcgccggaaaatggctgacctccatgcggtgccacgaggcatgtacgatggccctgtgtttgacctgacaactacccccaaaggaggcacccccgccgggtccgcacgtgggtcccctacacgacccaacccaccagtacggaacctgcaccagagtggcttctctctgtccggaactcaagtggacgaaggcgtgcggtctgcatccaagcgcatcgtagccccaccgggagggcggtcaaacatcacgtccctatcttag

SEQ ID NO: 114592 - DNA, 1719 bp, Artificial Sequence
  Description of Artificial Sequence: Synthetic coding sequence
atgtcatttcaggggaaaaaatcaattccacgaataacatccgaccgcctgctgattcggggtgggcgcatcgtcaatgatgatcagagcttttatgcggacgtgcatgtggaggatggccttatcaaacagattggcgaaaacctgatcgtccctggggggattaaaacaatcgatgcccacggcctgatggtactgccggggggcgtggacgtccacacacgactccaaatgcccgtcctgggtatgaccccggctgatgacttttgccagggcactaaagccgcactcgccggcgggacaaccatgatactggatcatgtctttccagacacgggagtttccctgctggcagcgtatgagcagtggcgagagagagccgattccgctgcatgctgtgactattcacttcatgtagatattacacggtggcatgaatccatcaaggaagagctggaggccttggttaaagaaaagggggttaatagttttttggtctttatggcgtataaggatagatgtcagtgttcggatagccagatgtacgagatcttctcaattattagggaccttggcgccctggcgcaggtgcacgcagagaacggagatatcgtggaggaggagcagaaacgccttctggaactgggcatcacaggacctgaaggacacgtcctaagtcaccctgaggaggtagaagcagaggctgtataccgggctgtgactatcgcaaaacaggccaattgtccgctatacgtcacaaaagttatgtctaagggcgctgcagacgccatcgcccaggcaaaaaggcgtggggtagtggtgttcggcgaacccatcaccgcgtccctcggaaccgacggttcccactattggtccaagaactgggctaaggccgccgcatttgttaccagccctccagtgaaccccgaccctacgaccgctgaccacctcacgtgccttctctcttcaggggatttgcaggttaccgggtcggcacattgcaccttcacaacagctcaaaaagccgtaggcaaagataattttgcccttatccccgaaggcacaaatggcatcgaggaaaggatgtccatggtgtgggagaaatgcgtggcttctggcaagatggacgagaatgagtttgtggcagttacatctaccaatgccgctaagattttcaatttttaccccaggaagggtcgcgtggcggttggaagtgacgcggatttagtcatctggaatcccaaagctaccaagataattagcgctaaaacacataacctcaacgtggagtataacatattcgagggtgtcgaatgccgaggggctccagccgttgtgatctcacagggcagggtggccctggaggacggaaagatgtttgtgacgcctggggctggcaggtttgtcccacggaagactttcccagatttcgtatataaaaggattaaagccaggaataggctggctgagattcatggtgtgccaagagggctctacgacgggcccgtccacgaagttatggtgccagccaagcccgggtctggggccccagctcgtgcatcatgccctggtaagataagcgtgcctcccgtccgcaatctccatcagtcagggttttccctctctggctctcaggctgacgaccatatagcccgccgcactgcccagaagatcatggcgccacctggcggacgatcgaatatcactagcctatcctag

SEQ ID NO: 114593 - DNA, 1239 bp, Artificial Sequence
  Description of Artificial Sequence: Synthetic coding sequence
atgccggttctggggatgacacccgccgacgacttttgccaagggaccaaagcagctctagccgggggcaccactatgatactcgaccacgtgttcccggataccggcgtttcattgctggccgcttatgagcaatggagggaaagagccgatagtgcggcttgctgcgattacagcctgcacgtggacatcaccaggtggcatgaatctataaaggaggagctggaagccctggtcaaggaaaaaggggtcaactcctttttagtgttcatggcttacaaagaccgctgccaatgcagtgattctcaaatgtatgaaatcttttcaatcatcagggatttgggggccctagcccaggtccacgccgaaaacggggatatagtggaagaggtggaagccgaagcagtctaccgagctgttaccatcgcaaagcaagctaactgtccattgtacgtcaccaaagtcatgagcaagggggctgccgacgcgatagcccaggctaagcggagaggggtagtagtttttggagagcccataacagcatctctgggcacagatggaagtcactactggtcaaagaattgggcaaaagccgctgccttcgttacgtccccaccggtgaatccagatcctacaaccgcagaccacctaacctgcctgctgtcaagcggcgacctgcaagttaccgggtccgcgcattgcacctttacaaccgcccaaaaggcagttggaaaggacaacttcgccctgatcccagagggcacgaatggcatcgaggagagaatgtctatggtctgggagaaatgtgtggctagtggaaagatggatgaaaatgagtttgtcgccgtgaccagcacaaacgcagccaagatttttaacttctaccctcggaagggacgggtggccgtaggttccgatgccgaccttgttatctggaacccaaaggccactaaaataatctccgcaaagactcacaatctcctggccgagatccacggggtgcccaggggactgtacgatgggccggtgcatgaagtgatggttccagcaaagccgggctccggagcccccgccagagcttcttgcccaggaaagatttctgttccgccagtgcgcaatttacaccaaagcggattctctttgtctggctcccaggcagacgaccacatcgcccgccgaaccgcgcaaaaaatcatggcccctcctggaggccggagcaacattacgtccctatcttag

SEQ ID NO: 114594 - DNA, 1239 bp, Artificial Sequence
  Description of Artificial Sequence: Synthetic coding sequence
atgcccgtattgggcatgactcctgcagatgacttttgtcaggggactaaagctgccctggctggggggaccacgatgattctggaccacgtgtttccagacacaggggtgtctcttctcgctgcctatgaacagtggcgggaacgggcagacagtgcggcctgttgtgattacagcctgcacgttgatattactcgatggcacgagtctattaaagaggaactagaagccctagtgaaggaaaaaggggtgaattccttcttggtgttcatggcctataaggacagatgccaatgctccgacagccagatgtatgaaatcttttcgatcatcagagatctgggagctctagcccaggtccacgcagagaatggggacatcgttgaggaagtggaggcggaagccgtctaccgggccgtcaccatcgcaaaacaggccaattgcccactttatgtcacaaaggtgatgtcaaagggtgctgcagacgctatagcccaggccaagagacgaggcgtggtggtgttcggcgaacccattactgcctcgctcggaaccgatggctcacactactggtcaaagaactgggctaaagctgccgctttcgtgacttctccccctgttaaccctgaccccacaaccgctgatcatctgacatgcctgttgtcaagcggcgacctgcaagtgacaggaagtgcacactgtacgtttactactgcacagaaggccgtagggaaggacaactttgccctgatacccgaaggtacaaacgggattgaagaacggatgagcatggtttgggaaaagtgcgtggccagtgggaagatggatgagaatgagttcgtagctgttacctctaccaacgcagctaagatctttaacttctaccctcgcaaggggagagtagctgtggggtccgatgctgatctggtgatttggaatcctaaagcaactaaaatcatttccgccaaaacacacaatcttctggccgaaatccatggcgtcccccgcggactgtacgacggaccagtgcacgaagtaatggtgccggccaagcctggttccggtgctccagccagagcctcctgtcccggcaaaatctccgtaccgccagtgagaaacttgcaccaatcgggcttcagcttgtctggatcccaggccgacgatcatattgcccgccgaactgcgcaaaaaattatggcccctcccgggggaaggtctaatatcacttctctgagttag

SEQ ID NO: 114595 - DNA, 1695 bp, Artificial Sequence
  Description of Artificial Sequence: Synthetic coding sequence
atgctcgctaattcagctagcgtgaggattctcattaaaggcggtaaagtagtcaacgacgactgtactcatgaagcggatgtctatattgagaatggtatcatccagcaggtcggccgggaacttatgatcccgggcggggccaaagtgatcgacgcaactgggaagctggtgattccgggggggattgacacctcaacccattttcaccagacattcatgaacgctacctgtgttgacgatttttaccatggaactaaagccgccttggtgggcggtactaccatgataattggccatgttttgcccgataaggagacatctctggtcgatgcgtatgagaagtgtcgcggcctcgcagacccaaaggtgtgttgtgactacgcattgcacgtgggtattacctggtgggcccctaaagtgaaggcggagatggaaacactggtacgggagaaaggagttaacagctttcagatgttcatgacctacaaggatctctacatgctgagggacagcgagctatatcaggtgctgcacgcctgcaaagacatcggagcaatagcccgggtccatgcggaaaatggcgagttagtggcagaaggggccaaagaagcgctggatttgggcatcaccgggcccgagggaattgagatcagtagaccagaagagctcgaagcggaggctacccaccgggtgatcactatcgctaaccgcacacattgtccaatctatctggtcaacgtatcatctatctctgccggtgacgtgatcgccgctgctaaaatgcaagggaaggtggtgttggcagaaaccaccaccgcccatgccactctgactggtcttcactattatcaccaggattggtctcatgccgccgcctatgttactgtgccaccgcttcgcctggacacaaacacatcaacatatctaatgagcctgcttgctaatgacacacttaacattgtagcgagtgaccaccgccctttcactacaaaacaaaaagcaatgggcaaagaagattttaccaagattccacacggggtctctggagttcaggacaggatgagcgttatttgggaacgcggcgtggttggggggaagatggacgaaaaccgctttgtggccgtgacatcctcgaacgccgccaagcttctgaacttgtatcctaggaaaggtcgcatcatcccgggtgctgatgcagacgttgtcgtgtgggatccagaggcaactaagacgatctcagcttccactcaggtgcaggggggcgactttaatctctatgagaacatgagatgccatggcgtgcctctggtcaccataagtcggggacgggtggtttatgaaaatggagttttcatgtgcgctgaggggactggcaagttctgtccactacgctcctttccagatactgtgtataaaaagcttgtgcagagagagaagacactgaaagtccgtggtgtggataggaccccttacctcggcgacgttgcagtggtcgttcatcccggcaagaaagagatgggcaccccccttgccgacactcctacgagacctgtaactcgccatggcggcatgagggaccttcacgagtcctccttttccctctctgggtcacagatcgatgatcacgtgcccaagcgtgcctccgccaggatcctggcccctccgggaggacgaagttcagggatctggtag

SEQ ID NO: 114596 - DNA, 1695 bp, Artificial Sequence
  Description of Artificial Sequence: Synthetic coding sequence
atgcttgcaaatagcgcttctgtgagaatcctcattaagggtgggaaggtggtaaacgacgattgcacccacgaagctgatgtgtacatcgagaacggaattattcagcaggtcggccgggaattaatgatacccggaggagccaaagtcatagacgccactgggaaacttgtaattcccggaggaatcgacacgtcaacccattttcatcagacatttatgaacgctacttgcgtcgatgatttctatcatggaacaaaggcagcactcgtgggaggcactacgatgattattgggcacgttctgccagataaggaaaccagcttggtggacgcgtacgaaaaatgtagaggcttagctgaccctaaggtgtgctgcgactacgcattgcatgtggggattacttggtgggctccgaaagtgaaagcagaaatggagaccctggtgagggaaaagggcgtcaactcgttccagatgttcatgacctacaaagacttgtacatgttgagggactccgagctctatcaggtgctgcacgcatgtaaagatatcggagcaattgcgagggtgcacgcagagaacggtgagcttgtcgccgagggcgctaaagaggctcttgacttggggatcactggccccgaggggatcgaaatctcccggccggaggagctggaagcagaggccacccaccgcgtcattactattgcgaaccgcactcattgtccaatatatctggtaaacgtctctagcataagtgctggagatgtgatcgctgctgccaaaatgcaaggaaaagttgtactggccgaaaccacaacagctcatgccaccttaaccggcctgcactactatcatcaagattggtctcatgctgccgcttacgtgaccgtgccccctctgaggctggacacaaatacaagtacctaccttatgtccctcctggcaaatgatactctgaacatcgtggctagcgaccacaggcccttcaccacaaaacagaaggccatgggcaaagaagactttaccaagatcccccatggtgtgagcggcgtgcaggatagaatgagtgtcatttgggagcggggagtagtgggtggcaagatggacgaaaaccggttcgtggcggtcaccagttcaaatgccgccaagcttctgaacctctacccgagaaaaggacgcattatccccggggctgatgcagacgtcgttgtttgggatccagaggcgaccaagaccatctccgctagcactcaagtgcagggaggtgactttaatctgtacgagaacatgcgctgccacggcgtgcccctggtgaccattagtcgaggacgggtggtctatgagaacggcgttttcatgtgcgccgaaggcaccggcaaattctgccctttacgttcatttcctgacacagtctataaaaagcttgttcagcgcgagaaaaccttgaaagtaaggggcgttgataggaccccctatctaggtgacgtggcagtggttgtgcaccctggaaagaaagaaatgggaactcccctcgcagatacaccaactagacctgtgacgcgccacggtgggatgcgcgatcttcacgaatcctcttttagcctctccggatcacaaatcgatgaccacgtgccgaaaagggcatccgcgcgcatcctggctccaccaggaggaaggtcatccggaatctggtag

SEQ ID NO: 114597 - DNA, 573 bp, Artificial Sequence
  Description of Artificial Sequence: Synthetic coding sequence
atgctggccaactctgcctccgtccgcattctgatcaaggggggtaaggtggtgaacgacgattgcacgcacgaagctgatgtctacatcgagaatggcatcattcaacaggttgggagagagctgatgattcccgggggagctaaagtgatcgatgccaccggaaaacttgtgataccgggggggatcgacacctccacccattttcaccagacatttatgaacgccacatgtgtcgacgacttttatcacggtactaaagccgctctcgtaggcggtactacaatgattatcggccacgttttgccggataaggaaacctccctggtcgatgcgtatgagaaatgccgtgggcttgcggatccgaaagtatgttgtgattacgctctgcacgtcggaatcacatggtgggctccaaaggttaaggccgagatggagaccctggtgcgggaaaagggagtgaacagctttcagatgtttatgacttacaaggacctgtacatgctgcgggacagcgaattgtatcaagtgctgcacgcttgcaaggacattggggctatcgcgagggtctag

SEQ ID NO: 114598 - DNA, 525 bp, Artificial Sequence
  Description of Artificial Sequence: Synthetic coding sequence
atgctggcaaattctgctagtgtgcgaatcctcatcaagggaggtaaggtggtcaacgacgactgtacccatgaggccgatgtgtacatcgagaatggtattatacagcaggtggggcgtgaactaatgatccctgggggcgccaaggtcatagatgccaccggcaaacttgttattcctggggggattgatacctcaacacacttccaccagacctttatgaatgcgacctgtgttgacgatttttaccacggcaccaaagccgccctggtgggaggtacgacaatgatcatcggccatgtcctgcccgataaagagacctccttagttgatgcttatgagaagtgccgggggctcgccgaccccaaggtttgctgtgattatgccttacacgtgggtattacatggtgggcaccaaaggtcaaggctgaaatggagacactggttcgcgagaaaggcgtaaactcctttcagatgttcatgacctataaggacttgtacatgctgagagacagcgagctctag

SEQ ID NO: 114599 - DNA, 498 bp, Artificial Sequence
  Description of Artificial Sequence: Synthetic coding sequence
atgctagccaatagtgcatccgtgcggatcctcatcaaaggcggcaaagtcgtaaacgacgattgtactcatgaagctgatgtgtatatagaaaacggcattattcaacaggtaggtcgtgagttaatgatacccggaggagccaaagtgattgatgctaccgggaagctcgtgattcctggcggcatcgataccagtacccacttccatcaaacttttatgaatgctacatgtgtggacgatttttaccacggcacgaaggctgccttggtggggggaacaaccatgattataggccatgtgttgcccgataaggagacaagtttggtggatgcatatgaaaagtgtcgcggtctggctgatccaaaagtctgctgcgactacgcccttcacgttggtattacttggtgggcccccaaggtcaaggccgaaatggaaactctagtgcgcgaaaagggcgtcaactcttttcagatgttcatgacttacaaggattag

SEQ ID NO: 114600 - DNA, 522 bp, Artificial Sequence
  Description of Artificial Sequence: Synthetic coding sequence
atggcacctgtgctgagcaaagatagcgcagacatagagagcatactcgctttgaaccctagaacacaaacgcatgcaacactccgaagcacgagcgctaagaagcttgataaaaagcattggaagcggaaccccgacaaaaactgttttaattgcgagaagctggaaaataattttgacgatattaagcacactactttaggagagcgtggtgcactgcgagaggccatgcgctgcttgaaatgtgctgatgcaccttgccagaaatcttgcccaacaaatctggatattaagagtttcatcacctctatagccaacaaaaattactacggggcagccaagatgatctttagtgacaacccactggggctgacttgtggtatggtgtgccccacatcggacctctgtgtaggggggtgtaatctgtacgccactgaggaggggccaattaatattggcgggctgcagcagttcgccacggagacgttgatcctggcgttttccttgatgaatcatctctag

SEQ ID NO: 114601 - DNA, 3078 bp, Artificial Sequence
  Description of Artificial Sequence: Synthetic coding sequence
atggcccccgtgctcagcaaagactctgctgatatagagtccatacttgctctgaatcctcgaacacaaacgcacgctaccctgagatcaacctctgcaaagaaactagacaagaagcactggaaaagaaacccagataaaaactgcttcaactgtgaaaaactcgagaataactttgacgatatcaagcatacaaccctgggtgagcgcggtgccttgcgagaggctatgcgttgtcttaagtgcgccgatgctccctgtcagaagagctgccccactaacttagacatcaaatccttcattacttctattgcaaataaaaattattatggggcagcgaagatgattttttctgacaatccactcggcttgacctgtggcatggtgtgccctacgagcgatctgtgcgttggagggtgcaacctttatgcaacagaagaaggacctatcaatattggtggcctgcagcagttcgcgactgaggtgttcaaagcgatgtccatcccacagatccggaacccgagcctgccaccgcctgaaaaaatgtctgaggcctacagtgctaagatcgccctgttcggtgcgggccctgcttctatttcgtgtgcctcgtttctggcccgactcgggtatagtgatattaccatcttcgaaaagcaggagtatgtcggcgggctctctacatcagaaattccccaatttaggctcccatacgatgtggttaattttgaaattgaactgatgaaggacctgggggtcaaaattatttgtggtaagtccctctccgtgaacgagatgaccctgagcacactgaaggaaaaaggatataaggcggccttcatcggcatcggcttgcccgagccaaataaagacgcaatcttccagggactaacccaagaccagggtttctacacgtccaaagacttcctgccgttagtggcaaaagggtccaaggctggcatgtgtgcttgtcatagccctctacccagcatccggggtgtggtgatcgtactgggtgccggggacaccgcattcgactgcgcaacatcagccctgagatgcggagcccgacgagtttttatcgtgttccggaaaggatttgtgaacatccgcgctgtgccagaagagatggaactggccaaggaagagaagtgcgagtttctgccttttttatctcccaggaaggtgatcgtgaagggcggcagaatagtggcaatgcagtttgttcgcacggagcaggacgagacaggtaagtggaatgaggatgaggatcagatggtgcatctcaaggccgacgttgtgatctcagcttttggcagtgtgttaagcgatccaaaagtcaaagaagccctctcgcccatcaagttcaacaggtgggggttgcctgaggtggaccccgagacaatgcagacttccgaagcctgggtgttcgccggcggagatgtggtcgggctggctaatactacagtcgaatctgtcaacgatggcaaacaggcttcctggtatattcacaaatacgtgcagtctcagtacggggcgtcagtttctgccaaaccggagctgcccctgttctataccccaatcgacctagttgacatttctgtggaaatggccggattgaaatttatcaatccttttgggctagcttccgcgactccagcaacctcaacgtctatgattcgtagagcctttgaggcaggatggggattcgcattaacgaagactttctccctcgacaaagacatcgtcaccaatgttagccctagaattattcggggcactacgtctggtcctatgtacggccccgggcaatcctccttcttgaatattgaactgatctctgaaaagaccgccgcctactggtgtcagtccgtcactgaactcaaggcggatttccccgacaatatcgtgatagcgagtattatgtgcagttacaacaagaacgattggactgagctggcaaaaaagtctgaggatagtggcgctgatgctctggaactgaatctcagctgtccgcacggaatgggcgagcgcgggatggggctggcctgtggtcaggatcctgaactcgtccggaatatttgccgctgggtccgtcaggctgttcagatccccttcttcgccaaacttaccccgaatgtaacagatattgtgtccatcgcacgggccgccaaggaaggcggagccaacggagtgaccgccaccaataccgtttctggtttaatgggactgaaaagcgatggaaccccgtggccagcagtagggattgccaaacgtaccacatatggaggagtgtctggaaccgctatacgcccaatcgccctcagagcggtgacatcaatcgctagagccctgcccgggtttccaattctggctacggggggaatagacagcgcagagagcgggctccagtttctccatagtggcgcaagcgtgctgcaggtgtgtagtgcaatacagaatcaggactttacggttattgaagactattgcactggcctcaaagctttgttgtacctcaagagcatcgaggagctgcaggactgggacggacaaagcccagcaacagtgagccatcagaaaggcaaaccagtaccccgcattgctgagttaatggataaaaaactcccctcttttggaccatatctagagcagagaaagaaaattatcgcagagaataaaatccggttaaaggagcagaacgtggctttctcacccttgaagcggaactgcttcatccctaaacgcccaattcccaccataaaagatgtgattggcaaggcactgcagtatctcgggaccttcggagaactctctaacgtcgaacaggtggtcgccatgatagacgaagaaatgtgcataaattgtgggaagtgttatatgacatgtaatgatagtggctatcaagccatacaattcgacccagagacgcacctgccaacgatcacagatacgtgtactggatgtaccttgtgcttgagcgtgtgccccattgtggattgtatcaaaatggtcagcaggaccactccctacgagcccaaaaggggagttcccctgagcgtgaacccagtatgctag

SEQ ID NO: 114602 - DNA, 471 bp, Artificial Sequence
  Description of Artificial Sequence: Synthetic coding sequence
atggccccagtcttgagtaaagactctgctgatatagagaactgtgaaaagcttgagaacaatttcgacgacatcaagcacactaccctcggagagcgaggtgccctccgcgaggctatgagatgtctcaaatgcgccgacgctccttgtcagaagtcttgcccaacaaatctggatatcaaaagtttcatcacctccatcgccaacaagaactactacggggctgccaagatgatcttctcagataaccctctaggcctcacctgtggcatggtttgccccacttcagatttgtgtgttggtggttgcaatctctacgccactgaggaaggacccataaacatcggcgggctacagcagtttgcaaccgaggtcaacggactcttgcactttcaaaacagtgtgtccctttggtttcagaagactgccaatatttcatttttgagttgtggcagtctgcaggacgcgtag

SEQ ID NO: 114603 - DNA, 1482 bp, Artificial Sequence
  Description of Artificial Sequence: Synthetic coding sequence
atgatcctgaacagcctgtctctgtgctaccataacaagcttattcttgctccaatggtgcgcgtaggcaccctgccgatgcgcttgttagcattggattacggcgcagacatagtatattgtgaggaacttatcgacttaaagatgatccagtgtaaaagggtcgtcaatgaggtgctgtccaccgttgatttcgttgcacctgacgatagagtagtgttccggacctgcgaaagagagcagaatcgcgtggtgttccaaatgggcacctcggacgcagaacgggcgctcgcggttgcaaggctcgtagagaatgatgtcgcggggattgatgtaaatatggggtgcccaaagcaatattcaactaaaggtggcatgggtgctgcacttctcagcgatcctgataagatcgaaaaaatactcagtacactagtgaagggcacacgccggcctgtgacttgtaagatccgaatattaccgtcactggaagacaccttgagtctcgtgaagaggattgagagaactgggatcgcagccatagcagttcacggaagaaagagagaggaaagacctcagcatcccgtttcatgcgaggtcatcaaggccatcgcagataccttatccattccagtcattgccaatggtggttcccatgatcacatccaacaatactcggacatcgaagacttccgccaagccaccgcagccagtagtgtgatggttgcacgcgcggcaatgtggaacccaagcatcttcctgaaggagggattgaggccactcgaggaagtgatgcagaaatatatacggtacgctgtgcagtatgacaaccattacacgaacaccaaatattgtctctgtcagatgctccgcgagcaattggaatctccccaggggaggctgctccatgcggctcagagctcacgcgaaatatgcgaagcattcggacttggagctttttacgaagaaacaacgcaggaactggacgctcaacaggccagactatcagctaagactagtgagcaaaccggggagcccgcagaggacacctctggggtcattaaaatggccgtaaagttcgatagaagagcctatcccgcccagataacaccaaagatgtgtctccttgaatggtgtcgtcgtgagaagctcgcccagccagtgtacgaaacggtgcagcgacccttggatcgactatttagttccatcgttacagtggccgaacagaaataccagtccaccttgtgggacaagtcaaagaagctggccgagcaagctgccgccatcgtctgtcttagatcccagggtctgccagagggccgcctcggggaagagtccccctcactgcacaagcgcaaaagggaggcccctgaccaggatccgggcggcccgcgggcacaggaacttgcacaacccggagacttgtgtaaaaagcctttcgtggccttagggagtggtgaggagtcccctctggagggctggtag

SEQ ID NO: 114604 - DNA, 1482 bp, Artificial Sequence
  Description of Artificial Sequence: Synthetic coding sequence
atgatcctcaattcactgtcgctgtgctaccacaataagttgatcctggcgcctatggtgcgggttggaaccctccctatgcgcctattggcgctagattatggcgctgatattgtgtactgcgaagagcttattgatttaaaaatgattcagtgtaagcgcgtagttaacgaggtactgagtacagttgatttcgtggctccagacgacagggtggtctttaggacctgcgaaagagagcagaacagggtggtgtttcaaatgggtaccagcgacgccgaacgagccttggcagtggcacgacttgtggagaatgatgtggccggcattgatgtgaacatgggctgccctaaacagtacagtaccaagggaggcatgggggcagctctgctctccgatcctgacaagatagaaaagattctcagcactttggtcaagggaacccggagaccagtgacctgcaagattcggatactgcctagcctggaggacactctgagcctggtcaaacgcattgagcggaccggtatagccgcgatcgctgtgcacggcaggaaacgcgaagagaggcctcagcaccccgtgtcctgtgaggtcatcaaggctattgcagacactctcagcataccagttatcgccaatggcggttcacacgatcacattcagcagtatagcgacatcgaggattttcggcaggctacagctgcttcctcggtgatggttgcccgcgctgctatgtggaatccttcgatttttctgaaggaagggctccgccccctggaagaggttatgcagaaatatattcgctacgccgtgcagtacgacaaccactatactaacaccaaatattgtttgtgtcagatgttgcgcgaacaacttgaatctcctcaaggccggctgctccacgctgcacaaagctcacgggagatctgtgaagcattcggattgggagccttctacgaggaaaccacacaggagctggacgcacagcaggcccggctgtcggccaagaccagcgagcagacaggtgaacccgctgaggacaccagcggtgtgataaagatggcggttaagtttgatcggcgagcatatcctgcccagattacaccgaaaatgtgccttcttgagtggtgtcgtcgggaaaagctggcacaacccgtttacgaaaccgtgcaacggcccctggaccgcctcttttcctccatcgtaacagtcgccgagcagaaataccaatcgaccctctgggacaagtcaaaaaaacttgccgaacaggcagcagccattgtatgccttaggagccagggactcccggagggacggctcggcgaagagtccccttctctgcacaaaaggaagagagaagcacccgaccaggatcccggagggcctagggctcaggagctggctcagccgggggacttatgcaagaaaccttttgtggcactgggcagtggggaggagtcccctctagaagggtggtag

SEQ ID NO: 114605 - DNA, 1377 bp, Artificial Sequence
  Description of Artificial Sequence: Synthetic coding sequence
atgatattgaattctctgtcgctctgctatcacaataaactcattctcgccccgatggtcagagtggggaccctacccatgcggctgctagccctggattatggggccgacattgtttattgtgaagagttgatcgatcttaaaatgatccaatgtaagcgtgtcgttaatgaggtgctgtctacagttgactttgtagcacctgatgatcgggtcgtgttcagaacatgtgagcgcgagcaaaaccgggtcgtgtttcagatgggcggcatgggggcagccctgctgtcggaccctgacaagattgaaaaaatcttgagtaccctggtgaaggggacgagacggcccgtcacatgcaaaatcaggattcttccgtctctggaagatacgctctccttggtcaaaagaatagagcgaactggtattgctgctatcgccgtccacggacgcaagcgcgaggaacgaccccagcaccctgtttcatgtgaggttattaaagccatcgccgacaccctatctatcccggtgatagctaacgggggctcccacgaccatatccagcaatactccgacatagaggactttcgacaagctactgccgcttctagcgttatggtcgcccgggccgcaatgtggaatccctctatatttctgaaagagggcctgcgccccctcgaagaggtcatgcagaagtatatccggtacgccgtgcagtacgacaatcattataccaacacaaaatactgtctctgtcagatgttgagggaacaattggagtctcctcaggggcgtctgctccacgccgctcagagcagtcgcgaaatctgcgaagcattcggtttgggcgccttctatgaggagacgactcaggaattagacgcccagcaggcccgcctctccgccaaaacatcggagcagacaggcgaacctgccgaagacacaagcggggtgattaagatggctgtaaagttcgacagacgcgcttacccggcccagatcactccaaaaatgtgcctcctggagtggtgccgcagggaaaagttagcacagccagtctacgagacagtgcagcgtccattagaccgactgttttcgtctattgtgaccgtcgccgaacagaaatatcaatcaaccctgtgggacaaaagtaaaaagctcgccgaacaggccgctgcgattgtttgtcttcgctctcagggccttccagagggccgtctgggagaggaaagcccaagtctgcacaagagaaaacgcgaggctcccgaccaggaccccggaggcccgagagcccaggaactagcccagcccggcgacctgtgcaagaaacccttcgtggcactgggctcaggggaagagtctcctctcgagggatggtag

SEQ ID NO: 114606 - DNA, 858 bp, Artificial Sequence
  Description of Artificial Sequence: Synthetic coding sequence
atggcaggattagggcaccccgccgcctttgggagagccacacacgcagtcgtcagggctctccctgagtcacttggacaacacgcgctcaggtctgctaagggagaagaggtcgacgtagccagagcagaaaggcaacatcagctatatgtgggcgtgttgggctccaaactggggctacaggtcgtggagctccctgcggacgagagcctcccagactgtgtctttgtggaggacgtggctgtcgtttgtgaggaaactgcccttattaccaggccaggtgcaccctctcgacgcaaggaagtggatatgatgaaggaagccctcgaaaaactgcagcttaacatcgtcgaaatgaaggacgagaacgctacactcgatgggggggacgtcctgtttaccggacgggaattcttcgtgggcttaagtaaacgtacaaatcagagaggggccgaaatactggccgatacgttcaaagactatgcagtgtccaccgtccccgttgcagatggtttgcatttgaagtcgttttgctctatggccggtccaaatctgatcgcgattggatctagtgaatctgcacaaaaagcattgaaaatcatgcaacagatgtctgatcatcggtacgataagctgactgtccccgatgatatagcagccaattgtatctacctgaacatccccaataagggacacgtgctcttacataggactcccgaagaataccccgagtcggcaaaggtatacgagaagctaaaagaccacatgctgatccccgtgagcatgagtgaactagagaaagttgatggacttctgacctgctgtagcgtgctgataaacaaaaaggtcgacagttag

SEQ ID NO: 114607 - DNA, 579 bp, Artificial Sequence
  Description of Artificial Sequence: Synthetic coding sequence
atgtggctgtatgggctgggccaagtggatatgatgaaggaggctctcgagaagctccaactcaatatagttgaaatgaaagatgagaacgccaccctagatggcggagacgtgttgttcactggccgtgagttcttcgttggactctcgaagagaacaaaccagaggggcgctgagatcttggccgacacatttaaagattatgccgtctccaccgtgccggttgccgatggactacaccttaagtccttttgctctatggccgggccgaacttgattgcaataggttcctccgagagcgcccagaaagctctcaagataatgcagcagatgagcgaccacaggtacgacaagcttacagtgcccgacgacattgctgccaattgcatttacttgaacattccaaataaaggccacgtcctgctgcaccgcacacctgaggagtatccagaatccgcaaaagtgtacgaaaaacttaaggaccacatgttgattccagtgtcgatgagcgagttggaaaaggttgacggccttctaacctgctgcagcgtgctaatcaataagaaggtggattcatag

SEQ ID NO: 114608 - DNA, 549 bp, Artificial Sequence
  Description of Artificial Sequence: Synthetic coding sequence
atgatgaaggaggcgctggaaaagctacagttgaatattgtagaaatgaaagacgagaatgctactctcgatggcggcgatgttttattcaccggccgagaattctttgtaggcctgtcaaagcgcacaaatcagcggggcgccgagatccttgccgacacattcaaagattatgcagtatccactgtgcccgtcgctgacggcttgcatctgaaaagcttctgttctatggccggcccaaacctgattgctatcggttcttcagagtctgctcaaaaagctctaaagattatgcaacagatgtccgatcaccgctacgataagctgaccgtacctgacgacatagctgccaactgcatttacctaaatatcccaaacaaggggcacgtacttctacaccgaacaccagaggaatatcctgagagcgccaaagtctacgagaagcttaaggaccatatgctgattcctgtgtctatgagtgagttggagaaggtcgacggattgctgacgtgctgctcagtgctgatcaacaagaaagttgactcctag

SEQ ID NO: 114609 - DNA, 858 bp, Artificial Sequence
  Description of Artificial Sequence: Synthetic coding sequence
atggccggcttaggacacccagcagccttcggtcgggccactcatgccgtggttcgtgcgctgccagagtcactcggtcaacatgccttgcgtagtgctaagggcgaagaagtggacgtggctcgagccgagaggcagcaccagctgtatgtgggcgtgctgggctcgaagcttggactccaggtggtagaattgccagcggatgagtctctcccagattgtgtgtttgttgaggatgtagcagtggtttgcgaggagacagcactcataacgcgtccaggggcaccatctcggaggaaagaagtagacatgatgaaggaggcgctggaaaagctccagctgaacatagtcgagatgaaagacgagaatgctactcttgatggaggtgacgtcctctttacaggtagggaatttttcgtcggcctgtctaagagaacgaatcagagaggagccgagatcctagctgatacctttaaggattatgcagtgtccacagtacctgtcgctgatgggctccacctgaagagcttctgcagcatggctggaccaaacttgatcgctataggttccagcgaatccgcccaaaaggctctgaagattatgcaacaaatgtctgatcacagatatgataagctcacagttccagacgacattgccgccaactgcatctatctcaatataccaaataaggggcacgttctgttgcatcggacacccgaagagtacccagaaagcgcaaaggtctacgagaaactgaaggaccacatgctgatacctgtcagtatgtcggaactggaaaaagtggatggcttgttgacgtgttgctctgtcctcatcaataagaaggtcgactcctag

SEQ ID NO: 114610 - DNA, 558 bp, Artificial Sequence
  Description of Artificial Sequence: Synthetic coding sequence
atggtcgatatgatgaaagaggcacttgaaaagctgcagttgaacatcgttgagatgaaggacgagaatgctacattggacggcggagacgtactgttcacaggcagagagttctttgtcggtttgagcaaaaggaccaaccagcgcggcgccgagatcctggcggacacttttaaagactatgcagtgtcaactgtgcctgtagcagatggacttcaccttaaatctttttgtagtatggctggcccgaatctaattgccattgggtcatccgaatccgctcagaaagccctgaagattatgcagcagatgtctgatcaccgctatgacaagctcaccgtccccgacgacatcgcagctaattgcatatacctgaatatcccaaataaaggacacgtgctgctgcatcgaacaccagaggagtaccccgaatctgccaaggtctacgaaaaactgaaagatcacatgctaatccctgtcagcatgagcgagttggagaaggttgatggtctgcttacctgttgttctgtgctgatcaataaaaaggtggacagctag

SEQ ID NO: 114611 - DNA, 858 bp, Artificial Sequence
  Description of Artificial Sequence: Synthetic coding sequence
atggggactcccggagagggacttggcaggtgctctcacgccctcatacggggtgtcccagagtctctggcttcgggagaaggggctggggctggtctgcctgctttagatctcgctaaagcccagagggagcacggcgtgctggggggtaagctgagacagcgcctcggcctacagctcctggagttgccgcccgaagagtctctgcctttggggccactgctcggcgataccgcagtcattcagggcgatactgctctgataactcggccgtggagccccgcacggcggcctgaggtggacggcgtgcgaaaagccttacaagacttggggctccggatcgtggagatcggtgatgaaaacgccacactggatggtactgacgtcctctttaccgggagagagtttttcgtgggcctctcaaaatggacaaatcacaggggggccgagatcgtggcagatacctttagagacttcgccgtgagtacagtacctgtgtccggccccagtcaccttcgtggcctatgcggtatgggcgggcctcgcaccgtggtggccggctcatccgatgccgcgcagaaggccgtccgggcaatggccgtgctgacggaccacccttacgcttccctcacactccctgacgatgccgctgccgattgcctgtttctccgccctggcctaccaggagtgcctcccttcctccttcaccgcggtggcggtgacctcccaaattctcaggaggccctgcagaagctatccgatgtgactctagtccctgtgagttgctccgagctagaaaaggctggggctggcctgagcagcctgtgtttagtgctgagcacccgtcctcacagttag

SEQ ID NO: 114612 - DNA, 858 bp, Artificial Sequence
  Description of Artificial Sequence: Synthetic coding sequence
atgggcacccctggagagggcttaggacgttgcagtcatgccctgatacgcggggtacccgagtccctggcatctggagaaggtgccggggctgggctgccggccttagacctcgccaaagcacagagggaacacggcgtgctgggaggaaaattgcgtcaacgtctcgggctgcaactgctggaactacctccggaagagagcctccctctggggcccttgctgggggacacagcggtcattcagggggatacagccttaatcacgcgcccttggagtcccgctagaagacctgaggtggatggggttaggaaggctctgcaagacctgggtctgaggattgtggagatcggggatgagaacgccaccctggacggaacggacgtgctctttactgggagggagttctttgttgggcttagtaaatggactaaccaccggggcgctgaaatcgtcgcagacaccttcagggacttcgcagtgagtaccgttccagtgtctggcccctcgcacctgcggggcctgtgtgggatgggagggccacgcaccgtggtcgccggatcttccgacgcagcccagaaggccgtacgcgcgatggcagtcttaactgaccacccctacgccagcctgaccctgccagacgatgcagctgccgactgcctttttctgaggcccggattaccgggagtccctccctttctcttgcataggggaggtggggatctacccaactcacaggaggctctccaaaagctgtctgacgtaacgctcgtcccagtatcttgttctgagctggaaaaagcaggtgctggactgtcgagtctatgcttagtcctctctacgaggcctcatagctag

SEQ ID NO: 114613 - DNA, 858 bp, Artificial Sequence
  Description of Artificial Sequence: Synthetic coding sequence
atggggacacccggtgaggggctaggccgctgctcccacgcactgatccggggagtacccgagtcccttgccagtggggagggcgcgggagctggcctcccggccctcgacttagcgaaagcccagcgtgaacatggggtcttgggtggaaaactgaggcagcggctgggcttgcagcttcttgaattaccacccgaggaatccttgccgctcggtcctcttctgggcgacacggcagtgattcagggggataccgccctgattacccgcccatggtcgcctgctcggagacccgaggtggatggcgtcagaaaggcacttcaagacctcggcctgagaatcgtggagatcggagatgagaatgccacccttgatggaacggacgtcctgttcactggtagggagttcttcgtgggtctgagcaaatggactaaccataggggagctgaaattgttgctgatacatttagggatttcgcggtgagcacagtgcctgtttctggacctagccacctgagaggcctttgtggcatgggtggaccccggaccgtggtagcaggtagctccgacgctgcccaaaaagctgtacgggcgatggccgttctgacggatcacccttatgctagcctcacactgcccgacgacgcggcagctgattgtctctttttacgcccaggtctgcccggcgtcccacctttcttactacaccggggcggaggggacctcccaaacagccaagaagcattgcagaaattgagtgacgtgacactagtgccagtgagctgcagcgagttggaaaaagcgggggcaggactttcatccctttgtctggtgctgagcacacgacctcatagctag

SEQ ID NO: 114614 - DNA, 858 bp, Artificial Sequence
  Description of Artificial Sequence: Synthetic coding sequence
atgggaacacccggcgaaggattggggcgatgttctcacgccctgattcgcggcgttcccgaaagtcttgcttctggtgagggagccggagccggactccctgccctggacctggctaaagcccagagagagcacggcgtgctgggtggaaaactgcgacaaaggttaggtctccagctgctggagcttcctccagaggaaagtctaccactggggccactccttggagacaccgctgttatccaaggagatacagcactgatcacaaggccgtggtcccctgcccgcagaccagaagtcgacggggtacggaaggccctgcaggacctggggctgcgcatcgtcgagataggcgacgagaacgccacgctagacggaactgatgtgttattcacaggccgtgagttcttcgtggggctgagtaagtggaccaatcaccggggcgcagaaatcgtggccgacacatttagggactttgccgtcagtactgtgcctgtgagcgggccgagccacttacgaggcctttgcggcatgggtggccctcggaccgtggttgctggcagctctgacgccgcccagaaggccgttagggccatggctgtgcttacagaccacccttacgcctcactaaccttgcctgacgatgccgctgccgattgcctgttcttgaggcccggtctgcctggagtccccccctttttgctgcacaggggaggcggagatttgccgaacagccaggaggccctccagaagttatctgacgtgaccctggtgcccgtctcctgcagtgaactcgaaaaggcaggggcgggactgagcagtctctgtctggtgctgagtacacggcctcacagttag

SEQ ID NO: 114615 - DNA, 858 bp, Artificial Sequence
  Description of Artificial Sequence: Synthetic coding sequence
atggggacccctggagagggtctagggaggtgtagccacgctctgatcagaggcgtgcccgagtctctcgcctctggcgaaggtgcaggagcgggcctgccggcactggacctggctaaagcccagcgggaacacggcgtgctcggcgggaagctgagacaaagattaggtctgcaactgctagaactaccacctgaggagagtttgcccctgggtccattactcggagatactgccgtgatccagggcgacaccgccctgatcaccaggccatggtcacccgctaggagaccagaagttgacggggtgcgtaaggccctacaggatcttggtctgcggatcgtggaaatcggagacgagaatgctactcttgatgggaccgacgtgttgtttactggaagggagttttttgtgggattgtcgaaatggactaatcacaggggggcagagattgttgctgatacattccgtgacttcgcagtttccactgtaccagtgtctggcccctctcatttgcgcgggttgtgtggtatggggggcccccgaacagtggttgcggggagtagtgatgcagcacagaaagcggtccgagccatggccgtgctgacagaccacccctacgccagcttgactctacccgatgacgctgccgctgattgtctttttttgagacccggactgcccggggtgcctccgttcctccttcatcggggaggaggagatctccctaattctcaggaggccctacaaaaactgtccgatgtcacgctcgttcctgtatcctgctcagagctggaaaaggccggtgcaggcctaagtagtttgtgcttagtccttagtaccagaccgcattcctag

SEQ ID NO: 114616 - DNA, 858 bp, Artificial Sequence
  Description of Artificial Sequence: Synthetic coding sequence
atgggcacacccggggaaggtttgggaaggtgcagtcacgctctaattcggggcgttcctgaatcactcgcctctggcgagggcgcaggggccggcctccccgccttagatctcgcaaaagctcagagggaacacggcgttctgggtggcaagctccgtcaaaggttggggttgcaactgctcgagctgcctccagaggagagcttgcccctagggccattgctgggcgacaccgctgttattcaaggggacacggctctgatcactaggccctggagtccagctcgacggcctgaggtggacggtgtccgaaaggccctacaagatttgggcctgcgtatcgtggaaatcggcgacgaaaatgccactctggacggcaccgacgtccttttcacaggcagggaattctttgtgggactgagcaagtggaccaaccaccgcggggctgagatcgtggcagacacatttcgcgatttcgcagtgtccacggtccccgtgtctggcccctcacatctgcgtgggctttgtggcatggggggaccaagaacggtggtggctggcagtagcgacgcagctcagaaggccgtgagagccatggccgtcttgaccgatcacccctacgcctccctaacacttcccgacgacgcagccgctgattgtctcttcttgaggccagggctgccaggggtgccaccattcctcttacaccggggcggaggggacctgcctaactcccaggaggctctgcagaaactaagtgacgtcactcttgtgccagtgtcatgtagcgaattagagaaggcaggagctggcctctccagcttgtgcctggtgctctccacacgcccacacagctag

SEQ ID NO: 114617 - DNA, 858 bp, Artificial Sequence
  Description of Artificial Sequence: Synthetic coding sequence
atgggaaccccaggggaggggctggggcggtgcagccacgctctgattagaggagttccagaatcactcgccagtggcgaaggcgccggcgcggggctcccggctttagacttggctaaagcccaaagggagcacggcgtgttaggcggaaagctccgacagaggctagggctgcagctgctggagttaccccctgaagagtccctgccattagggcccctcctgggcgacaccgcagttattcagggcgataccgcactgattacccgaccatggtcccccgcccgccggcctgaggtcgatggcgtgaggaaagccttacaggatttagggttgcggattgtcgaaatcggagacgagaatgctacgctcgacggaacggacgtgctcttcaccggacgtgagttttttgtgggccttagcaaatggactaatcatcggggcgccgagatcgtggccgatacttttagggactttgcagtgtcaactgtccccgtgtcaggtccttcccacctgagagggctatgcggcatgggaggccctagaacggtagtcgctggctcatcagatgccgcacagaaggcggtgcgggctatggccgtgcttacggaccatccttacgcatcgttaacgctcccagatgatgcagcagcggattgtctatttcttaggccaggtctccccggagtgccaccatttctgttacatcgcggcggcggggatttgcctaattcccaggaggcactccagaagctctccgatgtgaccctggtgccagtgtcctgcagcgagctagagaaagccggggccggcctgagttctctctgtctggtgctctccacgagaccccatagctag

SEQ ID NO: 114618 - DNA, 567 bp, Artificial Sequence
  Description of Artificial Sequence: Synthetic coding sequence
tgaaggagacccgaggtggatggggtgcgaaaagctttacaggaccttggcctgcgaattgtggaaataggggatgagaacgctacgctggacgggactgacgtgttatttaccggccgggaatttttcgtcgggctcagcaagtggaccaatcatcgtggtgctgaaatcgtggccgacactttccgagactttgcggtcagcactgtccctgtgtccgggcctagtcatctccggggcctgtgtggcatgggcggccccagaacagttgttgctggcagcagcgatgcagctcagaaggcggttcgaatgacgcagctgcttacggtgtcttttttcgtgttaggctgcttagtatgtcccctttcctcttgcaccgtggaggtcggaatctgccctacagcacgcaggcattgcagatcatctctaatgagcccctggtatctgtgtccagctcagaattggcgtcgtctggcgcccgggtctgccccatccgcatggtgtagcgcacacgctcctacagcagaggggctggctttaggatactgctggcccggcgtggggtag

SEQ ID NO: 114619 - DNA, 567 bp, Artificial Sequence
  Description of Artificial Sequence: Synthetic coding sequence
tgacgaaggcccgaggtggacggagttcgcaaggcacttcaggacctcggactgcggattgtggagatcggcgacgagaacgcaacactagatggcacagatgtccttttcaccggtcgggagtttttcgtgggcctctccaaatggactaatcaccggggggctgagatagtggcagacacgttcagggatttcgccgtaagcacggtcccagtctcaggtccttctcacctgaggggcctgtgcgggatgggaggtcctcggacagtggtggccggcagctccgacgcagcccaaaaagccgtgcgtatgacccagctacttacggtatcgttcttcgtcctgggctgcctcgtctgccccctgtcatcgtgtaccgtagaggtgggaatttgcccaaccgcgcggagacactgccgatctagcctgatgtccccctggtacctctgccccgcccagaactggcgaagactggccccaggctcagcccctagtgcttggtgcagcgcccatgctcctacagccgagggtctggcgctgggctactgttggcctggcgtggggtag

SEQ ID NO: 114620 - DNA, 858 bp, Artificial Sequence
  Description of Artificial Sequence: Synthetic coding sequence
atgggtactcctggagagggcctgggccgctgcagccacgcgctgataagaggcgtgccggagtcgctcgccagcggcgaaggggctggagccgggctgcccgccctggacctcgccaaggcacagagagaacatggcgtattggggggaaaactacgacagcgcctgggactccagcttttagagttgccgcccgaggagtcgctgcccttaggccctttgctaggagacacggctgtgatccagggtgataccgcattgatcactcggccttggtctcccgctcgacgacctgaagtagacggtgtcaggaaagccctgcaggacctggggctgaggatcgtcgaaattggagacgaaaatgcgactctcgatggtactgacgtgttattcaccgggagggaatttttcgtgggcctgtcaaaatggaccaatcatcggggggcagagatcgttgcggatacatttcgtgatttcgcagtatctactgtgcccgtgagcggcccaagtcatcttcgaggcctgtgcggaatggggggtccccgcacagtggtagctgggagttctgacgccgcccagaaggccgttagagctatggccgtcttaaccgatcatccgtacgctagcctaacattaccagacgacgccgccgcagactgcctttttctgcgcccgggactacctggcgtgccaccattcctgcttcaccgcgggggcggtgacctgcccaacagccaggaggccctccagaaattgtccgatgtcactctcgtgcctgtctcttgttccgaactcgagaaggccggggctggcctctcatccctgtgccttgtgttgtcaacacggcctcacagttag

SEQ ID NO: 114621 - DNA, 858 bp, Artificial Sequence
  Description of Artificial Sequence: Synthetic coding sequence
atggggaccccgggagagggtcttggccgttgtagccacgcactgatcagaggagtaccagaatctcttgctagtggcgagggagcaggagcaggattgcccgccttagatttggctaaagcacaacgggaacacggggtcttaggcgggaaactgcgccagaggctcggcttacagttactagagctgccccctgaggaatccctccccctgggtcccctcttgggggataccgcggtgatccagggcgacacagccctgatcactagaccctggtcccccgcccgccggcccgaagtggatggtgtgcgcaaggctctgcaggatttgggactgaggatagttgagatcggtgatgagaacgccacactggatggcactgacgtgctgtttacaggccgggagttcttcgtgggcctctctaagtggactaatcaccgaggcgctgagattgtcgctgacactttccgagatttcgctgtgagtacagtgcctgtgagcggcccaagccacctgcgaggcctctgcgggatgggcggaccgcgcaccgtggtggccggctcctccgacgcagcacaaaaagcggttcgggccatggctgtgttgacggaccacccgtatgcctctttgaccctccctgacgacgccgcagccgattgtctgtttctgaggcctggattgcccggggtgcctccctttcttcttcaccgtggcgggggcgaccttcccaatagtcaggaggcactgcagaaactttccgacgtcacattagtaccagtgagctgctccgagctcgagaaagccggagctggactgtcttcgctgtgcctggtgctgtccactcggccacatagctag

SEQ ID NO: 114622 - DNA, 858 bp, Artificial Sequence
  Description of Artificial Sequence: Synthetic coding sequence
atggggaccccaggagaaggattgggccggtgctcacacgccctgatccgaggcgttccagaatccttggcctctggtgagggggccggagctggtttgcctgcgttagacctggcgaaagcccagcgtgagcacggtgtcttgggaggcaagctccgtcagagactggggttacagctgctcgagcttccgcccgaagaatcactcccattgggcccactactgggggatactgcggtcatccagggcgacacggctttaatcacgaggccgtggtctcccgcgcggaggcccgaagttgatggggtgcgcaaagccttgcaggacctggggctccggatagttgaaatcggtgatgagaacgcgaccctggacggaaccgatgtgctatttactggcagggagttctttgtgggactgtcaaagtggactaatcaccgaggagccgagatcgtggccgatacatttagggacttcgctgtctccacagttcccgtctcagggccttctcatcttcgaggactctgtggaatgggcggacctaggaccgtggtggccggctccagcgacgccgcccagaaggccgtgagagctatggcagttctcactgaccacccctacgcaagtttgactctgccagacgatgcagcagccgactgcctcttcttacgccccgggctgcccggagtccccccgttcctattgcatagaggcggtggtgacttgccaaactctcaggaagccctgcagaagctatctgatgttactcttgtgcctgtatcgtgttctgagctcgagaaggccggcgcaggtttgtcatccctatgtctggtcttgagtacccggccacacagttag

SEQ ID NO: 114623 - DNA, 711 bp, Artificial Sequence
  Description of Artificial Sequence: Synthetic coding sequence
atgggaacccctggtgaaggactgggtcggtgtagccatgcactaatcaggggtgttccagagagtctggcaagcggtgagggggcaggcgccggcctgcccgctctggacttagctaaagctcagagagagcacggcgtgttaggcggcaagctccggcaacggctcgggctacagttactcgagcttcctccggaagaatctctacctctcgggcccctgctgggagataccgccgtgatccagggagacaccgccctgataactcggccctggtctccagcaaggagaccagaggtggatggagtcaggaaggctctacaagacctcggtcttcggatcgtggaaatcggagatgagaacgctactcttgacggcactgacgtgctgttcactgggagggaattctttgtcgggctttctaaatggaccaatcaccgcggcgctgagatcgttgctgacacatttcgcgactttgcagtgtccactgtgccagtttccggaccgtcccacctgcggggcttgtgcggcatgggtgggccacgcactgttgttgcaggcagttccgacgctgcccagaaggctgttcgagcgatggccgtcctgactgatcatccctacgcgtctcttacactccccgacgatgccgctgccgactgcctgttcctacggcctgggcttcccggagtacccccttttcttctgcattag

SEQ ID NO: 114624 - DNA, 681 bp, Artificial Sequence
  Description of Artificial Sequence: Synthetic coding sequence
atggggactccgggtgaaggcctgggaaggtgtagccatgcactaataaggggcgtccccgagagcttggccagcggagaaggcgcaggggccggactccccgctttggatttagccaaggcccagagggaacatggcgttctgggagggaaattgcggcagagactgggccttcagctactggagctgcctccagaggagtctctgcctctgggtccgctactgggcgataccgcggtaatccagggagatacagccctgataactaggccatggtcacccgctaggaggcctgaggttgatggcgtccgaaaagccctccaggatcttgggcttagaatcgttgaaattggcgacgagaatgccaccctggatggcacagacgttttatttaccggtcgagagttcttcgtgggcctttccaaatggactaatcacagaggcgcagaaatcgtggcagatacttttcgcgattttgctgttagcacagtccccgtgagcggacctagccatctgcgaggactttgtggcatggggggtccgagaactgtcgtggcaggctccagcgacgccgcccagaaagcagtgagggctatggccgttctcactgatcatccctacgccagtctgaccctccccgacgacgccgccgcagactgtcttttcctgagaccggggtag

SEQ ID NO: 114625 - DNA, 711 bp, Artificial Sequence
  Description of Artificial Sequence: Synthetic coding sequence
atgggaacccccggcgagggtctgggtcggtgctcacacgctctgattcggggcgtccctgaatcgctggccagcggtgagggcgctggggccgggctgcctgctctcgacctcgctaaggcccagcgggagcacggcgtcctgggaggtaagctccgccaacgcctggggctgcagcttcttgagctgccacctgaggaatcactgcccctgggcccactgctcggcgacacagcggtcatacagggggacaccgcattaattaccagaccatggtcacccgctagacggccagaggtagatggcgtgaggaaggcactgcaggatctgggccttcggattgttgaaatcggcgacgagaacgcaaccctggatgggaccgatgtgttgtttaccggcagagaattctttgtagggctgtcaaaatggacaaatcacagaggggctgagatcgtggccgataccttccgggatttcgcagttagcactgttccagtgtcagggccctctcatctcagaggtctgtgcggcatgggaggtcctagaaccgtcgtggcgggctcatcagacgccgctcaaaaggctgtcagagctatggccgttctaacagatcatccttatgcaagcttgactctacccgacgacgctgccgctgactgcctgttcctgcgaccaggcctgccaggagtgcccccgtttttgctccattag

SEQ ID NO: 114626 - DNA, 858 bp, Artificial Sequence
  Description of Artificial Sequence: Synthetic coding sequence
atgggtactcccggcgagggcttaggacgctgctcccacgccctgatacgtggggtgcctgagtcgctagcctccggcgagggggccggggcaggcctgcctgcactggacctcgctaaggcccaacgcgaacacggggttctcggtggcaagctgaggcagcgcttgggcctccaactgctggaacttccacctgaagagagccttcccctgggaccactgctgggggacaccgccgtgatccagggggacacagcccttattactagaccatggtcaccagcaaggcgccctgaggttgatggggtgcggaaggccctgcaggacctcggcctgcggattgtggaaattggcgacgagaatgcaaccctagacggcacggatgtgcttttcactggacgagagttctttgtggggttgtccaaatggaccaaccatcgtggagctgaaatcgtcgccgatacattccgggatttcgccgtgagcacagtgcctgtctccggcccatcccacctgcgtggcttgtgtggaatgggcgggcctcggacagtggtggccgggtcctcagacgctgctcagaaggctgtgcgggcaatggccgttctgaccgatcacccgtatgctagcctgacactgccggacgatgctgcagctgactgtttatttctgcgacctggattaccaggagtcccaccattcctccttcatcgtggtggaggagacctccccaactcccaggaggctctgcagaagctatccgacgtgactctcgtacccgtgagctgctcagagctggaaaaggccggtgccggtctgtcctccctgtgcctcgtcttaagtactcggcctcactcttag

SEQ ID NO: 114627 - DNA, 858 bp, Artificial Sequence
  Description of Artificial Sequence: Synthetic coding sequence
atggggaccccaggggaagggctaggccgttgcagccacgccttgatccggggagtacccgagtccttggcgagcggagagggagccggtgccggtttgccagccctggatctagcaaaagcccagcgggagcatggggtgttgggcgggaagctgaggcagaggctcggtctgcaactgctggagctgcctcccgaagagagtctccctctgggccctttactgggtgatactgccgtgatacagggtgataccgctctaattacgagaccctggtcgccggccagacggccagaggtggacggcgtgcggaaggccttacaggatctggggctgcgtatagtggaaatcggcgatgagaacgccacactggacggaacggatgttctgtttactggccgggagttcttcgtgggcctgtctaagtggacaaatcaccgaggggctgaaatcgtggctgataccttccgcgacttcgctgtcagcacggtgccggtctcaggcccatctcatcttcgtggtctgtgtggaatgggggggcctcggacggtagtggcaggttcttctgatgccgcccagaaagcagtacgggcgatggcagtgttaacggaccacccatacgcctcactgactctccccgacgatgccgccgctgattgcctgtttcttagacccggtcttccaggggtccctccatttttgctgcatcgagggggaggggacctccccaacagccaggaggccctgcaaaagttgtctgatgtgactttggtaccagtatcctgctccgagttagagaaggcgggcgctgggttgagctcactgtgcctcgtgttgtcaactcggccgcacagctag

SEQ ID NO: 114628 - DNA, 858 bp, Artificial Sequence
  Description of Artificial Sequence: Synthetic coding sequence
atgggcactcccggggaaggtcttggacgatgtagtcatgctctaattcgcggggtgccagagagcttagcctcgggcgagggtgctggagcaggcttgcctgctctggaccttgccaaggcccagcgggagcatggcgtcctgggcgggaaactccggcagcgtctgggcctgcaacttctggaactcccgccagaagagtcactgcctttagggcctctgctcggggacacagccgtgatccagggtgacaccgctttgattacacgaccatggtcccccgcaaggcggccagaggtggacggcgtgcggaaagccctgcaagaccttggtcttcgaattgtcgagatcggggatgaaaatgctacgctggacggaacagacgtgctatttaccgggcgcgagttcttcgtgggactttccaaatggaccaatcacagaggcgctgaaatcgtggccgacacttttcgcgacttcgccgtgtccacagtcccagtgtccggccccagccacctcagagggctatgcggcatgggggggccaaggaccgtggttgcaggctcctcagacgctgcccaaaaggctgtgcgagcaatggccgtcctgaccgaccatccttacgccagtctcaccttgcccgatgatgcggccgcagactgcctgtttctgcgccccggcctcccaggggtgcccccattcttgcttcacagaggaggcggtgacttgcctaatagtcaggaagcgctccagaaactgtcagacgtgaccttagtaccagtgtcatgcagtgagttggagaaggccggggccgggctgtcctccctctgtctggtcctcagcaccaggccgcattcatag

SEQ ID NO: 114629 - DNA, 681 bp, Artificial Sequence
  Description of Artificial Sequence: Synthetic coding sequence
atgggcacgcccggggaagggcttggccgttgcagccacgcgctgattaggggcgtccctgagagcctagccagtggtgagggggctggagccggcctccccgccctggacttggctaaggctcagcgcgagcatggcgtgctcgggggcaaattgcgccagcggctggggctccaattacttgaactcccccccgaggaatctctgcctctgggtcctctgcttggcgacaccgcggttattcagggagacacagctctgataacgagaccatggtcgcccgctagacgacctgaggtagacggggtgagaaaagcacttcaggacctcgggctgagaattgtggaaatcggagacgagaacgctactttggacggtacagacgtcctcttcaccggtcgggagttttttgtgggcctcagcaaatggaccaaccatcgcggtgcggagatcgtggctgacacgtttcgggactttgccgtttccacggtgcccgtatcgggaccctcccatctccgcggactgtgtggcatgggcggtcctcgaacagttgtagcgggatcaagcgatgctgcccagaaagcggtcagagccatggccgttctgaccgaccacccctacgccagtcttaccttgcctgacgacgccgccgccgactgtctcttccttcggccgggatag

SEQ ID NO: 114630 - DNA, 858 bp, Artificial Sequence
  Description of Artificial Sequence: Synthetic coding sequence
atgggtaccccaggagagggcttgggacgatgctctcatgctctgataagaggcgtcccagaaagtctggcatccggcgagggcgcaggcgccggcctccccgcactggatcttgccaaagctcagcgggagcatggcgttctggggggtaagctccgccagcgcttgggtttgcaacttctggaactgccgcccgaggaatcgttacctctgggtcccctactaggcgatacagcagtgatacaaggcgatactgctctgattactcgtccctggagtccggcccgccggccagaggttgatggggttcgtaaggccttgcaggacctcgggctgagaatagtcgaaataggggatgaaaacgcaactctggacggtacagacgtcctgttcaccgggcgggagtttttcgtcggcttgtccaaatggaccaatcacaggggggctgagatcgttgccgacactttcagagattttgctgtgtctacagtgcctgtatcagggcctagccacctgagaggcttatgtggtatgggaggcccacggaccgtcgttgctggcagctcagacgccgcacagaaagccgtacgggccatggccgtgcttacagaccatccctatgcctcgctgactctccctgatgacgccgccgccgattgcctctttttgaggcccggtttgccaggggttccacccttcctactccaccgcggcggcggggatctgcccaattcacaggaagctctccagaagttgagtgatgtgacattagtgcctgtttcgtgtagtgagctcgagaaagccggagccgggctctcatccctgtgcctggtgttgtcaaccaggcctcattcatag

SEQ ID NO: 114631 - DNA, 681 bp, Artificial Sequence
  Description of Artificial Sequence: Synthetic coding sequence
atgggcacaccaggggaaggactcggccgctgttcgcacgccctgatcagaggggtgccggagtctctggcctccggcgagggggccggagccgggcttccagctctggacttggcaaaagcgcagagggagcacggggtgctcggggggaagttgcggcagaggctcggattgcagctgttagagcttccccccgaggaaagcctgccgcttgggcctctcttaggcgatactgccgtgattcagggggacacggccttaattactaggccttggtcaccggcccggaggccagaggtggatggcgtccgcaaggctctccaagatctgggactgcggatcgtcgagattggcgacgaaaacgccacgttggatggaacagatgtcctgttcactggaagggaattcttcgttggtctgtcaaaatggactaatcaccgtggtgctgaaatagttgccgatacctttcgcgacttcgccgtgtcgacggtcccagtttcaggcccctcccacctaaggggactgtgtggaatgggagggccccgaacagtcgttgctggttcaagcgacgctgcccaaaaagcggtgcgtgctatggctgtcctgacagaccacccttacgcctcgctcacgctgcctgatgacgctgccgccgactgtcttttcctgcgaccaggctag

SEQ ID NO: 114632 - DNA, 681 bp, Artificial Sequence
  Description of Artificial Sequence: Synthetic coding sequence
atggggaccccgggcgagggactgggtaggtgtagtcacgcattgattaggggggtacctgagagcctcgctagtggcgaaggagccggcgcagggctacccgctcttgatctggccaaggcgcaacgggagcatggagtcctgggagggaagctgcgacagcgactcggcctgcagcttctcgagctgccacccgaagaatcactgcctttgggtccacttctaggagatactgccgtgatccaaggagatacagccctgatcactagaccttggtcccccgctaggaggcctgaagtggacggagttagaaaggcccttcaggatctcggactcagaatcgtagagatcggtgatgagaatgccaccctcgatggcacagacgtgctgtttactgggcgcgagttcttcgtcggtctgtctaaatggacgaaccaccgaggggccgaaattgtggcggataccttcagggattttgctgtaagtaccgtgcccgtaagtggaccttcccacctcagaggattatgtggtatgggcggccccagaacagtggtggccggatcatccgacgccgctcagaaagcagttagagccatggccgtgctcacggatcacccatacgcatcgcttacccttcccgatgatgctgccgcagactgcctctttctgcggccaggttag

SEQ ID NO: 114633 - DNA, 858 bp, Artificial Sequence
  Description of Artificial Sequence: Synthetic coding sequence
atgggcacgcctggagaaggcctggggagatgttcacatgctctgatcagaggggtgcccgaatctctcgcttctggggaaggagccggagctgggctccctgctctcgacctcgcaaaggcgcagagggaacatggtgtgctggggggcaaactgagacaaaggctgggcctgcagctgctcgagctcccgcctgaagaatccctccctcttggaccattgttaggggacaccgccgttattcagggggatactgctctaataacacgtccatggagcccagcccggagacccgaggtggatggcgtccggaaagcccttcaggacttgggcctgcggatcgttgaaattggtgatgagaacgctaccctcgatggaacagacgtgctgttcactggtcgcgaattctttgtaggtctttccaaatggaccaaccatagaggggcggagattgttgctgacacctttagagatttcgctgtctcaaccgtgcctgtgtccggtccctcccatctccgggggctatgtggtatgggcggccctcgcactgtagtagctggtagttctgacgcagcccagaaagccgtcagggctatggccgtgctgaccgatcacccctacgcgtcactgacactccccgatgacgcagctgccgattgtcttttcttgcggccgggactcccaggtgttccaccttttctgctacacaggggcggaggggatctgccaaacagccaggaggctctgcagaagctctcagatgtcaccctagtaccggtttcctgtagtgagctggaaaaggccggcgcagggctgagcagtttgtgtttagttctgagcaccaggccccacagctag

SEQ ID NO: 114634 - DNA, 681 bp, Artificial Sequence
  Description of Artificial Sequence: Synthetic coding sequence
atggggactcccggtgaggggcttggaagatgctctcacgctctcatcaggggcgtgcctgaaagcctggcatcaggggagggagcgggggccggtcttcctgcacttgacttagccaaagcccagagggaacacggcgtgctggggggcaagctgcgtcagcgcttagggctccagctgcttgagctccctccggaagaatccctgccactcgggcctctgttgggcgatactgcagttatccaaggtgacacagcccttattacaagaccctggtcccccgccaggagacctgaagtggacggggtgaggaaggcccttcaagaccttggattaagaatagtagagatcggcgacgagaatgccacactggacggaactgacgtgttatttaccgggagggaatttttcgtcggactgagtaagtggaccaaccatcgtggagcggagattgtggctgatactttccgggatttcgcagtgagcacagtgccagtaagcggtcccagccacctgcggggattatgcggcatgggaggccccagaacggtggtggctggtagctccgacgccgcccagaaggctgtgcgcgctatggccgtgctgaccgatcacccttatgcttccctcacattacccgatgacgccgccgcggactgtttgtttttgcggcccgggtag

SEQ ID NO: 114635 - DNA, 567 bp, Artificial Sequence
  Description of Artificial Sequence: Synthetic coding sequence
tgacggaggcccgaggtggatggggttaggaaagctcttcaggaccttgggctccgcattgtggagatcggtgacgagaacgccacactggatggaacagacgtgttgttcactggccgcgaatttttcgtgggcctgtcaaagtggaccaatcaccggggtgccgaaattgtggctgacacattccgggattttgccgtgtcgactgttcctgtatcaggtcctagccatctacgcggactctgtgggatgggcggaccaagaaccgtggtggcgggcagcagtgatgcagcgcagaaggctgtaaggatgacacagttacttaccgtgagctttttcgtgttgggatgcctcgtatgccccctgagctcctgtaccgtggaagtgggcatctgccccactgccagacgacactgtcgatctagcctgatgtccccatggtatctctgtcctgcccaaaactggaggcgtctggcccccggctccgccccttctgcatggtgctccgcacatgcccccactgcagaggggcttgccttggggtattgctggccaggtgttggatag

SEQ ID NO: 114636 - DNA, 567 bp, Artificial Sequence
  Description of Artificial Sequence: Synthetic coding sequence
tgacgcaggcctgaggtggatggagtccgaaaagctcttcaggacctagggctccgtatcgtcgagataggcgacgaaaatgccacactggacggcactgacgtgctcttcacggggcgcgagtttttcgtcggactctctaaatggactaatcacagaggggccgaaattgtcgccgacacatttcgcgactttgctgttagcactgtacccgtctctggaccaagccacttacgagggctgtgcggaatgggcggtcccagaaccgtcgtagctggttctagtgatgccgctcagaaggccgtgagaatgacccagctgctcacagtctcattcttcgtactggggtgcctggtctgtccgctgagcagttgcaccgtggaagttggtatttgtcctaccgcccgccggcactgccggagtagcctgatgtcgccttggtatctgtgccccgctcaaaattggagacgactcgcaccaggatccgctccatccgcctggtgttctgcccacgcaccaaccgctgagggcctcgcattggggtactgctggccaggcgtcggctag

SEQ ID NO: 114637 - DNA, 681 bp, Artificial Sequence
  Description of Artificial Sequence: Synthetic coding sequence
atgggcacacccggagaagggctgggacggtgctcgcacgcgctgattcgaggagttccagagagccttgcttctggtgaaggggcaggggcgggattgccggcattggaccttgctaaagctcagcgggaacatggtgtgctgggaggcaagctgcggcagcgactcggcctgcagcttctcgaactccctcccgaagagtccttgccactcggcccccttctgggtgacaccgctgtgattcagggggacacagcactcattactagaccctggtcaccagcccggagaccagaagtcgatggagtgcgcaaggccctccaggatctggggctccgcatagttgagataggggatgagaacgcaacgcttgacggcaccgacgtgctcttcaccggcagggagttttttgtcgggctctctaagtggaccaatcatagaggggccgagattgtggccgatacctttcgcgattttgctgtgagcactgttccagtgtccgggccatcgcacctgagggggctgtgtggcatgggtggccccaggaccgtagttgccggcagttccgacgccgctcagaaagcagtgagggctatggccgtgctgacggaccacccctatgcctctcttacacttcccgatgatgccgctgcagattgtttgtttttgaggcccgggtag

SEQ ID NO: 114638 - DNA, 858 bp, Artificial Sequence
  Description of Artificial Sequence: Synthetic coding sequence
atgggcacccctggtgaaggcctgggccgctgctcacacgccctgattaggggggttcccgagagtctggcttctggggaaggcgccggtgcaggtttgcccgcccttgatcttgcaaaagcacagcgcgagcacggcgtcctgggcgggaaactgagacagaggctgggcttgcaactgttagaactcccccccgaggagtccctccctctcgggccacttctcggagacacagctgttatacaaggggacaccgctcttatcacccgtccgtggtccccggctagacgcccagaagttgacggggtccggaaagcacttcaggatttaggcctgcggattgtggagataggggacgaaaacgctacactcgacgggacggatgtgcttttcacaggccgggaattctttgtagggctgtctaaatggaccaatcatcggggagctgagattgtggctgatacatttcgagacttcgctgtgagtaccgtccctgtgtcaggaccgagtcatttgagagggctgtgcggcatgggagggcctagaaccgtagtggcgggctcctccgacgcagcccagaaggcagtcagagccatggctgttctcaccgaccacccatatgcctcactcactctcccagatgacgctgccgctgattgcctattcctcagaccaggcctgcccggggtacctcctttccttctccatcggggaggaggggatttgcccaacagccaggaagccctgcaaaagctgtccgatgtgactttagttcccgtctcttgcagcgaacttgagaaggcaggagccggcctctccagcctttgtctggttctttcaacccggccccattcttag

SEQ ID NO: 114639 - DNA, 711 bp, Artificial Sequence
  Description of Artificial Sequence: Synthetic coding sequence
atgggcaccccaggcgaagggctcggtaggtgctcacacgccctcattcgaggcgtcccagaatctttggccagtggggagggcgctggtgccgggctccccgcactcgacctagcaaaggcccagcgcgagcatggggttttgggggggaagctcagacaacggctgggacttcagctcctggaactacctccagaagagtccctgcccctgggtcccctcttgggcgataccgctgtgattcagggcgatactgccttaataactcgcccttggtcccctgctcggagaccagaggtcgacggcgtcagaaaagcactccaggatctgggcttgagaatagttgagatcggtgacgagaacgccacactggatgggaccgacgtcttatttactgggagggagttttttgtgggactcagcaaatggacaaatcatcggggcgcagagatcgtggctgatactttcagggattttgcggtcagtactgtgccggtgagtggaccaagtcacctgcgcggattatgtggtatgggcggcccacggacagtcgtggctggctcaagtgatgctgcacagaaggccgtgcgggccatggccgtcctgaccgaccatccttacgcatcactgaccctccccgacgacgccgcagccgactgcctattcctgcggcctggcctccccggtgttccccccttcctgctccactag

SEQ ID NO: 114640 - DNA, 711 bp, Artificial Sequence
  Description of Artificial Sequence: Synthetic coding sequence
atgggcaccccgggggaggggctcggtcgatgtagtcacgcattaattcgtggggttccagagagtctcgcctcgggtgagggtgcaggggctgggctgcctgcattagatttagcaaaggcacagcgggagcacggggtcctgggtggcaagctgcggcagcggttaggtttacagctgctggaactgccacctgaagagtcgctgcccctcgggcccctcttgggggacacagctgtgattcagggcgataccgctctgattactcgcccatggtcacctgcgcggcgcccggaagtcgacggcgtccgaaaggcccttcaggatctgggcctaagaattgtggagattggggacgaaaatgccacactggacggcaccgacgtgctcttcaccggtagggagttcttcgttgggctcagcaaatggacaaaccaccggggcgccgaaatcgttgctgacacttttcgagacttcgcagtttccactgtccccgtctcagggcctagtcaccttaggggcctgtgcggaatgggcgggccccgaactgttgtggcagggtcctccgatgccgctcagaaggcagtgcgggcgatggccgtactcaccgatcacccatatgcctcccttacgctgccagacgatgctgctgctgactgtctgtttctccgcccagggctaccgggagtgccccctttcctgctgcattag

SEQ ID NO: 114641 - DNA, 858 bp, Artificial Sequence
  Description of Artificial Sequence: Synthetic coding sequence
atgggtacccccggggagggcctggggaggtgtagccacgccttaatacggggggtccctgaatcactcgcctctggggagggagccggcgccggcctgccggctttagatctggcgaaagcccagagggaacacggggtgctcggaggcaaactgcggcagagactgggcctccagctgctggaattgcccccagaagagagtcttccgctgggacccctccttggagacacagctgtaattcaaggagacaccgcattgatcacacgcccctggtcaccagctcggcgccccgaggtggacggagtgagaaaggccttgcaggacctaggactcagaatcgtcgaaattggggacgaaaacgctactctggacggaacagacgttttgttcacaggccgtgaattctttgttggactgtcgaaatggacaaatcaccgaggcgcagagattgtagcagacacctttcgggattttgctgtgagtaccgtgccagtgtcaggacccagccacctcaggggcttgtgcgggatgggcggaccacgcaccgtcgtagccggttcttccgatgcagcacagaaggcagtgagggccatggccgttctgactgaccatccatatgcaagcctgactctcccggatgatgctgctgctgactgcctttttttgaggcctggcctgcccggagtcccccctttcctgctccaccgcgggggcggagatcttcccaactcacaagaagcattgcagaagctgtcagacgttactcttgtaccagtgtcatgctcagagcttgagaaagcaggggccgggctaagcagcctttgcctcgtgctgtcaactaggccacattcctag

SEQ ID NO: 114642 - DNA, 678 bp, Artificial Sequence
  Description of Artificial Sequence: Synthetic coding sequence
atgggtaccccaggggagggcttgggacggtgttctcacgcccttatcagaggggttcccgagtcgctggcctccggagaaggagccggtgccggcctccccgccttagacttagccaaagcacagagagagcatggggttcttggcggaaagttgcgacagcgactgggcctccaactgctggaactcccccctgaggagtctttacctctcgggcccttgcttggcgacaccgccgtaatccagggcgataccgcgctgataactaggccttggtcgcctgccagacgacctgaggtggatggggtcaggaaagccttgcaggatctcggtctacgtatcgttgagataggagatgagaacgccacacttgacggaaccgatgtgctctttacagggagggaattttttgtgggactgagcaaatggactaatcaccggggcgctgaaatcgtcgctgacaccttccgagacttcgccgtttcaaccgtgccagtatcaggaccaagccatttacgaggactgtgcggaatgggagggcctcgcaccgttgtggcaggttcttcagacgcggcgcaaaaggctgttagggccatggctgtgctaacagaccacccgtacgcaagtctcaccttgccagacgatgctgcagccgattgtcttttcctgcgaccatag

SEQ ID NO: 114643 - DNA, 858 bp, Artificial Sequence
  Description of Artificial Sequence: Synthetic coding sequence
atgggaactcccggggaagggttagggaggtgtagccacgcattgataaggggggttcccgagagcctggcgtccggggaaggggcaggggccgggcttccagctctggatctggccaaggcacagagggagcatggagttctgggcgggaaactccgccagagactgggacttcagctgctggagctgcctcctgaggagtctctcccacttggaccgctcctgggggacacagccgtaatccagggagataccgctctgattacacggccctggagccccgctcggaggcccgaagttgatggtgtgcggaaagccttgcaggacctgggtcttcgcattgttgagatcggcgacgagaatgccactttggatggcacagacgtgctcttcaccgggcgcgaattcttcgttgggctttcaaagtggacaaatcacaggggagccgagatcgtggccgacaccttcagagactttgctgtgagtaccgtgccggtcagcggcccgagccatctgcggggcctttgtggaatgggtggcccgaggaccgtggtggccggctccagtgatgccgctcaaaaagcggtacgagctatggcagtcttgacagatcacccatacgcatccctcacactgcccgatgatgcagccgctgactgtttgtttcttcgtcccggattgcctggcgtacctcccttcctactccatagaggtgggggcgacctcccaaatagccaagaggctctgcagaagctgtccgacgtgacgcttgttccagtgtcttgttcggagctggaaaaagctggagccggcctgtcctccctttgccttgtcttgtcaacccggccacactcttag

SEQ ID NO: 114644 - DNA, 567 bp, Artificial Sequence
  Description of Artificial Sequence: Synthetic coding sequence
tgaaggcgacctgaagtggacggtgtccgcaaggctcttcaggacctgggccttcgcatagtagagatcggcgacgaaaatgccacgctggacggcacagacgtgctcttcacaggccgagagttctttgttggtctgtcaaaatggaccaatcaccgcggagccgaaatcgtcgcagataccttccgcgactttgcggtaagcaccgtcccagtatcgggcccctcccacttgcggggcttatgcggcatgggggggccccgcacagtcgtcgccggtagcagtgatgccgcccagaaagccgtgaggatgacacaactgcttactgtgagtttttttgtgttgggatgtttggtctgccctctgtcctcatgtaccgtggaggtcggcatttgccctaccgcgcgtcgacactgccgtagctccctgatgtctccctggtacctgtgcccagcacagaattggcggaggctggccccaggcagtgctcctagtgcttggtgctctgcccacgccccaacggcagaggggttggcattgggctactgctggcccggcgtgggctag

SEQ ID NO: 114645 - DNA, 567 bp, Artificial Sequence
  Description of Artificial Sequence: Synthetic coding sequence
taaagaaggcccgaggtggacggggtgagaaaggcccttcaggatttgggactccgcatcgtcgagattggggacgagaacgccacactggacgggactgacgtgctttttacggggagagaatttttcgtggggctgtccaagtggacgaaccacagaggggccgagatcgttgctgacaccttcagggatttcgcagtgtctactgtgcccgtgtcaggccccagtcacctccggggcctgtgtggaatggggggtcccagaacagtggtagccgggagttccgacgctgcccagaaggctgtgagaatgacgcagctcctcaccgtcagcttcttcgttctgggctgtctggtgtgcccactcagtagctgcaccgttgaggtaggcatttgtccaacggccagaagacattgccgaagcagtcttatgtcaccatggtacctatgcccagcgcagaactggcggcggctggcaccaggcagtgccccgagcgcatggtgttccgcacatgcccccacagcagagggcctggccttgggctattgctggcccggcgtgggatag

SEQ ID NO: 114646 - DNA, 858 bp, Artificial Sequence
  Description of Artificial Sequence: Synthetic coding sequence
atggggactcccggggagggcttgggacgctgctctcacgccttgataaggggcgttccagagagtttggcttcaggtgaaggcgcaggagccggactccctgcactggacttggcaaaggctcagagggaacacggtgtgctgggaggaaaactgcgacagcgacttggtctccagcttctcgaattaccaccagaagagtccctgcccctgggccctcttcttggagataccgctgtgatccagggggatactgccctcattaccaggccatggtcccccgccaggcgcccagaagtggatggggtcaggaaagccctgcaggatttggggttgcgcattgtcgagattggtgatgagaacgccacattagatggaacggacgttctcttcaccggtagggagttctttgtcgggctgtccaaatggacaaatcacagaggtgcagaaattgtggccgatactttcagagactttgctgtttcaacagttcctgtgtccggaccctctcacctgcggggcctctgcggtatgggaggtccacgcacagtggttgcaggaagctccgatgccgcccagaaagcagtgagagccatggctgtcctgacagaccatccttacgccagcctcacactccctgacgatgccgccgccgattgcctcttcctgcgcccaggactgcctggcgtccctccttttctactgcaccgtggcgggggagacctgcctaatagtcaagaggcccttcagaagctttccgacgtgacactcgtcccagtgtcttgcagcgagttggaaaaggctggcgctggcttgtcctccttatgtttggttcttagtactaggcctcacagctag

SEQ ID NO: 114647 - DNA, 711 bp, Artificial Sequence
  Description of Artificial Sequence: Synthetic coding sequence
atgggcactccaggtgaagggctcggtaggtgctctcacgcactgatcagaggcgtgcctgagagcctcgcatcaggagaaggtgccggggctggtctacccgctctggacttagccaaagcccagagagagcatggcgtcctgggaggtaaattgcggcaaaggctgggtctgcagttgctggaattgcctccggaggaaagtcttcctttgggtcctcttctgggagacaccgctgtgattcaaggcgacacagcattgatcaccagaccctggtcgcccgcccgtagaccggaggttgacggggtcaggaaggccctccaggacctgggcctgcggattgtggaaattggtgacgaaaatgctacccttgatgggactgacgtgctttttacagggcgcgagttcttcgttggtctgtctaagtggacgaaccacaggggagcagagatcgtagctgatacattcagggatttcgcagtgagtaccgtgccggttagcggaccttctcacctcaggggcctgtgtggaatggggggacccaggaccgtggtcgccgggagcagtgacgcagcccagaaagccgttcgggcgatggctgtgctaaccgatcacccatatgccagcctgacgctccccgacgacgccgcggcggactgtctgttcctgaggcctggtctgcccggggtcccgcccttcttgctgcactag

SEQ ID NO: 114648 - DNA, 567 bp, Artificial Sequence
  Description of Artificial Sequence: Synthetic coding sequence
tgaaggcgccccgaagtggacggcgtacggaaagccctccaagaccttggcttgcggattgtcgaaatcggggatgaaaacgcaaccttggatgggactgatgtgctgttcactggtcgtgagttttttgtggggctgagcaaatggacaaaccatcgtggtgccgagatcgttgccgacacgtttcgcgacttcgccgtatcaactgtccccgtgagtggcccctcccacttgagagggctgtgcggtatgggggggcctagaactgtggtggccggctcctccgacgcagcacagaaggctgtacggatgacccagttgctgacggtgtcattctttgtgctggggtgcctggtatgtccactaagctcctgcactgtggaggtgggcatatgccccacagctcgacgacactgccgctcctctcttatgtccccctggtacctttgccctgctcagaattggagaaggctggcaccaggttcagccccctcagcatggtgctctgcccacgcacctaccgcagaaggcctggcactgggatattgttggcctggagtcggctag

SEQ ID NO: 114649 - DNA, 858 bp, Artificial Sequence
  Description of Artificial Sequence: Synthetic coding sequence
atggggacccctggtgaggggttggggagatgttcccacgctctgattagaggcgtcccagagtccctggcgtcaggcgagggagccggggctggcctaccagcacttgatttagcaaaagctcagagggagcatggcgtgctcggcggcaagcttcgacagcgtctgggactacagctcctggagttaccaccggaggagagcctgcctctgggccctctgttgggggacaccgccgtgatccagggtgatactgccctgatcacacgcccttggtcacccgctcggcgaccagaagtggacggggtacggaaagcactgcaagatctcggcttaagaattgttgagatcggtgacgagaatgctactctcgatgggacggacgtgttattcaccgggcgggagttttttgtgggcctcagcaagtggacaaatcacagaggcgcagagattgttgctgatacctttcgtgatttcgcagtgtccacagttcccgtgagcggcccctcccaccttcgtgggctgtgtgggatggggggtccccgaacagtggtggccggaagttccgatgccgcccaaaaagctgtccgcgccatggccgtgctgactgaccacccttacgcctctttgaccctccctgatgatgcggccgcggactgtctgtttctcagaccaggcctgcccggagtaccgccgttcctgctccacaggggaggtggagatttgcctaattcccaggaagctctgcagaaactgtccgacgtcaccctcgtacctgtgtcctgttccgagctggagaaggccggcgcaggcctgtcatctttgtgcctcgttttatccactcgaccccacagctag

SEQ ID NO: 114650 - DNA, 858 bp, Artificial Sequence
  Description of Artificial Sequence: Synthetic coding sequence
atgggcaccccaggagagggactcgggagatgctcacatgcgctaatccgaggggtcccggaatccctggctagcggggaaggcgccggagccgggttgcccgccctggatctcgccaaggcgcagcgagaacatggagtcctcggcgggaagctccggcagcggctggggctccaactgctggaattaccccccgaggagtccctccctctcggtccccttcttggtgatacagccgttatccagggcgacaccgccctgatcacccgtccctggagccccgccaggcggcccgaggtggacggagtacgcaaggcgcttcaggatctgggtcttcgcatagtcgagattggggacgagaatgccactctagatgggaccgacgtattatttactgggagagaatttttcgtcggacttagtaagtggacaaatcatagaggagcggagattgtggccgacacgtttagagacttcgccgtcagtactgtgcccgtctctggtcctagtcacctgcggggtctctgcggaatggggggaccgaggacagtggtcgccggcagctccgatgcagcgcagaaagctgtgcgtgctatggcagtgctgaccgaccacccatacgccagcttgaccctgcccgatgatgcggctgccgactgtctcttcctgcggccagggctgccaggggttcccccctttcttctgcaccggggcggaggagaccttcctaactctcaggaggccttgcagaagctgtcagatgtgaccctcgtgcccgtgtcctgctcagagcttgagaaggccggcgctgggctgtcttctctgtgcttagtcctctcgacgcggcctcattcttag

SEQ ID NO: 114651 - DNA, 711 bp, Artificial Sequence
  Description of Artificial Sequence: Synthetic coding sequence
atgggcacccctggtgagggattaggtcggtgcagccatgctctgatccgaggagtccccgagagcctggcatccggtgaaggtgctggtgctgggttacccgccctagatttggctaaggcgcagagagaacacggcgtgctgggagggaagcttaggcagagactgggcctccagctgctggaactgccccctgaagagtcattaccattaggcccattgctcggggacaccgctgtgattcagggggatacagcattgatcacacgtccatggtctcctgccagacgccccgaggtggatggagtaagaaaggctcttcaagatttggggttgcgcatcgtggagattggcgacgagaacgccacgcttgacggaaccgacgtgctgtttaccggccgcgagttcttcgtcgggctaagtaaatggacgaatcataggggcgcggagatcgtcgccgatacattcagggactttgcagtgtctaccgtcccagtttccggaccgtcacatttacggggattgtgtgggatggggggtcccaggactgtggttgctgggagcagtgatgccgcgcagaaggcggtcagggcgatggcggtcctgactgaccacccgtacgcatccctcactctgcctgacgacgccgcagctgactgtctgttcctaagacctggtctacccggcgtgccgccctttctcttacactag

SEQ ID NO: 114652 - DNA, 711 bp, Artificial Sequence
  Description of Artificial Sequence: Synthetic coding sequence
atggggacacccggcgaggggctgggacggtgcagtcatgccttgatcagaggggtgccagaatccctggcttccggagaaggggcgggcgcagggcttcccgctctggacctcgcaaaggcccagcgtgaacacggagtcctgggcgggaagctgaggcagcgcttaggtctccaacttttggagctgcctccagaagagagcctcccccttggtcccctgctgggagatacagccgtcatacagggtgacacagcgttgattacccgcccatggtcgccagccagaaggcccgaggtcgatggagtgaggaaagcactgcaggatctggggctgagaatcgtcgaaatcggagacgagaacgcaaccctggacggaacagatgtgctttttaccggccgagagttctttgtcgggcttagcaaatggacaaaccaccgcggagcagaaattgtggcagacacattcagagattttgcagtgtcaacggtgccggttagtgggccatcgcatctcagaggtctttgcggtatgggagggccgcggaccgtagtcgcaggcagctctgatgctgctcagaaggcggtgcgggcgatggccgtgctaactgatcacccttacgcgagcctaacgctgcccgatgacgccgctgcggattgcttgttcctcaggcccggtctgcccggcgtcccgccgtttctgctgcactag

SEQ ID NO: 114653 - DNA, 2601 bp, Artificial Sequence
  Description of Artificial Sequence: Synthetic coding sequence
atgctcaggcccggcgcccagcttttaagggggcttctgctaaggtcttgtcccttacagggatctcctggcaggccgagaagcgtctgtggaagggagggggaggaaaagccccctctctccgccgaaacccaatggaaggacagggctgagacagtgatcattggcggtgggtgtgtgggcgtgtccttggcataccatctggccaaggcaggaatgaaggatgtggtgttgttggaaaagtctgagctgaccgccggatctacatggcacgcagccggtttaacgacctatttccaccctggcatcaatctgaaaaagattcattacgactccataaaactctacgagaagctcgaagaggagaccggacaggtggtgggcttccatcaaccaggatctattcggctggccaccactcctgtccgagtcgacgaatttaagtaccagatgaccagaacgggctggcatgcaacggaacagtacttgatcgaaccagaaaaaatacaggagatgtttccactcctgaatatgaataaagtactcgctgggctatataaccccggtgatgggcacatagatccctatagcctcacaatggctctggctgctggggcaaggaagtgcggcgcccttctgaaatacccagctcctgttacatcactgaaagcgagaagtgatgggacctgggatgtcgaaacaccacaagggagtatgcgagccaatcgcattgtgaatgccgcaggtttctgggctcgggaggttggaaagatgataggactggagcatccattgatccctgtgcaacaccagtatgtcgttacctctaccatctctgaggtcaaagccctgaagcgcgagctccccgtccttagggacctcgagggctcctattacttgagacaggaaagagatggcctactgttcggaccttacgagtcccaagaaaaaatgaaagtccaagattcttgggtcactaacggcgtcccacctggattcggtaaggagctattcgaatcggacttggatagaatcatggaacacatcaaagcggctatggagatggtgcccgtgctgaaaaaagccgacattataaacgttgtgaatggacctatcacttattccccagacatcttgccaatggtcggacctcaccagggagtgaggaattactgggttgccattggatttggctacgggattatccacgccggaggagtgggcaaatatctatctgattggatcctacacggcgaaccacctttcgacctgatcgagctcgatccgaaccgctacggcaaatggacaacgacccagtataccgaggccaaggctagggaatcctatgggttcaacaatatcgtaggataccccaaggaagagcgttttgcggggcgcccaacccagcgcgtgagcggcctctaccagcggttggagagtaagtgttccatgggctttcacgctggatgggagcagccgcattggttttataaacctgggcaggacacgcagtataggcccagcttcagacgaactaattggtttgagcctgtagggtccgaatacaagcaggttatgcagcgagtagctgttactgatctgtcacccttcggcaagtttaacatcaaggggcaggatagcatccgtttgctagatcacctgttcgccaatgtaattccaaaagtcggctttaccaatattagccacatgttgacgcctaaaggccgggtgtacgctgagcttaccgtgagtcatcagtcccccggggaatttctgctcatcacaggtagtggctctgagctccatgaccttaggtggattgaagaggaggccgtgaagggcgggtacgatgtggaaatcaagaacatcactgatgaactcggagtcctgggggtggccgggccacaagccagaaaagtcctccaaaaactcacttccgaggatttgagcgatgatgtgtttaaatttctccaaactaaaagtctgaaggtctcaaatatccctgtgacggccattcgcatcagctacacaggtgagctcggatgggagctgtaccaccggcgggaggactccgttgcgctctatgacgccataatgaatgccggacaggaagagggtatcgataattttggaacttacgcaatgaatgccttgagactcgagaaagccttccgtgcgtgggggttggagatgaattgcgacacgaaccctttggaagcaggactggagtactttgtgaagctcaataaaccagccgattttattgggaagcaggcactaaagcagattaaggccaaggggctgaagaggcggctggtgtgcctgacactggcaactgacgacgttgatccagagggaaatgagagcatttggtataatggcaaggtggtcggcaatactaccagcggctcctactcctatagtatccagaaatccctggcctttgcctatgtgccagtgcagctttctgaagttgggcaacaagtggaagtcgagcttcttgggaagaattaccccgctgtgatcatacaggaacctctggtgctcacagagccaacccgcaatcgtttgcagaagaaaggcggtaaagacaaaacatag

SEQ ID NO: 114654 - DNA, 1722 bp, Artificial Sequence
  Description of Artificial Sequence: Synthetic coding sequence
atggagcggcagtctcggaatagtgataattggcgttggctgtgctggtgcgaatccggcctgtcacccgggcagagcagggacgagaggtgtggtcccgctggtgaaatccgagcgcatggatggatttatttagcccggaggttttgggccagagaggtgggtaagatgattggtttagagcacccgcttatccctgttcagcaccaatacgtggtcactagcaccataagcgaagttaaggctctgaaaagggagttgccggtactgcgggacttggaaggctcatactacttgcgccaggagcgtgatggactactctttgggccctatgagagccaggaaaagatgaaggtgcaggattcctgggtgaccaatggtgtgcctccagggtttggaaaagaactgttcgaaagcgaccttgaccggattatggagcacattaaagcggcaatggaaatggtgccagttctgaaaaaggccgatatcattaacgtagtgaacgggccgatcacatacagccctgatatcctgcctatggtcgggccgcatcagggcgtgagaaactactgggtggccatagggttcgggtatggtattatccacgcaggaggagtcggaaagtatctgagcgattggattctgcacggagaacccccctttgacctgatagaacttgaccccaaccggtacggcaaatggacaactacacagtatacggaagctaaggcgcgggagtcgtacggcttcaacaatatcgtcggttaccccaaggaggaacgctttgcagggcgtccaactcagcgggtgagtggcctgtaccagcgcttggaaagcaagtgttctatgggctttcatgcaggctgggagcagcctcactggttctataagcctgggcaagacactcagtaccgcccttccttccgcagaaccaattggtttgagcctgtggggtcggagtataagcaggtaatgcagcgagtggccgttaccgacctgagtcccttcgggaaattcaatatcaagggacaagattccattcgtttactggaccacctgttcgctaatgtgatacctaaggttgggttcaccaacatttcccatatgctgacgcctaaagggcgggtgtacgccgaacttactgtgtcacaccagagcccaggcgagtttctactgatcactggatccgggagtgagcttcacgacctgaggtggattgaggaggaggccgttaagggggggtacgatgtggagatcaaaaacatcaccgacgagttaggagtgttgggggtggcgggcccccaagctcggaaagtgctgcagaagttgactagtgaggatctgtcagatgacgtcttcaagttccttcagaccaagtcactaaaggtcagcaacatccctgtaacagctatccgcatcagttataccggcgaactgggatgggagctctaccacagaagagaggacagcgtcgcgctgtatgacgcaataatgaacgcagggcaggaagaaggcattgacaactttggcacttatgccatgaacgctttgaggctcgagaaagctttccgggcctggggtctggaaatgaattgcgatacaaacccattggaggctggactagaatactttgtgaaattaaacaaggaccagaatagctgcttcgctcatttcaaagaagagaacggttgggtgtctcggtgggccatccgtccctattag

SEQ ID NO: 114655 - DNA, 1842 bp, Artificial Sequence
  Description of Artificial Sequence: Synthetic coding sequence
tacttgatcgaaccagagaaaatacaggaaatgttcccgcttcttaacatgaataaggtcctcgctggactgtacaatccgggcgatggacatattgacccatacagcctcactatggctctcgcggcgggagctaggaagtgcggggcactcctgaaatatcctgcccccgtaacaagcttaaaggcaagatccgatgggacctgggatgtcgagacacctcaaggctctatgcgcgccaatcgcatcgtgaacgccgccggcttctgggcacgtgaggttggcaagatgatcggcttggagcatccccttatcccagtgcagcaccaatatgttgttacatccaccatttcagaggtaaaggccctcaagcgcgagctcccagtattgcgcgatctcgaggggtcttattatctcaggcaggagcgagacggcctgttatttggaccttatgagtcccaagagaagatgaaagttcaggatagttgggttaccaacggggtgccgcccggcttcggaaaggaactctttgagtcggacctggaccggattatggaacacatcaaggcggcgatggagatggttcctgtgctgaaaaaagcagacattatcaatgtggtgaatgggcccataacatattccccagacatcctacccatggttggaccacatcaaggcgtcaggaattactgggtggctattggctttggttatggtatcattcacgctggtggggtgggcaaatacttgagtgactggattctgcatggggaacctccctttgatttgatcgagttagacccgaacagatacggaaaatggactaccacccaatacaccgaggccaaggctcgcgagtcttacggctttaataacattgtgggttatccaaaagaggaacggtttgcaggccgcccgacacaacgtgtgagcgggctctatcaacgactggaatctaagtgcagcatgggattccacgccgggtgggagcaaccgcactggttctataagcctggacaggatacacagtatcgccctagcttccgccggacaaattggttcgagcccgtaggctccgagtataagcaagtgatgcagagggtcgcagttacagacctgagccctttcggaaagtttaacatcaagggacaggacagcatcagattgcttgatcatctcttcgcaaatgtcatccctaaagttggtttcactaatatctcccatatgctgacaccaaagggtcgcgtatacgccgaacttaccgtatcccaccagagtcctggagaattcttacttattacaggttccggaagtgagcttcatgacctgcggtggatcgaggaagaggcggtaaagggtgggtacgacgtagagattaaaaatatcacagatgagctaggtgtcttaggtgtagccggcccgcaggcaaggaaagtgcttcagaagttgacatccgaagacctgtccgatgacgtgttcaagtttctccagaccaagtctctgaaagtgagcaatattcctgtgacagcgattcgaattagttatacaggtgagttgggctgggagctgtatcataggcgcgaggattctgtggctctgtacgatgccataatgaatgccgggcaggaagaaggaatcgacaattttgggacttatgctatgaatgcgctgagactggaaaaagcttttcgtgcttggggattggagatgaattgcgataccaaccccttggaggccggccttgagtattttgtcaagttgaacaaggaccagaatagttgctttgctcattttaaagaggaaaacggatgggtctcacgttgggcaatccgcccgtattag

SEQ ID NO: 114656 - DNA, 1875 bp, Artificial Sequence
  Description of Artificial Sequence: Synthetic coding sequence
atgacaaggacaggatggcatgccaccgaacagtatctgatcgaaccggaaaagattcaggaaatgttcccactgctcaatatgaataaggtgctcgccggtctttataatcctggggacggccacattgacccgtattctttgaccatggccctggccgctggcgctagaaaatgcggcgccctgctaaagtacccggccccagtcaccagcctaaaagccagaagcgacggaacatgggacgtggagaccccacagggcagtatgcgagccaatagaatcgtgaacgcggcagggttctgggcacgcgaggtggggaagatgatcggcctggagcatccacttattcccgtgcagcaccagtatgttgtcacctctacaatttccgaggtgaaagccttgaagcgcgaactgcccgtactgcgagacctcgagggttcctattacctgcgacaggagagggacgggttactgttcgggccttacgagtcacaagaaaaaatgaaggttcaggattcttgggtgaccaacggcgtgcccccgggatttggaaaggaattgtttgaatccgatctggaccgtataatggaacacataaaggctgccatggagatggtgcccgtgctcaagaaggccgacatcatcaatgtggttaacggtcccatcacttacagcccggatatcttgcccatggtgggccctcaccagggagtgcgcaactattgggtggcgattgggtttgggtatgggatcatccacgctggcggcgtgggcaagtatctcagtgattggattctgcacggcgaacctccgtttgacctgatcgagctggatccaaatagatatggaaaatggaccaccacacagtatactgaggcaaaggcccgggagagctatggttttaataatattgtcggataccccaaagaggaacggttcgctggccgaccgactcagcgggtttcagggctctaccagagactggaaagcaaatgttctatgggtttccatgctggatgggagcagccacactggttttacaaacccggtcaagatacacagtaccgcccttcttttcgacgaaccaactggtttgagccagtcggctctgagtataagcaggtcatgcaaagagtggcagttacagacctgagccccttcggcaagtttaatattaaaggccaagactcgattcggctgttggaccacttgtttgcaaatgtcatccccaaagtgggcttcactaacatctctcatatgctgacgcctaaaggaagagtatacgctgagttaactgtgtcccaccagtcacccggtgagtttctgctgatcaccggatccggttcggaactgcatgacctccgctggatagaagaggaagcagtcaaggggggatatgacgtggagatcaagaatatcactgatgaattaggcgttcttggagtggccggccctcaggcaagaaaagtcctgcaaaaacttaccagtgaggacttgtcagatgatgttttcaaattcctgcagactaaaagtctgaaggtgtctaacatccccgtgaccgccataaggataagctacactggcgagcttggctgggagttgtatcacaggcgtgaggatagcgtggctctgtatgatgctatcatgaatgcgggacaagaagaagggatagataacttcggaacctatgctatgaatgctctccggctggagaaggcgtttcgggcttggggtctcgagatgaattgtgacaccaaccctctcgaggctgggcttgaatattttgtaaaactgaataaggaccagaactcgtgctttgcccactttaaagaggaaaacgggtgggtctcaaggtgggcgatcagaccgtattag

SEQ ID NO: 114657 - DNA, 1185 bp, Artificial Sequence
  Description of Artificial Sequence: Synthetic coding sequence
atgtggagttgctggcggaatcagtcaagtagactcgatctgcctggcacccagtatgggattatccacgcgggcggggtgggaaagtacctgtccgattggattctccacggagaaccgccatttgatctcattgagctggacccaaaccggtacggcaagtggaccaccactcagtacaccgaagctaaagctcgggagagttacggtttcaacaatatagtcgggtaccctaaggaggagcggtttgctggtagacccacacagcgcgtcagtggcttataccaaaggttggagagtaaatgctcaatggggtttcacgccggatgggaacagcctcactggttttataaacctggccaggatacccagtaccggcctagcttcaggaggaccaattggttcgagcctgttggctccgagtataagcaagtcatgcagcgggtggccgtgacagacctgtctcccttcggcaaatttaacattaaaggacaggatagcatcaggttgctggaccacctcttcgccaatgtaatccccaaggtagggtttacgaacatatctcatatgctgacccctaagggccgcgtctacgcagagctgaccgtaagtcatcagagcccaggcgagtttttgctgatcacgggctcaggctcagagctacacgatctgaggtggatagaggaagaagcggtaaaaggcggatacgacgtggagatcaagaacataaccgatgagctcggtgtcctgggtgtggcggggccacaggctaggaaggtgttacaaaagctcacttcagaggacctgtctgacgatgtgtttaagttcctgcagaccaagagcctgaaggtgtccaatataccagtcacggccattcgcatcagctacaccggtgagctcggatgggaactttaccacaggagagaagattccgtggccctctacgatgcaattatgaacgcagggcaggaggaagggattgataacttcggaacctacgcaatgaacgctctccgtcttgagaaagccttccgggcgtggggtctcgagatgaactgtgacaccaaccccctggaggccggactggagtacttcgtgaaactcaataaagatcaaaactcctgctttgcacattttaaagaggagaacggctgggtctccagatgggccatcagaccatattag

SEQ ID NO: 114658 - DNA, 4731 bp, Artificial Sequence
  Description of Artificial Sequence: Synthetic coding sequence
atggcagaacgcggtcttgaacccagccctgcagcagtggctgccctgccgccagaagtccgggcgcagctcgctgaattggagctcgaactctctgaaggagatatcacacaaaaaggatatgagaagaagaggtcaaaacttctgtctccctattctcctcagacacaggaaaccgactccgctgttcagaaggagctgcgcaaccagacacccgctccatcggcggcgcagacaagcgcccccagcaagtaccacaggacccggagcgggggggcgagagacgagcgataccgctcagatattcacacagaggctgtgcaagctgccctggccaaacacaaagagcagaagatggcactgcctatgccgactaagagaagaagtacatttgtccagtcgccagctgacgcatgcactcctccagacacatccagtgcctcagaagacgagggaagccttagacgccaggccgccctctccgccgctcttcagcagtcactgcagaacgccgaatcgtggattaacaggtccattcaggggagcagcacctcttcttccgcctctagcaccctgtctcacggcgaagtcaaaggtacctccggctccctggccgacgtcttcgccaacacacgcattgagaatttctcggcgcctcctgatgtgactaccacaacttccagctcgtcttcatcgtcttctatcagaccagcaaatatcgatctgcctccatcaggcattgtgaaaggcatgcataaaggatccaaccggtctagcctaatggacaccgccgacggagtgcctgtgagctcacgagtttccacaaagattcagcagttattaaatactttgaagcgcccgaagcgacccccgttaaaagagttcttcgtggatgattccgaggaaatcgttgaagtcccgcaaccagaccccaatcagcccaaacctgagggaagacaaatgactcctgtgaaaggcgagccacttggagttatttgtaactggccccccgccctggaatccgccctgcagcggtggggaacaacgcaggcaaaatgctcctgcttaaccgcactggatatgacgggcaaaccagtctataccctgacgtacggaaagctgtggtctcggtccctgaagttggcatatacgcttctaaataagctcggcacgaaaaatgaaccagtgctcaagcccggggatagagtggccctggtctatcccaacaacgatccagtgatgtttatggtggctttctacggatgcctgctggctgaggtgatccctgtccctatagaggtccccctgacacgaaaagacgccggcggccagcagataggatttctgctgggctcttgcggtatcgcactggctctgacatcagaagtttgtctgaaaggtctccctaaaactcaaaacggagaaatcgttcagtttaagggttggcccagactgaaatgggtggtaacagactcaaaatacctctccaaacctccgaaggattggcagcctcacatttctccggctgggacagagccagcctatattgagtataagacgtccaaagagggcagtgttatgggggtgactgtctcaaggctggccatgctgagccattgccaggctttgtcccaggcatgtaattatagtgagggcgagacaatcgtcaacgttctggattttaaaaaggacgccggcctgtggcatggcatgttcgccaacgtgatgaataaaatgcacaccatcagcgtcccctactcagtcatgaagacctgccctctttcttgggtacagcgcgtgcacgcacacaaagctaaagtggctctagtcaaatgccgcgacctgcactgggccatgatggctcaccgggatcaaagagacgtgtctcttagctctctgaggatgttgatagttaccgatggcgcgaacccttggtcagtgtcctcatgcgatgctttcttgtccctattccagtctcacggtttgaaacctgaagcaatctgtccttgcgccacgagtgccgaggcaatgaccgtcgccatccgacggcctggcgtcccaggggcgcctctacctgggcgggctatcctgagcatgaatggcttaagctacggggttatcagagtaaacaccgaagataagaactctgccctgacagtgcaggacgtcggacacgtgatgccgggcggaatgatgtgcatcgtgaagcccgacggaccgccacagctctgtaagacagatgaaataggggagatatgtgtgtccagcaggactggtggtatgatgtatttcggccttgcaggcgtgaccaagaacacgtttgaagtcatccctgtaaacagcgctggttcccccgttggggatgtcccctttatcagaagcggactgctgggttttgtcgggccaggctctcttgtgttcgtggtcggaaagatggatggtcttctgatggtatcagggagaaggcacaatgccgacgatatcgttgctaccgggctcgctgtggaatccatcaagacggtgtatcggggaagaattgccgtcttctcagtgtctgtcttctacgatgagagaattgttgtcgtggcagagcagcggcccgatgctagtgaagaagactctttccaatggatgagtcgggtcttgcaggctattgactcaattcaccaagttggagtctactgcctagctttggtgcctgcaaacactctgcccaaaacccctcttggagggatccacatttcccagaccaagcagttattcctggagggcagcctgcacccctgcaatatcctcatgtgcccccacacctgtgtcactaaccttccaaagcctagacaaaagcaacctggagtcggacctgccagtgttatggtcggcaacctggtggcaggcaaacgaatcgctcaggccgccggtcgcgaccttggacagatcgaggaaaatgatctggtcagaaagcaccagtttctggccgagattcttcagtggcgggcccaggctacacccgatcacgttctcttcatgctgcttaatgccaaagggactacagtgtgtaccgcatcttgcctccaattgcacaagagagctgagcggatcgcctcagtgttgggtgataagggtcacctgaacgccggcgataacgtggtgttgttgtacccaccaggtattgagctgatagctgccttctatggctgcctgtacgcagggtgcatccctgtcactgtccgacccccccacgcccaaaaccttaccgcaacactccccaccgtgcgcatgatagttgatgtgagcaaagctgcatgtattctcacctcacagaccctgatgaggttactgagatcacgagaggcggctgctgccgtcgacgtaaagacctggcctactataatcgacactgacgatctgcctcggaaaaggcttccccagctatataaacctccgactcctgagatgctggcctacttggatttcagcgtttcaacgaccggcatgctgaccggggtcaagatgtcacactccgctgtgaacgctttatgcagggccattaaactgcagtgtgaactctacagttctcggcagatcgcaatttgtctagacccttattgtgggctggggttcgccctatggtgtctttgctcggtatattctggacatcagagcgtactgataccccctatggagctcgagaacaaccttttcctgtggcttagtaccgtcaaccagtacaagatcagagatacgttttgttcttacagcgtcatggagctatgtacgaagggattgggaaatcaagtggaggtactgaagaccagaggtattaacctgtcatgcgtgcgcacctgtgttgttgtggcggaggaacgtccccgcgtagcactgcaacagtcattcagcaagctgttcaaggatataggcctgtcccctagggcagtttctactacttttggctccagagtaaatgttgccatatgtttgcagggcacgtctggacctgatccaacaaccgtctacgtcgatctgaagtccctgcggcatgatcgcgtcaggctggtagagcgtggcgccccccagtccctgctgctctccgaaagtggtaagattcttcctggagtgaaagtggtcatcgtaaatcccgaaaccaagggaccggtgggcgattcccatctgggggaaatctgggttaactcgccccacaccgcatctggctactacacaatttatgactccgaaacgctccaggccgaccatttcaatactaggttgtctttcggtgacgccgcccagacgctgtgggcccgaactgggtacctggggttcgtgcgtcgcaccgagctgaccgctgcgaccggagaacggcatgacgcactctacgtcgtgggtgctctggacgaaaccctcgagctgcggggcctacggtaccatccaatcgacatcgagaccagcgtaagccgcatccatagatcgatcgcagaatgtgctgtcttcacgtggacaaatttacttgtagtcgtggtcgaattgtgcggatcagaacaggaggcactggaccttgtgcctctggtaactaacgtggttctggaggaacattatctaattgtcggggtggtagtggtggtggatcccggagttatcccgatcaatagtaggggtgagaaacaaagaatgcatcttagagactcgttcctggctgaccagcttgatcccatctacgtggcatacaacatgtag

SEQ ID NO: 114659 - DNA, 1179 bp, Artificial Sequence
  Description of Artificial Sequence: Synthetic coding sequence
atggcagaacgggggctggaacctagccccgccgccgtggcggcacttcctccagaagttcgcgcgcagttggctgaacttgagttggaacttagcgagggcgatataactcaaaagggatatgagaagaagcgctctaaactgctgagtccctatagcccccagactcaggaaactgattcagcagttcaaaaggaactccgaaaccagacccccgcccccagcgccgcccaaacaagcgctcctagcaaataccaccggacgagaagcggtggggctcgcgacgagcggtatcgaagcgagttttcactagtccgcatctactcagaagatatccacactgaagccgtacaggcggcactcgcaaaacacaaggagcaaaaaatggctctgccaatgccaaccaagcggaggtcaacattcgtccagagccctgctgatgcctgcaccccacctgacacgagcagtgccagtgaggatgagggctccctaaggagacaggcagccctttccgcagctctgcaacagagcctgcaaaacgcggaaagttggatcaatcggagtatccagggatccagtacgtcgagctccgcgtcctcaactctcagccacggtgaagtgaaaggcacatccggatctctggccgatgtgttcgcaaataccagaattgagaatttttcagcacctccagacgtgaccaccaccacgtcaagctcttccagcagcagtagcatccggccagctaatattgatttacccccatcaggcatagtcaaaggtatgcacaagggcagtaacaggagttcactgatggacaccgcggacggcgtgcctgttagctctcgtgtgtccaccaaaattcaacagttgctcaatactctaaaaagaccaaagagaccacctttgaaagaatttttcgtggacgactccgaggaaatcgtagaagtgccccagcccgaccctaaccaaccgaagccagaggggagacagatgacccccgttaagggcgaaccattaggggttatttgcaactggccacctgcactcgagtccgccctgcagagatggggcaccacccaggccaagtgttcctgcttgacggcgctggatatgaccggtaaaccagtatacaccctcacttacggtgaatctgcccgatttcagattctactgagttag

SEQ ID NO: 114660 - DNA, 4671 bp, Artificial Sequence
  Description of Artificial Sequence: Synthetic coding sequence
atggccgacagaagtctggaggggatggcccttccactagaggtgcgagccaggctggctgagctggagctcgagctgagcgagggagacatcactcaaaagggctatgagaaaaaaaggagtaaactgatcggtgcttatctgcctcagcctccaagagtggatcaggccctccctcaggaaaggagggcccctgtaacccccagctccgccagccgctaccacagacgccggtcttccggatcccgagacgagagatatagaagtgacgttcatacagaggcagttcaggctgccttggcaaagcataaagagagaaagatggccgtgccgatgcctagcaaaagaagatctcttgtcgtgcagacatccatggatgcgtatacaccgccagatacaagttctgggagtgaggacgagggcagcgtgcagggcgacagccagggcacaccaacatcatcccaagggtcgatcaacatggaacactggatcagccaggcgatccacgggtctaccactagcaccacaagttcctcttcaacacagtcaggcggatccggagccgcccatcgtctggccgacgtcatggcccagacacatatagagaaccactcagccccaccggatgtcacaacatatacgtccgagcactccatccaagtagagcgccctcagggatcaactgggtctaggacagccccgaagtacggaaatgccgaactgatggaaacaggcgatggcgtcccagtgtctagccgggtctcggccaaaattcagcaactggtgaacacactgaaacggcccaaacggcctcctctgcgcgagttttttgtggatgacttcgaggaattgctggaggttcagcagcctgatccgaaccagccaaagcctgagggggctcagatgttagctatgcgtggagagcagttaggcgtagtaacaaactggcccccaagcctcgaggcggcacttcagcgttgggggaccattagcccaaaagccccttgccttacgacaatggataccaacgggaaacctctctacattctgacatacggcaagctgtggacccggagtatgaaagtcgcctattcaatcctgcacaagctgggaacaaagcaggagcctatggtccggcccggtgacagggtcgccctggtcttcccaaacaatgacccagccgccttcatggcagccttctatggctgcctgctggctgaggtagtcccagttccaattgaggtgcccctgacccggaaggatgctggcagtcaacagattgggtttttattaggatcctgcggggttaccgtggctctgaccagtgacgcctgtcataagggcctgcccaagagtcctaccggggaaatcccgcagttcaaaggatggccaaaactgctctggttcgtaactgaatccaaacatttgagtaagcctccgagagactggtttccccatattaaggatgctaataatgacaccgcttacatagagtataaaacttgtaaggacggtagcgttctgggtgtaacagtcacgagaaccgcactcttaacccattgccaggccctgactcaggcttgcgggtacacggaggccgaaaccattgtaaacgtgctggacttcaaaaaggacgtcggtctgtggcatgggattctaacttctgtgatgaacatgatgcatgttatcagcattccctatagcctgatgaaggtcaatccactatcctggatccaaaaggtatgccagtacaaagctaaggtggcatgtgtcaaatctagagacatgcattgggccctagtagctcaccgcgatcagcgggacatcaatctatccagcctgcgcatgctgattgtagccgacggggccaacccctggagcatttcttcgtgcgatgccttcctcaacgtttttcaatccaagggcttgcggcaggaggtcatctgtccctgtgcctcctcccccgaagctttgaccgttgctatcagacggcccacagacgatagcaaccagccacccggcagaggcgtattgagcatgcatggactgacttacggcgtcattcgagtcgacagcgaagaaaagctatcggtcttaactgtgcaggacgtgggcctggttatgcccggggccattatgtgctccgtgaaacctgacggggtgcctcagttgtgccgcacagacgagatcggtgagttatgcgtttgtgcagttgccacgggaaccagctactatggtctgtctgggatgaccaaaaacacatttgaagtcttcccaatgacaagcagcggcgctcccatttccgagtacccatttattaggacgggtcttttggggttcgtgggccctggcggcttggtcttcgtggtcggcaagatggatggtttgatggtcgtaagtggccgcaggcataatgcggacgacatagtagccacagccctggcagtggagcctatgaagttcgtataccgagggcgtatcgctgtattttctgttaccgtattgcacgatgaacggatcgtgatagtcgctgagcaacgccctgactccacagaggaggactccttccagtggatgtcaagagtccttcaggcaatagacagcatacatcaggtaggagtttattgcctggcacttgtcccagcaaatactctccctaaaacccctctgggaggaatccacctctctgagaccaagcagttgttcctggagggttctctgcacccttgcaatgtcctgatgtgtcctcacacttgcgttactaatcttcccaagcctcggcaaaaacagcccgaaattggtcccgccagcgtaatggtggggaatctggtgagcggaaagaggattgctcaagcttctggtcgcgatttggggcagatcgaggataacgatcaagcgcgaaagttcctgtttctgagtgaggtgctacagtggagagcgcaaactacccccgaccatattttatacacgctcctcaactgcagaggcgcaatcgctaactccctcacatgcgtgcaactgcacaaacgtgcagaaaagatcgcagtgatgttgatggagaggggacatctgcaagatggggatcacgtggccttggtttacccccccggaatagatctgatcgcggccttttacgggtgcctttacgctggatgcgtgccaatcaccgtgcggccccctcacccccaaaatattgcaactacattgcccacagtgaaaatgattgtagaagtgtcgcgaagcgcctgcctgatgactacacaactcatatgtaagttgcttaggtcgagggaggccgcagctgcagtggacgtgcgcacatggccccttattctcgataccgacgatctgccaaagaaacggcccgcgcagatatgcaagccctgcaatcctgacaccttagcgtacctcgacttctcggtgagcacaactggcatgctggcgggggtcaagatgagccatgctgccacctctgcattttgcaggagcattaagttgcagtgcgaattataccccagccgggaagtggctatctgtttggatccatactgcggtctgggtttcgtattatggtgtctatgtagcgtctattccggacaccagagtatccttatcccaccgagcgagctagaaacaaaccccgctctgtggctccttgcagtgagccaatataaggtgcgcgacacattttgttcttactctgttatggaactgtgtacaaagggcttgggaagtcagacggaatcattaaaggcaagggggcttgacttaagtcgggtaagaacctgcgtggtggtcgccgaggaacgccctaggatcgccctaacacaaagcttttccaaattgtttaaggatctaggactgcaccccagggcagtgtccactagcttcggctgccgagtcaatctggctatttgccttcaaggtacgtcgggcccggacccaaccaccgtgtacgtggacatgagagctttgagacatgacagagtgcgactggttgagaggggcagcccccattccctgccactcatggagagcggtaagatactgccaggggtgaggattataattgctaacccagaaactaaaggcccccttggtgactctcatctcggcgagatttgggtgcactcagctcataacgcgtcaggctatttcacaatctacggagacgaatcattgcaaagtgatcatttcaatagtaggctcagcttcggggacacacaaaccatctgggccagaacgggatatctcggattcttacgacggacagaactcaccgatgcaaatggtgagaggcacgatgctctttacgttgttggcgcgctggatgaggccatggagttacgagggatgaggtaccatccaatcgatattgagacttcagtgatacgggcgcacaagtccgtgactgagtgtgcggtttttacatggactaacctcctggtggtggtggtcgaactcgatgggtcagagcaggaagctttggatttggtcccgctagtgaccaatgtggtcctggaagaacattaccttattgtcggcgtagtcgttgtggtcgatatcggcgtcattcccataaatagtagaggggaaaaacagcgcatgcacctgcgcgacggctttctggctgatcagctggatccgatctatgtcgcctataacatgtag

SEQ ID NO: 114661 - DNA, 1971 bp, Artificial Sequence
  Description of Artificial Sequence: Synthetic coding sequence
atggcagttcctatgccgtccaagcgccggtcactggtggttcaaacctcaatggacgcgtacacacccccggatacatccagtgggtcagaggatgagggatctgtgcagggagacagccagggcaccccaacctcatcacagggttccatcaatatggaacattggataagtcaagctatccatggctccacaacatctaccacctccagtagctccactcagagcggcgggagtggagctgcgcatcgcttggctgacgttatggcccagacacacatagagaatcactccgcaccacccgacgtcacaacatacacctccgagcattcaatccaggttgagagacctcagggtagcacagggtcaaggacagcacctaaatatggtaacgcggaactcatggagacaggagatggcgtacctgtctcgtctagggtgagcgccaaaatccagcagctggtgaataccttgaagaggccaaaaagacctcctctacgcgagttcttcgtggatgatttcgaagagctgctagaagtgcaacagcctgaccccaaccagcctaaaccagagggtgcacagatgcttgctatgcgtggtgagcagctgggggtcgtgaccaactggcccccttcactagaagctgctctgcagcggtggggtacaatctcccccaaggccccttgcttgaccactatggacaccaatgggaagcctctctatattctgacttacggcaagctgtggacacgcagtatgaaagtcgcctattcgatcctccataagttgggtaccaagcaagaacccatggtacgccctggcgaccgggttgctctggtgttccctaacaacgaccccgcagccttcatggccgccttctacggttgtctgctcgcagaggttgtgcctgtgccaattgaagtccccctgacaaggaaagacgctggctctcagcagatcggtttccttttaggctcgtgtggagtgaccgtagccttaacctccgacgcctgtcacaagggactgccaaagagcccaacgggcgaaattccacagttcaaaggatggccaaaacttctttggtttgtgacagagagcaagcacctgagtaagcctccccgagattggttcccacatatcaaagacgctaataacgacacagcctatatcgaatataaaacctgcaaagacgggagtgtgctcggtgtaactgtcaccagaacagcactgctgacacactgccaggcacttacacaggcatgcggctacacagaggccgagaccatcgtgaacgtgctcgatttcaaaaaggacgtaggcttatggcacggtattcttacgagtgtgatgaacatgatgcacgtgatatctattccctattctctgatgaaagttaaccccctgtcttggatccagaaagtctgtcagtacaaggcgaaggtggcatgcgtaaagtcccgggacatgcactgggcactggtggcacaccgcgatcagcgggatatcaacctgtcgagcctgcgcatgctcatcgtggctgacggcgccaacccttggagcatctcctcttgtgatgccttcctaaatgtcttccaatcaaaaggactgagacaggaggtcatctgtccctgcgcctccagtcccgaggcactcaccgtggcaatacgccgaccgactgatgattcaaatcagcccccgggaaggggtgtgctctctatgcacgggctgacctacggtgtgattcgagtagattcagaagaaaaactgtcagtgctgactgtacaggacgtaggcctggtgatgcctggagcgatcatgtgcagcgtgaaacccgatggggtcccccagttatgcaggaccgatgagattggagagctgtgcgtctgcgcagtggcaacaggcacctcatactacggcctctctgggatgacaaagaatacgtttgagcacacaagtaacaaaggaaaatag

SEQ ID NO: 114662 - DNA, 597 bp, Artificial Sequence
  Description of Artificial Sequence: Synthetic coding sequence
atgtcccatgctgctacctccgccttctgccgtagcattaagctgcaatgtgagctctatccatcccgcgaggtggcaatatgcctcgatccatactgcggcctgggctttgtgctgtggtgcttatgttcagtgtactcgggacatcagtccatcctcattcctccatctgaacttgagaccaaccctgctttatggctgctggccgttagccagtataaagttcgggacacattttgcagctattcggtaatggaactctgcactaaagggctgggctctcagacagagagcctgaaggctaggggactagacttaagtcgtgtgagaacatgcgtcgtcgtggccgaagagcgtccccgcatagctctgacccagtccttctctaaactctttaaggacctcgggcttcatccaagagcggtgtcaacatcattcggctgccgggtgaacctggctatatgcctccagtgttgggattacagacacgagccacctaggcccgccccaaaatgctttaagatggtttacaaggagggggtgcgctccgtgggagaagacaagatcagagaaaaacgcacaaagacatggagatag

SEQ ID NO: 114663 - DNA, 696 bp, Artificial Sequence
  Description of Artificial Sequence: Synthetic coding sequence
taggagacgatcgtcaatgtgcttgactttaagaaggatgtcggcctctggcacgggattttgaccagcgtgatgaacatgatgcatgtgatctctattccctacagcctgatgaaagttaaccccctgagttggatccagaaggtgtgtcagtataaagctaaagtggcctgcgtaaagagccgggatatgcactgggcactggtagcgcacagagaccagagagacattaacctgtcctccttgagaatgctaattgtggcagacggggcgaacccctggtctatttccagctgcgacgcttttctgaatgtgttccagtccaaaggacttcgccaggaagtgatttgcccatgtgcaagttcaccagaggctctgaccgttgctatacgaagacccactgacgatagtaatcagcctccagggcgaggcgtactgtcaatgcatgggcttacgtacggagttattagagtagactcagaagagaagctctcagtgctcactgtacaggatgttggcctcgtgatgcccggcgcaattatgtgttcggtaaagccagatggcgtccctcaactgtgcaggacggacgagatcggcgaactgtgcgtgtgcgcggtagccaccggcacatcgtactatgggctgagcggcatgacaaaaaatacctttgaacacacctctaacaaaggcaaatag

SEQ ID NO: 114664 - DNA, 564 bp, Artificial Sequence
  Description of Artificial Sequence: Synthetic coding sequence
atggccgatcgcagtctagaggggatggcactgccattagaagtgagggcccggttagctgagctcgagcttgagcttagcgagggtgatatcacacaaaaaggatacgaaaaaaagcgctccaaactgattggagcctacctaccccaaccacccacagctaacggagcggctgttgtacgttgtcgcctgcaacatagcgaaggcgcgccaagacggacttttaggtccgcccacatcggcgtgtgcgatgtgcgagaggcagctgcccgagagagagttgcctcaactgccggtaatcgtccactattttattttcgatttggagtagaccaggccttgccccaggaacgcagggcgcccgtgaccccttcgtcggcttccaggtatcataggagaagaagctccggcagtagagatgaaagatataggtccgacgtgcatacggaagctgtgcaggctgccttagctaaacacaaagagagaaagatggctgtcccaatgccgtcaaaacgacgtagtcttgtcgtgcagacctctatggatgcctatacaccaccttag

SEQ ID NO: 114665 - DNA, 468 bp, Artificial Sequence
  Description of Artificial Sequence: Synthetic coding sequence
tgagtgtacagcggccatcagtccattttaattccgcccagtgagctcgaaacaaacccagccctgtggctgctcgcagtgagccagtataaggttcgggatactttctgcagctactctgtgatggaactttgcaccaagggattgggtagtcagactgagtcgctgaaagccagaggcctggacctttcgcgggtgagaacttgcgtggttgttgccgaagaaaggccaaggatagctttgacccagtcctttagcaaactgttcaaggatttaggactgcatccccgagccgtgtccacctcctttgggtgtagagtaaacctagcaatttgtttgcagtgctgggattaccgccacgaacccccaaggccagctcccaagtgttttaagatggtctacaaggaaggcgttagatctgtgggagaggacaagatcagagaaaaaaggacgaaaacgtggcgctag

SEQ ID NO: 114666 - DNA, 1446 bp, Artificial Sequence
  Description of Artificial Sequence: Synthetic coding sequence
atttgggtgagtagaagtgcgtgcctcatgactactcagttaatttgtaagctcctccgaagtcgcgaggctgcagcagcagtagacgtgcggacctggccgctaatcctggacacggatgacctccccaaaaaacgccctgctcaaatttgtaaaccatgcaatcctgacacactggcttatctagatttttccgtgtcaacgacgggaatgttagctggagtgaaaatgtctcatgccgccacgagcgcattctgtcgttccattaagctgcagtgcgagctgtatccatccagagaggtggcaatttgcttggacccgtactgcgggctcggctttgtcctttggtgtctttgtagcgtttatagcggccaccagtctattttgatacccccttctgaactcgagactaacccagctctctggctgctcgcggtctcacagtataaggtgagagacaccttttgctcatattccgtgatggagctgtgtaccaagggtctgggcagccagaccgaatctctgaaagcgcgaggtctggatctgagccgagtgaggacttgtgtagttgttgccgaagagcgtccgagaattgctcttacacagtccttttctaaattattcaaggacctgggacttcaccctcgggcagtaagtaccagttttggctgccgggtgaatctggccatttgtctgcagggtaccagcggacctgaccctactaccgtatatgtggacatgagagctctgcggcacgatagagttcgactggttgagcggggaagcccccactccttacccctgatggagagcggtaagatcctgccaggggtgcgcattattattgccaacccagagactaagggtcccctcggcgattctcacctgggtgagatttgggtccattcagcccacaacgcttctggttactttacgatctacggagacgagagccttcagagcgatcacttcaactcacgattaagcttcggtgatacacagacaatctgggctagaactggctacctaggcttcctccggcggactgagcttaccgacgcaaatggcgaaaggcatgacgcgttgtacgttgttggcgctctcgatgaagccatggagctccggggaatgaggtatcacccgattgatatcgaaacctctgtgattcgggcacacaaatctgttacggaatgcgccgtgttcacttggactaatctgctcgttgtggttgtggaactggatggctccgagcaggaagccctcgacctggtccctttggtgaccaatgtcgtcttggaagagcattacctgatcgtgggggttgttgtggtagttgatatcggagtgataccgattaattccaggggagagaagcagcgcatgcacttgcgtgatggatttctcgctgaccagctagacccaatatacgtcgcctacaatatgtag

SEQ ID NO: 114667 - DNA, 1116 bp, Artificial Sequence
  Description of Artificial Sequence: Synthetic coding sequence
atgcacggcctgacatacggggtgattagggtcgattccgaagagaaactgtcagtcctgacagtgcaggatgtcggattggtgatgcctggagccatcatgtgcagcgttaaacctgatggagtgccacagctttgtcgaacagatgaaattggcgagctgtgcgtatgcgcagtcgcaactggcacttcatactacggactatctggcatgaccaaaaatacctttgaggtgttccctatgacgtcatccggcgcccctattagtgagtatccctttatacgaactgggctgcttggtttcgtagggcccggtgggctggtgttcgtggtcgggaagatggatggcttaatggtggtgtcagggagacgacataacgcagatgacatcgtggccactgctttggccgtggaacctatgaagttcgtctatcgaggtcgaatcgccgtgttctctgtgaccgtgttacacgacgaacgaattgtcattgtggccgaacagagacctgattcaacagaggaagatagtttccagtggatgtctagagtgcttcaggccatcgactctattcatcaggtaggtgtgtactgtctggccctggtgccagcaaataccctgcccaaaacacctctggggggaattcatctctctgaaacgaagcagctcttcctggaaggcagtctccatccttgcaacgtcctgatgtgccctcacacatgcgtgaccaatcttccgaagccacgccagaaacagccagagattgggccggccagcgttatggttggtaacctcgtgagtgggaagcgcattgcccaagcttccggccgggacctgggacagatcgaggataatgatcaggcccgcaagtttctttttctttcagaggtactgcagtggcgcgctcagactactcctgaccacatattatataccctcctcaactgtagggtgcgccggggtgccgggctgccctggttgctggcttcacgcgggctcgcttggtttttaggtgccctcctcctgttgagcctaaatccgttcgcatccgtgctctgggaattttttctttgttttgcgatcttaactgaaacgtttgtcccaagggactgtttctag

SEQ ID NO: 114668 - DNA, 1236 bp, Artificial Sequence
  Description of Artificial Sequence: Synthetic coding sequence
atgtggtcaggttggtggctgtggcctttggtggccgtttgcactgccgatttcttccgtgatgaggctgagcgcattatgagagattcaccggtgatagacgggcacaacgacctgccctggcagctgctggatatgtttaacaatcgactccaggacgaaagagccaacctcaccacactggccggcacacataccaatatccctaaactccgggcaggtttcgtaggaggacagttctggtcagtctacaccccctgtgacacgcaaaacaaagacgccgtcagacggacattggagcagatggatgtggtccaccggatgtgccggatgtatccggagacttttctctacgttacctcttcggccggcatcaggcaggccttcagggaaggaaaggttgcctccctgatcggcgttgaaggaggccactcaatagactcttccctgggagtgctgcgagcactgtatcagctcgggatgagatacctgacactgacccattcatgtaataccccttgggcagacaattggcttgttgacaccggggactcagaaccccagtctcagggcttatctcccttcggtcaacgggttgtcaaggaattgaacaggctgggagtccttattgacctcgcccacgtaagcgtcgctactatgaaggcgactcttcagctatcgcgagctccagtgattttttcacactcctcagcttattccgtttgcgcaagcagaagaaacgtccctgacgacgtgctgaggctcgtcaagcagaccgatagcctggtcatggtgaatttctataacaactacatctcctgtactaataaagccaatctgagccaggtggctgaccacctggatcatataaaagaggtggctggcgcacgcgccgtgggattcggcggtgacttcgatggagtcccgcgcgttccagaaggcctcgaggacgtgagtaaataccccgatctgattgcagagctcctgcggcgtaactggactgaggccgaagtcaaaggggctctcgctgacaacttgttgcgggtttttgaagcagttgagcaggcttccaatttgacccaagcgcccgaagaagaacctatccctcttgatcaactgggaggctcttgcagaacccattatgggtattcgtcaggggcctccagcctgcaccggcattggggactgctgttggcaagcctggccccgctcgttctgtgcctgagccttttatag

SEQ ID NO: 114669 - DNA, 1236 bp, Artificial Sequence
  Description of Artificial Sequence: Synthetic coding sequence
atgtggtctgggtggtggttgtggcctttagttgctgtctgcacggctgacttctttagggatgaggccgagaggatcatgcgcgattctccagtcatcgacggtcacaatgaccttccgtggcagttgctcgacatgtttaacaaccgcctgcaggatgaacgtgctaacttaacaaccctggccggaactcacacgaatatccctaagctgagagctggctttgtcggaggacaattctggtccgtctacacgccatgcgacacccagaataaagacgctgtccgtcgcaccctggaacagatggacgtcgtgcatcggatgtgtaggatgtaccccgagacattcttgtatgttacatcatctgcaggtatccggcaggcatttagagaaggtaaggtagcctcccttattggagttgaaggcggtcactcaatagattcttcactaggggtgctacgggccctatatcaacttggcatgcgttatctcacactgacacattcttgcaatacaccatgggcggacaattggctcgtggacactggcgactcagagccacagtcccaggggctctcccctttcggccagcgtgtggttaaggaattgaatcgcctcggcgtgctcattgacctggctcacgtatccgtggcaacaatgaaagccactctgcagttgtcgcgagcccccgtaatattctctcacagctcagcttatagcgtatgcgcatctcggagaaatgtgcccgatgatgtcctcaggctagtcaagcagacagatagtttggtgatggttaatttctacaataactacatcagctgtactaacaaggccaatctgtctcaggtggcagaccacctcgaccatatcaaagaagtggcgggggcccgggccgtggggtttggaggggacttcgatggtgtgcctagggtgcccgagggcctggaagatgtctcgaagtatcctgatctcatcgcggaactcctcagacgaaattggactgaggccgaagtgaagggggcccttgccgataacttactccgagtttttgaggcagttgaacaggcttccaacctaactcaagccccagaagaagaacccattcccctagaccaactcggagggtcttgcagaacccactacggatactcttccggggccagctcgctgcaccgccattggggcctgttgctagcgagtctggccccgctcgtcctctgtttgtcgctgctgtag

SEQ ID NO: 114670 - DNA, 1236 bp, Artificial Sequence
  Description of Artificial Sequence: Synthetic coding sequence
atgtggagtgggtggtggctctggcccctggtcgcagtgtgtacagcagacttctttcgggacgaagcagagagaattatgagggattcccctgtgatcgatgggcacaacgatctcccttggcagctactcgacatgttcaataaccggttgcaggatgagcgggcaaatctgaccacgcttgccggtacccacactaatatccccaagctaagggccgggtttgtcggcggacagttctggtcggtctacactccttgcgacacccaaaataaggacgccgtcagaaggacgctggagcagatggacgtggttcacaggatgtgcaggatgtatccggagactttcctgtatgttacctcttcagctggcatccgtcaggccttcagagaaggtaaagtggccagtctgattggtgtggagggcggacactctattgacagttcattaggcgttctccgcgcattataccagttgggtatgaggtatctcaccctaacacatagttgcaacactccatgggcagacaactggttagtggacactggggactccgaacctcagtcccagggactcagtccgttcggccaacgggtcgtgaaggagctgaatagactgggggtcctgattgatcttgcccacgtgtcagtggctacaatgaaggccacgctgcaactgtcccgggctccggtgatcttttctcattcttccgcttattccgtgtgcgccagccggcgcaacgttcctgacgatgtgctccgacttgtgaaacaaaccgactctctagtgatggttaacttctataataactatataagctgcacaaacaaggctaacctttcccaggtggcggaccatctggatcacatcaaggaagtcgcgggtgcgagagccgttggctttggaggcgacttcgatggagtgccccgggtccccgaaggcttggaggatgtctcaaagtacccagatctgattgccgaactcctccgaagaaactggaccgaagccgaggtgaagggtgctctcgcagacaacctgctccgggtgtttgaggcagtggaacaggcctctaatctgacgcaggctcctgaggaagaacctatccctctggaccagcttgggggaagctgcaggacccattatgggtatagtagcggggcttcatccctgcatagacattgggggctactgctcgctagtctggcaccactggtcctttgcctcagcctgctctag

SEQ ID NO: 114671 - DNA, 381 bp, Artificial Sequence
  Description of Artificial Sequence: Synthetic coding sequence
atgcagccgtcaggcctagagggaccaggcacctttggtcgctggcccctgctctccctgctcctgttgctgttgttgctgcagccagttacctgtgcatatactacacctgggccaccccgagctctgactactcttggcgcccccagagcccacacaatgcccggcacatatgcccccagtacaacattgtcttctccctcaactcaggggctgcaggaacaggcaagggcactgatgagagatttccctctggtagacggttcaggtcaacccatgtgccatgcccggcccagaactggcatgccttgtgcctctccctggagccggctcacttcatacgctgcctgcgtgcctccaatattgagctggtccctctag

SEQ ID NO: 114672 - DNA, 1200 bp, Artificial Sequence
  Description of Artificial Sequence: Synthetic coding sequence
atgcagcctagtggtttggaaggacccggaacttttggcagatggcctctcctgagcctcctgctgctgctgctccttctccagccagtgacctgtgcatatactacgccggggcctcctcgggcattgttttggagtgcatacgtaccatgccagacgcaggaccgcgacgctctgcgacttaccctcgaacaaattgacttaatcagacggatgtgcgcatcatacagcgagctagagctagtgactagcgcaaaggccctaaatgatactcagaaactggcatgcctgatcggagtagagggtgggcacagcctggataattctttgagcattttacctacgttttacatgctgggcgttcgatacctcactctgacacatacctgcaacaccccttgggccgagtcaagtgctaagggagtccacagtttttacaataacatctctgggctcacggattttggagagaaggtagtagccgaaatgaacaggctgggaatgatggtggatctcagccatgtgtccgacgcggtggcaagaagagctctcgaggtctctcaggcaccagtgatttttagccattctgctgctcggggtgtgtgcaactccgcaaggaatgtgcctgatgatatcttacagctccttaagaagaatggcggcgtagtcatggtgagcctctccatgggcgtgatacagtgcaacccatccgccaatgtatccaccgtcgctgaccacttcgaccatattaaagctgtgatcggttccaagttcattgggatcgggggggattacgacggcgctggcaaattccctcagggactggaagacgttagcacatatccggtcttgattgaagagttgctgagcagagggtggagcgaagaggagctgcaaggtgtgctgcggggcaacctgctgagggtatttcggcaggttgaaaaggtgcaggaggagaacaaatggcaaagccccctggaagacaaatttccagacgaacagctgagctcaagctgtcactcagacctcagtagactgcggcagcgccagtcactgactagtgggcaggaattaacagagatcccgattcattggacagcaaagttaccagcgaaatggagtgtgtcagaatctagcccccacatggcgcctgtattggccgtcgtcgccacattccctgtgctgatcctctggctttag

SEQ ID NO: 114673 - DNA, 1461 bp, Artificial Sequence
  Description of Artificial Sequence: Synthetic coding sequence
atgcagccaagcggtctagaaggccccggtaccttcggccgctggccgttattgtcactattgttattgttgctgctgctccagcccgttacatgtgcatatacaactccaggaccgcccagagcactaaccacactgggagctccacgagcacataccatgcctggaacctacgccccttccacaaccttgtccagccccagtacccaagggttgcaggagcaggccagggcattaatgagagattttccactcgtcgacggacacaacgatctgccacttgtccttagacaggtgtatcagaagggcctgcaggatgtcaaccttaggaacttcagctacgggcagacctctttggaccggttaagggatggactagtgggggcacagttctggagtgcatatgtcccttgtcagacccaggacagagatgccctgcgactcactctggaacagatcgacctgatccgccggatgtgcgcaagctacagcgaacttgaactagtgacttctgctaaggccctgaacgacacacagaaactcgcttgcctgattggcgtagaaggaggtcactctcttgataattccctcagtatcttgcccacattctatatgctgggggtgcgctacctcactttgacacacacatgtaacacaccctgggcggagagctcagccaagggggtccatagtttttacaacaatatctccgggctgacagactttggtgagaaagtagtcgctgaaatgaacagattgggcatgatggttgatctgtctcacgtcagcgatgcagtggcaaggagggccctcgaggtctcccaggctcctgtcatcttctctcacagcgcagccagaggggtgtgtaatagtgctcgaaacgttcctgatgatattcttcaattgctgaagaagaatggcggagttgtaatggtctcactgagcatgggagtgatccagtgtaatcctagcgccaatgtgtcgacggtggcggatcatttcgaccatatcaaggccgtcataggaagtaaattcatcgggatcggcggcgactacgatggcgctgggaagttccctcaagggctggaggacgtctccacatatccagttttgatagaggagttgctgagtcgggggtggagcgaagaagagttacagggcgttctgcgaggtaacctgctgagggtgttcaggcaggtggaaaaggtccaggaggagaacaaatggcagtcaccactggaggataaattccccgacgagcaactgtcaagctcgtgccacagcgatctgtcgcgcctgcgccagcggcagagcctaacaagtggccaagaactcacagaaatccccattcactggacagctaaattgccagctaaatggtctgtcagtgagtcttcaccgcatatggcccccgtcctcgctgtagttgcaacctttcccgtgttaattctatggctctag

SEQ ID NO: 114674 - DNA, 1461 bp, Artificial Sequence
  Description of Artificial Sequence: Synthetic coding sequence
atgcaaccgtctggtttggaggggcctgggacttttggacgctggcctttactgagtctcctcctcttgttgctgctgcttcagcccgtgacgtgcgcctacaccacccccggtccgccccgggcactgactacgctgggcgcaccaagggcacatacaatgcccggcacatacgccccctcaaccacactgagcagccctagcacgcagggactgcaggagcaggcacgtgccctgatgcgagacttccctctggtcgatggccacaacgacctacccctggttttacgtcaggtgtaccagaaggggctacaggatgttaacctaaggaacttctcctacggtcagactagcctggatcgtcttagagacggcctcgtgggcgcccaattctggagtgcttatgtcccctgtcaaacacaagatcgcgatgctctacgcttaacgctggagcaaatcgatctgattagaaggatgtgtgccagttacagtgagttagagctggtgaccagtgcaaaggctctcaacgatacacaaaagctcgcttgcttgattggcgtcgagggggggcactccctcgacaatagtctgagcatcctgccaaccttttatatgctaggagttcggtatctcactctcactcacacatgcaacacaccatgggctgagtcatcagccaagggagttcattctttttacaacaacatctccggcctgaccgatttcggagagaaggtcgtggctgagatgaatagactggggatgatggtcgacctcagccacgtgtctgatgctgttgcccggcgggctctagaagtaagtcaggcccctgtcatattcagccactccgccgcgcgcggggtgtgtaactctgccaggaatgtgcctgacgacatcctgcagctccttaagaagaacggaggggtcgttatggtgtcactgtccatgggcgtaatccagtgtaatccctccgctaatgtgagcaccgttgctgaccatttcgaccacattaaagcagtcatcggttctaagtttattggcatcggtggggactatgacggagctggcaagttcccccagggcctggaggacgtgtcgacataccccgtgctaatcgaagagttgctgtcccgcggctggtccgaggaggaactgcagggagtgcttagaggcaacttgctcagagtatttaggcaagtggaaaaagtgcaggaagaaaataaatggcagagtccattggaggacaagtttcccgacgagcagctgagctctagctgtcatagcgacctcagtagactacgccagcggcagtcgctgacaagcggacaggaattaacagaaattcccattcactggacagccaaattacctgcaaaatggtcagtctctgagtcatctccgcatatggcgcccgtacttgcggtcgtggctaccttccccgtcctgatcctgtggctctag

SEQ ID NO: 114675 - DNA, 1542 bp, Artificial Sequence
  Description of Artificial Sequence: Synthetic coding sequence
atgataaggacccctttgagtgctagcgcgcataggcttttacttcccgggtctagaggcaggcctccaagaaatatgcaacccacgggcagggaagggtctcgcgccctgagccggcgctacttacgtaggctactgctgttgctgctcctgcttcttttacgtcaacctgtcacaagggcagagactactcccggtgccccccgagcgttgagcacactcgggtcccctagtctgtttacaaccccgggggtgccttccgcgttgactactcccggcctcaccactccggggacgccgaaaacactcgacctcagaggccgtgcccaggccctgatgcgctcctttccccttgtggacgggcataacgatttgccgcaggttcttagacagcgttataagaacgtcctgcaggacgtgaacctgaggaatttttcccacggacagaccagcctagatcgactgagggacgggctggtcggcgcacagttctggagcgcctcggtgtcttgccagagtcaagatcagaccgccgtcagacttgcactggagcagatcgatctgatccacagaatgtgcgctagttattcagaactggaactggttacgagtgccgagggtctgaattcctcacaaaagctggcttgcctgatcggggtagaagggggacattccctcgatagcagcctgtctgtccttaggagtttctacgtgctgggagtgcgatatctgacccttacattcacatgcagtacaccctgggcagaatcctctaccaagtttcggcatcatatgtatacgaatgtgagtgggctgacatctttcggcgaaaaggtggtggaagaactgaacaggttggggatgatgatcgatctgtcttatgcttccgacacgctcattagaagggtgctggaggtcagtcaggcccccgtgattttcagtcacagcgcggcccgggctgtctgcgataatctattaaacgtccccgacgacattcttcaattgcttaaaaagaatggtggcattgtgatggtaacgctcagcatgggagttttgcagtgcaacctgctggctaatgtgtcaacggtagccgaccacttcgaccacattagagctgtgatcggcagcgagtttattgggatcggcggcaactacgacggcaccgggcggtttcctcagggcttggaagacgtgtctacttaccctgtcctcatcgaagagctcctctctaggtcttggtccgaggaggagctgcagggggtgctgcgaggtaatcttctcagagtgtttcggcaggtggagaaagtgagggaagagagtcgggcacaaagtcccgtggaggccgagttcccctacggacaactctccacctcttgtcattcccatctggtcccccagaatgggcatcaggccacacacctggaggttacaaaacagccaaccaatcgagtgccatggcgcagttctaatgcctccccctacttggtcccgggactggtcgctgccgcaactataccgacattcacccagtggctctgctag

SEQ ID NO: 114676 - DNA, 2370 bp, Artificial Sequence
  Description of Artificial Sequence: Synthetic coding sequence
atgcgaaaagtagaaagtaggggggaaggggggcgtgaggaactaggaagtaactcccctcctcaaaggaactggaaaggaatcgccatcgccctgctcgtaattttggtggtgtgcagcttgattactatgagtgtgattctcctgacccctgatgagctaaccaacagttctgagacacgcctgagtctcgaggacctcttcagaaaggacttcgtgttacacgatccagaggccagatggattaacgataccgatgtcgtgtacaaaagcgagaacggccacgttatcaagcttaacatcgaaaccaatgccactacccttcttttggagaacaccaccttcgtcacatttaaagctagtcgtcattctgtcagccctgacctgaagtatgttctacttgcttatgatgtaaaacagatttttcattacagctacacggcatcctatgttatttataacattcacactcgagaggtgtgggaactcaatcccccagaggtggaagattccgtgctgcagtatgccgcatggggagtccagggccaacagttgatctacatatttgagaataatatttactaccagcctgacattaagtccagctctctaagactgacgtcttccggaaaggaagagatcatttttaacgggattgcagactggctctacgaggaggaacttctccacagtcatatcgctcactggtggtctcctgatggggagcggctagcattccttatgattaacgactcgctggtgcctactatggtaatcccccggttcaccggcgccctgtatccaaagggcaagcaatacccttatccaaaagctgggcaagtaaaccctaccattaagctttatgtggttaacctgtacggccccacccacacgttagagcttatgccccccgactctttcaagtccagggaatactacataactatggttaagtgggtgagtaacactaagacagttgttagatggctgaatagggcccagaacatatccattctgacagtgtgcgagacaacaaccggagcttgctccaagaagtatgagatgacgtccgacacttggcttagccagcagaacgaggaacctgtgttttctcgagatgggtcaaaattctttatgaccgttcctgttaaacagggtgggaggggcgagttccatcacgtcgccatgtttcttatccagtccaagagcgagcagattactgtgcggcacctcacgtccggaaattgggaggtgattaagatcttggcatatgatgagacaacccagaaaatttattttttgagtacagaatcttcaccccgcggccggcagctgtattccgctagcaccgagggtctcctgaaccgccagtgtatcagctgcaactttatgaaggagcagtgtacctattttgatgcatcgttcagtccaatgaatcagcacttcctgctgttctgtgaggggccaagggtcccagtagtgagtttacattcgacagataatccggccaagtatttcatattggagagtaacagcatgcttaaagaggcaattctgaagaagaagattggcaaacctgagatcaagatcctgcacatagatgattatgagctgcctctgcagctgagcttgccgaaggactttatggaccggaaccagtatgctctgctgcttatcatggatgaggagcctggtggacagctggtaaccgataaatttcacattgactgggatagtgtcctgatcgacatggataacgttattgtcgcaagatttgacggacgggggtccggctttcaggggctgaaaattctgcaagaaattcatcgccgcttgggctcagtggaggtgaaagatcaaattaccgctgtgaaatttttgctcaagctaccctacatcgattcaaagaggctttctatattcgggaaaggatacgggggatatatcgcctcaatgattctgaaatctgatgagaagctgttcaagtgtggatctgttgtcgcgcccataaccgacctcaagctgtacgcctctgcttttagcgaacgttacctgggaatgccaagtaaggaagagtctacctaccaggctgctagcgtgctgcacaatgtccatgggctcaaagaggagaatatcctgattatccacgggactgcagacacaaaggtgcacttccagcattccgcagagctgataaagcatctgatcaaagcaggcgttaattataccatgcaagtgtaccctgacgaagggcataatgtgtccgaaaaaagtaagtaccacttatattctaccatcctgaagttttttagcgattgtctgaaggaggagatatctgtgctaccccaggagcctgaagaagacgaatag

SEQ ID NO: 114677 - DNA, 2403 bp, Artificial Sequence
  Description of Artificial Sequence: Synthetic coding sequence
atgaccgctgccaaacaggagccacagccaacacccggcgcccgtgcaagccaggcccagccggccgaccaggagctgggtagcaacagcccccctcagcggaattggaagggtatcgcgattgctctgcttgtcatactggtagtctgctccctgataaccatgtctgtgatcctgctaactcccgatgagttgaccaattctagcgaaacgcgcctctctcttgaagatctcttccggaaagactttgtccttcacgatcctgaggcccgctggattaacgatactgacgtcgtatataagtctgagaatggacatgtcatcaagttaaacattgaaacgaatgcaacaaccctactgctggagaatacaactttcgtcaccttcaaggcatcacgacactccgtctctccagatctgaaatacgtactcctggcctacgatgtgaaacaaatcttccactactcgtacactgcatcttacgtgatctacaacatacacacgcgggaagtgtgggaactcaatccccccgaagtcgaggacagtgtgctacagtatgcggcctggggggtccagggccagcagctgatctacatttttgagaacaacatatactaccaacccgatatcaaaagctcatccctccgcttaactagtagcggaaaggaagagatcatatttaatggcattgctgactggctttacgaggaagagctactgcactcccacattgcacattggtggtctccagatggtgagcggctggcattccttatgatcaatgacagtttagtgccaacaatggtgatccctaggtttactggagccctgtacccaaagggcaaacagtatccttacccaaaagctgggcaggtgaaccccaccataaagctgtatgttgtgaacttatacggtccaacacacactcttgaacttatgccgccagacagctttaagtctagggagtactacattacaatggtgaaatgggtatcaaacactaagacagtggtacggtggctcaatcgggctcagaatatctctatattaacagtttgcgagacaacgaccggtgcctgcagtaaaaaatacgagatgacatctgacacatggttgtcgcagcagaacgaggagcccgtctttagcagggatggctcaaaattcttcatgacggtgcctgttaaacaaggagggaggggcgaatttcaccatgtcgcaatgtttttgatccagtcaaagagtgagcagattacggtcaggcatttaactagcggtaactgggaggttatcaagatcctcgcatatgatgaaaccacccagaaaatatacttcctgtctactgaaagctccccgcgaggacggcaactgtactctgcctctacagaggggctcctgaacagacagtgtatttcctgtaacttcatgaaggagcagtgcacatactttgacgcaagcttttccccaatgaaccaacacttcctgctgttttgtgaaggtccccgcgttcccgtggtgagcctgcacagtactgacaaccccgccaaatattttattttggagtctaactcaatgcttaaagaagccatcctgaaaaaaaaaatcgggaagccagaaatcaaaatcctgcacattgacgattatgaactgccattgcaattgagtcttccaaaggatttcatggacaggaaccagtatgcacttctgctaatcatggacgaggagccaggcgggcagctcgtcacggataaatttcacatcgattgggacagcgtgctgattgatatggacaatgttatcgtggctagatttgatggcaggggatccgggttccagggattgaagattttacaggagatccatcgtcgcctgggtagtgtggaggtcaaggaccagataacagctgtcaaattcctcctgaaacttccgtacattgacagtaagaggctgtcaattttcggcaagggctacgggggatatatcgccagcatgattctcaagtctgatgaaaagcttttcaaatgcggttctgtggtggccccgattactgacctgaagttatacgcctcagcgttcagtgagaggtatctcggcatgccaagtaaagaggaaagcacttaccaggcggccagtgtgctgcataatgtgcatgggctcaaggaggagaatattttgatcatccacggcacagcggacaccaaggtgcattttcaacacagtgccgaactgattaagcatcttataaaggccggggtcaactatactatgcaggtgtacccagatgaaggtcacaacgtctccgagaagagtaaatatcatctgtattccacaatactcaagttctttagcgattgcttaaaagaggagatcagtgtgttaccgcaggaacccgaggaagacgaatag

SEQ ID NO: 114678 - DNA, 2391 bp, Artificial Sequence
  Description of Artificial Sequence: Synthetic coding sequence
atgaaccagactgcaagtgtctcacaccacataaaatgtcagccaagcaaaaccataaaggagcttgggagtaatagcccaccacaacggaattggaagggtatcgcgatagctttgcttgtgatcctggtggtatgtagcctcattacaatgtctgttattctcctgactcccgacgaattgacaaacagctccgagacaagattatcacttgaagatctatttaggaaagatttcgtgctgcatgatcctgaggcaagatggattaatgacacagacgtggtgtataagtccgaaaatgggcacgttatcaagctaaacatagaaacaaatgctacaaccctcctcctggagaacacaaccttcgtcaccttcaaggcttccagacattcagtgtccccagacctgaaatacgttctgcttgcatatgatgttaagcagattttccactactcctacaccgcgtcctacgtgatctataatattcatacacgggaggtatgggagcttaatcctcccgaggtggaggatagtgtcctgcaatacgctgcttggggcgtgcagggacagcagttgatctacatctttgaaaacaacatctactatcagcctgacattaagtcctcgagcctgcgtctgaccagttctgggaaggaggagatcatcttcaacggaattgcagactggctttacgaggaggaactccttcattctcacatagcgcactggtggtctcccgacggagaaaggctggctttcctgatgatcaatgacagcctggtaccaaccatggtcatccctagattcactggagctctatacccaaagggaaagcagtacccctaccccaaggccggtcaagtcaaccccacaataaagctctacgtggtcaacctttacggaccgacccacacactggagttaatgccgcccgattccttcaaaagtagggagtattacattaccatggtaaaatgggtgtctaatactaagaccgtcgtgcgctggctaaaccgcgctcaaaatatatctatcttgacggtgtgtgagaccacaacaggagcatgcagtaagaaatacgaaatgacatcagatacgtggttgtcacagcagaatgaggagcccgtgttttcccgggatggcagcaagttttttatgaccgtccctgtgaaacagggtggccgaggtgagtttcaccatgtggcgatgttccttatccagagcaagtccgaacagattacagttcgccacctgacaagcggtaactgggaggtgatcaagattttagcttatgacgagaccacacagaaaatctatttcctctctaccgagagcagcccacgcggtagacaactgtattccgcatcaactgagggactgctgaaccgacagtgtattagctgcaatttcatgaaggagcagtgcacctacttcgatgccagcttcagtcccatgaatcaacatttcctgctgttctgtgaaggacccagagtcccagttgtgtctcttcattctaccgacaatcctgccaagtatttcatcctggagtcgaattctatgctgaaggaagcaattctgaagaaaaagatcggtaagcccgaaattaaaattcttcacatagatgattatgagctccctcttcagctgagcctgccaaaagatttcatggatagaaatcagtacgccctgctgctcattatggacgaggaacctggggggcagttggtgaccgacaaattccacatagactgggacagtgtgctaatcgacatggataatgtgatcgtggcgcgcttcgacggcaggggatcagggtttcagggcctgaagatccttcaggagatccacagacgactgggcagcgtggaggtcaaggaccagatcacagcagttaagtttctgctgaagctaccctatatcgattctaagcgactgtccatcttcggtaagggatacggaggctacatcgccagtatgattctgaaaagtgacgagaagctttttaagtgcggatccgtcgtcgcacctattactgatctcaaattgtatgcgagtgccttttcagaaaggtatctcggcatgccaagtaaggaagaaagcacttaccaggctgctagtgtgctccataacgtccatggactgaaagaggaaaatatactcatcattcacggcactgccgatacgaaggtccattttcagcatagcgcagagcttattaagcatctgatcaaggcaggagttaactacacaatgcaggtctaccccgacgagggccacaatgtgtctgaaaagagcaagtaccatttgtacagcaccatacttaagttcttctcggactgtctgaaggaagaaatcagtgtgctgccacaggagcccgaggaggatgaatag

SEQ ID NO: 114679 - DNA, 294 bp, Artificial Sequence
  Description of Artificial Sequence: Synthetic coding sequence
atgagtgtgattctactgactcctgatgagctgactaactcctcggagactcgcctctctctcgaagacttgtttcggaaagactttgtcctgcacgacccagaagcccgctggatcaacgacactgacgttgtctataaaagcgagaatggtcacgtgatcaagttgaacatcgagacaaatgccaccacacttcttttagagaatacgacattcgtgacttttaaagcgagtcgccattccgtcagtcctgatctcaagtatgttttgctcgcgtatgatgtcaaacagtag

SEQ ID NO: 114680 - DNA, 1803 bp, Artificial Sequence
  Description of Artificial Sequence: Synthetic coding sequence
ctcagtattctgatcttgaccagtaacgagttgacaaattcttccgagacgcgcctttccttggaggatctgtttagaaaggatttcgtgctgcacgatccagaagcgagatggataaatgataccgacgtagtatataaaagcgagaacggccatgtgattaaactcaacatcgagaccaacgccactactctgctactcgaaaataccacttttgtcaccttcaaggcatctaggcactctgtatcgccagacttaaaatacgtcttgcttgcgtatgatgtgaagcagatcttccactacagctatacagcatcgtacgtcatttacaatattcatacgagagaagtgtgggaactcaaccccccggaagttgaggacagcgtactgcagtacgccgcctggggcgtgcaggggcaacagctcatctatatcttcgagaataatatttattatcagcccgacatcaagtcctcaagtcttaggcttacaagttccggaaaagaagaaatcatcttcaatggcatcgccgactggctgtacgaagaggagctgttgcatagtcatatcgcacattggtggagcccagatggggaaaggctcgcctttctcatgataaacgacagcctggttccgactatggtgattccccgtttcactggcgccctttatccgaagggaaagcagtatccttaccctaaagcaggtcaggtcaaccctaccatcaagctgtatgtcgtcaacctgtatggcccaacacacaccctggagctcatgcctcccgactcctttaaatctcgggagtactacataaccatggtgaagtgggtatcaaatacaaaaactgtagtgcgctggttgaacagagcccagaacatctccatccttacagtctgcgagacaacaactggagcttgtagcaagaagtacgagatgacatccgatacttggcttagtcagcaaaacgaggaaccggtttttagccgcgacggctctaaattcttcatgacagtacctgtgaagcaagggggaaggggagaattccaccacgtagcaatgtttcttatacagagcaaaagcgaacagattacggtgagacacctgacctccggaaactgggaagtgatcaagatactggcctatgacgagacaactcaaaaaatctacttcctctccactgagagtagtccccgcggcagacagctgtactccgcttccactgaaggactcctgaacaggcagtgtatctcttgcaattttatgaaggagcagtgtacctatttcgatgctagcttctctcccatgaaccagcattttctcctattctgtgagggacccagggtgcctgtggtatccctccactccacagataacccagccaagtattttattctcgaatcaaactcaatgctgaaggaagctatactgaagaaaaaaattggcaaacctgagatcaagattctgcatatcgacgactatgagctgccacttcaactcagtcttccaaaggactttatggaccgcaatcaatatgctttgctgctgattatggatgaagaacccgggggccagctggtgactgataagtttcacattgactgggactcggtattgatcgatatggataatgtgattgtagcccggtttgacggtaggggctccggcttccagggactgaaaatcttacaggagattcaccgacgtttggggagcgttgaagtaaaggaccagattacggccgtgaaatttctgctgaaactgccttatatcgattctaaaagactgtcaattttcggaaagtag

SEQ ID NO: 114681 - DNA, 2241 bp, Artificial Sequence
  Description of Artificial Sequence: Synthetic coding sequence
atgtctgttatcctgctgactccagacgaactgacaaacagctccgagactcggctgagtttagaggacctgtttcggaaagactttgttctgcatgatcccgaggcaagatggattaatgatactgacgtcgtttacaaaagcgaaaatgggcacgtgatcaagctgaacatagagacaaatgctaccaccttgttactcgaaaatactacattcgtcacattcaaggcttcaaggcactctgtttcccctgatctgaagtacgttcttctcgcctacgacgttaagcagatatttcactattcttacaccgcctcatatgtaatatacaatatccacactcgcgaagtgtgggaactcaatcctcctgaggtcgaagatagtgttctgcaatacgcagcctggggcgtccaaggtcagcagctgatttatatttttgagaacaacatctactaccagcccgatatcaagtccagcagtctacggcttactagtagcggaaaggaagagatcatattcaatggcatcgcagactggctttatgaagaggaactactgcactctcatatcgcacactggtggagtccagacggcgaaagactggccttcttgatgatcaatgactcactcgttccaactatggtcattccaagattcacgggagcgctgtatcctaaggggaaacagtacccctacccgaaagcgggacaggttaatccaacaattaagctgtacgtagtgaacctttatggtcccacacatacactggaactgatgccgcctgattcattcaagtcaagggaatactatataacaatggtgaaatgggtttccaacacaaaaaccgtcgttaggtggttaaatagagcacaaaacatttccattctgaccgtgtgtgagaccacaaccggagcttgttctaagaaatatgagatgaccagtgacacgtggctgtcccagcagaacgaagaacccgtgttcagccgtgacgggtctaagttctttatgactgttcccgtgaagcaggggggcaggggtgagttccaccacgtggcaatgttcttaatccaatcaaaaagtgaacagataacagttaggcatctcacctccggcaactgggaagtgattaaaattttggcctatgacgagaccacccagaagatttacttcctctcaaccgagagttccccccgtggtcgtcagctttactctgctagcacggagggattactgaatcgccagtgcatctcatgcaatttcatgaaggagcagtgtacttactttgatgcctctttttccccaatgaatcagcattttctgctcttctgtgagggcccccgtgttcctgttgtttctctccattctaccgacaaccccgctaaatactttatcctggaatctaacagcatgctgaaagaagcgattctgaaaaagaaaattggcaagcctgaaatcaagatcctgcacattgacgattatgagctgcctctacagctgtccctgccaaaggacttcatggaccggaaccagtacgcactgctactgatcatggatgaggagcccggcgggcagcttgtgactgataagttccacattgactgggactccgtgctgatcgacatggacaatgtgatagttgcccgttttgatggccggggctcaggctttcaaggactgaaaatccttcaggagattcaccgccgcctcggttccgtggaagtgaaagaccagatcacagccgtcaaattcctcctgaaactcccatatatcgacagcaagcggttatccattttcggtaaaggttatggaggttacatcgcttctatgatccttaagtctgatgagaaactgttcaagtgtggttcggtggtcgctccaattaccgacctgaaactctatgcctcagcgttttccgaacggtatctgggcatgccttctaaagaggagtctacctatcaggcagcatcagttctacataacgtccacggcttgaaggaggagaatatcctaattatacacggcaccgctgataccaaggtgcatttccagcactcagctgaactaatcaagcaccttattaaggccggggtgaattacaccatgcaggtgtatcctgatgaggggcataacgtaagcgagaagagtaagtaccacctctactcgaccatcctcaaattctttagcgactgcctgaaagaggagatcagtgtgctgccccaggaacctgaagaagatgaatag

SEQ ID NO: 114682 - DNA, 954 bp, Artificial Sequence
  Description of Artificial Sequence: Synthetic coding sequence
atggcagacacgcagtacattctccccaacgacattggggtaagcagcctcgactgtagggaggcctttcggctcctcagcccaaccgaaagactgtacgcgtaccacctgtcaagggctgcgtggtatggcgggcttgctgtgctgttacagacctcacccgaagctccttacatttatgctctgctgagccggcttttccgggcacaggatccggaccagctgagacagcatgctctggcagaaggcctaaccgaggaagagtaccaagccttcctcgtgtacgctgccggagtctattccaacatggggaactacaaatcatttggcgatacaaagttcgtacctaacctgccaaaagaaaaactagaaagagttatccttgggtctgaagccgcccaacagcatcctgaagaggtccgaggactgtggcagacctgtggagaattgatgttcagtctggagccccggttacgccatctcggcctgggcaaggaaggcatcaccacctacttttcagggaactgtacgatggaagatgcccgggttcgtctggataggtccaagatccggtctgttggcaaaccagcactggagcggttcctgcggcgcctgcaggtgctaaagtcaacgggggatgtggccgggggcagggctctgtacgagggttatgctacggtaacagacgcacccccggaatgctttctcactctgcgcgatacggtgctgctgcgcaaggaatccagaaagctgatcgtgcagcctaacacccgcttggagggcagtgacgtgcagctattagagtacgaagcctccgcagcgggcctcattcgtagtttctccgagagattcccggaggacgggcctgaactggaggagatcctcacacagctagctactgcagatgccaggttttggaaaggacctagcgaagcccccagcgggcaggcatag

SEQ ID NO: 114683 - DNA, 2214 bp, Artificial Sequence
  Description of Artificial Sequence: Synthetic coding sequence
atggcggatacacagtatatactgcctaacgatattggggtgtcaagcttagactgtagagaagcgttccgtctgctgagccccacagaacggttatacgcttaccacttgtcaagggcggcctggtacggcggcctagcggtattgttgcagaccagcccagaggcaccttatatttacgcattacttagtagattgttccgcgcgcaggaccctgaccagctccggcagcacgcactggccgagggcctgactgaggaggagtatcaggcttttctcgtgtacgcggccggggtgtattccaatatggggaactataaatccttcggcgataccaagttcgtcccaaatttacccaaagagaagcttgagcgggtgattttgggatctgaagccgctcagcagcaccctgaagaagtgcgcggattatggcaaacctgcggcgagctcatgttctccctggagccaaggctcaggcatctgggccttggcaaagaagggatcaccacttatttcagcgggaattgtacaatggaggatgctaagctggcccaggactttcttgattcccagaacctgtccgcttacaatactagattattcaaggaagtggatggcgagggaaaaccttactacgaggtgagactggctagtgtgctaggctccgagcctagcctagactctgaagtaacctctaaactgaaatcatatgagttcagggggtctcctttccaagtgacccgaggagattacgcacctattctgcagaaggtagttgagcagctggagaaagctaaggcctacgccgctaatagccaccagggccagatgttagctcagtacattgagagcttcacgcagggtagtattgaagcccataagaggggttctagattctggatacaggataagggacctattgttgagagctatataggctttatcgagtcttaccgagatccatttggctcgagaggtgagtttgaggggtttgtcgccgtagtgaataaggctatgagcgccaagttcgaaagactggtggcctcggccgaacagctgctaaaggaattgccctggccccctacgttcgagaaagacaagttcctgacacctgacttcacatcactcgacgtgctcacatttgccggatctggcatacctgccggaattaacattccaaattacgatgatctgcgccagaccgaaggtttcaagaacgtttctctcggcaatgttttagcagtcgcatatgcaacccagcgcgagaaattgaccttcctggaggaggacgataaagatctgtatattctgtggaaggggccatcattcgacgtccaggtgggtctgcacgagctccttggtcatggatcagggaagctcttcgtgcaggacgaaaagggggcattcaatttcgaccaggaaacagttattaaccccgagacgggagagcagattcagtcctggtatcgcagtggcgagacctgggacagcaaattctctacaattgcaagctcttatgaagaatgccgcgccgaatcagtgggtctgtacctgtgtctccatccacaggtcttagagattttcggttttgaaggtgcagacgcggaagacgttatctacgtgaactggctgaacatggtgcgggccggactcctggccctggagttctatacccccgaggcttttaattggaggcaggctcacatgcaggccagatttgttatcctgcgggtcctgctcgaagccggagagggcctggtgacaattaccccgactaccggctcagatggtagacccgatgcacgtgtacgcctggaccgaagcaagattcggagtgtcggaaaacccgcgcttgagcgatttttgcgacgccttcaggtcttaaagagtacaggggacgttgcaggaggcagagcgctgtacgaaggctatgcaaccgtgacagatgctcccccagagtgctttcttactctgagagatactgtgttactcagaaaagaaagtaggaaactgatcgtccagcctaacaccaggctggagggaagtgatgtgcagctgctagagtacgaggctagcgctgccggactcatccgctcattcagcgagcggttccctgaggatggcccggaactggaggaaattctgacgcagctggctaccgccgatgctaggttctggaagggcccgagcgaggctccatcaggacaggcctag

SEQ ID NO: 114684 - DNA, 2214 bp, Artificial Sequence
  Description of Artificial Sequence: Synthetic coding sequence
atggccgatacccagtatatcttgccaaacgacatcggcgtaagctccctcgactgtcgggaggctttcaggcttttaagtccaacagaaagattgtacgcgtaccacctctcaagggctgcctggtacggtggcctggctgtgctgctgcagacaagtcccgaagccccctacatctacgcattgctgagcagattgtttcgggcccaggacccagatcagctgcgacagcacgcactggcagagggtctgacggaggaggagtatcaggcctttttggtttacgctgcaggagtgtacagcaacatgggtaattataaaagcttcggtgacacaaagttcgtgcctaacctgcccaaggaaaagctagaacgtgtaatcttgggcagcgaggctgcccagcagcaccctgaggaggtcagggggctgtggcagacatgtggcgagctgatgttttccctcgagccccgtctgagacatttgggcttgggtaaggagggcattaccacatacttttctggaaactgtaccatggaggacgccaagctagcccaggactttctggacagtcagaacctgtccgcgtacaacaccaggttgttcaaagaggttgacggcgaggggaaaccctactatgaggtacgcctggcttcagtattagggagcgaacctagcctggacagcgaagtcacgagcaagctcaaatcttacgagttccgtgggtctccattccaggtgactaggggcgactacgcaccaattttacagaaagtagtggagcaactggaaaaagccaaggcttacgccgccaactcccaccaggggcagatgctcgctcagtatatagagagtttcactcaggggagcattgaggcacacaagcgcgggagtaggttctggattcaggataagggacccatcgttgaatcctacattggcttcatcgaatcctacagagaccccttcggtagtaggggcgagttcgagggatttgtggcagtggttaacaaagctatgtccgcgaagtttgaaaggctagttgcctccgccgagcagctcctgaaagaactcccttggcctcctacattcgaaaaagataagttcttgactcccgactttaccagcctggatgtgcttacctttgcaggatcgggaatcccagctggcatcaacattccaaactatgatgacctgagacagactgaaggttttaagaatgtgtcactggggaacgttctggctgtggcgtatgctacccaaagggagaaactgacgttcctggaggaggacgataaagatctttatatcctgtggaaaggcccgtccttcgatgttcaggttggtctgcatgagctgcttgggcacgggtctggcaagctgttcgtgcaagacgaaaaaggtgcattcaacttcgaccaggaaaccgtaattaaccctgagacaggcgaacagatccaatcatggtacaggagcggggaaacatgggactctaaattctccacaatcgcatcctcatatgaagaatgccgggcggagtcggtagggctgtacctgtgtctccacccacaagtcttggaaatttttgggttcgagggcgccgacgcggaggatgtgatttacgtgaactggctcaatatggttagggccggtctcttggcgctcgagttctacactcctgaggctttcaactggaggcaggcccatatgcaggctcgctttgtaatcctgcgggtcctcctggaagctggggaagggttggtgaccatcacacccaccaccgggagcgacggcagaccagacgcccgagtgcgcttagatcgaagtaaaatcagatccgtaggtaaacccgccttggagagatttctgcgcagattacaggtcctgaaatcaacgggcgatgtggccggtggtcgggccttgtatgaggggtacgccacagtgacggatgctccccccgaatgcttcctgaccctgagagacacagttctactgagaaaagaaagtcgaaagctaatcgtgcagcccaatacacgtctagaaggctccgatgtgcagctacttgagtatgaggcctccgcggccgggctgattcgctctttctccgaacggtttccagaggacggcccagaattagaggaaatcctgacgcagctagccacagccgacgcgagattttggaagggcccttccgaagcaccctctggacaagcttag

SEQ ID NO: 114685 - DNA, 273 bp, Artificial Sequence
  Description of Artificial Sequence: Synthetic coding sequence
atggccgacacacagtacattctgcctaatgatattggggtgagttctttggattgccgtgaggctttccgactgctgagccctaccgagcgactatacgcctatcaccttagtcgcgcagcctggtatgggggattggccgtattgctccagaccagccctgaagctccttatatatacgctctactgtctcggctcttccgtgcccaagatcccgatcagctcagacagcacgctctggctgaggggctcactgaagaggaatatcagtag

SEQ ID NO: 114686 - DNA, 606 bp, Artificial Sequence
  Description of Artificial Sequence: Synthetic coding sequence
atggctgatacgcagtatattctccccaacgacatcggtgtgtcgtctctggattgtcgcgaggcattccggctgttgtcacctactgaaagactttatgcctatcacttatcccgcgccgcatggtatggcggtctggccgtacttctccaaacgtctccagaggccccctacatttacgcgctcctttctagactgtttagagcacaggatcctgaccagttgcgacagcacgccttggccgaggggttgactgaggaggagtaccaggcttttctggtgtatgctgctggagtctattcgaatatgggtaattacaagagtttcggggataccaaatttgtgcccaatttaccaaaagagaagcttgaacgcgtaatcttaggctccgaagctgcccaacagcatcctgaggaggtgaggggcttgtggcagacttgcggggaactcatgttttctctggagcccagactgaggcacctaggcctcggtaaagagggtataactacatacttcagcggaaattgcacgatggaagacgccaagctcgcacaagactttctggactctcagaatttgtcagcttacaataccagactcttctag

SEQ ID NO: 114687 - DNA, 2274 bp, Artificial Sequence
  Description of Artificial Sequence: Synthetic coding sequence
atgggtgagcccgaggcaggttcggagttcgctaatggagccgctgcagccgccggccccatggctgacactcagtatattctgcctaacgatatcggagtgtcatcgctagattgccgggaggcattccgccttctctcgcccacagagagactgtatgcataccacctcagcagagccgcctggtacggcggtctggctgtgcttctacaaaccagccctgaggcaccttacatttatgctttgttgtctcgactgtttcgagcccaggaccctgatcaactacgacaacacgcattagctgaaggcctgacagaagaggaataccaggcatttctagtttacgcggccggtgtctactccaacatgggtaattataagagttttggcgacacgaaattcgtaccgaatttgcccaaggagaaactggaaagagtgattctgggcagcgaagcggctcagcagcacccagaagaggtgaggggactttggcagacctgcggagagctgatgttcagcttggaaccacgtctccgccacttgggcctggggaaagagggtataacaacatacttctcaggaaattgcactatggaggacgccaagctggctcaagacttccttgattcacagaacttatcggcctataatactcgcttatttaaagaagtggatggcgagggaaaaccctattatgaagtccgactcgccagtgtgctgggctccgaacctagcctggattcagaagtgacatctaagctgaagtcctatgagtttcgtggttctccattccaggtcacccgcggtgactatgctccaattctacaaaaggtcgtcgagcagcttgagaaggcgaaggcatatgctgccaattcacaccagggacagatgctcgctcaatacatcgagagcttcacacaggggtcgatcgaagcccataaaagggggtctcggttttggatccaggataaaggacccatagtggagagctacatcggatttatcgagagttacagggatccattcggatctcggggagaattcgagggctttgtcgccgtggtgaataaggcaatgagcgcaaagtttgagcggttggttgctagcgcagaacaattgttaaaagagctgccctggcctcctacctttgaaaaggataagttccttaccccagacttcacctccctggacgttttaacatttgctgggtctggcattccagccggcattaacattcctaactacgacgacctgagacaaaccgaaggattcaagaacgtgagcctgggtaatgtgcttgcagtcgcctacgccacgcagagggagaaactgactttcctcgaagaagacgataaagacctctacatcttatggaaggggcctagttttgacgtgcaggtggggctccacgaactcttgggtcacggaagcgggaaactgttcgtgcaagatgaaaaaggagcctttaactttgatcaagaaacagtgatcaaccccgagaccggagaacaaatccagagctggtatcgatcaggggaaacctgggacagtaagttttccactatcgcaagttcctacgaagagtgccgcgctgagtccgtggggctctacttgtgcctgcatccccaagttcttgagattttcgggttcgagggtgcggatgccgaggatgtgatttacgtgaattggctgaacatggtgcgagccggattgctagccctggaattctacactcccgaggcttttaattggaggcaggcacatatgcaagcaagatttgtgatactcagggttctgctcgaggcaggcgagggcctggtgacaatcacccctaccacaggatcagacggaaggccagatgctcgagtccgcttggaccgaagtaagattagatctgtcggaaagccagcattggaaagatttctgcggaggctgcaggttttgaaatcaacaggggatgtggctggaggcagggcattgtacgaggggtatgctacagttacggatgcccctcctgagtgcttcctgaccctgcgggatacagtgcttcttagaaaagagtctagaaagctgattgttcagcctaatactcggctcgaggggagtgatgttcagctgctggagtacgaagcatcggccgcaggtctgatccggtctttcagcgagagattccccgaggatggacccgagttggaagaaattctgactcaactggctacggctgatgctcgcttctggaaaggaccatccgaggccccttcaggccaggcatag

SEQ ID NO: 114688 - DNA, 2271 bp, Artificial Sequence
  Description of Artificial Sequence: Synthetic coding sequence
atgggggagcccgaggccggttcagaattcgccaacggggccgccgctgctgggcctatggcagatactcagtacattttgcccaacgatatcggtgtgtctagcctcgattgtcgagaagcttttcgactgctgtctccaacagagaggctctatgcgtatcatctgagtcgggctgcctggtacggaggattggctgtcttgctgcagacttcacctgaagcgccgtacatctatgctttactcagccgcctgtttagggctcaagatcctgaccagttaagacaacatgcactggctgaaggcctcactgaggaagagtatcaggcatttctggtgtatgctgctggagtgtacagcaatatggggaattacaagtctttcggcgacacaaagtttgttcctaacctacccaaggaaaagctggagagagtgatactggggtccgaggccgcacagcagcatccagaagaagttcggggactgtggcaaacctgtggggagctgatgttctctttagagcctcggctgaggcatctgggattgggtaaagagggaattaccacttacttttcgggaaactgtaccatggaagatgccaagctggcacaggacttcttggattctcagaatctttccgcatataatacacggctctttaaagaagtcgatggagaaggaaaaccctactatgaggtgcgcctcgcttcggtactaggatccgaaccatccctggatagcgaggtaacttcgaaactgaagtcctacgaatttaggggctcaccatttcaagtcacccgtggagactatgctcctatcttgcaaaaggtggtcgagcagctagagaaggcgaaggcttatgccgccaattcgcatcaggggcagatgctggcccaatatatcgaaagcttcacacaaggttccattgaggcgcacaagcgcgggtccaggttctggattcaggacaagggacccatcgtggaatcgtatatagggttcattgagtcatatagggacccattcgggtccaggggcgagtttgagggtttcgtggccgtggtgaataaagctatgtcagccaaattcgaaagactggtggccagcgcagagcagctattgaaagagctgccgtggccaccaacattcgagaaagataaatttctgaccccggattttacctccctggacgtactcaccttcgcaggttcaggtatccctgcagggataaacatcccaaactacgatgatcttagacaaacggaggggttcaagaatgtttccctggggaacgtgctcgcggtcgcttacgcaacacagcgcgaaaagctgacttttcttgaggaggacgacaaggatttgtatatattatggaaggggccaagtttcgacgtccaagtgggactgcacgaactgcttggccacggctctggtaagcttttcgtccaggacgaaaagggggcttttaattttgaccaagagactgtgattaatcccgaaacaggagaacagatacagtcatggtacagaagcggagagacttgggactctaagttcagcactatcgcatcgtcctatgaagagtgtcgggccgagtccgtcggactttatctttgcctgcacccacaggttctcgagatttttggcttcgagggcgctgatgctgaggatgtcatctatgtgaattggctgaatatggtcagggctggcctgctggcactcgaattttatacccccgaagcctttaattggcggcaggctcacatgcaggcgaggtttgtgatcctgcgggtgctgctggaggctggcgagggcttggtaactatcactcccacaacgggatcagatggacggcccgatgctagagtacggttagataggtcaaaaatccgctccgtggggaaaccggctctcgagaggttccttagacgcctccaggtgctcaaatcaaccggagatgtcgctggcgggcgggccctgtacgagggatatgcgaccgttactgatgctccaccagagtgctttttgacccttcgagacacagtgctgctccggaaggaatctaggaaactaatcgtccaacctaacactagactggaaggctctgatgtgcagcttctggagtacgaggccagcgctgccgggctcatccgcagtttttccgaacgtttcccagaagatggtccggagcttgaggaaatcttgactcagctagcaactgcagatgcccgtttctggaaggggccgagtgaagctccctccgggcaggcttag

SEQ ID NO: 114689 - DNA, 2214 bp, Artificial Sequence
  Description of Artificial Sequence: Synthetic coding sequence
atggctgacacccagtatatcctgccgaatgacattggcgtgtcatctcttgattgcagagaagcgtttcggcttctctctcctactgagagactgtatgcttatcatctctctagggcagcctggtacggcggattggcagtgttactgcagactagtcctgaggccccatacatatatgccctgttatccagactcttcagggcacaggatccagatcaattgaggcagcatgccctcgcagagggactcaccgaggaagagtatcaggcgttcctggtctatgcggcaggggtgtactccaacatgggcaactataagagttttggcgacacgaaattcgtccccaacctgccaaaagaaaagctcgaacgggtgatcctcggaagcgaagctgcgcagcaacatcctgaggaggtgagagggttatggcagacttgtggagaactcatgttctctctcgagccacggttgagacatctcgggcttggaaaagagggtattaccacctacttttcaggaaattgcaccatggaggatgcaaagctagcccaagattttctcgacagtcaaaacctgtccgcttataacacaaggcttttcaaggaggtagacggagagggtaagccctactatgaggtaaggctcgcctcagtactcggctccgaaccatcactagattccgaggtaacaagtaaactaaagtcatacgagtttcggggctccccatttcaggtcactagaggggactatgccccaatcctccaaaaagttgtggagcagttagaaaaagcaaaggcctatgctgcgaattcacatcagggccagatgctggctcaatatatagagtcctttacgcagggatcaatcgaggcccataaaagggggtccagattttggattcaggacaagggacccatagtcgaatcctacatcggctttatcgaatcttaccgggacccttttggttctaggggcgagtttgagggcttcgtggctgtggtcaacaaggctatgtcggcgaagtttgaaagactggtggctagcgcagagcagctgttgaaggagctgccttggccacccaccttcgagaaggataagttcctgacacccgacttcaccagtctggacgtactaaccttcgctggttctggaatcccggcaggcattaatattcccaactacgacgacttaaggcaaacggagggtttcaagaatgtaagcctaggtaatgtgctggctgtggcgtacgccacccagcgggagaagcttacatttcttgaggaagacgataaggatttatacatactgtggaaaggcccctctttcgacgtgcaagttggtctgcatgaactgctgggacacgggtctggtaagcttttcgtccaggatgagaaaggcgctttcaatttcgatcaggaaactgttataaatccagagacaggtgagcaaattcagtcctggtatagatcaggagaaacatgggactccaagttctctacaatcgcttccagctatgaagagtgccgcgctgaatcagtaggactctacctgtgcctgcaccctcaggttctggagattttcgggttcgaaggcgcagacgcagaggacgtaatctatgtgaactggttgaacatggtccgggctgggctcctggctctagagttttacacgcctgaagcctttaactggaggcaggcccatatgcaagctaggttcgtgattctgagagtcctgttggaagcaggcgaagggttagtgacaattactccaacgaccgggagcgatggccgccccgatgcacgcgtgagactcgacaggagtaagattcggtccgttggtaagcccgcactcgaaagatttctccggagattgcaggtgcttaagagcaccggcgatgtggctggcggtagagcgctgtacgagggatacgcaaccgtcaccgacgccccaccggagtgcttcttaactttaagggacacggtgcttcttcggaaggagtcccgaaaactgatcgtccagcccaacacacgactcgagggctctgatgtgcagctgcttgagtatgaagctagcgctgccggattgatccggtcatttagcgagcgattccccgaagacggcccggagcttgaggagatcctcactcaactcgccaccgctgacgcccgtttctggaagggaccttccgaagcaccatcggggcaggcatag

SEQ ID NO: 114690 - DNA, 1908 bp, Artificial Sequence
  Description of Artificial Sequence: Synthetic coding sequence
atgggaaactacaaatctttcggcgacacgaagttcgtgccaaatctcccaaaggagaagctagaacgggttattcttggatcggaggccgcccagcagcaccccgaagaggtacgtggcctatggcaaacatgtggtgagttgatgtttagtttggagcccaggctgcgccatctgggacttggcaaggagggaatcacaacttatttttccggaaattgcaccatggaggatgcgaagctcgcccaagactttctcgatagtcaaaatctgtcagcttataacacacgtttgtttaaagaggtcgatggcgagggtaagccttattatgaggtgaggctggcgagtgttttaggatccgaaccttcactcgatagcgaagttacttctaaactcaaatcctacgagtttcgcgggagccccttccaggtaacccggggtgattatgctccaattctacagaaagtcgttgaacagctggaaaaagctaaggcctacgccgcgaactcccatcagggacaaatgctcgctcagtacatcgagagctttacgcaagggagcattgaggctcataagagagggagcaggttctggattcaggataagggtcccattgttgagtcctacattggattcattgaatcatatagagaccctttcggctctcgcggtgaatttgaaggcttcgtggctgttgtgaataaggcgatgtcagcgaagttcgagaggctcgtggcgtccgccgagcagctcctgaaagagctcccctggcctccaactttcgaaaaggacaagttccttacgcccgactttacgtccctcgatgtgctcaccttcgcaggctccggcatccctgccggaatcaatattcctaactatgacgatctgaggcaaacagagggattcaagaacgtcagcctaggaaacgtgctggctgtcgcctacgccacacagcgggagaaactcacttttctggaggaagacgataaggacctgtacattctatggaaggggccctcctttgatgtgcaggtggggctgcacgagctcctgggacatggctcaggaaagctgttcgttcaggacgagaagggcgcttttaacttcgatcaggagacagtcattaaccccgaaacaggcgagcagattcaaagctggtacagaagtggggagacgtgggattctaagttttctacaatagcatcttcttatgaggagtgccgggccgagtctgtggggctctatttatgtcttcatccacaggtgctcgagatctttggcttcgaaggtgccgacgcggaggatgtcatttacgtcaattggctaaacatggtcagggcgggccttctggccctggagttctatactccggaggcgtttaattggcgccaggctcacatgcaggcccgcttcgtcatcctgcgggtgctcctcgaggctggggaagggctcgtgacaataacgcctaccactgggagcgacgggcgaccagacgctcgggtgagactggatagatcaaagatccgatcagtgggtaagcctgcactcgaaaggttcctgaggagattacaggtgcttaaatcaaccggtgatgtggcaggaggtagggctctttatgagggctatgccacagtgaccgacgctcctcccgagtgcttccttacgctacgggataccgttctccttaggaaagagtccaggaagttgattgtgcagcccaacacccggctggaaggtagcgacgtccagctgctggagtatgaagctagcgccgctgggctgatccgttcttttagcgagcgattccccgaggatggtcccgaactggaggaaattctgacgcagctcgccaccgccgatgcgcggttctggaagggaccaagtgaagcacctagcggccaagcctag

SEQ ID NO: 114691 - DNA, 2412 bp, Artificial Sequence
  Description of Artificial Sequence: Synthetic coding sequence
atgactacagccaaagagccaagtgccagtggaaagtctgtgcagcagcaagaacaagagttggtgggctctaatcctccacaacggaactggaagggcatcgctatcgccctattagtgattctggtcatctgctccctgatagtgaccagtgtgatcttgctgacccccgcggaagataacagtctgagccaaaagaaaaaagtcaccgttgaagatctcttctctgaggactttaaaattcatgatcccgaagctaagtggatctcagacacagaatttatttatagagaacagaagggaacagtcagactctggaacgtggagacaaatacttcaacagtgctcatagaaggaaagaagattgaatccctccgcgccattcggtacgaaatttccccagatagagaatatgccctcttcagttataatgtggagcccatctaccagcacagctacaccggctattatgtgctgtccaagatccctcacggagatccccaatcactggaccctcctgaagtttctaacgccaagttacagtacgcaggctggggccccaaagggcaacagctgatcttcatctttgagaacaacatttattactgcgcccacgtgggaaagcaggctataagggtagtgtcaactggcaaagagggtgtcatttataatggtttgtcagattggctgtatgaggaagagatactgaaaacccatatcgctcactggtggtctccagacgggacgaggctggcgtatgcggctataaacgacagcagagtccccattatggagcttcctacatataccggcagtatatatcccactgtgaagccgtatcattatccaaaggccgggtccgaaaatccaagcatctccctacacgtcatcggccttaacggaccaactcatgatttagagatgatgccgcctgatgacccaagaatgcgtgaatattatatcacaatggttaaatgggcaacctcaacaaaggttgcagtcacgtggttaaatagggcccagaatgtttcaattctaactctgtgtgacgctaccaccggggtgtgtactaagaaacatgaggacgaatccgaggcctggctgcaccgccaaaatgaggaacctgtatttagcaaggatggaagaaaatttttttttataagagctatcccacagggcggaaggggtaagttctaccacatcacagtgtcctcatcacagcccaattcttccaatgataatattcagtcaattacctctggagactgggacgtgacaaaaatcctggcctatgacgaaaaaggtaataagatttatttcctttctacagaggatctacctagacgcaggcagctgtacagcgcaaataccgtcggcaattttaataggcagtgtctgtcctgcgacctggtggaaaactgcacctacttctccgccagctttagccattctatggacttcttcttgctgaagtgcgagggaccgggcgtgccaatggttacagtgcacaatactacggataagaagaagatgttcgatctggaaactaatgagcatgtgaagaaggccattaacgatcgacagatgcccaaagtggagtatcgggatatcgaaattgatgattacaacctccccatgcagatcctgaaaccagcaacatttactgacactacacactacccactgctgttagtggtggatggaacaccgggttcccaatcggtggcagaaaaattcgaggtatcctgggagacggttatggtgagctcccatggtgccgtagttgtaaaatgtgatgggcgtggctctggattccagggcaccaaactgttgcacgaggtgagaaggcgactggggctcctggaggagaaggatcaaatggaagctgtccgcactatgttgaaggaacagtacattgatagaaccagagtcgccgtctttggcaaggactatggagggtatttatctacctatatcttgcctgctaagggagagaatcaggggcagacctttacgtgtggatcagccttgagcccaattaccgattttaagctctacgctagcgctttttcagagagatacctgggacttcatgggctggataatcgcgcctatgagatgaccaaggtagcacatagagttagcgccttagaagagcagcaattcctgattattcatcctacagccgatgaaaaaatccacttccagcataccgcagaactgatcacccagttgattagagggaaggccaattattctctgcagatctacccagatgagtcccactacttcacttcaagctccctgaaacaacatctttacagaagcataattaacttctttgttgagtgtttccgtattcaggacaagcttctgacggtcaccgctaaagaagatgaggaagaagactag

SEQ ID NO: 114692 - DNA, 2598 bp, Artificial Sequence
  Description of Artificial Sequence: Synthetic coding sequence
atggcaagcctctaccagaggtttaccggaaagatcaacacctcaaggagcttccccgccccaccagaggcctcacacctgctaggaggccagggcccggaagaggatggtggggccggagccaaacccctgggacctagagcacaggcagctgctcctcgggagaggggaggtggcggcgggggtgccgggggtcgcccacgctttcagtaccaggcccgaagtgatggggacgaagaggacgagctggttggcagcaaccccccacagaggaattggaaaggtatagccatcgccctgcttgtaatactcgtcatttgttccctgatcgtgacatccgtgattctgctaacacctgctgaggacaactccctgtcccagaaaaaaaaagtcacggtcgaggacctgttcagcgaggatttcaagattcacgatcctgaggctaagtggatctctgatactgaattcatctaccgagagcaaaaagggaccgtgcgcctgtggaacgtggagactaacacctctacagttttaattgagggtaagaagatcgaatcgttacgggccatcaggtatgagatctcccctgaccgcgaatatgccctcttttcttacaacgtggaacccatttatcaacactcttataccgggtactacgtgctctccaagataccccacggagatccccaaagcctcgatcctccagaagtgtctaatgccaagctccaatacgcagggtggggacctaaaggccagcagctcatttttatattcgaaaataacatctattattgcgcacacgttgggaagcaggccatcagagtcgtcagtaccggaaaagaaggagtgatttataatgggttgtccgactggctatacgaagaggagatcctgaagacccacatagcccactggtggtcccctgacgggactagactggcctacgccgctatcaatgatagccgagtgccaatcatggaactgccaacttatacaggctctatttatccgaccgtcaagccataccattatccaaaggcagggagtgagaatccctctatcagtctgcatgtgattggtctgaacggccccacccatgacctggagatgatgcctcccgacgacccacgaatgcgggaatattacattacaatggtgaagtgggcaacgtccactaaagttgcggttacatggctgaatagggcacaaaatgtctctatactcactctctgcgacgctacaaccggagtgtgtacaaaaaaacacgaggacgaatccgaggcgtggctgcacagacagaatgaagaaccagtcttcagcaaggacggcaggaaattcttttttattcgagccattccacaaggaggaagaggaaaattctatcacatcacggtctcgtcatcacagccgaactcatccaatgataacattcaaagtatcacgtccggagactgggacgtaactaaaatactcgcgtatgacgaaaaaggaaacaagatctattttctttcaactgaagacctgcccagacgcaggcagctgtacagtgccaataccgtcgggaatttcaatagacaatgtctgtcctgcgatctcgtggagaattgcacctacttcagcgctagctttagccacagcatggatttctttttactgaaatgcgaaggacccggcgttcccatggtaacagtgcataacacaactgacaaaaaaaagatgtttgacttggaaaccaacgagcacgtgaaaaaggccattaacgataggcaaatgcctaaagtggagtatcgagatatcgaaattgacgactataatctgcccatgcagatcctgaagccagccacgtttactgatacaacacattatccactccttcttgtcgtcgatgggacacccgggagtcagtctgtggctgagaaattcgaggtctcgtgggaaactgttatggtctcttcccatggcgccgtggtggtgaagtgcgacgggcgcggttctggtttccagggcactaaactgcttcatgaggtgcgacggagattgggcctcctagaagaaaaggaccagatggaggccgttcgaacaatgttaaaggagcaatacatcgataggactcgcgtcgcagtctttggaaaagactatggtggatatctcagcacctacattctgcctgccaagggcgagaatcaaggacaaacctttacatgcgggtccgccctgagcccaattaccgatttcaaactctacgcttcagccttttcggagcggtatttggggctgcacggcttagataatagagcctacgagatgactaaggtggcccaccgtgtttccgcattggaggaacagcagttcctgataatccacccaaccgcagacgagaaaatccatttccaacatacagccgagttgataacgcagctaattcggggaaaggctaattattcactgcaaatttaccctgatgaatcccactatttcacaagtagttctctgaagcagcatctgtatcgctccataatcaattttttcgttgaatgctttcggattcaagacaaattgctcaccgtgacagcaaaggaggacgaagaggaggattag

SEQ ID NO: 114693 - DNA, 2406 bp, Artificial Sequence
  Description of Artificial Sequence: Synthetic coding sequence
atgaaagaaaaggccatgattaagacggcaaagatgcaaggcaacgttatggaactcgttggttctaacccgccccaaaggaactggaagggcatcgcaattgccctgctcgttattctcgttatatgttctctgatcgttacctctgtgatcctcctgactcctgccgaggataacagcctgtctcagaagaaaaaagttacagtcgaggatcttttctctgaagacttcaaaattcatgacccagaagccaagtggatcagcgacaccgaattcatctacagggaacagaaagggactgtgcgcctgtggaatgtggaaactaatacctctaccgtcctgatcgaaggcaaaaaaatagagtctctacgggcaataagatatgagataagtccggatagggaatacgccttgtttagttacaatgtggagcctatttaccagcacagctacaccggttattatgtcctgagcaaaataccacacggcgaccctcagtcgctcgaccctcccgaggtgagtaatgcaaagctccaatatgctggctgggggccgaagggtcagcagcttatcttcatctttgaaaataacatctactattgcgcccacgtgggcaaacaagccatccgtgtcgtgagtacgggaaaggagggggttatctacaacggcttgagcgattggctctatgaagaggagatcctcaagacccacatagcccactggtggtccccagatggaacacgtttagcctatgccgctattaatgacagtcgtgtcccaatcatggagctcccaacatacaccgggtccatctatcctactgtgaaaccttaccactacccaaaagcaggcagtgagaatccttctatcagtctccatgtgattggcctcaacgggcccacacacgacctagaaatgatgcccccggacgatcctaggatgagagaatattatatcaccatggtcaagtgggccactagtacgaaggtggcagttacgtggctgaatagagcccagaatgtcagcattctgaccctgtgcgacgcaacgaccggggtgtgcaccaagaaacacgaggatgaaagtgaggcctggcttcaccgccagaatgaggaacctgtgttttcaaaagacggccgtaaatttttttttatccgggctatcccacagggcggaaggggtaaattctaccacattactgtgagctcttctcaaccaaattcgtccaatgataatattcagtctataactagcggggactgggatgtcacaaaaatcctggcctacgacgagaaagggaataaaatctattttctctcgacagaagatcttcccagaaggcggcaactgtacagcgcgaatacagtcggcaactttaacagacaatgcctatcttgcgacctggtggagaactgtacctacttctccgcttccttttcacattcgatggatttcttcctcctgaaatgcgaaggcccaggagtgcccatggtcactgtacacaatacaaccgataagaaaaagatgtttgatttggaaactaatgaacacgtcaaaaaagctatcaacgatcgacagatgccaaaagtcgagtacagggacatagaaatagacgattacaacttgccaatgcagatccttaagcccgctacttttacagacactactcactaccctttgttgttagtagtagatggaacccctggcagccagagcgttgcagagaagttcgaagttagctgggagaccgtcatggttagctcccacggtgccgtggtggtcaagtgcgatggaaggggcagcggattccagggaaccaagcttttgcatgaagtccgtcgccgcttggggctcttagaggaaaaagaccagatggaagcagtgcggaccatgctgaaggaacagtacatagacagaacaagggtcgccgtgtttgggaaagactatggaggatacctgtccacctacatcctgcctgctaagggagaaaatcaaggccagaccttcacatgtggatccgctttatccccgatcacagattttaagctgtacgcatctgcattcagtgagaggtatcttggcctgcacggtcttgacaatcgcgcctatgagatgacaaaggtggctcacagagtaagcgccctggaggagcagcagttcctcatcatccatccgactgcggatgagaagattcattttcagcatacggccgagcttattacacagctcatccgcggtaaagctaattactcgcttcaaatttatcccgatgagagtcattacttcaccagtagtagcttaaagcagcacttgtacagatctatcattaacttctttgtggagtgctttagaattcaagataaattgctgaccgtaactgccaaggaggacgaagaagaagactag

SEQ ID NO: 114694 - DNA, 2277 bp, Artificial Sequence
  Description of Artificial Sequence: Synthetic coding sequence
atgaccaccgctaaggagccaagcgcgtccggtaaaagcgtgcagcagcaggaacaggaactagtaggtagcaacccgccacagcgcaactggaagggaattgctattgccttgctggtgattcttgtgatatgttcgttgatcgtgaccagcgtgattctcctcactcctgctgaggacaattcactgagtcagaagaagaaggtgacagtggaggatcttttcagcgaggattttaaaatccacgaccccgaggctaagtggatctccgataccgagtttatctaccgcgagcagaagggaacagttaggttgtggaacgtcgaaacaaacacttctaccgtccttattgaggggaagaaaatagaaagtctgcgagctatcagatacgagatatcaccagaccgggagtatgctcttttttcctacaacgtcgagccaatatttattttcgagaacaatatttactactgcgcccatgtgggtaagcaggccatacgcgtagtgtcaacggggaaagagggggtaatttacaacggcctttcggactggctctacgaggaagagatcttaaaaacacacatagcacactggtggtctcccgatggcacccgattggcctatgccgccatcaatgacagtcgggtccctatcatggagctccccacgtacacagggtcaatttatccaaccgtgaagccatatcactaccctaaggcagggtcagagaatccctcaatttccctgcacgtcatcggcctgaatggtcctacacacgacctcgaaatgatgcctccggacgacccgagaatgcgcgagtattatataacaatggtgaaatgggccaccagcactaaagtggccgtaacctggctcaatcgggcccagaacgtgtctattctgacactgtgcgacgccacgaccggggtttgcacaaaaaagcacgaagacgagtccgaagcgtggctgcacaggcagaatgaagaaccagtgttctctaaggatggccggaagtttttcttcatccgcgccattccccaaggcgggcgtggaaaattctatcacatcaccgtgtcctcctctcagcccaacagcagcaatgacaatatccagtccataacaagtggtgactgggatgtcacaaagatactggcctacgatgaaaaaggcaataagatatacttcttatccacagaagacttacctaggcgccgtcagctctacagcgctaacaccgtcggcaatttcaatcggcagtgtttgtcttgcgatcttgtggagaactgcacttacttcagcgcgagttttagtcacagtatggatttttttctgctgaaatgcgaggggcctggagtacccatggttactgtgcataacaccactgataaaaagaagatgtttgatcttgaaaccaatgaacacgtcaaaaaagccattaacgaccgccagatgcccaaagtggaatatagggacatcgaaattgacgattacaacctgcctatgcaaatactcaagcctgctacattcacagacacaacccactacccactcctcttggtggtggacgggacacctgggtcacagtctgttgctgagaagtttgaggtcagttgggaaactgtaatggtgtcctcccatggagccgtggtggtgaagtgcgatggcagaggcagtgggttccaggggacaaaattgctgcacgaagtccggaggagacttggtttgctggaagaaaaggaccaaatggaagcagtgaggactatgttgaaagagcaatacatagaccgtaccagagtcgcagtgttcggcaaggattatggaggatatctctccacctacatactcccagccaaaggagagaaccaaggacagacattcacttgtggatccgccctgtcccccatcacagattttaaattatacgcctctgctttctctgagagataccttggactacatggactggacaatcgggcgtacgaaatgaccaaagtggcccacagggtgtccgccctggaggaacaacagtttctcataattcacccaactgctgatgaaaagattcactttcaacataccgcagagctgatcacacagctcattaggggcaaggccaattattcactgcagatctatcccgacgaatcccactactttacaagttcctccctaaagcagcatctctaccgaagcatcatcaacttttttgtggagtgttttcgcatccaagacaagctgctgacagtcaccgcaaaggaggatgaagaagaggactag

SEQ ID NO: 114695 - DNA, 2649 bp, Artificial Sequence
  Description of Artificial Sequence: Synthetic coding sequence
atggccgccgccatggagactgaacagctaggtgtcgagatttttgagactgcagactgtgaggagaacatcgagagtcaagatagacctaagttggaaccattctatgtcgagaggtattcttggagccaattgaagaagctgctggctgacactcggaagtaccacggctacatgatggctaaggctccccatgactttatgtttgtcaagaggaacgaccctgacgggcctcactcggacaggatttactacctcgctatgtccggtgaaaaccgggagaacactttgttctattctgagatacctaaaacaattaaccgggccgccgtccttatgttgtcgtggaagcctttactcgacctgtttcaagccacgctggactatggaatgtatagtcgcgaggaagaactgcttcgagaacgcaagcgcatcggaacagtgggaatcgcctcttatgactatcaccagggatccggaacctttctgttccaggcagggtccggcatctaccacgttaaagacggtggaccccaggggttcacccagcagccgcttcggccaaacttggtggagactagctgccccaatatccggatggatccaaaactctgcccagcagatccggactggattgcctttattcacagcaacgatatttggatatccaatatcgtaacccgggaggaacgacgtcttacttatgttcataacgagctggccaatatggaggaggatgccaggtccgctggggtcgccacttttgttctacaggaagaattcgacaggtatagcggatactggtggtgtccaaaagcggagactactccaagcgggggcaaaatattacgtattctctacgaagagaacgatgaatccgaggtcgagatcatccatgtgacctctcccatgctggagaccaggcgcgcagatagcttccgttaccccaagactggcaccgccaaccctaaagtaaccttcaagatgagcgagattatgatcgacgccgagggtcgtatcattgatgtcattgataaggaattgatacagccttttgagatcctatttgagggcgtggagtatatcgctcgcgctggctggacccccgagggtaaatatgcatggtccatccttcttgataggagccagacccgattgcaaattgtattgatatcgcctgagctatttatcccagttgaagacgatgtgatggagcgtcagaggttgattgagagcgtgccggactccgtgacgcctctgattatctatgaggagaccactgacatttggattaatatccacgatatttttcacgtatttccacaaagccacgaggaagaaattgaatttattttcgcttcagagtgcaagactggatttagacacctgtacaaaattacatcaatccttaaggagtccaaatataaaagatcgtctggggggctgcccgcaccttcagactttaagtgtcccattaaggaagaaatcgctatcactagtggtgaatgggaggttcttggacggcacggctctaacattcaggttgacgaagtcagacggttggtgtattttgaggggacaaaagattccccactcgaacatcacctctacgtggtatcatacgtgaacccaggcgaggtaactcgcttgactgatcgcgggtacagtcattcgtgctgcatttcacagcactgcgatttttttatctctaaatattctaatcagaaaaaccctcactgcgtgtcactgtataagctgagttccccagaagatgacccgacatgcaaaaccaaagaattttgggctacgatcttagatagtgccgggcctctgccagactatacacctccagagattttctctttcgagtcaacaactggttttacactatatggcatgctgtataagcctcacgacctgcagccaggcaagaaatacccaacagtcctattcatctacggcgggccgcaggtccagctcgtaaacaacaggtttaaaggagttaagtattttcgcctgaacacactggcttcccttggttatgtggtcgtcgtcattgacaatcggggatcatgtcaccggggcttgaagttcgaaggcgcattcaaatacaaaatgggccagatcgaaatcgatgatcaggtggaaggtctgcagtacctcgcttcacgctacgatttcatcgacctcgatagggtagggattcacggatggtcttatggaggttacctgagccttatggctcttatgcagcggagcgacattttccgcgtagcgatcgcgggcgcgccagttaccctctggattttctacgacacgggctacaccgagaggtatatggggcaccctgatcagaacgagcagggttactacctggggtccgtggcaatgcaagccgaaaagttcccgagtgaaccaaatcgattactgttgctgcatggttttctagatgaaaatgtgcatttcgcgcacactagcattcttctgtccttcttagttcgcgctggaaagccttacgatctacagatataccctcaggaacggcactctatacgcgtgccagagtctggcgaacattacgagctgcacttactgcactatctgcaagaaaacctcggctctagaattgccgcactgaaagtcatctag

SEQ ID NO: 114696 - DNA, 2550 bp, Artificial Sequence
  Description of Artificial Sequence: Synthetic coding sequence
atgtggaaacggtcagagcagatgaagataaagtctggcaaatgtaacatggctgctgccatggagaccgaacagctgggggttgaaatcttcgagactgccgattgcgaggagaacatcgaaagtcaggaccgcccaaagctagaacccttttatgtggagaggtactcatggagccagcttaagaaattgttagcagacacccggaaataccacggttatatgatggccaaagcaccccacgatttcatgttcgtgaagagaaacgacccggacggcccccactctgacagaatatattacctggctatgtccggagaaaaccgcgagaatactctgttctacagcgagatccctaaaaccatcaaccgggcagctgtgctgatgttgtcctggaaacctctcttagacttgtttcaggcgaccttggactacggcatgtatagtagggaggaagagctgcttcgcgaacggaaacggatcggaactgttggaattgcaagttatgattatcaccaaggctcgggcacatttttgtttcaggcaggctccggaatataccacgttaaggatggaggacctcagggtttcactcaacagcctcttcgccccaaccttgtggaaactagctgcccaaatatcaggatggatccaaagctctgtcccgccgatccggattggattgccttcattcattccaatgacatttggatttccaacattgtgacccgagaagagcgcagacttacttatgtgcataatgaactcgccaatatggaagaggacgcgaggagcgcaggagtggccacctttgtgttgcaggaggagtttgatcgctacagcgggtactggtggtgtcctaaggcagagactaccccttctggcggaaagattctgcgcattctgtatgaggaaaacgacgagtctgaagttgagataatccatgtgactagtccaatgcttgagacgcggcgggcggatagctttcggtacccaaagacaggaaccgccaacccaaaagtgaccttcaagatgagcgagattatgattgacgcggaaggccgcataattgatgtgatcgataaggaacttattcagcctttcgaaattcttttcgaaggtgtggaatacatcgcacgcgcaggctggacacctgagggcaagtatgcctggtcaattttgctggaccggagtcagactaggttgcagatcgtgctgatcagcccagagttatttattccagtggaggatgacgtaatggagcgacagcgattgatcgagagtgtcccagactctgtcacacccctgatcatctacgaggaaaccacggacatctggataaacatacacgacatcttccatgtctttcctcaaagtcatgaggaagagatcgagttcattttcgcctcagaatgcaagacggggttccggcacctgtacaagattaccagcattcttaaagagtcaaaatacaaaagaagttcgggcggactgccggctccttccgacttcaaatgtccaatcaaggaggagatagccattacctctggcgagtgggaggtgctgggtcgacacggctcaaatatacaggtggatgaagttaggagactggtgtatttcgaaggtaccaaagattcccctctcgaacaccacctctacgtagtgtcgtatgttaaccctggcgaggtgacaagactcacagacaggggctattctcatagttgttgtataagccagcattgtgatttttttatcagcaagtatagcaaccagaaaaaccctcactgcgtttctctctataagctctctagtcctgaagacgaccctacgtgtaagaccaaggagttttgggccactattctcgacagcgcagggcctctgcccgattatactccaccagaaatattttcctttgaatccacaacaggcttcaccctgtatggtatgctttacaagcctcatgatctccagccagggaagaagtatccgactgtcctgttcatctatggtggtccacagggtcagattgagattgacgaccaagtcgaaggtctccagtacttggccagcaggtatgactttattgatcttgacagagtgggaatccacggctggagttacggtgggtatttgagcctcatggctttaatgcagaggagcgatatatttcgggtggcaatcgccggcgcaccggtcacactttggattttttatgacaccggatacaccgaaaggtacatgggacaccccgatcagaatgagcaaggatattacttggggtcagtagccatgcaagcagagaagttcccaagtgagccaaatagactgctccttttacatggttttttggatgagaatgtgcatttcgcccacaccagcattttgttgagttttcttgtgcgcgcaggtaaaccctacgatctccagatatacccccaggagaggcactcaattcgcgtgcccgagtcaggagaacactacgagttgcatctcctgcattaccttcaggagaatctgggctccagaatcgccgcactcaaggtgatttag

SEQ ID NO: 114697 - DNA, 2544 bp, Artificial Sequence
  Description of Artificial Sequence: Synthetic coding sequence
atgtggaagaggtccgagcagatgaaaattaaatctggaaaatgcaacatggcagctgccatggagaccgagcagcttggagtcgagatatttgaaacagcggattgcgaggaaaatatagaaagccaggacagaccaaaactcgagcctttctacgtggagaggtattcctggtcacagctaaagaagctgctggcagacaccaggaagtatcatgggtatatgatggccaaggcccctcatgacttcatgtttgttaaacgtaatgatcccgatgggccacattccgacaggatttattatctagccatgtcaggagagaacagggagaatactctcttttatagcgaaattcctaaaaccattaacagagcagccgtgctgatgctgtcctggaagccattactggatctcttccaggcgacgcttgactatgggatgtactccagagaagaagaactgctccgcgaaaggaagcgcatcggcacagtgggaatcgcgtcctatgactaccatcaaggcagcggtactttcctattccaagctgggagtgggatttaccatgtgaaggatggtgggcctcaggggttcacacagcagcccttaagacccaacctggtcgagactagctgtccaaatattagaatggaccctaagctgtgtcctgccgaccctgactggattgccttcatacactctaacgacatctggatctctaacatagtaacgcgggaggagaggaggctcacctatgtccataacgagctggccaacatggaggaagacgcgcgctccgcaggtgtggcgacattcgtccttcaggaggaatttgatcgctattccgggtactggtggtgtcccaaagccgaaacaactcccagcggagggaaaatcttgagaattctttatgaagaaaatgatgagtctgaagttgagatcatacatgtgaccagtcccatgctggaaactagaagggcggacagtttcaggtatcccaagaccggaactgccaatcctaaggtgacttttaaaatgagtgagataatgatcgacgccgaaggtcgcatcatcgacgtgattgacaaggagttaatccagccttttgagatcctgttcgagggggtcgagtatatcgctagggcaggctggaccccagagggtaaatacgcctggtccattcttcttgacaggagtcagaccaggctccagattgttctcatctcaccggagctgttcatcccagtggaggacgatgtaatggagaggcagcgactgattgagagcgttccagacagtgtaaccccactgatcatatacgaagaaactacagatatttggatcaacatccatgatatctttcacgttttcccgcagtcacacgaggaggagattgagttcatttttgctagtgagtgcaaaacaggattccgacatctgtataagatcacatctatattgaaagagagcaagtataaaaggtcctccggaggactgcccgcccccagtgacttcaagtgcccaattaaggaggagattgcaattacctcaggagagtgggaagtgttgggaaggcacgggtccaacattcaggtggatgaggtgagaagacttgtgtactttgaaggcactaaggacagccccctggaacaccacctgtatgtggtaagctacgttaacccgggcgaggtcacacggctaacggatcgaggctatagccactcatgttgcatctcacagcattgtgactttttcatatcaaagtacagcaaccagaagaacccccactgcgtgagcttgtataagttgtcctcccccgaggacgatcctacgtgcaagactaaggaattctgggccaccatcctcgatagcgccggaccactgccagactacacaccgcctgagatcttctcgttcgaatccacgaccgggtttacactgtacggcatgctatacaaaccacatgacctccagcccggcaagaagtatccgaccgtcttgtttatctatggcggtcctcaggtgcaactagttaacaacagatttaaaggagtgaaatactttcgcctaaatacactcgcctcgctgggatacgtagtcgtggtgatcgataaccgcggctcttgccaccgaggcctgaaattcgaaggcgcgttcaagtataaaatggtggctattgccggtgctcctgttactctgtggattttctatgataccgggtatacggagcggtacatggggcaccccgatcagaacgagcaggggtactatctcgggtccgtcgccatgcaggccgaaaaatttccctctgagcccaatcgcttgttactcctccatggctttctggatgaaaacgtgcatttcgcccatacatcaatcctgctgagtttccttgttcgagccggcaaaccgtacgacttgcagatttacccccaggagcgccatagcatcagggtacccgagagtggggagcattacgagctccacctgctacattacctgcaggaaaatctgggaagcaggatcgcagccctgaaggtaatctag

SEQ ID NO: 114698 - DNA, 2178 bp, Artificial Sequence
  Description of Artificial Sequence: Synthetic coding sequence
atgtggaagcgatctgagcagatgaaaatcaaatctggcaagtgcaacatggccgccgcaatggaaaccgagcagctgggcgttgagatatttgagactgcagattgtgaggagaacattgaaagccaggacagaccaaagctcgaaccattctatgtcgagcgatatagctggtcccaattgaaaaaacttctggctgatacaaggaaataccacggatacatgatggcgaaagcaccccatgattttatgttcgtgaagcggaacgacccggatggccctcactccgaccgcatctactatctagccatgtccggggagaacagggaaaacactctcttttactcggagattccaaaaacaattaatcgtgctgccgtacttatgctctcctggaaaccacttcttgatctgtttcaggcaaccttggactacgggatgtattccagggaagaggagctgctgcgcgaaagaaagcgcattgggaccgtcggcatagcctcttatgattaccaccagggaagcggaaccttcctgttccaggcaggtagcggtatctaccacgtcaaggatggcggccctcagggtttcactcagcagcccctgagacctaacctggtcgaaaccagctgtccaaatatccggatggacccgaagctctgccccgctgacccagactggattgccttcatccactccaacgatatctggatcagcaatattgtaacgcgcgaggaacgaagattgacctatgtacataatgagctcgcaaacatggaggaagatgcgcgcagcgccggtgtcgctacattcgtcctacaggaagagttcgacagatacagcggctattggtggtgcccgaaggccgagactacaccttctggggggaagatccttagaatattgtacgaagagaacgacgagtccgaagtagagatcatacacgttacatcaccaatgctcgagactagaagggccgactcattcagatatcccaagactggtaccgcaaacccaaaagttacgtttaagatgtcagagattatgattgatgcagaaggaagaatccaggttgacgaggtcaggagattggtctactttgagggcactaaagattctccacttgagcaccatctgtatgtggttagttacgtcaacccaggagaggtgacaagattgaccgatcgagggtactcccattcctgctgtatctcccagcattgcgactttttcatcagcaaatacagtaatcaaaagaacccccattgtgtgtcgctgtataagctgtcctctcccgaggatgaccccacctgcaaaactaaagaattctgggctaccatcttggactccgctggcccccttcccgactacacgccccccgagattttctcattcgagtcaacaaccggcttcactttgtatgggatgctgtataagccacatgatcttcagcccggcaaaaagtatcctaccgtcctgttcatctacggagggcctcaggttcagttagtaaacaatcgcttcaagggagttaagtactttagacttaacacattggcaagcctcggatatgtggtggtggttatagataacaggggctcttgccatagggggctgaaattcgagggagccttcaagtacaagatgggccagattgagatagatgatcaggtagagggactgcaatatcttgcaagccggtatgatttcattgacctcgaccgggtcggaatccatggctggagctacggaggctacttatccctgatggccctcatgcagcggtccgacatctttcgtgtggcaatcgccggggcacccgttactttgtggatcttttatgacacgggctataccgaacgctacatggggcaccccgaccagaatgagcagggttactatctcggatccgtcgcaatgcaggccgagaaatttccatccgagccgaatcgtctgctcttgctacacggcttcttagacgagaatgtccactttgcacatactagcatcctgctttcctttctggtaagagccggcaaaccttatgacctgcagatttacccccaagaacgtcacagcattagggtcccggaatctggtgagcattatgagctacatctgctccactatttgcaagaaaacctcggctcacgcattgcagcactgaaggtgatttag

SEQ ID NO: 114699 - DNA, 2697 bp, Artificial Sequence
  Description of Artificial Sequence: Synthetic coding sequence
atgtggaaaagatccgaacagatgaaaattaagtccgggaagtgcaatatggctgcggccatggaaaccgaacagttaggggtggaaatctttgaaacagcggattgcgaagagaacatcgagtctcaggatcggccaaaattggaacccttctatgtggagcggtactcctggagccaactgaagaaactcctggccgatactcgcaagtaccacgggtatatgatggcgaaagccccccacgactttatgttcgtgaaaaggaatgaccccgacggcccacattctgacaggatctattacttggccatgtcaggggaaaatagagagaatacattattctatagcgagatcccaaagactatcaatagagcggctgtgctcatgctttcgtggaagcccctgctggatcttttccaggccacactggattacggcatgtattcacgggaggaagaactgcttagggagagaaagagaattggtactgtgggcattgcttcttacgattatcaccagggctccggcacgttcctgtttcaggctgggtccggcatttaccacgttaaggacggtggaccacaaggattcacacagcagccactacgaccgaatctcgtggagacctcatgtcctaatatccgtatggatcctaaattgtgtccggctgacccagactggatagccttcatccactctaatgacatttggatttccaacattgtaacaagagaggagcgtcgtttgacttacgtgcacaacgagctcgccaatatggaggaagatgctaggtccgccggcgtcgctaccttcgtgcttcaggaagaattcgaccgctactctgggtactggtggtgtccgaaggctgaaacaacaccatcaggggggaagatcctgcggattttatacgaagagaatgatgagagtgaggtggaaataatccatgttacaagcccaatgctcgagacccggagagccgattccttcagatatccaaaaactgggactgctaaccctaaggtcacatttaagatgagcgagatcatgatcgatgccgagggacgaattatagatgtaattgataaggagcttattcagccttttgagatcctgttcgaaggggtggagtacattgcacgcgccggatggacccccgagggcaaatacgcatggtcaattttgctggacaggtcccaaactcgtctgcaaatcgttctaatctcccctgagttgttcataccggtggaagatgatgttatggaaagacagcgacttatcgagagtgtacccgactcagttaccccactgatcatatacgaggagaccactgacatatggattaatatacacgacatctttcatgtattccctcagtctcacgaagaggaaattgaattcatttttgcctccgaatgcaaaactggattccggcacctttacaaaatcactagcatactgaaagaatcaaaatacaaacgctcctccggtgggttaccggctccctcagatttcaaatgtcccattaaagaggaaatcgcaattaccagtggcgagtgggaggtcctgggtcggcatggcagcaatattcaggtcgacgaggtgagaaggctggtttattttgagggtaccaaggactctccactggaacaccacttgtacgtggtgtcctatgtgaatcccggggaggtcactcggctgactgacaggggttatagccacagctgctgcatttctcagcattgcgatttcttcatctcaaagtatagcaatcagaaaaacccccattgtgtgagcttatacaagctgtcctccccggaggacgaccccacatgtaagacaaaggaattctgggccaccattctcgattctgctgggccactaccagattatactccccctgaaatattcagctttgagagtaccactgggttcaccctgtacggcatgctgtacaagccgcacgacttacaaccggggaagaagtaccctaccgttcttttcatttacggaggccctcaagtccaattggtgaacaaccggttcaagggcgtaaagtacttccgactgaacacccttgcctctcttgggtatgtcgtcgtggtgatagacaacaggggctcttgccaccgtggcctgaagttcgagggtgcctttaaatataagatgggccagattgaaattgatgaccaggtggaaggtctacagtatttagcaagcagatacgatttcatcgacctcgatcgtgtgggtatccacggttggtcgtatggaggctacctgagtctgatggcgctgatgcagagatctgatatcttccgagtggccattgcaggggcccctgttacactgtggattttctatgatactgggtataccgagaggtacatgggacacccagaccaaaacgagcaaggttactacctgggcagtgtggctatgcaggcagagaagtttccatccgaacctaatcgcctgctcctgctccacggtttcttggacgagaacgtgcacttcgcccacacaagcattcttctttccttcctggtgagagcgggaaagccttacgatttgcaaatttacccccaggaaaggcattcaatacgcgttcctgaatccggagagcattatgaactgcacctgttgcactacctgcaggagaatctgggaagccgcatcgctgctcttaaagtcatttag

SEQ ID NO: 114700 - DNA, 2349 bp, Artificial Sequence
  Description of Artificial Sequence: Synthetic coding sequence
atggccgccgccatggagaccgagcagctgggagtggagatattcgagactgcagattgtgaggagaatattgaatcgcaggacaggccaaagttggaacctttctatgtggaacggtacagttggtcccagctgaagaagctccttgccgatactcgaaagtatcacggttacatgatggctaaggctccacacgactttatgttcgtcaagagaaatgaccctgacggtcctcatagtgaccgcatctattatttggctatgtctggcgagaaccgcgagaacactttgttctactctgagatacctaagactataaacagagccgcagtgcttatgttgtcctggaaaccactgctggatctctttcaggccactcttgattacgggatgtatagccgggaggaagaattgttgcgggaaaggaaaaggatcggtactgtcggtatcgcctcctacgactaccaccagggatctggtacgtttttatttcaggccggctcaggcatctaccacgttaaagatggagggcctcaggggtttacgcagcaacccttgcggcccaacctggttgagaccagttgcccaaatataagaatggatcccaagctgtgtccggccgatccggactggatcgcgtttatccatagtaacgacatttggatttctaatattgtgacccgggaagagcgccggttgacatatgtgcataacgagctggcaaacatggaagaagatgccaggagtgccggcgtagccaccttcgtacttcaagaggagtttgaccggtattccggctattggtggtgccctaaagccgaaaccactccatcgggcgggaaaatcctcaggatcctgtacgaggagaacgacgagtctgaggttgagataatccatgtgacgtcacctatgctcgaaacacgtcgggcagattccttcagatatcctaagacgggcaccgccaatccgaaagtcactttcaaaatgagcgagattatgatcgacgcagaaggtagaattattgacgtcatcgataaagagctgatccagccctttgagatcctgtttgagggagtggagtacatagcccgagccggctggactccagagggcaagtacgcttggagtattctgctagatcgcagccagaccaggcttcagatcgtgcttatcagcccagaactatttataccggtggaagatgacgtcatggagagacaacgcctgattgagtcggttccagactccgtcacacccctgatcatctacgaagagacgacggatatatggataaacatacacgatatcttccatgtgttcccgcagtcccacgaagaagagatcgagttcatctttgcttctgagtgtaaaactggcttcaggcatctgtataagatcacatctatcctcaaagaaagcaaatataaaagatccagcggtggtttgcccgcaccatccgattttaagtgtccaatcaaagaggagatagcaatcactagcggggagtgggaagttctggggagacatggcagcaacattcaagttgacgaggtgcgccgacttgtttattttgaagggaccaaagactctccactggaacaccatctgtacgtggtgagctacgtaaaccccggcgaggtaacccgcctgaccgaccggggttactcccactcctgctgtatcagtcagcactgcgacttcttcatatctaaatactctaatcaaaaaaatcctcattgtgttagcctctacaaactatcttcacccgaagatgaccctacttgtaaaactaaagagttctgggctactatactcgacagcgccgggcctctgcccgactatacgcctcctgaaattttctcattcgaatcgactacaggtttcacactatatgggatgctgtacaagccgcacgacttacagccagggaaaaagtacccaactgttcttttcatttatggcgggccacaggtggctattgctggagctcccgtgaccctgtggatcttctacgacaccggatatacagaaaggtatatgggacatcctgaccagaacgaacaaggctattacctgggcagcgtggctatgcaggcagagaagttcccaagtgagccgaatagactgctgttactccacgggtttctcgacgaaaacgtccactttgcccatacaagcatactcttgtcttttctggtacgggccggcaaaccttacgatttgcaaatctatccacaggaaaggcattccatccgggtcccagagagtggcgagcactacgaactgcacttgctgcattacctgcaggaaaacctcgggtcacgtatagctgccctcaaagtcatttag

SEQ ID NO: 114701 - DNA, 2697 bp, Artificial Sequence
  Description of Artificial Sequence: Synthetic coding sequence
atgtggaaacggtctgagcagatgaagattaagagtggcaagtgcaacatggccgccgccatggaaacggaacaactgggggtcgagatattcgagacagccgattgtgaagagaatatcgaatctcaggaccggcctaaattggagcccttttacgtggaaagatactcatggtcacagctgaagaaactgttagccgacactagaaagtaccacgggtatatgatggccaaggccccccatgattttatgtttgtaaaacgcaatgaccctgacggcccccactctgacagaatttattacttagccatgtctggtgagaaccgggagaacacactcttctattccgagattcctaaaacaattaatcgagccgctgttctgatgctgagttggaagcccctgctcgatctttttcaggctaccctcgattacggcatgtacagccgcgaggaagagctcttaagagaaagaaagcgaataggcaccgtcggaatcgctagctacgattatcatcagggaagcggcacctttttgtttcaggccggtagcgggatctatcacgtgaaggacggcggcccccagggattcacacaacagcctctgagacccaatctggtcgaaacaagttgtcccaatatcagaatggatcccaaattatgcccagcagatcctgactggattgcgtttatacatagtaacgatatctggatatcaaatatcgtgactagggaagagcgtcgcttgacctacgtacacaatgagttggccaacatggaagaggatgctagaagcgccggagtggctacattcgtgctccaagaagagtttgataggtacagcggctattggtggtgcccaaaggccgaaaccaccccatcgggcggcaaaatactgagaatcctctacgaagagaacgatgaaagcgaggtcgaaatcatccacgtgaccagcccaatgcttgagacgaggagagcagattctttccgctatcctaagacaggcaccgccaatccaaaggttacttttaaaatgtccgaaattatgatcgacgcagaagggaggattatagatgtaattgataaggagttaatacaaccattcgagatactgttcgaaggggttgaatatattgccagagcagggtggaccccagaaggaaaatatgcatggtctatcctccttgatagatcgcagactaggctgcagattgtgcttatctctcccgaattgtttatccctgttgaggacgacgtgatggaaagacaacggctcattgagagcgttccagacagtgtcactcctctcattatctacgaggaaacaacggacatctggatcaacattcacgacatatttcacgtgttcccgcagtcccacgaggaggagatcgaatttatcttcgcatctgaatgcaaaaccggcttcagacacctgtacaagattacgtcaatcctgaaagagtctaagtataaacgaagcagtggaggcctgccagccccttcagattttaaatgcccgatcaaggaggaaattgcaattacctccggggagtgggaggtgctgggtaggcacggctcaaacattcaagtggacgaagtgcgcagactggtctactttgagggaactaaagactcaccattagaacatcacctgtatgttgtgtcatatgtcaacccaggggaagtgacgcgtctgaccgatcggggctactcacattcgtgttgtatctcacagcattgtgacttttttatcagcaagtattcaaatcaaaagaatccacattgtgtgtcactgtacaagctatctagccccgaagacgaccctacctgtaagacaaaagaattctgggcaaccattttggattcagccggtcccctgccagattacacaccccccgagattttttcattcgagtccacaacagggttcacactgtatggaatgttatataagccacacgacctgcagcccgggaaaaagtatcctactgtactatttatctacggaggtccccaggtccaactggtcaataatcgatttaagggagtgaagtacttcagactgaataccctcgcctctttaggctatgtggtcgtcgtcattgacaaccgaggctcttgccaccgtggcctcaaatttgagggcgcttttaagtacaaaatggggcagatcgaaattgacgaccaggtggagggcctccagtatctggccagcagatacgacttcattgatcttgatcgggtggggatccatgggtggagttatggggggtacctgtctcttatggccctgatgcagagaagtgacatttttagagtggcaatagctggagcccctgtcacactgtggattttctacgacactggatatacagaaaggtacatggggcacccggaccagaatgagcagggctactaccttggaagtgtcgctatgcaggccgagaaatttcctagtgagcctaacaggctgttgctgctgcacggtttcctggatgagaacgttcactttgctcatacctcaatcctgcttagcttcctggtgcgcgcaggaaagccttatgacctacaaatctacccccaagaaaggcacagtattcgagtgcctgagtcgggagagcactatgagctccatctgctgcattacctacaggaaaatctggggagtagaattgctgcgctgaaggtgatatag

SEQ ID NO: 114702 - DNA, 3669 bp, Artificial Sequence
  Description of Artificial Sequence: Synthetic coding sequence
atgtctgaggcaccgagatttttcgtgggaccagaggatactgagatcaaccctggaaattatagacatttttttcaccacgccgacgaggatgacgaggaagaggacgatagcccgcccgagagacagattgtggtcggaatatgtagcatggcaaagaagagtaagagtaagcccatgaaggagattttggagcgcataagcttgtttaaatatattactgtggtcgtgtttgaagaagaggtgattttgaatgagcccgtggagaattggcctctctgtgattgcctgatctcgttccatagcaaagggttccccctggataaggctgtggcgtacgctaagttaaggaacccttttgtaattaatgacctgaatatgcagtatctgatccaagaccgacgagaggtctattctatcctgcaagctgagggaattctgcttcccaggtacgctatcctgaatagagaccctaataatccgaaagagtgcaacctgattgagggcgaggaccatgtggaggtcaacggcgaggtgttccagaagccctttgtggaaaaacctgtcagcgccgaagaccataatgtgtacatctattaccctacatctgcgggggggggctcacagcgactgttccgaaagatcggcagcaggagctctgtatacagccctgagtctaatgttcggaaaaccgggtcgtacatatacgaggagttcatgccaaccgatggaacagacgtaaaggtttacaccgtaggcccggactacgcgcatgccgaagccagaaaatcccctgccctcgatgggaaagtcgagagggattcagagggtaaggaggtacggtaccctgttatacttaacgcaagggagaagctgatcgcatggaaggtgtgtctggccttcaaacagactgtctgcgggtttgacctgctgcgggccaacggacagagctatgtctgcgatgttaatggatttagcttcgttaagaactcaatgaagtattacgatgactgcgctaagattttggggaacatcgttatgagagaattggctccacagttccacataccctggagcatcccgctcgaggccgaagacattcctatcgtacccacaacttctggaacaatgatggagctcagatgcgtcatcgccgtgattagacatggtgatcgtacacccaagcagaagatgaaaatggaagtccgccatcaaaagtttttcgacctatttgagaagtgtgacggttacaaatcaggcaagttgaagctaaagaagcccaagcagctccaggaagtactagacatagccagacagttgttgatggaactggggcagaacaacgatagtgagattgaagagaacaagcccaagctggagcagcttaagaccgtcctggaaatgtatggccattttagcgggatcaacagaaaggtgcagctgacatatctaccccacggatgccctaagactagtagtgaagaagaggacagtagaagagaggaaccatccctgctgctggtactcaagtgggggggagagttaacacccgctggacgcgttcaggccgaagagctgggccgtgctttcagatgcatgtacccgggaggtcagggtgactacgctgggtttcccggttgcggcttacttcgactgcacagcacctaccgtcacgacctcaaaatctatgcttcggacgaggggagggtgcagatgaccgctgctgccttcgctaaaggactgctggctctggaaggggagttgacacccatcctggtacagatggtcaaaagcgcaaacatgaatggactgctggattcggactccgattcactctccagctgtcagcaacgagtaaaggctaggttgcatgaaatcttgcaaaaagatagggactttaccgctgaggattacgaaaagctgactccctccggaagcatctccctgataaaatccatgcatctgatcaagaatccggtcaagacttgcgacaaggtctattccctgatacaaagcttgacctcacagatccgccacagaatggaggacccaaagtcctctgacatacaactttaccactcggaaaccctcgagctcatgctgaggagatggagtaagctggagaaagacttcaagactaagaacggccggtacgatattagcaagatccctgacatctatgattgtataaagtatgacgttcagcataacgggtcattgaagttagagaacaccatggagctctaccggcttagcaaggctctagcggatatcgttatcccacaggaatatggtatcaccaaggccgaaaagctggaaatcgctaagggctactgtaccccgctggtgagaaagattcgtagcgacctacaaaggacacaagacgatgacacggtgaacaagctgcacccagtctacagtagaggtgtgctttcccctgaaagacacgtgcggacgagactttacttcacttcggagagtcatgttcattcacttttgagtatccttcggtatggggcactgtgtaacgagagtaaggatgagcagtggaagcgcgccatggattacttgaacgtagtgaacgaactgaattatatgacacagatcgtaataatgttatatgaagatcccaacaaggacctgtcatcggaggagcgctttcatgtggaactgcactttagccccggtgctaaaggctgtgaggaagataagaacttaccttctggatacgggtatagacctgcttcacgggagaatgaaggacggcgtcccttcaaaatagataacgacgatgaacctcataccagtaagcgggatgaagtggaccgggccgtgattctatttaagcccatggtctctgaacccatccacatccatcgtaaaagccccctgcctagaagtcgcaagaccgcgacaaacgatgaagagtcccccctgtcagtgtctagccctgaggggaccgggacctggctacactatacgtccggggtcggaactgggcgcagacgacggcgcagtggggagcagattacatccagccccgtgagtccaaagagccttgccttcacttcttctattttcggaagttggcagcaggttgtgagtgaaaatgcaaattacctccgtaccccccgaactctggtggagcaaaagcaaaaccctacggtgggctctcactgcgctggattgtttagcacctccgtgctaggcggctcatcatctgctcctaatctccaggattacgcaaggacccatcgcaagaaactgacatcttccggttgcattgatggcttcgaactgtattctatggtgccctctatctgtcctttggagacgctgcataacgctctgtccctgaagcaagtcgatgaatttctggctagcattgcaagcccctcatccgatgtaccccgaaaaactgctgagatttcctccaccgcccttagatcttcccctattatgaggaaaaaagtgagtctgaacacatacacacccgccaaaattttgccaaccccacctgcaactctaaaaagtaccaaagcaagcagcaagcccgctacgtccggcccaagctcagccgtggtgccaaacacaagtagcagaaaaaaaaacatcacttccaaaaccgaaacccatgaacataagaagaacaccggcaaaaagaaatag

SEQ ID NO: 114703 - DNA, 3732 bp, Artificial Sequence
  Description of Artificial Sequence: Synthetic coding sequence
atgagcgaagccccgaggttcttcgtaggtcccgaagataccgagataaatcccggaaactaccgacacttttttcaccacgcagacgaggacgatgaagaagaggacgattccccaccagagcggcagatcgttgtgggaatctgcagcatggctaagaagagcaagagcaaacccatgaaagagattctggaacgcatctcactgttcaaatacattaccgtagtggtgtttgaggaggaggttattctgaacgagcccgtggagaattggcccctgtgcgactgtctgatttcattccatagcaagggcttccccctggacaaggccgtggcatacgcgaagcttcgtaacccttttgtaatcaatgatctcaatatgcagtacctgattcaggaccgccgcgaggtttattccatcctgcaggcagaaggtattcttctccctaggtacgccatcttgaatagggatcccaacaaccctaaagaatgcaatttgatagaaggcgaggatcatgttgaggtgaatggcgaagtattccagaagcccttcgtggagaaaccagtctctgccgaagatcacaacgtgtatatatactaccctacctctgctggaggcggatcacagcgactcttcagaaagatcgggtctcgcagctctgtgtactccccggagagcaacgtccgcaagactggctcttatatatacgaggaattcatgcccactgacgggacagacgtgaaggtctatacggtgggccccgattatgctcacgccgaggcaagaaagagccccgcgttggatggcaaagtggaacgagattctgagggcaaggaagtgcggtacccagtgatcttgaacgctcgagaaaagcttatcgcttggaaagtgtgtttggccttcaagcagactgtttgcggctttgacctgctccgagcgaatggtcaaagctatgtctgtgacgtaaatggattttcctttgtgaaaaactcaatgaaatattatgatgattgcgccaagatacttggcaatatagtgatgagggaactcgctccgcagttccacataccctggagcatccccctcgaggctgaggacattccgatcgttcccacaacttccggaaccatgatggagttaagatgcgtcatcgccgtaatccggcatggcgacagaactcctaaacagaagatgaagatggaggtaagacaccagaaatttttcgatctattcgagaagtgtgacggatacaagtctggtaagctgaagctgaaaaagcccaaacagttgcaggaagtactggatatcgcacgacagctgctgatggagctgggccagaataatgattccgaaatagaggagaacaaacctaagctggagcagcttaagaccgttctggagatgtacggacacttttccgggataaatcgcaaggttcagttaacctacctgcctcacggttgtccaaagacgagtagcgaggaggaggactcgcgacgagaagaaccttctctcctccttgtactcaaatgggggggggagctgacacccgccggccgagtgcaggccgaggagctcggccgcgcatttagatgcatgtatccgggcggccaaggcgactacgccggtttccctggctgcggtctgttgagactgcactcgacctacaggcacgatctgaaaatctacgcctcggacgagggccgcgttcagatgactgccgcagcttttgccaagggtttacttgccctggaaggagaattgacgccaatccttgtgcaaatggttaaaagcgccaacatgaatggattactagatagcgattctgattctctaagctcctgccagcagcgggtgaaggcaagattacatgagatcctgcagaaggatcgggacttcactgctgaagattacgagaagctaacccctagcgggtccatatccctgatcaaatctatgcatttgatcaagaatcctgttaagacttgcgataaggtctattctctgatccaaagtctcacatcccagattcgccatcggatggaagatccaaagagctccgacattcaactatatcactctgagactttggagttgatgctgaggaggtggtcaaaattggaaaaggattttaagaccaaaaacggcaggtatgacatttcaaagatacctgatatctacgattgtatcaaatacgatgtccagcacaacggatctctcaagcttgagaatacaatggaattatatcggctgtccaaagccctggccgacatcgtcattccccaggagtacgggatcactaaagcggaaaaactggaaatcgcaaagggttattgcacacctttggtcaggaagattcgcagcgatctgcagcgaactcaggatgacgacactgtgaataagctgcacccagtctactcaagaggcgtgcttagccctgagaggcatgtaagaacccgcctgtacttcacctcagaatctcacgtccactcgttgctgagcatactgagatacggcgccctgtgcaacgagagcaaggatgagcagtggaaacgcgccatggattacctcaatgtcgtgaacgaattgaactatatgacccaaattgtcattatgctttacgaggacccgaacaaagatttatctagtgaagagaggtttcatgtggagctgcatttttcgcctggggccaagggctgcgaggaggacaagaatctgccctctggatacgggtatcggccagcgtcacgcgaaaatgaaggaagacggcctttcaaaatcgataatgacgacgagcctcacacatccaaacgggacgaggtggaccgagccgttatcttatttaagcctatggtgagcgaacccatccatattcaccgtaagtcaccgttgccccgtagcaggaagactgctactaacgacgaggagagtccgctgagcgtttcgtccccagaaggcaccggaacttggttgcactatacctccggtgtgggaacaggcagacgccggaggcgatccggcgagcagatcacatcatcacccgtgagccccaagagtcttgcttttacttcatcgatttttggatcttggcagcaggttgtctcagagaatgccaactatttacgaactcctagaacactcgtggagcaaaaacagaatcctaccgttggttcacattgtgccgggctgttttcaacttcagtgctcggcggctcgagttctgctccaaatctccaggattacgctcgcacacatcgcaaaaagctcacatcatctggatgcatcgatgacgctacccgagggtccgctgtgaagcgattctccattagcttcgctagacaccctacaaacggctttgaactttacagcatggtgccatccatctgccctctggagacacttcataacgcgctgagcttaaagcaggtagacgaattcctcgcttctatcgcctcaccctcttcagacgtgcctaggaagaccgctgaaatcagttctaccgctttgcgaagctcccccatcatgcgaaaaaaggtctcgctgaacacgtacactccagctaagatcttacctactccgcccgctacactcaaaagtacaaaggcttccagtaaaccggcaacgagcgggccatcttcagccgtggtgcctaacacctcaagtcggaaaaaaaacattacgagcaagaccgagacccacgagcacaaaaagaacaccggcaaaaaaaagtag

SEQ ID NO: 114704 - DNA, 3669 bp, Artificial Sequence
  Description of Artificial Sequence: Synthetic coding sequence
atgtccgaggccccaaggttttttgtggggccggaggataccgagattaatccggggaactataggcatttctttcaccacgccgacgaagatgatgaggaggaagatgactcacccccggaacgtcaaattgtggtcggtatctgcagtatggctaagaaaagtaagtctaaacctatgaaggaaattttggaacgaatatcactgttcaagtacatcacggttgtggtgtttgaagaggaggtcatcctgaatgaaccggtagagaattggccattgtgtgactgtctgatctccttccattccaaaggtttcccactggataaggcggtggcttatgcaaagctgcgcaatccattcgttatcaatgacctgaacatgcagtacctgatacaggaccggagagaggtgtattctattttgcaggcggagggaatccttttgcctagatacgcaatcctgaaccgagaccccaataaccccaaagagtgtaacttgattgaaggcgaggaccatgtcgaagtgaacggagaagtgttccagaagcccttcgttgaaaagcccgtcagtgcagaagaccacaacgtgtatatatattatcccacctccgctggtggcggctctcagcgtctcttccggaagatcgggagtcgcagttcagtgtacagcccagagtctaatgtgcgaaaaaccggttcttacatatatgaggaattcatgcccacagacggcaccgatgtaaaagtttacactgttggacctgattacgcgcacgcggaagctaggaagagccctgccctagacgggaaggtcgaaagggacagtgaggggaaggaggtgcgctaccctgtgatccttaacgcccgtgaaaagctgatcgcctggaaggtctgccttgctttcaagcagaccgtgtgcggatttgatttgcttcgcgccaatggccagtcctacgtgtgcgacgttaatggttttagttttgtaaagaattctatgaagtactatgatgactgcgcaaaaatactgggaaatattgtgatgcgggaactggcccctcagttccacatcccctggtcaatccctctcgaggcggaagacatccctattgtgcctaccacttctgggaccatgatggaactcaggtgtgtgattgcggtgatccggcacggcgaccgaacacccaaacaaaaaatgaagatggaagttcgtcatcagaaatttttcgatctttttgagaagtgtgacggttataaatctggcaagctgaaactgaagaagccgaaacagctccaggaggtccttgacatcgctcgccaacttctgatggagcttgggcagaacaacgactctgagattgaagaaaataagcctaagctggaacagctaaaaactgtgctggagatgtatgggcatttttcagggattaacagaaaggtacagctgacatatctgccgcacggctgccccaaaacgagcagtgaggaagaagattcccgccgggaggagccctctctgcttctcgttttaaaatggggcggcgaactgacacctgctgggagggtccaggccgaggaactgggccgagcttttcggtgtatgtaccctggcggtcagggagactacgcgggctttccaggatgtggcctgcttcgcctccactcgacttaccgccatgatctcaagatttacgccagcgatgaaggacgcgtgcagatgacagccgcagccttcgcaaaggggctcctggctttagaaggggagctgacccccatcttagtgcagatggtgaagagcgctaacatgaatgggctactggattctgatagcgatagcttatcctcttgtcagcagcgcgttaaggcgcgccttcacgagatcctccagaaggaccgtgacttcaccgctgaggattatgaaaaactgactccgagcggctccataagccttatcaaatctatgcacctgattaagaatcctgtcaagacctgcgataaagtgtattcactgatccagagcctgacctcccagattaggcaccgcatggaggaccccaaatcttcagacatccaattatatcattccgaaacccttgaactgatgctgcgccgttggtctaagctggagaaagattttaagacgaagaacggacggtatgacatcagcaaaatacccgatatatacgactgcataaaatatgatgtgcagcataacggctctctcaaattggaaaatacgatggaactgtatagactgtccaaagcactcgctgatatcgtgattccccaggaatacggcataaccaaggccgagaaactcgagatcgccaaggggtactgtacgcccctggtgagaaagatacggagcgatctgcagagaacacaggatgatgacactgtcaataaactgcacccggtctactcgcgcggggtgctctcaccggagcgacatgtgaggactcgtctctatttcacttcagagtcccatgtgcacagcctgctgtccatcttaagatacggagccctgtgtaatgaaagcaaggacgaacagtggaagagggccatggactatctcaatgtggtgaacgagctcaactacatgacccaaattgttatcatgttgtacgaggaccccaataaggatctgtctagcgaggagcgttttcacgtcgagctgcacttttccccaggcgcaaaagggtgcgaagaggataagaatctcccaagcggatatggttatagacctgcctcgcgcgaaaatgagggaagacgacccttcaaaatagataacgatgacgagccacatactagcaagagagacgaagtagatagagccgtgatactgttcaagcccatggtttccgagccaattcacatccatcggaagtctcccctgccaagatcccggaagaccgccacgaacgatgaggagagtccgctgagtgtgtcatcacctgaaggcacaggcacgtggctgcactacacctccggggtaggcacgggcaggcggaggcggcgctcaggtgagcaaataacttcctcccctgtctcccccaagagtctcgcctttactagttccatttttggctcctggcagcaagtagtgtcagagaatgccaattaccttcgcacccctcgcacactggtcgagcagaagcagaatcctaccgtaggcagccactgcgccgggctgttttctacgagtgttctgggaggttccagcagtgcaccaaatctccaagactacgcccgcacgcatcgaaaaaagttgacatcttccgggtgtatagatgggtttgaattatactccatggtgccctccatttgtcctttggagactctgcacaacgcactatcccttaagcaggtggatgagttccttgccagtatcgcttctccttcctctgacgtgccccgaaaaaccgcggaaatttcgagtaccgctttacgaagcagtccaatcatgcggaagaaagtctcactgaatacctatacacccgcgaagattctgccgaccccacccgccactctgaagagcaccaaggccagctcaaagccagccacatctggacccagctctgcggttgtacccaatacgtctagccgtaaaaaaaacatcactagtaagaccgagacacacgaacacaaaaagaacaccgggaaaaagaagtag

SEQ ID NO: 114705 - DNA, 3837 bp, Artificial Sequence
  Description of Artificial Sequence: Synthetic coding sequence
atgagtgaggctccaagatttttcgtcggccctgaggacactgagattaatccgggcaattaccggcacttcttccatcatgccgacgaggatgacgaggaggaagacgattcgcctccggaaagacagattgtagtggggatttgctcaatggcgaaaaaatccaaatctaagcctatgaaagaaattctcgaacgcatatctttgttcaagtacattaccgtcgtggtatttgaggaggaggtgattctgaatgaacccgtggagaactggcccctttgtgattgtctaatcagcttccacagcaagggatttccactggacaaagctgtggcgtacgcgaagctacggaatcccttcgtcatcaacgatctgaacatgcagtatctgatccaagacagacgtgaagtgtattctatcttgcaggcagaaggtatattactgcctagatacgccatacttaacagggatcccaataaccccaaagagtgcaaccttatcgaaggagaagatcatgtcgaggtgaacggggaagtctttcagaaaccattcgtcgagaaacccgtatctgcggaggatcataatgtctacatttactaccccacatcagctgggggggggtctcagcggttgtttcggaaaatagggtcgcgttccagcgtgtactcccccgaatctaacgtccgtaagaccgggtcgtatatctatgaggaattcatgccaactgacggtactgacgttaaggtctacaccgtgggaccggactatgcccacgccgaggccaggaaaagtccagctctggatgggaaagtggagagggattctgaaggaaaggaggtgcgctatcccgtgattctgaatgctcgagaaaaactgattgcctggaaagtgtgtctggcatttaagcagaccgtctgtggttttgacctgctgcgtgctaacggccagagctatgtttgcgacgttaatggattttctttcgtcaagaacagcatgaagtactacgatgactgcgccaaaattctcggaaacattgtcatgcgtgaactggctccgcagttccacattccatggagtattcccctggaggccgaagacatcccaattgtgcctacaacgagcggtacgatgatggagctgagatgtgtaatcgccgttatcagacacggggaccgaacgcctaagcagaaaatgaagatggaggtaaggcaccagaagttctttgatctgtttgaaaagtgcgacgggtataagtcagggaagttaaagctgaaaaagcctaagcagctccaagaggtcctggatattgccaggcaactcttgatggagctggggcaaaataacgattccgagatcgaagagaacaagccaaagctggagcagctgaaaaccgtgctcgagatgtatggtcatttttcaggcataaacaggaaggtacagctgacctacctcccgcacgggtgccctaaaacctcatctgaggaggaagattctcggagggaggaaccatcccttctcttagtccttaagtggggtggcgagctgacacccgcaggtagagtgcaggctgaagaacttggccgggccttcaggtgtatgtatccaggtggccagggcgactatgccgggttcccaggctgtggactgttgagactccatagtacctacaggcatgatctgaagatctacgcctccgacgaaggccgcgtccagatgacggccgctgcgtttgcgaaaggtcttctggcactcgaaggcgaactgacccctatcctggttcagatggtgaaaagcgccaacatgaatgggctgttggacagcgatagcgatagcctgagcagctgccagcaacgagtgaaggcacggctgcatgagattctccaaaaggatcgcgattttaccgccgaagactacgaaaagctgactccttcaggatcaattagcctcatcaagagcatgcatctgatcaagaatcccgtcaaaacatgcgacaaagtctatagcctcatacagtccttaactagccaaatacgacacaggatggaagatccaaaatcaagcgacattcagttgtatcactcggagaccctcgaactcatgctaagacgctggtctaagctggagaaggacttcaaaacaaagaacggccggtacgacatcagcaaaatcccggatatctacgactgtattaagtacgatgtgcagcataatggttccctgaagcttgagaatacgatggagctgtatcggctgtctaaggctctcgccgacatagtgatcccccaggaatatggtattactaaggccgagaaactggagatcgccaaaggatattgtactcctctcgtgcgaaagatcaggtcagatctgcaaaggactcaggatgacgacacagttaacaaactgcacccagtatattcgagaggagttctgtcaccggagagacacgtgcggacccgtttatacttcacctccgagagccacgtgcattccctgttgtccattctccgctatggtgctctgtgcaacgatcacgactcccagaacgaggacggtggaatggtcaaagagatggaaagcaaggacgaacaatggaagagagctatggattacctgaacgttgtgaacgagctgaactacatgacgcagatcgtgatcatgctgtatgaggaccctaacaaggacctgagtagcgaggaaagattccatgtagagctgcactttagtccaggtgccaaaggttgcgaggaagataagaacttacccagcggatacgggtatagacccgcgtctcgggaaaatgaggggcgccgcccttttaaaatcgacaacgacgacgaaccccataccagcaagcgagacgaggtggacagggcagtcatcctgttcaagcctatggtgtcagagcccattcatatccatagaaaatctccgctcccacgatcccgtaagactgccaccaacgatgaagagagtcctctttcagtgtcttctcctgagggaacaggaacctggcttcactacacttccggagtggggacaggccgccggagacgccggtctggagagcagattacatctagccccgtctcccctaaatcactggcattcaccagttcaatatttggatcctggcaacaagtggtaagcgagaacgccaactacctgcggactcccaggaccttggtagagcagaaacagaacccgacagtaggcagtcactgcgccgggttgttttccacctctgtcctaggagggtcgtcatccgcacccaatttacaggactatgctcggactcatcgtaagaagctgacctcttcgggctgtatcgacgacgcaacccggggcagcgctgtcaaacggttttcaatctctttcgctcggcaccccactaacgagcatcttcatctgtacagatgttggtctgtgagctccgtcgagtttctcggatccagtggattcgagttatatagtatggttcccagcatttgtcccttagaaaccctgcacaacgctctttccctgaagcaggtagacgaattcctggctagcattgcttcaccctcaagcgacgtacctcgcaagacagccgagattagcagcactgctctcaggagttcacctattatgaggaagaaggtaagcctcaacacctatacgccggcaaagattcttccaaccccaccggcgacactcaagtctacgaaggcaagttcaaagcccgctacgagcgggccttcctcagccgtcgtgcctaatacatcatcacgaaagaagaacattaccagcaagactgagactcatgaacataagaagaacacagggaagaaaaagtag

SEQ ID NO: 114706 - DNA, 177 bp, Artificial Sequence
  Description of Artificial Sequence: Synthetic coding sequence
atgtctgaagcccctcgatttttcgtcggtcccgaagacacagagatcaaccctggaaactacagacatttcttccatcatgctgatgaagacgacgaggaagaggacgattcaccaccggagagacagatcgtcgttggaatttgttcgatggccaaaaaatcaaagagcaagtag

SEQ ID NO: 114707 - DNA, 2877 bp, Artificial Sequence
  Description of Artificial Sequence: Synthetic coding sequence
atgctcaagagcaaaacctttctcaagaagactcgggccgggggtgtcatgaagattgttagagagcactacctgcgtgatgacattgggtgtggggcacctgggtgcgctgcatgcggcggggcccacgaagggcctgccctggaacctcagccgcaggatcctgcttcaagtgtctgtccccagccgcattacctgctacccgacaccaatgttttgctgcaccaaattgatgttcttgaggatcctgccattaggaatgtgatcgtccttcagacagtactacaggaggtaagaaatagatccgcccctgtctacaagcgcattagagacgtcacaaacaatcaagagaaacacttttatacctttacaaatgagcaccatcgagaaacctacgttgaacaggagcagggagagaacgcgaacgaccgtaatgacagggctatccgcgtcgccgcaaagtggtacaacgagcacctgaaaaagatgtcagcagataatcagctccaggtcatctttatcacaaacgatcgccggaacaaagaaaaggcgatcgaagaaggtatcccagcctttacctgcgaagagtacgtaaagagcctgactgctaatcccgaactcattgataggctggcctgcctgtccgaggaaggcaatgagattgaatctggtaaaatcatctttagcgaacacttaccgctgtcgaaactgcagcagggcatcaagagcggcacctacctccagggcacttttagggccagccgagagaactatctagaagccactgtttggatacatggcgataacgaggagaataaagagataatcctgcaggggctgaaacacctgaatcgagccgttcatgaggacatagtggccgtcgaactcctgcccaaatcccaatgggtggcgcccagctctgtggtgctgcacgatgaaggccagaatgaggaggacgtcgagaaagaagaggaaacagaacggatgctgaaaacagcggtcagcgaaaaaatgttgaagcccacgggccgcgtcgtaggaatcattaagcggaattggcgcccatactgtgggatgctctcgaaatcagacatcaaggagtctcgcagacacctcttcactcccgccgataaacgcattcctagaattcgtattgaaactagacaagcctcaaccttggagggtcggagaataattgttgcaatagacggatggccccgcaacagtagataccccaacggccactttgtacgcaatcttggcgacgtgggtgagaaggagactgagaccgaagtattgttactagagcatgatgtgcctcatcaacccttctcccaagctgtgctaagtttccttcctaagatgccatggtctattacagagaaggacatgaagaaccgtgaagatctgcggcacctatgcatatgttctgtcgacccaccgggttgcactgacatcgacgatgcgctgcactgccgcgagctggagaatgggaatctggaggttggcgtgcacatcgcagacgtcagccactttattagacccggaaatgccttagatcaggagtcagctagaagaggcacaacagtttacctgtgtgagaaaagaattgatatggtgcctgaactattgagttctaatctgtgtagccttaaatgcgacgttgatcgtctggccttctcttgcatctgggaaatgaaccataacgctgaaatcttgaagaccaagttcacgaagagcgttatcaattcaaaggccagtctaacatacgccgaagcccaactgcgtattgacagcgctaacatgaatgatgacatcaccacgtcacttcgtggtttgaataagctggccaaaatcctgaagaagaggcggatcgagaagggggctctgactctttcgagccctgaagttcgattccacatggattcggagactcatgaccctatagacctccagaccaaagagttgcgagaaacaaactcgatggtcgaggagtttatgctgctggctaatatctccgtcgctaaaaaaatacacgaggagttctccgagcacgccctgctgcggaagcaccctgctccacctccctcgaattatgagatcttagtcaaggccgcccgcagcagaaacctggagatcaagacagacacagctaaaagcctcgctgagtctctggaccaggcggaaagtcccaccttcccctatctcaataccctcttgagaatactggccacaaggtgtatgatgcaggctgtctatttttgctctggcatggataacgattttcatcactacggcctagcaagcccgatctatacccattttactagtccaatccgtaggtacgctgacgtcatcgtacaccgtctgctggctgtggctatcggcgccgattgtacttaccccgagttgacagataagcacaagctggccgatatatgtaaaaacctgaattttcggcacaagatggctcaatacgcccaacgagcaagcgtagctttccacactcagcttttctttaagtccaagggaatagttagtgaggaggcctatattctcttcgtacggaaaaacgccatcgtcgttttaattcctaagtatggactggagggaaccgttttcttcgaggagaaagataagcccaatccacagcttatttatgacgacgagatccctagcttaaagatagaagatacagtattccatgtcttcgacaaggtcaaggttaaaattatgcttgactcgtccaatctccagcaccagaaaatcaggatgtcactcgtggaacctcagatcccaggtatcagtattccaactgatacttctaatatggacctgaacggacctaaaaagaagaaaatgaagctcggtaagtag

SEQ ID NO: 114708 - DNA, 2391 bp, Artificial Sequence
  Description of Artificial Sequence: Synthetic coding sequence
atgtccgccgataatcagctgcaggtcattttcattaccaatgatcgccgtaataaggagaaggcaatcgaggaagggattcccgcctttacatgtgaggagtacgtcaagtctctgaccgccaaccccgagctaatcgatcgactggcttgcctcagtgaggaaggcaatgagatagagtcgggcaagattatattcagcgaacacttgccgttgagtaagctgcagcagggcatcaaatccggcacctatttgcaagggacatttcgtgccagccgagaaaattacttggaagctaccgtttggatccacggagacaatgaagagaataaagaaatcattttgcagggtctgaagcatctcaaccgggccgtccacgaagacattgttgctgtcgagctgctgcctaagtctcagtgggtcgcaccctcatctgtagtgcttcacgatgaaggccagaacgaggaggatgtggaaaaagaggaagaaactgagagaatgctgaagacggcggtctccgaaaagatgctaaaaccaacaggacgcgtggttgggataataaagcgcaactggagaccctactgcggcatgctgtctaagtccgacattaaggagagcaggagacatctttttaccccggcagataagcgcatacctaggatcaggattgagacgcgccaggcatcaactcttgagggacgacgtatcatagtcgctatagacggatggccgagaaattccaggtacccaaacggacactttgtgcgcaatctgggggacgtgggggaaaaggagacggagacagaagtgctgctgctcgagcatgatgtgccccatcaacctttctcccaggccgtgctttcttttctgcctaagatgccctggagtattaccgagaaggatatgaaaaacagagaagatctgcgtcatctgtgtatatgttcagtggatccacctggctgtactgatatcgacgacgccctacactgtagggaactggagaacggtaacctggaagtcggcgtgcacattgcagatgtgtcgcactttatccgccccggaaatgcactagatcaggaatcagccaggcgtggcaccacagtgtacctttgcgaaaagcgcatcgatatggtgcccgagcttctgtcgagcaatctgtgctcattgaaatgtgacgtagacagactggctttttcctgtatctgggagatgaatcacaacgcggagattcttaaaacgaaattcaccaaatccgtgatcaattcaaaagcctctttaacctacgcagaggcccaattacggatcgacagcgcaaacatgaatgacgatatcaccacttcactgagaggtttgaacaagttggctaaaatccttaaaaaacggcgtattgagaagggtgcactgactctgtcctcccctgaggtacgcttccacatggattctgagacacatgacccaattgatctacagacaaaggagttgagggaaacgaactctatggtggaagaatttatgctgctggcaaatatatccgtcgcgaagaagatccacgaagaattcagcgaacatgccttgctaagaaaacacccagcaccacccccttccaattacgagatactggtcaaggctgcgaggtcacgaaacctggaaataaagacagatacagctaaatctctggccgaatccttggatcaggcagaaagccccaccttcccctacctcaatacactcctccgcatcctggctactagatgtatgatgcaggctgtgtatttttgctccggcatggataacgatttccatcactacggacttgcttctcccatttatacccactttacgtcccccattagaagatacgctgatgtgattgtccaccggctgctggccgtggccatcggagccgactgtacctaccccgaactgactgataagcataagttagccgacatctgtaaaaacttaaatttcagacacaaaatggcccaatatgcacagcgcgcctctgtggcgttccatactcagctattttttaaatctaagggcattgtcagtgaggaggcttatattctgtttgtgagaaagaacgctattgttgtgctaatccccaaatatggcctggaagggactgttttttttgaagagaaggataagccaaatccccaactgatttatgacgatgagattccatccctcaagatcgaggatactgtctttcatgtttttgataaggtcaaagtgaagatcatgctggactctagcaaccttcagcaccagaagatcagaatgagtctggtggagcctcaaatccctggcatctctataccaacggacacgtccaacatggatctcaacggacctaaaaaaaagaagatgaagctggggaaatag

SEQ ID NO: 114709 - DNA, 2787 bp, Artificial Sequence
  Description of Artificial Sequence: Synthetic coding sequence
atgctcaaaagcaagactttcctcaagaaaacgcgggcagggggggtgatgaagatcgtgcgggagcactatctcagagacgatattggctgtggggcccccggatgcgccgcttgtgggggcgcacacgagggtccggctctcgaaccacagccccaagatcctgcgagctcagtgtgtccacagccccactacctcctacctgacaccaacgtgctgctccatcagattgtgtcggcctggcggcccggaacgtgggcatccgtcgccagttcattgagactgccagggtctctcgaaacatatgttgagcaggagcagggggaaaatgccaacgaccgcaacgaccgcgcaattcgagtggccgccaaatggtacaatgagcacctgaagaagatgtcagcggacaaccagctgcaggttatcttcatcacgaatgataggcgtaataaggaaaaggctatagaggagggcatccctgccttcacctgcgaagagtatgtaaaatcactcaccgcaaatccagaactgattgacaggctggcctgtctctcagaggaggggaacgaaatcgagagtggtaagatcatcttttcagagcacctgcctctgtctaaactgcagcaggggatcaaatctggaacctatctgcagggaacattcagggcctcaagagaaaactatctcgaggccacggtgtggattcatggcgataacgaagagaacaaagagatcatcttgcagggtctcaaacatttaaacagagctgtccatgaggatatcgtcgcagtggagttgctgcccaaatcccagtgggttgccccctcatccgtagtgctgcatgacgaggggcaaaacgaagaggacgtggagaaagaagaggagacggaaagaatgctgaaaacagctgtatcggagaaaatgctgaagccaactggcagggtcgtggggatcatcaaacggaactggcgcccttactgtgggatgctctcaaagtctgacatcaaggagtctagaagacatctctttacgccagccgataagaggatcccccgcatcaggattgagaccaggcaggcctctaccctcgaaggccgccgcattattgtagccattgacggatggccccgcaatagcaggtatcccaacggacactttgttcgaaacctcggggatgtgggtgagaaagagacggaaactgaggttttactgctggagcacgacgttccgcatcagcctttttctcaggccgtgctctccttcctgcctaaaatgccctggtccataacagagaaggacatgaaaaatcgcgaagatctccgacacctctgtatctgttcagtggacccccctggctgcactgacatagatgacgctctgcattgccgagagctggaaaatggaaacttggaagtgggtgttcatatcgccgacgtgtcacactttatccggcccggaaacgcactggatcaggagagcgcccgacgtggaacaacagtctatttgtgtgaaaaaaggatagacatggtgcccgagctgctgtcctctaatctgtgcagtctaaaatgcgacgttgatagactggccttttcctgcatatgggagatgaatcacaatgccgagattctgaaaacaaagttcacgaagtccgtaatcaactccaaagcttctctcacctacgctgaagcacagctccgcatcgattccgcgaacatgaacgacgacattaccacttctcttagaggcttaaataagctcgcaaagattctcaagaagcgcagaattgagaagggggccttgaccttgtccagtccagaggtgcgatttcatatggattctgaaacccatgaccctatcgatcttcagacaaaagagctgcgtgagacaaactcgatggtggaagagttcatgctcctggccaatataagcgtagccaagaagattcatgaggaattctctgagcatgccctgctgcgaaagcatcccgccccacctccctctaattatgaaatcctggttaaggccgcccgatctaggaacctggagataaagacagatacagctaagtcccttgccgaatctctggatcaagccgaatcccctaccttcccgtatctgaatactctgctgcggatccttgccactcgttgtatgatgcaggcggtgtacttctgcagtggcatggacaacgattttcatcactatgggcttgccagccccatctatacacatttcacttcaccaataaggaggtacgccgatgtgattgtacatagactgctggctgtcgctataggagccgattgcacctatcccgagttgactgataaacacaagctcgctgacatctgcaagaatctcaattttaggcacaagatggcccagtatgctcagagagcctctgtggccttccatactcagcttttcttcaagtccaagggaattgttagtgaagaggcatacatcctctttgtccgcaagaacgccattgtcgttctgatacccaagtatggcctggaggggaccgtgttttttgaggagaaagataagcctaatccccagctgatttatgacgacgaaattccctccctgaaaattgaggatacagtgtttcatgtattcgataaagtaaaggtcaagatcatgctcgattccagcaacctgcagcaccagaagattcgcatgtcattggtcgaaccacagatcccgggaatttctatacctacagatactagcaatatggacctgaatggtccaaagaagaaaaagatgaaattggggaaatag

SEQ ID NO: 114710 - DNA, 2916 bp, Artificial Sequence
  Description of Artificial Sequence: Synthetic coding sequence
atgcagacagcatgccaggctgttcagcatcagaggggtagaaggcagtataacaaactgagaaacctgctgaaggatgctcgacatgattgtatcttgttcgcaaacgaattccagcagtgttgctacttaccccgcgagcgtggggagtctatggagaaatggcaaacgcgttctatttacaatgcagccgtttggtattatcaccattgccaggaccgcatgcctattgtgatggtcacagaagacgaggaggcaattcagcagtacggatcagaaacagagggtgtttttgtgataacatttaaaaattacctggataacttctggcccgatctcaaagctgctcatgagctctgcgactctatcctgcaaagccggcgggaaagggaaaatgaaagccaggagagtcatggaaaagagtatcccgaacacttaccattggaagttctggaggccggaatcaaatcggggcggtatattcaggggatcctgaatgttaataagcatcgcgcgcaaatcgaggctttcgtcaggcttcagggggcctcatctaaggactctgatttggtgtcagacatcctgatccacggaatgaaggcaagaaatcgcagtatccatggcgatgtcgtggttgtggaattgttacccaagaatgagtggaaaggaagaacggtggctctgtgcgagaacgattgtgatgataaggcttctggcgaatccccatcagagcccatgcccactgggcgtgtagtgggcattctccaaaagaattggcgggactacgttgtgacctttccttcaaaggaagaggtgcagagccaaggaaaaaatgcccagaaaattcttgtgacgccctgggactaccgcatcccaaagatacgaatttctacccagcaggcagagaccctgcaggatttccgggttgtggtcagaatcgacagctgggagagcaccagtgtgtacccgaatggccattttgtgagagttctcggccgcatcggtgatctggagggcgagatagccacgatcctggttgaaaactccatcagtgtgatccctttcagcgaagcccagatgtgcgagatgcccgtgaacactcccgagtctccttggaaagtgagtcccgaagaggaacaaaagcgaaaagacctgagaaaaagccacctcgtgttttctattgaccctaagggctgcgaagatgtggacgacacactatcggtgcgaacgttgaacaatggaaatttggaattgggagtgcacattgccgatgtgacgcatttcgtggcacctaatagttacattgacattgaggcccggactagggccacaacctattaccttgccgacagaagatatgatatgctccccagcgtgctgtccgccgacctttgcagcttactgggcggtgtcgataggtatgcagtgtctatcatgtgggagttagataaagctagttacgaaatcaaaaaggtttggtacggacggacaattattcgttccgcatacaagctgttctacgaagcagcccaggagctcctagacggcaatctgagcgtcgtcgacgatatcccagagttcaaagacctagacgagaaatcacgtcaggccaaattagaggagctcgtctgggcgatcggtaaattaaccgatattgcgcgccatgttagggcaaaaagggatggttgtggcgccctcgagctggagggagtggaggtttgcgtccaactggatgacaaaaagaacattcacgatctcattcctaaacaacccttggaagtgcacgagactgtcgccgaatgcatgattctggccaaccactgggtggccaagaaaatctgggagtccttcccccaccaggccctgctccgacaacacccacctccgcatcaggaattcttctcagagttgcgtgaatgcgcaaaagccaaggggttcttcatcgacacacggagtaataagaccttggcagactccctggacaatgccaacgatccccacgacccgattgtgaatcggctgctgcggtcaatggccacacaagccatgtctaacgcattgtactttagcactggaagctgtgcagaagaagagttccaccactatggactagcccttgataaatatactcactttaccagccctatccggcgatacagcgacatagtggtgcacagacttttaatggcagcaatatcaaaagacaagaaaatggagatcaagggcaatcttttcagtaataaggacctggaagagctgtgtcggcatatcaacaataggaaccaggctgcacagcacagtcagaagcagtctacagaactgtttcaatgtatgtattttaaggacaaggaccccgctacagaagagcgctgcattagcgatggggttatctactccatacggacaaacggagtgcttctcttcattccgcgctttggaatcaaaggggctgcctacctgaagaacaaggatgggttagtgatctcttgcggcccagacagttgttccgagtggaaacccggctccttacaacggttccagaacaaaatcacctccaccacaacagacggtgaatcggttacatttcacctgttcgaccatgttacagtgaggatcagcattcaggcttcacggtgtcattccgacacaattcggctcgagattattagcaacaaaccttacaagatacctaatacggaactaattcatcaaagcagcccactgctgaaaagcgagctagtgaaagaagtgaccaaatctgtcgaggaggctcagctggctcaagaggttaaggtgaatataattcaagaggagtatcaggagtacagacagactaaaggaaggtccctatacacattgctagaagaaatccgggatttggctctactcgatgtctcgaataattatgggatttag

SEQ ID NO: 114711 - DNA, 3165 bp, Artificial Sequence
  Description of Artificial Sequence: Synthetic coding sequence
atgctgcagaaaagggaaaaagttctgctgctgcggaccttccagggacggaccctgcgaatcgtgagggaacactatctgcggccctgtgtcccctgtcactctcctctatgtcctcagcctgccgcctgctctcacgatggcaagttgctctccagcgacgtcacacactatgtgatccctgactggaaggtggtgcaagactatctagagatcttggagttccccgagcttaaaggcattatctttatgcagaccgcctgtcaggcggtacagcaccaaagagggaggaggcaatataataaactacgtaacctgctgaaggacgctagacatgattgtatcttattcgcgaacgagtttcagcagtgttgttacctgcctcgcgagagaggcgagtctatggaaaagtggcagacgagatccatttataacgctgcggtgtggtactatcaccactgccaagatcggatgccaatcgtcatggtcacagaggacgaggaggcaattcagcagtatggaagtgagactgagggagttttcgtgattacgtttaagaactatttagataatttttggccggatttgaaagccgcacacgagctgtgcgacagcatcctgcagagccggagagaaagggagaatgagtcgcaggaatctcacggcaaggagtaccctgagcacctacccctggaagtgctggaagccgggataaagagtggcaggtatatccaaggaatcctcaatgtgaacaagcacagagcacagattgaggcatttgtgaggctccaaggtgcgtcatctaaggatagcgacctcgtatccgatatactgattcacggaatgaaagccagaaatcgcagtattcatggggacgtggtagtcgttgaactcctccccaaaaacgagtggaagggacggacagtggcgttgtgcgaaaacgactgtgatgataaggcatccggggagagcccgtctgaacctatgcctaccggcagagtcgtcggaatcttgcagaaaaactggagggattatgtcgtgactttcccttccaaggaggaggttcagtcccagggcaagaacgcccagaagatcctggttactccgtgggattaccgaatccccaagatcaggatctccacccaacaagcggaaacactacaagatttcagagtggtcgtgcggattgattcttgggagtcgaccagcgtttatcctaatggacacttcgtcagggtgctgggacgcatcggcgacctagaaggagagattgccacaatcctagtcgagaacagcatctctgttatccctttctccgaagctcagatgtgtgaaatgcctgttaacactccagagtcgccctggaaggtgagcccagaggaggagcagaaaagaaaggacctgcggaagtcccacctggtctttagcatcgatcccaaaggatgcgaggatgttgacgacactctctcagtcagaaccctgaacaatggaaacctggaattaggggtccatatcgctgatgtgacgcactttgtcgcaccaaactcgtatatcgacattgaggcacgcaccagggctaccacatactatcttgcggatcggaggtacgacatgctccctagtgtcttgtcggccgacttatgcagtcttctagggggcgtggatcggtatgcggtatcaataatgtgggagctggacaaggcttcctacgaaatcaaaaaggtatggtatggacgtacaataattcggagcgcctacaagcttttttatgaagccgcccaggaattgctcgatggcaatctctccgtggtggacgacatccctgaatttaaagatctagacgagaaatcacggcaggctaaactcgaagagttggtttgggccatagggaaactcacagacattgcacggcacgtgagggctaagagagacggctgtggagccctggagctggagggcgtggaggtctgcgtccagttagatgataaaaaaaacattcacgatttgattccgaagcagccgctggaagtgcacgaaaccgttgccgaatgtatgatactcgcgaatcattgggttgccaaaaagatttgggaatctttcccccaccaggcactcctccgccagcatccgccaccacaccaggagtttttttctgagctccgtgagtgcgccaaagctaagggattcttcatcgataccagaagtaataagacactggcagattctctagataacgcgaacgaccctcacgatcccatcgtaaacaggctcctacgtagtatggctacccaggcgatgtccaacgccctctactttagcaccgggagctgtgccgaagaggagttccaccactatggtttggcactcgacaaatacactcattttacttctcctatcaggcgctattctgacatcgtcgttcataggcttttaatggcggcaatctccaaagacaagaagatggaaataaagggaaatctgttctcaaataaggatctggaggaactgtgtcgacatattaataataggaaccaggctgcacagcactctcaaaagcagtccacagagctgttccagtgcatgtatttcaaagataaggatcccgcaacggaggaaagatgcatttctgatggggttatttactctattcggactaatggtgtgcttttgtttatcccgcgatttggaattaaaggcgccgcttaccttaaaaacaaggatggcttggtcatcagttgtggccctgattcatgctcagagtggaagccgggatccttacagaggttccagaataaaatcacctcaacgactactgatggggagtccgtcacgtttcacctgtttgatcacgtgacggtgcgtataagtattcaagccagtaggtgccacagtgacaccattaggcttgagattatcagcaataagccctacaagatccccaatactgagctcatccaccaaagtagtcccctgttgaagtccgaactcgtgaaggaagtgaccaagtccgttgaggaggcacagttagcccaagaagtcaaggtgaatattatccaggaagaataccaggagtatcggcagaccaaaggcaggtctctgtacaccctgctggaagaaatccgcgacctggccctcttggatgtatcaaacaactatggaatttag

SEQ ID NO: 114712 - DNA, 762 bp, Artificial Sequence
  Description of Artificial Sequence: Synthetic coding sequence
atggagaagtggcagaccagatcaatctacaacgcagcagtgtggtattatcatcattgccaggatcgcatgcccatcgtgatggtgacggaagacgaagaggctattcaacagtacggctcggagaccgaaggcgttttcgtgattacttttaagaattatcttgacaatttttggccagacctgaaggctgctcacgagctgtgcgactctattttgcagtccaggcgggaaagggagaatgagtcccaggagagccacggcaaggaatatcctgaacatctgccactagaggtgttagaggcggggatcaaatcggggaggtacatacaaggcatcttaaatgtaaacaaacatagggcccagatcgaagccttcgtgcgcttgcaaggcgctagttcaaaggattctgatctggtcagcgacatcctgatacatggaatgaaagcaagaaaccggtcgattcacggggatgtcgtcgtagtagagctcctgcccaagaatgagtggaaggggaggaccgtagcactgtgtgagaatgactgcgacgataaagctagtggcgaaagtccctctgagccaatgcccactggactccaggggggtcgggctcatcgctttttaggagtgaatatctgcgtgagtaaatggaccttctgcgcctgttttcggaaaaatcgcaggtccggtaggggaaattgcaatcaccctgggggcaagcagtacttctcatacagttttctccgcagcagcgatgtgtag

SEQ ID NO: 114713 - DNA, 453 bp, Artificial Sequence
  Description of Artificial Sequence: Synthetic coding sequence
atggagaaatggcaaacaaggtctatctataacgccgcggtgtggtattaccaccattgtcaggacagaatgcctattgtcatggtgaccgaggatgaggaggccatccagcaatatggatcagaaaccgagggggttttcgtgattacatttaagaactatctggacaacttttggcccgacctgaaagccgcccatgagctgtgcgattcaattctacagtcccgaagagaacgtgaaaatgagagccaggagtcccacgggaaggagtaccccgagcatttgcccctggaggtgctggaagctggcataaagagcgggagatacattcagggtattctgaatgtgaataaacatcgggctcagattgaagccttcgtgcgtctccagggtgccagctccaaggacagcgacctggtgtccgatatcttgatccacggtatgaaggcttag

SEQ ID NO: 114714 - DNA, 174 bp, Artificial Sequence
  Description of Artificial Sequence: Synthetic coding sequence
atgcaaaccgcatgtcaggccgtgcaacaccaaagaggcaggcgacaatataataaactgaggaacctgctcaaagacgccagacatgactgtattctatttgctaacgagtttcagcaatgctgctacctgccgcgcgaacgcggagaatcgatggagaaatggcaaacttag

SEQ ID NO: 114715 - DNA, 294 bp, Artificial Sequence
  Description of Artificial Sequence: Synthetic coding sequence
atgcagaccgcctgtcaggcagtccagcaccagaggggacgaaggcagtacaataaactccgcaatctcttgaaagacgcaaggcatgattgtattttgttcgcaaacgagttccagcaatgttgctacctccctcgagaaaggggggagagtatggaaaaatggcagactagatctatttataatgctgcagtgtggtactatcaccactgccaagatcgcatgccaatcgtgatggtgaccgaggacgaagaggcaattcagcagtatggtagcgagaccgagggcgtgtag

SEQ ID NO: 114716 - DNA, 312 bp, Artificial Sequence
  Description of Artificial Sequence: Synthetic coding sequence
atgcagaccgcttgccaggccgtgcagcaccagcgaggacggaggcaatacaacaagttgaggaatcttcttaaggatgccagacatgattgcatcctgttcgcaaacgaatttcagcagtgctgctaccttcctagagagcggggggagtctatggagaagtggcagacccgatccatttacaacgcagccgtatggtactaccaccactgccaggatcgtatgccgattgtgatggtcaccgaggatgaagaagccattcaacaatatggctctgaaactgagggcgtgttcgtgataacattcaagtag

SEQ ID NO: 114717 - DNA, 1812 bp, Artificial Sequence
  Description of Artificial Sequence: Synthetic coding sequence
atgagtcacccggactaccgcatgaacttaaggcctctgggtacccctagaggcgtgtccgccgttgccggaccacacgacatcggagcttccccaggggacaagaaaagcaagaatcgatcgacacgcggcaaaaaaaaaagcatctttgaaacctatatgtcaaaggaagatgtgagcgaagggctgaaaagaggaacactgatccagggagtgctccggataaacccgaagaaatttcacgaggcgtttatcccttcacccgacggggacagagatatatttatcgacggcgtggtcgcaagaaaccgcgccctgaatggagatttggtagttgtgaaactccttcctgaggaacattggaaagtggtgaaacctgagagtaacgataaagagacggaggccgcctatgagagtgatatacctgaggaattgtgtggacatcaccttccgcagcaatctttgaaatcttataatgactccccagatgtaatcgtcgaggcacagtttgatggctcagattcagaggacggccatggcataactcagaacgtgttagtggacggcgtcaagaagctgtctgtctgcgtctctgagaaaggccgggaggacggagacgccccagtgactaaggatgaaacaacctgcatctcccaagatactcgagccctttccgagaagagtctgcagaggtccgctaaggtcgtctacatcctagaaaaaaaacactcgagggccgccacagggtttctcaaactcctggcagacaagaactcagaactgtttaggaaatatgctttattctccccttccgaccatcgcgttccccggatttatgtgccgttaaaggactgccctcaggacttcgtggctcgacccaaggactatgctaacactctgttcatctgtaggatcgtcgattggaaggaggactgcaattttgctctcgggcaacttgctaaaagcctgggccaagctggcgaaatagaaccagagacagagggaattttgactgagtatggggtggacttctcagacttctctagcgaagttctggagtgcttgccccaaggcctgccatggaccattcctcccgaagagtttagcaagcgcagggaccttcgaaaagattgcattttcacgatcgatcccagtacagcgcgagatctagacgatgccctgagttgcaagcctttggcggacggaaatttcaaggtgggggtgcacattgctgacgtgagctatttcgttcccgagggaagtgacctagataaagtggctgccgagcgggccacttctgtatacttggtccaaaaggtggtccccatgctcccaagactgctgtgcgaggagctgtgcagtttgaatccaatgtctgataaactgactttcagcgtcatatggacacttacacccgaaggcaaaatccttgatgaatggtttgggcgtactatcattcggtcctgtaccaaactcagctacgagcacgcccagtctatgattgagagtcccactgaaaagattcccgctaaagaactgcctcccatttcacccgaacactctagcgaggaggttcaccaacaaaacgccgacaaggatggcgctgcccacctccaggcctcacactcaccatcagccgaagacgccgaagcccagccctcaacagaggaaagactgccagaaacgaggggaatctgtgaccgtgatccagatacccggttgttttttttacaacagcagtcccgagtcctagaggcaaaacctcagaacacaatccgcgtggaggagcaaacaactcagcttcaaatttag

SEQ ID NO: 114718 - DNA, 2658 bp, Artificial Sequence
  Description of Artificial Sequence: Synthetic coding sequence
atgagccaccctgattacagaatgaatcttcgccctctcgggaccccacgtggcgtgtctgctgtcgctggaccccacgacataggcgcatctcccggcgataaaaaaagtaaaaaccgatctacccgtgggaagaaaaagtccatcttcgagacgtacatgtccaaggaggacgtctccgagggcctgaaacggggaacgcttattcagggggttttgaggatcaatccaaaaaagtttcacgaagcttttattccctctcccgatggcgatagagacatctttattgatggagtggttgccagaaacagagcactgaacggcgacctcgtggtggttaagcttctgccagaggagcattggaaggtggtgaagcctgagtctaacgataaagagaccgaagcagcatatgaaagcgacatcccagaggagctgtgcggtcatcacctcccacagcaatctctcaaatcgtataacgatagccccgatgttatcgtcgaagcccagttcgatgggtcagatagcgaagatgggcacgggattactcagaacgtgctggtggatggcgtaaagaaattgtctgtgtgtgtgagtgaaaagggacgggaagatggcgacgcaccggtcacgaaggacgagaccacctgtatcagtcaagacactagggctctctctgagaaatcccttcagcgttctgctaaagtcgtatacatcctggagaaaaagcactcacgcgccgctactgggttcctgaagctgctagcggacaagaatagtgaactgttccggaaatacgctttattctctccttcggaccaccgggtgccaagaatctatgtgccgctgaaagactgtccccaggactttgttgccagaccaaaagactacgcaaacactctgtttatatgtcgaatcgtggattggaaggaagactgtaatttcgcgctcgggcaattggcaaagagtttaggccaggcaggggagatcgaacccgagacagaaggtattctaactgagtatggcgtcgattttagtgactttagcagcgaggtcttggagtgtctcccacagggcctcccgtggactattccgcccgaggaattttccaaaaggagagatttacgcaaagattgtattttcaccatcgacccctccaccgcaagggatctggacgacgcactttcctgcaagcctctagccgacggcaactttaaagtaggagtccatatcgcagatgtgtcatacttcgttccggagggtagcgaccttgataaagtcgccgctgagagagccacttccgtctacctggttcagaaggtcgtaccaatgctgccacgtctcctttgcgaggaactttgttctctgaatcctatgtccgacaaactgactttcagcgttatttggaccctgacacccgaggggaagatattagatgagtggtttggcaggaccattatcagatcctgcactaaactaagctatgagcatgctcaatctatgattgagtcccctaccgagaagatcccagccaaagagctgcctccaattagccctgaacactcttctgaagaagtccaccaggctgttttaaatctgcacgggattgcgaaacagttaaggcaacagaggttcgtggacggagccctgaggcttgaccaactcaagttggcatttaccctggatcacgagacggggctgccccagggatgtcacatctacgagtatagggagtctaacaaattggtcgaggagtttatgctcttggctaacatggctgtggctcacaagattcatagggctttccctgaacaggcacttctgagaagacatccgcccccccagaccaggatgctgagtgatctcgttgaattttgcgatcagatgggcctgccggtggatttcagttctgctggtgccttgaataaatcactcacacagacgtttggggatgacaagtactctctcgctcggaaagaggtccttaccaacatgtgttctaggccaatgcagatggcgttgtacttttgttcgggcctactgcaagaccccgctcagttccgccactatgctctcaacgtaccgctttatacacacttcaccagcccaattaggagatttgccgatgtactggttcacaggctgttggcagcagccctgggctaccgtgaaagactggacatggctcccgacacgttacagaagcaagcagaccattgtaatgatcggcggatggcaagcaagagagtacaggaactgagcacatcactgttttttgctgttctagtgaaggagtcagggccgctagagtccgaagccatggtgatgggcatccttaaacaggcattcgacgtgctggttcttcgctatggtgtccagaagagaatctactgtaatgcactggcccttcgctcacatcactttcagaaggtgggcaaaaaacctgagctgaccttggtgtgggaaccggaggatatggagcaggagcccgcacagcaggttatcacaatcttcagtctggtggaagtggtgcttcaggcagagtcaaccgcccttaagtattccgctatactgaaaagacccggcacccagggacacctcggacccgaaaaggaggaggaagagagcgatggggaaccagaggactcctcaacctcttag

SEQ ID NO: 114719 - DNA, 1071 bp, Artificial Sequence
  Description of Artificial Sequence: Synthetic coding sequence
atgtcccatcccgattatcggatgaacctgcggcctttggggactcctcgaggagtcagcgccgtcgcaggcccacacgacatcggtgcatctccaggagataagaagagcaaaaatagatcaacgagggggaagaaaaaatcaatctttgagacttacatgtcaaaggaagatgtctccgaagggctcaagagggggaccttgatacagggggtgctccgtattaatcctaagaaatttcacgaggcatttatcccatccccagacggagacagagatatcttcattgacggggtcgtagccaggaacagagcactgaatggcgacctggtggttgtcaagctgctccctgaagagcattggaaggtcgtaaagccagaaagtaacgataaggagactgaggccgcttacgaatcagacattcctgaggaactgtgcggccaccatctgcctcagcagtctttgaaaagctacaatgactctccagacgtgatcgttgaagcccagtttgacggatcggactcggaagacggacacggtatcacacaaaatgttctcgttgatggggtgaaaaagctctcagtgtgtgtgtcagagaaggacaatgaaatcgaggcgcagcggtcaagctgggcttaccccgtctcccataggaaatccgaggagagaatggtgatgcacagactccagaagatgcgccccccagccttccacaagactcaggagctgtacagaagaaatccatgtaaggaccagcaaagatggtttacgtcatggcgcaaaaacatcctagaacagcaaccagccagctcaaattcttggttgatccgaactgctaattgcctaggcaacactccttgcttcctaccacagacgacagaatgcctagaatttatgtgcctgagtagaaccgtacctcgcacactctggcatgggctgaagataatgccaactcactgtagcagtgctgcactttggaccggtcgccgcactgccatcctcccctggggcagctggcttcgcgttctggggcgcctggtcaagctgtctttgaagcagaaggagtactag

SEQ ID NO: 114720 - DNA, 2658 bp, Artificial Sequence
  Description of Artificial Sequence: Synthetic coding sequence
atgagccacccggactatcggatgaacctgcggccacttggcacaccccggggggtatccgcggtagctggacctcacgatattggcgctagccctggcgacaagaaatccaagaataggtcgacacgcggtaagaagaagtcaattttcgaaacttacatgtccaaggaagacgtctccgaaggactaaagcgggggacactcatccagggtgtgctgcggataaatcccaaaaaattccacgaggcttttattccatcgcccgatggagatcgcgacatcttcatagatggggtggttgctagaaacagagccctcaatggggaccttgtcgtggtgaaattgctgccagaggaacactggaaagttgttaagccagagtccaacgacaaagaaactgaagcagcgtatgagtctgacatccccgaagagctatgcggacatcatctgccccagcagtcacttaaaagttacaatgatagtcccgatgtcattgtggaggctcagtttgatggctctgatagtgaggatggccatggaatcacccagaatgtgctggtggatggcgtcaagaagctgtcagtatgcgtttccgagaaaggcagagaagacggggacgccccggtgacaaaggacgaaaccacatgtattagccaggatacccgggcactgagtgaaaaatctctccaacgcagtgcaaaggtggtgtatatcctggagaagaagcattctcgagcagctactggctttctgaagctgctcgcggataaaaactccgagctgttcagaaaatatgccctgttcagcccctccgaccatcgtgttccgcgtatttatgttcctcttaaggactgcccacaagatttcgtcgcccggccaaaagattacgcgaacactctgttcatctgccgtatcgtggactggaaggaggactgcaactttgctctcggtcagcttgctaaaagcctgggccaggccggagagattgagccagagaccgaaggaattctgacagaatatggggtcgatttctctgacttctcatccgaagtgctggagtgcctgccccaaggactgccatggacaatccccccagaggaattctctaagaggcgcgacttaaggaaggactgcattttcaccatcgacccaagcaccgcccgtgatctcgacgatgccctgtcttgtaagcctctggccgatggaaactttaaggtgggtgtgcacattgccgacgtgtcctactttgtgcctgaaggttccgatctcgataaggtggctgctgagcgcgctacctcggtctacctagtgcaaaaggtcgtacctatgctcccccgcctcctctgtgaagagctatgctctctcaacccgatgtccgacaagttgacttttagcgtcatctggactctcacacccgaagggaagatcctcgatgaatggtttggaagaacaatcattagatcatgcaccaaactttcctacgaacatgcacagtccatgatcgagtctccaacagagaagatccctgcaaaggagcttccaccgatctcccctgagcacagctctgaggaggttcatcaagcggtgctgaacctacacggcattgccaaacaattgaggcaacagcgattcgttgacggtgctttaagactcgatcagctgaaactggcgttcaccctcgaccacgaaaccggtctgccgcagggctgtcatatttatgaatatcgagagagcaataagctcgtggaggaattcatgctgctggccaatatggccgtggcccataaaattcatcgagccttccccgagcaagccttgttacggcgtcaccccccaccccagacaaggatgctgagcgatttagtggagttttgtgaccagatggggctaccggtggacttctcctcagctggagctcttaataagagccttacccagactttcggtgatgataaatacagtcttgcgcgcaaggaagtgctcactaacatgtgctctagaccgatgcagatggccctgtacttttgttctggtctgctgcaggacccagcgcagttcagacactatgcactgaatgtaccactctatacccatttcaccagccctatccgacgctttgctgacgtactcgtccaccgccttttggccgctgcattggggtatagggagaggttggacatggcacccgacactctgcagaagcaagccgatcattgcaacgaccggcgaatggccagcaaaagggtgcaggagctgtccacctccctgttctttgctgtacttgtgaaggaaagcgggccccttgagtcagaggcaatggtgatggggattctgaaacaggccttcgacgtgctagtgcttcgctatggtgtacagaagcgcatctactgtaacgccctggccctacggtctcatcactttcagaaggtgggtaagaaaccagaattgactctggtctgggagccggaggacatggaacaggagccagcacagcaggtcattactatcttctcactggtggaagtggtgctgcaggccgagtcaaccgcgctgaagtacagtgcgatcctgaagaggcctggtacgcaaggtcacctgggtcctgagaaagaagaggaggaatcggacggggaacccgaagacagttcaacttcgtag

SEQ ID NO: 114721 - DNA, 750 bp, Artificial Sequence
  Description of Artificial Sequence: Synthetic coding sequence
atgtcgcaccctgactaccggatgaatctgaggcctttaggcacccccagaggtgtttccgccgtggctggccctcatgatatcggagcttcccctggtgacaaaaagagcaaaaacagaagtacgcgcgggaagaaaaagagcatcttcgaaacctatatgagcaaggaggatgtgagcgagggcctcaaacgcggcactctgatccaaggagtcctgcgtatcaacccaaaaaagttccatgaggcctttattccaagccctgacggcgatcgcgacattttcatagacggggtggtggcacgcaacagagcgctaaacggagatctcgtggtggtgaagttactaccagaagagcattggaaggtggtcaagcccgagtcaaatgataaagaaactgaagccgcctatgaatcagacatcccagaagagctctgcggacaccatctccctcagcaaagcctcaaaagctacaacgactctcccgacgtcatcgtggaggctcagtttgatggcagtgattctgaggacggacatggtattacccaaaacgttcttgttgacggcgtgaaaaagttgagcgtgtgcgtttccgagaaggggagagaagacggggacgctcccgtcactaaagacgagaccacctgcatttcacaggacacaagagccttgagcgaaaagagtcttcaacgctccgccaaagtaatcgcataccgcttctcaccgcgcgtgcagatggccttcacttag

SEQ ID NO: 114722 - DNA, 2028 bp, Artificial Sequence
  Description of Artificial Sequence: Synthetic coding sequence
atgtctcatccagattatcgcatgaacttgcgccccctgggcacccctcgcggtgtgtccgccgtggccggcccccacgacatcggcgccagcccaggggataaaaaaagcaaaaatcgctcgaccagagggaagaaaaagtctatttttgagacttacatgtctaaggaggacgtgtccgagggcctaaagcgaggcacgttaatccagggggtcttgcggatcaatcccaagaagttccacgaagcattcattcctagccccgacggtgatcgcgatatcttcattgatggcgtggtcgcccggaatagggcccttaatggcgacctagtggtggtcaagctgctgccggaggagcactggaaggtggttaaacccgaatccaacgacaaagagacagaggcagcttacgagtctgacattccggaagagctatgcggtcatcaccttcctcagcagtctttgaagtcatataacgatagtccggacgtgattgtcgaagcccaatttgatggcagtgacagcgaagacggccatgggattactcaaaacgtgctggtcgacggagttaagaagctctcagtatgcgtgtccgagaaagggcgagaggatggcgacgctcccgtgacaaaggatgagaccacttgcattagccaggacactcgagctctgtccgaaaaatctctacagagaagcgccaaggttgtatacatcctcgagaagaaacactcacgggccgccacaggttttctgaaactcctggcagacaagaattcagaactgtttcgcaagtacgctttgtttagccctagcgatcatcgcgtgccacggatatacgtgccattgaaggactgcccgcaggatttcgtggccagaccaaaagattatgccaacacattgtttatttgcaggattgtagattggaaagaggattgtaacttcgcattagggcaactagcaaaatcactcggccaagccggggaaatcgagccagaaaccgaaggaatcctgacggaatacggggtggatttctccgacttctcaagtgaagttctcgagtgcctgccacaagggctgccctggaccatacccccggaggagttttcaaaacggcgagacctgcgaaaagattgcatcttcactatagacccgtctacggcccgcgacttggacgatgcgctttcctgcaagcctctggccgatgggaactttaaggtgggggttcacattgccgatgtgagctactttgttccagaaggctccgaccttgataaggtggctgctgagcgtgccacatcggtctatctggtgcagaaggtcgtgcctatgctgccacggcttttatgtgaggaactgtgtagcctgaaccccatgtcagacaaactgaccttctccgtgatctggacactcacccctgaaggcaagattctggatgagtggtttgggagaactatcataaggagttgtaccaaattgagctatgagcacgcccagtccatgattgagtctcccactgagaaaatccctgcaaaagaactgcctcctattagtccagaacacagctccgaggaggtgcatcaggccgtgctcaacctgcacggaatcgccaaacaactgaggcagcagcgattcgtcgatggggccctccgcttggaccaactgaagcttgcctttaccttagaccatgagaccggcctgcctcagggttgccatatttacgagtacagagaaagcaataaattagtcgaggaatttatgttattagccaacatggcagtggctcacaaaatccaccgggccttcccagagcaggccttgctgcgtcggcacccccctcctcagacaagaatgctgagtgatctggtggagttctgtgaccagatgggcctgcccgtggactttagctcagctggcgccctgaataagagcctgacacagacctttggcgatgacaagtattccctggccaggaaggaagtgttaactaatatgtgttcccggctgcctgtccctccccattggctttag

SEQ ID NO: 114723 - DNA, 435 bp, Artificial Sequence
  Description of Artificial Sequence: Synthetic coding sequence
atgtcgcaccctgactaccgaatgaatctacgacctctggggaccccacgtggggtctctgccgtggcaggtccacacgatattggcgcaagtcctggtgataagaaatcaaagaaccgttcgacaaggggcaaaaagaaatccatctttgaaacatatatgagcaaggaggatgtcagtgagggactaaagcgcggaacgctaatccagggagtactgaggatcaatcccaagaaatttcacgaagcctttattccctccccagacggagatcgggacatttttattgatggagttgtggcaagaaacagggctctgaatggggacctcgtagtggtgaagctgctgcccgaggaacattggaaagtcgtgaagccggaaagtaacgacaaggaaactgaggccgcgtacgagtccgacattccagaagaatag

SEQ ID NO: 114724 - DNA, 1860 bp, Artificial Sequence
  Description of Artificial Sequence: Synthetic coding sequence
atgtcacacccagactaccgcatgaatttaaggcctctggggactccccgaggagtcagtgccgtggctggaccacacgatattggagcatcccccggcgacaagaagagtaagaaccggagcacacgtggcaaaaaaaaatccattttcgagacctacatgtccaaagaggacgtttcggaagggctcaagagagggacactaattcagggcgtcctaagaatcaaccccaagaagttccacgaggcttttattcctagcccagacggagatagagatatttttattgatggcgtagttgccaggaacagggccctgaacggcgacctcgtggtagtgaaactgttacctgaagagcattggaaagttgtgaaaccagaatctaatgacaaagagaccgaggccgcctacgagtccgacattccggaggagctctgtggccaccatttacctcaacagagtttgaagtcctataatgactcgccggatgtaatcgtggaagctcagtttgatgggtcggactctgaggatggacatgggataacccagaacgtgttagtagatggcgtcaaaaagctctcggtgtgcgtgtctgagaaagggcgcgaggacggggatgcaccagtgactaaagacgagacaacctgtatatcccaagacactagagcccttagtgaaaagagcctgcaacggtccgccaaggttgtttacatcctggaaaaaaaacacagcagggccgcaaccgggttcttgaaactgctggcggacaagaactccgaactctttaggaagtacgccctgttcagccctagtgatcatagagttccacggatctacgtccccctgaaggactgccctcaggactttgttgccagacccaaagactacgcgaataccctcttcatctgtcgaatcgtggattggaaggaagactgtaactttgccctgggacagttggctaagtccctggggcaggcgggagagattgagcctgaaaccgaggggatactcaccgaatatggtgtagacttttctgacttttcctccgaggtgctggagtgtcttccacagggtctgccctggaccattccacccgaagaatttagcaagagacgggatctacgcaaagactgtatcttcacaattgatccgtccactgcacgcgacctggacgacgcactgagctgcaaacctctcgctgatgggaatttcaaggtgggagtccacattgctgatgtgagctattttgtgcccgagggaagtgacctcgataaagtggcagccgagagggccacaagcgtctatctagtccaaaaggtcgtgccaatgctgcctcggttgctttgcgaggaactttgttccctcaatccaatgagcgataaactaacattcagcgtaatctggaccctcacccccgagggaaagattttagacgagtggttcggccgcaccattatccgctcttgtaccaaactgagctatgagcacgcacagagtatgattgagagcccaacggaaaaaatcccggctaaagaattgcctccaatctctcccgagcatagtagcgaggaagtacaccaggctgtgcttaatcttcatgggattgcaaagcagttgcggcaacagcggtttgtagacggagctttgcggctcgatcaactgaagctcgccttcaccctggatcacgagactggcctgcctcagggttgccatatctatgaatatagggagagcaataaaccctgttgcgcaggaactccgcgccctaagcagggttgttctgtcacatggtggaactctgccacccggtggggctgcccttggactagcgcccctcaggagccatccatgaaagcttag

SEQ ID NO: 114725 - DNA, 615 bp, Artificial Sequence
  Description of Artificial Sequence: Synthetic coding sequence
atgtctacagagaccgaattgcaagtcgcagtgaagacatccgcgaagaaggactctcgcaagaaggggcaggaccggtcggaggctacattgattaaaaggtttaagggagagggtgtgcggtacaaggcgaagttaattggcattgacgaagtctctgccgctagaggagataagctctgccaggattctatgatgaaattaaagggggtcgtcgccggagcgcgcagcaagggcgagcacaagcagaagatcttcttgaccatcagctttggcggcattaagatattcgacgaaaaaacaggtgctctgcagcatcatcacgctgtgcatgaaatctcctacattgctaaagacatcacagaccatagagctttcgggtatgtctgcggcaaggagggcaaccaccggtttgttgctatcaagacagcacaagccgctgagcccgtaatcctcgacttacgcgacttgttccagctgatatatgagctcaagcagagagaagagctcgagaagaaggcacagaaggataagcaatgtgaacaggcagtgtatcaggtgcctacttcccagaagaaagaaggcgtatatgacgtgcctaagtctcagccatag

SEQ ID NO: 114726 - DNA, 642 bp, Artificial Sequence
  Description of Artificial Sequence: Synthetic coding sequence
atgagcacagaaacagagttacaagtcgctgtgaaaacttccgccaaaaaagatagtcggaaaaagggccaggacagatccgaagctaccctcataaagagatttaaaggagaaggtgtgcgttataaagctaaactaatcggaatcgacgaagtcagtgcagcccggggcgacaagttgtgtcaggatagtatgatgaagctgaaaggcgtcgtggctggcgcacgctctaaaggcgaacataaacaaaaaatattcctgacaattagtttcggaggaatcaaaatatttgacgagaagactggcgctcttcagcatcaccacgcggtccatgagatatcctacatagctaaggacatcactgaccaccgcgctttcgggtacgtctgtggtaaggaaggcaatcatcgatttgtggcgattaagaccgctcaggctgctgaacccgtgattcttgaccttcgcgacttgtttcagctaatctatgaattgaagcaacgggaggagctggaaaaaaaggcacaaaaggacaaacaatgcgaacaggctgtctaccaaaccatcctcgaggaggatgtcgaggacccagtgtatcaagtaatctcggagacatctcgggggtttcgtttcaaatctgattag

SEQ ID NO: 114727 - DNA, 1767 bp, Artificial Sequence
  Description of Artificial Sequence: Synthetic coding sequence
atgtccaccgaaaccgaactgcaggtggctgttaaaacaagcgccaagaaggattcccggaagaaagggcaggatagatctgaggccacacttattaagagattcaagggtgagggcgtccggtacaaggcaaaactgatcggaatcgacgaggttagtgctgccaggggcgacaagctgtgccaggactctatgatgaagttaaagggagtcgtggcaggagctaggtctaaaggagagcataagcaaaagatcttcctgacgatttcctttggcggaatcaaaatcttcgatgaaaagaccggtgcattgcagcaccaccatgctgtgcatgagatcagctatattgcgaaagatattactgaccaccgggctttcggttatgtttgtggtaaggagggcaaccacagattcgtcgccatcaagacggcccaggcggcggaacctgtaatcctggaccttagagaccttttccagctgatctatgagttaaagcagagagaggagctagaaaagaaggctcagaaggataagcaatgcgaacaggcagtctaccaaaccatattagaagaagacgtagaggaccccgtgtaccagtacattgtctttgaggccggtcacgagccgatcagggacccagagacagaagagaatatctaccaggtgcctacctcgcagaaaaaagaaggcgtgtatgatgttccaaaatcacagcctgtttccaatggttattcgttcgaagacttcgaagagcggttcgcagccgccactcctaaccggaacttaccaacagattttgacgaaatttttgaagccaccaaggcagtgactcagctggagcttttcggagatatgtcaaccccaccagatatcacatcacccccgactcctgccacgcctggggatgcttttattccttcatccagtcaaactctccctgcgagcgctgacgtattctcctctgttccgtttggaactgctgccgtgcccagcggctatgtcgctatgggtgcggtgcttccgtcattctgggggcagcaaccactggtgcagcagcagatggtgatgggcgcacaaccaccagttgcccaggtgatgcccggtgcccagccgattgcgtggggacagccagggctgttccctgcaacccagcagccttggccaacagtggcagggcaattcccacctgccgccttcatgcccactcagaccgtgatgccattgccagctgcaatgttccaggggccccttaccccactggcaaccgtgcctgggacgtcagacagcacccggagcagtccgcagaccgacaagcccagacagaaaatgggaaaggagacttttaaagacttccagatggcacagcccccacccgtgcccagcagaaaaccggaccagcccagcctcacatgtacgtctgaagccttctcttcctactttaataaagtgggcgtagctcaagacactgatgactgcgacgatttcgatattagccagttaaatctgaccccagtgacgagcacaactccttcaacaaactcaccacctacacctgcacccagacagtcctcaccctctaaatcaagcgcatcccacgcttctgatccaacgaccgacgacattttcgaggaaggattcgaatccccatctaagtccgaggagcaagaggccccagacggatctcaggcgagttccaattcggacccattcggggagcccagtggagaaccaagtggagacaacatcagccctcaggccggttcctag

SEQ ID NO: 114728 - DNA, 720 bp, Artificial Sequence
  Description of Artificial Sequence: Synthetic coding sequence
atgtctaccgagaccgaacttcaagttgcagtgaaaacttctgcaaagaaagacagcaggaaaaagggccaagatagaagcgaggctacattaattaaacgctttaaaggcgagggggttcggtataaggccaagttaatagggatagatgaggttagcgccgccagaggggataaactctgccaggattccatgatgaaactgaagggtgtggtggccggggcccgctcaaaaggtgaacacaagcagaaaatcttcctcacgatctcattcgggggcatcaagatcttcgacgagaagactggtgtcccaacttcacagaaaaaggaaggtgtgtacgatgttcccaaatctcagccagtgagcaacgggtacagtttcgaggattttgaggagcgcttcgcagctgcaacaccaaatcgaaatctgcccacagactttgatgagatcttcgaagccacaaaagccgtgacccagctggaactctttggcgatatgtccacgccgccagatataacaagcccccccacacccgcaacccctggagacgcattcattccctctagtagccagaccctgcccgcaagcgcggatgtgttttccagtgtacctttcgggaccgctgccgttcctagcggctatgttgccatgggcgctgtcctcccctctttctgggggcagcagcctctggttcagcagcaaatggtcatgggagcctag

SEQ ID NO: 114729 - DNA, 1668 bp, Artificial Sequence
  Description of Artificial Sequence: Synthetic coding sequence
atgtccactgagacagagctgcaagtcgcggtcaaaacttcagccaagaaagattccagaaagaagggccaagatagatctgaagctaccctaattaagaggtttaaaggagagggggtgcggtacaaggcaaaactcatcggaattgatgaggtctccgctgcaagaggcgataaattatgtcaggattccatgatgaagttgaaaggggtcgtggccggggcccgctcaaaaggggagcacaaacaaaaaatcttcctcactatctcattcggagggatcaaaatcttcgacgagaagacgggggcattgcagcatcaccacgctgtgcacgaaatctcctacatcgctaaggacatcactgatcacagggcctttggctacgtttgcgggaaagaggggaatcaccgtttcgtggctattaaaaccgcccaggctgctgagcccgtcatccttgaccttcgggatctgtttcagcttatctatgaactaaaacagcgagaagaactcgagaagaaagcacagaaagacaagcagtgtgaacaggctgtgtaccagactatcctggaggaggacgttgaagacccggtttaccaatacatagtcttcgaggccggacatgagcccatcagggaccccgaaacggaggaaaacatatatcaagtgccgacatctcagaaaaaggaaggagtttacgacgttcctaaatcccagcccgtgtcagcagtcacacagctggagctttttggcgacatgagcaccccccccgatatcacttccccacccactccggccacacctggcgacgcattcatcccttcctcatcgcagacacttcccgcatcggccgacgtgtttagctccgtcccttttggcactgccgctgtcccaagcggctatgtggcgatgggcgccgtcttgccaagtttctggggccagcaaccactggtccagcagcagatggtgatgggcgcccagcctccggttgcccaggtcatgcccggcgcccaacccatcgcatggggtcagccggggctgtttcccgctacacagcagccttggcccaccgtagctggccagtttccccctgcggcatttatgccgacccagacggtcatgccactccccgccgccatgtttcagggaccccttacaccactggcgaccgtgcctggcacttccgacagtactagatcctctccacagaccgacaagcctagacaaaagatgggcaaggagacgtttaaggacttccagatggcacagcccccacccgtgcctagcagaaagcctgatcagccaagcctcacatgtacgtcagaagcttttagcagttatttcaataaagtaggagtcgcccaggatacggatgattgcgacgatttcgatatttcacagctaaacctgacccctgtgacgagcaccacaccatctacaaattcaccccctacaccagcccctcgccaatctagtccctccaagtcatctgcatcgcacgcttcagacccgacgaccgacgacatctttgaagagggatttgagtcacccagcaagagcgaagagcaagaggcacctgacggcagtcaggccagcagtaatagcgaccccttcggcgaaccatctggtgagccctccggagacaatatatcccctcaggccgggagctag

SEQ ID NO: 114730 - DNA, 1668 bp, Artificial Sequence
  Description of Artificial Sequence: Synthetic coding sequence
atgtccactgaaacagaattacaggtcgctgtaaagaccagtgccaagaaagattcccggaagaagggccaggacaggagtgaagccacactgatcaaaaggttcaaaggcgagggcgtgcgatataaggctaagcttattgggatcgatgaagtcagtgccgctcgtggagacaagctatgccaggactctatgatgaagctcaaaggggttgtcgcaggcgcccgaagtaaaggcgagcacaagcagaaaatttttctgacaatatctttcggtggaataaagatttttgacgaaaagaccggcgccttacagcaccatcatgcagtgcatgagatcagttatatcgccaaggatatcaccgaccaccgcgctttcggatacgtgtgcggaaaagagggaaatcataggtttgtagctattaaaaccgcccaagcagctgagcccgttatcttagatttacgagacctgtttcagctgatctacgagctgaagcagcgggaggaattagagaagaaggcccagaaggataagcagtgcgagcaagcagtgtaccagacaatactggaagaagatgtcgaagatccagtgtaccagtacatcgtcttcgaagctggtcatgagccgatccgtgaccccgagacagaagagaacatctaccaggtccccacgagtcaaaagaaggagggtgtgtatgatgtgccaaagtcccagccggtgagcgcagtgacacagctggaactttttggcgacatgagcacccctcctgacataacgagcccccctacacccgcaacacccggtgacgcttttattcccagcagctctcaaaccctcccagcttctgccgatgtcttttcctccgttccttttggaaccgccgctgttccaagtggctatgtcgccatgggagctgtactcccctcattctggggacagcaacccttagtgcaacagcagatggttatgggagctcaacccccagttgctcaggtcatgccgggcgcccagcctatcgcctggggccagcctgggctgttccccgccactcagcagccttggcccactgtcgccggccagtttccccctgcagcctttatgccaacccagacagtgatgcccctgcccgccgccatgtttcagggaccactgaccccgctagcaaccgtccctggcactagtgatagtaccagatcaagcccccagaccgataagcctaggcaaaagatgggcaaggagacctttaaggattttcaaatggcacagcctccccccgtgccaagtcggaagcctgaccaaccctccctgacatgcacaagcgaagccttctccagttactttaacaaggtcggggtggcgcaagacaccgacgactgcgacgattttgacattagtcagctcaatctgacacccgtgacttcaacaaccccttcaacgaattcgcctcccacacctgcgccccggcagtcctccccgtccaaatccagtgcatctcacgcctctgaccccacaaccgatgacatttttgaggaaggctttgagagcccatccaagtccgaggaacaggaggcaccagatggctcccaggcgagctccaacagcgatcctttcggtgagccaagtggcgagccctctggcgataacatttcaccccaggctggctcctag

SEQ ID NO: 114731 - DNA, 1668 bp, Artificial Sequence
  Description of Artificial Sequence: Synthetic coding sequence
atgagtactgaaacagaactccaggtggcggtgaaaacctccgctaagaaagacagtcgtaagaaaggccaggacagaagcgaggctaccctgatcaagcgctttaagggtgaaggggtgcgatacaaggcaaagttgatcggaattgatgaggtcagtgccgcccggggtgacaaactatgccaggattccatgatgaagctaaagggtgtggttgctggcgctagatccaagggtgagcacaaacagaaaatatttctgaccataagctttggcgggataaagatcttcgatgaaaaaaccggagcacttcaacatcaccatgctgttcatgaaatctcatatattgccaaagacattacagaccaccgcgcctttggttatgtgtgcggcaaggagggcaatcaccgattcgtcgccattaagactgctcaagcagctgaacctgtcatcttagacctgagggaccttttccaactgatatacgaactaaaacagcgcgaggagctcgaaaaaaaggctcagaaggataagcagtgtgagcaggctgtataccagactatcctggaagaggatgtggaagaccctgtgtaccagtacattgtgttcgaggccggacatgaaccaattcgggacccagagacagaagaaaacatttatcaggtgcctacttcccagaagaaggagggggtctacgacgtgcccaagtcccagcctgtgtccgccgtaacccaactggagctttttggcgatatgagtaccccacctgacatcaccagccctccaactccggccacacctggagacgccttcataccaagctcttctcagacacttccagcttctgccgatgttttttcaagcgtcccatttggcactgcagccgtgccctcaggctacgtggctatgggggccgtgttgccttccttttggggacagcagccccttgtgcagcaacaaatggtgatgggggcgcaacctcccgtggcacaagtgatgccgggggctcagcctatcgcctggggtcagcccggccttttccctgccacacagcaaccttggcccacagtggctggccaatttcccccggccgcattcatgcccacccagaccgtgatgcccctccccgcagcaatgtttcagggccccctcactccgctggcaactgtgccaggtacaagtgactccactagaagctccccccagaccgataagcctcgtcaaaagatgggaaaggagacctttaaagacttccaaatggcacagccaccaccagtgccctctaggaagcctgaccagccctccctgacgtgtacaagtgaggcgttctcttcctacttcaataaagtaggcgtggcccaggatacagacgactgcgatgatttcgatatttcacagctgaatttgacaccagtgacctctaccacgcccagcactaatagtcccccgactcctgctcctcgccagagttccccaagtaaatcctctgcatcccatgcaagtgacccaactactgacgacatattcgaagaaggcttcgagagtccgtcaaaatccgaggaacaggaggcaccggatgggagccaagccagttctaatagcgacccttttggcgaaccgtcgggggaacccagcggtgataacatctctccacaagccggctcctag

SEQ ID NO: 114732 - DNA, 1614 bp, Artificial Sequence
  Description of Artificial Sequence: Synthetic coding sequence
atgtcgaccgaaaccgagctgcaggtcgctgttaaaacatcagctaagaaagattctcgcaagaagggtcaagatcgtagtgaggcaactctgattaagcgctttaaaggagaaggcgtaagatataaggctaaactgatcgggatcgacgaggtgtcggctgctaggggcgataaactgtgtcaagacagcatgatgaagctgaagggtgttgtcgcgggcgcccgaagcaaaggagagcataaacagaagatcttcctcacaatctccttcggcgggatcaaaatattcgatgaaaagactggggcgctgcagcaccatcatgccgttcacgaaattagctacatcgccaaggatattactgatcaccgtgcatttggttatgtgtgcggcaaggaggggaaccatcgctttgtcgccatcaagacggctcaggctgcggagcccgtgatactcgacttgagggacctgttccaactgatctatgaactgaagcagagggaggagttagagaaaaaggcccagaaggacaaacaatgcgaacaggccgtctatcaggttccaacttcacaaaagaaagagggagtttacgacgtccccaaatctcagcctgtctccaatggttatagcttcgaggactttgaggaaagatttgccgctgccacccccgcagtgacacagttggagctttttggggacatgagtacccctccggacattacttcccctccaacccctgccacccccggagatgcatttatcccaagctcttctcagaccctgcccgcttcagccgacgtattttctagcgtcccctttggtactgccgccgtgccttcaggctacgttgcaatgggagcagtcttgccaagcttctggggccagcagcctttggtgcagcagcaaatggtgatgggcgcgcagcccccagtggcgcaggtcatgccaggtgcacaaccaattgcgtggggacagccaggcctgtttcccgctacccagcaaccttggcctaccgtagccggacaattccctccagcagccttcatgccaacccagaccgtcatgccgttgcccgccgccatgttccaaggtcctctcactcctctggccactgtccctggcactagcgattccacacgatccagccctcagacagacaagcccagacaaaagatggggaaagaaacgttcaaagatttccagatggcccaacccccgcctgtccctagccgaaagcccgatcaaccttcactgacatgcacatcagaggctttctcaagctacttcaacaaagtcggagttgctcaggacactgatgactgcgacgactttgatatcagtcagttgaatctgaccccggttacgtctacaactccaagcacaaattctccccctacacctgcccctaggcaaagctcaccttcaaaatcctccgcctctcacgcctccgatccgactactgatgatatcttcgaggaagggttcgaatccccttccaaatcggaagagcaggaagcccctgacggaagccaggcctcctctaacagtgaccctttcggggagccttccggtgaaccctcaggcgataatatttccccccaagccggatcgtag

SEQ ID NO: 114733 - DNA, 1662 bp, Artificial Sequence
  Description of Artificial Sequence: Synthetic coding sequence
atgagcaccgaaacagaacttcaagtcgccgtgaagacatccgccaagaaggattcccggaaaaaaggtcaggatcgctctgaagctaccttgattaaaaggtttaagggagaaggcgtgcgttataaggccaagctgatcggcatcgacgaggtgagcgctgcccggggagataagctgtgtcaggattcgatgatgaaactcaaaggcgtcgttgcaggtgctcgctccaagggcgaacacaaacagaaaatctttcttacgatcagtttcggtggcattaagatctttgacgaaaagactggggctctccaacaccaccacgctgtgcacgagatatcttatatcgccaaagatatcaccgaccacagagcttttggatatgtctgtggcaaagagggaaaccatcgttttgtggccattaaaacggcccaggcagccgaacctgtgattctggaccttcgagacctattccagctgatctatgagcttaagcagcgagaagaactggagaaaaaggcccagaaagataagcagtgtgaacaagctgtttaccaggttccaacctcccagaagaaagaaggtgtctatgatgtacctaagtctcagcccgtgagtaacggctatagcttcgaagactttgaagagcgtttcgccgccgccacccccaaccgcaatctcccaaccgatttcgacgagatattcgaggccactaaggcagtgactcagctggaacttttcggagatatgagcactccacccgacattaccagccctcccactccggccaccccgggagatgcgttcattccttcgagctcgcagactttgccagcttctgccgacgtgtttagttccgtccccttcggcacggccgctgtgcccagtggatacgtcgcaatgggagcagtactgcccagcttttggggtcaacagccattggtacaacagcagatggtgatgggagcgcaacctcctgtggctcaggtcatgcccggcgcgcaacccatcgcatggggtcagccaggtctgttccccgctacccaacagccctggcccaccgttgcaggccagtttccacctgctgctttcatgccgacacagaccgtgatgccattgcctgctgccatgtttcaggggcccttgacccccctggccaccgttcccgggacgtctgattccactcgcagctcaccacaaaccgacaaaccaagacagaagatgggtaaggaaacttttaaggacttccaaatggctcaaccgcctccggtaccctctcgaaagccagatcagccatccttgacatgcacgtcagaggcattttcatcatatttcaataaggtcggcgtggctcaggacactgacgattgtgacgacttcgatatcagccagctgaacctgacccctgtgacaagtactacccctagtaccaatagtcctcctacgccagccccccggcagagttcacccagcaagagtagcgccagccatgcttccgatccgaccaccgacgatatcttcgaggaaggtttcgagtctccatctaagtccgaagagcaagaggcccccgatgggagccaggcctcatcgaactctgacccctttggcgaacccagcggcgagccaagtggggacaatatctccccccaagccggcagttag

SEQ ID NO: 114734 - DNA, 1410 bp, Artificial Sequence
  Description of Artificial Sequence: Synthetic coding sequence
atgtcgaccgaaactgagctacaagttgcggtgaagacatcagccaagaaagactctagaaaaaagggtcaggaccggtccgaagcgacgctgatcaaaagattcaagggagagggggttagatataaggcgaagctgatcgggatagatgaagtctcagcagcgaggggtgacaaactctgtcaggacagtatgatgaaattaaaaggcgtggtggctggagctaggagtaagggtgaacataaacaaaaaattttcttaacgatctctttcgggggcattaagatctttgacgagaagactggagtgccgacatcacagaagaaggaaggcgtgtatgatgtccctaagagtcaaccagtgagtaacggctattcatttgaggacttcgaggaaaggtttgcggccgccactcccaatcggaatctgccaactgatttcgatgaaatttttgaagctactaaagccgttacacagttggagctctttggggatatgtcaaccccaccagatatcacctctccacccactccggcaaccccaggggatgctttcatccctagttcttctcagacactgcccgctagtgcagacgtctttagctctgtgccttttggcactgctgccgtgccttcaggctatgtcgccatgggcgcagttctccctagcttctgggggcagcaaccgctcgttcagcagcagatggtcatgggggctcagcctcccgtcgcccaagtcatgcccggtgcacaaccgatcgcttggggccagcctggcctttttcctgccacgcaacagccttggcccaccgtggccggtcagtttccgcctgccgcatttatgcccacccagaccgtgatgccactgcccgccgctatgttccaggggcctcttacaccactcgcgactgtgccaggcacttccgactcaacaaggtcttctcctcaaacggacaagccccgccagaagatgggcaaagaaacctttaaggactttcaaatggcacagccacctcctgtacccagccgtaaaccggaccagccttctctcacctgcacatctgaagctttcagctcttacttcaataaggttggggttgcccaagatacagacgattgtgatgattttgacattagtcagcttaacctgacgcccgtgacttcaaccactccctccacaaattcgccccccacaccagctccacgacagagttctccttccaaatcgagtgccagccacgcctccgaccctacaacagacgacattttcgaagaaggattcgagagcccttcaaaaagcgaggagcaggaagccccagacggctcacaggcctcatctaattccgacccttttggggaaccatctggcgagcctagtggggacaatatctccccacaggccggttcttag

SEQ ID NO: 114735 - DNA, 2313 bp, Artificial Sequence
  Description of Artificial Sequence: Synthetic coding sequence
atgtccaatgaggtggaaacctccgccactaatgggcagcccgaccagcaggccgccccgaaagcaccctctaagaaagagaaaaagaagggaccggaaaagaccgacgaatatctcctggctcgattcaagggagacggtgtcaagtacaaagcgaaattgataggcatcgatgacgtgccggatgctcggggagataaaatgagtcaggacagtatgatgaagctcaagggtatggctgccgcagggagatcgcagggacaacacaagcagcggatatgggtgaacatatctctctctggtatcaagattattgacgagaaaacgggagtgatcgagcacgagcacccagtcaataagatcagctttattgcgagagatgtgactgataacagggctttcgggtacgtttgcggcggggaaggccagcatcagttttttgcaatcaaaactggtcagcaagctgaacctctggtagtggacctgaaggacctgttccaggttatctacaacgtgaaaaaaaaagaggaggaaaagaaaaagattgaggaagcaagcaaggccgtggagaatggcagcgaagctctgatgattctggatgaccagacaaacaagctcaagagcggagtggatcagatggacttgtttggtgacatgtcgacaccccctgacctgaactcccctacagagagtaaggacatcctgctcgtagacctgaacagtgagattgataccaaccagaattccctccgtgaaaatccatttctcaccaacggcattacatcatgcagcctcccacgcccgactccccaggcttcatttttaccagagaatgcattctccgccaaccttaatttcttccctactcccaaccccgatccgttcagagacgatccctttacccagcccgaccaatctaccccctctagttttgactctctgaaatcccccgaccagaagaaagagaattcttccagtagctctactcctctgtctaacgggccattgaatggagacgtcgactacttcggccagcagtttgaccagatttccaataggacaggcaagcaggaagctcaggcgggcccttggccattctcaagttctcagacccagcctgccgttaggacccaaaacggcgtgtcagagcgtgaacagaacgggttttcagtgaagagcagcccgaacccatttgtcggatctccaccgaagggccttagcatccagaacggagtgaaacaggacctcgagtcatcagtccagagctctcctcacgactcaatcgccataatcccacccccacagtctaccaaaccgggacgcggccggaggacagccaagagcagtgccaacgatctgctggcgagcgatattttcgcccctcccgtaagtgagccgtccggtcaggcctcccccaccgggcagcctactgcattgcagcctaatcctctcgatctctttaagactagcgcgccagcccccgtgggacctcttgtgggccttggtggcgtgacggtaactctccctcaagccgggccctggaataccgcgagcctcgtgtttaaccaaagcccatccatggcacctggggccatgatggggggacagccctctggattttcgcagcccgtgatattcggaacctccccggctgtttcagggtggaaccagccatctccctttgctgcatcgacgccaccaccggtcccagttgtgtggggcccatccgcgagcgttgctcctaacgcctggagcacaacctctcctttaggaaacccctttcagagtaacattttcccggcacccgccgtgtctactcagccaccaagcatgcatagtagtctgctcgtgacccccccacaacccccgcctcgtgctggcccccctaaggacatcagttcggacgcttttactgcgctagatcctctgggcgacaaggagatcaaagacgtcaaggaaatgtttaaagacttccagcttcgtcagccccccgctgtgcctgcaaggaagggcgagcaaacatccagtggcactctgtccgcgttcgcctcttacttcaacagcaaggttggcatcccccaagagaacgcagaccacgacgactttgatgccaatcaactgctgaataagattaatgagccacctaagcctgccccacgccaggtttccttgcctgtgacgaaaagtaccgataatgctttcgaaaatccctttttcaaagacagcttcggcagctcccaagcgagtgttgcgtcctcgcagcccgtatcctcagaaatgtatcgagatcccttcgggaatccttttgcctag

SEQ ID NO: 114736 - DNA, 1659 bp, Artificial Sequence
  Description of Artificial Sequence: Synthetic coding sequence
atgtctaatgaagtcgagacaagtgccacaaacgggcagccggaccagcaagctgcacctaaggccccatctaagaaagagaagaagaagggccctgaaaaaaccgacgaatacctgcttgctcgcttcaagggcgacggagtgaaatacaaagccaaactgattggcattgacgatgtgcccgatgcgcgaggagataagatgtcacaggacagtatgatgaaactgaagggaatggccgccgccggacggtcacaaggtcaacataagcagaggatctgggttaatattagtctgagcggcatcaaaattatcgatgagaagaccggtgtgattgagcatgagcaccccgttaataaaatcagcttcatcgctcgcgacgtgaccgacaacagagctttcgggtatgtgtgtggaggggagggacagcaccagttcttcgctattaagaccggtcagcaggccgagccgttggtcgtagacctgaaggacctatttcaggtgatttacaatgtgaagaagaaagaagaggagaaaaagaagattgaggaagcatccaaagccgtagagaacggatccgaagccttgatgatcttggacgatcagaccaataaactgaagtcaggcgtcgaccaaatggatttgttcggggacatgtcaacaccccctgatttgaactctcccacctccagcgcaaacgacttactggcaagcgatatttttgcccctccggtgtctgaacctagtggacaggctagccctacaggacagccgaccgcactgcagccaaatcctttagacttgttcaagacttctgcaccggcccccgtgggccctttggtgggactgggcggggtaaccgtgaccctgccgcaggcaggcccctggaacacagcctctctcgtgtttaatcaatcacctagtatggcaccgggggccatgatgggtgggcagccttcaggattctctcagccagtaatttttggaacatcccccgcagtttccggctggaatcaacctagccccttcgccgctagtactcctccacccgtgcctgtcgtgtgggggcccagcgctagcgtggcacctaatgcctggagtacaacttcacccctcggaaacccatttcagtccaatatattccctgcccccgccgtgtccacccaaccaccctctatgcactctagcctgctggtaactcctccccagcccccaccccgagccggacctccaaaggatatctcctcagatgccttcaccgccttagaccccttgggagataaggagattaaggatgtgaaagagatgtttaaggactttcagttgcgccagccacctgctgttccagccagaaagggtgagcaaacttctagtggaacactttccgcatttgcaagttattttaacagcaaagtgggcattcctcaggaaaacgccgaccatgatgactttgacgccaaccagttgctcaataaaattaatgaacccccgaaacctgctccgagacaggtgagcctgccagtcaccaagtctaccgacaatgctttcgagaaccctttttttaaggactcttttggctccagccaagcttcagtcgcttcaagtcaacccgtcagctcagagatgtatagggatcccttcggtaatccgtttgcctag

SEQ ID NO: 114737 - DNA, 204 bp, Artificial Sequence
  Description of Artificial Sequence: Synthetic coding sequence
atgtctaacgaggtcgagacgagcgcaacaaatgggcagcccgatcagcaagccgcgccgaaagccccgagcaaaaaggagaagaagaagggacccgaaaagactgatgagtatctgctggcccggttcaaaggcgacggcgtgaaatataaagctaagctgataggcattgacgatgtgcctgatgcccggggagacaaatag

SEQ ID NO: 114738 - DNA, 231 bp, Artificial Sequence
  Description of Artificial Sequence: Synthetic coding sequence
atgtccaatgaggtggagacatctgccacaaacggacagcccgaccaacaggccgcccctaaagcaccgtccaagaaagagaaaaagaagggaccagaaaagaccgatgagtatttattggcacggttcaaaggagatggagttaagtataaggccaaattgatcggtatagacgacgtacctgatgctagaggcgataagatgagccaggatagtatgatgaagctctag

SEQ ID NO: 114739 - DNA, 120 bp, Artificial Sequence
  Description of Artificial Sequence: Synthetic coding sequence
atgtcaaacgaagtggaaacaagtgcaacaaacggacagcctgatcagcaggccgcacccaaagcgccttccaagaaggaaaagaagaaaggccccgaaaaaactgatgagtatttgtag

SEQ ID NO: 114740 - DNA, 2250 bp, Artificial Sequence
  Description of Artificial Sequence: Synthetic coding sequence
atgagcaacgaggtggagacgtcagctaccaacggacagcccgaccagcaggccgcccctaaagcccctagcaaaaaggaaaagaagaagggcccggagaaaactgatgagtacctgttggctcgcttcaagggggacggcgtgaagtacaaggcaaagctgattggcatcgacgatgtgcccgatgccaggggggacaagatgagccaagatagcatgatgaagctgaaagggatggcagcagcgggacgcagccagggccagcacaaacagaggatatgggtcaacatcagcctttctggtattaagatcatcgatgaaaaaacaggggtcattgagcatgaacaccccgttaacaaaatctcatttatagcaagggacgtcaccgataatcgcgctttcggatatgtgtgtggcggggagggtcagcaccagtttttcgcgataaaaacgggccagcaggccgaaccgttggtggttgatcttaaagacctgttccaggtgatttacaacgtgaagaagaaggaagaggagaaaaaaaaaattgaggaagccagcaaggccgttgaaaacggtagcgaggctctgatgatcctcgatgaccagaccaataaactcaagtccgagtccaaagatatacttctcgtggatcttaactcggaaatagataccaaccagaatagcttaagagaaaatcctttcctgaccaacggcatcacttcttgcagcctgccgagaccgaccccccaggcctccttcctgcccgaaaacgccttctctgctaaccttaacttctttcctactccaaaccccgacccatttcgggatgatccttttacccagcctgaccagagcacaccatcttccttcgatagtctgaaatcaccggatcaaaagaaagagaacagtagctcatcttcaacacctttgtccaatggtcccttaaatggggatgtggattactttggccagcagttcgaccaaatatccaatagaactggtaaacaagaagctcaggccggaccgtggcctttttctagcagccagactcagccggccgtgcgaacccagaacggggtctctgagcgggagcagaatggctttagcgttaagtcctcccccaacccattcgttggaagtcctcctaagggcctgtcaatccaaaacggcgtcaaacaggacttggaaagctccgtacagtccagcccgcatgactcaatagctattatccctccgccccagtcgacaaagccgggacgcggtcgacgtacggctaagtcctcagcaaatgaccttctggccagcgacattttcgccccaccagtgagtgaacctagtgggcaggcatcccccactgggcaacctaccgccctacagcctaacccactcgacctgttcaagacaagtgctcccgcacccgtcggcccactggtgggcctcggaggcgtgaccgtcaccctgccccaggcaggtccttggaataccgcctctctcgtgttcaaccagtcccccagcatggcaccaggcgctatgatggggggacagccctccgggttcagtcaacccgttatcttcgggacttctcccgctgtgtcaggctggaatcagcctagcccattcgctgcatctacacccccccctgtgccagtggtgtggggtccaagtgcctccgtggcgcctaatgcctggtctactacttctcccctgggcaacccctttcagagcaatatctttccggcacccgcagttagcacccagcccccttctatgcactcttccctgttggtcacccctcctcaaccaccaccccgggccggaccacccaaggacatctctagtgacgcttttaccgccctggacccgttgggggacaaggagatcaaagatgttaaagaaatgtttaaggactttcagctacgccaacctccagcagtcccggcccggaagggcgaacaaacaagctctggcacgctctccgcctttgccagttacttcaatagcaaggttgggatccctcaggaaaatgcggatcacgatgatttcgatgccaatcagctcctcaacaaaatcaatgaaccacctaagccagcccctagacaggtcagtcttcccgtgacaaagagtactgataacgcttttgaaaatccgtttttcaaggatagcttcggatcttcacaggctagtgtcgcctcatcccagccagtctccagcgagatgtaccgagacccattcgggaatccttttgcatag

SEQ ID NO: 114741 - DNA, 2568 bp, Artificial Sequence
  Description of Artificial Sequence: Synthetic coding sequence
atgattctcatacctcgaatgttactagtgctttttcttctgctgcccatcctttcttctgccaaggcccaggtcaatccagccatttgccgttaccctctgggtatgagcggaggccaaattccagatgaagatataacagctagttcccagtggagcgaatcgacagccgcaaagtatggccggctcgactccgaggagggagatggcgcttggtgccctgagatccctgtagaacctgacgacctaaaagaattcctccagatcgatttacacactctccatttcatcaccctcgtggggacccaaggaagacacgcaggaggtcatggcatcgaattcgctcccatgtataagattaactactctcgggacggaacgcggtggataagctggcgtaatcgccacggtaagcaggtactggacggaaattccaacccatacgatatctttttgaaagatttagaacctccaatagtggccagattcgtgcgttttattccagtcactgaccactccatgaacgtgtgtatgagagttgagctgtatggctgtgtctggctagacgggcttgtgtcatataatgccccagcgggccagcagtttgtccttcctggcggctccatcatctacctgaatgacagcgtttacgatggcgcggtgggatacagtatgaccgagggcttgggccagctgacagacggtgtcagcggacttgacgatttcacccagacccacgaataccacgtatggcccggatacgactacgtgggatggaggaacgagagtgccaccaatggttacattgagatcatgttcgagttcgacagaattcggaattttaccaccatgaaggtacattgtaacaatatgtttgcaaagggagttaagatctttaaggaagtgcagtgctacttccgcagtgaggcgtccgagtgggaacccaacgccatctcgtttcccttggttctggatgatgtcaatcctagcgccaggtttgttaccgtaccactgcatcatagaatggcctcggccatcaagtgtcagtatcatttcgcagacacctggatgatgtttagcgaaatcacctttcagagcgatgctgcaatgtataataactctgaggctttgcctacaagcccaatggcgcctacaacatatgatcctatgctgaaggtggacgactctaatacccgtatcttgattggatgtctggtggctataattttcattctgcttgcaattattgtgataattctgtggcgccagttctggcagaagatgctagaaaaggcatcccggaggatgctagacgatgagatgaccgtctcacttagcctgccttccgactccagtatgttcaacaacaaccgttccagctccccttcagagcagggttccaacagcacctacgacagaattttccctctgcgccctgactaccaggaacccagccggctcatccgcaagttacccgagttcgctccgggcgaagaagaaagcgggtgctctggcgttgtcaagcctgtacaaccttctgggcccgaaggcgtccctcattatgccgaagctgacatcgtgaaccttcagggtgtcactggtgggaatacatatagtgtgcctgccgtgaccatggatcttctctctggcaaggacgtggccgtggaagagtttccaaggaagctgttaacctttaaagagaaactgggcgaaggccagtttggcgaagtgcatctctgtgaggtggagggcatggaaaaattcaaagacaaagactttgcgctggatgtgagcgccaatcagcccgtccttgtcgctgtgaagatgctcagagctgatgcgaacaagaacgctcgcaacgatttcttaaaagagataaaaataatgagtcggttgaaggaccccaatattattcacctgctagccgtgtgcataaccgatgatccgttatgtatgattactgagtatatggaaaatggagacctgaatcagttcttgagccgtcacgaaccaccaaatagttcttcctctgatgttagaacagtatcttacaccaacctgaaattcatggcgacccagatcgcatctggaatgaagtacttgtcttctctgaactttgtgcatcgcgatctggccacccgcaactgtctcgtgggcaaaaattataccattaaaatcgctgattttggtatgtccagaaacctttatagcggggactactaccgcattcaggggcgagcagtgctgcccattcgttggatgagctgggaaagcatcttgctgggaaaattcacgaccgcatctgatgtctgggcgttcggagtgacgctgtgggagacatttaccttttgtcaagaacagccttactctcaactgtccgatgaacaggttattgaaaacacaggcgaattctttcgggatcaagggaggcagacatatctgccccagccagcaatttgcccggactcagtgtacaagctcatgctttcatgctggcgaagggacacaaaaaatcggccctcttttcaggaaattcacctccttctgctccagcagggggacgaatag

SEQ ID NO: 114742 - DNA, 2568 bp, Artificial Sequence
  Description of Artificial Sequence: Synthetic coding sequence
atgattttgataccccgcatgcttttagtcctgttccttcttttgccaatcctatctagcgcgaaagctcaggtgaatcccgctatttgtaggtaccctctgggaatgagtggaggtcagattcctgatgaggacattacagcttcctctcagtggagtgagtctaccgctgccaagtacggacgactggattccgaagagggtgacggagcctggtgtcctgagatcccagtcgaacctgatgacctgaaggagtttctccagattgacctccacactctccattttattacgttggtcggcacccagggaaggcatgcgggcggacatgggatcgagtttgccccaatgtacaagatcaattactcacgggatggaacccggtggatcagctggagaaataggcatggcaagcaggttctggacgggaacagtaacccttatgatatcttcttaaaagatttagagcctcctatcgtggcaagatttgtcaggtttatcccagttaccgaccatagtatgaatgtgtgcatgcgcgtggagctttacggctgtgtgtggctggatggcctggtctcctacaatgccccagcgggccaacagttcgttctgcccggtggatccataatctatctaaacgattcagtgtacgatggcgcagtgggctatagtatgactgaaggcctcggtcagcttacggacggagtgagtggcctggacgattttacccaaacccatgaataccacgtctggcccggctacgactacgttggctggaggaacgagtccgcaaccaacggctatatagagatcatgttcgagtttgacagaatccgaaatttcactacaatgaaggttcactgcaacaacatgttcgcaaagggagtgaaaattttcaaagaggtccagtgctacttccgctcggaggctagcgagtgggaacctaatgccatcagtttccccctcgtattggatgatgtgaatccttccgctagattcgtgacggtaccactccaccacaggatggcatctgcaataaaatgtcagtatcactttgcggacacatggatgatgttttccgaaattacgttccagagtgacgcagctatgtataacaactctgaggctctaccaacgtcacctatggcccccactacatatgacccaatgctaaaggtagatgacagtaacactagaatcctgatcggatgtctggtcgcaatcatctttatcctgctggcaataattgtgatcattttatggagacagttctggcagaaaatgttagaaaaagcctcccgccggatgctcgatgatgagatgacggtgtctctatctctgccctccgactcttccatgttcaataataatcgatctagcagtccttctgaacaaggatctaactccacatatgaccggatttttcccttacggccggactaccaggagcccagtcggttgatccgcaaactgcccgagttcgccccaggggaagaggagtctggctgttcgggagtggtgaagccagttcagcctagtggccctgaaggcgtgccacactacgcggaagcagacatcgtgaatttacagggcgtcacaggaggaaatacatactctgtacccgccgtgacgatggacctcctgtctggaaaagatgtggccgtggaggaatttccacgcaagctgctaacgttcaaagaaaagctgggtgagggacagtttggggaagtccatctttgcgaagttgaagggatggaaaagtttaaagacaaagatttcgccctagatgtgagcgcaaatcagcccgttcttgtagcagttaagatgctccgagccgatgcaaacaaaaacgctcgaaatgattttctcaaagagatcaagatcatgtctcggttgaaggacccgaatatcatccacctgctggccgtatgcatcaccgacgatccgctgtgtatgatcaccgagtatatggaaaatggcgatttaaatcaatttctgtcccgccacgagcccccgaattcgtcatcctcagacgtgagaacagtctcatataccaacctgaagttcatggcaacacaaatagcatccgggatgaagtatctatcatcactaaattttgtgcaccgggacctagccacgcggaattgccttgtcggaaagaattataccattaaaatcgcagatttcggcatgagccgcaacctgtatagtggtgattactatcggatccagggtagggccgtgttgccgatacggtggatgtcctgggagtcgatcctcttagggaagttcaccactgcctccgacgtgtgggccttcggcgtcacgctgtgggagactttcaccttttgtcaggaacagccctactctcagctctctgatgagcaggtgatcgagaacacgggcgaattcttccgggaccaggggcgccagacgtacttgcctcagcccgccatttgtccagattctgtgtataagctaatgctcagctgctggcgcagagacaccaaaaataggccgtcattccaggaaatccacttattgctcctacagcagggcgacgagtag

SEQ ID NO: 114743 - DNA, 447 bp, Artificial Sequence
  Description of Artificial Sequence: Synthetic coding sequence
atgatacttattccaaggatgttgttggtgttgtttctccttctcccaatactgtcatctgcgaaggcgcaggtcaatcccgcgatctgtagataccctctgggaatgtctggaggccaaatccctgacgaggatatcacagcctcaagtcagtggagtgagtccactgctgcgaagtatgggcggctcgattccgaggaaggcgacggtgcctggtgtcccgagataccagtggaacctgacgacctgaaagaatttctgcagatcgatctgcatacactgcactttataaccctcgtgggaacacagggacgccatgctggcggccatggaattgaattcgcgcctatgtataagattaactattccagggatggaacccgatggatttcttggaggaatagacacggaaagcaggtccttgacggaaatagtaatccctattag

SEQ ID NO: 114744 - DNA, 516 bp, Artificial Sequence
  Description of Artificial Sequence: Synthetic coding sequence
tgaatttttatcctgttggctattatcgttattatcctatggcgtcagttttggcagaagatgctcgagaaggcctcaagaagaatgctggatgatgagatgacagtatccctgtctctccctagcgacagcagcatgtttaacaataatcggtcctcttctccctccgagcagggcagcaactctacctacgatcgaatattccccttgcgaccggattaccaggagcctagcagattgatccgcaagctcccggagtttgccccaggtgaagaggagtcaggctgcagcggggtagtgaaaccagtgcagcctagcggaccagagggtgtgccccattacgccgaggctgatatcgtgaacctgcagggcgtcacggggggaaatacatactcggtgccggcagtcactatggacctcctgtctggcaaggacgttgcggtggaagaatttccaagaaagctactaaccttcaaggagaagttgggcgaaggacagttcggtgaagtctcatag

SEQ ID NO: 114745 - DNA, 393 bp, Artificial Sequence
  Description of Artificial Sequence: Synthetic coding sequence
atgatcctgattccccgaatgctgcttgttctgtttcttttgctgcccattctgtccagcgctaaggcccaggtgaatcccgctatatgtcggtatcctttaggcatgtcgggagggcagattcctgacgaggatatcaccgcttctagccaatggagtgagagtactgctgccaagtacggccgcctggattcggaggaaggagacggagcatggtgtccagagattcccgtggagcccgatgatctcaaagagttcctgcagatcgacttacacacactgcattttattaccctcgttgggacccaggggaggcatgccggcggccacggtatagagtttgccccgatgtacaagattaattacagccgagacgggactagatggatttag

SEQ ID NO: 114746 - DNA, 501 bp, Artificial Sequence
  Description of Artificial Sequence: Synthetic coding sequence
cttaaggttgatgactccaatactcgaatcctgattgggtgtctggtggcaatcattttcattctactcgccataatagtgataatcctctggcgacagttttggcaaaagatgcttgagaaagcatcccgaaggatgctcgacgacgagatgacagtctccctctctctgccctcggattcgagtatgtttaacaacaatcgttcaagcagcccaagcgagcagggcagcaatagtacatatgaccgtatatttcctctgaggccggattatcaggagccctcaagactgattcgaaagttgccagaatttgcgcctggcgaggaggaaagcggcgaagacgacgtcgtgggcagagtatctagagaaaagccacaacaggctagtgggcgttatgataccccagctccctcgtctctgcacctgtttctggtgtccgccaacttactgcgaagccctcatagcctctctcggtttggactgccgctgcttttggcatag

SEQ ID NO: 114747 - DNA, 447 bp, Artificial Sequence
  Description of Artificial Sequence: Synthetic coding sequence
atgattttgatccctcgcatgctgctggtgctgttcctccttctccccatcctctcatcggctaaggctcaggttaaccccgctatttgcagatacccactgggcatgagtggaggccagattcctgatgaggacatcactgcaagttcacagtggagcgagtcaacagccgccaaatatgggcgcctggattcagaagaaggtgacggtgcttggtgtccggagattccagtcgaaccggatgatcttaaggagttcctccagatcgatctacatacactgcacttcatcactcttgtcggcacacaggggcggcacgcaggtggacacggtatcgaatttgcccccatgtacaaaatcaattattctcgagatggcacacgttggatttcatggcggaatcgtcacggcaagcaggtgcttgacggcaactctaacccctactag

SEQ ID NO: 114748 - DNA, 2403 bp, Artificial Sequence
  Description of Artificial Sequence: Synthetic coding sequence
atgaattacattttcggtaataatactcttctgtattctcgcggctcacgggggggaaatacatcctccagccacggctccgctgggcccaaacagaagcattgggctaaaaagggtagctcagatgagctccaggcagagccagaaccttcacgttggcagcagattgtggctttctttactaggagacactcgttcatcgattgcattagtgttgcaaccagctctactcaggccaatccaccccctgtattagtgaatacagactccctggagacacccacctatgtcaacggcactgacgcggattatgagtatgaagaaattacgctggagcggggtaactccggcctggggttcagcattgccggcggcaccgacaacccgcacatcggagacgatagttctatcttcataaccaaaatcatcacagggggcgccgccgcacaggacgggagattgagagtcaatgactgcatccttagggtgaatgaagttgatgttcgagacgtaacccactccaaggccgttgaggctttgaaagaggccggaagtattgtgcggctgtacgtcaagagaagaaagcccgtgagtgaaaagattatggagattaagttaataaagggaccaaagggactgggattcagtatcgccggtggcgttggcaatcaacatattcccggcgataatagcatctacgtgacaaaaattatcgaaggcggagcggcccacaaggatggcaaactccaaatcggggataagcttctggccgtcaacaatgtgtgcctggaagaggttacacacgaggaagccgtcaccgccctcaaaaatacatcagacttcgtgtatcttaaagtcgccaagccaaccagcatgtacatgaacgacggctatgcaccacccgatattaccaacagcagcagtcaacctgttgataaccacgtgtccccctccagtttcctggggcagaccccagcctctccggcaaggtatagccctgtttctaaagcggtgctgggggacgatgagatcactcgagagccgcgaaaggtggtgctgcacagaggatcaaccggtctgggctttaacatcgtcggtggcgaagatggggaagggatttttatttcattcatcctggctggtgggcccgctgacctctccggcgaactccggaagggggatagaattatctccgtgaattccgtggatctacgcgccgcttcacatgagcaggctgctgctgcacttaagaatgccggccaagccgtaacaatagttgctcagtatcgccccgaagaatacagcagattcgaggccaaaattcacgacttacgggaacagatgatgaactctagcatctcaagcggatcagggtcactgcgcactagccaaaagcggtcgttatatgtgcgggctctttttgactacgacaagaccaaagactccgggctcccttctcagggcctgaactttaagttcggcgacatcttacacgtcattaatgccagcgacgatgaatggtggcaggctagacaagtgactccggacggtgagtcagatgaagtgggggtcatcccttctaagcggagggtagagaagaaagaacgggctaggctgaagaccgtaaagttcaattcaaaaacacgggacaaaggggaaattcctgatgacatgggatctaaggggctgaagcatgtcacctcaaatgcaagcgattccgagtccagctatcttatacttattaccgatgaatacggctgctccaagggcgggcaagaggaatatgtattgagctatgaacctgtgaaccagcaggaagtcaactacacaaggcccgtgatcattctggggccaatgaaggaccgaatcaatgatgatctcatttctgaattcccggacaagtttgggtcatgtgtgccgcataccacacgcccaaaaagggactacgaggtggatggaagagactatcattttgtgacttctagggagcagatggagaaggacattcaggagcataagttcatcgaggcgggacagtataataatcacttatatgggactagcgtccagagcgtccgggaagtcgcagaaaaggggaaacattgcatactggatgtttcaggaaatgctattaaaaggttacagattgcgcagttgtatcctatatcgatcttcatcaagcccaagtcaatggagaacatcatggagatgaataagcgcttaactgaagagcaggctcgcaagacctttgagcgtgcgatgaagctcgagcaggagtttacagagcacttcacagcaattgtgcagggagacactctggaagacatatataaccaggtgaaacagataatagaggagcagtctggttcatacatttgggtgcctgccaaggagaagctgtag

SEQ ID NO: 114749 - DNA, 2367 bp, Artificial Sequence
  Description of Artificial Sequence: Synthetic coding sequence
atgaactatatattcggtaacaacacccttctgtatagtcggggttcgcgtggagggaacaccagttcttcacacggctcagctggacctaagcaaaaacactgggctaaaaagggatcctccgatgagctccaggcggagccagagccgtcccggtggcagcagatcgttgctttctttacccgccgccactcgtttattgactgcatatcagtcgcaacatcctctacacaggccaatcctccaccagttctcgtaaatactgattcgctcgaaacccccacctacgtcaacggcaccgacgccgactatgaatacgaggaaattactctcgagcgcggaaacagtggattgggctttagcattgccggtggtactgataacccacatattggtgacgatagcagcatatttataactaaaataatcacgggcggggccgccgctcaggatggtcggcttagggtgaatgactgtatccttcgggtcaacgaggtggatgtacgggatgtaacccacagtaaggctgtggaggcactaaaagaagcgggaagcattgttcggctctacgttaaacgcaggaagcccgttagcgagaagattatggagattaaactgatcaaaggaccaaagggcctgggattctccattgcaggcggagtgggtaatcagcacataccaggagacaacagcatctatgtgactaaaataatcgaggggggagcagcacataaagatggaaagctgcaaatcggggacaaactgctggccgtaaacaatgtgtgcctcgaagaggtgacacatgaagaagctgtcacggcactaaagaacacatcagatttcgtctatctcaaggtggcaaaacctaccagcatgtacatgaatgacggttatgccccccccgacatcacaaatagttcctcacagcctgttgataaccatgtcagccctagttcattcttaggacaaaccccagctagccctgcccggtattccccagtgagtaaggctgtgctcggggatgatgaaattacacgggagcctcgcaaggtagttcttcacaggggttccacaggactagggttcaacatcgtgggcggcgaggatggggagggcatctttattagcttcattcttgccggtggccccgccgatctctccggtgaactcaggaagggggatcggattatatctgtcaattcagttgacttgcgtgccgctagccacgaacaggccgccgctgccctaaaaaacgctggccaggccgttaccattgtggcacagtacagacccgaggaatactcaaggttcgaggccaaaattcatgacttgcgggaacagatgatgaactccagtatcagttctggttctggaagccttcggacttcacagaaaaggtcattgtatgtgcgcgcgctctttgattatgacaaaaccaaagattccggcctcccatcgcaaggcctgaacttcaaattcggggatatactgcacgtgatcaacgcatccgacgatgagtggtggcaagccagacaagtgacaccagatggtgaatcggatgaagtgggtgtaatccccagcaaacgcagggtggaaaagaaagaacgggcaaggctgaagacagtaaagtttaacagcaagacccgggataagggggaaatacccgacgatatggggtctaagggactaaagcatgtaaccagcaatgcatccgattctgagagctcctacaggggccaggaagagtatgtgctgtcctatgagcccgtgaaccagcaggaggtgaattatactcgccccgtaatcatccttggacctatgaaggatagaatcaacgatgatctgattagtgaatttcccgacaagttcggctcatgtgtgccacatacgactcgcccgaaaagggactatgaggtggacggccgtgactatcacttcgtaactagccgcgagcagatggagaaagatatccaggagcacaagttcatagaagcaggccagtataacaatcatctttatggtacgtccgtacagagcgtccgagaagttgccgagaaagggaaacactgtatcctggacgttagtggcaatgccatcaagaggctgcaaattgcacaactatatcccatttctatctttatcaaaccaaagagtatggagaatatcatggagatgaacaagcgactgacagaagagcaagcaaggaagaccttcgaaagagctatgaagttagagcaggagttcaccgaacacttcactgccatagtgcagggggatacactcgaagacatctataatcaggtcaaacagatcattgaggaacagtcagggtcctacatctgggtcccagcaaaagagaagctttag

SEQ ID NO: 114750 - DNA, 1539 bp, Artificial Sequence
  Description of Artificial Sequence: Synthetic coding sequence
atggagcgggctcgcaagttttccggtagtggcctagccatgggactcggttcagcctccgcctccgcctggagacgggcgagtcagcggtgggcttggccccttcgtagcctccgccctggaggggacgctcgcgagccacgcaaaatcatcctccataagggcagcaccggcctcgggttcaacatcgtgggcggagaggacggtgaaggtatctttgtgtccttcattcttgctggcgggccagctgatttatctggtgagcttaggcgcggagacaggatactttccgtgaatggtgtgaatctccggaacgctacccatgagcaggctgcagcggccctcaaacgggctggtcagtctgtgaccatagtcgctcagtaccgtccagaagaatactcccggtttgagtcaaaaattcatgacctgcgtgagcaaatgatgaacagtagtatgtcgtctgggtccggaagcttgcggacatctgagaaaaggagcctgtacgtaagggctctcttcgattacgacagaacccgcgacagctgtctgcctagccaggggctgagtttttcctacggcgatatcctgcatgttatcaacgccagcgatgacgagtggtggcaagcccgtctcgtgactcctcacggggagagtgaacagatcggagttatcccatccaagaaacgtgttgagaaaaaagagcgtgccagactaaaaaccgtgaaattccacgcccgaacaggaatgattgaaagcaatcggtccatcaagactaaacgaaaaaaatccttccggttgtcccgaaaattccccttttataaaagcaaagagaatatggcacaagagagcagcatacaggagcagggcgttacttcaaatacgtcagactcggaatctagtagcaaaggtcaggaggatgccatcctctcttacgaacctgtgactaggcaagagatccactatgcccgaccagtgatcatcttagggccgatgaaagacagggtgaatgacgatcttatttcagagttcccccacaagtttggctcatgtgttccccacacaactcgtcccagacgggacaacgaagtcgatggtcaagattaccatttcgttgtttccagggaacagatggagaaggacatacaggataataaatttatcgaggcaggtcagttcaatgataatctgtacggaacctcaatacagagcgtgcgggccgttgccgagagagggaaacactgtatactcgatgtcagcggcaacgccatcaagagattacagcaggctcagctgtaccctatcgctattttcattaagcctaaatccatcgaggcccttatggaaatgaacaggagacagacatacgagcaggccaacaaaatatacgataaggccatgaagctggagcaggagtttggtgagtacttcaccgcaatcgttcagggtgactccctggaggagatctacaacaaaatcaaacagatcatcgaggatcaaagtgggcactatatttgggtgccctcacctgaaaagctctag

SEQ ID NO: 114751 - DNA, 3021 bp, Artificial Sequence
  Description of Artificial Sequence: Synthetic coding sequence
gaagaagaagccggagatttggtacagccaggcatcagcttccccggtccagcagaggaggatctggacccacagtattcttggagccccacacagcactttaacgaagagaggtactcaccagccccacgatccatgaagggcctttcagggtctcgaactcagccaccattatgcagcgggcacacgtgcggtttggctcccccagaagattgcgagcacctgcatcacggacctgatgcccggcctccataccttctgtctccagccgacagctgccccggtggtaggcataggtgctcgccaaggagttccgtacacagcgaatgtgtcatgatgcccgtggtactgggtgaccacgttagttcttccaccttcccgaggatgcactactccagccactatgatactcgggatgattgcgccgtggcccacgcaggcgcaaaaatcaaccgaatccccgccaatctgttggatcagttcgaaaaacaactgccactccaccgagatggtttccacaccctgcaataccagagaacaagtgccgccgcagagcaacgctctgagtcccctggacgcattaggcacctggtgcactccgtccagaagttgtttacgaagtctcacagtttagagggcagctctaagagcaacgctaatggtactaaagctgacggcagagcagacgatcatcaccacgcgcaccacgcaaagcacagtaagagatctaagtccaaggaacgcaaaccagaaggcaagccgcgaccaggtatgtcctcctggtggtctagtgatgataacctcgactcagatagcacataccgaaccccctctgttctgaatcggcatcacttagggccagtggcccattgttaccccgacgcattacagagtccctttggtgacctgtcgttgaagacttctaagagtaataacgatgttaaatgcagcgcttgtgaaggcctggccttgacaccagatgcaaagtatcttaagcggtcctcttggtcaaccctgaccgtgtcacaggccaaggaagcatacaggaagtcctctctgaatttggacaagcccttgctgcatcaggacgctaaacctgccctgagaccttgccactatctgcaagttcctcaagacgagtgggggggctaccccaccggcggtaaagatgaggagataccttgcagaaggatgcggtcagggtcctacattaaggccatgggggacgaagagtcaggagaaagcgattcttccccaaagacctccccaaagtctgccattctgcccgaacctttgctcaagtccataggacaacggcctctgggtgaacaccaaactcagacctacctacaggcggctagcgatgtccccgtggggcactctcttgaccctgccgccaactacaacagccctaagttccgttccaggaatcagagttacatgagggctgtgagcacactatcccaggctagttgcgtgtcgcaagtttccgaggccgaaatcaatggacagttcgagtctgtatgtgagagtgtttttagcgaggtggagagtcaggcgatggatgcactggacttgcccggatgcttccgtaccaggtcacactcctatctgcgagccattcaggccggatattcccaggatgacgagtgcattccaatgatgactccaagcgacatcactagcactatccggagtactgccgccgtctcatacacaaattataagaaaaccccaccccctgtgcccccccggaccacttctaagcccctcatctctgtcacagcacagtcaagcactgagtcaacccaagatgcataccaggactctagggcccagagaatgtcgccctggccacaggacagtcggggcctttacaacagtacagattctctggactctaacaaagcaatgaatctcgcactggaaacagccgctgcccaaaggcatctacccgagtcccagtcaagtagtgtcagaacctccgacaaggccatcttggtgtccaaggccgaagagctgctgaagagcaggtgttcctccatagggatccaggtggaaaccgcaaccgattctgacaccgagtctagagggctacgagaataccatagcgtgggcgtgcaagtggaagacgaaaagagacacgggaggttcaagcgatccaactccgtcactgctgccgtgcaggcagatctcgaactggaaggtttccccggtcacattacaactgaagataagggactgcaattcggcagttcatttcagcggcattccgagcccagtacacctactcagtactcggcagtgcgtactgttcgtacccagggtttgttctcgtaccgggaagactaccgaacccaggtagacacaagcacgctgccccctccagatccatggttagaacccgcaattgatacggttgagactgggcgcatgtctccttgccgaagagatgggtcctggttcttaaaactgttacatgcggagacaaaacggatggaaggctggtgcaaggagatggaacgagaggctgaggagaacgatctctcagaggagattcttggcaagattcgctccgctgtgggcagcgcgcaattacttatgagtcaaaaatttcaacaattttactggctatgccaacagaacatggatccctccgccatgcctaggccaacatcacaagatcttgcaggatactgggacatgctgcagctgtctatcgaagacgtttctatgaaattcgatgagctgcaacggctgagattaaacgattggaaaatgatggagagccccgagcggaaagaggaaaggaaggtcccgcctcccatcccgaagaagccaccaaaagggaaatttcctatcactcgggagaagagcctggacctgcccgatcgtcagagacaggaagctaggcgccgcctcatggcagcaaagcgcgccgctagtttcagacagaactctgcctctgagcgggcagactctattgagatttacattcccgaagctcagacccgattatag

SEQ ID NO: 114752 - DNA, 2928 bp, Artificial Sequence
  Description of Artificial Sequence: Synthetic coding sequence
atgaaaggacttagcgggagccggacacagccacctctctgttccggtcatacctgtggtcttgcaccccctgaagactgcgaacatctccatcatgggccggacgcgagacctccatacttgttgagccctgctgacagctgcccaggcggccgccaccgttgctccccccgttcctccgtgcattcagagtgtgtcatgatgcccgtggtcttaggagatcatgtgtctagtagcacatttccaagaatgcattactcgtcccactacgatacacgggatgattgcgctgtggcccacgcgggagcaaagataaatcgtattccagcaaatcttctggaccaattcgaaaagcaattgccgctacatcgagacggttttcatacactccagtatcagcggaccagcgccgctgccgaacaaagaagtgagtctccgggcaggatccgacacctagtccattctgtccagaagctgttcactaaaagccattccctggaaggctcgtccaagagcaacgcaaacggaaccaaggccgacgggagggccgacgatcatcaccatgcccaccacgcgaaacactctaaaaggtcaaaatcaaaggaacgaaagcctgaaggcaaacctcgccccggaatgagtagttggtggtctagtgacgacaatttggattcagatagcacttacagaaccccctccgtgctgaatcggcaccatctcgggccagttgcccattgctaccccgatgccctgcagagtccttttggggacttaagtctgaagacaagtaaatccaataacgacgtcaaatgcagcgcctgcgaagggctcgctctcaccccagacgccaaatatctgaaaaggagttcctggtctacactcacagtcagccaggctaaagaagcctatcgcaaatctagtctgaatctggataagcccctgctacatcaggatgccaagcccgcacttcgtccctgtcactatctacaggtgccccaggacgagtggggcggctatccaacgggggggaaagatgaagaaattccgtgtcggaggatgaggagtggatcctacatcaaggctatgggcgacgaggagagcggcgagagtgattcgtcaccaaaaacaagtccgaaaagtgccatcctgcccgaacccctgctcaagtcaatcggtcaaaggccgctcggagagcatcagacacagacgtacctacaagcagccagcgacgtacctgtggggcatagcttggatccggcagcaaattacaatagccccaagtttcgatctcggaatcaaagctacatgcgagcagtctcaactctgagtcaggctagctgcgtgtcgcaggtcagcgaagccgaaatcaacggccaatttgagagtgtatgcgagagtgtcttctctgaagtggagtcccaggctatggacgccttggatctgcccggctgctttagaaccaggagtcatagctacctgcgcgccattcaggcaggctattctcaggatgatgaatgtattcccatgatgactccctctgacattacgagtaccatccggagtactgccgcggtaagctatactaattacaaaaaaaccccgccccctgtcccgccccgcacgacttctaaacccctgatcagtgtgacagcacaatcgtctaccgaaagcactcaagatgcgtaccaggactcacgtgcacaacgcatgtcaccctggcctcaagactcccgaggactctacaatagcactgatagcctcgactccaacaaggctatgaatctggctctggaaactgccgccgcacagaggcatctacccgagtctcagagctccagcgtccgcaccagtgacaaagccattttagtgtcaaaggccgaggagctactaaagtctcggtgctctagcattggaattcaagattctgaatttcccgagcatcaaccgtacccacggagtgatgtggaaacggctacagattctgacactgaatccaggggtttgagagagtatcactccgtaggtgtacaagtggaggatgagaagaggcacggccgattcaagaggagtaactctgttacggctgcagtgcaagccgacctggagctagaaggattccccggacatattaccacggaagataaaggcttacagtttggctccagctttcagaggcattctgagccaagcacgcctactcagtactctgctgttaggaccgtgagaacccagggactgttttcatacagagaggattaccgaacccaggtagacacatctacactgccgccccctgacccttggctcgaacctgctatcgatactgtggagactggccggatgagcccatgcaggcgcgacggaagctggttcctgaaacttctacacgctgagaccaaacggatggagggctggtgtaaagaaatggagagggaggccgaagaaaatgatttgtccgaagagatcctgggaaagatccgatctgctgtgggctcagcccagctgctgatgtcacagaagttccaacagttttactggctgtgtcaacagaatatggatccctctgcaatgcctagaccaacttcacaggatcttgctggatactgggatatgctgcagctcagcattgaggatgtgtcaatgaaattcgatgagctccaacgtctgcggttgaacgactggaagatgatggagtccccagaaaggaaagaggaacgcaaggtgccaccccctatccccaaaaaaccccccaagggaaaattcccaatcactagggagaagagcctggacttgcctgaccggcagcgtcaggaggcccggcgtcggctaatggctgctaaacgggctgcctcatttcgtcagaattccgcgtcggagcgggctgacagtatcgagatttatattcccgaggcacagacccggctgtag

SEQ ID NO: 114753 - DNA, 2937 bp, Artificial Sequence
  Description of Artificial Sequence: Synthetic coding sequence
tagccgacacaacacttcaacgaggagaggtatagccccgctccccgctcgatgaaggggttgtctggctcccgcacgcagcccccactttgtagcggccacacatgtggcctcgccccccccgaggattgcgaacatttacatcatggtccagatgctcgcccgccctatctcctgtctcctgcggacagctgccccggaggcaggcatagatgttccccaagatcttccgtgcactctgagtgcgttatgatgccagtggttctcggagatcacgtgagcagttcaaccttccctaggatgcactatagtagtcactatgacactagagacgattgtgcagttgcacatgctggggcgaagattaacaggattccagccaacctgttggaccagttcgagaagcagcttcccttacatcgcgacggtttccacactcttcagtatcaacgcactagcgctgcagccgaacagaggtccgagtcgcccggaaggattcgccatctggtccattctgtccagaaactattcacaaaaagccacagtcttgaagggagctcaaaatccaatgcgaacgggaccaaggcagacgggcgagcggacgatcaccaccacgcccaccatgccaagcattccaagagatctaagagcaaggagagaaagcccgaggggaagcccagaccaggcatgagctcttggtggtcttccgacgataacctggattccgattctacctaccggaccccctctgtgcttaatcggcaccacttggggcctgtggctcattgctacccggacgccctgcagtctccctttggggatctttccttaaaaacctctaagtcaaataacgacgtgaaatgtagcgcctgcgagggtctggctttgacaccagatgcaaaatatctgaaacgatctagctggtccaccctaactgttagccaggctaaggaggcctacagaaagtcctctctgaacctggacaaacctctgctgcaccaggacgcgaaaccagccctcagaccctgccattaccttcaggtcccacaggatgaatggggggggtaccccacgggcggcaaggacgaggagattccatgccggcgcatgcggtccggttcctatataaaggcgatgggggatgaggagtcgggagaaagcgatagctcacctaaaacatcccccaagtccgccatactgccagagcctttgctcaaaagcattggtcagcgaccactgggagaacaccagacccagacataccttcaagccgccagcgacgtcccagtaggccatagccttgatcccgcagcaaattacaattcacccaaattccgcagccgtaaccaaagctacatgagagcagttagcacactgtcccaggcatcatgtgtgagccaggtgtcagaggccgaaatcaatgggcagttcgagtccgtctgcgagtcagttttttccgaggtcgagtcccaggccatggatgcgctggacctgccggggtgttttcggacccgctcccacagctacttacgcgctattcaggcaggctattctcaggacgacgaatgtattcctatgatgactccctcagatattacctctacaatacggagtactgctgcagtttcctacactaattataaaaagaccccaccccccgtgccgccccggaccacatctaaacccttaatctctgtcacggctcagtcttccaccgagagtacgcaggacgcataccaagattcacgggcccagcgaatgagcccatggccccaggatagtcgggggctgtacaattccactgattcgttggactccaacaaggccatgaacctcgctctcgaaaccgccgccgcccaacggcacttgccagagtctcaatcttcatctgtgcgcaccagtgacaaagcaatcctcgtctccaaagccgaggaactgctgaaaagtagatgctctagcatcggtatacaggttgaaacagctactgacagtgacacggagtccaggggcctgcgcgaataccactctgttggcgttcaggtggaagacgaaaagaggcatgggcggttcaaacgctctaattcagtcacagccgctgtgcaggccgatcttgagctggaaggatttcccggccatatcacaaccgaggacaagggcctgcaattcggcagcagcttccaacgtcattctgagccctctactcccacgcagtattcagctgtgcgcactgttagaacccagggactgttctcctaccgtgaagactacagaacgcaggttgataccagtacactgcccccaccagatccttggttggagccagctatcgacactgtggaaaccggacggatgtccccttgccggagggatgggagctggtttctgaaattactacatgctgaaactaaaaggatggaaggctggtgcaaggagatggagagagaagcagaggagaacgacctgagcgaagaaattctcggcaagatccgctccgccgtgggcagtgcccaactcttgatgagtcaaaagttccaacagttctactggctctgtcagcagaatatggatccatctgctatgcctagaccgaccagccaagatttggcaggttattgggatatgctgcagttaagtattgaggatgtgtccatgaaattcgacgaattgcaacgcctgagactaaacgactggaagatgatggagagccctgagagaaaagaggaacggaaagtgcctcctccaatcccaaaaaagccccccaaaggaaaatttccaattacccgtgagaagtcactggaccttcccgacaggcagcgtcaggaggcaaggcgtagattgatggccgcaaagagagcagcttcatttcggcaaaattcagcttctgagcgtgctgatagcatcgagatttacattcctgaagctcagaccagactgtag

SEQ ID NO: 114754 - DNA, 2562 bp, Artificial Sequence
  Description of Artificial Sequence: Synthetic coding sequence
atgccagttcgtaagcaggacactcagagagcactgcatcttctagaagaataccgatcaaagctctcacagactgaggacagacagctgaggagttccattgaacgggtaattaatatcttccaatccaaccttttccaagctttaatagatattcaagagttttatgaagtgacactcctcgataaccccaagtgcatagatcgctccaaaccgtctgaacccatccagccagtgaatacgtgggaaataagctcgctaccatcctccaccgtaacttcggaaacgctgccaagctcattgagcccatccgtggagaagtatcggtatcaggacgaggacaccccccctcaagagcacatctccccccaaatcaccaacgaggtgatcggccccgagctggtccatgtgtccgaaaaaaatctgtcggaaattgaaaatgtgcacggcttcgtctcccattcacacatcagccctatcaaggtgaacggcaccgatgcagactatgaatatgaagagataacgctcgagagagggaattctggactgggatttagtattgcagggggaactgataaccctcacatcggagatgactcctctatcttcataaccaaaatcattacgggaggagccgccgcgcaggatgggaggctccgcgtgaacgattgcatccttcgggttaacgaagttgacgtccgggacgttacacatagcaaggccgtggaggctttgaaggaagcagggtctatcgtgagactgtacgtgaagagacggaagcctgtatctgaaaagatcatggaaatcaagctcattaaggggcccaaagggttagggttctccattgccggtggggtgggtaatcagcacatacccggagataattctatctatgtcactaagataatcgaaggtggagccgcgcacaaggatggtaaattgcaaataggcgacaagttgcttgccgtgaataatgtgtgtcttgaggaggtcactcacgaggaagccgtaaccgcactcaaaaatacttcagatttcgtgtatcttaaggtggccaagccaacgtctatgtacatgaacgacggatatgccccacctgacatcacaaattcttcatcccagcccgtggacaatcacgtgtctccctcgtccttcctagggcaaacccctgcatcgccagcgcgatactcacccgtgtcgaaggccgtgcttggggatgatgagattacgagggagccccgaaaggtggttctccatagagggtccaccggcctcggtttcaacattgtcgggggagaggatggagaaggcatttttattagtttcatcttagccggcggtcctgccgatctgtcaggcgaactgagaaaaggcgatagaatcatcagcgtgaactctgtggatctgcgtgcagcaagtcacgaacaggccgcagccgcgctcaaaaatgccggccaggccgtgacaattgtcgcccaatataggcctgaagaatattcccggtttgaggcaaagatacacgatctgagagagcagatgatgaactcttctatttcatctggtagcggatcactgcgtaccagccagaagcggtctctctatgtccgtgctttgttcgactatgacaagactaaagatagtggcctgccctcccagggcctgaattttaagttcggcgatattcttcacgttataaatgctagcgacgacgaatggtggcaggcaaggcaagtgacacctgacggtgagagtgacgaggtcggagtcatcccctcaaagcgaagggttgagaagaaggagcgtgcacggctcaagaccgtgaagtttaacagtaagacacgggacaagggagagatccctgacgacatgggaagcaaaggccttaagcatgtgaccagcaacgccagtgattctgagtcttcctacaggggccaggaagaatacgtcctgtcttacgagcctgttaatcagcaagaagtgaactacacccgtcctgtcattatacttggcccaatgaaggaccgcataaacgatgatctgatctcggagtttcctgataagttcggcagctgtgtgccccacacaactagaccgaagcgcgattacgaagtggacggtagggactaccattttgttaccagtagggaacagatggagaaagacattcaggagcacaagttcatcgaggccgggcaatataataatcacctttatggaactagcgttcagtcggtccgggaggtggcggagaagggcaaacactgtatcttggacgtgagtgggaatgcgataaaaagactccaaatcgcccaactgtacccaatttcgatcttcattaaacctaagtcaatggagaatattatggaaatgaataaacggctgaccgaggaacaggcacggaagaccttcgaacgagctatgaaactggaacaggagtttacagagcattttaccgcgatcgtccagggagatacactcgaggacatttacaaccaggtgaaacagatcatcgaggaacaatctggaagctacatttgggttcccgctaaagaaaaactctag

SEQ ID NO: 114755 - DNA, 2781 bp, Artificial Sequence
  Description of Artificial Sequence: Synthetic coding sequence
atgcctgtgaggaaacaggatacgcagagagccctccacctgcttgaggagtaccgaagtaagctctcccaaacagaagacagacagcttcggagtagcatcgaaagggtcatcaatatttttcagtccaacttattccaggcccttattgacatccaggagttttacgaggttacattattggataatcccaagtgtattgaccgcagtaaacccagcgagccaatccagcctgttaacacctgggaaatttcctctctgccatctagcaccgtaacttccgagactctcccctcaagtctatctccttcagtggagaagtatcgataccaggatgaagacacacctccccaggagcatataagccctcagatcactaacgaggtgatcgggcctgagctcgtccatgtgtctgaaaagaacctgtccgagattgagaacgtgcatgggtttgtgtcccattcacacatctctcccattaagccaactgaggctgtgctgccaagccccccaaccgtgccagttattcctgtcctcccggtgcctgctgagaacacagtgattctgccgaccataccccaagctaatccccccccagtcctggttaatacagactcgctggaaacccccacttacgtgaatgggacagacgcagactatgagtacgaggagatcaccctggaacgggggaattcaggcttgggattttccatcgccggggggactgacaatccacatatcggagatgactcctcgatattcatcactaaaattatcaccgggggcgccgcagcccaggacggcagactgcgggtgaatgactgtattcttcgcgtcaatgaggtggacgtccgcgacgtgacccacagtaaggcagtggaggcgcttaaggaagctggaagcatcgtgcgtctttatgtcaagagacgaaaacccgtgagtgagaagatcatggagattaaactgattaaggggccaaaaggattaggtttctcaatcgccgggggcgtcggaaaccagcatatccccggcgacaatagtatctacgttacaaaaattatcgagggaggggctgcccataaggatgggaagctacagatcggagacaagctattagctgtcaataatgtgtgcctcgaggaggtcacacacgaagaggctgttaccgccttgaaaaacactagcgacttcgtctatcttaaggtggcaaagcccacctctatgtacatgaatgatggctacgctccgccagacatcaccaactcatctagtcagcccgtggataaccacgttagtccgtccagtttcttagggcaaactccagcctctccagccagatattcccctgtgagtaaggcagtgcttggggatgacgagattacgcgggagcctcgcaaagttgtgctgcaccgcgggagcaccggtctgggttttaacatcgtggggggagaggatggagaagggatcttcatctcctttattctggcaggagggccagccgacctcagcggggagctgcgcaaaggcgaccggatcattagcgtgaacagcgtggacttgcgtgccgcctcccacgagcaggcagcggccgctctaaagaacgcaggacaagcagtgacaattgtggctcaataccggccagaggagtacagtcggttcgaagccaagattcatgacctaagggagcaaatgatgaattcatctatatcaagcggatctggttccctccgcacttctcagaaaagatctctgtatgttcgcgcattgtttgactatgataagactaaagactctggacttcccagtcagggcctcaactttaagtttggcgatattttacacgtcattaatgctagcgacgacgaatggtggcaagccaggcaggtgacacctgatggcgaatcagacgaggtcggcgtcatccccagcaaaaggcgggtagaaaagaaggaaagagccaggctgaaaacagtgaaattcaacagtaagacacgggataaaggacagagttttaacgacaaacgaaaaaagaatttgttctcccgaaaatttccgttctacaaaaacaaagatcagtcagagcaggaaacaagcgacgccgaccagcacgtaacttccaatgcttcagacagcgaatcttcttacagagggcaggaggaatacgtgctgagctatgagcccgttaaccagcaggaggtcaattacacccggccggtcattatacttggacccatgaaagacagaataaatgatgacctcatttcagagttcccagacaaatttggatcctgtgtccctcataccactcggcctaagcgggactacgaggtggacggtagagactatcactttgtgacctccagagagcagatggagaaagacattcaagagcataagttcattgaggccggacaatacaacaatcatttatatggaacttccgtgcaaagtgtacgtgaagtggccgagaaagggaaacactgcattttagacgtctccgggaacgccattaaaaggctgcagatcgcacagctgtatcccatctcaatctttatcaaaccaaaaagtatggagaatataatggagatgaacaaaaggctaaccgaagaacaagctagaaagacctttgagcgagccatgaagctcgagcaggaatttacagaacatttcacagcaatcgtgcagggagacaccctggaagatatttacaaccaggtcaaacagatcatcgaggaacagtctgggagttacatctgggtgccggccaaggagaagttgtag

SEQ ID NO: 114756 - DNA, 2682 bp, Artificial Sequence
  Description of Artificial Sequence: Synthetic coding sequence
atgcctgtgcggaagcaggatactcaaagagccctacacctcttagaggagtatcgaagcaagttgtcacagaccgaagaccgccagctgagatccagcatcgaacgggttattaacatcttccagtccaatctgtttcaggctctaattgacattcaagagttttatgaggttacacttctggataacccgaaatgcatagaccggagtaagccctcggagcccatccagcctgtgaacacgtgggagattagcagcctcccttcttccacggtgacgagtgagaccttgccgtccagtttgtccccctctgttgaaaagtaccgataccaggacgaggatacacccccgcaggaacacattagtccccagataaccaacgaagtaatcggccctgagctggtgcacgtctcagagaagaacttgagcgagatcgagaacgtccatgggttcgtgtcccattctcacatcagcccaattaaagccaatcctccccccgtgttggtcaataccgacagcctggagaccccaacctacgtgaacggaaccgatgccgattacgagtacgaggagatcacactcgagcggggcaacagcggccttggcttctccatagctgggggcacagacaatcctcacattggggacgatagctcaatatttatcactaaaatcatcacaggcggcgccgctgcccaggacggacgactccgagtgaatgattgcatactacgggtgaacgaggtagacgtacgtgacgttacccactcaaaggccgtagaggctctgaaagaggctggtagcatcgtccgtctctatgttaagcgccggaagcccgtgtctgaaaagatcatggaaattaaactgatcaagggccccaagggcctgggctttagtattgctggtggagtagggaatcagcacatcccaggcgacaactccatttacgttacgaaaattatagaaggtggggcagcacacaaggacggcaaacttcagattggggataaattgctcgctgttaataatgtctgcctggaagaggtcactcatgaggaagctgttaccgccctaaaaaacacctcagactttgtttacttgaaagtggcaaagccaaccagtatgtacatgaacgacggatatgccccccccgacatcacgaattcaagcagccaaccagtggacaatcatgtttctccctcatcatttcttggtcagactcctgcgtcacctgcccgttatagccctgtgagcaaggcagtcttaggggatgacgagatcacacgcgaacctagaaaagtcgtgctccaccgcggctcaactgggctggggtttaacattgtgggaggggaggatggcgagggcatcttcatcagcttcattctggccgggggacccgctgaccttagcggcgagctgcggaagggcgatcgtataatatctgtgaactccgtcgatctccgggcggcaagtcatgagcaggccgctgccgccttgaagaacgcgggccaagccgtgactatcgttgcacaatacaggcctgaagagtattctaggtttgaggccaagattcacgatctgcgcgaacagatgatgaattcatctatttcctccgggtccggcagtcttcgcacctcccagaagaggtcgctttacgtccgggccctcttcgattacgacaagacaaaagattctggattgccctctcagggcctgaactttaagttcggggatattttacacgtcattaacgcaagtgacgatgagtggtggcaggccaggcaggtgactcccgacggtgagagcgacgaggtgggcgtcattccctccaaacggcgggtagagaaaaaagagcgtgccagactcaagacggtcaagtttaattcgaaaacccgcgataagggacaaagtttcaatgataagcggaagaaaaatctgtttagcaggaagttccctttctacaaaaacaaggatcaatcagagcaggagaccagcgatgcagaccagcacgttacgtctaatgctagcgatagtgaatcatcctatcggggccaggaagagtacgttcttagctacgaacccgtgaaccaacaagaggtcaactacactaggccagtcataattctcggcccgatgaaagatagaattaatgacgacctgatcagcgaattccccgacaagtttggttcttgcgtgccccacactactaggcccaaacgcgactatgaagtcgacggccgagattatcacttcgtgacctctcgggaacagatggagaaggacattcaggaacacaagtttattgaagccggtcagtataacaatcatttgtatggaacctctgtacagtcagtgagagaagtggccgagaagggaaagcactgtatcctggatgtgtccgggaacgcgattaagcgcctccagatcgcccagctataccctatttccatattcatcaagcccaagtctatggagaatatcatggagatgaataaaagattgactgaggaacaggcccgcaagacattcgagagggccatgaaattagagcaagagttcaccgagcatttcactgcaattgtacagggcgatacgctcgaggacatttacaatcaggtgaaacagatcattgaagaacagtctgggagctatatctgggtccctgccaaagagaagctgtag

SEQ ID NO: 114757 - DNA, 2754 bp, Artificial Sequence
  Description of Artificial Sequence: Synthetic coding sequence
atgcccgtgaggaagcaggacactcaacgagcacttcacctcctggaagagtaccgatcaaaactgtcacagacggaagacagacagctcagaagttctatcgaacgtgtcattaacatattccagtccaacctctttcaggctcttatcgacatccaggaattctatgaagtcaccttgcttgataatcccaagtgtatcgacagatctaagccaagtgagccaatccagcctgttaacacatgggagatatccagcttgccctctagtactgtgacatcagagacgctgccgtcttccctctcaccctccgtcgaaaagtataggtaccaggatgaagacacccccccacaggagcacatctctccacagattacaaacgaagtaatagggcccgaattggtccacgtctccgagaagaatctctctgagatagaaaacgtgcacggatttgtgtcgcatagtcatatcagcccaatcaagccaaccgaggccgtgctgccatccccgccaacagtgcccgtgatccctgtactgcccgttccggctgaaaacactgtgatactgccaactatacctcaggcgaaccctcctcctgtcctggtaaatactgactcgctggaaactccaacctacgtgaatggaacagatgccgattatgagtacgaggaaattactctggaacggggaaattcgggtctgggattctccatcgccgggggaaccgacaacccacacataggcgacgactcttccatttttattactaaaatcatcaccggcggggcggcagcccaagatggtcggctacgtgtgaatgactgcatccttcgggtaaatgaggttgatgtgagggacgtcacgcactccaaggctgttgaagcactaaaagaagccggctcaatcgtcagactgtacgttaagcgccgcaagccagtgtctgagaagatcatggagatcaagctgattaagggtccgaagggattgggatttagcatagcaggaggagttggcaaccagcacatccccggcgacaatagtatttatgtcactaaaataatcgagggtggcgctgcacacaaggatggaaagcttcagattggcgataaacttcttgccgttaacaatgtttgcctcgaggaggttacacatgaagaggcagtcaccgctctgaagaataccagcgatttcgtttacctcaaggtggccaaacctacttctatgtatatgaatgatgggtacgccccacctgatataaccaacagttctagccaaccggtggataaccatgtgagccctagcagtttcctggggcagactcctgctagcccagcccggtactcccccgttagcaaggccgtgttaggcgacgacgagatcaccagagaacctaggaaggtggtgttacatcggggcagcacaggactgggctttaacatcgtgggcggtgaggatggcgaggggattttcatctcttttattttggccggaggtcccgctgatctctctggagaactcaggaaaggcgacagaatcatttcagtcaacagcgtggacttaagagccgctagccacgagcaggcagccgcggcactgaagaacgcaggccaggcagttactatcgtggctcagtatcgtcctgaggagtacagcagatttgaggccaagatccacgatcttagagaacaaatgatgaatagcagcattagttccggctctggctcgctaaggacctcacagaaaagaagcttgtatgtccgagcattgttcgactatgacaaaactaaggatagcgggctgccgagccaaggtctgaacttcaagttcggggatatcctccacgttataaacgcctcagacgatgagtggtggcaagccaggcaggtgacccccgatggggagagcgacgaagtgggggtgataccatctaaaaggcgcgtggagaagaaggagagagcacgactcaaaactgtgaaatttaatagcaaaactcgcgacaagggcgagatccccgatgacatggggagcaagggcctcaagcatgtgacgtccaacgctagtgactcggagagctcctacctcatacttattacggatgagtatggttgctccaaagggagggggcaggaggagtacgtgctgagctacgaacctgtgaaccagcaggaagtgaattatacaaggcccgtcataatcctggggccgatgaaggacagaatcaacgatgatctcatctctgagtttcctgacaagtttggatcctgtgtgccccataccacccgcccgaagcgagactacgaggttgatgggcgcgactatcactttgtcacctcacgcgagcagatggagaaagatatccaggaacataagttcattgaggccgggcaatacaacaaccatctttatggcacttcagtacagagcgtaagggaggtggctgaaaaaggaaaacactgtatcctcgatgttagcggcaacgctattaaacggcttcagattgcacagctttacccaattagtatttttattaaacccaaaagcatggaaaatatcatggaaatgaataagcgactcacagaggagcaagcccggaaaacattcgagagagcgatgaaacttgaacaggagttcaccgagcattttacagctatcgtgcagggtgataccctggaagatatctataatcaggtaaagcagatcatcgaagaacagtccggaagctatatttgggtgcccgccaaggagaagctatag

SEQ ID NO: 114758 - DNA, 2676 bp, Artificial Sequence
  Description of Artificial Sequence: Synthetic coding sequence
atgcccgtgagaaagcaggatacacaacgagctctccacctcttggaagagtacaggtccaagctgagccaaacagaggaccggcagctgcggagctccattgaacgcgttataaacatcttccagagcaatttgttccaagccctgatcgacatccaagaattttatgaggtcactctgctcgacaatcccaaatgcatcgataggtctaaaccgtctgagcccatccagcccgttaacacttgggagatatcttcactgccctcttccaccgtgactagtgaaacactaccctcatcactttctccgagcgtagaaaaatacaggtatcaagacgaagacaccccaccccaagaacatatttctcctcagattacgaatgaggtaattgggcccgagttggtacatgtgtctgagaaaaatctgagcgagattgagaatgtccatggcttcgtgtctcattcgcacatctccccaataaaacccaccgaggccgtcctgcctagtcctcccacagttccggttatcccagtcctcccagtcccagctgagaataccgttatcctgcccactatacctcaggccaacccaccccccgtgctggtgaacaccgatagcttggagaccccgacctacgtaaacggaaccgacgctgactatgaatatgaagaaatcaccctcgaacgcgggaacagcggactagggttctccatcgccggcggtacagataacccccatatcggcgacgatagcagtatctttattaccaagatcataacgggcggcgcagccgcgcaagacggtcggctgcgggtcaacgactgtatcctccgtgtaaacgaggtggacgtgagggatgttactcatagcaaagccgtggaggccttaaaggaagccgggagcatagtacgtctgtatgtgaaaaggcggaaacctgtgtccgaaaagataatggagattaaactgatcaaaggcccgaagggactcggctttagcatcgccggcggtgttggtaaccagcacataccaggggataatagtatctacgtcacaaagattatcgagggaggcgccgctcataaagatggaaaattgcaaatcggtgacaagttacttgcagttaataacgtctgcctggaggaggtcacacacgaggaagcggtgactgcgctgaaaaacactagcgactttgtgtacctgaaggtcgcaaagccaacatcaatgtatatgaatgacggctatgccccacccgacatcactaactcctctagccagcccgttgacaaccacgtgtccccaagcagcttcctcggtcagactcccgcttcaccagcgcggtactctccagtctctaaggccgttctgggagacgacgaaatcacaagagagcccaggaaagtggtgctgcaccgtggtagcacagggctgggcttcaacattgtgggaggagaggacggtgagggaatctttatttctttcattctcgccggtgggccagctgatcttagtggcgagttaagaaaaggcgatcgaatcatctcagtaaattccgttgatctgcgggctgccagccatgagcaagctgccgcagcactcaaaaatgcaggacaagccgtcacgattgttgcccagtatcgccctgaagaatactctcgcttcgaagcaaagattcacgacctcagggaacaaatgatgaactcttctatttccagtgggtccggcagcctgaggactagccagaaacggagtctgtacgtgcgcgccctttttgattatgataaaaccaaagactcaggattacccagtcagggcctgaacttcaagtttggcgatatcctgcatgtgatcaacgccagcgacgacgagtggtggcaagcccgccaggtaaccccagatggcgaatcagatgaagtcggagttataccctccaaaaggcgcgtggagaagaaggaacgcgctcggctgaagaccgttaagtttaactcaaagacgcgggacaagggggaaataccggatgacatgggaagcaagggcctcattggggggcaagaggaatacgtcctctcatacgagcccgtgaatcagcaagaggtgaattacacgagaccggtcattatcctgggccctatgaaagataggatcaacgacgatctgatatccgagtttcctgataagttcgggtcatgcgtgccacacaccacacggcctaaacgagattacgaggttgatggtagggattaccatttcgtcacctccagggaacagatggagaaggacatccaagagcataaatttatcgaagctggtcagtacaataatcatctttatggaaccagtgtccagtcagtaagagaggtcgcagaaaagggcaaacactgtattcttgatgtgagcggcaacgcgattaaaagactacagattgcccagctgtaccccatttccatatttatcaagcctaaatccatggagaatattatggaaatgaacaaaagattaacagaagaacaggcccggaagacttttgaaagggctatgaaactggaacaggagttcacagaacattttacggcaatcgttcagggcgacactctcgaggacatttataaccaagtgaaacagataatcgaagaacaatcagggagttacatctgggtccctgccaaagaaaagctgtag

SEQ ID NO: 114759 - DNA, 627 bp, Artificial Sequence
  Description of Artificial Sequence: Synthetic coding sequence
atgcccgtgcgcaaacaagacacgcagagagccttgcacctcctggaggagtaccgctctaagctcagccagacagaggaccggcagcttcggagctctattgagcgggtgatcaacatcttccagtccaacctgtttcaggccctgattgatatccaagagttttacgaagtcacactgctcgataaccccaagtgcattgaccggtccaaaccgagtgaacctatacagcccgtgaacacctgggaaattagctccctaccctctagcacggtgacgtcagaaaccctgccgagttctttatcaccctctgtcgagaagtaccggtaccaagacgaagacactcccccacaggaacacattagtccacaaatcaccaatgaggtgattggcccagagctcgtccacgtgtccgaaaagaatctctcagagattgagaacgtgcatgggtttgtaagtcacagtcatatctctccgatcaaacccaccgaggctgttttgcctagtcccccgaccgtgcccgtgattcctgtgctgcccgtccctgctgagaatactgtgattttgccaactattccccaagctaaccctcctcctgtcttggtgaatactgatagtttagaatag

SEQ ID NO: 114760 - DNA, 2616 bp, Artificial Sequence
  Description of Artificial Sequence: Synthetic coding sequence
atgcccgtgcgaaagcaggacacacaaagagccctccatctcttagaagagtatcgatccaaattgagtcagaccgaggaccgacagctaaggtcttccatagagcgagttatcaatatctttcagtctaacctattccaggctcttatagacatccaggaattctatgaagttaccctgctcgataaccccaagtgcattgatcggtcaaagccttcggagccaattcaacccgttaatacctgggagatttcctctctcccaagttccaccgtaacgagcgagacactcccatcctctctctctccaagcgtcgagaagtatagatatcaggatgaagacactcccccacaggagcacatttccccccagattactaacgaggtcattgggcctgagctcgtgcacgtgagcgagaagaatctcagtgagatagaaaatgtccacgggttcgtcagccactcacatatcagcccaatcaaagcaaatcctccaccagtgctggttaacacagactccttagagaccccaacgtacgtcaacggtactgacgcagactacgaatatgaggaaatcacccttgaacggggaaacagtgggttaggcttctcgatcgcagggggtacagacaacccacatattggggatgatagttcaatatttatcaccaaaattatcacagggggcgccgcagcccaagacggccgccttcgggtcaacgactgcattctgcgagttaacgaggtggacgtaagggacgtgacccactctaaggccgttgaggccctcaaggaggccgggtcaattgtgagactttatgtcaaaagacggaagccagtgtccgagaagattatggaaataaaacttataaagggaccaaaaggcctgggtttttccattgccggcggcgttggaaaccaacacataccaggcgataacagtatttatgtgaccaaaatcattgaagggggcgcagcacacaaagatggcaaattacagataggcgacaaactactggctgtgaataatgtatgtctggaggaggtgacccatgaggaggccgtgactgctttgaagaacacatccgacttcgtctatctgaaagttgccaagcctaccagtatgtacatgaacgacgggtatgcccctcctgacattacgaacagttcaagtcagcccgtggataatcatgtgagtccaagctcattcttgggacagaccccagctagcccagccagatattccccggtgagtaaagccgtgctaggagatgatgagatcacccgggagcctaggaaagttgtgttacaccgcggttctactgggcttggcttcaacattgtcgggggtgaggacggggagggcatctttatctcctttattctggccgggggaccggctgatctgagcggtgagctcagaaagggcgaccgcatcatctctgttaactcagtggatctccgcgctgcttcacatgaacaagctgcagcagcgctcaagaacgcaggccaggccgtgaccatcgtggcacagtataggccagaggagtattcccgattcgaggctaagatacatgatctgcgcgaacaaatgatgaactcctcgatatcgagcgggagcggtagtttgcgaacaagccagaaaaggtcgttgtacgtacgggccttattcgactacgataaaaccaaggattccggcctgccaagccagggccttaattttaaatttggggacatcctacacgtcatcaatgcttcagacgatgagtggtggcaggcgcgccaagtgaccccagacggagagagcgatgaggtgggagtgatccctagtaaacggcgcgtggagaagaaggaaagagcccggttgaagacagtgaagttcaacagcaaaacccgcgataagggtgagattccagacgacatgggctccaaagggctgaagcatgttactagcaacgctagcgatagcgaatcatcctataggggccaggaagaatacgtgctcagttacgagccggtcaaccagcaggaagtgaattatacaagacctgttatcattctgggacctatgaaagacagaattaacgatgatctgatcagcgagtttcccgacaaatttggcagctgtgttccccatacaactcgccctaaacgcgattatgaggtggacggtagagattaccattttgtaacatcccgtgaacaaatggaaaaagacattcaagaacataaattcattgaggccgggcaatacaataatcacctgtatgggacttccgtgcaatctgtgcgtgaggtggcagagaagggtaaacactgtattctggacgtgtcgggcaatgccattaagcggctgcagatcgctcagctgtatcctatcagcatatttatcaaacccaagtccatggaaaatataatggaaatgaataaacgcctgaccgaggaacaggcgcgcaaaacattcgagcgggccatgaagctggagcaggaatttacagaacactttactgctatagtgcagggggatacattggaagacatttataatcaggtcaaacagattatcgaagagcagagtggcagctacatctgggtccctgctaaagagaagctttag

SEQ ID NO: 114761 - DNA, 321 bp, Artificial Sequence
  Description of Artificial Sequence: Synthetic coding sequence
atgcccgtgaggaaacaggacacacagcgtgcactgcacctcctggaggaatatcggtccaaactttctcagacggaggaccggcaactacgcagtagcattgaaagggttatcaatatttttcagtcaaatctgttccaggccctcattgacatccaggaattttacgaggttacgcttctggacaatcctaagtgcatagaccgatctaagccctcagagccaattcagccagtgaatacctgggaaatcagctcactgccctcaagtacagtaacctctgaaactttaccatccagcctgagccctagtgtggagtag

SEQ ID NO: 114762 - DNA, 1113 bp, Artificial Sequence
  Description of Artificial Sequence: Synthetic coding sequence
atgcctgttcgcaaacaagatacccagcgtgcactgcacttgctcgaagaatacaggtctaaactgagccagacagaagataggcagttgaggtcaagtatcgaacgagtgatcaacatctttcagtcaaatttgttccaggctctgattgacattcaggaattttacgaagtgactttgcttgacaaccccaaatgcatcgaccggagtaaaccctctgaacccatccaaccggtgaacacttgggaaattagctctctacctagcagcacggttacaagcgagaccctgccttcctccttgtctccaagcgtggagaagtatcgataccaggacgaagatactcctccacaggaacatatttctccacagatcacgaacgaggtgattgggcctgagctcgttcatgtttcagagaagaatttaagtgagattgaaaacgttcacggctttgtctcacactctcatatttctccaataaaggtgaacggcacagatgcagattacgagtatgaagagatcaccttggagcgtggcaattctggactggggtttagcatcgccggcgggaccgataatccacatatcggtgatgacagctcgatatttatcactaaaattattactggcggcgcagcagctcaagatggcagactgcgcgtcaacgattgtatcttgcgcgtgaacgaggtggatgtgcgcgacgttactcactctaaagctgtagaagctctcaaggaggccggaagcatcgtgagactctacgtcaagcggagaaaacccgtgtcagaaaaaattatggagatcaagttaataaaaggccctaaaggactgggcttctccatcgccggtggcgttgggaaccagcacataccaggtgataatagcatatacgtcacaaagatcatcgaaggtggcgctgcccataaagacggcaagctacagataggggacaaacttttagcagtcaacaacgtttgcctcgaggaggtgacacatgaagaagctgtgaccgccctcaagaataccagtgatttcgtgtacttaaaagtggctaagccgacttcgatgtatatgaacgatggttacgcaccaccggacatcacgaactag

SEQ ID NO: 114763 - DNA, 2715 bp, Artificial Sequence
  Description of Artificial Sequence: Synthetic coding sequence
atgcctgtcagaaagcaagatacacaacgcgccttacacctccttgaagagtaccggtccaagctctctcaaaccgaggatcggcagcttcggtcctcaattgagcgcgttataaatatcttccagagtaatctgttccaagccctgattgacatccaagaattctacgaggtgaccctattggacaacccaaaatgcatcgatcgctccaaaccttccgaaccgatccaaccagtgaatacctgggaaattagctcactgcccagcagtacagtcacctctgaaactctccctagctccctctccccttcagtggaaaagtaccggtatcaggatgaggatactcctccgcaggaacatatcagcccccagattaccaacgaggtgataggaccagagctcgtgcatgtgtctgaaaagaatctatccgaaatagagaatgtacatggattcgtttcacactctcacatctcacctatcaagcccaccgaagccgttttgccttctccgcccactgtccctgtgatacccgtcctcccagtccccgcggagaacacagtgatcctgccaactatccctcaagcaaatcccccccccgtcttggttaacactgatagtcttgaaacaccaacttatgtgaacggcactgacgccgactatgaatacgaagagatcactttggagcgaggtaacagcggactgggcttctcaatagccggagggactgataatccacatatcggtgacgatagttctatctttattaccaaaataatcactggaggagcagccgctcaggacggtcgtttacgtgtgaacgattgcattcttagggttaatgaggtggatgttcgcgatgttacccactccaaagctgtggaagccctaaaagaagccggctccatcgtgagactgtacgttaagcggagaaagcctgtgtccgaaaaaattatggagattaaactgatcaagggcccaaagggactgggattctctattgcaggaggagtcggtaaccagcacatcccgggagacaacagtatttacgtgactaagatcatcgagggaggagcagcccataaagacggtaagctccaaataggcgataagctgctcgccgtgaacaacgtatgtctggaggaagttacccacgaggaggccgttaccgcactaaaaaacacatcagactttgtatatctaaaggtggccaagccaactagcatgtatatgaatgatgggtacgctcccccagatatcacgaactcaagctcacagcccgttgataaccacgtctcccctagtagcttcctgggtcagacccccgcttcgccggcaagatattcaccggtctctaaggctgtcctcggggacgacgagatcaccagagagccacgcaaggtagtgctccacaggggctcaacaggactgggatttaatattgtcggaggcgaagacggagaaggaattttcatctcctttatactagctggagggcctgctgacctttcaggggaactccggaagggggaccggatcataagtgtgaactctgtcgatctccgcgctgcctcacatgaacaagccgccgctgctctgaagaatgctggtcaggccgtgactatcgtcgcacaataccggccagaggagtattcccggttcgaagctaagatccacgacttacgtgaacagatgatgaatagcagtatctcctctgggtccggatctcttcggacgagccagaaaagatccctgtacgtgcgcgcactttttgattatgacaaaaccaaggattctggactgccatcacagggccttaatttcaaattcggagatatcctccacgtgatcaatgcttcagacgatgaatggtggcaggccagacaagtgaccccagacggagagagcgacgaggtgggagtgattccatcgaaaagacgggtggagaagaaggagagggcacgactgaaaactgtaaagtttaactccaaaaccagagataaaggggagattcccgacgacatggggtctaagggccttaaacacgtgacgagtaacgcaagtgacagcgagtcctcttataggggccaggaggagtacgtcctctcttatgagcctgtaaaccagcaggaggttaattacacacgacccgtaatcatcttggggcctatgaaggatcgcatcaatgacgacctcatctcagaatttccggataaattcggctcttgtgtgccccacacgactagacctaaaagagattacgaagtggatggaagggactaccacttcgtaacatcgagggaacagatggaaaaggatattcaagaacataaattcatcgaggcaggacagtacaacaatcatctgtatggaacttcagttcagagtgtgagggaggtggccgaaaaaggcaaacactgcattctggacgtgtctggcaacgccatcaagaggctgcaaatcgcacaactctaccctattagcatcttcataaaacctaagagcatggagaatataatggagatgaataaacggctgaccgaggagcaggcaagaaagacattcgagcgggcaatgaaactggaacaggagtttacagagcatttcactgccatcgtgcagggggatacactggaggatatttataaccaggtgaaacaaattattgaagaacagtctggctcttacatctgggtgccggccaaggaaaaactctag

SEQ ID NO: 114764 - DNA, 465 bp, Artificial Sequence
  Description of Artificial Sequence: Synthetic coding sequence
atgcctgtgaggaaacaggatactcaaagggctttgcacctgctggaagaatatcgcagcaaactgtctcagacagaagaccgacagcttaggagctcaatcgagagagttataaatattttccagtctaatttattccaggcactcatcgatatccaggagttttacgaggtgacactccttgacaaccccaagtgtatagacagatctaaaccaagcgaaccaattcagcccgtcaacacctgggaaatcagttcgctaccctcttccacagtcacgtctgaaacgctcccttcatcactatcccccagcgtggaaaagtaccgttatcaggacgaggacacacccccacaggagcacatctcgccccagattaccaacgaggttatcggccccgagctcgtgcatgtgagcgagaagaatttgagcgagattgaaaatgtgcatggattcgtgtcacattag

SEQ ID NO: 114765 - DNA, 2562 bp, Artificial Sequence
  Description of Artificial Sequence: Synthetic coding sequence
atgcccgtgcgtaaacaggacacccagagagccctacacctgctggaggaataccggagcaagttgagccagactgaagacaggcaactgagatcctccatagagcgagtcatcaacatcttccagtcgaacttattccaagccctcatcgatatccaggaattttacgaggtgacattactcgacaatcccaagtgcatcgatcggtcaaagccctcagagccgatccaacctgtcaatacatgggaaataagctcgctgccctcttccaccgtgactagtgaaacactgcccagctctctctccccgtccgtggagaagtaccgataccaggacgaagacacacctccacaagaacacatcagtcctcaaattaccaacgaagtcattggcccagagcttgtgcacgtcagcgagaaaaacctgtcagagatcgaaaatgttcatggttttgtctctcatagtcacatttccccaataaaagtgaacggtaccgatgccgattacgagtacgaagaaatcacgttggaacggggaaacagtgggctcggcttctccatcgccgggggcactgacaatcctcacattggagatgattcttcaatcttcattactaagattataaccggcggcgcagcggcacaagacggtagacttcgtgttaacgattgcattctgagagtcaatgaggtagacgtgagggacgtgacacactccaaagcagtggaggccctaaaggaggccggctcgattgtcaggctgtacgtaaagcgccggaaacccgtaagcgaaaagatcatggaaataaagttaatcaaaggtccaaagggcctgggtttctccatcgcaggcggagttgggaaccaacatatcccaggtgacaacagtatctacgtgaccaagattatcgagggcggagctgcgcacaaagatggcaaattgcagattggggacaaactgctggccgtgaacaacgtgtgtcttgaagaagtgacccatgaagaagctgttacggctctgaagaatacctcagactttgtgtacttgaaagtcgctaagccaactagcatgtatatgaacgatggctatgctccgcctgatatcacaaatagttctagtcagcccgtggacaaccacgttagcccttcttcatttctcggacagacaccagcttctcccgctcgatactcccctgtgtccaaggctgtcttgggggacgacgagatcactagggagccccgaaaggtggtccttcaccgtggtagcaccggcctggggttcaacattgtggggggcgaagatggtgaggggatatttatcagctttatccttgctggtgggcccgccgacctgtctggagaacttaggaagggggaccggattattagcgtgaactctgtggacctgagggccgcctcccacgagcaggctgccgcggccctgaagaacgccggccaggctgtgaccatcgtagcccagtaccgccccgaggagtatagcaggttcgaagcaaagatccatgatttacgtgagcagatgatgaactcttcgatatcctccggaagcggctcactgcgaaccagccaaaagcgtagcctgtacgtgagagcccttttcgactacgataaaacaaaggattcaggactaccaagtcagggtctgaacttcaaattcggagacatcctccacgtaatcaacgccagcgatgatgagtggtggcaggctcggcaagtcaccccggatggcgaatctgacgaagtgggagtcattccaagcaaacggagagtggagaaaaaggaacgcgcccggctgaagactgtgaagttcaattctaagacaagagataagggtgagatcccagacgatatgggctctaaaggtcttaaacacgttacttccaatgcgagcgattccgaaagttcttatcggggtcaagaagaatatgtgctgagctatgaacctgtcaaccagcaagaggtcaattatacccgccccgtgatcatcctgggccccatgaaagataggataaacgatgacctcatcagtgaattcccagataagtttggcagctgtgtgcctcataccacacggccaaagcgtgattacgaggttgatggcagggactaccactttgtgacaagcagggagcagatggagaaagatattcaggaacataagttcatagaggcaggccagtataataatcacctgtacgggacatccgttcaaagcgtccgcgaggtagcagagaaggggaagcactgcatactggatgtgtcaggcaatgctattaaaaggctgcaaattgcccagctgtatcctattagtatttttatcaaacctaagagtatggagaacattatggagatgaataagcgtctgacggaggaacaggcccgcaagaccttcgagagagctatgaagctggagcaagagtttaccgagcacttcacggcaatcgtgcaaggggacacactggaggatatttataaccaggttaaacagattatcgaggagcagagtggaagctacatctgggtccccgcaaaggagaagctttag

SEQ ID NO: 114766 - DNA, 111 bp, Artificial Sequence
  Description of Artificial Sequence: Synthetic coding sequence
atgcccgtgcgcaagcaggatacacagagggctctgcatcttctcgaagagtaccgtagcaagctcagccagaccgaagacagacagctgcgcagttcgattgagcgttag

SEQ ID NO: 114767 - DNA, 372 bp, Artificial Sequence
  Description of Artificial Sequence: Synthetic coding sequence
atgccagtacggaagcaggacacacagagagcgctgcatctcctagaggaataccggagtaagttgtctcagactgaggatagacagctgaggtccagtattgagagagtaattaatatcttccagtctaatctattccaggcccttattgacatacaagagttctatgaggtgaccctgctggacaaccctaaatgcattgatcggagcaaaccctcagaacctatccagcccgttaatacgtgggagattagttcactcccatcatcaactgtgacttcagagacactcccgagttcgctgtcccccagtgtggagaaatatagatatcaagatgaagacacaccccctcaagaacacatatcaccttag

SEQ ID NO: 114768 - DNA, 2715 bp, Artificial Sequence
  Description of Artificial Sequence: Synthetic coding sequence
atgcccgtgcgcaagcaggatacgcagcgggccctgcatctgctggaggaatataggtctaaactctcgcaaacagaggaccgccaattaaggtcttcaattgagagggtgatcaacatcttccagagtaacctgttccaggcactcattgacatacaggagttttacgaggtgaccctccttgataaccctaagtgcatcgacaggtcaaaaccctcggaaccgatccagcccgttaacacttgggagatttctagtctgccttcttctacagttacgtccgagaccctgccttctagcctttcaccctctgtcgaaaaataccgttatcaggatgaggacacaccccctcaggagcatatctccccccagatcaccaacgaggttatcggacctgagctcgttcacgtttctgagaaaaacctgagcgagatcgaaaatgtgcacgggtttgtatcccattcccacattagtcccataaagccaaccgaagccgtgctgccaagcccgccaaccgtccctgtgattcctgtcctgcctgtgcccgcggagaatacggtgatccttcccactattccacaagccaatccaccccccgttctcgtcaacacggatagtctcgagacacccacatatgtaaatgggaccgatgcagactatgagtacgaagaaatcactctggaaaggggcaactctggactggggttctccatcgccggtggcaccgataacccccacattggtgacgactcttctatcttcataacaaaaatcattaccggcggtgcagcagcccaagatggccgcctgcgggtcaatgactgtattttgcgggtgaacgaggttgacgtgagagacgtgacccattcaaaggctgtggaagctcttaaggaagccggcagcatagtgcggctgtatgttaaacggcgaaagccagttagcgaaaaaatcatggagattaagctcattaaagggcctaaggggttgggattcagcatcgccgggggcgtggggaaccagcacattccaggcgacaacagtatatacgtcaccaagatcattgagggcggagctgcccataaggacggcaaactgcagatcggagacaagcttcttgctgtgaacaacgtgtgtctagaagaagtaacccacgaagaagccgttactgccctgaaaaatacaagcgattttgtgtatttgaaggtggcaaagccaacgtctatgtacatgaatgatggttacgcaccacctgatattacaaacagctcttctcagcccgtggacaaccatgttagccccagctctttcctcggccagacacccgcatcaccggctaggtattctcccgtgtcaaaagctgtgctcggcgatgatgaaatcacccgcgagccccgtaaagttgtactgcaccgagggtcaaccgggttgggattcaatatcgttggtggggaggacggtgaaggaattttcatctcctttattctagcaggaggacctgcggatttgagcggcgagcttcgcaaaggggataggatcatcagtgtaaattctgtggatctgcgcgcagcctcccacgaacaggccgccgccgccttgaaaaacgccggccaggctgtaacaattgtggcacagtacaggcctgaagaatattcacggtttgaggccaagattcacgacctcagagagcagatgatgaatagtagcatttcctctggcagcggaagcctcaggacaagccagaagcggtctctctacgtgcgagcactctttgactatgataaaacaaaggacagcgggctgccaagccaggggctgaactttaagtttggggacatcctccatgtaattaacgctagcgatgatgaatggtggcaggcaaggcaggtgacacctgatggggaaagcgacgaggtgggcgtgatcccatcaaagcgacgtgtagaaaagaaggagcgggcccgtcttaaaactgttaagttcaactccaagaccagagacaagggggagatcccagatgacatgggaagtaaagggttaaaacatgtcactagcaacgctagcgattctgaatcatcctaccgaggacaggaggagtatgtattatcctacgaacctgttaaccagcaggaggtaaattacaccagacccgtgattattctcggccccatgaaagacagaatcaacgatgatctaatatctgaatttccagacaaattcggctcctgtgtaccacacacaactcggccaaagcgagattacgaagtggatggacgggattaccacttcgttacctcaagagagcagatggaaaaggacattcaggaacataaatttattgaagccggccaatacaataatcacttgtatggaacttctgtacagtctgttagggaggtggccgaaaaggggaagcattgtatcctggacgtctccggcaacgccatcaagcgtttacaaatcgcccagctctacccaatttcgatcttcatcaaacccaagtcaatggaaaacattatggaaatgaacaaacggttgaccgaggagcaggctagaaagaccttcgaaagggctatgaagctggagcaggaatttaccgaacatttcaccgctatagtacagggtgacacccttgaggatatctataaccaggtcaagcagattatcgaagagcagtccggcagctatatttgggtgcccgctaaagaaaagctttag

SEQ ID NO: 114769 - DNA, 2682 bp, Artificial Sequence
  Description of Artificial Sequence: Synthetic coding sequence
atgcctgtcagaaaacaggatacccagcgcgctctccatctgctagaggaataccgatctaagctctcgcaaaccgaagaccgtcagctgcgctcttccatcgaaagagtgataaatatttttcaaagcaacctgttccaggctcttattgatattcaggaattttacgaagttacacttcttgacaaccctaagtgcattgaccgctctaaaccttctgagcctattcagcctgtgaatacctgggagataagttcgcttccctcctccaccgtgacctcagaaactttgcccagctctctcagtccctccgtagaaaagtacagataccaggacgaagataccccaccccaggagcacatttctccccagatcaccaacgaagtcatcggccctgaacttgtgcatgtaagtgaaaaaaatcttagtgagatcgagaacgttcacggattcgtaagtcattcccacatctccccgatcaaagcaaatcccccgccagttttggtaaataccgactccctggagaccccaacttatgtcaatggtaccgacgccgattacgaatacgaggaaataacactggagcgaggtaattctggcctgggatttagcatcgcaggggggactgacaatccccatattggtgatgatagctctatctttattactaaaataatcaccgggggcgcagccgcccaggacggaagattgagggtgaatgactgtattctccgcgtaaatgaggtggacgtcagagacgtgacacattccaaggccgtggaagctctcaaagaggctggctcaattgtaaggctgtacgttaaaaggagaaaacccgtaagtgagaagattatggagattaagctaatcaagggccccaagggcttagggttcagtattgcaggcggagtgggaaatcagcatatacctggtgataattccatctacgttacgaaaatcatcgagggaggcgccgcacacaaagacggaaaactgcagatcggagacaagctgctggccgtgaacaacgtgtgcctcgaagaagtgacacacgaggaggctgtcacggccttaaaaaataccagcgacttcgtttacctcaaggtcgctaagcctacctcgatgtacatgaatgacggttatgcaccacccgatatcacaaacagtagttcacagcccgtggacaatcacgtaagcccaagcagtttccttggtcaaaccccagcaagtcctgcaagatactcacctgtctcaaaggctgtcctcggcgatgatgaaatcactcgcgagcctaggaaggtcgtgctgcaccggggctcaaccggacttggattcaacatcgtgggtggggaggatggggaaggcatctttatttcttttattcttgcaggagggcctgccgacttgtctggcgaactgcggaagggggatagaatcatttctgtgaattcagtggatctgcgcgccgcatcacacgaacaagccgctgcagcattgaaaaatgcggggcaggcagtaaccatcgtggcgcagtacaggcctgaagagtactcccgttttgaagctaaaattcatgatctgcgtgagcagatgatgaatagttcaatttctagcgggtctggctcgctaaggacaagtcaaaaacggtcgttatacgtccgcgctctattcgattatgataaaaccaaggacagcggactgcctagccaggggttaaattttaagtttggcgacattttacacgtgatcaacgccagtgatgatgaatggtggcaagctagacaggtcactccagacggtgagtctgatgaagtgggggtgatccccagcaaacggcgcgtagaaaagaaggaacgagccaggctgaagaccgtgaaattcaatagcaagacacgggataaggggcagtccttcaatgacaaacggaaaaaaaacctattctcaagaaagtttcccttttataagaataaagatcagtccgagcaggagactagtgacgccgaccagcatgtaacttccaacgcgagtgattcagaaagcagctacaggggccaggaggagtacgtcctgtcttacgagcctgttaatcaacaagaagtgaattatactaggcccgtgataatactcgggccgatgaaggaccgcattaatgacgacctcatctcggagtttcccgacaagtttggcagttgtgttcctcataccacccgacccaagcgcgactacgaggttgatggaagggactatcacttcgtcactagcagggagcagatggagaaggacattcaggagcacaagtttatcgaggcaggccaatacaacaaccatttatatggtacgtcagtccaatccgttagggaggtcgcagagaaaggaaaacattgcatcctcgatgtctcaggaaatgctatcaaaaggttacagatcgctcagctgtaccctattagtatctttatcaaacctaagtctatggaaaatatcatggagatgaacaaacggctcacggaggaacaggctaggaagacctttgaacgtgctatgaaattggaacaggagttcacagagcacttcaccgcgatcgtccaaggagatacgctcgaagatatctataaccaggtcaagcagattattgaggaacagagcgggagctatatatgggttccggccaaggagaagctctag

SEQ ID NO: 114770 - DNA, 2730 bp, Artificial Sequence
  Description of Artificial Sequence: Synthetic coding sequence
atgaacgcttatctcacgaagcagcattcatgcagcagggggtcagacgggatggatgcagtcaggtctgcccctactctgatcagagatgcacattgtgcgtgtggttggcaaagaaactgtcagggcctgggatacagttcacagacaatgcccagttccggccccgggggcccagcctccaacagaacaggaggctcctccttcaaccgcaccctctgggactccgtacgcaagtcgccccacaaaaccagtactaaggggaaaggtacatgtggagagcactgcacttgcccacacggatggtttagtccagcccaagcctccccagctcccatcatcgtcaacacggatactctggacaccatcccgtatgtgaacggaactgagatcgaatacgagtttgaggagatcaccctggaacgggggaacagcggactggggttcagcatagctggaggaacagacaatccacatataggcgatgaccccggcatctttatcactaagatcatacctggcggcgctgcagctgaggatggccgccttcgggtgaatgactgtatcctgagggtcaatgaggtcgatgtgtccgaagtcagccacagcaaggccgtggaagccctcaaagaagcgggaagtatagtaaggctatatgtccgacggcgcaggcctatcctggagaccgtggtggagattaagctctttaaaggtccaaagggtctgggcttttcaatcgcgggcggggtaggaaatcagcacattccaggggataattccatttacgtgacaaaaattatagacggcggagctgctcagaaggacggcaggttgcaggtgggggacagactgctcatggtaaataactactctctggaagaggttacccacgaagaggcagtggctatcctaaagaatacctcagaagttgtgtatctcaaagtaggtaagcccaccaccatctatatgactgatccttatggtccccccgacataactcactcctacagcccccccatggaaaaccatttactctcgggcaacaacgggactctcgaatacaaaactagtctgcctcccatttcaccgggcaggtacagcccgattcccaagcatatgctcgttgatgacgattatactcgccccccagaacctgtgtactcaacagtcaacaaactttgtgacaaacctgccagccctcggcactacagtccagttgagtgtgataagagtttcctgctttccgctccatacagccattaccatctggggctcctgcctgattccgagatgacttcacattcccagcattccaccgctacacggcagccctcaatgacccttcagcgtgctgtgagccttgaaggtgaaccaaggaaggtagtcctgcataaaggtagtacaggcctgggatttaatattgtcggaggggaggacggagagggaatcttcgtgagctttatcttagccggcggtcccgcggacctgagcggggagctgcaacgaggggatcagatcttatcagtcaatggcatagatctcagaggagcatcccatgaacaagctgccgccgcgctgaaaggggccggacaaaccgtgaccattatcgcacagtatcaaccggaggactatgccaggtttgaagccaaaattcacgaccttagggaacagatgatgaatcattccatgtctagcggttccggctcattgagaaccaaccagaagaggtctctgtatgtgcgagctatgttcgactacgacaaatcgaaagacagcggtctgccctctcaggggctgtccttcaagtacggagacatcctgcacgtgatcaatgcctcagatgacgagtggtggcaggctcgaagagtgatgctggagggggacagcgaggagatgggtgtaatccctagtaagaggcgggttgagcgcaaggagcgagccagacttaagaccgtgaagttcaacgcaaaaccgggcgttatagacagcaaaggtagctttaatgataagcgcaagaaaagttttatttttagtcgtaagttccccttctacaagaacaaagagcagagcgagcaggaaacctcagacccagagagagggcaagaggacctgatactgtcgtacgaacctgtgaccaggcaggaaataaattacactaggcccgtgataatcctggggccgatgaaagatcgcattaatgatgatcttatttccgagttcccggataagtttggatcgtgtgttcctcataccacaaggccaaagcgggactacgaagtggacgggcgagactatcactttgttatttctcgggaacagatggaaaaagacattcaggagcacaaatttatagaggccggacagtataacgacaacctgtacggcacaagtgttcagagcgtacggtttgtggcggaacgcggtaaacactgcatactggacgtgtccggcaacgcaattaagagattacaggtagctcagttatatcctattgccatttttatcaaaccccggtcactcgaaccactgatggaaatgaacaagcgtctgacagaggaacaggccaaaaagacatatgacagggccataaagctcgaacaagaatttggcgaatatttcaccgctatcgtgcagggggacactctggaggacatttacaatcagtgtaaactggtgattgaggaacaaagtggtccctttatatggatcccgtcaaaggagaaactatag

SEQ ID NO: 114771 - DNA, 2376 bp, Artificial Sequence
  Description of Artificial Sequence: Synthetic coding sequence
atgcaacacgcttttatccctgcgtcgcctgcgcctattatcgtgaatactgacacactggacacaatcccttatgtgaatggaacggaaatcgagtatgagtttgaggagataaccctcgagcgcgggaattccggacttggattctccatcgcaggcggcacagacaacccgcacattggcgacgacccaggaattttcatcaccaaaattatcccaggaggggctgccgccgaagatgggagactccgggttaatgactgcatcttacgcgtaaatgaggtggatgtctccgaggtgtcacactccaaagcagtggaggccttgaaagaagccggctctatcgttagactatacgtccgacgccggcgtccgattctcgagaccgttgttgagataaaactgtttaagggaccaaagggactcggtttcagcatcgcaggaggcgtgggcaatcaacacatcccgggggacaactcaatctacgtgacaaagatcatcgatggtggcgctgcccagaaggatggccgcttgcaggtgggggatagactgttaatggtcaacaattactctctcgaggaggtgacccacgaggaagcggtcgcgatcctgaaaaatacaagcgaggttgtgtatctgaaggtgggcaagcctactactatatacatgacggacccatacggccctccagacattactcacagctattccccgcccatggaaaatcatctgttgagcggtaacaacggtacgttagagtacaagaccagcctgccaccaatctctccagggcggtactcccctattccaaaacacatgcttgttgatgatgattacaccagacctcctgagcccgtatactctaccgtcaacaaactatgcgacaaacccgcatcaccgcgtcattacagcccagtagagtgcgacaagagctttctcctctcggcaccctattcccactaccacctggggctcctgccagacagtgagatgacttcacatagccagcacagtactgctacacgccagccttcaatgacactgcagcgcgcagtgtctttggaaggcgagcctagaaaggtggtcctgcataagggaagcacaggtttggggtttaacattgtcggcggagaggatggtgaaggcatcttcgtgtccttcattctggcaggaggccctgcagacctctcaggagaactgcagagaggtgaccagatcctgtccgttaacggcatcgacctgcgcggagcctcccatgagcaggcagcagccgctctcaagggagcaggacagaccgttaccataatagcccagtaccaaccggaagactacgcccggttcgaggccaagattcatgatttaagggagcagatgatgaaccacagcatgtctagcggcagcggcagcctgagaacaaatcagaaacgctccctgtacgtgcgggctatgtttgattatgacaagtcaaaagatagtgggttaccctcacagggcctctcgttcaagtatggggacatcctgcatgtgataaatgccagcgacgatgagtggtggcaggccagaagagtgatgctcgaaggcgattctgaagaaatgggcgttatccctagcaaacgcagagtcgagaggaaagaaagagcaaggctgaagaccgtgaagttcaacgcgaagccaggcgtaattgattctaagggagacatccccggtcttggggatgatggatatggcactaaaacgttgagggggcaagaagaccttatccttagttacgagcccgtgacccggcaggagattaactacactagaccggtgattattttgggccctatgaaagacagaatcaatgatgatctgatcagcgagttccccgataaatttgggagctgtgtgccacacactactagaccaaaacgggactatgaggtcgacgggagggattatcattttgtgatctcccgggaacagatggaaaaagacatacaggagcacaaatttattgaggcgggccagtacaatgataacctctatgggaccagcgtgcagagcgtgagattcgtggctgaaaggggcaaacactgcatcctagacgttagcggcaatgcaatcaagaggctccaggtagcgcagctgtatcctattgccattttcatcaagcccagaagtttggagccccttatggagatgaataagagactcaccgaagagcaggctaaaaaaacgtatgacagggccatcaagcttgagcaggagtttggtgagtatttcactgccatcgttcagggtgatacactagaagatatctataatcagtgcaagctggtgatcgaggagcaatccggcccattcatctggatcccatctaaagaaaagctatag

SEQ ID NO: 114772 - DNA, 2928 bp, Artificial Sequence
  Description of Artificial Sequence: Synthetic coding sequence
atgggtatctttaagagcagtctctttcaggcccttctcgatatccaagaattttacgaggtgacattgcttaacagccagaaatcctgcgaacaaaagatagaggaggctaaccaggtcctgcagaaatgggagaaaacgtccctgctggcgccgtgtcatgaccgcttgcaaaagtctagtgaactgactgattgttctggctcaaaggaaaacgcatcttgcatcgaacaaaataaggagaaccaatcgttcgagaatgagactgacgaaaccacaacacagaaccagggccgctgccccgcccagaattgctcagttgaggctccagcctggatgccagtgcatcactgcacaaagtaccgataccaggatgaggatgctccacatgatcacagcttgccaagactgactcatgaggtcagagggccagagctcgtccacgtgtcagagaagaaccttagccagattgagaacgtgcatggatacgtgctccagagccacatttctccccttaaggcaagcccagctccaatcatcgtcaacacagacacactcgacacaattccttatgtcaatgggactgagattgagtacgaatttgaggaaatcacacttgagcggggaaatagcggactggggttttctattgccgggggcacagataatccacatatcggagacgaccctggcatcttcatcaccaaaattataccgggcggcgctgctgcagaagacggaaggctccgcgtgaatgactgcattctgcgcgtgaacgaggttgacgtgtccgaggtgtcacactcaaaggctgttgaagcattgaaggaggcaggaagtatagtgaggctgtatgtgcgtcgacgcagacctatcttggaaacggtggtagagatcaagctgttcaagggacctaagggccttggcttctccattgccgggggcgtcgggaatcaacatataccaggtgataattctatttacgtaaccaagatcatcgacggaggggccgcgcagaaggacggacggctgcaggtaggtgatagactcctcatggtaaacaattattcactagaggaggttacccacgaagaggccgtcgctattctgaagaatactagtgaggtagtttacctgaaggttgggaagcctacaaccatttacatgacagatccctacggcccaccggatattacccatagctattcacctccgatggagaatcatctcctctcagggaataacggaacactggagtataaaacaagtctgccccctattagtcccggccggtactccccaattccaaagcatatgctggttgacgacgactacacacgacctcccgagcccgtctacagtacagtcaataagctgtgtgataaacctgccagccccaggcattacagcccggtggaatgtgacaaaagctttcttctaagcgctccttattctcattatcaccttgggttgctgcccgattcagagatgacaagccactcacaacactccacagctacaagacaaccatctatgacattacaacgagctgtgagtctggaaggagagcctagaaaagtcgttttgcacaaaggtagcactgggctcgggtttaacattgtcgggggagaggacggcgaaggcattttcgtgtcgttcattctggccggcggccctgctgatctcagtggcgaattgcagcggggcgatcaaatcttatcagttaatggcattgatctgcgaggggcatcacatgagcaagctgctgccgcactgaaaggagcaggacaaaccgtaacaataattgcccagtatcagcccgaggactatgccaggttcgaggccaaaattcatgatttacgggagcagatgatgaatcactccatgtcgtcagggtcaggctccctcagaactaaccagaaaaggtccctgtacgtgagggcgatgtttgactatgacaagtccaaggatagtggtttgccgagccagggcctaagcttcaagtacggcgacattcttcatgttattaacgctagcgatgatgagtggtggcaggctagacgggtaatgctcgaaggcgactcggaggagatgggcgtgatacccagcaagcgtcgggtggagcgcaaggagcgggcccggctcaaaaccgtgaagtttaatgcaaagcccggcgtgattgattctaaaggaagctttaatgataaaagaaagaagagctttatcttttcaaggaagttcccgttttacaaaaacaaggaacagagcgagcaagagacaagcgaccctgaacgtggtcaggaggatcttatcctttcctatgagccagtgactcgtcaggagattaactacacacggccagtgattattctggggccgatgaaagaccggattaatgatgacctgatttccgaatttcccgataaatttggcagttgcgtcccacataccacccggcccaagcgtgattatgaagtggacggtcgggattaccactttgtcataagccgcgaacaaatggaaaaagacatacaggagcataagttcattgaggccggccaatacaatgataacctgtacggcacttcggttcagtctgtaagatttgtggccgaaagaggtaagcattgtatcctcgatgtgtcaggaaatgccataaaacgcttgcaggtcgcccaactgtatcccatcgcaattttcatcaaaccgcggtccctagagcctcttatggaaatgaacaagaggctaaccgaagaacaggcgaaaaaaacctacgatagggcaattaaattggagcaggaatttggagagtacttcaccgccatcgtgcaaggggatacgctagaggatatatacaaccagtgcaaactggtaatcgaggagcaatccggccccttcatatggattccctcaaaggagaaactctag

SEQ ID NO: 114773 - DNA, 1005 bp, Artificial Sequence
  Description of Artificial Sequence: Synthetic coding sequence
atgatgaatcatagtatgagttctggctccggtagcttgcgaacaaaccaaaaaaggagcctctatgtcagagcaatgttcgattatgataagtcaaaagactccggacttccatcccaaggtctgagcttcaaatatggggacattctgcatgtgatcaatgcctcggacgacgagtggtggcaagctcgtagggttatgctggagggtgactccgaagagatgggtgttattcctagcaaaagaagagtagagcggaaggagcgcgcccggctaaagactgtgaaattcaatgcaaaacctggggtgattgattcaaagggtgatatcccaggcctcggcgatgacggatatgggaccaagacactgcgtgggcaggaggacttgatactaagttatgaaccagttacacggcaggagattaattacaccaggcccgtgatcatcttgggccccatgaaagaccggatcaacgacgatctcataagcgagtttccggacaagttcggaagctgcgtcccccacaccacacgccccaaacgagattacgaagttgatggtcgcgactaccacttcgtgatttcaagagagcaaatggagaaggatatccaggagcacaaattcatcgaagccgggcaatacaatgacaatctgtatgggacgagcgtccagagcgtgcggttcgtggccgaaaggggcaaacattgtatcctcgatgtcagcggcaatgccatcaaacggctccaggtagctcagctctacccgatcgccatcttcatcaagccaagaagcctcgaaccactcatggagatgaataagcggctgacggaggaacaggctaagaagacctacgaccgcgccataaagctggagcaagaattcggagaatattttacagccattgtccaaggcgacacactcgaggatatatacaatcagtgcaagttagtcattgaggagcagtctggcccatttatctggataccctccaaggaaaaactgtag

SEQ ID NO: 114774 - DNA, 2613 bp, Artificial Sequence
  Description of Artificial Sequence: Synthetic coding sequence
atgttcttcgcttgttattgtgcgcttcgcactaacgtgaaaaaataccgataccaagacgaggacgcaccacatgatcattccttgcctcgtctgacccatgaggtcagagggcctgaactcgtacacgtaagcgagaaaaacctgtcccagattgagaatgtgcacggatacgttttgcagtctcacatatctcccctgaaagccagtcccgcacccatcatcgtgaatactgacaccctggacacgattccatacgtcaacggaaccgagatagagtacgagtttgaagaaataactctagagagagggaattctggactgggattctcaatagcaggcggaacagacaacccccatatcggagatgacccgggcatattcataaccaagattatccccggaggtgctgccgccgaagacggacgcctgagggtaaatgactgcattctgcgggtgaatgaagtcgacgtctcagaagtttctcactccaaagcagtggaggccttaaaagaagccggctcaattgtgagactgtatgtaagacgacggagaccgatcctggagacagtcgtagaaatcaaactttttaagggccccaaagggctgggcttctccatagccggcggggtgggtaatcagcatatcccaggcgacaattccatttatgtaaccaaaattattgatggcggagcagcacagaaggatggaagacttcaggtgggtgaccggctgctcatggtgaataactattcactagaggaggtgacccacgaagaggctgtagcgatcctcaagaatacatctgaggtcgtgtatctaaaagttggaaagcctaccacaatctatatgacagatccctacggccccccagacatcacacactcctattccccccccatggagaatcatcttctctcaggaaataatggaacactcgagtacaaaacaagcctgcctccaatatcccctggtcggtactcaccaattcctaaacacatgctggttgatgatgattacacacggccacccgagccagtctatagcactgtaaataagctctgtgataagccagcatctccccggcactactctcctgtggagtgtgataaatcttttcttctgagcgccccatacagccactaccacctcggcctgcttcccgactctgagatgacctctcactcacaacacagcaccgccactagacaaccttcgatgactttgcagagagcggtttccttagaaggcgagccccgaaaggtggttcttcataagggttctaccgggctcggattcaacatcgtaggtggagaggacggcgagggcattttcgtgtccttcatcctggcaggaggacccgctgacctttccggagagttgcaacgtggcgaccaaatcttgtctgtaaacggaatcgatctcaggggcgcatctcatgagcaagctgcagcagcactgaagggagcggggcagactgtgaccattatcgctcaataccagcctgaagactacgcccgtttcgaagcgaaaatccatgatttaagagaacagatgatgaaccacagcatgtcatctggaagtggctcgctgcgaactaaccagaaaagatcactgtatgtgagggccatgttcgattacgacaagtccaaagacagtggacttccatcccaaggcctgtcgtttaagtatggcgatatcctgcacgtgatcaacgcatccgacgatgaatggtggcaagcacgtcgcgtcatgcttgagggtgatagcgaggaaatgggggtgatcccaagcaaaagacgggtggagcgtaaggaacgcgctagattgaaaacggtgaagtttaacgccaagcctggggtcattgatagtaagggtagttttaatgataaacgcaaaaaatcattcatcttcagtcggaagtttcctttttacaagaacaaggaacagagcgagcaggagacatctgaccctgagcggggccaggaagacctgattctatcctacgagcccgtgaccaggcaggagatcaattatacaaggcccgtgattatcctcgggcccatgaaagaccgcataaacgacgatttaatttccgagttccctgataagttcggctcgtgtgtcccccatacgacacggccaaaacgggattacgaggtggacgggagggactaccacttcgttataagcagagagcagatggagaaggatatccaagagcacaaattcatcgaagctggacagtacaatgataacctgtacgggacctccgtccaatccgtgcggtttgtggcagagagagggaagcattgcatcctcgatgtgagcggcaacgccattaaacggctacaggtggcgcaattgtacccaatcgcaattttcataaaacctagatcgctggaaccgttgatggaaatgaataaacggctaaccgaggaacaggctaaaaagacgtacgatcgggctatcaaacttgagcaggagtttggcgaatattttactgccattgtacaaggagacactctggaggacatttacaaccaatgcaagctggtcatcgaagaacagagtgggccttttatctggatcccgtcgaaggaaaagttatag

SEQ ID NO: 114775 - DNA, 1047 bp, Artificial Sequence
  Description of Artificial Sequence: Synthetic coding sequence
atgatgaaccactcaatgtcatccggcagcggctctctgcggacaaaccagaagcgcagtttgtacgtcagagcgatgtttgactacgacaaatcaaaggacagcggattgccgagtcagggactttcttttaagtatggagacattctgcatgtgattaacgcctctgatgatgaatggtggcaggcccggagggtgatgctggagggagactcagaagagatgggagtgatcccatctaaacgtcgagtggagaggaaggagcgtgcacggctcaaaacagtaaagttcaatgccaaacccggggtgattgacagtaagggcgatatccccgggctgggagacgacggctacggaacaaaaacgctaaaacatgtgtcctccaacgctagcgattcagagagtagttataggggccaggaagaccttatcctgtcctatgagcctgtcactcggcaggaaatcaattatacgagacccgtcatcatactcggccccatgaaggacagaattaatgacgatttgataagtgagtttcccgataaattcggatcatgcgtgccacacacaactcggcccaaacgggactacgaggtggacggccgcgactaccactttgtcatttcaagagaacagatggaaaaagacattcaggaacacaaattcatagaggccggtcaatataacgacaacctgtatggcacctcggtgcaatccgtgagattcgtggccgagagggggaaacattgcattctcgatgtctctggcaatgccattaagcgtctgcaagttgcccagttataccccatcgctattttcataaagccccgcagcctcgaacccctgatggaaatgaacaaaagactgactgaagaacaggctaagaaaacctatgatagggcgattaaattggaacaagagttcggagaatatttcactgccattgtccaaggggatacactagaagacatctacaaccagtgcaagttggtaattgaagagcaatccggccccttcatctggatcccctccaaggagaagctgtag

SEQ ID NO: 114776 - DNA, 2250 bp, Artificial Sequence
  Description of Artificial Sequence: Synthetic coding sequence
atgcaaagacccagcgtgtcaagagcggaaaattatcagctgctatgggacacgatcgcctcactgaaacaatgtgagcaagctatgcagcacgcatttattcctgtcaacggtactgaaattgagtatgagttcgaagagatcactctggagagaggcaactccggattgggtttctccatagccggcgggacggacaatcctcatatcggcgacgaccccggaatatttatcaccaaaattatacctggcggcgcagctgctgaagatgggcggctcagagtgaatgactgtattctgcgcgtcaatgaggtggatgtgtcagaggtcagtcactccaaggccgttgaagccctgaaagaggccgggtccattgtccgtctgtatgttaggcgcaggaggcccatcttagagactgtggttgagataaaattattcaagggccccaagggcctcggcttctcaatcgcagggggcgttggtaaccagcacatcccaggcgacaattctatttacgttacgaagataatagatggaggtgcagcccaaaaggacggtagacttcaggttggcgataggctgctgatggtgaacaactactccttggaggaagttacgcatgaggaggcggtggctatcctaaagaacacttcagaagttgtgtacttaaaggtcggcaaaccaacaaccatttacatgactgacccttacggccctcccgatatcacccattcttattctccacctatggagaaccacctcttgagcgggaataacggaaccctggagtacaaaactagtttacctcccatctcgccagggcgatattccccgattcccaaacatatgttagtagacgatgattatactagccattctcagcacagcacagccacgaggcagccttctatgaccttacagagagcagtgtccttggagggcgaacccaggaaagtcgtgctgcacaaggggagcaccggactgggcttcaacatcgtcggcggggaggatggcgagggtatttttgtgtctttcattctcgctggggggcctgccgatctctccggagaattgcaacggggggatcagatcctgagcgtcaacggcattgatctacgcggcgcctcccatgaacaggcagccgcggcacttaaaggtgcggggcaaacagtgacaattatcgcccaataccaaccggaagactacgcccgattcgaagcaaagatccacgaccttcgcgagcaaatgatgaatcactccatgtcatctggaagtggatcactcaggacaaatcagaagaggtctctgtatgtacgcgcaatgttcgattacgacaagtcaaaggacagcggtcttccttctcaaggcttaagttttaagtacggcgacattctgcacgtcataaacgcttccgatgacgaatggtggcaggctaggcgggttatgctagaaggtgacagcgaagagatgggcgtgatcccctccaagagacgtgtggagcgaaaggaacgagctaggctcaagactgttaagtttaatgctaagcccggagtcatcgactctaaaggcgacatacccgggctcggtgatgatggctacggaaccaagacactgagagggcaggaggacctgattttgtcttacgagccagtgaccagacaggaaatcaattacaccagaccggtgattattttgggacccatgaaagatagaatcaacgacgatctcatttctgaatttcccgacaaatttggttcctgtgtcccgcacacaactaggcccaaaagagactatgaggtggacggacgggattatcacttcgtcatttctcgtgagcagatggaaaaagacattcaggagcacaagttcatcgaggctggccagtacaacgataacctttacggtacttctgttcagagtgtacggttcgtggccgaaaggggaaagcattgtatcctggatgtgtctggaaacgctataaaaagactccaagtggcacagctttacccaatcgccatctttatcaagccaagaagcctagagcccctcatggaaatgaataagaggctgactgaggagcaggctaagaaaacatatgaccgggctattaaactggaacaagaattcggcgagtactttaccgcgattgtgcagggcgatacactggaggacatctacaatcagtgcaagctggttatcgaggagcagtccggccccttcatttggattccttctaaagagaagctctag

SEQ ID NO: 114777 - DNA, 1005 bp, Artificial Sequence
  Description of Artificial Sequence: Synthetic coding sequence
atgatgaaccactctatgtcctcagggtccggcagcctcaggaccaaccagaagcggtctctctatgtgcgggcaatgttcgactacgacaaaagcaaggacagcggtctcccgagtcagggcctttcgtttaagtacggagacatcctccatgttatcaatgcctccgatgacgaatggtggcaggcccgcagggtaatgcttgagggagattctgaagagatgggcgttatccctagcaaaagaagagtggagcgcaaggaacgcgcccgactaaaaactgtgaagtttaatgccaagcctggagtgatcgattcaaagggcgacatacccggtcttggggacgacggatacggcaccaaaactctccggggtcaggaagacttgatattgagttatgaacctgttacgaggcaggagataaactacacacgacccgtgataatattaggtccaatgaaagaccggatcaacgacgacctgatcagcgaattcccggacaaattcggatcatgcgtcccccacactacccgccctaaacgcgactatgaagttgacggtagagactaccacttcgtcatctccagagagcagatggagaaggacatacaggagcacaaattcattgaagcagggcagtacaatgacaacctgtatggtacctcagtgcagtctgttcggttcgtggctgaacgcggcaagcattgcattttggatgtgtctggaaacgccattaagcgtctccaggtagcccagctgtaccccattgccatttttattaagcctcggtcgttagaaccattgatggaaatgaataagcggctcactgaggagcaggccaagaagacctacgacagagccataaagcttgagcaggagtttggtgaatacttcacagccatcgttcagggagatactctggaggacatttacaaccagtgcaaactggtaattgaagaacagtcaggcccattcatatggataccttctaaggaaaagttgtag

SEQ ID NO: 114778 - DNA, 2601 bp, Artificial Sequence
  Description of Artificial Sequence: Synthetic coding sequence
atgttcttcgcctgttactgcgccctgagaactaacgtgaaaaagtaccggtatcaggatgaggacgcccctcatgaccactccttgccccggttaacccatgaagtgcggggcccagagctggtgcacgtgagtgaaaagaacctttctcagattgagaacgtccatggctatgtgctccagagtcatataagccccctgaaagcaagccctgcccccatcatcgtaaacacagatactctcgatacgattccatatgttaatggcactgagatcgagtatgagttcgaagaaattaccctggaacggggcaactccgggttgggcttctcaatcgcaggtggaactgataatcctcatattggagatgacccaggaatcttcattacaaaaatcattcctggaggcgccgctgcggaagatgggagactgcgagtgaacgattgcatattgcgcgtcaatgaggtagatgtgtccgaagtgagccacagtaaggccgtggaagctttgaaggaagctggtagcatcgtgcgcctatatgtgagacggcgacggcctattctcgagaccgtggtagaaatcaagttgtttaaaggacccaaagggctgggctttagtatcgcaggcggggtcggtaatcaacacattcctggcgataactcaatatatgtgacaaaaataatagatggaggggccgcacagaaagatgggcgtcttcaggtgggggatcggctgctcatggtcaacaactactccctcgaggaggtcactcacgaagaagctgttgcaattctaaagaacacttccgaggtcgtgtacttgaaagtgggaaagccaacgaccatctatatgaccgacccatatggaccgccggatattacacacagttacagtcctcccatggagaatcacttgctcagtggcaataatggaacactggagtataaaactagcctcccacctatttctcctggcagatactcgcccatccccaagcatatgctggtggacgatgattatactcggccacccgaacctgtgtattcgaccgtgaataaactgtgcgataaaccagcatcgcctagacactactcccctgtcgaatgtgataaatccttcttgctgtctgctccctactcccattaccacctcggtctgctgcctgacagcgagatgacctcccacagccagcactccactgccaccaggcagccatctatgacccttcagcgtgctgtgagtctagagggtgagccccgtaaggtggtgttgcacaagggatccactggcttggggtttaatatagtagggggggaggatggtgagggtatttttgtgagcttcattttggccggtggccccgccgacctgagcggtgagctacagcggggcgaccagattctatcggttaatggaatcgaccttcgaggagctagtcacgaacaggcagcagccgccctgaagggagccggtcagaccgtgactattattgcacagtatcaaccagaggactatgctagatttgaggctaagatccacgatctccgcgagcaaatgatgaaccactccatgagcagtggctccggtagcctaaggacgaaccagaaacgcagcctgtacgtacgcgccatgttcgattatgataaatccaaagactcaggcctgccttcacagggtctgtcctttaaatacggcgatattctgcatgtgataaatgcgagcgacgatgaatggtggcaagcaagaagggtgatgcttgagggcgacagtgaagaaatgggcgtgatacctagcaaacgtcgtgtcgagcggaaggaacgcgcccggctgaagacagtgaagtttaacgccaaaccaggtgtaattgacagcaagggcgacattcctggcctgggcgacgacgggtacggcacaaagactctcaagcacgtgagcagtaatgcctccgacagcgagagcagctatcgcggccaggaagatcttatattatcttatgaacctgttacccgccaggaaattaattatacgcggcctgtgatcattcttgggcccatgaaagatagaatcaatgacgaccttatctcagaatttccagataagtttgggtcctgcgtaccccacacgacacgtcctaagcgcgactatgaagtggacgggagggattatcacttcgtaattagccgtgaacaaatggagaaggatattcaggaacataaattcatcgaagctggccagtacaatgacaatctgtacggtaccagtgtgcaatcagtgcgctttgtggcagaacgcggcaaacactgcatacttgacgtaagcggcaatgccatcaagcgacttcaggtggctcagctgtaccctattgccatttttatcaaaccccgctccctagaacctctgatggagatgaataaaaggctgactgaagagcaggcaaagaagacgtatgacagagccataaaattagagcaagagttcggggaatattttacagctatagttcagggcgacacgctggaggacatttataatcagtgtaaacttgtcatcgaagaacagtctggaccctttatatggattccgtctaaagaaaagctttag

SEQ ID NO: 114779 - DNA, 285 bp, Artificial Sequence
  Description of Artificial Sequence: Synthetic coding sequence
atgatgaatcactctatgtcgagcgggagcggatccctgagaacaaatcagaagcgttccctgtatgttcgagcgatgtttgactacgataagtcaaaagacagcggcttgcctagtcaggggctaagttttaagtacggggatattctgcacgtcataaatgcttcagatgacgagtggtggcaggcccgtcgagtcatgctcgaaggtgatagcgaggagatgggggtgataccgagcaaacgccgagtagaaaggaaggagcgagcccgactaaaaacttag

SEQ ID NO: 114780 - DNA, 2559 bp, Artificial Sequence
  Description of Artificial Sequence: Synthetic coding sequence
atgttcttcgcgtgctactgcgcactccggaccaacgtgaagaagtacaggtaccaggatgaggatgcgccacatgaccactcccttccccgcttgacccacgaagtgcgggggccagaactggtccacgtctcggagaaaaatctctctcagattgagaacgtgcatggatatgttctacagtcacacatcagccctttaaaggcgtcccctgccccgataattgtcaatacagacacattggacacgataccctatgtcaatggaaccgagattgagtacgagtttgaggaaatcaccctcgaacgagggaattcaggactgggatttagcatagcgggaggcactgataatccacatattggggatgatccaggcatatttatcactaaaatcataccgggcggagcggctgcggaggatggacggttgagagtaaatgactgcatcttgagggtcaatgaggtggacgtctctgaggtgtcgcactcgaaagccgtcgaagctctgaaagaagctgggtccatagtccgcctgtacgtgcgtcgccggagacccattcttgaaactgtggttgagataaagctcttcaaaggtcccaagggcctcgggttttcaatagctggaggggtgggcaaccagcacatccccggcgataactccatttatgtgaccaagatcattgacgggggcgcagctcagaaagatgggcgccttcaggtaggagataggttactgatggttaacaattactcactcgaagaggttactcatgaggaggcagtagctatccttaagaacactagcgaagtcgtgtacctaaaggtcggtaagcctaccactatctacatgactgacccttatgggccccccgacatcacacatagttattccccgccaatggagaatcacctcctcagcggcaataacgggacactggagtataagacttccctgccccccattagcccaggacgttactcccctatccctaagcatatgcttgtggacgacgactacacaaggccaccagagcccgtttacagcacggtaaacaagctgtgtgacaagccagcttccccccgacactactcccccgttgaatgcgataagagctttctgctaagcgccccgtactctcactatcacctggggttgctccctgactccgagatgacctcccattcccagcactcaacggccaccagacaacccagcatgacactccagcgagcagtgtccctagaaggcgagcccagaaaagttgtcctccacaaaggctccaccggcctaggcttcaacattgtggggggcgaggatggagaagggatattcgtcagctttattcttgcgggaggcccagctgacctcagcggagagctccaacgtggggaccagattctgagtgttaacggaatagatctgcgcggcgcatcccacgagcaggccgcagctgcgttgaagggcgcgggacaaaccgtgaccattattgcccagtaccagcctgaggattacgccagattcgaggcgaagattcacgatttgagggagcaaatgatgaaccattccatgtcatctggctccggaagtctgcggacaaatcagaagaggagtttgtatgtgcgcgccatgttcgactacgataagagcaaagattccggtttgccatctcaaggcttatctttcaagtacggcgatatcctccacgtgatcaatgccagtgacgacgaatggtggcaggccaggagagttatgctggaaggagacagtgaagaaatgggggtaattccaagtaagagaagagtcgaacgaaaagaacgtgcaaggctgaaaaccgtgaaatttaatgctaagcctggcgttatcgacagcaagggggatattccgggtttaggcgacgacgggtatggaacaaagacactgaggggccaagaagatcttatccttagttacgagcctgtgacaagacaggagattaactacacaaggccagtcattattctgggccctatgaaagacaggatcaacgatgatctaatcagcgagttccccgataagttcgggtcctgcgtgcctcatactacgagaccaaagagagactacgaagtcgatggacgcgactaccactttgtcatcagcagagagcagatggaaaaggacattcaggaacataagttcattgaagcagggcaatataacgacaacctttacggcacatccgtccagagcgtgcgttttgtggcggagcgcgggaagcattgtattttggatgtcagtggcaacgctatcaaacgtctgcaggtggcgcagctgtaccctatcgccatcttcattaaacctcgctcccttgaacccctcatggaaatgaacaaacgccttactgaagaacaggccaaaaaaacttatgacagggctattaaactggaacaggaattcggggagtatttcacagcaatagtgcagggcgacaccctggaagacatttataatcagtgtaaactcgttattgaagagcaaagcggtccttttatctggatccctagcaaggaaaagctttag

SEQ ID NO: 114781 - DNA, 1863 bp, Artificial Sequence
  Description of Artificial Sequence: Synthetic coding sequence
atggtgaacaactatagcctggaagaggtgacccatgaggaggcagtggccatcctgaaaaacactagtgaagttgtttatctgaaagtgggaaaacccaccacaatatacatgaccgacccttacggtccccccgacatcactcactcctacagtccaccgatggaaaatcacctgctgtcaggtaataacgggacgctcgagtacaaaacatccctgcctcccatcagcccgggaaggtattcacccatccctaagcacatgctggtcgatgacgattatacccggcctccagaacccgtgtacagtaccgtgaacaaactctgtgacaagccagcatcaccaaggcactactcccctgttgagtgtgacaagtcctttcttctgtctgccccatattcccactaccacctgggacttctgcctgactctgaaatgacatcccatagtcagcatagcacagcaactaggcagccctccatgacgctccagagggctgtctccctggagggggaaccccgtaaagtcgtattacacaagggatcgactgggttgggattcaacatagtgggaggggaggatggggagggaatttttgtttcctttatacttgccggcggtcccgctgacctgagtggcgagctgcagagaggggatcagatacttagcgttaatggcatagatctacggggggcctcccatgagcaggccgccgccgccctcaagggtgccggacagacggtcacaataattgcccagtaccaacctgaagactatgccagattcgaagctaaaattcacgaccttcgggagcaaatgatgaatcactcgatgagcagcgggagtggatcgctgagaaccaatcaaaaaaggtcattgtatgtgcgggctatgtttgattacgataagtcaaaggactctggtttgcctagccagggcctctcatttaagtacggcgacattctgcatgtcatcaatgcctctgatgatgaatggtggcaagccaggagggtcatgttagagggtgactcagaggagatgggagtcatccccagcaagagaagggttgagagaaaagagagggccagattgaaaaccgtcaaatttaatgcgaagccaggggtgattgactctaaaggagacattccaggactcggcgatgatggctatggcacaaaaaccctgaagcacgtaagtagcaacgcctcagactctgagagcagctaccgcggacaggaagacttgatactgtcgtatgaacctgtgacacggcaggaaattaattacacgaggcctgtcatcattctgggaccgatgaaggatagaattaacgatgacttgatctccgaattccccgataagttcgggagctgtgtcccacacactacacgtccaaaacgtgactatgaagtggacggtcgcgactaccacttcgtgatctctcgggaacagatggaaaaggatatccaagaacacaagtttatcgaagctgggcagtataacgacaatctgtatggcactagtgtgcagtctgtccgcttcgtggcagagcggggaaaacactgcatcttggatgtgtctggcaacgccattaagcggctacaagtggcacagctgtatcctattgccattttcatcaaaccccggtccctcgaacctttgatggaaatgaataagcgccttactgaggagcaggcgaaaaagacctatgaccgcgccatcaaattggagcaggagttcggcgaatacttcactgcaatcgtgcagggggatacacttgaagacatctacaatcaatgcaagctggtgatcgaagagcagtcgggaccattcatctggattccaagtaaagaaaagctgtag

SEQ ID NO: 114782 - DNA, 2928 bp, Artificial Sequence
  Description of Artificial Sequence: Synthetic coding sequence
atgggaatttttaagtcttctttattccaggctctgctggatattcaagagttctacgaagttactctcctgaacagccagaaatcctgtgagcagaagatcgaggaggcgaatcaagtgctgcagaagtgggaaaaaacatccctgttggcaccttgtcacgatcgcttacagaagtcttcagagctgacagactgttccgggtcaaaagagaacgcctcttgtatcgagcaaaataaggaaaaccagagctttgagaatgagaccgatgaaaccaccacacagaaccaggggcggtgcccagcccagaactgttctgtggaggcgcccgcttggatgcccgtgcatcattgcacaaaatacagatatcaggacgaggacgcaccacacgatcactcgttgccacgattaactcacgaagtgcgcgggcccgaactggtgcatgtgtcggaaaagaacctgtctcaaatcgagaatgtgcatggatacgtgctccagagccatatctcccctctaaaggcatctccggctcccattattgtgaatacagatactttagataccataccatacgttaacggtacagagatcgaatacgaattcgaggagattactctggagcggggcaacagcggactgggctttagcatcgctggtggaaccgacaacccccacataggtgacgaccctggaatattcatcaccaagatcatccccggcggcgctgctgctgaggacgggcgcctgagggtgaatgactgcatcctgagggtaaatgaagtggatgtgagcgaagtctcccacagtaaggccgtggaggcgctcaaggaggcaggatctatagtcagattgtacgtccggcggcgaaggccaatcctggagaccgtggttgagattaaactgttcaagggcccaaagggactgggcttctccattgccggcggagtgggaaatcagcacataccgggcgataacagtatctacgtgaccaagattattgatggcggagccgcgcagaaagacggtaggctgcaggtgggtgacaggctgttgatggtgaacaattactcattggaagaagtgacacacgaggaagccgtcgcgatactgaagaatacttccgaggtcgtatacctcaaagtcgggaagcccactaccatctacatgactgacccatatgggcctcccgacataacccactcctattcaccacctatggagaaccatctgttgagcggcaacaacggcactctcgagtacaaaacgagcctgcctccgattagtcctggcaggtactcccccataccaaagcatatgctggttgatgatgattatacgagaccccctgaaccggtgtactcgactgttaataagctttgcgacaagcccgccagcccacgccactattctccagtggagtgcgataaaagcttcctgctgtcagccccctattcccattatcacctcggactgctgcctgactctgagatgacgagtcacagccagcatagcacggccacaagacagcctagcatgacgctccaacgggccgttagtcttgaaggtgagcctcgcaaggtggtgttgcacaagggttcgaccggtctgggcttcaatattgtgggcggggaggacggggagggaatcttcgtttcctttatcttggccggaggtcccgcagatctgagtggtgagcttcagcggggcgatcagattttaagtgttaacgggatcgaccttcgcggggccagtcacgaacaggcagccgctgctttgaaaggagcaggacagacagtgaccatcattgcgcagtatcagcccgaggattatgccaggtttgaagctaagattcacgacctgcgcgagcagatgatgaaccattctatgtcaagcgggtccggctctctcagaacgaaccaaaaacgctcattgtacgtgcgcgctatgtttgactatgacaagagcaaagacagcggtctcccatcacaggggttatccttcaagtacggcgatatccttcatgtgattaacgccagcgatgacgaatggtggcaagctcgccgcgtaatgttggagggggactccgaagagatgggcgtcattccgtccaagcggagagtcgaacgcaaggaaagggcccgcttgaaaactgtcaaattcaacgcgaagccaggagttatagattcaaaaggatctttcaacgacaaacggaagaagagtttcatcttctcaaggaagtttcctttttataagaacaaagaacagagcgagcaagaaacatctgatcctgagcggggccaggaagatctaatcctgtcttacgagcctgtcactcgacaagaaattaactatactcgccctgtgatcattctgggacccatgaaagacagaatcaacgatgatttaatcagtgaattccctgataagtttgggagctgcgtgccccataccacacgacccaagcgcgattacgaagttgacggccgagattaccactttgttatttcaagggagcagatggagaaagatatccaggagcacaaatttatagaggcaggtcagtacaatgacaatttgtacggtacttccgtccagtctgtgcgctttgtcgcggagagaggcaagcattgcatcctggatgtcagcggaaacgctattaagagactgcaggtcgcccagctctatcctattgcaattttcattaaacctagaagcctggagcccctgatggagatgaacaaacgcctcaccgaggaacaggcaaaaaaaacttacgatagggcaataaagctcgagcaagagtttggcgaatactttacagctatcgtacagggagatacgctggaagacatatacaatcagtgtaagctagtgatcgaggaacagagtggaccgttcatctggatcccaagtaaggagaaattgtag

SEQ ID NO: 114783 - DNA, 2928 bp, Artificial Sequence
  Description of Artificial Sequence: Synthetic coding sequence
tttgggtttatagtctctgttcactttcagagctacctcaatatacaggagttttacgaagttacacttctcaactctcaaaaatcctgtgagcagaaaatagaagaagcaaatcaagtgctgcagaagtgggagaagactagcctgttggccccgtgccacgaccgcctccagaaatccagcgaactgaccgattgctccggctctaaagagaacgctagttgtattgaacagaacaaagaaaaccagtcattcgagaatgaaaccgatgaaactactacccagaatcagggaaggtgccctgcacagaactgcagcgtcgaggccccagcgtggatgcccgtgcatcactgtaccaagtaccggtatcaagatgaggacgccccacatgatcacagtctgcccaggttgacacacgaggtccggggccccgaactcgtacacgtgagcgaaaagaatctatcacagattgagaatgtgcacggatatgtcctgcagtcacatatttctcctctgaaagctagccctgctcccatcattgtgaacaccgacacccttgacaccatcccgtacgtcaatgggacagagatcgagtacgaattcgaggagattaccttggagcgaggcaacagtggtctggggttttccatagcagggggcaccgataatccacacattggcgacgaccctggaatttttattacaaaaattatccccggtggggcggccgcagaagacggccgtctgagagtaaacgactgtatccttagagtgaacgaggtcgacgtgagtgaggtctcacactctaaagctgtggaggccctcaaagaggccggttcaatagtgaggctttatgtccgcagacgccggcccattctcgagactgtggttgaaatcaagttatttaaggggcccaaaggcctcgggttcagtattgctggtggcgttggcaaccaacatatacctggggacaattctatctatgtaaccaagatcatcgatgggggtgccgctcagaaagacggccgactgcaggtaggggacagacttcttatggtgaataactattcactggaagaggtaactcacgaggaggctgtggccattttaaagaacacaagcgaggtggtgtatctcaaagtggggaagccaaccactatctacatgaccgacccttacgggccacccgacattactcacagctacagtcccccaatggagaatcatctgctcagcggaaacaatggtaccctggagtataagacaagtttaccacctatatcaccaggaaggtacagtcctattcccaaacatatgctcgtggatgatgactataccagaccacctgagcccgtgtactctaccgtgaataagctctgcgataagccagcctcacctcgccattatagccctgttgaatgtgacaagtccttcctcctcagtgctccatacagccactaccatttgggactactgcccgactctgagatgactagtcatagccagcacagtacagcaacacggcagccctcaatgacactacagcgggcagtctcccttgagggagaaccaaggaaagtggtgctgcataaaggctccaccggcctcggttttaacattgtcggaggcgaggatggtgagggcatctttgtctcctttatactggccggaggaccagccgacttgtctggtgagttgcaacgaggcgatcagatattatccgtaaacggcatagatctgagaggggccagtcatgaacaggcagcggctgctctgaagggagccgggcagaccgtaaccatcatcgcgcagtaccaacccgaagactacgcacgctttgaggccaagattcacgacttgagggagcagatgatgaaccacagcatgtctagcggctcaggatccctgcgcaccaatcagaaaaggagtctttatgtacgcgcaatgtttgactatgataaaagcaaagacagtgggctgccctcgcagggtctttctttcaagtacggcgacattttgcatgtaattaacgcctcagatgatgaatggtggcaagctaggcgggtgatgctcgagggagactccgaagagatgggggtgatccctagcaagagacgagttgagagaaaggaacgtgcgcgactgaaaacggtaaaatttaacgccaagccaggggtgatcgattcaaaagggtcttttaatgataaaagaaagaaatcttttatcttctcgaggaagttccccttctataaaaacaaagaacagtcagagcaagaaacctctgatcctgaacgcgggcaggaggatctcatcctgtcgtatgagccggtcacacgacaggaaatcaattatactcgaccagtgatcatccttggaccaatgaaggacaggattaacgacgatctgatctccgaattcccagacaagtttggcagttgtgtgccacatactactcggcctaagagagactacgaagttgatggccgggactatcattttgtgatcagtagagagcagatggagaaagatatccaagagcataagtttattgaggctggacagtacaacgacaacctgtacggtacctcagtgcagtccgtcagatttgtggccgagagggggaagcattgcatactggatgtgtccgggaatgccataaaacggcttcaggtcgcccagctctaccctatcgctatctttatcaaaccccgctcactcgagcctctgatggagatgaataagcggcttacagaagagcaggcaaagaaaacctacgaccgtgcaatcaaactcgaacaagaattcggagaatactttactgctattgtgcagggcgatacactcgaagatatatacaaccagtgcaagctggttattgaggagcagtcggggccatttatctggataccatccaaagagaagctgtag

SEQ ID NO: 114784 - DNA, 2550 bp, Artificial Sequence
  Description of Artificial Sequence: Synthetic coding sequence
atgcacaaacatcagcactgttgcaagtgtcctgagtgttacgaggtgacccgtctcgcagccctacgccggctggagcctcctggctacggggattggcaggtgcctgacccatacggaccaggagggggaaacggtgccagcgctggatacggtgggtattcgagtcaaaccttaccgagccaggcaggagccactcccaccccccgcacaaaggccaagctcatcccaacagggcgggatgtggggcctgtgcctcccaaacctgttcctggaaaatctacacccaagctaaatggcagcgggccgtcatggtggcccgagtgtacctgcactaacagagattggtacgagcaagccaggcctgccccgcttctggtcaaccctgaaactctcaagcactcattatccgtgaatgggtccgatgggatgtttaagtatgaagagattgtgctggagagaggtaatagtggccttggttttagcatcgcaggagggatagacaatccccacgtgccagatgaccccggaatctttataactaagattatccctggcggcgccgcagcgatggacgggagactaggtgttaatgattgcgtgcttcgagtcaatgaggtcgacgtgtcagaagtcgttcattctagggccgtagaggccctgaaagaggctgggcccgtagtgcgtctggtggtgaggaggcgtcagcctccccccgaaaccatcatggaagtaaatcttctaaaaggacccaaaggccttggtttcagcatcgctggcggcatcgggaatcaacatatccctggcgacaatagcatatacatcaccaaaattattgaagggggggcagcccaaaaagatggaagactgcagatcggagacagactattggctgtgaataacacgaatcttcaggatgttcgtcatgaggaagccgtggctagcctgaagaacacctctgacatggtctatctcaaagttgcaaaacctggctcacttcaccttaacgacatgtatgcgccacctgattatgcttcaacatttactgccctggcagacaatcatattagtcacaattcttcactgggctacctgggagcagtcgagagtaaagtgagttatcccgctccccctcaggttccaccaaccagatatagcccaatacctcgacacatgcttgccgaggaggattttactcgagagccccggaagatcatcttacacaaggggtcgactggattgggtttcaacattgtggggggtgaggatggcgaaggtatttttgtttcattcatcctggctgggggcccagctgatctctctggagagttgaggcgaggcgatcgcatactgtcagtgaatggagtcaatttgaggaacgccactcatgagcaagccgccgctgcgttgaagcgggcagggcagagcgtgactattgttgcccagtatcgccccgaagaatactcccggtttgaaagtaaaattcacgacctacgagagcagatgatgaattcaagcatgtctagtggcagcgggagcttgcggacaagcgagaagagatcactctatgtgcgagctctcttcgattacgatcgcaccagagactcttgcctcccatcccagggccttagcttttcatatggcgatatccttcatgtgattaatgcaagtgatgatgaatggtggcaggcaagactcgtgactccccacggtgaatccgaacagataggcgtgataccatccaagaaacgggtggagaagaaagaacgggcaaggttgaagaccgtgaagtttcatgccagaacaggtatgattgagtctaatagggattttcccggcctttccgacgactattacggagccaagaatctcaaaggcgtgacctccaacaccagcgactccgagtctagcagtaaagggcaggaggatgcaattttatcttacgagccagtgacaaggcaggaaatccattatgcaagaccagtgattatactgggccccatgaaggaccgagtgaacgatgatctcattagtgaatttccacacaaatttgggagctgtgtgcctcacacaacacgcccgcgaagggataacgaagtggacggacaagactaccactttgtggtgtcaagagaacagatggaaaaggacattcaggataacaaatttattgaggcgggtcaatttaatgacaacctttatggtacctccattcagtccgtacgtgccgtggctgaaaggggaaagcactgtattctggatgtgtccggaaatgccattaagcgactgcaacaggcccagctctaccccattgctatatttattaagcctaaaagtattgaggcactgatggagatgaaccgcagacagacatatgagcaggccaataaaatctacgataaggcaatgaagttggaacaggagttcggcgagtactttacagccattgtgcagggagactccctcgaagaaatatacaacaagataaagcaaatcatcgaagatcaatctgggcattatatctgggtgcccagtcctgaaaagctctag

SEQ ID NO: 114785 - DNA, 2454 bp, Artificial Sequence
  Description of Artificial Sequence: Synthetic coding sequence
atgcataaacaccagcactgttgcaaatgccctgaatgttacgaggtcacccgactcgccgccctgcgtagattggagccccccggctacggcgactggcaggttccggacccatatggccccggcgggggaaatggtgccagtgcaggatacggcggctactcaagccagaccctccctagtcaggccggtgctactccgacccccaggaccaaagctaaactgatcccaactgggagagacgtgggtcccgtgccacccaaacccgtgccaggtaaatccacgccgaagctgaacggcagtggaccctcttggtggcctgagtgcacctgtacgaaccgggactggtacgagcaggtcaacggctcagacggtatgtttaagtacgaagaaatagtcctggaaaggggaaacagtggtttggggttcagcattgcaggtgggatcgacaacccacacgtaccagatgacccaggaattttcattactaaaattattccgggtggggccgccgccatggatggtaggcttggggtcaatgactgcgttctccgtgtgaacgaggttgacgtgtctgaggtggttcactcgcgagccgttgaagcacttaaagaagccggtccagtggtacgcctggtcgttaggcgacgacagccaccgcccgaaaccattatggaggtaaacctcctcaagggtcctaagggcctgggattctctatcgccggagggatcggaaatcagcatattccaggtgataacagcatttacatcactaagattatcgaaggcggcgccgcccaaaaagatggaagactccagatcggtgatcgtctgttggccgtgaacaacaccaatttacaagacgttcgccacgaggaagcagtggcatctctcaagaataccagcgacatggtttacttaaaggtggcaaaacccggctcccttcacctgaatgacatgtatgcacctcctgattatgcctctactttcacagctctcgctgacaatcacataagccacaatagcagtcttggataccttggggctgtcgagtccaaagtttcgtatcctgccccaccccaagtgccaccaacacgatacagtcctattcctcggcacatgctggccgaggaggactttacacgggagcccagaaagattatcttgcataaaggctcaacgggacttggtttcaatatcgtgggtggggaagatggcgagggaatcttcgtctccttcattctggcaggcggcccggctgacctttctggagaattacgccggggcgataggatcctaagtgtcaacggagtcaacctcagaaacgccacccacgagcaggcagcggcagctctaaagcgagccggacagagcgtaactattgtcgcacagtataggcctgaagagtactccagatttgagtccaaaatccacgacctaagagaacagatgatgaactccagtatgtcttcggggagtggtagtctgaggacatccgagaaaaggagtctctacgtacgtgctcttttcgattatgaccggacacgggattcctgtcttccctcacagggtctgagctttagttatggcgacatcttgcacgtaataaatgcatccgatgatgaatggtggcaggccaggctggttaccccgcatggcgagtctgagcagattggggttataccaagtaaaaaaagagtagagaagaaggaaagggcgcgccttaaaactgtgaaattccatgctagaacaggaatgatcgagtccaacagggatttcccaggactgagcgacgactactacggggcaaagaatctcaaggggcaggaagacgcaatcctgtcatacgagcccgttaccaggcaagaaatccattatgcgcgtcccgtcattatactaggcccaatgaaggacagggtgaatgatgacctgatctccgagttccctcataagttcggatcatgcgtccctcacacaacccggcctcgacgcgataatgaagtggacggccaggattaccacttcgtcgtctctcgagagcaaatggagaaagatatacaagataacaagttcatcgaagccggtcagttcaatgacaacctgtatggcacaagtattcaaagtgtcagagccgtggccgagagaggcaagcactgcattctcgatgtctccggcaatgccatcaagcgcctgcagcaggcccaactttatccaattgcgattttcatcaaacctaaatcaatcgaggcgttaatggagatgaatagacggcagacctacgagcaagctaacaagatatatgacaaggctatgaaactggaacaggagttcggtgagtactttacggctattgtgcagggcgacagcttggaggaaatctacaacaaaatcaaacaaattatcgaagatcaatccggacactatatctgggtgccctcccccgagaagctgtag

SEQ ID NO: 114786 - DNA, 1101 bp, Artificial Sequence
  Description of Artificial Sequence: Synthetic coding sequence
atgatgaactcatccatgtcgtctggaagtggaagtctgcgcacaagtgagaagcggtctctgtacgtgagggctctgttcgattacgacaggaccagagattcctgcctaccatcacagggcctgtctttttcttatggcgacatacttcacgtcatcaatgcatccgacgatgagtggtggcaagcccgactcgtgactcctcatggagagtcagaacaaatcggagtgatcccatccaagaaaagggttgaaaagaaagaacgcgccaggttaaaaactgtgaagttccatgcccggacgggcatgatagaatccaaccggtcgatcaagactaagaggaagaagtcttttcgattaagccgcaagtttcccttctacaaatctaaagagaacatggcccaggaaagctctatacaggaacagggagtgacatccaatacttccgacagtgagtcctcgtccaaagggcaggaagatgcgatcctcagctatgagcccgttacacggcaggagattcactatgcccgcccagtgatcatactgggccccatgaaagaccgcgtgaacgacgatcttataagtgaatttccacacaagtttggaagttgcgtgccacacactacacgacctagaagagacaacgaagtggacggacaggactatcatttcgtggtctctcgagagcagatggagaaagatatccaggacaataaatttatcgaggcgggacaatttaatgacaatctgtatggaacctccatccagtctgtgagggccgtggcggaacggggtaagcactgcatcctagatgtatccggcaacgcaattaagaggctgcagcaggcccagctttatcctattgccattttcatcaaaccgaagagcattgaggctcttatggagatgaatcgccgccaaacctacgagcaggccaacaagatctacgacaaggcgatgaaactggaacaggagttcggggaatatttcacagcaatcgtccagggagattccctggaagagatctacaataagattaaacaaattatcgaagatcagtcgggccactacatctgggtgccctcccccgagaagttgtag

SEQ ID NO: 114787 - DNA, 2304 bp, Artificial Sequence
  Description of Artificial Sequence: Synthetic coding sequence
atgagccagcgcccgcgggcaccacgtagcgccctctggctcttggctccgcctctcctgcggtgggcccctccgctgctgacggtgctgcatagtgacttgttccaagccctgctggacattttagattactatgaagcgagcctgagcgaatcacagaaataccgttaccaggacgaagatacgccacctctggagcattctcccgcccatctcccaaaccaagcaaattctcctcctgtaatagtgaacaccgacacactggaagcacctggctacgagctccaggtcaatgggaccgaaggcgaaatggagtacgaggaaattactctcgagaggggcaattccggtctgggattctccattgctggcggcactgataatccccatattggcgacgatccctcgattttcatcaccaagatcatcccaggaggcgccgccgcacaggatggacgcctgcgggtaaatgactcaattctgtttgtgaacgaagttgatgttagagaagtcactcactccgccgcagttgaggctctgaaagaggcagggagcatagtacgcttgtacgtgatgaggcgcaaaccaccagccgaaaaggtaatggagataaaacttattaaaggccccaagggactcggcttttcgattgccgggggggttgggaaccagcacattcctggcgacaattccatctacgtgaccaaaatcatagagggaggtgctgcccacaaagatggacgtttgcagattggcgataagatcctggccgtaaactcagtcggactggaagatgtgatgcacgaggatgccgtggctgcactgaaaaacacatatgatgtggtgtacctgaaggtggccaaaccatcaaatgcttatttgtccgacagctacgctccacctgatatcaccacttcatactcacagcacctggacaacgagataagccattcgtcttacctggggacggattaccctactgctatgactccaacaagtccccgacgttacagccctgttgctaaggacttgctgggcgaggaggatatcccacgggagccccgccgtatcgttatccatagaggcagcaccggcctgggcttcaacattgtgggcggtgaggatggggaggggattttcatatcatttatcttggccgggggacctgctgacctttccggagaactccgcaagggagatcaaatcctgtccgtgaatggcgtcgacctgaggaacgcaagtcacgagcaggcagcgattgctctaaaaaatgcgggccagactgtcacaattatcgctcaatataaacctgaagaatactctcggtttgaagctaagatacacgacttgagggaacaactgatgaactcgagtctggggagtgggacagccagcctgagatctaatcccaaaagaggattctatatacgagctctcttcgattatgataaaacgaaagattgcggctttctctcccaggctctttcatttaggtttggggacgttcttcatgtgattgacgccagcgacgaggaatggtggcaagccaggagagttcatagtgacagcgagacagatgatatcggctttataccaagcaagcgccgggtcgaaaggcgcgagtggtcccgtctgaaggccaaggactggggcagctcttccggcagtcaggggagagaggactcagtgttgtcttatgagaccgtgactcagatggaagtccactatgcacggcctataattattctcgggccaacaaaagacagagcaaacgacgacctcctgtctgaattccctgacaaatttggatcttgtgtcccacacaccacgaggcctaagagagagtacgaaatcgacggcagggactaccactttgtttcttctcgtgagaaaatggagaaggatattcaggctcacaaatttattgaggctggtcaatataactctcacctctatgggacctcagtgcaatcagtgagagaggtagctgaacaggggaagcattgcatcctcgacgtgtctgctaacgcagtccgacgcctgcaggccgctcatctccacccaatcgccatttttatccgtcctagatcccttgaaaacgtgctggagattaataagagaataactgaagagcaggcccgcaaggcctttgacagagcgacaaaacttgagcaggaatttaccgagtgtttcagtgctatcgtggaaggcgactcatttgaggaaatctatcataaggtgaagcgggtgattgaggacctctccggtccttacatttgggtgccggcccgcgagaggctctag

SEQ ID NO: 114788 - DNA, 2166 bp, Artificial Sequence
  Description of Artificial Sequence: Synthetic coding sequence
atggactgtttatgcattgtcaccaccaagaaatatagataccaggacgaagataccccccccctggagcattccccggcccatctccctaaccaggccaactcacctccagttattgtaaacacggacaccctcgaagcccccggctacgtgaatggaacagagggcgaaatggagtatgaagagatcacactcgaaagaggaaacagcggactgggatttagtatcgctggcggcacagacaatcctcacattggcgatgatcccagcatcttcattacgaaaatcattcctggtggcgccgccgcccaggatggcagactgagagttaatgactccatcttgttcgtcaatgaggtggacgtaagggaagtgactcactcggctgctgtggaggcattgaaagaggcgggaagcatcgtccgcttgtacgtgatgcggagaaagcctcctgccgagaaggtaatggagatcaaactgatcaaagggcctaagggcttaggctttagtatcgccggtggagtaggcaatcagcacattcccggtgataactctatatacgtcacaaaaattatcgagggaggcgcagctcacaaggacgggagacttcagatcggcgacaagattctggcagtgaatagcgtgggcctggaagacgttatgcacgaggacgccgtggctgctcttaaaaatacctatgacgtggtgtacctcaaggtcgccaagcctagcaatgcatacttatccgattcttacgctccgcccgacatcactacttcttattctcaacatctcgataacgagatcagtcactcttcatacctggggacagattatcccacagccatgactcccaccagcccgcgaagatatagcccggtcgcaaaagacttactcggggaggaagatattcctagggaacctcgccgcattgtgattcatcgggggtcaactggtttgggatttaacatcgttggaggcgaggacggggaggggatatttatttcatttatcctcgccggggggcctgcagacctctcaggggagttgcgtaaaggtgaccaaatcctgtcagtgaatggcgttgatctcagaaacgctagtcacgaacaagctgccatcgcactcaagaatgctggccagacagtgaccatcatagcacagtataagcccgaagaatattccaggtttgaggcgaagatccacgatctgagagaacagctgatgaattcgtctctcggaagcgggaccgccagcctgagaagcaatcccaagaggggtttctatattcgcgctctttttgattatgataagactaaggattgcggctttttgtcacaggctctgtcttttcgcttcggcgacgttctccatgtgatcgatgctagtgatgaggagtggtggcaggcgcgtcgcgtgcactcagattcggaaactgatgatatcggttttatccccagtaagcggcgcgtcgaaagacgggagtggtcacgtttgaaagctaaggattggggctcctcaagtggcagccaaggcagggaggactccgtcttaagctacgaaaccgtgacacagatggaggttcactacgcgcgacctataatcatcctgggcccaacaaaagatagagccaatgacgaccttctaagtgagttcccggacaagtttggctcttgtgtaccacacactaccaggcccaaacgggagtacgaaattgacggcagagattatcatttcgttagctcccgggagaaaatggagaaggatatccaagctcacaaattcatcgaagctggtcaatacaatagccacctgtatggaacctcagtgcagtccgttcgggaggttgcagagcaagggaagcactgtattctggacgtgtctgcaaatgctgttcgcagattacaggccgctcatctgcatccaattgccatctttattcggcctcggtcactggaaaatgtgctggagattaacaagagaataacagaggagcaggcaaggaaagcatttgacagggcaacaaagttagagcaagagtttacagagtgcttttccgctatcgtggagggcgactcctttgaagagatttatcacaaagttaagcgggtcattgaggacttaagtgggccgtacatatgggtgccagctagggagcggttgtag

SEQ ID NO: 114789 - DNA, 1995 bp, Artificial Sequence
  Description of Artificial Sequence: Synthetic coding sequence
atggaatacgaggaaatcaccctggaaagaggaaactcaggcctgggcttcagtatcgccgggggcactgataatccacacatcggagatgatcctagcatttttattactaagattatccccggaggtgcggcagcacaggacggcagactccgggtcaatgactcaattctttttgtgaatgaggtcgatgtccgtgaagtgacccatagtgcagccgtggaagctttgaaggaggccggctctattgtgcgcctttatgtcatgcgccgaaagccacccgcagagaaggtgatggagatcaagctgattaaaggacccaagggcctcggtttcagtattgccgggggagtcggcaatcagcacattcctggggataatagtatttatgttactaaaattattgagggaggcgcagcccacaaagacgggcgccttcaaatcggggacaagattttagcagtgaactccgtcggcctcgaagacgtgatgcatgaggatgccgtggctgcgttgaaaaatacctacgatgtcgtgtatctcaaggtggccaaacctagcaatgcatacctcagcgactcttatgcccctcccgacatcaccacctcatatagtcagcatctggacaatgaaatcagtcatagtagttacttaggtacagactaccctactgctatgacaccaacttcccctaggagatatagcccagtggcaaaggatctgctgggggaggaggacatcccccgggagccacggcgcattgtgatccaccgcggctcaacagggctaggattcaacatagtgggaggggaggatggtgaaggcatctttatatcctttattcttgcaggagggcccgccgatctgagtggagagctgagaaagggggatcagatactgagcgtaaacggcgtggatctcagaaatgctagtcacgagcaagccgctattgcgctcaaaaatgccggtcagacagtcactattatcgctcaatacaagcctgaggagtactctagatttgaagccaagatacacgacttgcgggagcagctgatgaattcttcactcggtagtggtacagcctcacttcgctccaaccccaaaagggggttctatattcgcgccctgttcgactacgacaagactaaagactgcggtttcctgtctcaggccctctcgtttcggtttggagatgtactccacgtaatcgatgcttcagacgaggaatggtggcaggcaagacgcgtgcattcggattcagaaacagacgacatcgggttcattccttctaagaggcgcgttgaacgccgtgagtggtccaggttgaaggctaaggactgggggtcttcttcagggtcccaggggcgtgaagacagcgtcttgagctatgagactgtaacccagatggaggtacactatgctcggcccatcatcatcctgggccctactaaggaccgggccaacgacgacctgctatctgagtttcctgacaagtttggaagctgcgtccctcacacaactaggcccaaaagggaatatgaaatcgacggccgcgattatcatttcgtgagcagcagggaaaagatggagaaggatatccaggcccataaattcatcgaggccgggcagtacaactcccatctgtacggtacaagtgtacaaagtgttagggaggtcgctgagcaggggaaacattgcatcctcgatgtgtccgctaatgccgtgaggcgcctgcaggcagcccatctacaccctattgccatctttatccgcccacggtccctggagaatgtgttggagattaacaaacgcattaccgaagaacaggcgcggaaggcatttgatcgtgcaactaagctggaacaagaattcaccgaatgcttctcggcaatcgtcgagggagattcattcgaggagatttaccataaggttaaacgcgttatcgaggatctctcgggcccatacatttgggtgcccgcccgggaacgattgtag

SEQ ID NO: 114790 - DNA, 2175 bp, Artificial Sequence
  Description of Artificial Sequence: Synthetic coding sequence
atggactgtctttgtatcgtcacgacaaaaaagtaccgataccaggacgaagatacaccgccgctggagcattctccagcccacctaccaaaccaggctaacagcccgcccgtcatagtgaacacggacacactcgaggctccaggttacgtcttacaggtgaatggaacagaaggcgagatggagtacgaggaaatcacgctggagagggggaacagcggactggggtttagcattgccgggggcaccgacaacccccatattggggatgatccatcgatctttattactaagataatccccgggggtgctgccgcgcaagacgggagacttagggtgaatgatagtattctttttgtaaacgaagttgacgtgagggaggtgacgcacagtgctgccgtcgaggccctgaaagaagccggtagtatcgtgcgcctgtacgtgatgcgccggaagcccccggcggagaaggtgatggaaataaagctaattaaaggacctaaagggctcgggttttcaattgccggcggggtaggtaaccagcacatccctggggataattcaatttatgtgaccaagattattgaaggcggagcagcccacaaagatggtcggctccagattggtgacaaaatactggcggtgaactccgtggggctagaggacgtgatgcacgaagatgccgtcgccgccctaaaaaatacttatgatgtagtctatcttaaggttgctaaaccgagcaacgcttacctctctgactcttacgccccacccgacataacgacctcgtactcccagcacctggacaatgagatcagccacagctcgtatttggggaccgattatcccaccgctatgacccctacgagccctcgccggtactcccccgttgcaaaggacctcctgggggaggaggatattcccagagagccccgccggatcgtgatccatcggggtagtaccgggctggggttcaatatagtgggcggcgaggacggagagggtatcttcatttccttcatattggccggtggtcccgccgatctgagcggcgagctccggaagggagaccagatactcagcgttaacggggtggatctccgaaatgctagtcatgaacaagccgccatcgctttgaagaacgccggccagaccgttacaataattgctcagtacaagccagaggaatactctcggttcgaagccaagattcacgatctcagggagcaacttatgaactccagcctgggtagtggaactgctagtttgagaagcaacccgaagcgcggcttttacattcgtgcgctctttgactacgataagactaaggattgcggcttcctgtcacaggcactctcattccggttcggcgatgtgttgcacgtgattgatgcatcggacgaggaatggtggcaggcaaggcgggtccattccgactctgaaacggatgacattggtttcattcctagcaagcgccgagtcgaacgacgcgagtggagccgccttaaagcaaaagattggggtagtagttccggttcacagggcagagaggattccgtgttaagctatgagactgtgacccaaatggaggtgcactatgcacgccccattataatcctgggtccaactaaggacagggccaacgacgacctcttatccgagtttcccgataaatttggctcatgcgtccctcatactacccggcccaagagagagtacgaaattgacgggcgcgattaccactttgtgtctagcagggaaaagatggaaaaggatattcaagctcacaagttcatcgaggctggtcagtacaactcacacctgtatgggacatcagtccagagtgtgcgcgaagtggctgagcaaggcaaacactgcattctggatgtgtcagccaatgcggtacgccgtttgcaagctgctcacttacaccccattgctatcttcatccgaccgaggtctctggaaaatgtgctggaaatcaataaacggatcactgaggagcaggcgagaaaggctttcgacagggccaccaagttagagcaggagttcaccgagtgtttctctgcaattgtggaaggggatagttttgaagaaatatatcacaaggtgaagagagttatagaagacttatccggtccatacatttgggtgcccgctcgggagagactgtag

SEQ ID NO: 114791 - DNA, 2304 bp, Artificial Sequence
  Description of Artificial Sequence: Synthetic coding sequence
atgtctcaaagaccccgtgcacctcggagcgctctgtggctgctggctcctcctctgcttagatgggctcccccattgctgacagtgctgcatagcgacctgttccaggcactgctagatattcttgattactacgaagcgtcattgtccgaatctcagaagtatcgataccaagatgaggacacacctcccctcgagcactcccctgcacacctaccaaatcaggcgaattctccgcccgtgattgtgaatactgacaccctggaagccccgggctatgtgctgcaggtcaatggcacagaaggggagatggagtacgaggaaatcactttagaacgggggaactctggtcttgggttctctatagctgggggtaccgacaatcctcatatcggcgacgacccttctatttttatcactaaaatcattccaggcggcgctgccgcgcaggatgggagactaagggttaacgattcgatactgtttgttaatgaggtagacgtgcgggaagtcacgcatagcgctgccgtagaggcactcaaggaggctggcagcatcgtgagattgtacgtaatgcgcaggaagccccctgcggagaaggtgatggaaattaaactgattaagggccctaaggggctcgggttcagcatcgctggcggcgtcgggaaccaacatatccctggggacaattcaatctacgttactaagattattgaaggaggagcagcacacaaggatggtcgactgcagattggtgacaaaatcctggccgtcaacagcgttggcctggaagacgtcatgcatgaggatgccgtggccgccttgaaaaatacttacgacgtagtctatctgaaagtagccaagccatctaacgcttacctctcagactcctatgcacctcccgatatcaccactagttactctcagcatctggataatgaaatttctcacagttcctacctcggcacagactacccgacagcgatgacaccaacaagtcctagaaggtatagtcctgtcgctaaggacctcctgggcgaagaagacattcccagagagccacggcgcattgtcattcatcgagggtccaccggactaggcttcaatattgtgggcggggaggatggtgagggaattttcatctcttttatcctcgccgggggaccagccgacctgtcgggagagctccgtaaaggcgatcaaattttatcagtgaacggggtggatttgaggaacgcatcacacgagcaggccgctatagccctgaaaaatgctgggcagacagtgaccataatagctcagtataaacccgaggagtatagtagattcgaagcgaaaattcacgacctgagagagcagctgatgaactcttcgctggggagcggcacagctagcctcaggtcaaatccaaagcggggcttctatattcgtgccctcttcgattacgataagacaaaggattgcggcttcctgtctcaagccctcagtttccggttcggggacgtcttacacgttatagatgctagcgacgaggagtggtggcaggcccgccgcgttcactccgattctgagaccgatgacattggattcatcccaagtaaacggcgtgtcgaacggcgcgagtggtcgcgcctcaaggcgaaagactggggaagctctagcggctcccagggccgcgaggactctgtgctgtcctatgaaacagtgacccaaatggaggtgcattacgcaaggccaatcatcatcttggggcccaccaaggaccgcgctaatgacgatctgttgagtgagttccccgacaaatttggctcgtgtgtgccccacacaacgcgtccgaaacgcgaatatgagatcgatggacgggactaccatttcgtgtcgtcccgagagaagatggaaaaggacattcaggcccacaaattcatcgaggccgggcagtacaacagccacctctatggaacctctgtccagtccgtgagggaagtggctgagcagggaaaacactgtatcttagacgtgagcgccaatgccgttcgcaggctgcaggccgcccatcttcacccaattgccatctttatcagacctcggtccctggagaatgtgcttgagatcaacaaacgcatcacagaggagcaagcaaggaaagctttcgacagggcaactaaactggagcaggaatttacagaatgtttctcagctattgtcgaaggtgacagcttcgaagaaatctaccacaaggtgaaaagagtgatcgaggacctttctggtccgtacatctgggttccggcgagggagcggctgtag

SEQ ID NO: 114792 - DNA, 2004 bp, Artificial Sequence
  Description of Artificial Sequence: Synthetic coding sequence
atgtcccagaggcctcgggctcctagatccgcactgtggcttctagcaccacccctgctgcgctgggcaccccccctgttaacagttctgcatagcgacctgtttcaggctttgctggatatactagactactatgaggctagcttgagtgaatcacagaagtaccggtaccaggatgaggacacaccgcccttggagcattctcccgcccacctgcccaaccaggcaaactctccgcccgtcattgtgaacactgataccctggaggcaccaggttacgagttacaggtgaacggcacagaaggcgaaatggagtacgaggaaataactctggagagggggaactctgggctgggattcagcatcgccggcgggacggacaacccacacattggcgatgacccaagcattttcatcaccaaaatcattcctggcggcgctgcagcccaggatggacgactacgggttaatgatagcatcctgtttgtgaacgaggtggatgtgagggaagtgacccatagtgctgctgtcgaggcccttaaagaggctgggagtatcgtccggctgtatgtgatgagacgaaagcctcccgcagagaaagtgatggaaatcaagttgatcaaaggccccaaaggtctgggcttctcaattgcaggcggtgtgggaaaccagcatatccccggtgacaactctatatatgtcacaaaaatcatcgaaggaggggccgcccacaaggatgggcgactgcagataggcgacaaaatcttggcagtaaactctgtcggcctagaggatgtgatgcatgaagacgccgtggctgctttaaagaatacatatgatgtcgtctatttgaaagtggctaagccctctaacgcatacctgtctgacagttatgcccccccagatattactacatcgtactctcagcatctggacaacgagatcagtcacagcagctacctcggcacggactatcccactgcaatgacccctactagccctcggagatacagcccagtagccaaagacctgttaggagaggaggatatccctcgagagccgcgacgcattgttatccatagagggtccacgggcttaggctttaatatcgtcggtggtgaagatggcgagggtatcttcatttcatttattctcgctggcggtccagctgatctgagcggagagcttagaaagggagaccagatcctctccgtcaatggtgtcgatctgagaaatgcatcccacgaacaggctgccattgccctcaagaatgcaggtcagactgtgaccatcatcgcgcaatataaaccagaagaatattccaggttcgaggccaagatacacgatctcagagagcagctaatgaatagttcgcttggcagcgggaccgcttcgcttcgaagcaaccctaaacgcggattttacattagggccctgtttgattacgacaagaccaaggattgtgggtttctctcacaggcactgtctttccgtttcggagacgttcttcacgttattgacgcttctgatgaggagtggtggcaggctcggcgcgtgcatagcgactccgaaaccgacgacattggttttataccatccaaacggcgagtcgagaggcgggagtggtcacgcctcaaagctaaggactggggctcttctagtggctcccagggccgagaggattcggtgctttcatacgagacagtgacacaaatggaagtgcactacgcccgtccaattatcattctcggacctactaaggatagagcaaacgacgatttgctgtcagaattccccgataaatttggtagctgtgtgcctcacaccactcgtccgaaaagagagtacgagatagatggccgcgactatcactttgtgtctagtcgggagaagatggaaaaagatatccaagcacataagtttattgaggctggccaatacaactctcatctttacggaactagtgtccagtctgtgcgcgaggtggctgagcaacgggactag

SEQ ID NO: 114793 - DNA, 4740 bp, Artificial Sequence
  Description of Artificial Sequence: Synthetic coding sequence
atggaaccgcaaaggagagagctactggcacagtgccaacagagcctcgcacaggccatgacggaagtggaagcagttctggggctgttggaagctgcgggagcactcagtccaggagagcggagacagcttgacgaggaggccggcggggctaaggctgaactcctcctgaagcttctgctcgcaaaggaacgggatcactttcaggacctgcgggcagcactggagaaaacgcaaccccatctacttccgatcctctacttgaacggtgtcgtgggccccccccagcccgcagaaggcgctggcagcacctacagtgtgctcagtaccatgccttctgacagcgagagcagctccagtctctccagcgtgggtacgacaggcaaggctccctcccctccacctctccttactgaccagcaagtgaatgagaaagtggaaaatctgtctatccagcttagactcatgacgagggagagaaacgaactgcgaaaacgcctagcctttgctacccatgggaccgcgttcgataaacggccgtatcaccggcttaatccggactacgagcggctgaagatccagtgtgtgagagctatgtcagatctgcaatctttacagaatcagcacaccaacgccctgaagaggtgtgaggaagttgccaaagagacagacttctaccatacacttcactcccggctattatctgatcaaactcggctgaaagatgacgtcgacatgctaaggcgagaaaacgggcagcttctgcgtgagagaaatttgcttcagcagagctgggaagatatgaagcgcctgcacgaggaggatcaaaaggaaatcggcgacctgagagctcagcagcaacaggtgctcaaacataatggatcgtccgagatcttgaacaagctctatgatacagccatggataaattggaggttgtcaagaaggactacgatgcattgcgcaagcggtattctgaaaaagttgcaattcataacgcagatctgagccggctggagcagctaggggaggaaaatcaaaggttgctgaagcagaccgaaatgctgacccagcagcgagacaccgccattcagctacagcatcagtgcgctctctcattgagacggttcgaggcaatccaccatgagttaaacaaagccaccgctcagaacaaggatctgcaatgggagatggaactactgcagagcgagcttacagaactgagaaccacccaagtgaagaccgctaaagaatccgagaagtacagagaagaaagagacgccgtctactcagagtacaagctgatcatgtcagagagagaccaggtaatatctgaattggataagctgcagacggaagtggagctggcagaatcgaagctcaagagctccactagcgaaaagaaggccgccaacgaagagatggaagctctaagacaaatcaaggacactgttaccatggacgctggccgagctaacaaggaggtcgagatcctccgcaaacaatgcaaggcactctgtcaggaattaaaagaagcactgcaggaagccgatgtggctaaatgtagaagggattgggcttttcaggagagagataaaattgtggctgaacgggattccataagaaccctgtgcgacaacctgagacgcgagcgcgatcgagcagtgtctgagcttgctgaggctctcaggtctttggacgacactcgtaaacagaagaatgacgtgtctcgtgagttaaaggagctgaaggagcaaatggaatcccagctagaaaaagaagctaggttccgccagctgatggctcacagcagccacgatagcgcaatcgacacggatagcatggagtgggagaccgaggtggtggagtttgaacgcgagaccgaggatatcgacctcaaggctctcgggtttgacatggccgaaggcgttaacgaaccatgtttccctggtgattgcggtatcttcgtaacaaaagttgataaaggttccatcgcagatggaagactgagagtaaatgattggctgctgcgtatcaacgatgtggacctgattaataaggataaaaaacaggctattaaggctctgctgaatggagagggggctattaatatggtggttcgtcggagaaaatctctgggcggcaaagtcgtgactccactgcacataaacttgtccggtcagaaagattcaggaatttccttggagaatggtgtttatgctgcagctgtacttccagggtcacctgcagccaaggagggctcccttgctgttggcgatagaattgtggctattaatggcatcgccctggacaacaaaagcttgaatgaatgcgagtcattgctgcggagctgtcaagactccttaactctttccctcctcaaagagcagaagtgtgtgcccgcgtccggtgaacttagccccgagctgcaggaatgggctccttactcacccggtcactcttcaagacacagcaatcctcctctgtatccttcccgaccctccgttggcacagttcctaggtcccttactccctcaactaccgtctcaagcatcctccgcaatccaatctacacagtgaggtcgcatagggtaggcccctgtagttcgcctccggcagcccgcgatgccggcccacaaggtctgcaccccagcgtccagcaccaaggaagactgtctctggatctgagtcacagaacttgctccgattattctgagatgagggccacgcatggcagtaatagtctgcccagttccgccaggctgggttcaagttcaaaccttcagtttaaagccgaacggatcaaaatccccagtaccccccgttatcctcgatcagttgtggggtctgaaagaggatccgttagccacagcgagtgctccacacctccgcagagtccactgaatatagataccttgtcatcgtgtagtcaatcacaaaccagcgcgagcacactgccacgaatcgccgtgaatcccgcctctttgggtgagagaaggaaggacagaccctacgtcgaggagcccagacacgttaaagtacaaaagggttccgagcccctgggaataagcattgtgtcaggcgagaaaggcggaatctacgtgtctaaggtgaccgtgggaagcattgcgcatcaggcggggctcgaatatggcgaccagctgttggagttcaacggaattaacctgagaagtgcaaccgagcagcaagccagattgatcataggtcagcagtgcgacaccatcaccattttggcacagtacaatccccatgtacatcagttaagcagtcacagcagatcaagttcccacctcgacccagccggtacacacagtacactccagggtagcggtacaaccacccctgagcatcctagcgtcatcgatccactgatggagcaggacgagggcccttctacacccccagcgaaacagagctcgagtcgcatagccggtgacgctaacaaaaagactctagaacctcgggtggtttttattaaaaaatcccagctggagctgggggtgcacctgtgtggcggcaatcttcacggtgtcttcgttgcagaagtcgaagacgactccccggcaaagggacccgacggccttgtacccggagacctgatcttggaatacggcagcctcgacgtgcgcaataaaacagtcgaggaggtttatgtggagatgctgaagcccagagatggtgttcgcctgaaggtccagtaccggcccgaagagtttacaaaggcgaagggcttaccaggagatagtttctacattagagctctgtatgaccgactcgctgacgtcgagcaagagctgagctttaagaaggatgacatcttgtacgtggatgacacactgccacaggggactttcggttcttggatggcatggcagctggacgagaacgcacagaaaattcagcgaggtcagatcccctctaagtatgtgatggaccaagagtttagcagaaggttgtccatgtctgaggtgaaggatgataacagcgcaaccaaaacattgtctgccgccgcccgacgaagtttcttccgtaggaagcataagcacaagagatcaggaagtaaggacggcaaggacctgctcgctttggacgcatttagttctgactcaattccactttttgaggattccgtgagccttgcttaccagagagtgcagaaggtcgattgtactgcgctgcgccctgttctaatactgggtccattattggatgtcgttaaggaaatgctggtgaacgaggctccaggcaaattctgccggtgtccattggaagtgatgaaagcaagccaacaggccattgagaggggtgtcaaggactgcctatttgtggattataaacgacgaagtggacactttgatgtcacaacggtcgcctcaattaaggagattacggagaaaaatcgccattgtctgttagacatcgcacctcacgccattgaacggcttcatcacatgcatatttatcctattgttattttcatacactacaagtctgcaaagcacatcaaagaacagcgcgatcccatttacctgagggataaggtcacccaaaggcacagtaaagagcaattcgaggctgctcaaaaactcgagcaggaatatagccggtatttcacgggagtgattcaaggcggcgctttgtcatccatctgtactcagattctagccatggtgaaccaggagcaaaacaaggttctgtggattcctgcctgtcctctatag

SEQ ID NO: 114794 - DNA, 5760 bp, Artificial Sequence
  Description of Artificial Sequence: Synthetic coding sequence
atggaaccacagcgccgcgaattactggcacagtgtcaacaaagtttagctcaggctatgaccgaggtggaggcagtgctcggcctactcgaggcagccggggcgttgtcccccggggaacgaaggcaactcgatgaggaggcaggcggtgccaaggctgaactgctcctgaagttgcttcttgcaaaggagcgggaccatttccaggacctgagggccgcgctggagaagacgcagccccacctgttacccattttgtatctgaacggcgttgtgggccccccacaaccagcggagggggcgggaagcacatacagtgtgctatctacaatgccgagtgactctgagtcttcttctagtcttagcagtgtcggtacgactggcaaagctcccagtcctccaccacttctaaccgatcagcaggtcaacgaaaaggtggagaacctgagtatccaactccggcttatgactagagagcgaaacgaacttcgaaagagactcgcctttgcgacacatgggactgcattcgacaagagaccctatcaccgtctcaacccggactacgagcggttaaagatccagtgtgtgcgcgccatgagtgacttgcagtctctgcagaatcagcatacgaatgccctgaagcgatgcgaagaggttgccaaggaaaccgacttctatcacaccttacacagcagactgctctccgatcaaaccagactgaaggatgatgtcgacatgctgcggagggagaatggtcagttgctgagggaaagaaacctgcttcaacagagttgggaagacatgaagcgcttacatgaggaggaccagaaagagatcggggatctgcgcgctcagcaacaacaggtgctgaagcacaacggctcttcggagattctcaacaagttatacgacaccgcaatggacaagctggaggtggttaaaaaggactatgacgccttgcgtaagcgttactccgagaaagtcgcgattcacaatgcagacctgtctaggcttgagcagctgggagaggaaaaccagaggttgctgaagcagaccgagatgttgactcagcagagggacactgcgatccagctgcagcaccagtgtgccctcagtctacgcagatttgaggcaatccatcacgagctgaacaaggcaaccgctcagaacaaggacttacaatgggaaatggagctgctgcagtccgaactaactgaactgcgaacgactcaggtgaaaaccgctaaagagtccgaaaagtatcgcgaggagcgtgatgcagtttatagcgaatataaacttatcatgtcagagcgcgaccaggtcatctcagaacttgataagttgcagaccgaggtagaactggcggagtctaaactcaagtcgtctacaagtgaaaaaaaagctgccaatgaagaaatggaagctcttcgccagatcaaggacacagttactatggacgccgggcgcgcaaataaggaagtggagatcctacgtaaacagtgcaaagcattgtgccaggaactgaaggaagccctgcaagaggcagacgtggccaagtgcagacgggactgggccttccaagaaagggacaaaatcgtcgcagaaagagactccatcaggacactgtgcgataatctgcggcgggagagagaccgggcggtgtcagagttggcagaggcgctgaggagtctggacgatacgcgcaagcagaaaaatgatgtgagccgggaactgaaagaactgaaagaacagatggagagccaattggagaaagaagcccggtttaggcagctgatggcacattcttctcatgatagcgcaattgacaccgattctatggaatgggaaaccgaggtagtggagttcgagcgcgagaccgaggacattgatctcaaggcactcggtttcgatatggcagagggtgtaaacgagccatgctttcccggagactgcggcatcttcgtgactaaggtggataaggggtcgatagccgatggccggctgagggtaaatgattggcttctgcgtattaacgacgtggacttgattaacaaggacaaaaaacaagctattaaagcccttctgaatggagaaggcgcaatcaatatggtcgtcaggaggcgaaaatctctaggaggaaaggtcgtgactcccctccatattaacttgagcgggcagaaggacagtggtatctcgctcgagaacggagtgtacgctgcggccgtcttgccaggctcaccggccgccaaagaagggagcctggcagtcggagataggatcgtagctattaacggaatagccttggataataagtcattgaatgagtgtgagtccctgctgcggagttgccaggattcacttaccctgtcattgctaaaagtttttcctcagtcctcatcttggtcaggccaaaatatctttgagaacatcaaggactcagacaaaatgctgtctttcagggctcacggccccgaagtgcaggctcacaataaaagaaatctgattcaacataataacagcacgcaaactgacattttctacaccgacaggctcgaagaccggaaggaacctggcccccctggcggatcttctagttttttgcataagccctttcccggaggacccctgcaagtctgtccacaggcctgcccatcggcctctgaaagaagcctctcatcctttcggtctgacgccagtggcgaccgcggctttggtctggtggatgttcgtgggcgccggcctctcttgccattcgagaccgaagttgggccctgtggagttggggaggccagcctcgacaaagctgattccgaaggcagtaattctgggggcacttggcctaaagcaatgctgtcgtccacggctgttcctgaaaaactgagtgtgtataaaaaaccaaaacagcgtaagtccattttcgaccctaatacattcaagagaccccaaaccccccccaagatcgactacctgctcccgggcccagggcctgctcacagtccacaacctagcaaacgggcgggcccattaactccgccgaagcccccaaggcggagcgatagcattaaattccagcatagactcgaaacttcttctgaaagtgaggccaccctggtgggttcatcacctagcacttctccaccttccgcgctgcctccagatgtggatcccggagaacctatgcacgcatctccaccccgaaaggcacgggttcggatcgcctcctcatactaccctgagggcgacggcgactcatcacacctgcctgctaaaaaatcctgtgatgaggacctcaccagccagaaggtggacgaactgggacaaaagcggaggcgtcccaaatcagcaccctcctttaggccgaaattggcgcccgtcgtgattcccgctcagtttctcgaggagcagaagtgtgtgcccgcgagtggagaactgtccccagagttacaggaatgggcaccatactctcccggccactcaagccgacatagtaatcctcccctctacccatcaaggccaagcgtcggaacagtaccccgttcgttgaccccaagtaccaccgtctccagcatcctgagaaaccctatttatacggtccgctcccaccgagtagggccttgttcgtcccctcctgctgcaagagacgccgggcctcaggggctgcacccatcggtgcagcaccagggacgcctttccttggacctgtctcatcgcacttgcagtgattacagcgagatgcgcgccacgcacgggagcaatagtctccctagctcagctcgccttggatctagttccaacctgcagttcaaagctgagcggatcaagataccaagcactccccgatatccgcgttccgttgtcgggtcggagcgaggctcagttagccacagcgagtgttcaacccccccccagtcgcctctcaacatcgacaccttgtcatcctgctcacagtctcagacgtcagcaagcaccctgccccgcattgctgttaaccccgcctcattgggagagcggagaaaagatagaccctacgttgaagagccacgccatgtgaaagtacagaaggggtctgaaccgctggggatctccatcgtcagtggcgagaagggaggcatctacgtgtcaaaagtaacagtcgggagtatcgcccaccaggctggactagagtatggtgatcagctattagaattcaatggtattaacctgcgaagcgctaccgagcagcaagctcgtctaatcatcgggcagcagtgcgacacaataacaatcctggcccagtataacccgcacgtacatcagctcagtagccactctcggagctcaagtcacttggatcccgcagggacacacagtacattacagggatccggaacaacaacccctgaacacccttcagttattgacccattgatggaacaggatgagggacccagtacccctccagccaaacaatctagctcaaggatcgccggggatgcgaataagaagacacttgagcccagagttgtgttcatcaaaaagtctcagctcgagcttggagtgcatctgtgcggcggaaacctccacggagttttcgtggccgaggtagaggacgattctcctgcgaaagggcctgatgggttagtacctggcgatctgattctcgagtatggtagcctggacgtgcgcaataagaccgttgaggaagtgtatgttgagatgctcaagcctcgtgacggcgtgcggcttaaggtgcagtaccggcccgaagaattcacaaaggccaagggactcccgggcgactctttttacatcagggctctgtatgacaggttggcagacgtcgagcaggaactgtccttcaagaaggacgatatactttacgtagatgatactctccctcagggaactttcggcagttggatggcttggcaactcgatgaaaatgcacagaaaatccaaaggggccagataccctcaaagtatgtaatggaccaagagttcagccggaggttgtcgatgtcagaagttaaagatgacaactcagcgactaaaacattatcggccgctgctagaaggtccttctttagaagaaagcataagcacaagcgaagtgggagtaaagacgggaaggatttgcttgctctggacgccttctcatctgactcaatcccacttttcgaggactcggtgtcactggcctaccagcgggttcaaaaagtcgactgcactgcgttacgcccggtcctcattctggggccccttcttgacgtggtgaaggaaatgctagtgaatgaggcccctgggaaattctgtaggtgcccactggaggtcatgaaagccagccaacaggctatcgagcgcggcgttaaggactgtctcttcgtggactacaagcggcgttccggacatttcgacgtgacaaccgtcgctagcatcaaagaaattacagaaaagaaccgccattgtctgctcgacatagcaccacatgctatcgagagactccaccatatgcatatttacccgattgtgatatttattcattacaagtccgccaagcatatcaaagagcagcgggatcctatatacctccgggataaagtgacccaaagacatagcaaggagcaattcgaggccgctcagaagctggagcaggaatactctcggtatttcactggtgtcatacagggcggggccctgtccagcatctgtacacagatcctggccatggtgaatcaagaacagaataaggtcctctggatcccagcctgtccactttag

SEQ ID NO: 114795 - DNA, 2052 bp, Artificial Sequence
  Description of Artificial Sequence: Synthetic coding sequence
atggagccacagagacgggagttgctggcccagtgccagcagtctttagctcaagccatgacagaggtcgaggccgtgctggggttactagaggctgccggagccctgagtccaggcgagaggagacagttagacgaggaagcggggggtgcgaaggctgaactcttacttaagttactcctcgcaaaggagcgcgaccattttcaagacctgcgggccgcgctggaaaagacacagcctcatttgctgcctatcttgtacttaaacggggttgtcggcccccctcagccggctgaaggcgctggctccacgtattccgtcctgtctacaatgcccagtgatagcgaatcttccagctctctgtcaagcgtggggactacggttaagcatctgcgcgaacagatggagtcccagctggaaaaagaggcaagatttagacaacttatggctcactcctctcatgatagcgccattgatacagattcaatggaatgggagaccgaagtggtagaattcgaacgcgaaacggaagacattgatctcaaggctttggggtttgacatggccgaaggtgtcaacgaaccatgtttccccggcgactgcggaattttcgtgacaaaagttgacaaaggttcaatcgcagacggccgcctgcgagttaacgactggcttctgcgcattaatgatgtggatctcataaataaagacaaaaaacaagccatcaaagccttactcaacggcgagggtgctattaatatggttgttcgaagacgaaaatctctcggggggaaagttgtgacaccattgcacataaatctatccggacagaaggactccggaatatcactcgagaacggcgtctacgcggccgccgtcctgcccgggagcccagctgcaaaagaaggcagcctggccgtgggcgatagaatcgtggccattaatgggatcgcacttgacaacaagagtctgaacgagtgtgagagcctgctccgtagctgtcaagactctctaacgctgtctcttctcaaggttttccctcagagtagttcctggtcagggcaaaacatcttcgaaaacatcaaggattcagataagatgctgtccttcagagcccatggacctgaagtccaggcccacaacaagaggaacctgatccaacataacaacagtacccaaaccgatatcttctatactgatcgccttgaggaccggaaagagccgggacctccaggaggaagctcttccttcctgcataagccctttccgggtggccccctacaggtgtgtccgcaggcctgtccatctgcttccgaacgatcgttgtcttctttccgaagcgatgcctccggcgacaggggatttggcctggtagatgtgagaggacgcagacccctcctgccttttgaaactgaggtgggcccatgcggtgtgggcgaggcatcactcgataaagctgactctgagggcagtaacagtggcggaacgtggccgaaggctatgctctctagcaccgccgtccccgaaaagctgtctgtgtataaaaaacctaaacagcgtaaaagcatctttgatcccaacacatttaaaaggccccagaccccccccaagatagactatctgttgcctgggcccggccccgcccactccccccaacccagtaaacgtgccggaccactgacaccacccaaacctcctcgaaggagcgactctattaaatttcagcacagactcgaaacatcatcggaatctgaggctaccctggtcggttcaagtccttcaacgtccccacccagcgccctgccaccagatgtggatccgggtgaacctatgcacgcatcaccccctcgcaaggccagagtgcggattgcttcctcctattaccctgagggagacggcgacagctctcatctgcccgccaagaaatcctgcgatgaggacctgacttcgcagaaggttgacgagctggggcagaaacgaagacgccctaaaagcgcgccttcttttaggccaaagctggcccccgtggtgatccccgcacagtttcttgagtag

SEQ ID NO: 114796 - DNA, 2643 bp, Artificial Sequence
  Description of Artificial Sequence: Synthetic coding sequence
ggcgccataaatatggtcgttcgccgacggaagtctctgggcggaaaagtcgtaacaccattgcatatcaacttatccggccaaaaggacagcggcatttcccttgaaaatggtgtctatgcagcggccgtgctgccaggttctcccgccgccaaggaggggagcctggctgtgggtgaccgaatcgtcgcaatcaatggtattgcgctggacaacaagtccttgaatgaatgcgaatcgctgcttcggtcctgtcaggatagtctgacactgtccctcctgaaggagcagaagtgcgtgccggcttccggagaattaagcccagagcttcaagagtgggcaccatacagtcccggtcactccagccggcactctaacccccctctctatccctctcgacctagcgttggcaccgttccccgatcgttgactccttccaccacggtcagctcaattctacgaaatccaatatacaccgtgcgctctcatcgggtgggcccatgctcctcccccccagcggctagggacgctggacctcaaggactgcatccttctgtacagcaccagggtcgcctgtcactcgacctcagccatcgcacatgcagtgactactccgaaatgagggccacccacggcagtaactctctgccatcctcagcacggttgggatccagttcaaacctgcagtttaaggcagaacgtatcaaaattccatcaaccccaaggtacccccgctcagtcgtaggttcagagaggggatccgtctcacatagcgagtgttccaccccgcctcagtcacccctgaacatcgacactctgagtagctgcagccaatcacagacgagtgcgtcgactctgccgcggatcgccgttaatcctgcctcactgggggaacgccgtaaggacaggccgtatgtagaggagcctagacacgtgaaggttcaaaagggaagtgaaccactgggcatctctattgtgagtggcgagaaaggaggcatctatgtgtccaaggtgactgtgggtagcatcgctcatcaggcgggcctggagtacggggaccagttgctggagttcaacggtatcaatcttagaagtgccactgaacagcaagcaagacttatcatcgggcagcagtgcgacactatcacaatcctagcgcagtataatcctcacgtccaccaactttccagtcactcccgatcttcttcccatctggatcctgcaggaacccattcaacgctgcagggcagcggcactacaacaccggagcacccaagcgtgattgatcctctgatggaacaagatgagggtccatccacaccacctgcaaaacagagcagctccaggatcgctggagatgccaacaagaaaactctagaacccagggttgtgttcatcaagaagtcccagctggagctgggagtgcatctatgtggaggaaacctgcatggcgtgttcgtggcggaagtcgaggacgacagtcccgccaaaggccctgatgggctggtgcccggcgatctgatcttggagtacggctcattggatgtgaggaacaagacggtggaggaggtctatgtggagatgctgaagcctcgcgatggcgttcgtcttaaagtacagtataggcccgaagaatttaccaaggccaaaggtctaccgggtgacagcttttacatcagagccctatacgataggctagccgacgtggagcaggaattaagctttaagaaagacgacattctgtacgtagatgataccctgccccagggtacattcgggtcatggatggcttggcagctggacgagaatgcacaaaagatacagaggggacagatcccttcaaaatacgtgatggatcaagaatttagtagaaggctgagcatgtctgaagtcaaggacgacaattctgccacaaaaaccctgtctgccgctgctagaaggtcatttttcaggcgaaagcataaacacaagcgcagcggttcaaaggacgggaaggatctgttagctctggatgctttttcatcagatagcatacctctttttgaggacagcgtatcattagcctaccagagagtccagaaggtggattgcacagcacttaggcccgtgcttattttaggccccctgcttgatgtggtcaaagagatgttggtcaacgaagccccaggaaagttttgccgctgccctttggaggtgatgaaggccagtcaacaggctatcgagagaggtgtcaaagattgcctgttcgtggattacaaacggcgcagtgggcactttgacgttactacggttgccagtatcaaagaaattacagaaaaaaacagacactgccttctcgatattgctccgcacgcaattgaaaggcttcatcatatgcacatttatcctatcgttattttcattcactacaaaagcgctaagcatattaaagagcagagggaccccatttatttgcgggacaaagtgacgcaacgccattcaaaggagcagtttgaggccgctcaaaaactggaacaggaatactcccggtattttacaggggtgatccagggcggcgctctttcttccatatgtactcaaattctcgccatggtcaaccaagaacagaataaggtgctttggattccggcttgtcctttgtag

SEQ ID NO: 114797 - DNA, 3237 bp, Artificial Sequence
  Description of Artificial Sequence: Synthetic coding sequence
atggcacccaggaagcgcggtgggcgcggtatttctttcatcttctgttgctttcggaacaatgatcacccagaaatcacttatcgcctgcgcaatgactcgaatttcgcattacaaaccatggaacccgccctccctatgccccctgtagaagagctagacgtgatgttctcagaactggttgatgagttagacctgactgataagcaccgggaggcaatgttcgccttgcctgccgagaagaagtggcagatctattgctccaagaagaaggaccaagaagagaataagggtgctaccagctggcctgaattctacattgaccagttgaactccatggccgccagaaaatcgcttttagccctggagaaggaggaggaggaggaacggtcaaaaactattgagtcgttgaaaaccgcactgcgcactaagcccatgaggtttgttaccagattcatcgatctcgatggtctgagctgtattctgaactttctgaagactatggattacgagacgagcgagtcacgcatccatacctctttaatcgggtgtattaaagctctgatgaataattcccagggtagagcccacgttctggctcattccgagagtatcaatgttatcgcgcaatcactatctacagaaaatataaagactaaagtcgccgtactggaaatcctgggggcagtatgtctcgtcccaggtggacataagaaggttctccaggccatgcttcattatcagaaatacgcaagcgagagaactcggttccagacactgataaacgaccttgacaagtctaccggtcggtaccgcgatgaggtttctcttaaaactgctataatgtctttcatcaatgcagtcctctcccagggggctggcgtcgagagcttagacttcaggctgcacctgagatatgagtttctgatgttaggaattcagccagtgattgataagttgcgagagcacgaaaactctactcttgaccgacacttagatttcttcgagatgctgcggaatgaagacgaactcgagtttgccaagcgcttcgaactggtgcatattgatactaagagtgccactcagatgtttgaactgacccgcaaacggttaacgcactcggaggcatatccccacttcatgagcatactgcatcactgtttgcagatgccctacaaaaggtccggcaacacagtgcagtattggctccttctggataggattattcagcagatcgtaattcagaacgacaaaggacaggacccggacagcacccctctggaaaacttcaacataaaaaatgtggtgcggatgcttgtgaacgagaatgaagtcaagcagtggaaagagcaggctgagaagatgagaaaggagcacaacgagctacagcagaaactggaaaagaaggagagggagtgtgatgccaaaacccaggagaaggaggagatgatgcagacactaaataagatgaaagaaaagcttgagaaagagactacagaacacaagcaggtaaagcaacaagtggctgatctcacggcacagctccacgagctgagccggcgggctgtgtgtgcctcaatccccgggggaccatcccctggcgcacccggaggcccgtttcccagctccgtgccaggcagcctactgccacccccgcctcccccccctcttcctggcggtatgcttccacctccaccacctcccttgcctcctgggggtccacctcccccaccaggacctccaccgctcggcgccataatgccacctcctggcgctccgatggggcttgccttgaaaaagaaaagcatcccccagcccaccaacgcactgaagagctttaactggtctaaacttcctgagaataagctcgagggcaccgtgtggactgagatcgatgatacaaaagtatttaagatcttggatctcgaagaccttgagagaacctttagcgcttatcagagacaacaagatttctttgttaactccaattccaagcaaaaagaggcggatgccatcgacgacactctctcgtctaaactgaaagtcaaagaactgagcgtcatagatgggaggagggcacagaattgtaatatattgctgagccgattaaaattgtctaacgacgaaatcaagcgagccatactcacaatggacgaacaggaggatctcccaaaagatatgctcgaacagttactaaaattcgttccggagaagagtgacatcgatctgttggaagaacacaaacacgagctggatcgtatggccaaagccgaccggttcctgtttgagatgtcaaggattaaccattatcaacaacgactgcagagtctttactttaagaaaaagttcgccgaaagagttgccgaggtgaagccaaaggtagaagcaatccggagcggcagcgaagaagtcttccggtccggagctctcaaacagctcctggaggtggtgctagccttcgggaattacatgaataaagggcagcgcggcaacgcatacggcttcaaaatctcttctttgaacaaaatagccgataccaaatcatcaatcgacaagaatataaccctgctccactatttgattaccatcgtcgaaaataaatacccttccgtcctgaacttgaatgaagaattacgcgatattcctcaggcagccaaggtgaatatgacggagctggataaggagattagcactctgcggtctgggttgaaagcggtcgagaccgaactggaatatcaaaagtcccaacccccacagccaggggataagttcgtgagcgttgtctcccagttcatcacagttgcgagctttagcttctcagacgtggaggatcttctcgccgaagctaaagatttgtttacgaaagctgtgaaacactttggcgaggaagcggggaagatccaaccagatgagtttttcggaatcttcgaccaatttttacaggctgttagcgaagcaaaacaggagaatgaaaacatgagaaagaagaaggaggaagaagagcgccgtgcaaggatggaggcccagcttaaggaacagcgagagagggagcgtaaaatgcgaaaagccaaagagaattccgaggaatcgggtgagtttgacgatctagtctccgcactgcgatccggcgaagtgtttgacaaagacctcagtaagctgaagcgcaatcgaaagcggatcaccaatcaaatgacagattcctcccgtgagaggccaattactaagctgaatttttag

SEQ ID NO: 114798 - DNA, 2649 bp, Artificial Sequence
  Description of Artificial Sequence: Synthetic coding sequence
atggcacctcgtaaaaggggcggtcgggggattagcttcattttttgttgcttccgcaataacgatcatcctgagatcacctaccgtctgcggaacgatagcaatttcgccctgcagaccatggagcccgctctgccgatgcctcctgtagaagaacttgacgtgatgttttccgagctggtcgacgaattggaccttacagacaaacacagagaagccatgttcgccctaccagctgagaagaagtggcaaatatattgctctaaaaaaaaggaccaagaggaaaataaaggagctacaagctggcccgaattctacattgaccagttaaactcaatggccgctcggaagtctttgctcgccctggagaaggaggaagaggaggagcgttccaaaaccattgaatccctcaaaaccgcactgaggacaaagccgatgcgtttcgttacaagatttatcgatctggatggtctgtcatgtatattgaactttctgaagactatggattacgagacatcagaatctcgaatacataccagtcttatcggttgtattaaggctctaatgaacaatagccaggggagggcacatgtgttggctcattctgagtccatcaatgttatagcccagtcactgagcaccgagaacataaagaccaaagtggctgtgctcgagattctgggagctgtctgtttggtccccggaggccataaaaaagtgctgcaagctatgttacactatcagaagtatgccagcgagagaaccaggtttcagacactcataaacgacctggataagtccacggggcgttaccgcgatgaagtgtccttgaaaaccgctattatgtcgttcattaatgcagtactgagtcagggcgcgggtgtggaatctctggattttcgcttgcaccttcggtacgagtttcttatgctcggcattcagcctgtaattgacaagttacgggaacacgagaatagtactttagacagacacttggattttttcgagatgttacgcaacgaggacgagctagagttcgctaaaagatttgaattagtccacattgataccaaaagcgctacgcagatgtttgaactgacacgcaagaggctgacacactccgaagcctacccacacttcatgtcaatattacaccactgtttgcagatgccttacaaacgctcaggcaatacagtgcagtattggctgctgctcgaccggataatccagcaaatcgttatccagaatgacaagggacaagatcctgattctacccctttagaaaatttcaacataaaaaacgtggtacgaatgctggtgaatgagaacgaagtgaagcaatggaaagagcaagccgaaaaaatgcggaaagagcataacgaattacagcagaagctcgaaaagaaggaaagggagtgcgatgccaaaacccaggagaaggaagaaatgatgcagactctgaacaagatgaaggaaaagctggagaaggagacaacggagcataagcaggtgaagcagcaggtcgctgatctaacagcacagctgcacgagctgtcaaggagagcagtgtgtgcaagcatacccggcggaccaagcccaggtgcccccggagggcctttccctagcagcgtgcccggatccctgctaccccccccccccccccctccccttccaggcggcatgcttccccccccaccccccccattaccacccggcggcccgcctccgccaccaggcccccccccactcggcgcaataatgccccccccgggggcccccatgggattagctttgaagaagaaatcgatccctcagcccaccaatgcccttaagagctttaattggtctaagctgcctgagaacaagctggaaggcaccgtctggactgagatcgatgacaccaaggtcttcaagatcctggacctcgaggatttggagcgaacgttttctgcctaccagcggcagcaagattttttcgtaaactccaactcaaaacaaaaggaggctgacgctatcgatgatacactttcctcaaaactgaaggtgaaggagctctctgtcattgatggtcgacgggcccaaaactgcaacatcctgctgtcccggctcaagctgtcaaacgatgagatcaagagagccatcctcacgatggatgagcaggaagacctccccaaggatatgctggaacagctactcaagtttgtgcccgagaaatctgatattgatctcctcgaagagcataaacatgaattggatcgcatggccaaagctgatcggttcctgtttgagatgtcaagaattaaccactaccagcaaaggcttcaaagcctctacttcaagaaaaaatttgctgagcgagtggcctttggcaattacatgaacaagggtcaacgcggcaacgcctatggcttcaagatctcttctttaaataagatcgctgacacgaagtcttcgattgacaaaaatatcaccctgctgcactacctcattacgatcgtcgagaataagtatccatctgtcctgaatctcaacgaggaactgagggacatcccgcaggctgccaaggtaaagagttggaatatcagatcactcagccctcatagtcctgaaatcagcctctgcctcctgtcagcttcttccagtcaatag

SEQ ID NO: 114799 - DNA, 3207 bp, Artificial Sequence
  Description of Artificial Sequence: Synthetic coding sequence
atggctccccgcaaaagaggcggtagggggattagcttcatcttttgctgctttagaaacaacgaccacccagaaataacttaccgactgaggaacgactccaattttgccctgcagacaatggagcccgccttgcctatgcctcccgttgaagaactggacgtgatgttctctgaattagtcgatgagctggacctcacggataaacatcgagaagccatgttcgccctcccagccgaaaaaaagtggcagatctactgttctaagaagaaggaccaggaagaaaataaaggcgccacctcttggcctgagttctacatcgatcaactgaactctatggctgctcgaaagtccctactcgccctggaaaaagaagaagaagaggagaggtccaagacaattgagtccctgaaaactgccctccgcacaaagcccatgagatttgttacgcgcttcatcgatttagacgggctttcatgtatcctcaacttcctcaaaactatggactatgagacgtccgaaagtcgcattcacacatctctgatcggctgcataaaggcgctgatgaacaacagccaaggccgcgcacacgtactagcgcacagtgaatccatcaatgtaatcgctcaaagcctgagcacagagaacatcaagacaaaggtggctgtacttgaaattttgggcgccgtatgtctggtacccgggggccataaaaaggtcctgcaggcaatgttgcattatcagaaatacgcatccgagcgcacacgcttccagactcttataaatgatctcgataagtcaacaggtcgctacagggacgaggtatctctcaagaccgcaattatgagtttcatcaatgccgtcctgagccagggcgctggtgtcgagagcctcgacttccgtctccacttgaggtacgagtttctgatgctcggaattcaaccagtcatcgacaaactgcgtgaacacgaaaactccaccctcgatagacatctggacttcttcgaaatgctgagaaacgaagatgagttagagtttgctaaaaggtttgaattagttcacatcgataccaagtccgccactcagatgttcgagctgactaggaaaagactcacgcattccgaggcttacccacacttcatgtctatcttgcatcattgtctccagatgccatataagaggtccggcaataccgtgcagtactggctgctgctagatcgtattatacagcaaatagttattcagaacgataaaggacaggatccagactctactccattggagaactttaacattaaaaatgtggttcgtatgctcgtgaacgaaaatgaagtaaaacagtggaaggagcaggcggagaagatgcggaaggaacacaatgaactacagcagaaactcgagaagaaagaacgcgaatgcgacgcaaaaactcaggagaaagaagagatgatgcagactttaaacaaaatgaaggaaaagctggagaaggagactactgagcataagcaggttaagcagcaagtcgctgacctgactgcccagctccacgaattgtcccggcgagctgtgtgcgcaagcatccccggcgggccttcccctggtgctcctggcggcccgttccccagctccgtcccaggaagtctgctgcctccccctcccccccctcctctgcccggaggcatgcttcccccacccccccccccccttccccccggcgggcccccgccaccacctgggccccccccactgggagccatcatgccacctcctggggcaccgatgggactggccctgaagaaaaaatccattccacagcccaccaacgctttgaaaagcttcaattggtctaaactgcctgaaaataaattagagggcacagtgtggactgagattgacgacactaaggtctttaagatccttgatcttgaagacctggagagaacattctcagcctatcagcgccaacagaaagaggcggacgcaatagacgacaccctgtcatccaaacttaaggtgaaggagttgagcgttatagatgggaggagggcacagaattgtaatattttgctctccaggctgaagttgtccaacgatgagatcaagcgggccatcctgaccatggatgaacaggaggacctgcccaaggatatgttggagcagctcctaaagtttgtgcctgagaagagcgacatcgacttgctggaggagcataaacacgagttagataggatggctaaggccgacagattcctgttcgagatgagtagaattaaccactaccagcagcggctgcagtcgctgtattttaaaaagaagtttgccgaacgtgtagccgaagtgaaacccaaggttgaggctatccgaagcgggtcagaagaagtatttcgttccggcgccctcaaacagcttctcgaggtcgtactggctttcggcaactacatgaataaagggcagcggggaaatgcctatggcttcaaaattagcagcctcaacaagatcgcagatacaaagagtagtatagataagaatattactttgctgcattacctcattacaatagtggagaacaagtacccctccgtgttgaatctcaatgaagagctgcgcgacatccctcaggcagctaaagtaaacatgactgagctggacaaggaaatcagcacgctcaggagcggactgaaggcagtcgagaccgagctggagtatcaaaaatcccagcccccacagcctggcgataagttcgtatctgtggtgtcacaattcataacagttgcttctttcagcttcagcgacgtcgaagacctcctggcggaggccaaggatcttttcactaaggccgtcaagcattttggcgaagaagcaggaaaaatccaaccagacgagttcttcgggattttcgaccaattcctgcaagcggtcagcgaagctaagcaagagaacgagaacatgagaaagaagaaagaggaggaagaacgcagagcccgtatggaggcccaactcaaagagcagcgggagcgagaaaggaaaatgaggaaagccaaggagaactccgaggagtctggcgagtttgatgatcttgtctctgctctccggtccggcgaagtgtttgacaaggacctgagtaaactgaagagaaacaggaagaggatcactaatcaaatgacagatagctcaagagagcgacctatcacgaagcttaatttctag

SEQ ID NO: 114800 - DNA, 3237 bp, Artificial Sequence
  Description of Artificial Sequence: Synthetic coding sequence
atggctccccgcaaaaggggaggtcgtggaatcagtttcattttttgttgcttccgcaacaacgatcaccctgagatcacttacaggctccgtaatgattccaatttcgcattgcagacaatggaaccagccctgccaatgccacctgtagaggagctcgatgtcatgttctcagaactcgttgacgaactggacctgaccgataaacatcgggaagccatgttcgctctgcctgctgaaaagaagtggcagatctactgcagcaagaagaaggatcaggaagaaaataagggggcaacctcctggcctgaattctacattgatcagctcaattccatggccgcacgcaaaagtcttcttgcgttagagaaagaggaagaagaggaaagatccaaaacaattgaaagcctcaagaccgctctgagaacgaagccaatgagattcgtgaccaggtttatcgatcttgacgggctgtcgtgcattttaaacttcctcaagacaatggactacgaaacatcagaaagtagaatccataccagtcttattgggtgtattaaggccctgatgaacaacagccaaggaagagcacacgtgcttgcgcatagcgagtctatcaatgtgatcgcacagtcactcagtaccgagaacattaaaactaaagtggcagtgctggaaatcctcggcgccgtgtgtttggtgccggggggccacaaaaaggttctacaggccatgcttcattatcagaagtacgcctctgagaggacacgtttccagaccctgattaatgacctggacaagtctactgggcgttatcgggatgaggtgagcctgaagacagcaattatgagcttcatcaatgccgtgctgtcccaaggagcgggggtggaatcactcgatttcaggctacacctgcgctatgaattcctcatgttgggtatacagcccgtcattgataagttgagagaacacgagaactcgactctggatagacatctggatttctttgaaatgctcaggaacgaggacgagctcgagtttgccaaacggttcgagctggtccatatagacacgaaatcggcaacacagatgtttgaactcactcgtaagcggcttacacattctgaagcctatccacacttcatgagcattctacaccattgcctgcaaatgccttacaaaaggagtggaaacactgtgcaatactggttactgctcgatcgcatcattcagcagattgtcatacagaacgataaaggccaggaccctgactctacgcctctcgaaaactttaacattaaaaatgtagtgagaatgcttgttaatgagaatgaggttaaacagtggaaggaacaggccgagaaaatgcggaaggagcacaatgaattacaacaaaagctggaaaaaaaggaacgggagtgcgatgctaagacacaggaaaaagaggagatgatgcaaaccctgaataaaatgaaggaaaagttagagaaagagaccaccgagcataaacaggttaagcagcaagtggcggatctgactgcccagctccacgagctgtcgcgaagagcagtgtgcgcctctataccaggcggcccatcccctggagccccagggggcccctttccctcttccgtgcccgggagtctgctgccgcctccccctcccccacctctgcccgggggcatgctccctcccccaccaccccccctccccccggggggccctcctcccccccctgggcccccccccttgggagccatcatgcctcctccaggcgcccccatgggtctggcactgaagaagaagagtattccccaaccgacaaatgccctcaagtcattcaactggtcaaaactccccgaaaacaagttagaaggcacagtatggacagagatagacgacacaaaagtatttaagatcttggaccttgaggacctagaaagaacattctctgcttatcagaggcagcaggacttcttcgtcaattctaattctaagcagaaggaggcggacgcaatcgatgacaccttatccagtaagttgaaagtaaaggagttgagcgtgattgatggccggcgcgcgcagaattgtaatatattgttatcccggctgaagctttctaatgatgaaataaaacgggccatactcaccatggacgagcaggaggacctccccaaagacatgctagaacagttgctcaaattcgtgccggaaaagtcggacatcgaccttttggaggaacacaaacacgaattagataggatggctaaagctgatagatttttgttcgaaatgtcacgaattaaccattaccagcagaggctgcaatccctttacttcaagaaaaaattcgcggagagagtggcagaagtgaagcctaaagtggaagctattcgctctggcagcgaagaagtcttccgctccggcgccttgaagcagctgctggaggttgttttggccttcggtaattatatgaacaaaggacagagggggaatgcctacggttttaagatcagcagtcttaataaaatagccgataccaagtcatcaatcgacaagaacatcacactcctccattaccttataaccatcgtggagaataagtaccccagtgtccttaatttgaacgaggaactgcgcgatatcccccaggctgccaaggttaacatgacggagctagacaaggagatttcaaccttgcgctcgggactgaaggcagttgagaccgaactagaataccagaagtcacaaccaccacaaccaggcgataaatttgtttccgtggtctcgcagtttatcactgtggctagctttagcttcagtgacgtcgaagatctgttggccgaggcaaaggatttgttcaccaaggccgtaaaacacttcggcgaggaagccggcaagatccagccggatgagtttttcgggatcttcgaccagttccttcaagcagtgagcgaggccaagcaggagaatgagaacatgcggaagaagaaagaagaggaggaaagacgggcgaggatggaggcccagttgaaagagcagagagagcgcgagcgcaaaatgcgtaaggccaaggagaactcagaagagagcggcgagttcgacgaccttgtgagcgctcttcggtctggagaggtatttgataaggacttgtcgaaactgaagcggaataggaagcggatcacaaatcaaatgaccgatagtagccgtgagcgcccaatcactaagcttaatttctag

SEQ ID NO: 114801 - DNA, 3207 bp, Artificial Sequence
  Description of Artificial Sequence: Synthetic coding sequence
atggctcctcggaaacgttcccatcatggcctaggattcctgtgctgctttggagggagtgacatacctgagattaacctgcgggacaaccacccgctgcagtttatggagttcagctctccaatccccaatgccgaggagctgaacattagattcgctgagctcgtggacgagctggacctgacggataaaaaccgagaggccatgtttgcgttgccccctgagaaaaaatggcaaatatattgctccaagaagaaggaacaggaggaccccaacaagttggctaccagctggcccgattattacatcgaccggattaattcaatggcagccatgcagagcctatatgcttttgatgaagaagagaccgaaatgcgaaaccaagtggtcgaagacctaaaaaccgcgctgagaactcaaccgatgcggttcgtgacacggtttatcgagttggagggtttaacctgcctcctgaactttctgcgaagcatggaccatgcaacctgtgagtcacggatccacacctctctgatcggctgcataaaagcgttgatgaacaattctcagggacgtgcccacgtgttggcacagcccgaagccattagcaccatagctcaaagtctccgaaccgagaacagcaagactaaggtggctgtcctcgaaattctgggagcagtttgccttgtgcctggcggacataaaaaggttctccaggccatgctccactatcaagtgtacgctgctgagcggactagattccaaactttactgaacgagcttgaccgaagccttggtcgatatagagacgaagtgaacctcaagacagccattatgtcattcattaacgcagttttgaatgctggcgcaggtgaggacaatctcgaatttagactgcatctgaggtacgaattcctaatgttgggcatccagcctgtgatagataagctcaggcagcacgagaatgctatactggataaacaccttgactttttcgaaatggtgaggaatgaagatgacctcgagttagccaggcggtttgacatggtccatattgatactaagagtgcctctcagatgtttgaactgattcataagaaactgaaatacaccgaggcttatccttgcctgctaagcgttttgcatcattgcttgcagatgccttataaacgaaatggaggctactttcagcagtggcagctgctggaccgaatccttcagcagatcgtactacaggacgaacggggcgtggaccccgatttggctcccctggagaattttaatgtgaagaatatcgtgaacatgctcatcaacgaaaatgaggtgaagcagtggcgggaccaggcggaaaagttcagaaaggagcacatggagctggtttcaagacttgagagaaaagagagagagtgtgaaaccaaaacattagagaaagaggagatgatgaggactctgaacaagatgaaagacaaattggcgcgggagagtcaagagctccgacaggcccgcggccaggtggcggaactcgtggcacagctaagtgaactgagcacaggccctgtgagttctcccccccctcccgggggaccacttaccctctcaagctccatgactaccaacgacctaccccccccacctccacctctgccttttgcttgttgtccccctccccccccgccacccctaccacctggaggtccaccaacaccgccaggtgcacctccttgcctggggatggggctccctctgccgcaggatccttacccctccagtgacgtgcctttgcggaaaaaacgcgtgccccagccctcacacccattgaaaagtttcaactgggtgaagctgaacgaggaacgcgtcccaggcactgtgtggaatgaaattgacgacatgcaggtcttcagaattctggatctagaagatttcgaaaagatgttctccgcgtatcagaggcatcagaaggagctcgggtcaacggaggacatttacttagccagtcgcaaagtcaaggagctgagtgttatcgatgggagacgtgcccaaaattgtatcatcctattaagcaaactgaaactgagcaacgaagagattcggcaggccatcttaaagatggatgaacaggaggacctggctaaagacatgctcgaacagctcctgaagtttatccctgagaaatcagatattgatctgcttgaggaacataagcacgaaatcgagagaatggcccgtgctgaccgctttctgtatgagatgtctaggatcgatcactatcaacaaaggctccaggcactcttcttcaaaaagaagttccaggagcgactggccgaggctaaaccgaaggtggaggccattttgctggcaagccgagagctcgtacggtccaaaagattgaggcagatgctggaggtaattctcgctatcgggaactttatgaacaaaggtcaacgggggggtgcctacggctttagagtcgccagcctgaacaagatagccgacaccaaatcctccatagacaggaacatatccctattgcattacctgatcatgattttagagaaacatttccccgatatactaaatatgccaagcgagcttcagcatctgccagaagccgccaaagtgaacttggccgagctagagaaagaagtggggaatctgcgacgggggctgcgtgcagtcgaggtcgagcttgaataccagcgccggcaggttagagaaccttcagataaattcgtccccgttatgagcgattttataaccgtgtcctcctttagctttagcgaacttgaagatcagcttaacgaggcccgcgataaatttgcgaaggcactgatgcacttcggggaacacgattctaagatgcaacccgacgaattctttggaatcttcgatacctttttacaggcattctccgaagctaggcaggatctggaagccatgaggcgtaggaaggaggaggaggaaaggcgtgcccggatggaagcaatgctcaaagaacagcgcgagagagaacgctggcagaggcagcgtaaagtgctggctgctggatcctcccttgaggagggtggagaatttgatgatctagtcagtgctttacggtcaggcgaagtcttcgacaaggacctgtgcaagttgaaaaggagtcgcaaacgctcaggctcccaggcccttgaagttactcgagaacgcgccatcaatcgcttaaactattag

SEQ ID NO: 114802 - DNA, 3207 bp, Artificial Sequence
  Description of Artificial Sequence: Synthetic coding sequence
atggcccccagaaaaaggtctcaccacggcctggggttcctgtgttgcttcggggggtcggacattcccgaaatcaatctccgcgataaccatcccctgcagtttatggagtttagcagtcccattccaaacgccgaggagctgaacatccgcttcgccgagctggtggatgagctcgacctcacggataagaatagggaagctatgttcgccttaccccccgagaagaagtggcagatttactgcagtaaaaaaaaagagcaggaggacccaaataaactggctacctcatggcctgactactacatcgaccgtatcaatagcatggccgcgatgcaaagcctctatgctttcgacgaggaggaaaccgaaatgcgaaaccaggtggtggaagaccttaagacagcactacgtacccagccgatgcggttcgtcaccaggttcatagagctggaaggcctgacctgtttgctcaacttcttgcggtccatggaccatgcgacctgtgagtcccgaatccacacttctctgataggatgtatcaaagctcttatgaataatagccagggcagggcacacgtgctcgcccagccggaagctatttctaccatcgcccagtcgctgagaacagagaacagcaaaacaaaagttgctgtcttagaaatcttgggagctgtctgtctggttccagggggccacaagaaagttctgcaggcgatgctccattatcaggtgtatgcagccgagaggaccagattccagaccctcttaaacgagctggatagatctttggggagatatagggacgaggtcaacctgaagaccgccatcatgtcgtttataaatgctgtattgaacgccggcgccggagaagacaatttagagttcaggctccacctcagatacgaatttctgatgttgggaatacaaccagtgatcgataagctccggcagcacgaaaatgctatccttgataaacatctggatttcttcgagatggttcgtaatgaggacgacctcgagctggcaaggagattcgatatggtccacattgatactaagtccgcctctcagatgtttgagctgattcacaagaaactgaagtacaccgaggcgtacccctgtctgctgtctgtgctgcaccactgcctgcagatgccctacaagagaaacggcggttattttcagcagtggcagcttctcgatcggattctgcagcagatagtgctgcaagacgagcgaggagtagaccctgacctcgcccctctcgaaaacttcaatgtcaaaaatatcgttaacatgcttatcaacgaaaacgaggtgaagcagtggcgcgaccaggctgaaaagtttcgtaaagagcacatggaactggtgtcccgcctggagcgaaaagagcgggagtgcgagacaaaaacccttgaaaaagaagagatgatgagaacactgaacaagatgaaagataaactggcccgggagtcgcaggagctgcgacaagcacgcggtcaggtcgccgaattggtggcccagctgtcagaattaagtaccgggccagtgagctcaccgccaccacccgggggacccttgactctctctagttccatgactaccaacgatctccctccacccccaccccctctcccttttgcttgttgtcctcctccgcctcctccccccctaccaccagggggcccacctactcctccaggtgccccgccctgccttgggatgggcctccctcttcctcaggacccctatcccagtagcgacgtaccccttcgaaaaaagcgggtccctcaaccctcccaccctttaaagagtttcaactgggttaagttgaacgaggaacgagtgccaggtactgtgtggaacgaaatcgacgatatgcaggtgttcaggatactggacctggaggatttcgagaagatgttttcagcataccagaggcatcagaaggagctggggagcactgaagatatttacctcgcttcacggaaggtcaaggaactgagcgtgattgacgggagaagagcccaaaactgcattatcctgcttagcaagctcaagctgtccaatgaggaaattagacaagcgatcttgaagatggacgagcaggaggacttggctaaagacatgcttgagcaattgttgaaattcatcccggagaaaagtgacattgatttgctcgaagaacacaagcacgaaatcgaaagaatggctagggccgacaggttcctctacgaaatgtctcggattgaccattatcaacagaggctgcaggccctgttttttaagaaaaaattccaagagcgtctggccgaggctaagccaaaagtggaggcgattttgttagcatctcgcgaattagtcaggtctaaaaggctgagacagatgctggaggtgattctggcaatagggaatttcatgaacaagggacaaaggggaggtgcctacggattccgagttgcttccctgaacaaaattgctgataccaagagcagtatagataggaatatttccttgctccactacctgattatgatcctggaaaagcactttcccgacatattaaatatgcccagcgagctccagcatttgcccgaagcagccaaggttaacctagccgaactcgaaaaagaagtcgggaatctaagaagaggcctgcgcgccgtcgaagttgaactggaataccagagacgtcaggtcagagaaccttcggataaattcgttcccgttatgagtgactttatcacagtgagttccttcagtttttctgagctggaagaccagcttaatgaggcccgtgacaagtttgcgaaggctcttatgcactttggggagcatgattctaagatgcagccggacgaattctttggtatcttcgatacttttctccaggctttctcagaggcccgccaggacctggaagcaatgcgcaggaggaaagaggaggaggagcgacgcgctagaatggaagctatgctgaaagaacagcgcgagcgggagaggtggcagaggcagcggaaagtgctggctgccggtagctctctggaagaaggaggcgagtttgatgatctggtgtccgccttaagatctggggaagtctttgataaggatctgtgcaagcttaagcggagtaggaagcggtctgggtcccaggccctggaagttacaagggagagagctataaataggctcaactattag

SEQ ID NO: 114803 - DNA, 399 bp, Artificial Sequence
  Description of Artificial Sequence: Synthetic coding sequence
atggctcctagaaagcgttctcaccacgggctcggcttcctgtgctgcttcggtggtagcgatatccccgagatcaatctccgggataatcatccccttcagtttatggagtttagcagccccatccccaacgcagaggagctgaacatacgatttgcagagctggtggacgagttagacctgacggacaaaaatcgagaggcaatgtttgctctccctcccgagaagaagtggcaaatctactgttcaaagaagaaggtgcctagcctgactccactggcgacaagccagggctcatggcacggcgtggcccttgcggcgcttgcctgttcatgtattcatctaatgtttatcacctgccaaccgtgctccaggtgctggaggaataattcagaatag

SEQ ID NO: 114804 - DNA, 3204 bp, Artificial Sequence
  Description of Artificial Sequence: Synthetic coding sequence
atggcccctcgcaagcggagccatcacggactgggctttctctgctgctttggcggaagcgatatccctgagatcaatctacgtgataaccatcctcttcagttcatggaattctcttcacctattccgaacgcagaagaactgaatatcagatttgcagagctggtcgacgaattggatcttactgataagaatagagaagccatgttcgctcttcctcctgagaagaagtggcagatatactgtagtaaaaagaaggagcaggaagaccccaataagcttgccacctcttggcctgattattatattgatcgtataaatagcatggccgccatgcagtccttgtacgccttcgatgaggaggagacagagatgcgcaaccaagttgtggaagatctgaagacagcattgaggacccagcccatgagatttgttaccagatttatcgagctcgaaggtctgacatgtctgctcaattttttgcggtcaatggaccacgccacctgtgaatcacgcatccacacctcccttatcggatgcataaaggcgctaatgaacaactcccaggggcgtgctcatgttttggcccaaccagaggccatatcaaccattgctcagtcgttgagaactgagaatagtaagactaaagtagctgtgcttgaaatcctgggcgccgtctgcctcgtccccgggggtcacaagaaggtgttacaggcaatgttgcattatcaggtctatgcggctgaacggactaggttccagacccttcttaacgaactagaccgctccctcgggcgatatcgggacgaggtgaacttgaagacagccatcatgagtttcatcaacgccgtgctaaatgcaggcgctggggaagataacttggagttcagactgcacctgcgttacgagttcttgatgctgggcatccagccagtaatcgataagctgcgacagcatgaaaatgccatcttggacaagcaccttgatttttttgagatggtgaggaacgaggatgaccttgagctggcccgtaggttcgatatggtgcatatcgatactaaaagtgcttcacaaatgttcgagctgattcataagaagctgaagtacactgaagcctacccttgtctgctttcagtgctccaccactgcctgcagatgccgtataagcgtaacgggggctacttccagcagtggcagttgcttgacaggatcttgcaacaaatagttcttcaggacgagaggggagttgacccggatttagcacccctggagaacttcaacgtgaagaacatagtgaatatgctgattaacgagaacgaagtcaaacagtggagggatcaagcagagaagttccggaaagagcatatggagttagtgtcaaggcttgagcggaaagaaagagaatgcgagacaaaaaccttagagaaggaagagatgatgcgcaccttgaataagatgaaagataagctggcccgtgagtcccaggagcttcgccaggcacggggccaagtggccgagttagtggcccagctatccgagttgtctaccggccctgtgtcatctccgcctcctccgggaggcccactgacactgagctcctcgatgaccactaacgatctgccaccgccacctccgccccttccttttgcctgctgccctccaccaccccctcctcctctgccccctggcgggcctcctacgccccccggagcacccccttgtctcggcatgggcctccccctgccccaagacccttacccttcttccgacgtgcctctgcgcaagaaacgcgtgcctcagcctagccacccactcaagtctttcaactgggtgaaactgaatgaagaaagggttccaggaaccgtttggaatgagatcgatgatatgcaggtttttcggatactggacttggaagattttgaaaagatgttttctgcttaccagaggcatcaaaaagagcttggatccaccgaggacatctacctagcgagtcggaaagttaaggaattgagcgtgatagacggaagaagagcccagaattgtattatcctcttgagtaagctgaagctcagtaacgaagagatcagacaggctattctgaagatggacgagcaggaagacctggcaaaggacatgttggagcagctgctcaaatttattccagagaagtccgatatagacctcttggaggagcataagcacgagattgaacgaatggcacgggccgaccgcttcctgtatgaaatgagtcggattgaccactaccaacaacggctacaggctctgttctttaaaaagaagtttcaggagaggctagcggaggccaaaccaaaggttgaagccattctgctggcttctcgggagctggtgaggtccaaacggctgagacagatgctggaggtaattttggccattggcaactttatgaacaagggccagcgcggaggagcgtatggcttccgcgtggcatccctcaacaagatagcagatacgaagtcatcaatcgataggaatatcagcctgctgcactacctgatcatgatccttgaaaaacatttcccagatattctgaacatgccttccgagctacagcacctgcctgaagctgcgaaagtaaacttggccgaactcgagaaggaagttggcaatctgcgtaggggactcagagctgtcgaggtgctggaataccaacgcaggcaggtcagggagccttccgataaatttgtaccagtcatgtccgattttattactgtgtcttctttctcgttctcagagttagaagaccaactgaacgaagcacgcgataaattcgccaaggctcttatgcatttcggcgagcatgacagtaagatgcagcccgacgaatttttcggtattttcgacacatttctgcaagccttttctgaggcaaggcaggatctagaagcgatgagacgacgaaaagaggaagaagagcgtcgtgctcgtatggaagctatgctgaaagagcagcgggaaagggaaaggtggcaacgacagcgaaaagtcctggctgccggcagttccctggaggaaggaggcgagttcgatgacctggtgagcgcgctaaggagcggcgaagtgtttgacaaagacctgtgcaagctcaagcgtagccgaaagcgctcgggaagccaggccctggaagtcacacgcgaacgcgccattaacaggcttaactactag

SEQ ID NO: 114805 - DNA, 1062 bp, Artificial Sequence
  Description of Artificial Sequence: Synthetic coding sequence
atgggggccctgctctgcgatcaccggtcctgtcggccgatatccctgaccgtcgccaaatgttgggatccaacaccccggtcatactttacagtgccacgggccgacccagtcagaccaattgaccccgccgcttggctatcacacactgctgctcttacaggcgccttgccacggtacgagctggaagaagctcccctcacggtgaaatccgatatgtcagccgtggtgagagtaatgcagttgcccgacagcggtctcgagatccgtgatagaatgtggctaaaaattaccattgctaacgccgtgatcggcgctgatgtagtggattggctgtacacccacgtggaggggttcaaggagaggagggaggcacgcaaatacgctagcagtctcctgaagcacggattcctgaggcacacagttaacaaaatcacgttctcggagcagtgttactatgtgttcggtgacctgtgtagcaacctggcgacacttaacctcaattcaggatcttcaggcacttcagaccaggatacccttgcgccattgcctcaccctgccgccccctggcctttggggcagggatacccttaccagtatcctggcccaccaccctgctttcctcctgcttatcaggatcctggtttctcctatgggagtggatctacgggttctcagcagagcgagggctcaaagtctagcgggtcaacccgttcctctcgccgagctcccgggcgagagaaggagcgcagggcagccggtgcagggggatctgggtccgaatccgaccacactgccccttcaggggttggctccagctggcgcgagcgccccgctggacaactgtcacgtggtagctcccctaggtcccaggctagtgcaaccgctccagggctcccccctccgcatccaaccacaaaagcttacacagttgttgggggacctccaggcgggccacctgtgcgggagttggcagcagtgccacctgagttgactggcagtagacaatctttccagaaagccatgggcaatccctgcgaattctttgtggatatcatgtag

SEQ ID NO: 114806 - DNA, 1335 bp, Artificial Sequence
  Description of Artificial Sequence: Synthetic coding sequence
atggccgagaccaaaattatttaccacatggacgaagaggaaacgccttacctggtgaagcttccggtggctcccgaacgtgtcacgctggcagacttcaagaacgtgctgagcaatcgccctgttcatgcttacaaatttttctttaagagcatggatcaggactttggcgtagtgaaggaggagatattcgatgacaacgctaaactgccttgcttcaatggacgcgtggtttcatggcttgtactagctgagggcgctcactctgacgccggctctcaggggacggacagccacacggacttaccaccacccctggagcgcaccggtggcattggcgattctagacctccatcctttcatcccaacgtggcgtccagccgcgatggcatggacaatgagactggtactgagtctatggtctctcataggcgggaaagggccagacggaggaatcgggaagaggctgcacggacgaacggtcacccgcggggggaccgcaggcgggatgtcgggctaccaccagactccgcttccacagctctatccagcgaacttgagtcttctagcttcgtggactcggatgaagatggatccacaagtcgattgtctagttccaccgaacagtcaaccagctccaggctgattcgaaaatacgctagtagtttattaaaacatggcttccttcgtcacaccgtgaataagatcactttcagcgaacaatgttattacgttttcggtgacctctgcagcaatcttgcaaccctgaatctgaacagcggcagcagtgggaccagcgaccaggataccctggccccactcccccatcctgccgcaccatggcctcttggccaaggatatccctatcagtaccctggaccacccccttgctttcctcccgcgtaccaggaccctgggttctcttatggctctgggtcaaccggttcacagcagtctgaagggagtaagagcagtggcagcacaaggagttctaggagagcacccgggagggagaaggagaggcgagccgcaggagctggagggagtgggtcagaatctgaccacaccgcaccttctggggtgggtagttcgtggagagagagacccgccgggcaactctctcgcgggagtagcccccgctcacaagcatctgcaaccgctcctggcttacctcccccccacccaacaaccaaggcctacaccgtggtgggcggtccccccgggggccctcccgtgcgggaactggctgcggtcccccctgagttgacgggatccagacaaagttttcagaaggctatgggcaacccatgcgagttctttgtggacataatgtag

SEQ ID NO: 114807 - DNA, 2088 bp, Artificial Sequence
  Description of Artificial Sequence: Synthetic coding sequence
atggcagagactaaaattatctaccacatggacgaagaagaaaccccttaccttgtcaagcttcccgtggctcctgaacgagtgacactcgcggatttcaaaaatgtgctgtccaataggccggttcatgcttataagttcttcttcaagtctatggaccaggatttcggagtggtcaaagaggagatttttgatgacaacgccaagctgccctgctttaacggaagagttgtctcatggcttgtactggctgagggagcccacagcgacgcgggctcacagggaacagatagtcatacggacctgccaccccctctggagagaacaggaggcataggcgactcacgtcccccttccttccaccccaatgtggcttccagtcgcgatggaatggacaacgagaccggcactgaaagtatggtatcccaccggcgcgagagagcccggagacggaatcgtgaagaggctgcacgcactaacgggcatccccgcggagatcggaggcgggacgttgggcttccccctgattccgccagcacagctttgtctagcgagctggaaagtagcagtttcgtggactctgatgaggatggatccacctccagactatcgagttctacagagcagagtacgtcatcccgactcatcaggaagcataagcgcaggcgacggaagcagaggctgagacaggctgacagggcctcgagcttctccagtattacagactctaccatgtccctcaatattgtaactgtaactcttaacatggagcgtcatcatttcctagggatttcaatcgttggacaaagtaacgataggggggatggtggtatctatattggctcgatcatgaagggaggcgccgtagccgccgacgggagaatagagcccggagatatgctgttgcaagtaaatgatgtgaattttgagaacatgtcaaacgacgacgcagtgcgggtgttgcgagagatcgtgagccagactggaccaataagcctaacagtggctaaatgttgggacccaaccccgcggtcatatttcacggtgccgcgcgccgaccccgtacgacctatcgatccagctgcatggttaagccataccgcagccctgacgggcgcactgccgcggtatggcaccagcccttgcagttcggcggtcactcgcacaagctctagctcgctcactagcagtgtccctggggccccccagctagaagaggcccccctgactgtgaaatctgatatgtcagccgtggttcgggtgatgcaacttcccgacagcggactcgaaattagagaccggatgtggttaaagatcaccatcgctaacgccgtcataggcgcggatgtggttgattggttgtatacccacgtcgaggggttcaaggaacggagggaagcgcgaaagtatgcttcctcattgttaaagcacggttttctgcgacacactgtgaataagattacattcagtgagcagtgctattacgtgtttggggatctgtgctccaatttggccaccctgaatttaaactccggaagctccggcacgtccgaccaggacacactggcccccttacctcatccggccgccccctggccactgggacaggggtacccctatcagtatcctggaccaccaccttgctttccgcccgcttaccaggacccgggattcagctacggcagcggaagcactgggtcacagcagagtgagggaagcaagagctctggctcaacacggtcttccagacgcgctcccggaagggagaaagagaggcgcgcggctggggcaggcggaagcggttccgaaagcgaccacaccgccccaagtggggtcggttcatcctggcgcgaacgccccgccgggcaattgtcccgcggttccagtccacggagccaggcaagcgccacagccccaggcctccctcccccccacccgacaacaaaagcttacaccgtggttggcgggccacccggaggcccacctgttcgggaactggcggccgtaccgccagaactgaccggaagtaggcagagctttcagaaagctatggggaacccttgtgagtttttcgtggacatcatgtag

SEQ ID NO: 114808 - DNA, 2013 bp, Artificial Sequence
  Description of Artificial Sequence: Synthetic coding sequence
atggcagagacgaaaataatctaccatatggacgaagaggaaaccccatacctggttaaactccccgtggcccctgaacgcgtgacactcgcagacttcaagaatgtgctgagcaaccgcccagtgcatgcctacaagttttttttcaaatccatggaccaggacttcggcgtagttaaggaagaaatttttgatgacaatgcaaagcttccgtgtttcaatggcagagtggtgtcttggctggttctggccgagggggctcactccgacgcgggttctcaaggaaccgactcccacaccgaccttcctccacccttagaaagaaccggggggattggggacagccgtcccccctcttttcatccaaatgtggcctcctcaagagacggtatggacaatgaaacggggaccgaaagcatggtgagtcaccgcagagagcgggcccggcggcgcaacagagaagaagccgcgcgaacgaatggccatccaaggggtgatcggcggcgcgatgtcggcctccctccggactctgctagcaccgcacttagcagcgagcttgaatcaagtagttttgtcgactccgacgaagatggctccacctcgaggctctcctctagcacagagcaatcaacaagctctcgccttattcggaagcacaaaagaagaagacggaagcagcggctgaggcaagcggatcgggccagctcattttcctccattactgactccactatgagtcttaacattgtcactgtgacacttaatatggaacgccatcactttctgggtatcagtatagtcgggcagagcaacgacaggggagatggcggtatttacattggttctatcatgaagggtggcgcagtcgctgccgacgggcggattgaaccaggagacatgctcctccaggttaatgacgttaattttgaaaacatgtctaacgatgacgccgtccgggtactgcgagagatcgtaagccagacgggacctatcagcctgacagtggccaaatgttgggatccaacaccccggagttatttcacagttcctcgcgctgaccccgttcgacccatcgatcctgctgcatggctcagccacactgcggcccttaccggtgcattacctaggtacgagctggaggaagcgccgctgactgtcaaaagtgatatgagcgcagtggttcgggtgatgcagctgcccgactccggcctcgaaatcagggacaggatgtggttaaaaatcacaattgcaaatgccgtaattggggccgacgtggtcgattggctctacacccatgtagaagggtttaaagaaagaagagaggctcgaaagtacgcttcctcgcttctaaaacatggctttctacgtcatactgtgaacaagattacattctctgaacagtgctattacgtttttggcgatttatgctcaaatttagccacgctgaaccttaattctggctcctcaggtacctctgatcaggacactctcgctcctcttccacatccagcagcaccttggcccctcggccaggggtatccctaccagtatcctgggccccccccttgtttcccacctgcttaccaagacccaggcttttcttatgggtcgggctctacgggatctcagcagtccgagggctccaagagttctgggtccaccaggtcttcccggagggcccctggcagggagaaggaacggcgggccgctggagctgggggcagtggttctgaatcagaccacactgcccccagtggtgtggggtcttcttggagggagcggcccgctggacagctgagtcgtggatcgtcacctcgcagtcaggcatctgcaacagccccaggactgcccccaccacatcccaccactaaagcctataccgttgtgggaggacctccgggcggtccacccgtccgggagctggctgccgtcccccctgagcttaccggatctcgccaatcatttcagaaagcgatggggaacccttgtgaattttttgtcgatataatgtag

SEQ ID NO: 114809 - DNA, 2151 bp, Artificial Sequence
  Description of Artificial Sequence: Synthetic coding sequence
atgggtgagaccaaaattatatatcacctggatgggcaggagacaccctaccttgttaaactgcccctgcctgcagagagagttaccttggccgacttcaaaggcgtgttgcagcggcccagctataaatttttctttaagagtatggatgatgatttcggcgtcgttaaggaggagataagcgatgacaatgccaaactgccctgcttcaacgggcgggtggtgtcatggctggtgtctgcggaggggtctcatcccgatccagccccattctgcgctgacaatccaagcgagttgccccctccaatggagagaacgggtgggatcggcgactcacgccctcctagcttccatccccacgctggagggggatctcaagagaatctggacaacgacactgagactgattctcttgtatcagcacagcgggagagaccacggagacgggatggtcctgaacacgccaccagacttaatggcaccgcaaaaggagaacgtaggagggaacccggtggttacgacagttcttcaacgctgatgagcagtgagctggagaccacttcattttttgatagcgatgaagacgactcaacatctcggtttagttcttccaccgaacagagtagcgctagccgcctgatgcgcagacacaaacggagacggaggaaacagaaagtgagtcggattgagagatcgtccagcttttccagtatcactgactctaccatgtcccttaacatcattacagtcacgctcaatatggaaaagtacaactttctcgggattagcattgtcgggcagtctaatgagaggggagatggcggcatttacatcggatctatcatgaaggggggagctgtggccgctgacggtcgtattgagcctggagacatgctgttgcaggtgaatgagatcaatttcgagaacatgtcaaacgacgatgctgtaagagtgcttcgcgaaatcgttcacaagccaggccctattactctaaccgtggccaagtgctgggacccctctcctcgaggatgcttcacattgccccgctccgaacccatcagacctattgatccagctgcctgggtgtcccacactgcagccatgactggtacgttccccgcatatgggatgagtccttcactttccacaataacaagcactagcagcagcataaccagcagcatccccgatactgagcgcctggacgactttcacttaagcattcacagtgatatggctgcgatcgtgaaggcaatggcatcgcccgaatccgggttggaggtgagggatcgtatgtggttgaaaataaccattcctaatgcgttcatcggctcggatgtggtggactggctctaccacaacgtcgaaggcttcaccgatcggagggaagctaggaaatacgcgagcaatttgctgaaagctggttttataaggcatacagtgaacaagattaccttctccgagcagtgttattatattttcggcgacctttgtgggaacatggccaacttaagtcttcacgaccacgatggtagttcaggtgccagcgatcaggataccctggcaccactgccacaccccggggcagccccatggcctatggcattcccgtaccagtacccaccccccccgcatccctataatccccacccagggtttccagaactgggatactcttacggtggaggctcagctagttcacaacattcagagggcagtagatctagcggctccaacaggagcggcagtgatagaagaaaagaaaaagaccctaaagccggcgacagcaagagcggaggctctgggtctgagtcagaccatacaacccgtagtagtctgcggggacctcgcgagagagcgcctagcgagaggagtgggcctgcggcgtccgagcattcccaccgttcgcaccactctctggcctcttcattaaggagtcaccatacccatccatcctacggccctccaggcgtacccccactttatgggccccctatgcttatgatgcctcccccccccgcggctatggggccacccggagcccccccagggcgggatctggcttctgtgccacccgagctgactgcatcacgtcagtcattcagaatggcgatgggcaaccccagcgaattcttcgtagatgttatgtag

SEQ ID NO: 114810 - DNA, 2172 bp, Artificial Sequence
  Description of Artificial Sequence: Synthetic coding sequence
atgggggagactaagatcatttatcacctggacgggcaggagaccccttacctcgtcaagctgcccttaccggccgaacgagtaacactggctgattttaagggagtcctgcagcggccaagctacaaattcttcttcaaatctatggacgatgatttcggcgtggtcaaagaggagatttcagacgacaacgcaaagctgccatgttttaatgggcgggtggtttcttggcttgtgagtgctgagggctcccatccggatccagctcctttctgcgctgataaccccagcgaattgcctcctccaatggaacgtactggagggatcggagactcccgtccccccagctttcaccctcacgcaggggggggctcacaggagaacctggacaacgatacagaaactgatagtctggtgtcagcacaaagggagagacctcgcaggcgagatggacctgaacacgccacgcgactaaatggaacagccaagggggagaggcgccgcgagcctggagggtatgactccagttccacattgatgtcaagcgagctggaaacgacatctttttttgattccgatgaggatgacagtacttcccgcttttcttcttccacagaacagtcttctgcgtcccgcctgatgcgaaggcataaacggcgaaggcgaaagcaaaaggtctcacgtattgaaaggagcagtagctttagctccatcacagatagtaccatgagcttgaacatcatcacagtcacactcaacatggaaaagtataactttttaggtatctccatcgtgggccaatcaaatgaaagaggcgacggcgggatctatatcggctccatcatgaagggcggggccgttgccgccgacggccgtatcgaacctggagacatgctcctgcaggtgaacgaaattaactttgagaacatgagtaatgatgacgccgtacgggtgcttcgcgagatcgttcataagccaggcccaataaccctgacagtggccaagtgttgggacccttcccccagaggttgttttactctgccgaggagcgagcccatccgcccaatagatccggctgcctgggtcagccacaccgctgctatgacaggcaccttcccagcctacggcatgtcaccgtctctgagcacgattaccagcacaagcagctccataacttccagtatcccagacaccgaacgcctggacgatttccacctttccatacactctgacatggccgcaattgttaaagcgatggcgagtccagaatcgggtttggaggtgcgcgatcggatgtggcttaagatcactataccgaatgcttttatagggtccgatgttgtggattggctgtaccacaatgtggaggggtttaccgatcgtcgggaggccaggaagtacgccagcaacctgctcaaagcgggtttcatcaggcacaccgttaataaaatcacattttccgagcagtgctattacatttttggtgacctttgcggcaatatggctaacctatcattacacgaccacgacgggtcctcaggcgcctccgatcaggataccctggcccctttgccgcatcccggtgcggccccttggccaatggctttcccataccaataccctccccctccccatccatacaacccacaccccgggtttccagaactggggtattcatacgggggcggcagcgctagctcacagcattctgagggttctaggtcctccggttcaaataggtccggtagcgatcgtaggaaggagaaggacccgaaagctggggacagtaagtccggcggttccggttccgagtccgatcataccaccaggtccagtctacgcggacccagagagagagcgccatcggaaaggtctggaccagcggcttccgagcatagccatcgcagtcatcatagccttgcctcctctctccgcagccatcatactcatccctcgtacgggccacccggggtgccgccgctgtatggaccacctatgctcatgatgccccccccacctgcagccatgggtcccccgggtgcccccccaggtcgggatcttgcgtctgtgccgcctgaactcaccgccagcagacagagcttccgcatggccatgggtaatccttctgagtttttcgtcgacgttatggtgttacggggatggggcgcctag

SEQ ID NO: 114811 - DNA, 2100 bp, Artificial Sequence
  Description of Artificial Sequence: Synthetic coding sequence
atgggggaaacaaaaatcatttaccatctagacggccaagaaacaccctatctggtgaaacttccattgcctgctgaacgggtcaccttagcggattttaagggcgtcctccagagacctagctacaagtttttcttcaagtcgatggacgacgattttggtgtcgtgaaggaggaaatctctgacgacaatgccaagctcccatgcttcaacggccgggtggtgtcctggctcgtgtccgcagaaggaagccacccggaccccgctcctttttgcgcggataaccctagtgaactgcccccaccaatggagcgcacaggaggaatcggcgactctcgacccccctcgttccatccccacgcgggcggcggcagccaggaaaatctggacaacgacacggaaacagacagtctagtgtctgcccagcgcgaaaggcctagaaggcgcgatggcccagagcatgccaccaggttaaatggcacagcaaagggcgaacggcggagagaacctggcggatacgactccagttccaccctcatgtctagtgaacttgagaccacatccttttttgactctgatgaagacgacagcacatcacgtttttcaagtagcacagaacagagctcagcttcaagattgatgagacgccataagcggcggcggcgaaagcagaaggtgtcacggattgaaaggagctcatctttttctagcattaccgactccaccatgtcattgaatattattacagtaactctgaacatggagaagtataattttcttggtattagcattgtaggccagtcgaacgaaaggggcgatggcgggatctacattggcagcatcatgaagggtggtgccgtggccgcagacggtcgaatcgaaccaggagacatgctgctgcaagtgaacgaaattaatttcgagaatatgtcgaacgacgatgctgtccgcgtgctccgggagatcgtacacaaaccaggccccattactctgactgtcgcgaagtgctgggatccctcaccaaggggctgtttcacgctgccccggaccatgaccggtaccttccccgcatacggaatgagcccttcactgagcaccattacctcgacctcaagctcaattaccagtagtattcccgataccgagcggctggatgacttccacctctctattcatagcgacatggcggccattgtgaaggccatggccagccctgagagcggattggaagtgagagacaggatgtggctcaaaattacaataccaaatgccttcatcggaagtgatgtggtcgattggctatatcacaacgtcgaaggtttcactgaccgtcgggaggcacgtaagtacgcctccaacctcctgaaggccggctttatccgccacacagtgaataagatcacattcagtgagcagtgttattatatttttggcgacctgtgtgggaatatggccaacctatcattgcacgatcacgatggatcgtcgggagcttcagatcaagacacccttgcccctttgcctcatcctggcgctgcaccgtggcctatggctttcccgtatcagtaccctcccccaccccatccttataatccacatcccggcttcccagagctgggatactcctacggaggaggttccgccagttctcagcactccgagggaagtcggtcctccgggagcaatcggtccggctccgatcgccggaaggaaaaagatccgaaagccggagatagcaaatcaggcggctccggatcagaaagtgaccacaccactcgttcaagtctgaggggcccaagagagagagccccatccgagagaagtgggcctgcagcatcggagcattcacacagatcccaccattcactggccagttccctaagaagccatcacacccacccttcatacggcccaccaggggtaccgccactttacgggccgcccatgttaatgatgcctccccctccagccgccatggggccacctggtgcccctcctgggagagacctcgctagtgtcccgcctgaactgaccgcatcccgccaatcgtttcgaatggccatgggtaatccctccgagtttttcgtcgatgttatgtag

SEQ ID NO: 114812 - DNA, 315 bp, Artificial Sequence
  Description of Artificial Sequence: Synthetic coding sequence
atgccagaggcccacatgcaaccggcaaaacttcagacatcactgccaaccacagaccatggttccaagaagccagtaagctgttatctcccccccctctccaatgcccatcctatgtgcatcgaagttcagaacgcacaaaattgttcctccgctgcagccacgctggagccatcaattatctccgatacttgtttttacaaaccaatcaccaaagatcaactgtccagccgctctgagctcaatacagtacggttgaagtgtctgaacagcctgagaggctggaagatcttgaatcagctttccctgacctag

SEQ ID NO: 114813 - DNA, 1437 bp, Artificial Sequence
  Description of Artificial Sequence: Synthetic coding sequence
atgggttctaggtggtctagtgaagaggaacgccagcccctattgggccccggcctggggcccggcttaggggctagctggcgtagtcgagaagcggcagcagctgcactgcccgccgctgtccccggccccggtagagtctatggccgccgctggctggttctgttgcttttttctctcctggccttcgtccagggcctcgtctggaacacatggggacctatccagaacagcgccaggcaagcctacggcttcagtagctgggacattgcattgttagtgctctggggaccgatcggcttcctcccctgcttcgcgtttatgtggcttctcgacaagcgtggattgcgcattaccgttctgctgacctcctttctgatggtgttggggaccggcctccgttgcattcctataagcgacctaatcctgaagaggagactgattcatggcggccagatgctcaacgggctcgccgggccaacagtaatgaacgctgcaccttttctttcgacaacctggttttcagccgacgagcgcgccactgcaaccgctatcgcatccatgctcagttacctcgggggcgcctgcgcctttctggtggggccactggtggtgcctgcccctaatggtaccagccccttgctggctgccgagtccagccgggctcacatcaaagacagaatcgaggctgtcctgtatgccgagtttggcgttgtctgcctgatcttctccgctactttggcttatttccctcccagaccccccctgccaccttccgtagctgcagcttcgcaacgtcttagctatcgtcgatccgtgtgtagacttctctccaatttccggtttttaatgatcgccctcgcgtatgccatccccctcggagtgtttgccggctggtccggtgtgctcgacctgatcctgacacctgcacacgttagtcaagtggacgccggatggatcgggttttggtcaatagttggcggctgcgtggtgggcatcgccatggctcggtttgccgacttcataagagggatgttaaagctgatcctgctccttttattttccggggccacactatcttctacctggttcaccctcacctgtcttaactcaataacgcatttgccactgactacagttaccttatacgcctcttgcattcttctcggagtctttttgaattcctctgtcccaatttttttcgagttgttcgtagaaactgtatatcctgtgccagagggaattacttgcggggtggtgacctttctgagcaatatgtttatgggtgtgctcctgttcttcctgaccttttatcacaccgagctctcttggttcaactggtgcctgcctggatcctgtctgcttagccttctcctgatcctctgcttccgcgagtcttatgacagactgtacctcgacgtggtggtttccgtgtag

SEQ ID NO: 114814 - DNA, 1644 bp, Artificial Sequence
  Description of Artificial Sequence: Synthetic coding sequence
atgcctggcgggggcccccagggggcacccgccgcagccggcggaggcggcgtgagtcacagggccggatcgcgagactgtctgccccctgctgcttgcttccgtagacgccgactggcacgacgccccggttacatgaggtcttccacaggcccgggcatcggatttctaagtcctgcagtgggaacattgtttcggttccctgggggggtgagtggagaggaatcccaccactccgagtcaagggcacgccagtgcggtcttgatagccgcggtctgctcgtacgaagcccagtctcaaagagtgcagctgcaccaacagtaaccagcgttcgggggacttcagctcacttcggcattcagcttcggggggggacacggcttcctgacaggctgtcctggccttgtggtcctggatctgcaggctggcagcaggagtttgccgccatggacagttctgagaccttggacgcctcttgggaggcagcatgctccgatggggctaggagagtgcgcgctgccggctccttaccctctgcagaactgtctagcaatagctgttcaccagggtgcggcccagaggtgccacctacccccccaggctctcactcggcctttacatctagtttcagttttatccgcttgagtctgggatcggccggagagagaggggaggctgaaggttgtccccctagtcgagaggcagagagccactgtcagtctcctcaggaaatgggagctaaggccgcctccctcgacgggccacatgaagatcccagatgcctgagcaggcctttctcgctgctggcgacacgggtgtccgccgacctggcgcaggctgcgagaaatagttcacgccccgaacgtgatatgcactccctcccggacatggaccctggctcatcctcctctcttgatcccagcctggctgggtgcgggggcgacggatctagtgggtccggtgatgctcattcatgggacacgctgctgcgcaaatgggagccagtgctgagagactgcctcttaaggaaccgcaggcaaatggaagtcatctcgttgcggctaaagttacagaaattgcaggaagacgctgtggagaatgacgattacgacaaggctgagactctacagcagcgtctggaagatttagaacaggagaaaatctcactacattttcagctcccatcccgccaaccggccctgagtagcttccttgggcaccttgcagcacaggtgcaagctgccctgagaagaggagccacccagcaggcgtccggtgatgacacccatactcctcttagaatggaacctcggttgctcgagcctaccgcccaggattctttacacgtcagtatcactcggagggactggctcctgcaggaaaagcagcagctccagaaggagatcgaggcccttcaagctcgaatgttcgtgctggaagccaaagatcagcaactgcggcgggagattgaagaacaagaacagcagctgcaatggcagggctgtgacctcacgccactggtggggcagctcagcctgggtcagcttcaggaagtctctaaggccctgcaggatacactggcaagcgcaggtcagattcctttccacgctgaacctcctgagaccattcggcgctgcgtatag

SEQ ID NO: 114815 - DNA, 1110 bp, Artificial Sequence
  Description of Artificial Sequence: Synthetic coding sequence
atgcccggcggcggcccccagggggcgcctgcggcagccggcggcggtggggtgtcccaccgggccggctcccgggattgtctcccccctgccgcgtgtttcagaaggcgtaggctggcgagacggcccggctacatgagaagctccaccgggcccggaataggtttcctgtcacctgcggtaggcacgctgttccgcttcccaggcggagtttcgggcgaggaaagtcatcactctgaatcgagggccaggcaatgtggactcgattcacgaggactcctggtgcggtcccccgtttccaagtccgctgcagcacctacagtgacctctgtgaggggtacatcagcacacttcggcattcaacttagaggtgggaccaggctgccagatcgcctgtcatggccttgcggcccaggctctgccggatggcagcaagaatttgctgccatggatagcagtgagactctcgatgccagttgggaggccgcgtgctcggacggcgcgagacgcgttagggcagccgggtctctgccttctgcggaattgtcatccaactcctgctctcctggttgtgggcctgaagtcccccctactccccctggctcacacagcgccttcacctcaagctttagcttcattcgactctcccttggctccgccggggagagaggcgaggcggagggctgtccacccagccgcgaagctgaaagccactgccaaagcccacaggaaatgggtgcaaaagcagcaagtttggacggcccgcacgaagaccctcgttgtttgagtcgtcccttttctctgctcgctacccgggtgtccgccgaccttgcgcaggccgccaggaactcctcacgccctgaaagggacatgcactcattgcccgacatggatccaggttcgtcttcatcacttgacccttctctggccggctgtggcggggatggttccagcggaagcggcgatgctcatagctgggataccttactgcggaaatgggaacctgtgctacgagactgtctgctgaggaacagacggcagatggaactggagccgatagctctggaccccccgtggaagcctagacatcccgaacccaattcttactag

SEQ ID NO: 114816 - DNA, 717 bp, Artificial Sequence
  Description of Artificial Sequence: Synthetic coding sequence
atggactccagcgaaacactggacgcttcctgggaagcagcatgttctgacggagcccgacgcgtacgggctgctggcagtctgccatcggccgaactctcctcaaactcatgcagcccagggtgtggtcccgaagtcccgccaacccctccaggctcacactccgccttcacctcctccttcagctttatacgtctgtccctggggagtgccggggagcggggtgaagccgagggatgccccccatcccgcgaggctgagtcccactgccaatcccctcaggaaatgggagccaaagcagcttcacttgacggcccgcacgaggaccctaggtgtctgagtcgcccattttccctgctggcaacacgagtaagcgccgacctggcccaggccgctcgaaatagttctcggccagagagagacatgcactctctccctgacatggaccccggaagttcctcctctctggacccctccctggctggctgtggtggggatggttcttcaggatccggggatgctcattcatgggataccttgctcagaaagtgggagccagtcctgagagattgtctactgagaaatcgccggcagatggaagtgatctcattgaggctgaagctgcaaaaacttcaggaagatgccgtggagaacgacgactatgacaaagctgggaccaactgcttcggcagtactatggaagcttcaactagttag

SEQ ID NO: 114817 - DNA, 2268 bp, Artificial Sequence
  Description of Artificial Sequence: Synthetic coding sequence
atgccaggaggaggcccccagggcgctcccgccgctgccggaggtggaggcgtgagccacagagccgggtccagagactgtctcccgcctgccgcatgctttcgacggcgaagactggcacgacgcccggggtacatgcgatcgtcaaccggaccaggcatcgggtttttgtctcctgctgttggcactctgtttcggttccctgggggagtcagtggggaggaaagccaccactctgaatcaagggcaaggcagtgcggtctcgactctcgtgggctcctggttagatctccggtgtctaagagcgctgcagccccaacagtcaccagcgttcgcggcacctcggcacactttggaatacaactgagaggaggaacccgtttaccagatcgcctgagttggccctgtggtccaggtagcgcagggtggcaacaggagttcgccgcgatggactcatctgaaactttagatgcaagttgggaggccgcttgtagcgatggggcgcgaagggtgcgagccgctgggagcctgccttctgctgagctctcgagtaattcttgctcccccggctgcggacctgaggttccaccgacacctcccgggtcccacagcgcattcactagcagcttttccttcattagactcagcctgggcagtgcgggggaacgcggagaagctgagggatgtccccctagccgagaggcagagagtcactgccagtctccccaggaaatgggagccaaggccgccagcctggacggcccacatgaagaccctcgttgtttaagtcgtcccttttcattgttggcaacccgcgtcagcgctgatctggctcaagctgcacggaattcatctagaccagagcgcgatatgcatagcctacccgacatggatcctggatcttcctcttctctggatccctcactagccggctgcgggggagatggctcatctgggtccggggatgctcattcctgggatacccttctacgaaaatgggagcccgtgcttagagactgtttactgcgcaatcgacgccagatggaagttatttctctccgcctaaagcttcagaagctgcaggaggacgcagtcgagaacgatgattacgacaaggcagagacactccaacagaggttggaagacttagaacaagagaagatttccctacactttcagctgccttccagacaaccagccctgagttcctttttgggacacctcgccgcccaggtacaagcggccctgagaaggggggctacgcagcaggcctcgggtgacgatacccacacacctcttcggatggaacccagactgctggaaccaacggctcaggactctctacacgtgagtatcaccaggagagattggctcctccaggaaaaacagcagctgcagaaagaaatcgaagctctccaggcccgcatgttcgtgctggaagccaaggatcaacagttaagaagggagatcgaggagcaggaacagcagctgcaatggcaaggctgtgacctcaccccattggtgggccaactctcattgggacaactccaagaggtaagcaaggccctgcaagacacattggccagcgccgggcaaattcccttccacgccgagcctccggaaaccatcagaagtttgcaagagcgcataaaatccttgaatctcagtctaaaggaaattacaactaaagtatgcatgtcggaaaagttctgttcaactttaagaaaaaaagtcaatgatattgagacccagctccctgctctgctcgaggcaaaaatgcatgctattagcggaaatcatttttggaccgccaaggacttgacggaagagattagatccctcacatcagagcgagagggtctggaggggctactgagcaagctgttagtgttgagttctcgtaacgtgaaaaagctagggtccgtgaaagaggattacaacagactgagacgcgaggtggagcatcaggagaccgcctacgacggagtgagcctgtgcagacctgtatggtctgccgttgttcgctcttgctccctgcagccattgcctcccgaattcaaacaatttagctgtctgtccctacgcagctcatgggattatcggtgccctcccccatgtttagcaaatttcgtcttcctcgttgagatgggcttctaccatgtggaccagaccgggcttaagctgctcaccagcagcgaccctccttcctccgctagccaatccgccggaattacggatatgtcccattgtgcctggccactgcaatag

SEQ ID NO: 114818 - DNA, 2037 bp, Artificial Sequence
  Description of Artificial Sequence: Synthetic coding sequence
atgccaggaggtggcccgcagggggctccagctgctgccggagggggaggtgtgagccatcgagctggaagtcgcgactgcctgcccccagccgcctgcttcaggcgacgtcgcctggctcggcgaccaggctacatgaggtccagcactgggccaggtatcggattcctcagcccggccgtcggcaccctatttaggtttcccggcggtgtgtctggcgaggaatctcaccatagtgagtcaagggcgaggcagtgtggcttagatagccggggtcttctcgtacggtccccggtctcaaaatctgccgccgcacccaccgttacctccgttcggggaacatcagcgcatttcggaatccagctgagaggcggaaccagattgccagatcggctttcttggccctgtggacccggctccgcaggctggcagcaggagttcgctgctatggatagctccgagaccctcgacgcgtcatgggaggctgcttgtagcgacggtgcgaggcgcgtgcgggcggccggctcgctcccatcggctgagctgtcaagcaactcctgcagccctggttgcggtcctgaggtgccaccaactccacccggttcccactctgcctttacatccagtttctcattcattcgccttagcctggggtccgctggcgagcggggggaagcagagggatgtccacccagcagggaggctgaatcccactgccagagccctcaagagatgggtgcgaaagctgctagtcttgatggcccccacgaggatcccagatgcctcagtcgacccttcagtctactcgctactagggtgtctgctgacctcgcgcaggctgccagaaactcttcaagacccgagcgggatatgcacagcctgccagatatggacccggggtcttcttcttcacttgacccatctctggctggctgcggcggtgacggcagcagcgggagcggggacgcccacagctgggacacgctgctccggaagtgggagccagtgttaagagattgcttgttacggaaccgacgacagatggaggtgatctctctccgcctcaagctgcaaaagctgcaggaggatgctgttgagaatgatgattatgataaagccgaaacattgcagcagaggctggaggatctcgaacaagagaaaatcagtcttcatttccagctgccctcacgccagcctgccctctccagtttccttgggcacctagccgcacaagtccaggcagctctcagacgcggagcaacccagcaggcttctggcgacgatacacatacaccacttagaatggagccccggctactggagcccacagcccaggattctctccatgtttcaatcacccgtagggattggctgttacaggaaaagcagcaactgcagaaggaaattgaggcccttcaggctaggatgtttgtacttgaggcaaaggatcagcagcttaggcgcgagatcgaggagcaggagcagcagctgcagtggcaagggtgcgacctaactccgctggtgggacagctgagcctgggccaactccaggaagttagtaaagcgctacaggataccctggcaagcgccggccagattccttttcatgccgagcctccagagactatcaggtccctccaggagcgcatcaaaagccttaacctctccttgaaagaaattacgactaaggtctgtatgagcgaaaaattctgcagcactctgagaaaaaaggtgaacgacatcgagacacagttaccggcgctcctagaggcaaagatgcacgccattagcggaaatcatttctggacagcgaaagacctcaccgaagagattcgcagtctgacaagcgaaagggagggcctggaaggcttgctgagtaaacttctggtgcttagcagcagaaatgtaaaaaagctcggatctgtgaaagaagattataacagactgagaagagaggtagagcaccaggaaacagcgtacggctataagtactgcgacgcagagtcttggacccagagatcacaacagctagcctag

SEQ ID NO: 114819 - DNA, 2499 bp, Artificial Sequence
  Description of Artificial Sequence: Synthetic coding sequence
atgcccggggggggtcctcaaggagcgcctgccgccgcaggtggggggggtgtcagccatagggccggctccagggattgtctgccccctgccgcttgttttcggagacggcgcctcgccaggaggcccggatacatgcggtcaagcacagggccaggtattggtttcctgagtcccgcagtggggacattatttcggttcccaggtggggtgtcaggcgaggagtcacatcacagtgaatccagggcacgacagtgtggattggacagtagagggttgctcgtgcgcagtccagtgagtaagtctgccgctgcgcccacagtcacatccgtgcgggggacaagcgcccattttggtatccagttgcgggggggtacgaggttacctgacaggttatcgtggccatgcggccctggatcagccggctggcagcaagagtttgcagctatggatagtagtgagaccctggacgcctcctgggaagcagcatgcagtgatggagcacgcagggtccgcgcagccggcagtctcccgtcagccgaacttagctccaattcttgcagccctggatgcggacccgaagtcccaccaacgcctcccggttcacatagtgccttcacctcttcattttctttcatcaggctgtctctgggaagtgccggcgaaaggggagaggccgaggggtgcccccctagtagagaggccgaaagtcactgtcagtcgccacaggaaatgggcgcaaaagccgccagccttgatgggcctcatgaggaccccaggtgtctgtctcggccatttagtctgcttgccaccagagtgtccgccgacctggctcaggccgcacggaatagctctcgtcctgaacgggacatgcactccctaccagatatggatccggggtcgagctcatcgctggatcctagcttggctggatgcggaggcgatggctctagtggtagcggtgacgctcactcttgggataccttgcttcggaaatgggagcctgtcctaagagattgcctactcaggaatcgcagacagatggaagttataagcttgcggctaaaactgcagaaacttcaggaagacgccgtcgagaacgatgattacgacaaagcagagacattgcaacagcgcttggaggacctcgagcaggaaaagatttcactacacttccaactcccctcacggcagccagcactgtctagcttcctgggacacctggccgcccaggtgcaggccgcactgcggcgcggcgcaacacagcaggctagtggagacgacactcataccccactgaggatggaacctcggttactcgaacctacagctcaggattctctccatgtttccataaccagacgggactggctattgcaggagaagcaacagcttcagaaagagatcgaagcactccaggcccgtatgtttgtgttggaggctaaagaccagcagctgaggcgtgaaatagaggagcaggagcaacagctgcaatggcagggctgcgatttaactccactggtagggcagctgagtttggggcagttgcaagaggtgtcgaaggcccttcaggatactctcgcctctgccggccaaatccctttccacgccgagccacctgaaaccatacgtagcctgcaggaaaggattaagtccctgaacctgtccctcaaagagatcaccacgaaggtatgtatgtcagagaaattctgctccacactccggaaaaaagtgaatgatattgaaacccagctgcccgctctgctggaggcaaagatgcatgcaattagtggcaaccacttctggaccgcgaaggatcttacagaggagatccgctctctgacttcagagcgggaaggtctcgagggtttgcttagcaaactactggtgctgtcaagtaggaacgtgaagaagctaggttcagttaaggaagactataaccgtttacgccgcgaagttgaacaccaggaaactgcctatgagacctccgtcaaggagaacactatgaaatacatggagacattgaaaaacaaactgtgcagttgcaagtgccctctcctgggaaaggtgtgggaggctgatctggaagcctgccggctgctcatccagagcctgcagctgcaggaggcccgtggcagcctttctgtggaagatgagcggcagatggacgacctggaaggcgcagctccacccattccacctagacttcattccgaggataagaggaaaacccccctgaaagaatcgtacatcctgtctgcagaacttggggagaagtgcgaggatataggtaagaagctgctgtaccttgaggaccaactgcataccgccatacattcacatgatgaagacctaattcactctctgcgaagggagctgcagatggtaaaggagacactgcaagccatgatcttgcaactccaaccggctaaggaagcaggggagagggaagctgctgcatcatgtatgactgcaggggtgcacgaggcccaagcctag

SEQ ID NO: 114820 - DNA, 2661 bp, Artificial Sequence
  Description of Artificial Sequence: Synthetic coding sequence
atgcccggtggcgggccacagggggcaccagccgcggccggaggcggaggcgttagccatagagcagggtctcgggattgtcttccgccagctgcctgtttccggcgcaggaggctggctcggcgccccggctatatgagaagtagcaccgggccaggcattggttttctctcacctgctgtgggcacactgttcagattcccagggggggtctccggcgaagagagccatcatagtgaatcacgcgcaaggcagtgcgggcttgattctcggggtctgcttgtgagaagccctgtgtctaaatcggctgctgcacccacagtgacctcggtgcgcggcacctccgcccactttggcattcagctccgggggggaactagattgccggatagactctcctggccttgtggacctggcagcgccggttggcagcaggagtttgctgctatggattctagtgaaacgttggacgcatcatgggaggctgcttgctctgacggcgcacgtcgggtccgagcggccggaagtctgcccagcgccgagttgagttccaactcttgtagtccagggtgcggacctgaggtcccacccacaccacccggttcgcattcggcttttacttcctcatttagctttattagattgtctctggggtctgccggagagcggggggaagcagaaggttgtcctccgagtagagaggccgaaagccactgccagtcgcctcaagaaatgggagctaaagctgcttcgctggacggcccacacgaggatccaagatgcctctcccggccattttcactacttgcaacccgcgttagtgcagacctggcgcaggctgctcgcaattcaagcagaccggagagagatatgcactccctacctgatatggatccaggttcttcatcaagtctcgatccatccctcgctggttgcggcggcgatggaagctcgggttccggagatgcacactcatgggacacactgttgagaaagtgggagccagtcctaagggactgtctcctgcgaaacaggcgccagatggaggttatctctctcaggctgaaactgcagaaactccaggaagatgctgtggaaaatgatgactatgataaggtggagacaggattccattacgtcggccaagctggcttggaactcttaacctccagcaacccacccgcctcggccagccagtccgctggcatcaccgccgaaaccctccagcagaggctggaagatttggagcaagaaaaaatcagtctgcactttcagctgccatcccgccagccagctctctcctcattcctgggacatctggccgcacaggttcaggccgcactcaggagaggcgcaacacagcaggcgtcaggcgatgacacacacactcccctgcgaatggagcccagactcctggaaccaacagcgcaggactccttgcatgtgtccatcactcgcagagactggctacttcaggagaagcagcagctccagaaagagattgaggccctgcaagcacggatgttcgtgttggaagctaaagatcagcaactgcgaagggagatcgaagaacaagaacagcaactgcagtggcagggctgcgatctgacacccttggtgggccaactgtccctgggacagttgcaggaagtgtccaaggccctgcaagacacactggcctcagcaggacagatcccattccacgcagaaccccccgagacgattagatctctgcaggagcgtattaaatctttgaaccttagtctgaaggagattacaacaaaggtgtgcatgagtgagaagttctgcagcacattacggaagaaggtgaacgacatcgagacccagttaccggctctgctggaagccaaaatgcacgctataagcggaaatcacttctggaccgccaaggatctcacagaagaaattcgttccctgacctccgaacgggaagggcttgaagggctgctgagtaagctcttggtgttgtcctccagaaacgtcaagaaattaggcagcgtcaaagaggactacaatagactgcgccgtgaagtggaacatcaggaaacagcctacgagacaagcgtgaaggaaaatactatgaagtacatggaaactttaaagaataaactctgcagttgtaaatgccccctcctgggtaaggtctgggaggcggacctggaggcttgcagactgcttatccagagcctgcagttgcaggaggctcgcgggtctctatcagttgaggatgagcgccaaatggatgaccttgaaggagccgcaccacctatcccacctcggctacatagtgaagataagcgaaagactccacttaaagtgttggaagagtggaaaacccacctgataccatcactgcattgcgccggaggcgagcaaaaagaagagagctacattctgagtgctgagttgggcgagaagtgtgaggacatcggcaagaaactgctttacctggaggatcaattgcacaccgcgattcactctcacgacgaggaccttatacattccctgagacgcgaattgcagatggtcaaagagactctgcaggccatgatcctgcagctacagcctgccaaagaagccggcgaacgggaggcagccgcaagctgcatgactgcaggtgtgcacgaggcccaagcgtag

SEQ ID NO: 114821 - DNA, 621 bp, Artificial Sequence
  Description of Artificial Sequence: Synthetic coding sequence
tgaaatcacttctggaccgctaaggaccttactgaggagatcagaagcttgaccagcgaaagggaggggctcgagggcctgcttagtaaacttttagtactgtcttcaagaaatgtgaagaaattagggtccgttaaggaggactataaccggttgagaagggaagtggaacatcaggaaaccgcgtacgaaacttctgtgaaggaaaacacgatgaagtacatggaaaccttgaaaaataagctctgctcctgcaagtgccccctgttaggaaaggtgtgggaggcggatttggaggcttgtcgtctgctgatacagtctcttcaactgcaggaggcaagggggtcactatccgtcgaggacgaacgacagatggatgaccttgaaggagccgcaccccccatcccaccacggttgcatagtgaggacaagcgaaagactcctttgaaagtgctggaagagtggaagactcatctgattcccagcttacactgcgctggaggcgagcagaaggaagtgtgtccgttccacatggcctcacgcggcgacccctatagtaagggatgctttgggacaatgttacaaatgggaacgattaacattgggaaggcctctcactag

SEQ ID NO: 114822 - DNA, 279 bp, Artificial Sequence
  Description of Artificial Sequence: Synthetic coding sequence
atgaagtatatggagaccttgaagaataagctatgtagttgcaaatgcccattgctgggtaaagtatgggaggccgatctggaagcctgtcgcctccttattcagtcacttcagttgcaagaggcacgcggcagcctctcagtggaagacgagcgacagatggatgacctggaaggggcggcccctcctatccctccaagactgcatagcgaagataagagaaaaactccactgaaggtgctcgaagagtggaaaacacacctgattccctccctgtag

SEQ ID NO: 114823 - DNA, 2565 bp, Artificial Sequence
  Description of Artificial Sequence: Synthetic coding sequence
atgccaggagggggtcctcagggcgcgccagccgcagcaggtggggggggcgtcagtcatcgtgctgggagcagggattgcctaccgcccgccgcttgcttcagacgaaggcgactcgccagacgccccggatacatgagatcaagcactgggcccggcatcggatttctttcgcccgcggtgggtaccctgtttcggtttcccggaggcgtgagcggggaagaaagtcatcacagtgagagccgggcacgccagtgcggactagacagtcgcgggttactggtccggtcccctgtaagcaagtctgctgcagctccgaccgttacctctgttcgtggtactagtgctcacttcgggatccaactcagagggggaacacgcctgcctgataggctgagctggccctgtggacccggtagcgctgggtggcagcaggaattcgcagccatggatagttcagaaacgttagacgcctcctgggaggctgcatgcagcgacggagcacggagggttagggccgctggatctctgccaagcgctgaactgtcatctaactcctgctcccccggctgcggacccgaggtcccgcctacgccaccaggaagccattcagcatttaccagcagtttttcattcatacgcttgagtctcgggagcgccggagaacggggcgaggcggagggctgtccgccatcccgagaagctgagagccactgtcagtccccgcaagagatgggcgccaaggcagcttctctcgacggcccacacgaggacccccgttgcctttctcgccccttcagcctgttggcgacccgggtgagcgcagacttggcgcaggcagcccgaaacagctctagacccgaaagagatatgcacagtttgcccgatatggaccctggtagtagtagctccctcgacccatcccttgcgggatgcgggggcgacgggtcctcagggagtggggacgcccacagctgggacactctcctacggaagtgggaacctgtactcagggactgtctcctgcgcaataggcggcagatggaggtcatttcgctgaggctcaaattacagaagctgcaggaggacgccgtggaaaacgatgattacgacaaagctgaaactctgcagcagcgacttgaagatctggagcaggagaagattagtctgcacttccagttgccatcaaggcagcctgcactctcgtcattcctgggccacctcgcagcacaagtccaagctgccctacgccggggtgccacacagcaggcatcaggagacgacacccatactcccttgaggatggaaccacggctgttagaaccaacagctcaggattctctgcacgttagcattaccagacgggattggctactgcaggagaaacagcagctgcaaaaggaaatcgaggctctccaggccaggatgttcgtactcgaagccaaggatcagcagctaaggcgcgagatcgaggaacaggagcaacagctgcagtggcaagggtgcgacctgactccgttggtgggacagctttcattagggcagttacaggaggtctctaaggctcttcaggacaccttggcatccgctggtcaaatcccctttcatgctgaacctccagagaccataaggtcactgcaagaacgaatcaagtcgctgaatctctcgctgaaggaaataaccaccaaggtgtgcatgagcgagaagttttgctccactctccggaagaaagtaaatgacatagagactcagctgcctgctctcctggaagccaaaatgcacgccatctccgggaatcacttctggaccgccaaggacctcaccgaagaaataaggtccctgacatctgaacgtgagggtctggagggactactgagtaagttgctggttcttagctcccgcaacgtcaaaaaactgggatctgtgaaagaggattacaaccgccttcggcgcgaggtagagcatcaggagaccgcctatgaaacaagcgtcaaggaaaacacaatgaaatacatggaaacactgaagaacaagctgtgttcctgcaaatgcccactcttggggaaagtttgggaagctgatctggaggcctgccgcctgttgatccagagcctgcagcttcaagaagcccgcggaagcttgtctgtggaggacgagaggcaaatggacgacctcgaaggcgccgccccccctatcccccctcgattgcattccgaggataaaagaaagactcccctgaaagtactggaggagtggaagacgcatctcattcccagcctccactgcgccggcggcgaacaaaaggaggaatcttatatcctatcagctgagctgggagaaaaatgcgaggatattggcaaaaaactcttgtacctggaagaccaactccacactgctatacattcacacgacgaggatctgattcacagcctgcgtagagaactgcaaatggtgaaagagaccttacaggccatgattctacagcttcagcccgcgaaggaggctggagaacgggaggccgccgcatcgtgtatgacagctggtgtgcatgaggcccaggcatag

SEQ ID NO: 114824 - DNA, 2199 bp, Artificial Sequence
  Description of Artificial Sequence: Synthetic coding sequence
atgccagggggtgggccacaaggggcgcccgctgcagctggcggggggggggtgtctcacagagctgggagtcgcgattgcttgcctcctgccgcctgctttagaagacgtcggctggcacggaggcccgggtatatgcggagctctacaggcccaggtatcggattcttgagtcccgcggttggcactttgttccggttcccaggtggggtatctggagaggagagccatcactcagagtctagagctcgccagtgtgggcttgactcacgcgggctgctagtgaggtctcccgtgtcaaaaagcgctgcagcacctactgtgacaagtgtgcggggcacctctgctcactttggtattcagctgagaggcggtacccgattgcccgatagactgtcttggccatgtgggcccggatctgcaggttggcagcaagagttcgccgctatggatagttccgagacactggacgcctcttgggaggcggcctgctccgacggtgcacgacgcgtgcgcgcagccggtagcctgccaagcgccgaactctcctcaaattcttgcagtcccgggtgcggccccgaagtaccgcctacccccccgggctcacatagtgccttcacttcctctttctcgttcatccgactgtcccttgggagcgccggcgaacgaggggaggcagagggttgtccgcctagcagggaggcagagtcacattgccagtctcctcaggagatgggcgctaaggctgcctcgctcgatggccctcacgaggatcccaggtgcttaagtcgtcctttcagcctcctcgctaccagggtgagtgctgacctagctcaggctgcacgtaactcaagtagaccagaaagagacatgcactctttacctgacatggatcccggatccagcagtagcctggatccgtctcttgcagggtgcgggggcgatggatcctcgggtagcggggatgcccactcatgggatactctcctgcgtaagtgggagccagtactgcgcgactgtctgcttagaaaccgcaggcagatggaggtgattagtctacgcctgaaactgcagaagctgcaagaagatgcagtggaaaatgacgactatgataaggcagaaactctacagcagcggttggaagacctggaacaggaaaagatcagcctacactttcagctcccaagccgacagcctgctttgagttcattcctggggcatctggctgcccaggtgcaggccgctttaagaaggggggctacccagcacctgcaggagagaatcaagtccctcaacctgtcactcaaagaaatcaccaccaaagtgtgtatgtccgagaagttctgtagcactctcagaaaaaaggtgaacgacattgaaacacaactgcctgctctgctggaggccaagatgcacgccatctctggcaaccacttttggaccgccaaggacctaactgaggagattcgctcactgacctctgagcgcgagggacttgaagggctcctttcaaagctcctagtgctcagtagccgaaatgtaaagaagctcggctcagtgaaggaagattacaaccgcctacgacgggaggtcgaacatcaagaaaccgcctatgagacaagtgtcaaggaaaataccatgaagtatatggagacattaaagaacaagttatgcagttgtaagtgccccctccttggcaaagtgtgggaagctgatttagaggcttgtagactcctgatccagagcctgcagctacaggaagcaagggggtctctgtcagtcgaggatgaacgtcaaatggacgatttggagggcgctgctccaccaatccccccacgcctccactccgaggacaagcggaaaacccctctgaaagtcctcgaggagtggaaaacacatcttatacccagcctccactgcgccgggggtgagcagaaggaagaaagttacattctgtcagccgagctgggggagaagtgcgaagatatcgggaagaagctgctgtacctggaggaccaactgcacacagctatccactcacatgatgaagacctgattcatagtctccgaagggagctccagatggtgaaggaaaccttgcaggctatgatcctccagctacagccggcaaaagaagccggagagagagaagctgcggccagctgtatgacggcaggtgttcacgaggcacaggcatag

SEQ ID NO: 114825 - DNA, 1830 bp, Artificial Sequence
  Description of Artificial Sequence: Synthetic coding sequence
atgcctggaggtggaccccaaggagctcctgctgcagcaggtggcgggggcgtgtcccatcgcgccggtagccgtgattgtttgccccctgcagcttgctttaggagaaggagattggcgaggcggccgggctacatgcggagcagtaccggtcccggaattgggttcctgagtccagcagtaggtaccctttttcgattccctggtggtgtgagcggtgaggaatctcatcatagcgaatcgagagcccgtcagtgtgggctagacagtcgaggattactcgtacgcagtcctgtctcaaaaagtgccgccgctcccactgtgacctctgttcgcggcaccagtgcccacttcgggatccagctaagaggcggaacccgcctccccgacaggctctcctggccttgtgggccagggtccgcagggtggcagcaagaatttgcagccatggatagcagtgagactctggacgcctcgtgggaggctgcctgctccgacggagcgcgaagagtgcgcgccgccggtagccttccatccgcggagttgtcctctaattcttgttccccaggctgcggaccagaagtgcctcccacaccgcctggctcgcacagcgcttttaccagctcctttagttttattcggctctccctgggctcagcaggagaaaggggcgaagccgaaggctgcccacccagccgggaggccgaatcccactgtcagagcccacaggagatgggcgccaaagcagcctctctcgatgggccacatgaagaccctcggtgtttgtcccggcccttctcacttctagcgaccagagtgagcgccgacctggctcaggctgccagaaacagttcccgccccgaacgcgacatgcattccctcccagacatggatccaggcagttcctctagcctggacccaagtttggccgggtgtgggggtgacggcagctcgggatccggggatgcgcatagttgggacactctgttgaggaagtgggagcctgtgctgagggactgcctcctccggaaccgtcggcagatggaagtgattagcctccgtctcaagctccaaaagctccaggaggacgcggttgaaaatgatgattacgacaaggcggaaacccttcaacagagattagaagacctggagcaggaaaaaatatccctgcatttccagctgcccagccgccagccagctctctcttcattccttgggcacctggcagcacaggtgcaggctgccctgcgcagaggagctacacagcaggccagcggtgacgatacccacaccccactgcggatggagccccgtctgctcgaacccactgcccaggatagtctgcacgtgagcataacacgcagagactggctgcttcaggaaaagcagcaattgcagaaagagatcgaagccttgcaagccagaatgttcgtgttggaggctaaagaccagcagttgagacgcgaaattgaagagcaggagcagcagctccagtggcaagggtgcgatctgacccctctcgttggacaattgagtctggggcagctccaagaagtttcgaaggccttgcaggacactcttgcatctgctgggcaaataccattccacgccgagccacctgagacaattcggagagaggtgcggcaccaaacagccccctgtaggaatcaccaactcgaaaagccagtcatcaatatctgggccttccacctaagacgaaagatttgcctgtttcaggccgatggcttgcagcacgggagtgcagaggtgaagcacctgaaggagacttccgtggagcctgccggaagcaccgcctcccgcaaggagtag

SEQ ID NO: 114826 - DNA, 2088 bp, Artificial Sequence
  Description of Artificial Sequence: Synthetic coding sequence
atgcctggtggcggaccgcagggcgcccccgctgcagcgggaggaggtggagtatcacacagggcaggttccagagactgcctgccacccgctgcttgttttagaaggcgtaggctggctcgacgacccggctacatgcggtccagtaccggcccaggcataggatttctgtcccctgctgtggggacattgttccggtttccgggtggcgtctcaggggaggaatctcatcacagcgaaagtcgcgcacgccagtgcgggctggacagccgcgggctactggtgcgcagccccgtaagcaaatccgccgctgccccaacagtcacgtccgtgcgcgggacttcagcacacttcgggatacagttgagaggcgggacccggttgcccgaccggctgagctggccatgcggtcctgggtcggcggggtggcagcaagaatttgctgcaatggatagttccgaaactctagacgcgtcctgggaggcagcttgttcagacggagctagaagggtgcgtgccgcgggcagcttgccctctgcagagctgagcagtaatagctgtagcccagggtgcggaccagaagtaccacccactccacctggctcccacagcgccttcacttccagtttctccttcatcaggttgtcattgggctccgccggcgagaggggagaagccgagggatgccccccaagccgagaggccgagtcgcactgccagagcccccaagaaatgggcgcaaaagcagctagtttggatggaccccacgaggatccccggtgtctgtctagaccattcagccttctagccacacgcgtgtccgccgatctggcccaggcagccagaaatagcagccgcccggagagagacatgcactccctgccagacatggacccaggctcctcctcatccctggacccctctcttgccggttgcgggggcgacgggagttcagggtccggagacgcccattcttgggacacgttgctacggaagtgggagccggtgttacgagattgtctgttgcggaacagacgtcagatggaggttataagcctgcggcttaagctgcagaagctccaagaggatgccgtggagaacgatgattatgacaaagcagaaacattgcaacaaaggctcgaggatctggaacaggagaaaatcagcttacactttcagctcccgtccagacagccagctctttcttccttcctgggacacctggctgcccaggtccaggcggctctgaggcgaggggctacccagcaggcttccggagatgacactcacacaccattgaggatggaaccccggctgctggagcccacggcgcaggatagcctccatgtgtctatcacccgcagagactggctcctgcaagagaagcagcaactgcagaaagagattgaagctctgcaggcccggatgttcgttctcgaagcaaaggaccagcagctcagacgggagatcgaggagcaggaacagcagttgcaatggcagggatgcgatctgacaccactggtgggccaactttctctggggcagctgcaagaagtgtcaaaggcattgcaggatactctcgcctctgcagggcagattccattccatgctgaaccacctgaaacaattcggtctctccaggagaggatcaagtccctcaatcttagcctgaaagagattactaccaaggtatgcatgtctgagaagttttgtagcacccttcggaagaaggtgaatgatatcgagacgcagcttccagcccttctcgaggcaaagatgcatgcgattagtgggaatcacttctggactgcaaaagatctgactgaagagattcggtcattgacctccgaacgcgagggactcgaaggactgctgtcgaagcttctcgtactctcttccagaaacgtgaaaaaactgggttcagttaaggaggattataacagactgaggcgtgaagttgaacaccaggagactgcctatgcagcctcagtgcattgtctggggaagtgcggcaaacttacatggaagctagttgactgtctgtcgagggcctattcaagcaggaaaccaggagaggcgtgtctgtag

SEQ ID NO: 114827 - DNA, 1680 bp, Artificial Sequence
  Description of Artificial Sequence: Synthetic coding sequence
atgcccggcggcgggcctcagggggcacccgccgctgcaggaggaggcggggtatctcatcgggcaggaagtagggactgtctccccccagctgcgtgttttcgtcgccgtcggctcgcaagacgtcccggctacatgagaagcagtacagggcctggcatcgggtttctcagcccggccgtgggtaccctcttccggttccccggcggggtgagtggagaagaatcacatcacagcgagagtagggcaaggcaatgtggtcttgattcacggggattgcttgtaagatctcccgtatctaaatccgcggcggccccaaccgtgacctcagtgaggggcacatccgcccattttggaatccagcttcgcggcggcactcgcctcccggatcggctgtcctggccatgcggacccggtagcgccggatggcagcaggagttcgcagcaatggattcctccgagactttggatgccagttgggaggccgcctgttctgacggcgcccgccgtgtgcgagctgcgggctcactgccgtccgctgaattgtccagcaatagctgctcccccggctgtgggcccgaggttccgcccacccctcctggatcacatagcgcttttacttcctcattcagctttatccgacttagcctcgggtcagcgggagagcggggtgaggccgaggggtgtccgccgtcgagagaagccgaaagtcactgccagtcaccccaggagatgggggcaaaggccgcaagtctggacgggcctcacgaagaccctcgctgcctgtcgcggccattttcacttttagcgactagagtgagcgccgatctggcacaggcagccaggaatagcagtaggcccgaaagagacatgcattccctgccagacatggaccccggatcaagttcaagccttgacccttccttagccggatgtggaggagatggatccagcggcagtggtgacgcccattcatgggacacccttcttcggaaatgggagcccgtcctgagagattgtctactgagaaacaggaggcaaatggaggttatctccttgcggctgaagcttcagaagttgcaagaagacgctgtggagaacgacgactacgacaaggccgaaacattgcagcagcgacttgaagatttggagcaggaaaaaatcagtcttcactttcagctgccatcacgccaacccgctttgtctagctttcttgggcatttagctgcgcaggtgcaggcagccctccgcaggggggcaacccagcaggccagcggtgatgacacgcacacccctttgcgcatggagccccgactcctcgagccaaccgcgcaggactcgttgcatgtatctataacccgaagagattggctccttcaagagaagcagcagctgcagaaggagatagaggctctccaggcccgcatgttcgtgctggaggcaaaagatcagcagcttcgccgggagatcgaggagcaggaacagcaactgcaatggcagggatgtgatctcaccccactcgttggccagctctcactcggccagctgcaagaggtgagcaaggctctgcaagatactctcgcttctgctggacagatcccatttcacgcagaaccacctgagacaatacgccggaataaatgtgaaggaaaatactatgaagtgcacggtaacacatag

SEQ ID NO: 114828 - DNA, 1740 bp, Artificial Sequence
  Description of Artificial Sequence: Synthetic coding sequence
atgcctggcggcggcccgcagggggctcctgccgcagccggaggaggaggggtgagtcatcgtgctggcagcagggactgcctgccgcctgccgcctgtttcaggcgaagacgcttggccaggcgacctggatatatgagatcctcaactgggccagggatcgggtttctgagccccgcagtcggcacgctgttcagatttcctggcggggtttcaggcgaggaatcgcaccactcagaaagtagggccaggcagtgcggcttggacagtcggggtcttttagtgcgatctccagtgagcaagtcagcggctgcacctactgtcacttctgttcggggaacgtctgctcacttcggaattcaactgagaggtggcactagactacccgacagattgtcctggccatgcggtcccggatccgctggatggcaacaagaattcgccgccatggattcatctgagactcttgacgcctcctgggaggcggcctgttccgacggtgctagacgagtcagagctgccggttccctgcctagcgcagagttatcctctaattcttgttcacccggatgtggccccgaggtgcctccaacaccgccgggaagccactccgccttcacaagcagtttctcctttattcgcctgagcctaggctctgcgggggagcgaggcgaggcggagggatgccccccctcaagagaggctgaatcccattgtcagtctccccaagaaatgggcgcgaaagctgcctccctagacggccctcatgaggaccctagatgcctgagtagacccttttccttgctggcaacaagagtgtccgcagacctggctcaggccgcccggaatagctccagacccgagcgcgacatgcatagccttcccgacatggacccgggcagctccagctcattggacccttccttagccggctgtggtggggatggatccagcggctcaggggacgcacattcatgggatacactgctccgcaagtgggagcctgttctccgcgactgcctcctgaggaacaggcggcaaatggaagtgatcagcctcagactgaagctgcagaaactgcaggaagacgcggtcgagaacgatgactatgataaggccgagaccctccagcagcggctagaggacctggagcaagaaaaaatcagcctccattttcagcttccaagtcgccagccagcgctatctagtttcctggggcacctcgcagcgcaggtccaggcagccctgagacggggcgccacccagcaggcctccggtgacgacactcacaccccattgcggatggaacctaggttattagagcccacagcacaagactctctccacgtgagcattacacggagagactggctcttacaggagaagcagcaactccaaaaagagatagaggccctgcaggcacgtatgttcgtgctggaggctaaggaccaacagctgcgcagggaaattgaagagcaggaacagcagctccagtggcaaggttgcgacctgacgccgctcgtaggacaactgtcactgggtcagctccaggaggtttccaaggctctccaagacacgctagcaagcgcaggccagatcccttttcacgctgagccaccggagaccattcggagcttacaggaaagaattaagagtctgaacttgtccctgaaggagatcactacaaaggagactatttccgggagactcaaaacctccccaagacgtctggaccactag

SEQ ID NO: 114829 - DNA, 390 bp, Artificial Sequence
  Description of Artificial Sequence: Synthetic coding sequence
atgactatgacaactatgccagagtcacttaattctcccgtctcagggaaagctgtgtttatggagttcgggcccccaaaccagcagatgagcccgtctcccatgtctcacggccactactccatgcattgtctccattctgcaggtcattcccagcccgacggcgcttattctagtgcatctagtttctcccgtccgttggggtacccttatgtgaattcagtctcctcacacgcaagcagtccctacatctcctctgtgcagagttatccaggctcagctagtctagcgcaatcccgactggaggaccctgggcaggatctggtgccgaagcaggccatacaggtgcaggaggcagatgaggcagggtggggagggagcggcggctag

SEQ ID NO: 114830 - DNA, 516 bp, Artificial Sequence
  Description of Artificial Sequence: Synthetic coding sequence
atgactatgacaacaatgcctgagtccctgaacagccctgtgtctggaaaagcggtctttatggagttcggcccccctaatcagcagatgagtccttctccgatgtctcacggccattactccatgcactgccttcatagtgccggccattcccaaccggatggcgcctattcatctgcttcttctttcagtaggccactgggttacccctatgtgaattctgtctccagtcatgccagctccccatatatatcaagcgtgcagagctatcctggatctgctagccttgcccagtcacgactcgaggaccccggagcagactctgaaaaatctaccgtcgtggaagggggcgaagtaagatttaatggcaaaggcaagaagattcgaaaacctcgcaccatttactcgtcactgcagcttcaggccctcaacagaagattccagcagacccaatatcttgctctccctgagcgggccgaacttgctgcctccttgggccttacccagacccagtag

SEQ ID NO: 114831 - DNA, 768 bp, Artificial Sequence
  Description of Artificial Sequence: Synthetic coding sequence
atgactatgaccactatgccagagtcattgaactcacctgtgtcagggaaggccgtttttatggaattcggtccacccaaccagcagatgagcccgagcccgatgtcccacggacattactccatgcactgtctgcattctgccggccattcacaacctgacggggcctactctagtgcatcatcattctcgagacccctcggatatccatacgtgaacagcgtcagtagtcacgcttcttctccctacattagttcagtgcaatcctatcccggtagtgcttccctggcacagagcagacttgaagaccccggcgctgattcggagaagagtacagtggtggagggaggagaagtgcgattcaacgggaagggaaagaaaatccgcaaaccgaggactatctatagctccctgcagctgcaggctctgaataggagatttcagcagacccagtatctggctcttcctgagcgcgccgagttggctgcctctcttgggctgacccagacccaggttaaaatctggttccagaacaagaggagcaaatttaaaaagctcatgaagcaaggaggcgccgccctcgaggggagtgctctcgccaacggcagagctctgagtgccggatcccccccggtgcccccaggctggaatcccaattcttcgtctggaaaaggatccgggggcaacgcagggagctatatccccagttatacctcgtggtatcccagcgcccaccaggaggctatgcagcagccccaattgatgtag

SEQ ID NO: 114832 - DNA, 564 bp, Artificial Sequence
  Description of Artificial Sequence: Synthetic coding sequence
atgacaatgaccacaatgccggaaagcctgaactctcctgtgtctggaaaggcagtctttatggagtttgggcctcctaaccagcagatgtctccatcgccaatgtcgcatggccactactcaatgcactgcctgcactccgccggacatagccaacctgacggtgcctattcctctgcaagctcttttagcaggccattgggctacccatacgtcaactccgttagcagtcacgcatctagtccgtacatctccagcgtgcagagttatcctgggtccgcaagtcttgcccagagtagattggaggatcctggggccgactctgagaaatctacagttgtggaaggtggagaggtgcgatttaacggaaaagggaagaaaattaggaagccacgtacaatttactccagcctccagctgcaggctttaaacaggcggttccagcagacgcaatatctggctctccctgaacgcgccgaattggctgcaagccttgggctgacccaaacccaggtaaaaatttggttccaaaacaagcgctccaagttcaagaaactcatgtag

SEQ ID NO: 114833 - DNA, 1722 bp, Artificial Sequence
  Description of Artificial Sequence: Synthetic coding sequence
atgggcaagtgtctgagttgctgtaaagaggatcaaagtttccagagatgtagcccagaggatcaggtcagcactgatgctcaacaccggggggcttcaagcatatctcagccatcaatatctttgggtcataaaacaagctactcgccggtgacacacaaggttaacgcagctaaggcgagtagacggctgctctcagtgtcttctcccagttttagtgagcgaaggtacagcctctttgtgggcttccagaaaaggaacgcctctccctattggcagcagtccagggccaatttcgattctgaggaagacaccggattcacggacatcaagtctagcagcgaccactgcggatcctttatttcgcgcaggagaagattctcctcccggaaactgtccattgtgtcctactacaaaagcgccatctttttcgacccccaagcatctggccagaacgtcttcaacctaaacgagatagaaattttttccaaaacatcttctaacacagacgcaaagaagcacattaccatctctgcccccgagtataatacaaagaatttcaagaactttgagactaacaccacatctcccgccttcggaaacaccatagacaccgcgagttaccaacagtccacttctagcttcttttccctagctagcgacattagctcccccgaccaacaaaacggaattgccaacgacatccagcagagaggtcaactctgcaaggacctgaaggatttcctgcaccctagaccggagagttattctacgggacacagccccatcatgatcccccaacacccatctcagtccggaacttttcctttcctacataaggctgggttttcgagctcatacaagaattctggctgctttatccccccacagagcgagctcacaagcggcctatttgaggatgaggacttcgctgtgctgtttcaagacgaggatagatcgtcccccatcgagataccgaaaatcagatacataacagccaataccgatacagaggagcagagctttcccgtgccaaaggcctttaatacaagggtagaagagttgaatctggacgtgcttttgcaaaaggtcgaccacctgcgtatgagtgaaagcggcaaaagcgagagcttcgaactcctaagggatcataaggaaaagtttagggatgaaatcgaatttatgtggagatttgcacgggcctacggagatatgtatgagctttctaccaatacacaggagaagaagcactacgctaatattggcaagactctctccgaacgggccatcaatcgagcgcccatgaacgggcattgccacttgtggtacgccgttctctgcggctatgtatctgagtttgaaggcctgcagaacaagatcaactatgggcatttatttaaagaacatctcgatatagccatcaagctgctccccgaggaaccctttctttactatcttaaaggcagatactgctacactgtaagcaaactctcgtggattgagaaaaagatggccgctaccttgtttggcaaaatcccctcgtcaaccgtccaagaagccctccacaacttcttaaaggccgaggagctctgccctgggtacagcaaccctaactatatgtacctggccaagtgctacacagacttggaggagaatcagaacgccctaaaattctgtaatctagctctcctgctgccaacggtcacaaaagaagagttgtag

SEQ ID NO: 114834 - DNA, 654 bp, Artificial Sequence
  Description of Artificial Sequence: Synthetic coding sequence
atgaccggagttttcgacagtctggtggctgacatgcacagcacccagatcgccgcgtcctcaacctaccaccagcaccaacagcccccctccggcgggggggctggccccggaggaaacagttctagctctagctcgctgcacaaacctcaagagagcccaaccctgccagtgagtaccgccactgatagtagttactatactaatcagcagcatcctgctggggggggaggcggagggggatccccttatgcacacatgggatcgtaccaataccaggcatccggcctgaacaatgttccctacagcgcgaagtccagttacgacctgggatacactgccgcctacacgtcatatgccccctatggcacctctagtagccctgccaataatgaaccggagaaagaggatctggaacctgaaatccgcatcgtgaacgggaagccaaagaaggtgcgtaaacctcgaacgatctactcatccttccagctggcagcgctccaacgaagattccagaaaactcagtacctcgctctccccgaaagagccgaactcgcagcttccttaggcctcactcagacccaggttggcctcgccccttgccggggcgaggagtcagctgggctccgttggctcggctctcgaagggtgtag

SEQ ID NO: 114835 - DNA, 864 bp, Artificial Sequence
  Description of Artificial Sequence: Synthetic coding sequence
atgtccgggtctttcgatcgtaagctgagcagcattcttacggacatctctagctctctaagttgtcacgcaggatcgaaagactccccaacacttcccgagtcctccgtcacggacttgggttattacagcgcacctcagcacgattattattcaggtcaaccctacggacagaccgtgaacccctatacgtaccatcaccagtttaacctgaatggactggctgggaccggagcctacagtcctaaaagtgaatatacttacggggcttcttatcgccagtacggggcctacagggaacaaccccttcccgctcaagaccctgtgtccgtaaaggaagaacctgaggctgaagtgcgcatggtcaacgggaaacccaaaaaagttcggaaacctcgaactatctattcctcataccagcttgccgccctgcagcgccggttccagaaggctcagtatcttgccctaccagaaagggccgaattagctgcgcagcttggcctcactcaaacacaggtgaaaatatggtttcagaacagaagaagcaagttcaaaaagctgtacaaaaacggagaagtgccactggaacactcaccgaataatagcgactctatggcatgcaactctccccctagcccggctctttgggacacttcctcacattccacccccgccccggcccgttcccagctgcctcctcctctgccttatagcgcatcacctagttacctggacgacccaacaaactcctggtaccatgcgcagaatctgtccgggccccatctacagcagcaacctcctcaaccagccacactgcatcacgcgtcacctgggccaccacccaaccctggcgctgtctactag

SEQ ID NO: 114836 - DNA, 723 bp, Artificial Sequence
  Description of Artificial Sequence: Synthetic coding sequence
atgaccagcctaccttgtcctcttccgggacgggacgctagtaaggccgtcttcccagacctggctccagtgccaagcgtggccgcggcatacccccttggcctttctccaacaactgcagcatctcctaacctgtcctattcgcgtccatacggccacctgctgagttacccatacaccgagcccgctaaccccggagactcctacctttcctgccagcagcctgccgccctgtctcagccgctgtgtggccctgctgaacaccctcaagaacttgaggcggactctgaaaaaccccggctttcgcctgaaccctcagaacgtcggcctcaggccccggccaaaaaacttcgaaaaccaagaaccatttatagttcgcttcaactgcagcacctcaatcagagatttcagcatacgcagtatcttgccttgcccgaacgagcacagctggcagcacagctgggactcacacagacccaggtcaagatctggtttcagaacaagagatccaaatataaaaaacttctgaaacagaatagcggagggcaagagggtgatttccctggacggacattttctgtgtccccatgtagcccccctctgcccagtctctgggacctgcctaaagcaggaaccctgccaacttccggatacgggaatagttttggtgcatggtatcagcatcactcatcagatgtcctggccagcccccagatgatgtag

SEQ ID NO: 114837 - DNA, 507 bp, Artificial Sequence
  Description of Artificial Sequence: Synthetic coding sequence
atgaaactgtcggtcctccctccgcggagcctactggctccctacacggtcctgtgttgccctcccgactcagaaaaacctcgcctatcaccggaaccttcagagagacgacctcaagcaccagcaaagaagttgaggaaaccccggaccatctactcgtctctgcaactgcagcatctcaatcagcggttccaacatactcagtacttggccctacctgaacgcgcacagctcgctgcacagctgggcctcacgcagacacaagttaagatctggttccaaaacaaacgtagtaagtacaaaaagctgctgaaacagaacagtggtggccaagaaggggatttccctgggaggacattcagtgttagtccatgctcaccacccctccctagcctctgggacctgcctaaggctggcactctgccaacatctggttatggcaattccttcggggcttggtaccagcaccactctagtgacgtcctggcctcgcctcaaatgatgtag

SEQ ID NO: 114838 - DNA, 1473 bp, Artificial Sequence
  Description of Artificial Sequence: Synthetic coding sequence
atggaccataccgacaacgagttgcagggaacaaacagctctggctcactcggtggattagacgttcggcgtagaatacccatcaaactgatcagtaaacaggctaacaaggccaagcccgcccctaggactcaacggactatcaacagaatgccagcaaaggccccccccggtgatgaaggattcgactacaatgaggaggagcgttatgattgtaagggtggcgagctgtttgctaatcagaggcggtttcccggccatctgttctgggactttcaaatcaatatactcggcgagaaggacgataccccagttcacttctgcgacaagtgcgggctgccaatcaaaatctatgggagaatgattccgtgtaagcacgtattctgctatgattgtgccattttgcacgaaaaaaagggagacaagatgtgtcccgggtgctctgatccagtgcagaggattgagcagtgcacccgcggtagcctgtttatgtgttctatcgtgcaaggctgtaagaggacatacctgtcccagagggatctgcaggcccatataaatcaccgtcacatgagagcgggcaagcccgtgacacgggccagcttggaaaacgtacatcctccaattgctccaccacctacagagattccagagcggttcatcatgccaccggataaacatcacatgagccacatcccgcccaagcaacatatcatgatgcctccgccccctctgcagcacgtaccgcacgagcactataatcaacctcatgaagacattcgtgcaccgccggccgaactttcaatggctcctccacctcctcgctccgtgagccaggagacctttagaatcagcacaaggaagcattccaaccttataactgttcctatacaggatgacagcaacagcggtgctagagagcccccgccccccgcccctgcgccagcccatcatcatccagagtaccaggggcaacctgtggtaagtcatccccatcacattatgccgccccagcaacattatgccccacccccccccccgccaccacccatcagccaccctatgcctcatcctccccaagccgccggcaccccccatctcgtgtacagccaggcccccccaccaccgatgacgtctgcgccgccgcccattacgccccctcctgggcacattattgctcagatgccaccttatatgaatcacccacctcccgggcctccccctcctcagcatggtggtccccctgtcactgccccaccgcctcaccactacaaccctaatagccttccccagttcaccgaggaccaggggaccctttcaccccccttcactcagccggggggtatgagcccgggaatctggccagccccccgcggcccgcccccccccccaaggctccagggccctccctcacaaaccccccttcctggacctcaccacccagatcaaaccagatacagaccgtactaccagtag

SEQ ID NO: 114839 - DNA, 798 bp, Artificial Sequence
  Description of Artificial Sequence: Synthetic coding sequence
atgatgaccatgactacaatggccgatggcctcgaaggccaagatagttcaaaatccgcctttatggagtttggccaacagcagcagcagcagcactcccctgccatggccggggcacattatcctttacactgcttacatagtgcagccgccgctgcagcggccgggtcgcaccaccaccatcatcaccagcaccaccaccatggtagtccatacgcatcagggggaggtaatagctataaccaccggtcgttagccgcttatccgtacatgagccattctcagcactccccatacctacagtcataccacaactccagtgccgccgcgcaaaccagaggggacgatacagatcagcagaaaacaactgtgatcgaaaatggcgaaatccgttttaatgggaagggaaagaaaatccgtaaaccgagaacaatctacagtagcctccagctccaggctctcaaccaccgattccaacagacacagtatctggcgttgccagaaagagccgaacttgccgctagtcttgggttgacccagacccaagtcaagatttggtttcaaaataaacggtctaagtttaaaaaacttcttaagcagggcagcaacccccatgaatcggatcctctccaaggctccgcggccctttcgccgagaagccccgctctgccacccgtgtgggatgtctccgcatctgcgaaaggcgtgtcaatgccccccaattcatacatgccaggttactctcactggtactctagcccacaccaggatacgatgcagaggccacaaatgatgtag

SEQ ID NO: 114840 - DNA, 882 bp, Artificial Sequence
  Description of Artificial Sequence: Synthetic coding sequence
atgatgaccatgacaaccatggcagacggtctagagggccaggactctagcaaatctgccttcatggaattcgggcaacagcagcagcagcagcagcagcagcaacagcagcagcagcagcagcagcagcagccaccacctcctcctccacctcctccacagcctcacagtcagcaatcaagccccgccatggccggggcccactatcccctgcattgtttacactccgccgcagcggcagctgcggctggatcccatcatcaccaccaccaccaacatcaccaccatggcagcccttacgcatctggcggaggcaattcatataatcatcggagcctggctgcttatccctacatgagtcattcgcagcatagcccctacctgcagtcttaccataactcaagtgcggctgcacagacaaggggagatgacacagaccagcagaagactactgtgatcgagaatggagagatccggttcaacggaaaagggaagaaaattcggaagccacgtacaatatatagttcccttcagcttcaggctctcaatcataggtttcagcaaacacagtacttggctctcccagagagagctgaactggccgccagtctcgggttaactcagacacaggttaagatctggtttcaaaataaacgctccaaattcaagaagctcctaaaacagggttctaaccctcatgagtcggacccattacagggtagcgccgcattgagcccccgctctcctgccctccccccagtctgggacgtgagtgcctcagctaagggcgtgagcatgcctcccaactcttatatgccaggctattcacactggtattccagtcctcaccaggataccatgcagcggccccaaatgatgtag

SEQ ID NO: 114841 - DNA, 9084 bp, Artificial Sequence
  Description of Artificial Sequence: Synthetic coding sequence
atgaatctccaccaggtgctgactggtgccgtgaaccccggagaccactgcttctctgtaggctctattggcgatcaacgctttaccgcatatgcaagcgggtgtgatatcgtgatcctggggtctgatttcgagcgtctgcaaatcatccccggcgcgaaacacggaaatatccaggtgggttgtgtagattgctccatgcagcagggaaaaatcgccgcttcgtatggaaatgtgatcagtatatttgagcctgtgaacctccctaaacagaagaaaaatttggagctttactcccagtggcaaaagtccggccagttctttttagaatcaatcgctcataatatcacttgggacccgacagggtccagactgctgacggggtcctcctacttgcagctctggagcaatactaacctggagaaacctaccgaagacgaaaatctgaataagaccgacctcaatttcggggattggaagtgtatatggcactgcaaaaccgcaagccaagtgcacctaatgaagttttcaccagacggggagtttttcgcaacagcagggaaggacgactgtcttttgaaagtatggtacaacgttgagaactggagaaccgcagttacaagccctgacggctccagcgaaaaacaaagtcagggtgaaatagatttttcgtttgtatatttggcacaccctcgcgctgtgaatggtttttcatggaggaaaacttccaaatatatgcctcgcgcttcagtctgtaatgtgctgctgacttgttgtaaggataatgtctgtagactttgggtggagacgtttctgcctaatgattgtcttctctacgggggggactgttcccactggacggaaagtattaatctgacgaataacttcaaacggaatgcctcaagcaaggagcgcgtacagaacgctcttgaggtgaacctgcggcacttccggagggggcgtaggagatccctggccctggttgcccatacgggctacctgccacaccagcaggacccacaccacgtccatcgaaatactcccctgcacgccaacgctctctgtcactttcacatagcagccagcatcaaccccgccaccgatatacccctgctgcccagcatcacgtcactgtcattaaatgagaacgaagaaaagaccggtccgttcgttgtgcactggctgaataacaaagaacttcactttactctgagcatggaagtgtttctacagcagctgcgtaagagtttcgagcagccttcctcagaggcctctgtggaagactctaatcaagctgacgtcaaatccgacgaggagaccgacgacggcgtggacgatctgaaaatcaatccagagaagaaggagctcgggtgcgacaagatggtgccgaactcatcattcacctctctctccagtgcggcaatagaccaccaaatcgaggtactcctgtctgagtggtcaaagaatgccgacatgctgttttccatccaccccatggatgggagtctccttgtgtggcatgtggactggcttgatgagtaccagcctggtatgttcaggcaggttcaggtgagctttgtaagtagaatacccgtagcatttccaactggggatgcaaattcgctttgtaagagcataatgatgtatgcctgtaccaagaacgttgacctcgctattcaacagggcaagcagaagcccagcggactgacacgtagcacaagtatgctgatctcgagtgggcacaataagtccagcaacagtctgaaattgagtatcttcaccccaaatgtgatgatgattagcaagcacgccgatggatccctgaaccagtggctcgtaagctttgctgaggaatccgcattctctaccgtccttagcatcagtcataaatcccggtattgtggacacaggttccacctcaatgatctggcatgccactctgtactgccgctgctactcactacatctcaccataacgcgcttagaacacccgatgtggacaatcctgaacagccctttgatgctcttaacattgaagagtgcagcctgacacagcagaacaagtcaacagtggacgtcgccttccaggaccctagtgccgtttacagcgagctcatcttgtggcgcgtggaccccgttggccctcttagcttttctgggggtgtatccgaactggcacggataaacagtctgcatgtgagcgctttcagcaacgttgcctggctgcccacactcataccaagctactgtctcggtgcatattgtaattccccaagtgcctgttttgtcgcttccgacggacagtatctcaggctgtacgaagctgtgatcgatgccaagaagctgctgagcgagctgtctaatcccgagatcagtaagtacgtgggagaagtcttcaatatcgttagccaacaatcaacagctcggcctggatgcatcatagccctcgatccaatcacaaagcttcatggcagaaaaacacagctattgcacgtctttgaggaggatttcattctcaacaatctagaaaagaaaagcctgggcaaagattctattctgtcaaacgccggatccagtcccaacggattttccgagaagttctatctcattgtgatcgaatgcactcaagacaaccgcagcctcctccacatgtggaatctacatctgaagagtatccccgtttctctggacgagaaagtagatacaaaattgtcggaggccgtgtggcagccagaggagcattattcatctagtccagagaaaattctgtctcccttcagccagaaataccaggcatgtagggcaaatttgcagtcaacctcacggctcacactcttttccgaaatggtctattcacaggaattgcatctcccagagggggtcgagatcatctcaatcaagccaagcgctggccacctgtctagttcttccatctatcccgcctgtagcgctccgtatctcctggctacgtcctgcagcgacgaaaaggtgaggttttggcgttgtcgggtaaccgacggcgagtcagccacctcaaagaatggcaagatcgacttagcttacatctgggaagagtggcctctactcatcgaagacgggttgcaatcaaacagctcgatcactgtaccagggagacccgtagaagtgagctgtgcccacaccaatcgtctggcagtggcatataagcaacctgccagtaactctagatcgtcccaagattttgtgatgcatgtcagcatattcgagtgcgagtcaaccggcggcagttgttgggttctcgagcagactatacatctggatgagctttccaccgtgctcgattcaggcatttcagtagatagcaatttggttgcgtacaataaacaagatatgtatctttccagtaaagagaacattacctcgaacaccaagcatctggttcacctggattggatgagtcgcgaggacggtagccatatactcaccgtgggcattggttctaaacttttcatgtacggacccctcgctgggaaggtgcaggatcagacagggaaagaaaccctggctttcccactctgggaaagcacgaaggttgtccccttgtccaaattcgttttgctccgtagtgtcgacttggtgtccagcgtggatggctctccacccttccccgtgagcctgagctgggtaagggacggaattctggtcgttggcatggattgtgagatgcatgtgtactgccagtggcagccctctagtaaacaagagcccgtgattaccgacagttactcgggtagtacaccctccattaccagccttatcaagcaatccaacagtagcagcggacttcacccacccaaaaagaccctgacacgatccatgacttccttggcccagaagatctgtggtaagaagactgcattcgacccaagcgtggacatggaggactccggactctttgaggccgcacacgttttatcgcccacactgcctcagtatcatcctttgcagctattggagctgatggatctcgggaaggtccgccgcgccaaagccattctgagccatctggtgaaatgcattgcaggcgaggtggttgcattaaacgaggctgagtcaaatcatgagagaagactcaggagtttgacaatcagtgcgagtggctcgactacaagggatccccaagcttttaataaagcagaaaatactgactatacagaaatagacagcgtgccccctctacccctctacgcactgctggccgcagatgacgacagctgctactcgtctctcgaaaagtcctctaatgagagcacactgagtaaaagcaaccagctgtcgaaagagagctacgatgagctcttccaaactcagctcttgatgaccgatacccacatgttggaaaccgacgaagaaaacactaagccgagggtcatcgatctatcccaatatagtccgacctactttgggccagagcatgctcaggtactgtccggccacctcctgcactcttccctgccaggtctgtcacgaatggaacagatgtcgttgatggccctggccgataccattgctaccacgagcacggacattggggagagtagggacagaagccaaggtggcgaaacactggatgagtgcggactgaaattcttgctcgccgtacgactgcacactttcctaactaccagtctccccgcttatagggctcagctccttcatcaaggcctgagcacatcacattttgcttgggccttccactcagtggctgaggaggaattgctgaatatgttacccgctatgcagaaggacgacccaacctggtcagaattaagagcaatgggcgttggctggtgggtgaggaacactcgcattcttcgtaagtgtatcgagaaagtagcaaaggccgccttctaccgcaaaaacgaccctctggatgccgcaatcttttatttggcaatgaagaaaaaggctgtgatttggggattgtacagagccgagaagaatacacggatgacccagttctttgggcacaacttcgaagatgagagatggcggaaggccgcactgaagaatgccttttcattgcttggaaaacagcggtttgagcattccgcagccttcttccttctggccggttgcctgcgggatgctatcgaagtttgcctggaaaagctcaatgacattcagctggccctagtcatagctcggctttatgaaagtgaatttgatacttcagctgcgtataagtccatactgagaaaaaaagtgctcggaattgactctcccgtgtccgagctgtgcagcctcaacatcaatatgcaccatgatcctttcctgcggtcgatggcctattggatcctcgaggactattctggggcactggagactctcatcaaacaaccaatccgagagaacgatgaccaggtgctttctgcttcaaaccctaccgtgttcaatttctataattacctgcgcactcatcccttgctcctccggaggcatttcggctcttctgacacatttagtacccatatgtccttgaccggcaaaagcggcttagccggtactatcaacctgtcggaacggcgcctattctttacaacagcaagtgctcatttgaaagcgggctgccccatgctggccttagaagtgctgagtaaaatgcccaaggtgataaaaaagacaaggccattttaccgcgcctcctcctttctcgacacctcaaaggactgctctccctcttctcccctcaagctggacgcacgcgaagataaatcctctgccgttgactggagccagtcgctgatcaacggttttggctctagcagtgaggggtcaagcgaaaagcagtccaactctacgctgtcattcgattggagtcagcccagtgtcgtcttccaggacgactccttagagctgaagtgggatagcgacaacgatgaggagaatgaggacgtgccaattagcatgaaggagctaaaaccactgcagaggaagactgataagaagctggacgacataagctctaactatacggagtctttcagcacactggatgaaaacgatctcctgaatcccagcgaggatataatcgctgtgcagctaaagtttagagcctgcctaaaaatccttactgttgaactgagaacattgagcaccggctacgagatcgatgggggtaagctgcgttaccagctgtaccactggcttgaaaaggaggttatagctctgcagcgcacctgtgacttctgctctgatgcagaggaactgcagagcgcattcggccggaatgaagacgaatttgggttgaacgaggacgccgaggacctgccgcaccaaacaaaagtcaagcaactgagagaaaatttccaggagaagaggcaatggttactgaaatatcaatctctgctgcggatgttcttgagctactgcattttgcatggctcccacggcggaggcttagccagcgttagaatggagctgatcctactcctgcaagagtcacagcaggaaacttcagagccattgttctcgtctccactgagtgaacagacttccgtccctctcttgtttgcctgtaccgcaaatgctaagactgtggtcgctaatccattattacatctgagtaatctgacgcatgatatccttcacgccatcataaacttcgactcacctccccatcctgatattcagagcaataaagtatatgttatgcacactctggctgcttctcttagtgcgtgcatatatcagtgcctgtgcggctctcacaactacagttcattccagaccaatcaattcaccggaatggtgtaccaaaccgtcctgctgccccacaggcccagccttaagaccggaagcttggatgaggcactgactcctaatacttcacccgcacagtggcctggcattacctgtctgatcaggctgctgaacagctcaggcgaggaagcacaatcaggccttaccgtgctgctgtgtgagattctgaccgccgtttatttaagcttgtttatccacggtttggccactcactcctctaacgagctttttcggattgttgcccatccacttaatgagaagatgtggtcagctgtcttcggtggaggagctcacgtgccaagcaaggaacaaactcacagcaagacgctgccggtgtcaagccttgtcgaggagggcgagaagcaaaacaagaggttcaggccatcaaagatgagctgtcgtgagagcgcccctctgacaccgtcctctgctcctgtttctcaagagagtttggcagtcaaggaaaaattcatcccccccgaacttagtatctgggattacttcattgccaagccatttcttccatcctcccagtccagagcagagtacgacagcgaagaatccctgggctctgacgacgatgacaacgacgacgatgatgatgtgctagcctcagatttccatttacaggaacattctaatagcaattcttacagctggtctttgatgcgcctggccatggtgcaactggtcctgaataacctaaaaaccttttatcctttcgccgggcacgatttagctgagctgcctgtaagcagtcctttgtgtcatgcagttctcaagaccctacagtgctgggaacaggtgctgcttcggaggttggagatccacggaggtcctcctcagaattacatcgcctcacacacggccgaagagagcctgagtgccggaccagctattcttagacataaagccctgctagaacctacgaataccccctttaagtccaagcaccatctagctttgtcagtaaaaaggctctggcagtatctggtgaagcaggaggagatccaagaaacatttatcaaaaatatctttacgaagaaaaggtgcctcaatgagattgaagctgatctgggataccctggcggcaaagcacggattatacacaaggaatccgacattatcaccgccttcgccgtgaacaaagctaaccggaattgtatcgccatcgccagtagccacgacgtccaagaactcgatgtgtccggcatactcgccactcaggtctatacttgggttgacgacgacattgaagtcgagacaaaggggtctgaggatttcctcgtgatccatgccagggatgatttaaccgctgtccagggcaccaccccttatacccatagcaaccctgggacccccattaacatgccatggttgggatccacccaaaccggtcgcggggcttcagtaatgattaagaaagctattaataacgtgcgacgaatgacatctcatcctaccttgccgtactaccttacaggcgcccaggatgggagcgtgcggatgttcgagtggggacactcccaacagatcacttgtttcagaagcggggggaactcccgtgttacgaggatgaggtttaactatcaagggaacaagttcggaatagtcgacgccgatggatacttgagtttgtatcaaaccaattggaaatgctgtccggtgacaggctctatgcctaaaccctaccttacctggcagtgccacaacaagactgccaatgacttcgtctttgtctccagcagttctctgatcgccacagccggcctttccactgacaacaggaacgtttgtctttgggacaccctggtcgcgccagccaacagcctggtccatgctttcacatgccatgatagcggggcgaccgtcctggcctatgcccccaagcatcagctgcttatttctggaggacgaaaaggctttacttatgtgtttgacctctgtcagcggcagcagagacaactgttccagagccacgactcccctgttaaagccgtggccgtggaccctacagaggagtattttgtgaccggttctgccgagggcaacatcaagatttggtccctctccacattcgggcttctgcacacctttgtttctgagcacgcccgccagagcatattcagaaatattggcaccggagtgatgcaaatcgaaaccgggcccgctaatcatattttctcctgtggggcagatgggaccatgaagatgcgtatactgcctgaccagttctcaccacttaacgaggttctgaagaacgacgttaagtttatgctatag

SEQ ID NO: 114842 - DNA, 1770 bp, Artificial Sequence
  Description of Artificial Sequence: Synthetic coding sequence
atgaatctgcaccaggttctgacgggagccgtaaaccctggagaccactgctttagcgtgggcagcattggcgaccagagatttactgcatatgcatctggctgcgatattgttatactcggaagcgactttgagcgcctacaaattatccccggggctaaacacggtaatattcaggtgggttgcgttgactgtagcatgcagcagggcaagatcgcggcttcctacggtaacgtaatcagtatctttgaacctgtgaaccttcccaagcagaagaagaacctggaactatacagtcagtggcagaagtcaggacaattcttcctagagagcatcgctcacaatattacatgggaccccacaggcagccggttattaaccggttcttcctatctccagttgtggagtaatacaaatctggagaaacctaccgaagatgagaatctgaacaaaacagacttgaattttggggactggaagtgcatttggcattgcaagacagcatcccaagtccatctgatgaagttcagcccggacggggagttctttgcaacagccggtaaggatgattgtcttctcaaggtatggtataacgtcgagaactggcgcactgccgtgacaagccctgacggatcttctgaaaagcagtctcagggcgaaatagacttctcatttgtttatttggcgcacccccgggcggttaatggcttctcctggcgaaaaacctccaaatatatgccccgggccagcgtgtgcaacgtacttctgacgtgctgtaaagataatgtgtgcaggctttgggtcgagacctttttaccaaacgattgtcttctctatgggggcgactgctcgcattggactgaatcaattaatctgaccaataactttaagcgaaacgcatcctcgaaggaacgagtgcagaatgcactggaggttaacctgcgccactttcggcgcgggcgacgccggtccctggcactggtagcccacacaggatacctgccacaccagcaggacccacaccacgttcaccgaaatacacccctacatgccaatgccctctgccactttcacattgccgccagcatcaatccagccactgacatccccctcctgccaagcattacttctttgtccttgaatgagaatgaggagaagaccggtccattcgtcgtccattggttaaataataaagagctgcactttacactgtccatggaagtgtttctgcagcagctaagaaagtcctttgagcaacccagcagtgaagcctcagtcgaggactctaatcaggcggatgtgaagagtgacgaagagaccgacgatggagtggacgatctgaagattaaccccgagaagaaagagttgggatgtgataagatggtcccgaactcctccttcacatctctaagcagcgccgccattgatcatcagattgaggttcttttgtctgagtggtccaagaatgcggacatgctgttttccatccaccctatggacggatccctgctcgtttggcatgtggactggctcgatgagtatcaacccggcatgttccggcaggtgcaggtgagctttgtctccaggattccggttgctttcccaactggcgatgctaattctctctgcaagtctatcatgatgtacgcttgcacaaagaacgttgatttagcgattcagcaggggaagcagaagccgtcaggtcttacccgatccacctcaatgttgatctctagtggccataataagtccagtaattccctcaaatag

SEQ ID NO: 114843 - DNA, 9147 bp, Artificial Sequence
  Description of Artificial Sequence: Synthetic coding sequence
atgaaccttcatcaggtcttaactggcgccgtcaatccgggagaccactgtttttcagtgggttcaattggagaccagcggtttaccgcctacgcttcggggtgtgacattgtcattcttggaagcgattttgagcggctgcagatcattcccggtgcaaagcacgggaatatccaagtgggatgcgtggactgtagtatgcagcagggcaagatcgccgcctcctacggtaatgtaatatccattttcgaacccgttaacctacccaaacagaagaaaaatctggagctgtactcccaatggcaaaaatcgggacagtttttcctcgaaagtatcgcccataatattacttgggaccctaccggcagtaggctgcttacaggctcaagctatcttcagctttggtctaataccaatcttgagaagccaaccgaagacgagaatctgaataagaccgacttaaattttggggattggaagtgtatctggcactgcaaaaccgcttcccaggtgcacctcatgaaattctcgcctgatggcgagtttttcgctaccgcgggaaaagacgattgtctcctgaaagtgtggtataatgtcgagaactggcgcactgctgtgacttcgccggacggatcttcagaaaagcagagccagggggagatcgacttcagcttcgtttatctcgcccatccacgtgctgtaaacggattctcttggagaaaaacctctaagtatatgccgcgagcctctgtgtgcaacgtgctcttaacatgttgcaaggacaacgtatgcaggctgtgggtggagactttcctcccaaacgactgtcttttgtacgggggggactgctctcactggacagaaagcatcaacctgactaacaattttaaacggaatgcatcgtctaaggaacgcgtgcagaacgcactcgaggtcaatctccgacacttcagacgcggaagaaggcgttcactggctctggtcgctcacactggctatttaccccaccagcaggacccccaccacgtacaccgcaacacaccgcttcatgctaatgccctctgtcacttccatattgccgcctctattaacccagccacggatattcctctgctgccctctatcacaagtcttagcctgaacgagaatgaagaaaagaccggcccctttgtggtgcactggctgaataacaaggaactgcattttaccctgagcatggaggtttttctgcagcagctccgaaaatccttcgaacagcccagttctgaggcttcagttgaagacagcaatcaagccgacgtgaaaagcgatgaggagacagacgatggcgtagatgacctgaagattaaccctgagaagaaggagctgggatgtgacaaaatggtacctaattccagtttcaccagtttgtcatctgccgcaattgatcatcagatcgaggtgctccttagcgagtggtccaagaacgcagatatgctcttcagcatccaccccatggatgggtcgctacttgtttggcacgtggattggcttgatgagtaccagccaggaatgtttcgtcaggtgcaggtttcttttgtgtctaggatccccgtggcgtttcctacaggagatgccaatagcctttgcaaaagcatcatgatgtatgcatgtactaagaacgtcgatctggctatccagcaagggaaacaaaaaccatcaggcctgacgcggagtacctcaatgttaatatcaagcggacataataaatcttcaaactcattgaagttgagcatattcacaccaaatgtcatgatgatcagtaagcacgccgacggaagcctgaatcagtggctagtcagttttgccgaagaatccgccttctcaacggtgttatcaatatcccataagtctcgatattgcggtcacagattccacctcaatgacctggcctgccattctgttctcccactgcttctcacgacttcgcaccacaacgccctgcgaactccagacgtagataatccagagcagccttttgatgctcttaatatagaagagtgtagtctcacccagcagaacaaatccacagtggatgttgcatttcaggacccctccgcagtttattctgagctcatcctgtggcgagtggaccccgtcggcccactctcctttagtggaggggtgagcgagcttgcccgcataaattcgctccatgtgtccgccttcagtaatgtggcctggctccccactttgatacccagctattgcctgggcgcctattgcaactctccatcagcctgttttgttgcctcagatggtcagtatctgcggttgtatgaggcagtgattgacgccaagaaactgctcagtgaactgtccaacccagagatcagtaaatacgtgggcgaggttttcaatatcgtttcccagcagagcacagcaagaccaggctgcatcattgccttagatccaattaccaagcttcatggacggaaaacccagctcctccacgtgttcgaggaggattttattctgaataacctcgaaaagaaatccctgggcaaagattccattctatccaatgcaggatcctctccaaacgggttctccgaaaaattttacttgatcgtgattgaatgcacacaggacaatcggtctctgctgcatatgtggaacctccatctgaaatccattcctgtctcacttgacgaaaaggttgatactaaactgagtgaggctgtatggcagcccgaagaacactacagcagtagccctgagaaaatcttatctcccttctcccagaagtaccaggcttgcagggccaacctgcagtctacaagccgtctgaccctgttcagcgaaatggtctattctcaggagctccatctgcctgagggggttgaaatcataagtattaaaccaagcgctggacacctctcttctagcagcatctatccggcttgttctgctccctacctgctggcgacaagctgttctgatgagaaggtaagattttggagatgccgcgtgaccgatggtgaatcggcgacttctaagaacggcaagatcgatcttgcctatatttgggaggaatggccactattgattgaagatggtctgcagtctaattcttctattacagtgcccggcagacccgtggaagtttcctgtgctcacacaaacagacttgccgtggcttataaacagcccgccagtaattcaagatcttcacaggactttgtgatgcacgtaagcatcttcgaatgcgagtccacaggaggctcctgttgggtactggaacagactatccacttagacgagctgtctacagtccttgattctggcatcagcgttgatagcaacttagttgcgtataacaagcaagatatgtatctgtcctctaaggaaaatattaccagcaataccaagcatcttgttcacctggattggatgagccgtgaggatgggagtcatattctcaccgtcgggatagggtcaaagctctttatgtatggccctttggccggaaaagtgcaagaccagaccggcaaggagaccctggccttcccactgtgggaatccaccaaagtcgtacccctgtcaaagttcgtgttgctgaggagtgtagatttggtttcatccgtcgatggaagccctcctttccctgtcagcttgagctgggtccgcgatgggattctagtcgtaggaatggattgcgaaatgcacgtatactgtcagtggcagccatcatcaaaacaggagcccgtgatcacagacagctacagtggtagcacaccaagtatcaccagcctgattaaacaatccaactcatcgagcggcctacatccgccgaagaaaaccctgactagatctatgacttcgttagcccagaagatctgcgggaagaagacagcttttgaccctagtgtcgatatggaggactcaggccttttcgaagctgcccatgtgctcagccctacgctgcctcagtatcatcccttacagctgctagaacttatggatttggggaaagttcgcagggcaaaggccatccttagccatctggttaagtgcatcgccggcgaggtagtcgctttgaatgaggctgagagcaatcatgagaggaggctgaggtccctcacaatttctgcgtctgggtccaccacaagagatccacaggcatttaacaaggctgagaataccgactacacagaaattgattcagtcccaccgttgccactatatgcccttctggcagccgacgatgattcctgttattcaagcttggaaaaatccagtaatgagagcacattaagcaagtccaaccagttgtccaaggagtcctacgatgagctgttccaaacacaattactcatgactgacacgcacatgctggaaaccgacgaggagaacaccaagccacgggtgatcgacttatcccagtattccccaacgtatttcggcccagagcacgcccaggtattaagcggacacctgttgcacagctcactgccagggctttccaggatggagcagatgtcattgatggccctagcagatactatcgcaaccacatctaccgacattggggagagccgagatagaagccaggggggggagaccctggacgagtgtggtctaaaattcctgctggcagtgcggcttcatacttttcttactacatctttgccagcttacagggcacaactgctgcaccaggggctatctacaagccactttgcatgggcctttcatagtgtcgctgaggaggagctgctgaacatgctccccgcaatgcagaaagatgacccgacgtggtccgagttaagagccatgggggtcggctggtgggtaaggaatacccggatactcagaaagtgcatagagaaggtcgctaaagcagcgttctacaggaagaacgaccccctggacgcagctattttctacctggccatgaaaaaaaaggccgtgatatggggcctctacagggcggaaaaaaacacgaggatgacccaattttttgggcacaactttgaggacgaacggtggagaaaagccgccctaaaaaacgccttttctctactgggtaaacagagattcgagcattctgcagcattcttcttgctggccgggtgtttacgggacgcgattgaagtctgtttggaaaagctaaatgacattcagctggctttggtcatagcgagactgtatgaaagcgagttcgatacctccgcggcctataaatcgattctcagaaagaaagtcttaggcattgattcgccggttagtgagctctgtagcttgaacatcaatatgcaccacgaccccttcctgcggtccatggcatattggatcctggaggattacagcggcgccctggagacattgataaagcaacccattcgtgaaaacgacgaccaagtgttatcggcatcgaatccgacagtcttcaacttttataactacctacggacacaccctcttctccttcgtagacacttcgggtcctccgatactttctccacacatatgtcactcacaggtaaatccggtctggccgggacaattaacctgagcgagagacgcctgttttttacaactgcgagcgcccacctgaaagcaggctgtcctatgcttgcactcgaggtgctgtccaagatgcctaaagtcataaaaaaaacaagaccattctaccgggcctcttctttcttggataccagtaaggactgtagtcccagctcacctttgaagctcgatgcccgcgaggacaaatcaagtgcggttgattggtcgcaatctctcatcaacgggtttggcagcagtagtgaaggctctagcgaaaaacagagcaacagcactctgagttttgactggtctcagccaagcgttgtgttccaggacgatagcttggaactgaagtgggactcagataacgacgaggagaatgaggatgtgcctatctccatgaaagaacttaagcctctgcagcggaaaacagacaaaaagctcgacgatatatcctctaactacaccgaaagcttcagcactctggatgagaatgatctactcaatcctagtgaagacatcatcgccgtgcagctgaaatttcgagcctgtttgaagattctcaccgtggaactacggactctgtctacaggatatgaaatcgacggcggaaagctgcggtaccagctctaccactggctggaaaaggaggtgatcgccctgcagcggacctgtgatttttgctcggacgcagaggaactacaaagtgcatttgggcggaatgaggacgaatttggtctaaatgaggatgccgaggacctgccccaccaaacaaaagttaaacaactgcgagaaaactttcaggaaaaacgacagtggctgcttaagtatcaaagcctattgcgcatgttcttgagctattgtattttgcacgggtcgcatggcggtgggctcgcttctgtgcgtatggaattgattctgctcctgcaagaaagccaacaggagacctccgagcctttgtttagctcccctcttagcgagcaaacctccgttccactcctcttcgcctgtacagcaaatgcgaaaaccgttgtggcgaatcctcttcttcacctcagcaatttgacgcatgacatcttgcacgcaatcattaatttcgacagcccgccccatccagatatccagtctaataaggtgtacgtaatgcacacactcgccgcttccctgtccgcatgcatctaccagtgtctttgcggctctcataattactcgtcatttcaaacgaaccagttcactggcatggtgtatcagaccgtcttgctgcctcacagaccctcactgaaaacgggatctttggatgaagccttgactccaaacacctctcccgcacagtggcctggcataacatgcttaatcagacttctcaatagcagtggcgaggaagcgcagtcaggacttaccgtactgctctgtgaaattcttaccgcagtttatctctctctctttatccacggtctggcaacacatagctcgaatgaactttttcggattgtggcccacccactgaacgaaaaaatgtggagcgctgttttcggcgggggggctcatgttccaagcaaagaacagacccacagtaaaaccttgcccgtgagttcactggtggaggagggggaaaaacagaataaacgttttagaccatccaagatgtcttgcagggaatccgctcctttgacgccgtctagcgcgcccgtttcccaggagagcctggccgtaaaagagaaattcattccaccagagctgtcaatctgggactattttatcgctaaaccctttctgccctcatcacagtctcgcgctgagtacgatagcgaagagagtttggggtctgatgatgatgacaatgatgatgatgatgatgtcttagcaagcgattttcatctccaggaacactcaaattccaacagctactcttggagcctaatgcgactggccatggtgcagctcgtgctcaacaatctgaaaaccttctatccctttgctgggcatgatttagccgagttgccggtgtcatcacccctctgtcatgctgtgctgaagactctccagtgctgggaacaggtcttgcttaggcgacttgaaattcacggaggtcctccccaaaattatatagcttctcacactgcagaggagagcctgagtgcggggccagccatacttaggcacaaagccctcctggagcctacgaatacaccattcaaatccaaacaccatttggccctgtctgtcaaacgcttatggcaatatctcgtcaagcaggaggaaatacaggaaaccttcattaaaaacattttcaccaaaaaaaggtgcctgaacgaatctcttgaggacaactccgaaacaattaagaatagtatgatggaggagcccaatatcaataaaatcgaggccgacctgggctatcctggggggaaggctcgaatcatccacaaagaaagtgacatcatcaccgcctttgcggttaacaaggccaacagaaattgtattgcgatcgcctcctcgcacgatgtgcaggagctggacgtctctggcatcctggcaactcaggtttacacctgggtcgacgacgatatagaggttgagaccaaaggttcggaggacttcctggttatccatgcccgcgatgatctgacggccgtgcagggaacaaccccgtatacccacagtaacccaggtacacctatcaacatgccgtggctgggttccacccagacaggccggggtgcctcagtcatgattaagaaggctatcaacaacgtcagacgcatgacttcccacccgaccttgccttactacctgacaggagcacaggacggcagcgtccgcatgtttgagtggggccattctcaacaaataacgtgctttcgctccgggggaaacagcagggttacccggatgcgctttaactaccaggggaacaaattcggtatcgtggatgctgatggctacttgagcctgtatcaaaccaattggaagtgttgtccagtcaccggatcaatgccaaagccttacttaacttggcagtgccataataaaacagctaacgactttgtgtttgtgagcagctccagtcttatcgccactgctggtctgagcactgacaaccgcaatgtgtgtttatgggacacactggtggcccccgctaatagtctcgtgcacgcctttacgtgccatgactctggtgccaccgtactggcttacgcccccaagcatcaattactgatcagtggcgggaggaagggctttacctatgtgttcgacttgtgtcagcgacagcagcgtcaactatttcagagccacgatagcccagtgaaggccgtggcggtagaccccacagaggaatactttgttacaggctccgcggagggtaacattaaaatctggtcgctatccacttttgggctcctccatacctttgtgtcggagcatgccaggcaaagcatcttccggaacatagggactggggttatgcaaatcgaaactggtccagccaatcatattttcagttgtggcgctgatggcaccatgaagatgcgaattctgcccgaccagttttcacctctgaatgaggtgcttaaaaacgacgtgaagttcatgctgtag

SEQ ID NO: 114844 - DNA, 9111 bp, Artificial Sequence
  Description of Artificial Sequence: Synthetic coding sequence
atgcatctccatcaggttcttaccggggctgttaatcctggcgataattgttactccgtcggaagcgtgggtgatgtgccttttaccgcatatggttccggatgtgacatcgttatccttgcgaatgatttcgagtgcgttcagatcatccctggcgctaagcatggaaatatccaagtgagctgtgtggagtgttccaatcagcaaggccggattgccgcgtcatatgggaacgctgtgtgtatcttcgaaccgctcggtattaattcccataagagaaactgccagctgaaatgccaatggttgaaaacaggacaattctttctgtccagcgtcacttacaatttagcatgggacccacaggataaccggctgctgaccgctactgatagtatccaactatgggctcctcccggtgacgatattctggaagaggaggaggaaattgataacactgtcccacccgttctgaatgactggaagtgtgtttggcagtgcaagacaagcgtgagcgtccacctgatggagtggtcccctgatggagaatactttgctaccgccggcaaggacgattgtctcctcaaggtatggtaccccatgacgggctggaagtcttctattatcccacaggatcatcacgaggtgaagcgacgccaatcctcaactcagttctcattcgtgtatcttgcacatccccgcgccgtgaccggatttagctggaggaaaacatcaaaatatatgccgaggggaagcgtctgtaacgtgcttctcactagctgtcatgacggagtctgtagactatgggcggagactctgttgccagaagactgcctgttgggagagcaaatttgcgagactactacctcttccattgctagtagcttgagtcacgcaggccggcataaagacagaatccagcatgccttggaaactatccatcacctgaaaaatcttcgcaagggacagaggcggagcagcgtgctcgtcacccacgctgagcttatgcctgatcagacggccatgcacgaggtacagagacatatcagccaccacgccaacgccttgtgtcacttccatattgcggcctcaataaacccagccaccgatatcccaaacgttcttgtcggaactgcttttaacgtggacgacggtaacggtggtttcgtggttcattggctgaataacaaggaattccatttcacaagttctacagaggtgttcatgcatcagctccgcaagctatctgataagcaggtggaccatgagaatgatgacgctgacagagaggacgaagaacactcccaggaggaccgagaacgaggcctgcacatgaagcttgatcacgatctgagcttggaccgggaatctgaagcaggcaccggctcttccgaacacgaagacggtgagcgcgagggcagcccgaggacatactctcggctgtccgtgcccatgccactgccaacagtgctgcttgatagaaaaatcgagactctgcttacagagtggaacaaaaaccctgacatgctttttacaatacacccggttgatggtactttcctagtgtggcatgtgaagtacctggacgagtacaacccgggcatttttcgccaggtgcaggtgtcattttcgtcgcgtatcccagtcgcttttcccagtggggacgcctctagcctgtcaaagaacattatgatgtacgcctgcattaatgcaaccaaggacagccatcataccctgttacatcaggagggcatgtccgtgggcagtccccatgggagccagccacattctcggtcacatagtacacacatgaatattttagcccctacagtgatgatgataagcaaacacattgacggtagtctaaaccaatgggcagtgacattcgcggacaagtccgcttttaccacggtattaaccgtgtcccacaagttccgctattgtggtcacagatttcatctgaacgaccttgcttgccactccgtgctccctttgttgctgacttccagtcaccacaatgccctgttgacccccgagctggactgtcagtgggacagcgataataagctctcaagactgatggaccccgtaaagcacataaagggctccagcaagcagccattgaggaacgcagccacccgcacctttcacgacccaaatgccatctactccgagctcatactttggagggttgaccccattggcccactgtcctacacggggggtgtgtctgaactggctcgcattaactccttgcacacatcggcattttctaatgtggcttggctgcccacactcatcccaagctattgtctcgggacatattgcaactctgcttccgcgtgctttgtcgcatcagatggaaagaatctccggctctaccaggcggtggtggacgcccgcaagctgctggacgagctgtctgatcccgagagctcaaagttaattggggaggtgttcaacatcgtgtcccagcagtctactgctagacccggctgcatcatcgaactggacgcaattactaatcagtgcggcagcaatactcaactgctgcacgtgttccaggaggatttcataataggctataaacctcacaaagaggatatggagaagaaagaaactgagattttttttcagcctagtcagggctaccgtccacctcctttttccgagaaattttttctggttgtgatcgaaaaggactcaaataataattctatcttgcatatgtggcatctgcacttgaagagcgtgcaagcctgtttggcgaaggctagcgagggggctagtagcgaatccttgctctccgtccctgggcagaaaaacgtcgattcatccccagagaccagtccatcggtcagtccaatgcctcatagcagctctattgcgaatctccagacagcttcaaagctgatcctttcttcgcgccttgtctattctcagcccctagatttgccggaatccgtggaggtcatcagagctactccatccgccggtcatctgagctcaagctctatctatcccgtatgcctcgctccctatttagtcgtcacgacctgctccgataacaaggtgcgattttggaaatgttgcatggaagccaatcccgagtgtaacaaaagcgacgagaaagagatctatcattggaagagatggccactgatgaatgatgagggggaggacaatagcagtaccgtgagcatcgttggacgaccagtggccgtgtcttgctcatacacaggacggctcgcggtggcttacaagcagccaattcatcacaatggattcgtaagcaaagaatttagtatgcacgtgtgcattttcgaatgtgagtccactggtggaagcgagtgggtcctagagcagaccatacacctggacgacctggtcaaggtggggagtgtgctggactcacgggtctccgtggacagcaacttgtttgtgtattctaagagcgatgccctgctctctaaagataggtacttgatccccaacatcaagcatcttgtgcacctcgactgggtgtctaaggaggacggttcccacatattaacagttggggtgggggccaatatcttcatgtatgggcggctttcgggtatcgtcaccgagcagaccaatagcaaggacggtgtggccgttatcactttgcctctcgggggatcaattaagcagggggtaaagtcaagatgggttctgctgagatctattgatctggtgtcctcagtagacggtaccccctcattgcccgtgagtctctcttgggtgcgagacggcattcttgtggtgggcatggattgtgaaatgcacgtctacgcacagtggaaacatgccgtgaaatttggggacactgaggcagatagcagcaatgcagaggaagcagcaatgcaggatcacagcaccttcaagagtaacatgctggcgcgtaagtccgtggtggagggcaccgctatatccgatgacgttttttgtagtcccacagtgatacaggacggagggctgtttgaagctgcacacgtgctgagcccaacgctccctcagtatcatcctacccagcttcttgaactgatggatctgggcaaggtgcgtcgcgcaaaagcaatactatctcatttagtaaaatgcattgctggcgaggtggcaatcgtccgcgacccagacgctggtgaggggaccaagcgccacctgtctagaacaattagtgtctcaggtagcaccgccaaggaaacagtcacagtgggcaaagatggaacccgagactacactgaaatcgattcaattcctcctctacccttgtatgctctgcttgctgccgatcaggacacgtcgtataggatttcagaggaaagcaccaaaataccacagtcctatgaggaccagaccgtgagtcagcccgaggatcagtactccgaactgtttcagatccaagatattcccacggatgacattgatctggagccagagaagcgcgagaacaagtctaaggtcattaacttgagtcagtacggccctgcgtacttcggacaggagcatgccagagttctgtcatctcacttgatgcactcttccctgcctggcctgactagattagaacagatgttcttggttgctctggccgatacagtggccacaaccagcaccgaactggatgagagtcgtgataaatcctgtagcggtagggatacactagacgagtgtgggttgcggtatctcctcgcaatgagactccacacctgcctgctcacatccctgccaccactttaccgggtacagttgctgcaccagggcgtcagcacatgtcacttcgcttgggcattccactcagaagccgaagaagagctgatcaacatgattcccgctatccagcgcggagaccctcaatggagtgaacttcgagccatgggaatcgggtggtgggtgcggaacataaacactctgcgtaggtgcattgagaaagtggccaaagcttcatttcagaggaacaatgatgcactcgatgctgcccttttctatctgtcgatgaagaagaaggcagtagtgtggggactgtttagatcccagcacgacgaaaaaatgacgaccttctttagccataatttcaatgaggaccgttggcgtaaagcagcactgaagaatgctttctccttgctgggtaaacaacgatttgagcagtccgcagccttcttcctcctcgccggctcgctgaaagacgctatagaagtgtgccttgagaagatggaggacatacagttggccatggttatcgcaagactttacgagtcggagttcgagactagtagcacttatataagtatattaaatcagaagatccttgggtgccagaaagatggaagtggattttcttgtaaacggttacatcctgacccattcctgaggtcactggcctattgggtaatgaaagattacacaagggccctggatacactgttggagcagactccgaaggaagatgacgagcaccaagtaattatcaaatcatgcaaccccgtcgctttctcgttctataattatctccgaacccaccccctgctgatacgccgtaacctcgcttccccggaagggaccctggcgactctcggactcaagaccgagaaaaatttcgtcgataaaatcaacctcatcgaaagaaagttgttttttaccaccgccaacgcccatttcaaggtcggctgccctgtacttgccctggaggttctgagcaaaatccctaaggtcactaagacgtcagctctcagtgccaaaaaagaccagcctgatttcatcagccatagaatggacgatgtacctagtcattcaaaggccctgtcagatggtaatggctctagcggcattgagtggtcaaacgttaccagcagccagtatgactggtctcagccgatagtcaaggtcgatgaggaacccctgaatctggactggggggaagaccacgactcagcactggatgaggaggaagatgacgcggtcggactggtgatgaagagcactgacgcgcgcgagaaggataaacagtctgatcaaaaggcatctgatccaaatatgcttctcaccccacaggaggaggacgaccccgaaggagacacagaagtcgatgtgatcgccgaacagctgaaatttagagcatgtttgaagattctgatgaccgagttacgtaccctcgctacgggctatgaggtggatggtggcaaactgagattccagctttataattggttggagaaagagatcgccgcgctgcacgaaatctgcaaccatgagagcgtgatcaaggaatactcgagtaagacgtactccaaagtggaatctgacttgctcgaccaggaggagatggtagacaagccggacattggcagctacgaacgccaccagattgagaggcgtagattacaggcaaaacgagagcacgcggagcgacgcaaatcctggttacagaagaaccaagacctgttgagggtgttcctgtcttattgctccttgcatggggcacaggggggaggcttggcctcagtgcggatggaactgaaattcttactccaggagtcccagcaggaaactaccgtgaagcagctgcaaagtccactgccattaccgaccactctcccactgctcagtgccagcatcgctagtaccaaaaccgtgatcgcgaaccccgtgctgtacctgaacaaccacatccatgatatcctgtacaccattgtgcagatgaagacccctccacaccctagcattgaagatgtgaaggtgcataccttacacagcctggctgccagtctgagcgcgagcatctaccaagcgctgtgcgatagtcacagctactcacagacggaaggtaaccagtttacaggtatggcttaccagggcttactgctgtcagaccggcgccgactgagaacagaatccatcgaagagcacgcaactcctaacagctctcctgcccagtggccaggagtgtcctcactcataaacctgttgagtagcgctcaggacgaggatcagcccaagctgaatatcctgctctgcgaggctgtggtagccgtctacttatctttactgatccacgccctggctactaactcgagttctgaactattcagactggccgcccatcctctcaacaatcggatgtgggccgccgtgtttggtggaggtgtcaagctggttgtcaagcctcgccgtcaatcagagaatatcagcgccccgcccgtgctgagcgaggacattgataagcatcggaggcgctttaatatgcgcatgttagtgccaggacgccctgtgaaagatgcaacacctccacctgtgccggcagagcgtccaagctataaggagaaattcatccctccggaactgtcaatgtgggactatttcgtggcaaaaccctttttacccctatctgacagtggggtgatctacgactccgatgaatcaattcacagtgatgaggaagacgacgcctttttctctgatacccaaatccaggaacatcaagatcctaactcttattcttgggcactactacacctcaccatggtcaagctggcacttcataacgtgaaaaatttcttcccaattgctggcctcgagttcagtgaactccccgtcactagccccctgggtattgctgtgataaagaacctggaaaactgggagcagatcttgcaggaaaaaatggaccagttcgaaggaccccccccaaactatataaacacatatccgacggacctgagcgtcggggctggccctgcgatcctgcgcaacaaagccatgctcgaaccagagaatactcccttcaaaagtcgggactctagtgcctttccggtgaaacggctttggcacttcctggtcaaacaggaggttctgcaggagaccttcattcgatacatttttaccaaaaagcggaagcagtctgaggtggaggcagatttggggtacccaggaggcaaagccaaggtgatccacaaagagagcgacatgatcatggcctttagtgtgaataaagccaactgtaatgagatcgtgctggctagcactcatgacgtgcaagaactggacgtgacatcactgctggcttgccagtcatatatctggattggcgaggagtacgacagagaaagtaagagcagcgacgatgtggattaccggggttccacaaccactctgtaccagccctctgctacctcatactctgcttcccaagtccatccgccaagttcgctaccctggctcggaaccgggcagacctcaactggcgcttcagtgttaatgaagcgcaacctccataatgtaaagcgcatgacgagccacccagttcatcagtactaccttacaggcgcgcaggacggatcagtccgtatgtttgagtggactcggccccaacaacttgtgtgttttagacaggctggcaatgctcgcgtaacccggctgtacttcaattcgcagggtaacaagtgcggcgtggcagatggcgagggttttttgagtatatggcaggtgaaccaaacagccagcaacccaaagccatatatgagctggcaatgtcacagtaaggcgacttccgacttcgcatttatcacgagctcgagtctagtggccaccagtggccattctaacgataacaggaatgtgtgcctgtgggatacactaataagcccaggcaattctcttatccatggatttacctgtcacgatcatggagccaccgtgctccaatacgctccgaaacagcagctgctaatcagcggcgggaggaagggtcacgtgtgtattttcgacattagacaacgacagctgattcacacctttcaagcccatgattctgccatcaaagccctggcacttgatccttatgaggagtactttactaccgggtctgccgaaggaaatataaaggtgtggagactgacaggtcatggcctgattcattcgtttaaatctgaacatgccaagcagtctatattcagaaacatcggcgcgggggtgatgcaaatcgacatcattcagggcaacagactatttagctgtggagctgatggaacactgaaaacgcgcgtgctgcccaacgctttcaacatcccgaaccgcatattggacattctttag

SEQ ID NO: 114845 - DNA, 1809 bp, Artificial Sequence
  Description of Artificial Sequence: Synthetic coding sequence
atgtgggattacttcgtggccaaacccttcctcccactgagtgacagtggggtgatctacgactctgatgaaagcatacatagcgacgaggaggatgacgctttcttctccgacacacagatccaggaacaccaagaccctaattcttactcctgggctctcctgcatcttactatggtcaaactggcactgcataacgttaagaatttttttccaatcgctgggttggagttcagtgagctccccgtcacctccccactgggaatcgccgtcatcaaaaatttagagaactgggagcagatactccaggagaagatggaccagtttgaaggaccccccccaaattacatcaatacatatccaacagaccttagcgttggggctgggccagcaatacttcgtaataaagctatgctcgaacccgaaaacacccccttcaaatcgagggattcgagcgcttttcctgtaaaacggctgtggcattttctggtgaagcaggaggtgcttcaggaaacgttcataagatacatcttcaccaaaaaacgaaaacaatccgaatccatcgaggaacacgttgagcaggtgaatcagaactgtatcgccgaagattgtcacatcaaggtggaagcagacctgggctacccaggaggaaaggccaaggttattcataaggagtctgacatgattatggccttctctgttaacaaggccaattgcaatgaaatcgttttggcaagcacacatgacgttcaagagcttgatgtgactagccttctggcctgtcagtcctacatctggattggggaggaatatgatcgtgaatcaaaatcgtcagacgacgtcgattatcgcggaagcacaacgactctgtaccagccaagcgcaacgtcatacagcgctagccaagtgcaccctcccagttcacttccatggctcggcaccggccagacttccaccggagcaagtgtgctcatgaagaggaatctacacaacgtcaagcgtatgacgtctcaccccgttcaccagtactatctcaccggagcccaggacggttccgtgaggatgtttgagtggaccaggccccagcagctcgtatgtttcaggcaggcaggaaacgcccgagtgactaggctatacttcaattcccaggggaataagtgcggggttgccgatggagaaggatttcttagcatatggcaggtcaaccagaccgcatccaatccgaagccttatatgtcttggcaatgtcactccaaggctactagcgatttcgccttcatcacatcaagttccctcgtggccacttcagggcattctaacgacaacaggaacgtgtgcctatgggatacacttatctctcctggcaattcccttatacatggctttacatgccacgaccatggggccaccgtgctccaatacgccccgaagcaacagctgttaatctctggcggcaggaaagggcacgtctgcatattcgacatccgccagcgtcagctgatccatacttttcaggcccatgattctgctatcaaggccttagctctagatccttatgaagagtattttacaacaggcagtgcagagggcaatatcaaggtgtggcgcttaaccgggcatgggctgatccatagcttcaaatctgagcatgccaaacagtcaattttcagaaacatcggtgctggcgtcatgcagatcgatattattcagggtaataggctgttctcttgcggggctgacggcactctgaaaactagggttctgcctaacgcatttaacatcccgaatcggatattggacatcctgtag

SEQ ID NO: 114846 - DNA, 7203 bp, Artificial Sequence
  Description of Artificial Sequence: Synthetic coding sequence
atgcacctgcatcaggttctgactggagcggtgaaccccggtgacaactgctatagtgtcggctccgtgggcgacgtgccatttaccgcctacggttccggatgtgacatcgttattctggccaatgattttgagtgtgttcagattattccaggcgccaagcatggcaatatccaagtctcatgcgtcgagtgcagcaatcagcagggacgcatcgcggcgtcttatgggaacgccgtttgcattttcgaacccctggggataaacagtcacaagcggaattgccagctcaaatgccaatggctgaagacaggccagttttttttatcttcggtgacatacaacctagcctgggacccccaagacaatcgccttttgactgccacagactcaatccaattgtgggctccccccggggatgacatattggaggaagaggaggaaattgataacacggtgccgcccgttctcaacgactggaagtgcgtgtggcagtgtaaaacaagtgtatcagtccatctaatggagtggtcccctgatggcgagtattttgctactgctggaaaggatgactgtctcctgaaggtctggtacccaatgacgggctggaaatcttcaatcatacctcaggaccatcacgaagttaaaaggcgccagtccagcacacagttcagcttcgtgtacctggcccatcctagggccgttactggtttttcctggcggaagacctccaagtacatgcctcggggttcagtgtgcaatgtgcttctcacaagctgccacgacggcgtgtgtcgcctctgggcagagacactcctcccagaagattgtttattgggcgaacagatttgcgaaacgactacttcttcaatcgccagctccctgtcacacgccggccggcataaagatcggattcagcatgccctggaaaccatccaccaccttaaaaacctgcgcaaaggccaacggcgttcttcagtattggtaacccacgccgagcttatgccagatcaaaccgcaatgcatgaagttcagaggcacataagtcaccatgccaacgccctgtgccactttcacatcgccgcctcgatcaaccccgcgaccgacattccaaacgtgctagtgggaaccgcattcaacgtggacgatggaaatggcggattcgtggtccactggttgaacaacaaagagttccatttcacttcgagcacagaggtattcatgcaccaattaagaaagctaagtgacaaacaggtagatcacgagaatgatgatgccgatcgggaggacgaggagcacagtcaggaagatcgcgaacgtggcctccacatgaagcttgatcacgatctgtcgctagacagagaatcggaggcagggaccgggtcatcagagcatgaggatggggagagagaggggtcccctagaacatactccagactcagtgtgcctatgccactccccactgtccttttggaccggaagattgagacactcttgaccgaatggaataagaaccccgatatgctcttcacgatccatccagtcgatggcacgttcttagtatggcacgttaagtaccttgacgagtacaatcctggaatattcaggcaggtccaagtgagctttagctcgcgaattcccgtcgcctttccctccggtgatgcttcatccctttctaagaatataatgatgtacgcctgtataaacgcaactaaggactcccatcatacactgctccaccaggaagggatgagcgtaggctcccctcacgggtcacaaccccattcccgctcccactcgactcacatgaacatattggcgccaaccgtgatgatgatcagtaaacatatcgacgggtcactaaatcagtgggcggtcactttcgctgacaagtctgctttcaccactgtactgactgtgagccacaagtttagatattgtggccaccgctttcatctaaatgatctggcctgtcacagtgtgctgcctctgctcctgacgagctcacatcacaatgctctgctgacccctgaactagattgccagtgggattctgataacaagctttctagattgatggatccagttaaacacattaagggaagctcaaagcaacccctgcggaacgccgccactcgtactttccatgatcccaacgctatctactcagagctcattctgtggcgcgtggacccgattggtcctctctcttacactggcggtgtgtccgaactcgctaggatcaactcgctgcacaccagcgctttctctaacgtcgcatggctgccaactctgattccaagctattgcttaggaacgtattgtaacagcgcatcagcttgcttcgttgccagcgatggtaagaatctgagattatatcaggcggtcgtggacgcaaggaagctccttgatgaattgtccgaccctgagagttccaagctgattggagaagtgttcaacatcgtttcccagcagagtaccgctcgcccaggatgcattatcgaactagacgccatcaccaatcagtgtgggtccaatacacagctgctgcacgtttttcaagaagattttatcattggctataagccccataaagaggacatggaaaagaaagaaacagaaattttttttcagccatcccagggatacaggcctcccccgtttagcgaaaagttttttcttgtggtgattgagaaagatagcaataacaatagcattctacacatgtggcatttacacttgaaaagcgttcaggcttgcctcggcagagatacactggatgagtgtggcctccggtatctcctggccatgcggctccatacttgtctcctcacatcgctcccacccctgtacagggtgcagctcttgcatcagggagtgtctacctgccatttcgcttgggcctttcactctgaagccgaggaagagcttataaacatgattcctgctatccagcggggggatccccagtggtccgaactgcgggcaatgggcatcggctggtgggtgcgtaacatcaacacgctgaggcgatgcatcgagaaggtcgcaaaggcgtcctttcagaggaataacgatgctttagacgccgcattattctatctttcgatgaagaagaaggctgtggtgtggggactttttagatctcagcatgatgagaagatgacaacgtttttttctcacaactttaacgaggataggtggagaaaggcggcacttaaaaacgccttttctttgctggggaaacagaggtttgaacagtccgctgcgttctttctgctggccgggtctctgaaagatgcaatcgaggtgtgtctggagaaaatggaggacatccaactggccatggtcattgcacgcttgtacgaatccgagttcgaaacctcaagcacgtatatcagtattttaaatcaaaagatcctgggctgccagaaagatggaagcggcttctcgtgtaagcgcctccaccccgacccattcctgcggtcactcgcatattgggtgatgaaggattatacacgcgccttagacacgttgctggaacagactccaaaggaggatgatgagcaccaggttattattaaaagttgcaacccagttgccttttctttctataattacctaaggactcaccctttgttgattcgcaggaatttagcctcacctgaaggcactctggccacactggggctgaaaaccgagaagaacttcgtggataaaatcaaccttatcgagagaaagcttttctttactaccgccaatgctcactttaaagtcggttgtcccgtccttgccttagaggtgctgtcgaaaatccccaaggtcacaaagacttctgcactttccgcaaagaaggaccagcccgatttcatcagccacagaatggacgacgtgccatcccactctaaggccctaagcgacggcaatggtagctctgggatcgaatggagcaacgtgacgagcagtcagtacgattggtcacaacccattgtgaaggtcgacgaggaacctctgaacctggactggggggaagaccacgattcagcgctggatgaggaggaagatgatgctgtaggcctcgtgatgaagtcaacggacgcgcgcgaaaaggacaagcagagcgaccagaaggcttccgatcccaatatgcttctgactcctcaggaggaagacgatccagagggggataccgaagtcgatgttatagccgaacaactgaagtttagagcgtgtctgaagattcttatgaccgagctaagaaccctagctaccggatacgaggttgatggcggtaaactgcggttccagctgtataattggctcgagaaagagatcgctgccctgcacgaaatatgtaatcatgagtcagtcattaaggagtattctagcaagacctacagtaaagtcgagagcgacctgctggatcaagaggagatggttgacaagcctgatattggcagttatgaaaggcaccagattgagcggcggaggttacaggccaagcgagaacacgcggaaagacgaaaatcttggctgcagaagaatcaggatttacttcgggtcttcctctcatactgctctctgcacggagcccaggggggagggctggcttcagtacgcatggagctcaagttcttgttgcaggagtctcagcaggagacaacagtgaagcagctgcaaagcccgctgccactcccaacgaccctcccgctgttatcagctagcatagctagtactaaaacagttattgcgaacccagtcctctacctcaataaccacattcatgacattctttacaccattgtccagatgaagacccctcctcacccctccatagaagacgtgaaagtgcacacccttcattctttagccgctagcttaagtgctagtatctaccaggccctttgtgatagccactcttatagccaaactgaaggaaaccagttcacaggcatggcctaccaaggcctcctactgtcagaccgcaggcggctgcgcacagagagcatagaagaacacgccacacctaacagctcacctgcccagtggcccggagtgtccagcttgatcaacttgctgagtagtgcccaggatgaagaccagccaaaacttaatatcctcttatgcgaggccgtggtggcagtgtatctgagcctgctgattcacgctctggcaaccaacagttcctccgagctgttccggttagcggctcaccctctaaacaacaggatgtgggcggctgtgttcggaggaggtgtgaaattagtggtgaagccccgcaggcagagtgagaatatctcagctccaccggtgcttagcgaagacattgataagcaccggcggaggtttaacatgagaatgctagtgcccggtcgtcctgtgaaggacgcgactccaccccccgtccctgcggagcgcccaagctacaaagaaaaatttatcccacccgagctgtcaatgtgggactattttgtcgcgaaaccattcctgccacttagcgattcaggagtcatctacgactccgatgaaagtattcacagtgatgaggaggatgatgctttctttagtgacacccagatccaggagcaccaagaccctaactcatattcttgggctttgctgcatttaaccatggtgaagctggccttgcataatgtgaagaatttttttcccattgccggattggaattctcagaactgccagtgacatcgcctctgggaattgctgttattaagaacctcgaaaactgggaacagattcttcaggaaaaaatggaccaattcgagggccctcctccaaactacatcaacacttatcccactgacctgtctgtcggggccggacccgctatcctgagaaacaaggccatgctggaacccgagaatactccctttaaaagtagagatagcagtgcgttccctgtcaagcggttgtggcactttctggtgaaacaagaggtgcttcaggagacatttatcagatatatctttacaaagaagcgcaagcaatcggaggtggaggctgatctcgggtacccagggggtaaagcgaaggtcatccacaaagaaagcgatatgatcatggcattctctgtgaacaaggctaattgtaatgaaattgtcctcgccagcacccatgatgtgcaagagctggatgttaccagcctgctggcatgccaatcttatatttggattggggaggagtacgaccgtgagtcaaaaagttccgatgatgtagactatcgggggtctaccacaacactgtaccagcccagcgccacgtcttactctgcttcccaggttcaccccccatcaagtctgccatggcttggaactgggcaaacctctactggagcttcagtgctcatgaagcgtaaccttcacaatgtgaagcggatgacctctcatcctgtgcaccagtactacctgaccggcgcacaagatggcagtgtgcggatgtttgaatggacaagaccccagcaactggtttgttttcgccaggctgggaatgccagagtgaccagattatacttcaattcacagggaaacaaatgtggagtggcggacggtgaaggcttcctgagcatctggcaggttaatcagactgcatccaatcccaaaccttacatgtcatggcaatgccacagcaaagcgacaagcgacttcgctttcataacaagttcctccctggttgccaccagcggccactcaaacgacaataggaacgtgtgcctgtgggacaccctgatttctcctgggaattccctgattcatggatttacctgtcacgaccacggggccactgtcctgcagtacgcccctaagcaacagctgctgatttcaggaggccggaaaggccacgtctgtatttttgacatccgccagaggcagctcattcacacttttcaggctcacgattcagccatcaaggccctggcgctggatccttacgaagagtattttacaaccggctccgctgaaggcaacataaaagtgtggcgactaaccgggcacggattgatccactcctttaagtccgagcatgccaagcagtcaatcttccgtaatataggtgctggggtaatgcaaatcgatatcatccaaggcaatcgcctcttttcgtgcggcgctgacgggacactgaagacgcgggtgcttcccaacgcctttaacattccaaacaggatcttggacatcctgtag

SEQ ID NO: 114847 - DNA, 9114 bp, Artificial Sequence
  Description of Artificial Sequence: Synthetic coding sequence
atgcacctgcaccaggtgctgacaggtgccgtgaaccctggggataattgctactccgtaggatctgtgggcgacgttccatttactgcctacggaagtgggtgcgatatcgtcatactcgcaaatgatttcgagtgcgtccagatcattcccggtgcgaagcatggaaatattcaagtcagctgcgtagaatgctctaatcagcaagggcgaattgcagccagctacgggaatgcagtgtgtatctttgagcccttggggatcaactcgcacaaacgtaattgccagcttaagtgccagtggctgaaaaccggtcagttcttcctgagcagtgtaacctacaatttagcctgggacccacaggacaataggctgctaactgcaacggattctatccagctctgggcgccccccggagacgacatcctggaggaagaggaagaaatcgacaacactgttccccctgtgctcaacgattggaaatgcgtctggcagtgcaagacatctgtgagcgtacacttaatggagtggtcacccgacggcgagtacttcgcaaccgctggcaaagacgattgcctgctgaaagtctggtatcccatgactggctggaagagttcaataatcccgcaggaccaccacgaagtaaagcgccggcagagctccactcaattctccttcgtgtacctggcccatcctagagctgtgactggcttcagttggcgaaagacctccaaatatatgcccaggggctcggtgtgtaatgttctcctcacatcatgccatgacggagtctgtcgactgtgggctgagactctgctccctgaagactgtttacttggcgagcagatttgcgaaaccacgacaagtagcatcgcaagtagtctcagccatgcggggcgccataaagaccgcattcaacatgccttagaaaccatccaccatttaaaaaacctgcgcaagggacagaggcgctcctctgtgctcgtgacacacgcagagctgatgcctgatcagacagccatgcacgaagtgcagaggcacatcagtcaccacgctaatgccctgtgccatttccacatcgcagcatccattaatccggctaccgacatcccgaacgtgctggtcggcactgcctttaatgtggatgacggtaacggagggttcgtggtccactggctgaacaataaggagttccactttacttcctcaactgaagtctttatgcaccagctgcggaagctatcagacaaacaagtggatcatgagaatgacgatgccgatcgcgaagacgaggaacacagccaggaggatcgggagcgtgggctgcatatgaaacttgatcacgacctgtcgctcgacagggagagcgaagcagggacagggagtagcgagcacgaggatggtgagcgtgaggggagcccacggacctattccagactgtccgtgcctatgccactgcccaccgttttgttggatcggaaaatcgagaccctgcttacagaatggaataagaacccggatatgctgtttaccatccaccccgtcgacggcactttcctcgtgtggcatgtaaagtacctcgatgaatacaatcccgggatcttccgccaggtccaggtgagtttcagtagcagaatcccagtggcattcccttcaggtgacgcgagttctttatccaagaacattatgatgtatgcctgcatcaatgccacgaaggacagtcatcataccctcttgcatcaggaaggcatgagtgtcgggtctccacacggctctcagccccactccaggtcccactctacacatatgaacatattggcacccaccgtcatgatgatctcaaaacacatagatggatctctgaatcagtgggctgtgaccttcgcggacaagtcagcctttaccactgttctgaccgttagccacaagtttcgttactgtggccataggtttcatctgaatgacctggcctgtcattccgtcttgcccttgctccttacctcaagtcaccacaatgcactgttgaccccggaattagattgccagtgggactccgacaacaaactgtctcgcctcatggaccctgtgaaacacattaaaggatcctctaaacagcctctgaggaatgccgccacaaggacctttcatgaccccaatgcaatctatagcgagttaattctgtggagggttgaccccattggcccgctaagctacaccggcggggtgagcgagctggcccggatcaacagtctacataccagcgcattcagtaacgtggcatggctgcccactctgatccccagttactgccttgggacatattgcaacagcgcttctgcctgcttcgtggcaagtgacggcaaaaacctgcgactctatcaggccgttgtcgatgctcggaaactgctggatgaattatcggaccctgaatcctctaagctgattggcgaagtgttcaacatcgtgagtcagcagtccactgccagaccagggtgcattattgagctagatgcaatcaccaatcagtgtgggagcaacacacagcttcttcatgtgttccaagaggactttataataggctacaagccacacaaagaggacatggagaaaaaagagactgagatcttcttccagccatcacaggggtatagaccgccgcctttttccgagaagttcttcctagtcgtaatagaaaaggattctaacaataattccatacttcacatgtggcacctgcatctcaagagcgtgcaggcatgcctggcgaaagcctctgagggtgctagcagcgaatctcttttgagcgtccccgggcaaaagaatgtcgactctagccctgaaaccagcccttcagtgtcacccatgccgcactcctcttccatcgccaatctccagacagccagtaagctgattctgtcctcacgcctcgtatactcccagccactggatttacccgagtccgtggaagtgatacgcgcaacgccttcagcaggacatctttcctcatcttccatctacccagtgtgcttggcgccctacttagttgtaacaacctgttccgataataaggtccggttttggaagtgctgtatggaggccaatcctgaatgtaataagagcgacgagaaggaaatttaccactggaagaggtggcccctcatgaatgatgaaggcgaggacaattccagtaccgtttccatcgttggacgacccgtggccgtgtcatgctcctataccggaaggctcgccgtggcatacaaacagccgattcaccacaacggcttcgtttcgaaagagttttcaatgcacgtgtgcatttttgagtgcgagtccaccggcggaagtgagtgggttttagagcagaccattcatttagacgatttggtcaaggtaggttccgttctggatagcagggtgtcagttgactctaacctgtttgtgtactctaagtcagatgcgcttctctccaaagatcggtatctgattccaaatattaaacacttagttcatctggactgggtgtcaaaggaagacggcagccatattctcaccgtaggtgtgggcgccaatatttttatgtacggccggctgtcaggaattgtgaccgagcagaccaactccaaggatggcgtagccgtcattacactgcccctcgggggctctatcaaacagggggtgaagtcgaggtgggtactacttcggtctatcgatctcgtctctagtgtagacggcaccccctctctgccggtgtccctctcttgggtgcgcgatggaatcctggttgtcggaatggattgtgaaatgcacgtctatgcgcaatggaagcacgcagtgaaattcggcgatacagaagcagatagcagcaatgccgaagaagcagccatgcaggatcattccaccttcaagtccaacatgctggctagaaagtccgtggtagagggcacagccatcagtgatgacgtgttttgctcccccaccgtgattcaggatggaggcctattcgaggccgcgcacgtgttgagccccacgctgccgcaatatcatccaacacagctgctcgagctgatggaccttgggaaggtgcggagagccaaagcaattctgtcccatctagtcaagtgtattgcaggcgaggtggcaatcgttcgcgaccctgatgccggggaaggtaccaagcggcatctcagtcgaacaatcagtgtgtccgggtctacagctaaggaaacagtaacagttggcaaggatggcactcgtgattacacagaaatcgactctatccctcccctcccactctacgcactgttagccgccgaccaggatacttcatacagaatatctgaggaatctacgaagattcctcagtcctacgaggaccagacggtcagccagcctgaggaccagtactcggagctgttccaaatccaggacataccaactgacgacattgacctggagcctgagaagcgggagaataaatcaaaggtgattaacctgtcccaatacggtcccgcatacttcggccaggagcatgccagggttctttcaagccatctgatgcacagctccctcccaggtcttactcgtttagagcagatgtttcttgtagcgctggccgatactgtggcgaccacttctacagaattagacgagagtcgcgacaagtcctgttccggacgcgacacgctagacgaatgtggcctgcggtatctattagctatgaggctccatacatgcttattgacatccttgcccccgctatacagagtccaacttctgcatcagggggtatccacatgtcacttcgcttgggccttccacagtgaagcggaggaggaactgatcaacatgattcctgctatccagaggggcgaccctcaatggtctgagctccgagccatggggataggttggtgggtgagaaatattaatacgctccgccggtgtatcgagaaggtggcaaaggcgtccttccagagaaataacgatgcattagacgccgccttgttctacctgtcaatgaaaaagaaagccgtggtttgggggttatttaggtcacagcacgacgagaagatgaccacattcttctcgcataacttcaacgaagataggtggaggaaggcagctttgaaaaacgctttctcccttctgggcaaacagagattcgaacagagcgctgccttctttctcctcgccggctcattgaaggatgccatcgaagtttgcctggaaaagatggaagatattcagctcgccatggtaattgccaggctgtatgagagtgaatttgaaactagcagcacctatatctctatccttaatcaaaagatcctgggctgtcagaaagatggatccggattttcctgtaaacggctgcacccagacccatttctgagatccctggcctactgggtcatgaaggactatacacgcgccctggatacgctgttggaacagacacctaaagaggatgacgagcatcaggtgatcattaaatcatgcaatcctgtcgcatttagcttttataattaccttcggactcacccccttttaatcaggcggaaccttgcaagccccgaaggcaccctggcaaccttgggactgaaaactgagaagaattttgttgacaagattaacttaatagaaaggaaactgtttttcactactgctaacgcacatttcaaggtcggttgcccagttctcgcattagaagttctgtctaagataccaaaggtcaccaagacctcagcgctgtcagctaaaaaagaccagcctgattttatttctcatcggatggatgacgtaccttcacacagcaaagctttatcagacggcaatggatcaagcgggatcgaatggtccaacgtgacgtcttctcagtacgattggtctcagccaattgttaaagttgacgaggagcccttgaatctcgactggggagaagatcatgattccgccctcgacgaggaagaagacgacgcagtcggactggtaatgaaatcaactgatgcgcgcgagaaggataagcagtcagaccagaaagcttccgaccctaatatgctgctcacaccgcaagaggaggatgatcccgagggtgacactgaagttgacgttatcgctgagcagctgaagtttagggcatgccttaaaatcctgatgactgaattgcgaactctcgctaccgggtatgaagtggacggtggtaaattgcgcttccaactgtacaactggttagagaaggagattgccgccttgcatgaaatttgcaaccatgaaagcgtgattaaagaatatagctcaaagacctactcgaaagtggagagtgatctcttggaccaagaggagatggtggacaagcctgatataggatcatatgaaagacatcagattgagcgaagacgactgcaggccaagcgcgaacacgccgaacgccgtaagtcctggcttcagaagaatcaggacctgctgcgggtgttcctgtcttattgctctctgcacggcgcacaaggtggtggacttgcatccgtacggatggagttaaagttccttctccaggaatctcaacaggaaactacagtcaagcagctacagagccctcttccactacctactaccctccctctgctatcggcctctattgctagtacaaagaccgtgatagccaaccccgtgctgtaccttaacaaccacatccacgatatcctgtacactatcgtccaaatgaaaactcctcctcacccatcgatcgaagatgttaaagtgcacactcttcatagcctggccgcctctctcagcgcgagcatctatcaggcgctctgtgatagccattcttactctagtcaaaccgagggaaaccagtttacggggatggcttaccaggggctcctgttgagcgatagacggcggctgcgtaccgagtccatcgaagagcacgctaccccgaattccagtccagcccagtggccaggagtcagtagcctgatcaatcttctgtcatcagcccaggacgaagaccagccaaagctgaacatcctcctgtgtgaagctgtcgtggcagtgtacctcagcctactgattcatgcgttagctaccaactcctcctcagagctgtttagattggctgctcacccgttgaacaatcgcatgtgggcagctgtgtttggtggtggtgtgaagctcgttgtcaaacccaggagacagtcagagaatatttcagccccccccgtgttatcggaagatatagataaacatcgtcgccgatttaacatgcggatgctggtgcctggacggcctgtcaaagacgcgaccccacctccagtgccagccgaaagaccaagttacaaggaaaaatttataccgccagagctgagtatgtgggactacttcgtggcaaagccattcctgcctctcagtgactccggggtaatctacgacagtgacgagtcgatccacagcgatgaagaggacgatgcgtttttctctgatacacagattcaggagcaccaggaccccaatagttatagctgggccctcttgcacctgacgatggtgaaactcgccctgcataatgtgaagaattttttccctattgcgggcctggaattctctgagcttcccgtcactagccccctgggcattgcagtgatcaaaaacctagaaaattgggagcagatccttcaggagaagatggaccaattcgaggggccacccccaaattacatcaacacgtacccaaccgacctgtcagtcggtgccggcccggccatcctgcggaataaggctatgttagagcctgagaacactccttttaagtccagggacagctccgctttccctgtgaagcgtctatggcactttctagtgaagcaggaggttttacaagaaacatttatcagatatatcttcaccaaaaagcgcaagcagagcgaagtggaagcagatcttggttaccccggagggaaggcaaaagtaatccataaggaaagcgatatgattatggcgttcagcgtcaataaagccaactgcaacgagatcgttttagcaagcacacatgatgttcaggagctcgatgttacaagcctcctggcttgtcagtcctacatttggatcggggaggagtacgaccgtgagtcaaaatcttccgatgacgtagattatagggggtccaccaccactctgtatcaacctagcgcaacgtcttacagcgcaagccaagtccatccacctagcagcctgccgtggctgggcactggccagacatccactggcgcttctgtgcttatgaagaggaatctccataacgttaaaaggatgacctcacatccagtccaccagtattacctcaccggtgcccaagacggaagtgttagaatgttcgaatggacacggccacaacaactggtatgtttccggcaagctggcaacgcccgggtcaccaggctgtacttcaatagtcagggaaataaatgcggcgtagcagacggggagggattcctctccatctggcaggtgaatcagaccgctagcaaccccaagccttatatgtcatggcaatgtcactcgaaggcaaccagtgactttgcctttataaccagcagcagcctggtcgcaacaagcgggcactccaatgataatcgcaacgtgtgcctctgggacactttgatatctcccggaaatagcttaatccacggttttacatgccatgatcatggggctacagtactgcagtacgcccctaaacaacaactgctgatttctggtgggaggaagggccacgtgtgtatcttcgacatcagacaaaggcagctgatccacacttttcaagcccatgactccgctatcaaggccctcgccttggacccctatgaggagtacttcacaactggaagcgccgagggtaatattaaagtctggcggttaactgggcatggcttgatccattcttttaagtccgaacatgccaaacagagtatctttcggaacattggtgcgggcgttatgcaaattgacataattcagggaaacaggcttttctcctgcggggccgacgggaccctgaagacacgggttcttccaaacgcattcaatatcccaaatcggatcctcgacattctctag

SEQ ID NO: 114848 - DNA, 4851 bp, Artificial Sequence
  Description of Artificial Sequence: Synthetic coding sequence
atgcccgcgagaactgcccctgctagagtgcccaccctggcggtcccagccatttccctcccagatgacgtgcgacgcagactgaaagacctggagcgggatagcctaactgaaaaggagtgcgtgaaagagaagctgaatcttctccacgaattcctgcagaccgagataaaaaatcaactatgcgacctggaaactaaattacggaaggaagaactgagtgaagaaggctacctggcaaaagtcaaatcgttgttgaacaaggacctttctctcgagaacggagctcacgcatacaaccgcgaggtaaacggcagactggaaaacgggaatcaagcacgctcagaggcccgtcgtgttgggatggctgatgccaattcaccacctaaacccctgagcaaacctaggaccccccgccgttctaaaagtgacggagaggcaaagcctgagccgtctccctccccacggattaccaggaagtccactcggcagactacgatcacttcacacttcgctaagggccctgcaaaacgtaaaccccaagaggagtctgagcgggctaagagtgatgagagcattaaggaagaggataaggatcaagacgaaaagaggcgccgtgtgacctcccgcgaacgcgtggctagaccactcccagctgaggaacccgaaagggccaaatccgggaccaggaccgagaaagaagaggaacgtgatgaaaaggaagagaaacggctaaggtcgcagaccaaagaaccgacccctaagcaaaaacttaaagaggagcccgacagagaggctagggccggcgtacaggcggatgaggacgaggacggagacgagaaagatgagaaaaaacacagaagtcagcccaaagatctcgctgcaaaaaggcggcccgaagagaaggaacctgagaaggtgaaccctcaaattagtgatgagaaggacgaggatgaaaaggaggaaaaaaggcgcaaaaccacaccaaaggaaccaacagagaagaagatggcacgcgcgaaaacagtcatgaattccaaaacacaccctcccaaatgtatccagtgcggccagtatttagacgatcccgatctcaaatacggccaacacccacctgacgcagttgatgagccacaaatgctgacaaatgagaaactctctatttttgacgccaacgagagcggctttgaatcctatgaggctcttccccagcataaactgacatgcttcagtgtctactgcaagcacggccatctttgccctatagacacaggcctgatcgaaaaaaatattgaactgttctttagtggcagtgccaagccaatatatgacgatgatccaagtctggagggaggcgtgaatggcaagaatctcggcccaataaatgaatggtggattacaggcttcgacggcggggagaaggcattaatcgggttttctacaagttttgcagagtacatactcatggatcccagtccggaatatgcgcctatcttcggcttaatgcaggagaaaatttatatctctaaaatagttgtcgagtttctgcagagcaattcagactctacgtacgaagacttaatcaacaagattgaaacaaccgtccccccttcaggcctgaatttgaaccgttttaccgaagattccttactgcggcatgcacagtttgtcgttgaacaggtggagagttacgatgaagctggcgatagcgacgagcaacctatcttcctgacaccttgcatgagagacctgattaagttggccggagttacactcggacagagacgcgcacaggccaggcgacagactattaggcatagcacccgggagaaggacaggggccccacaaaagccacaaccacaaagctggtctaccagatttttgacactttcttcgcagaacagatagagaaggacgacagggaggacaaggaaaatgcatttaaacgacgtaggtgcggcgtatgtgaggtgtgccaacaaccagagtgtggcaaatgcaaggcctgcaaagatatggttaaatttgggggtagtggtcgttctaagcaggcctgtcaggagaggcggtgtccaaacatggcgatgaaagaggctgacgatgatgaggaggtcgatgataacataccggagatgccatccccaaagaaaatgcaccaggggaagaagaaaaaacaaaataagaaccgcatatcctgggtcggagaagccgtgaagactgacgggaagaaatcatattataagaaagtgtgcattgatgcggagaccctcgaagtgggtgattgtgtatccgttatccctgatgatagcagcaaaccgctgtacttggcccgagtgacagcattgtgggaggacagttccaacggccaaatgttccatgcccattggttctgcgctggtaccgatactgttcttggcgctaccagcgacccacttgagctcttcctggttgacgagtgtgaggatatgcaactgagctatattcattctaaagtgaaggttatctacaaggcgcccagcgagaattgggctatggaaggggggatggacccagagtcactgctggagggagacgatggtaaaacttatttttatcagctgtggtacgaccaggattatgcacgctttgaatctcctccaaaaactcaaccaacagaagacaacaagtttaagttttgtgtatcgtgcgcacgcctggcggaaatgcgacagaaggagataccccgcgtcttagagcagttggaggatttggatagccgagtactgtattattccgctacaaaaaacggcatcttgtatcgcgtgggcgacggagtgtatctgcctccggaggccttcacgtttaacattaaactgtctagtcccgtgaaaagaccccggaaggagccagtggacgaggatctttaccccgaacactataggaaatactccgactacatcaaaggttcaaaccttgatgcaccagaaccataccgaatcgggagaataaaggaaatattttgccctaaaaaatccaatggacgaccgaatgagaccgatatcaaaattcgcgtcaataaattttatcgccccgaaaatacacataaatcaacccctgctagctaccacgcagacatcaacctgctctactggtccgatgaggaagcagtcgtcgatttcaaggctgtacagggaaggtgtaccgtggaatatggagaggatctgcccgaatgcgtgcaagtgtactccatgggtggccccaacaggttctactttctcgaggcatacaatgctaagtctaagagctttgaggatccacccaaccacgccagatctcctggcaacaaaggcaaggggaagggtaagggcaagggcaagcctaagtcacaggcttgcgaacctagcgagcctgaaatcgagattaagctgccgaagttgagaacactcgacgtattcagtggctgtggcggcctgtctgaaggcttccatcaggccggaatttcagacacactctgggccatagaaatgtgggatcctgcagcccaggccttccggcttaataacccaggttccaccgtgttcactgaggattgcaatatcctcttgaagctggtgatggccggcgagaccactaatagtcgggggcagcgccttccccagaaaggcgacgtagaaatgctgtgcggaggccccccttgtcaaggattctccggaatgaatagatttaactctcgcacgtattcaaagttcaagaatagcttagtcgtcagttttttgagttattgcgactactacagacccaggttcttcctgctggagaacgtaaggaattttgtgtccttcaagaggtccatggtgctgaaattgaccttgcggtgcctggtgcgaatgggttaccagtgtacctttggggttctgcaggccgggcagtacggggtggcccagacaagaaggagggcaatcatcttggccgccgcaccaggcgaaaagcttccactatttcctgagcctctgcacgtctttgcccctcgggcgtgccaactgagcgtcgtggtggacgataagaagtttgtctccaacattactcgattatccagcgggcctttccggactattactgtaagagacaccatgagcgatctgcccgaggttcgcaatggagcgagtgcactcgagatatcctacaacggagaacctcaaagttggttccagcggcagctaaggggagcccaataccagcccattctgagggaccacatttgtaaagacatgtctgccttagtggctgcccgcatgagacatatccccctcgcccccggatcggactggcgggatctgcccaacattgaggtgaggctatccgatggtacaatggcacgcaagctgcgttacactcaccatgataggaagaacggacgttcaagcagcggcgcactgcgaggcgtctgctcctgcgtcgaagctgggaaggcctgtgaccctgccgcgaggcaatttaacacactgatcccttggtgcctaccgcacacaggaaataggcacaaccactgggctgggctgtacgggcggttagaatgggatggcttctttagtaccacagtaacaaaccctgagcccatgggcaaacagggcagggtattgcacccagaacagcaccgggtcgtgagtgtccgggaatgcgcccgctcccaggggtttccagacacatataggctgtttggtaacattcttgataagcacagacaggttgggaacgccgtgccgccacccttagccaaggctattggactcgagattaagttgtgtatgctggccaaggccagggaatcagcatccgcaaaaatcaaagaagaagaggccgcaaaagattag

SEQ ID NO: 114849 - DNA, 4899 bp, Artificial Sequence
  Description of Artificial Sequence: Synthetic coding sequence
atgccagcccgcacagcccctgcccgagtgcctacactggcggtccccgccatctcactaccagacgacgtgcggcggaggttgaaagacttagagcgggattcacttacagaaaaggaatgtgtcaaggagaaactgaacctgctgcacgaatttcttcagacagagatcaagaaccagttgtgtgatctggagaccaaactgagaaaggaggagttgtcagaagaggggtaccttgcaaaagtgaagtcacttctgaataaggacctaagcttggagaatggcgctcatgcatataacagggaggtgaacgggcggcttgagaacggcaatcaggccaggtccgaggctcgccgcgtgggcatggctgatgccaacagcccaccaaaacccttgtccaaaccacgtacgccacgcagaagcaagagcgacggagaggccaagcggagcagggacccccctgccagcgctagccaggtcaccgggatccgtgctgaacccagcccctcacccaggattacaagaaaaagtacccggcagacaaccatcacttcccactttgccaagggtcctgccaagcgcaaaccacaggaagaatctgaaagggccaagtcggatgagtctatcaaagaggaggataaggaccaagatgagaaacgtagacgtgtgacctcaagggaacgcgtcgcccgtccactcccggccgaggagccggagagagctaagtctggtactagaaccgagaaagaagaggagagggacgaaaaggaggaaaagaggctgagatcacagaccaaagagccgacccctaagcagaaactgaaagaggaacccgatcgcgaggcgcgggcgggggtccaggccgacgaagacgaagatggagatgaaaaagacgagaaaaaacaccggtcgcagccaaaggatctggcggcaaagagaaggccagaagagaaagaacccgaaaaggtgaaccctcagatatccgacgagaaggacgaggacgagaaagaggagaagcggcgcaaaacaacaccaaaggaaccgaccgagaaaaaaatggcaagggctaaaacagttatgaattccaaaactcatccgccaaaatgcatacagtgtgggcagtatctggacgacccagatctcaagtatggccagcatccacctgacgccgtcgacgaacctcagatgttgaccaatgagaaactaagcatcttcgatgctaatgagtccggttttgagagttatgaagcgctgccgcagcacaagctgacgtgcttttctgtgtactgtaagcatgggcacctctgtcccatcgatactggcctgattgaaaagaacatagaactgttcttttccggttccgcaaaaccgatttacgatgacgacccctcattggaggggggtgtgaacggaaagaacttaggtcctatcaacgagtggtggataaccgggttcgatggtggggagaaagcgctgatcggcttcagcacatcatttgctgaatatattttaatggacccctcacctgaatatgctcccatcttcggactgatgcaagaaaaaatctatatttcgaagatcgtcgtggaatttttgcagtccaattcagactcaacatacgaggatttaatcaataagatcgagacaacagtgcccccgtcaggcctcaatctgaatcggtttactgaggattcgttgctcaggcatgcacagttcgtggtcgagcaggttgagagttatgatgaagcaggggattctgacgagcagccaattttcttgaccccatgcatgagggatctgatcaagcttgctggcgtgacactcgggcagcgacgcgcacaggctagaaggcagacgatcagacactcaacccgggagaaggatcgcggtcctaccaaagctactactactaaattagtctaccagatattcgataccttttttgcagagcagatagagaaggatgaccgagaagacaaggagaacgcctttaagaggcgcaggtgtggcgtgtgcgaggtgtgccagcagcctgagtgcggaaaatgtaaagcctgcaaggatatggttaaatttggcgggtcaggacgaagtaagcaggcgtgccaagaacgccggtgcccaaacatggcaatgaaggaggcagacgatgacgaggaagttgatgataacattccagaaatgccttcccccaaaaagatgcaccagggaaaaaagaagaagcagaataaaaaccggatcagctgggtgggggaggccgtaaagacggacgggaagaaaagctactacaaaaaagtgtgtatagacgccgaaacccttgaggtgggggactgtgtgagcgtcatcccggacgattcctcaaaacccctctatctagcgagggtcactgcactgtgggaagactcttccaacggccagatgttccatgcccactggttctgcgccggtactgataccgtattgggcgccacatcagatccactcgaattgttccttgtggatgagtgtgaggacatgcaattaagctacatccactcaaaggttaaggtgatctataaagcaccttctgagaactgggcgatggagggaggcatggatcctgagtctcttttggaaggtgacgatggtaagacctacttctaccagttatggtacgaccaggactacgccaggttcgagtcaccccccaagacgcagcccactgaagataataagttcaaattttgcgtgtcatgcgccagactcgccgaaatgagacaaaaagaaatccctagagtcctggagcagctggaagacctggacagcagagtgctgtactattctgctacaaagaacgggatactgtatcgcgtgggcgacggagtttacctgccacccgaggctttcactttcaatatcaaactctctagcccagtgaaacgcccccgcaaagaacccgttgatgaggatctgtatccagagcactatcgaaagtacagcgactacattaaggggagtaatttggacgcccctgaaccttatcgcattgggcggataaaggagattttctgtccgaagaaatctaacgggaggcccaatgagacagacattaagattcgagtgaacaaattttataggccagaaaatactcataagtcgacacctgctagctatcacgccgatatcaatctgctgtactggagcgacgaggaagccgtggtggatttcaaagccgtgcagggacggtgcactgtagagtacggggaagatttgcctgaatgtgtgcaggtctatagtatgggtggcccgaacagattttacttcttagaagcctataatgccaaaagtaaaagtttcgaggatccccctaatcatgcacggtcacctggcaataaaggaaagggcaaaggcaaagggaaggggaaaccaaaatcacaggcctgcgaaccaagtgaacccgagatcgaaattaagctgccaaagctgcgcactctcgacgtatttagcgggtgcggcgggctttccgaaggattccaccaggcaggcatctctgacacactgtgggcaattgaaatgtgggatcccgccgcccaagctttcagactgaacaatcctgggtcaacagtcttcacagaggattgcaacattctccttaagctcgtcatggcaggcgagactactaattctaggggccagcgcctcccccagaaaggagacgtcgaaatgctgtgcggtggtccgccctgccagggtttttccggaatgaatcgcttcaatagccggacctactcaaaatttaaaaactctctggtggtgtccttcttatcctactgcgactactacaggcccagattttttctattggagaacgtgcggaacttcgtgtcctttaagagaagtatggttttgaagcttactctaagatgcctggttagaatgggataccagtgtacattcggagtccttcaggccggccaatacggggtggcccaaacacggcgcagggctattattttagctgccgcccccggtgagaagctccccctgttcccagagccgttacacgtcttcgcgcccagggcctgccagctgagcgtcgttgtcgatgataagaagtttgtctctaacatcacaagactgtcctctggaccctttcggaccattacggttcgtgacaccatgtctgaccttccagaagtgagaaatggtgcaagcgccttggaaatttcctataacggtgagcctcagtcctggttccaacgacagttgaggggcgctcaataccagcccatactccgagatcacatctgtaaagatatgtctgcccttgtggccgcacggatgagacacatccccctggccccaggcagtgattggcgggacctcccgaatattgaagtgagactgtccgacgggaccatggcgcggaagctacgctacacccatcacgatagaaagaacggacgatcttcctctggggccttacgaggggtttgcagctgtgtcgaggccggaaaggcttgtgatcctgccgcccggcagtttaataccctcataccatggtgtctcccgcatacaggaaacaggcataaccattgggccgggctgtacggccgactggagtgggacggatttttcagtactaccgtgaccaaccctgaacctatgggcaagcaggggcgcgttctgcaccccgaacaacaccgcgtggtgtctgtgagagagtgcgcccggagccagggcttccccgatacatatcgtctcttcgggaatattctcgacaagcaccgacaggtgggaaacgccgtgcctccgcccttggccaaggccatcgggttagaaatcaagctgtgcatgctcgccaaggcacgcgagagtgcatcggctaaaattaaggaggaagaggccgcgaaagactag

SEQ ID NO: 114850 - DNA, 4860 bp, Artificial Sequence
  Description of Artificial Sequence: Synthetic coding sequence
atgcctgccaggacagcacccgcacgagtaccgacccttgctgtgcccgccatctcactgcccgatgatgtgaggcgaaggcttaaagatctcgagcgggattcactcacagagaaggaatgtgtcaaagagaaactcaatttgcttcacgaatttctccagacggaaatcaagaatcagttgtgcgatctggagaccaagctcagaaaagaggaactcagtgaggaggggtatctcgcaaaagtgaagtcgctgttgaacaaggatctatccttagaaaatggcgcccatgcttacaatcgggaagtaaacgggagactcgaaaacgggaaccaagccaggtctgaggctaggagggtgggtatggccgatgcaaatagccccccaaagcccttatctaaacctcgaactccaagacggtctaagagtgatggtgaggcaaaaccagaacccagccccagcccccggataacacgaaagtccacgcgacagaccacgatcacatctcactttgccaagggccctgctaagaggaaaccgcaggaagagtctgagagggcaaagtccgatgaatcgattaaggaagaggataaggatcaggacgaaaaacgccgaagagtgacctctagagaaagggtcgcacggccgctccccgctgaggaacctgagcgggccaagtctggcacgcggacggaaaaagaggaggagagagacgaaaaggaggaaaagaggctcaggtctcagacgaaggagccaacgcctaagcagaaactcaaggaggaacctgaccgcgaagcgcgagctggcgtccaggccgacgaagatgaggacggagatgagaaggacgaaaagaaacacagaagtcagccaaaggatctggccgcgaagcggcgtccggaggaaaaggaaccggagaaggttaatcctcaaatttccgatgaaaaagatgaagatgaaaaggaggaaaagagacgcaagaccacacctaaggaacccactgaaaaaaagatggcccgagccaagactgtgatgaactcaaagactcatcctcccaaatgcatccaatgtggtcagtacctggacgaccctgacttgaagtatggccagcacccaccagacgcagttgacgagccccaaatgttgactaacgagaagctgtccattttcgatgcaaacgaaagcggcttcgagtcatacgaagccctgccccagcataagctgacgtgtttttccgtgtattgcaagcatgggcacctgtgcccaatagacacgggccttattgaaaaaaatatcgagctgttcttctccggttcagcgaagcctatctacgatgacgatcctagtctagaagggggagtgaacggaaaaaaccttggacctataaacgagtggtggattacgggattcgatggaggagaaaaagcactgatcggattttccacttcttttgccgagtatattctgatggatccgagtccggaatatgcacccatttttgggctgatgcaggaaaaaatctacattagcaaaattgtcgtggaattcctgcagagtaatagcgacagcacttacgaagatctgattaacaagattgagacgaccgtcccaccgagcggccttaaccttaaccggttcaccgaggattctcttctgcggcacgctcagtttgttgtcgagcaggtggagtcctatgacgaggcaggtgattcagacgaacaacccattttcttaacaccatgcatgcgcgatttgattaagctcgcgggcgtcacactgggccagaggcgcgcccaggctcgcagacagacaattcgtcacagcacccgcgaaaaagaccgagggcctaccaaggcaaccactactaagcttgtatatcagatcttcgacactttttttgcagagcaaatcgagaaggacgacagagaagataaggaaaatgcttttaagcgacgcaggtgcggcgtgtgtgaagtctgccagcagcccgaatgcggaaagtgcaaggcatgtaaggacatggtcaagtttggaggcagtgggagaagcaagcaggcctgccaggagcgcaggtgtcccaacatggcaatgaaagaagccgacgatgatgaggaagtggacgacaacattcctgaaatgccaagccctaagaaaatgcatcaaggaaagaaaaaaaaacaaaataagaatcggatcagctgggtaggggaggccgtcaagactgacggcaaaaagtcctactacaagaaagtgtgtatagatgctgaaaccttggaagtcggcgactgtgtgtctgtgattccagatgattcttccaaacccctgtatctggccagggtgactgctctgtgggaggactcctctaatggacagatgttccacgcccattggttctgcgccggaacagatactgtgcttggagccacctcggatcctctggaactgtttctggtggacgagtgcgaggacatgcagctcagctacattcacagtaaggtgaaggttatctataaggcgccttctgagaattgggctatggagggcgggatggacccggagtcattattggaaggcgacgatggaaagacatacttctaccagctgtggtacgaccaagactatgctaggtttgagtctccacccaaaactcagccaaccgaggacaacaagttcaagttctgtgtctcatgcgcacggcttgccgaaatgcgacaaaaagaaattcccagggtcttagagcagttggaggacctggattccagggtcctctactactctgccaccaaaaacggcatactctaccgggtgggggacggcgtttacctaccccccgaagccttcacatttaacattaaactttctagtcctgtaaagcgaccgcgcaaggagccagtggacgaagacttgtaccccgagcactatcgcaagtattctgattacatcaaaggttcaaacctggatgcacccgaaccatatcggatcggtcgtatcaaggaaattttttgccccaagaaatcaaacgggcgtcccaacgaaactgacattaaaatcagggttaataagttttacagacccgagaatacgcacaaaagtacacccgcgagctaccacgctgacattaatctactgtattggtccgacgaggaggcagtagtagatttcaaagcggtgcagggccgctgtaccgtggaatatggagaagacctcccggagtgtgtccaggtttacagcatgggcggtccgaatcgtttttactttctcgaggcctataatgcaaaatcaaagagttttgaagaccctccaaatcatgccaggtcacccgggaacaaaggcaaaggcaaggggaaaggcaagggtaaacccaagagtcaagcctgcgaaccgagcgagcctgaaatagagattaagctgcctaaactacggactctggacgttttctctgggtgcggtggcctcagtgaggggtttcatcaggctgggattagcgataccctgtgggcgattgaaatgtgggaccctgccgcccaggcgttcagactaaataaccctgggtccactgtttttacggaggattgcaatatcttgcttaagctggtcatggcaggcgaaaccaccaactcacgcgggcagaggctcccccagaagggcgacgtcgaaatgctatgtggagggcctccatgtcagggatttagcggaatgaatcggtttaactcccgtacctatagcaagttcaagaatagcttagtagtgtccttcctgtcatattgtgattattaccggccacgattcttcctgcttgaaaacgttcgaaattttgtttctttcaaacgttctatggtgttaaagttgaccctccggtgcttagtgcggatggggtaccaatgcacatttggcgtcctccaagccggacagtatggggtggctcagaccagacggcgggccatcatactggccgctgctcccggggaaaagttgccgctgtttcccgaaccactacatgtctttgcaccaagggcttgccaactgtccgtcgttgtggacgacaagaaattcgtgtctaatatcactcgcctgtcatcaggcccattccgtactataacagtgcgggacactatgagcgatcttcccgaggttaggaatggagcaagcgccttggaaatttcatacaacggcgagccccagtcttggtttcagaggcagctcagaggcgcgcagtatcagcccatcctccgggatcacatttgcaaggatatgtccgccctggtggcggccagaatgcggcacatcccactagcccctgggtccgactggcgtgacttgccgaacattgaagttcggctctcagatggtaccatggcgcgcaaactacggtacacccaccatgaccggaagaacggacgttcttcatctggcgccttaaggggggtgtgcagttgtgtggagggcgggtcatctggcaaggcctgcgacccggccgctagacaatttaacactctcatcccgtggtgtctcccacacaccggtaaccggcacaatcattgggccggcctttacggtaggttggagtgggacggtttcttctccaccactgttacgaacccagagcccatgggcaaacaggggcgggttctgcatccagaacagcacagggtggtgagtgttcgggaatgcgctcgctctcaggggtttccagacacttacaggcttttcggcaatattctggacaagcaccgccaagtcggaaacgcagtgcccccccctctggcaaaggcaatcggcctggaaatcaaattgtgtatgctggcaaaggcccgggagagcgccagtgccaaaatcaaagaagaggaggccgctaaagattag

SEQ ID NO: 114851 - DNA, 4455 bp, Artificial Sequence
  Description of Artificial Sequence: Synthetic coding sequence
gggtcatgccactcccccgccagcgcaagccaggtggccggtacaacagccgagcccagtccaagccccagaatcacccggaagtccacccggcagacgactatcacttcccactttgcaaagggcccggcaaaacgaaaacctcaggaagagtctgagcgcgccaaaagcgacgaatctatcaaagaagaggacaaggaccaggatgaaaagcgacggcgggtgactagtagggaaagagtggcccgacctctgccagcagaggagcccgagcgggcgaagtccggtacacgcactgaaaaggaggaggagcgggacgagaaggaggagaagaggctgcggtctcagacaaaagagccaacgccaaagcagaagctgaaggaggagcccgatcgcgaggctagagcgggggttcaggctgacgaggatgaagatggggatgaaaaagacgaaaagaaacaccgctcacagccaaaggacctggctgctaaacggcgccccgaggaaaaggagcccgaaaaggtaaatccccagatttctgacgaaaaggacgaagacgaaaaagaggagaagcggagaaagactactccaaaggaacccacagagaagaaaatggcccgtgcaaaaacggtgatgaactctaaaacacaccctcctaagtgcatccagtgcggccagtaccttgacgacccagaccttaagtatgggcaacacccccctgacgccgtagatgagccccaaatgctcaccaacgagaagctgagcatattcgacgctaacgagagtggctttgagtcctatgaagccctgccccagcataagctcacatgtttttccgtgtattgtaagcacggacatctgtgccctatcgatacgggattaattgaaaaaaacatagagttgttctttagcggtagcgcaaagccaatctatgacgatgatcccagtttggagggcggagttaatggtaaaaacctgggcccgataaatgaatggtggatcactggttttgacggtggggagaaagccctgatcggcttttcgaccagttttgccgagtatatcctgatggacccgtctcccgagtacgcccccatttttggcctgatgcaagagaagatctatatcagcaagatcgttgtagagtttctgcagtcaaacagtgattccacgtatgaggacttaataaacaagatagagacaaccgtgcctccttctgggctcaacctgaaccgtttcacggaggatagcctgcttcgacacgcccagtttgttgttgaacaggtagaatcttacgatgaagccggtgacagtgacgagcagcccatatttctgacaccttgcatgagggacctcatcaaactggcaggagttacactcggccaacgtcgcgcacaggctaggagacagactattaggcattctactcgggagaaggatcggggcccaaccaaagcaacaacgaccaaactggtgtatcagatcttcgacactttttttgccgaacagattgagaaagatgatcgcgaagataaggagaatgcgttcaaacgccggcgctgtggtgtatgtgaagtgtgccaacaacctgagtgtggaaagtgcaaggcttgcaaggacatggtcaagtttggcggatctggccgatcaaaacaggcatgccaggaaaggaggtgccccaacatggcaatgaaggaagcagacgacgatgaggaagtcgatgataatatccccgagatgccttctccaaagaagatgcaccaggggaagaagaagaagcagaacaagaacagaatctcatgggtgggagaggccgttaaaaccgacggcaagaaatcatattacaaaaaggtgtgcatcgacgccgaaacactggaggtcggggattgtgtttctgtgatcccagacgactcatcaaagcctctgtacctggccagagtgacggcgttatgggaggactcaagcaacgggcagatgttccatgcccattggttttgcgcggggaccgataccgtgctgggagcaacctcagatcccttggagttgtttctggtggacgagtgtgaggatatgcagctcagttacattcactccaaggttaaggtcatttacaaggcaccatcagaaaattgggccatggaaggtggcatggaccctgaatctttgctggaaggcgatgacggcaagacttacttctaccagctctggtacgatcaggactatgcccgcttcgagagtcctcctaaaacacaaccaaccgaggataataagtttaagttctgtgtgagctgtgcaaggctggctgagatgaggcagaaggagatccctcgggtgcttgaacagctcgaagacctggactcccgtgttctatattacagtgctaccaagaacggcatcctgtaccgggtgggtgacggagtatatctgcctccagaggctttcactttcaacattaagcttagttcgccggtaaagcgcccccgaaaggagcccgtcgacgaggacttgtaccctgaacactataggaagtactccgattatatcaagggtagcaatttggatgcccccgagccctacagaattggacgcattaaggaaatcttttgtccgaaaaagagcaacggacgccccaatgagacggatatcaagatcagggtcaataagttttacaggcccgagaacacccacaagagcacccccgcatcatatcacgccgacatcaacttgctgtactggagcgatgaagaggcggtggtggacttcaaggctgtccagggccggtgtaccgtggaatacggtgaagacctgcccgaatgcgtgcaggtctattcaatgggcggccccaataggttctatttcttggaggcctacaacgccaagtcgaagagcttcgaagatccccctaatcatgctcggtcaccaggaaacaaggggaaaggcaaaggcaagggtaaaggaaagcccaagagccaggcatgcgagccgagtgagccagagattgaaattaagctcccaaaactccggaccttggacgtctttagcggctgtggcgggcttagcgaaggctttcatcaagctgggatatctgataccctgtgggccattgagatgtgggatcccgcagcgcaggcattccgtctgaacaaccccggaagcacggtgttcaccgaagactgcaacattcttttgaagctcgtgatggcaggcgagaccaccaatagcagaggccaacgcctgccgcagaagggggacgttgagatgctgtgcggcggccctccctgccaggggttcagtggcatgaacaggttcaacagtagaacctacagcaaattcaagaattccctggtcgtctctttcctgagctattgcgattactatagaccaagattcttcctccttgaaaatgtgcggaatttcgtatcttttaagaggtcaatggtactcaagctgactctccggtgtctggtgcgtatgggataccagtgtaccttcggggtgctgcaggccggacagtacggcgtcgcccaaacacgccgcagggcaatcatcctggctgccgctcccggggaaaaactgccgttatttcccgaaccccttcacgtgttcgctcccagggcttgtcagctgtccgtagtagtggacgataagaaattcgtgtcaaacataaccagactttcttcaggacccttcaggacgatcactgtgcgggatacaatgtccgatctgcccgaggtgagaaatggagcttccgctcttgagatttcctacaacggcgagccccagtcatggtttcagcggcaacttagaggcgcccaataccagcccattttgcgggatcatatctgcaaggacatgtcggcactagtagctgcccggatgagacacattcctttggcaccagggtcagattggcgtgatctgcctaacatagaagttcgcctgtcggacgggaccatggcccgtaaactgcgctacacgcatcacgaccgcaaaaatgggcggagcagttcgggagccctgcgaggagtctgcagttgcgtggaggcgggaaaggcctgtgatccagctgctagacagttcaatacactcatcccttggtgcctgcctcataccggcaaccgccataatcactgggccggcctgtatggtcgccttgagtgggatggctttttctcaactaccgtgacaaacccagaacctatgggcaaacaaggtcgggtactgcatccagaacaacaccgagtagtgagcgtccgggagtgtgcccggtcccaggggtttccagacacttaccggttatttggaaacattctcgataagcacagacaggttgggaatgctgtgcccccacctctcgctaaagccatcggactcgaaatcaaactatgcatgctggctaaggccagggaatccgcctccgccaaaatcaaggaagaggaagccgccaaggactag

SEQ ID NO: 114852 - DNA, 2739 bp, Artificial Sequence
  Description of Artificial Sequence: Synthetic coding sequence
atgcctgcaatgccttccagcggccccggcgatacctcaagttctgctgctgagcgcgaagaggataggaaagacggtgaggagcaagaagaacctagagggaaagaggagcgccaagagccatccaccacggctaggaaggtaggcaggcctggacgcaaacgaaaacatcctccagttgaatccggggacacaccaaaggatcctgcggtgattagcaaatcacctagcatggcccaggattctggcgcctccgaactgttgcccaatggagatctcgagaagcgcagcgagccacaacccgaagaaggctcacctgccggcggacagaaggggggcgcacctgcagagggagagggggccgccgagactcttccagaggcaagcagagcagtggagaatggctgctgtaccccgaaggagggtcggggagcccccgccgaggccggcaaggaacagaaggagacaaatatcgagagtatgaaaatggagggaagccgggggagactccgcggggggttgggctgggaatcttctctccggcaacgaccaatgccaaggctgacattccaggcaggcgacccgtactacatttctaaaagaaagcgcgacgaatggttggcccgctggaaacgggaagcagaaaaaaaggccaaagtcattgctggaatgaatgccgttgaggaaaatcaaggccccggcgaatcccagaaggtggaagaggccagcccgccggccgtccaacagccgacagaccctgcgtctcccacggtagcaactacccccgagcccgtggggtccgacgccggggacaaaaacgccaccaaggccggcgatgatgaaccagaatatgaggatgggcgggggttcggaatcggcgagctggtttggggtaagctcaggggctttagttggtggccagggcgcattgtcagctggtggatgacaggccgcagtcgggcagccgaggggacacggtgggtgatgtggtttggcgatggcaagttcagcgttgtctgcgtggaaaaactgatgcccctgtccagcttctgttcagcttttcaccaggctacatataacaaacagccgatgtaccgtaaggccatctatgaggtgctccaggtagccagctctagggctggcaagctatttccggtgtgtcacgacagcgatgagtccgacacagctaaggctgtagaggtccagaacaagcccatgattgaatgggcgctaggcgggtttcagccctccggccctaagggcctggaaccacctgaagaggagaagaatccctacaaggaggtgtacacagatatgtgggtggagcctgaggctgccgcatacgccccacctccccccgccaagaagccccgcaagtcaaccgcagagaagccaaaggtgaaggagattatcgatgaaagaacaagagaaagactggtatacgaggtgagacagaagtgtagaaacattgaggatatttgcataagctgtggatctctgaatgttactctagagcaccctctgttcgtaggtggcatgtgccagaattgtaagaactgtttccttgagtgcgcgtatcagtacgacgacgacgggtatcagtcctattgtaccatttgttgtggaggccgagaagtgctgatgtgcgggaacaataattgctgtaggtgtttctgcgttgaatgcgtggatttgttggtgggccctggagctgcccaggcggctataaaggaggatccatggaactgttatatgtgtggccacaaaggcacatacggcctattaaggcgtcgtgaggactggcctagcagactgcagatgttcttcgcgaacaatcatgatcaggaattcgaccctccaaaggtttatcccccagtgcctgctgagaagaggaagcccatcagggtgctgtccttgttcgatggtatcgcgacagggcttctggtgctaaaggatctgggaatccaggttgacaggtatattgcttccgaggtgtgtgaggattcaataaccgttggcatggtccggcaccagggcaaaataatgtatgtgggggatgtccggtcagtgacacagaaacacattcaggagtggggcccatttgatctggtgatcggcggctcgccttgcaacgatctctccattgtcaatcctgctaggaaagggctctacgaaggaacggggaggttattcttcgagttctacagattattgcacgacgcgaggcctaaagagggagacgatagacctttcttctggcttttcgaaaatgtcgtggccatgggcgtgagtgataagcgggacatcagcaggttcctggaatccaacccagtgatgattgacgccaaagaggtttcagcagctcacagagcaagatatttttgggggaatctacccgggatgaatcgccctctggccagcaccgtgaatgacaaattagagctccaggagtgtctcgagcacggacgcatcgcgaaattttcaaaagtgcgaacaatcacaacgcgctccaattctatcaaacagggaaaagatcagcactttcctgtgttcatgaatgaaaaggaggacatcctgtggtgcaccgagatggagcgcgtttttggtttccccgtgcattataccgacgtgtcaaatatgagcagactagcaagacagagactgctaggccgctcctggagcgtgcccgtgatccgccatctgtttgcacctttgaaggagtactttgcctgcgtctag

SEQ ID NO: 114853 - DNA, 2739 bp, Artificial Sequence
  Description of Artificial Sequence: Synthetic coding sequence
atgcccgcaatgccttctagtgggccaggagataccagctcctccgcagccgagcgggaggaggaccgcaaggatggagaggagcaggaggagccccggggaaaagaagagcgccaggaaccaagcacgacagcccgtaaggtggggaggcctgggcgaaaaaggaagcatcctccagtggaaagcggggatacaccaaaagatcccgcagtaatctccaagtctccaagtatggcccaggactctggcgcaagcgagctgctccccaatggtgaccttgagaagcggagcgaaccacagcctgaggagggttcccccgcaggtgggcagaagggcggcgctccggccgaaggggagggagctgctgaaactctacccgaggcctctagagcggtggagaacggttgctgtactcccaaggaaggccgcggtgctcctgcagaagccgggaaggaacagaaagagaccaacatcgagtctatgaagatggaaggctcccgaggaagactccggggaggcctgggctgggagtcgtccctgcgccagaggccgatgccgaggctcaccttccaggcaggggatccctattacatctctaaacgaaaacgggacgaatggctagctcggtggaaacgagaggccgagaaaaaagcaaaagtgattgctggcatgaatgcagttgaggagaaccaggggccaggggaatcccagaaggtcgaagaagcaagcccgcctgccgtgcagcagcctacagatcctgcgtcgcctactgttgccactacacctgaaccagtaggctccgacgccggcgacaaaaatgccaccaaggctggcgatgacgaacccgaatacgaagacggaaggggattcgggatcggagaactggtatggggaaagctgcggggcttctcatggtggccaggacgcattgtgagttggtggatgactggacgctcccgagccgcggagggcacaaggtgggtgatgtggtttggggacggaaaatttagtgtggtgtgcgttgagaagcttatgcctttaagtagcttttgttccgcgttccaccaggcaacatataataaacagccaatgtaccgcaaggctatctatgaggtgctccaggtcgcctcatctagagcgggaaaactattccccgtgtgccatgattcagacgagagcgacacggcaaaagccgttgaagtgcagaacaagccaatgatcgagtgggcccttggtggcttccagccctccggacctaagggactggaaccacccgaggaggagaagaatccatacaaagaggtatacacagatatgtgggtggagccagaagcagccgcttacgctccgccaccgcctgctaaaaaaccccgtaaatcaaccgctgagaagcctaaggttaaagagatcatcgatgaaaggactagggaacgattggtttacgaggtaaggcaaaaatgtcggaatatcgaagacatttgtataagctgcggctcactgaacgttacgcttgaacatcccctctttgtgggtggcatgtgtcagaactgcaagaactgtttcctggagtgtgcttatcagtatgatgacgatggttatcagtcctattgcacaatttgttgcgggggacgcgaagttctgatgtgcggcaataacaattgctgtagatgcttttgtgtagagtgcgtggacctgttggtaggtccaggcgccgcccaggcagccataaaggaggatccttggaattgctatatgtgcggacacaaagggacatacggtctgctaaggaggagggaagactggccttccaggctgcaaatgttttttgccaacaaccatgatcaggaatttgatcccccaaaggtttatccacccgtcccggccgagaagagaaaacctatcagagtgctatcactcttcgacggaattgctaccgggttgttagtgctgaaagacttagggatccaagtggaccgctatattgcatctgaggtttgcgaggattctatcactgtgggaatggtacgtcatcagggaaaaattatgtatgtcggagacgtgcgttccgtgacccagaaacacatacaagagtggggtcctttcgatttggtgatcggcgggagtccatgtaatgacctcagcatcgtcaatcctgccaggaagggcctgtatgaaggtacaggtcgtctcttttttgaattctatcgtcttctccacgatgcacgtccaaaggagggtgacgatcggccgtttttttggttgttcgagaacgtggtggcgatgggtgtgagcgataagagggatatttcccgtttccttgaaagtaacccagtcatgatcgacgctaaggaagtgtcagccgctcacagagcccgctacttttggggcaacctccccgggatgaacaggcccctggcctccacagtcaatgataagctggagctgcaggagtgtcttgaacatggtcgtattgctaagttcagtaaggttcgaacaatcacaacccggtccaactctataaagcaaggcaaggatcagcatttccccgtgttcatgaacgagaaggaggatatcctctggtgcaccgagatggagcgcgtttttggcttccccgtacattacactgacgtgtcaaatatgtccagactggctagacaaagactacttgggcgctcttggtctgttcctgttataagacacctctttgccccattgaaggagtatttcgcctgtgtgtag

SEQ ID NO: 114854 - DNA, 2172 bp, Artificial Sequence
  Description of Artificial Sequence: Synthetic coding sequence
atgggcattttggagcgagtggtgaggcgcaacggacgcgtggacaggtcactgaaggatgagtgcgacacggcagaaaaaaaggccaaagtcattgccggcatgaatgccgtggaggaaaaccagggccccggagaatctcagaaagttgaagaggcctcaccccccgccgttcagcagcctactgaccctgcatctcccactgtcgctactacacctgagcccgtggggagcgatgcaggagacaagaatgcaacgaaggccggggacgacgaaccagagtacgaggacggaaggggctttggcatcggggaactcgtgtggggcaagcttcgtgggtttagctggtggccgggccgcatcgtttcttggtggatgaccggacgcagccgggctgccgaaggaacccgttgggtcatgtggtttggagatggtaagttctccgttgtttgtgttgagaagctaatgcctttaagctctttctgcagtgccttccatcaggctacctacaataagcagcccatgtacaggaaggcgatctacgaggtgttacaggtggcgtctagtcgagccggcaagcttttcccagtgtgccacgacagtgacgagtccgatactgccaaagcggtcgaagtccaaaacaaacctatgatagagtgggccctgggcggcttccaaccgagtggtccgaagggattggagccacccgaggaagagaaaaacccttataaggaggtctatactgatatgtgggttgaacccgaggccgctgcttacgcgcctccgccacccgctaaaaaaccccggaagagcaccgcagagaaacccaaggtcaaggagatcatcgacgagcggacgagggaaaggctggtgtacgaagtccggcagaaatgtagaaacatcgaagacatctgtattagctgcggatcactaaacgtgaccctggagcatccactcttcgtcggaggaatgtgccaaaactgtaagaactgtttcctcgagtgcgcatatcagtacgatgatgacggataccaaagctactgcactatttgctgcggcggccgggaggtacttatgtgtggcaataacaactgttgtcgatgcttttgcgtcgaatgtgtggacctgctcgttggccccggggccgcacaggcagcaatcaaagaggatccatggaattgttatatgtgcggacataaggggacgtacggtctgctccgccgccgagaagactggcccagtcgccttcaaatgttcttcgcaaacaatcatgatcaggagttcgacccacctaaagtctacccccctgtgcctgccgagaagcgcaaaccgattagagtgctgtccctgttcgacggcatagccacaggacttctggtcctgaaggatttgggaattcaggtagatagatacatagcctccgaggtttgcgaggacagtatcactgtcggcatggtgcggcatcagggcaaaattatgtacgttggagatgtgaggtccgtgacccagaagcacatccaggaatgggggcctttcgatcttgttatcgggggctctccatgcaacgatctgtctatagtgaatcctgccaggaaaggcctgtacgaaggcacaggcaggttgttctttgaattctaccggttgctacatgatgcaaggcctaaagagggcgacgatagacctttcttttggctgtttgagaacgtggtggccatgggcgtgtccgataagcgggacatcagtcggtttcttgagagcaacccagtgatgattgacgctaaagaagtgtccgctgctcacagggccaggtatttctgggggaatctccccggcatgaaccggcctctggcatccacagtgaacgacaagctggagctgcaggagtgcctggagcacggcagaatcgccaaattttcaaaagttcgaacaattacaacccgaagtaattctatcaagcagggcaaggatcagcattttcccgttttcatgaacgagaaagaggatatcctgtggtgcaccgaaatggagagggttttcggattccccgttcattacactgatgtgtcaaatatgagcaggctggcccgtcagagattactggggcgtagttggagcgtccctgtcattaggcatttgtttgccccactcaaggaatatttcgcctgtgtctag

SEQ ID NO: 114855 - DNA, 2070 bp, Artificial Sequence
  Description of Artificial Sequence: Synthetic coding sequence
atgaacgcggtcgaggaaaatcagggacccggcgagagccaaaaggtggaggaggcgtcgccaccagctgtccaacaacctacggatccagcttcccccacggtggccaccacccccgagcctgtggggagtgatgctggcgataagaatgctaccaaagcaggggatgatgagcctgaatatgaggatggccggggcttcggcataggtgagctggtatggggaaaactgcgtggcttttcttggtggcccgggcgcatcgttagctggtggatgactggccgttcacgagccgcggagggcactcggtgggtcatgtggtttggcgacggaaaattttccgtcgtgtgcgtggaaaagctcatgcccttatcctccttttgcagtgcattccatcaggcgacgtataataaacaacccatgtaccggaaagccatttatgaggtgctgcaggtcgctagttctcgggccgggaagctattcccagtttgtcacgattccgatgaaagcgacacggcaaaagctgtggaggtgcagaataaacccatgattgaatgggcactcggaggcttccagccctccggtcctaaaggtctggaaccaccagaggaagagaagaatccttacaaagaggtgtacaccgacatgtgggtcgaacccgaagccgccgcttacgcacctcctccccccgcaaagaaaccccggaagagtacagccgagaagccaaaagttaaagagatcatcgatgagcgaacaagggagcgccttgtgtacgaggttagacagaagtgcagaaatatagaagacatttgcatctcttgtgggagcctgaacgtgacacttgaacaccctctatttgtgggtggtatgtgccagaactgcaaaaactgctttctcgaatgtgcctatcaatatgacgatgatggctaccaatcttattgcaccatttgctgcggaggaagagaggttctgatgtgcgggaataataattgctgccggtgtttctgcgtggagtgcgtagacctactcgtgggccctggagcagctcaggctgctatcaaggaggacccctggaactgctacatgtgcggtcataagggaacatatggactgcttaggaggagggaggactggcccagtagactgcagatgttttttgccaacaaccacgaccaggagtttgaccctccaaaagtttatccacctgttccagccgagaagaggaagccaattagggtgctttccttgtttgatgggatagcaacagggctattagttcttaaggacctggggatacaggtcgacaggtatattgccagcgaagtctgcgaggacagtattaccgttggcatggtacggcaccaggggaaaatcatgtatgtcggcgatgtgcggagtgtcactcagaaacacattcaagaatgggggccatttgatctggtaattggaggatcaccatgtaatgacctcagcattgtgaaccccgccaggaagggtttatacgaaggcacgggacgcctgttcttcgaattctatcggctgctgcatgatgcccggccgaaggagggtgacgatagacctttcttttggttatttgaaaatgtggtcgcgatgggggtctctgacaagcgggatatcagcagattcctggaaagcaaccctgtcatgatcgacgcaaaagaagtctcagccgcccatcgggcacgctatttttgggggaacttgcccggcatgaaccggcctttagcctccaccgttaatgataagcttgaactacaagagtgcttggagcatggccgcatagccaagtttagtaaggtccgcacgataaccacccgctctaatagcataaaacagggcaaggaccagcatttccccgtgtttatgaacgagaaagaggacattctgtggtgtactgagatggaaagagttttcggcttccctgtgcactacacagatgtatccaatatgtcaaggctggcgaggcaacgactcttgggacgttcttggtctgtgccagtgatcaggcacctgttcgcacccctcaaagagtattttgcatgcgtgtag

SEQ ID NO: 114856 - DNA, 501 bp, Artificial Sequence
  Description of Artificial Sequence: Synthetic coding sequence
atgccagccatgccatcttcaggcccaggcgatacaagctccagcgctgctgagagagaggaagatcggaaggacggtgaagagcaggaagaacctcgtgggaaagaggaaaggcaagagcctagtactacagcaagaaaagtgggcaggccagggcgaaaacggaaacatccccccgtcgagtccggtgacacgcctaaagacccagctgtcattagcaaaagcccttctatggcacaggactctggcgcaagcgaactgttaccaaatggagatttggagaagcgatctgagccccagccagaggagggcagccccgcaggcgggcagaaaggcggcgctccggccgagggcgagggggccgctgaaaccctcccagaggccagccgggccgtggagaacggctgttgcactccgaaggaggggcgtggcgcacctgctgaggccggggaatcctcagctcctggcgctgcctccagcggacccactagtatcccctag

SEQ ID NO: 114857 - DNA, 2538 bp, Artificial Sequence
  Description of Artificial Sequence: Synthetic coding sequence
atggaacccagcccagaacctcctagcctggagtccatgaagggtgatactcggcatctaaacggcgaggaagacgctggcgggagggaagattcaatattggtgaatggtgcttgctccgaccagagtagcgatagcccaccaatcctggaagcaatcagaacacccgagattcgggggaggcgcagttcatctcggctgtctaaacgcgaagttagctctttgctttcctacactcaggacctgaccggcgacggggatggagaagacggggacgggtcagacacgcccgtgatgccgaagctcttcagggaaacacgaacaagaagcgaatctcccgccgtgagaactcgcaacaacaactcagtttcatcgcgcgagagacatcggcccagcccaagaagcacaagaggtcggcaggggcgcaatcatgtagatgaatccccagtcgagttccctgcaacaagatctctccggagacgggccactgcatcggctggaacgccgtggccctcgccgccttcgtcgtacttgaccatcgacctcaccgacgatactgaggacactcatggcactccgcagtcttcttcaacaccatatgcacggttggcacaagactctcagcaaggaggaatggagtcccctcaagtggaagcagatagcggcgatggtgatagctctgagtaccaggatggcaaagaatttggcattggggatctcgtgtggggtaagatcaagggcttctcttggtggcctgctatggtggtctcctggaaggccacaagtaaaaggcaagccatgagtggcatgaggtgggtccagtggtttggtgacggtaaattctcagaagtctccgcagacaaacttgtggcactcggcctttttagccaacacttcaatttggccaccttcaacaaactggtgagttatcggaaagcaatgtatcacgcccttgagaaagcccgtgtcagagctggaaaaacgttcccaagcagtccaggggacagtctggaggatcaactcaagccaatgcttgaatgggcccacggcggatttaaacctaccggtattgagggactcaagccgaataatacccaacccgagaacaaaaccagaagaagaacagccgacgatagcgccacttctgattattgccctgcccctaagcggcttaaaacgaactgctacaataacgggaaagaccgaggcgacgaagaccagagccgtgagcagatggcgagcgacgtcgcaaacaacaaaagttcactcgaagatgggtgccttagctgtggcagaaagaacccggtctcctttcatcctttgttcgagggcgggctgtgccaaacttgtcgagaccgattcctggagctattttacatgtacgatgacgatggctaccagtcatactgcactgtatgttgcgaggggcgggaactgctactgtgctccaacactagctgctgccggtgcttctgcgtggagtgcctggaagtattagtgggaacgggtactgccgccgaagctaagctgcaggagccgtggtcctgctacatgtgccttccccagcggtgtcatggcgtgctgaggcgaaggaaagactggaatgtccggctacaggctttcttcacttcagatactggcctggagtacgaggctcccaagctatatcccgccattcccgccgcacggcgtcggcccattagggtactctcattgttcgacggcatcgcaaccggttacctcgtgctgaaagagctggggattaaagttggtaagtatgttgctagcgaagtttgcgaggagtccattgccgtgggaactgttaaacacgaaggcaacattaagtacgtgaacgatgtgaggaatatcactaaaaagaatattgaggagtggggcccttttgatctggttattggtggatcgccctgcaacgacttgagtaatgtgaaccccgcacgtaaaggcctctacgagggaacaggcaggttattctttgaattctatcacttgctgaactatagtaggcccaaggaaggggatgacagaccttttttttggatgttcgaaaatgtagtggcaatgaaggtgggagataagagggatatcagtagatttctggagtgtaatccagttatgatcgatgcaattaaggtcagcgcagcccaccgtgcccgatacttctggggaaacttgcctggaatgaaccgtcctgtgattgctagcaagaatgataagctggaacttcaggattgcctggagtacaatagaatcgcaaagctgaagaaagtgcaaactattactacaaaatccaattccatcaagcagggaaagaaccagctttttcctgtggtgatgaatgggaaagaagacgtcctttggtgtaccgaactggaaaggatttttggctttcctgtgcactacaccgacgtgagtaatatgggcaggggcgcaaggcaaaaattgctggggagaagctggagtgtcccagttattaggcacctgtttgccccacttaaggactacttcgcttgtgagtag

SEQ ID NO: 114858 - DNA, 2562 bp, Artificial Sequence
  Description of Artificial Sequence: Synthetic coding sequence
atgaagggggacactagacacctcaatggggaagaagacgcaggaggaagagaggatagcatcctagtgaatggcgcttgtagcgatcagagttccgacagcccccctatcctggaggccatccggaccccagaaatcagaggccgccgcagcagctcacggttgtccaaaagggaggttagttcgctgttaagctatactcaggatctaacaggtgatggggatggcgaggatggggacggtagcgatacccccgtcatgcccaagttatttcgggaaactagaaccagaagcgagagccccgccgtccgcacacgcaataataactccgtgtcaagcagggagcgccaccgcccctcaccacgctctacacgagggagacaggggcggaaccatgtcgacgagtctcctgtggaatttcctgctacccgcagcctgcgtagaagggctactgcctccgccggaaccccatggccgtctcctccctcttcttacctgacgatagatcttaccgacgacaccgaggatactcatgggacaccacagtcaagtagtaccccttatgctcggctagcacaggatagtcagcagggaggcatggaaagcccacaggtggaggccgactcaggtgacggcgacagctctgagtatcaggacggaaaagagtttggcataggggatctggtttgggggaagataaagggttttagctggtggcctgctatggtggtcagctggaaagccacatcaaagaggcaagcgatgtcaggtatgaggtgggtacagtggttcggcgatggcaaattcagtgaggtcagcgctgataaacttgtcgcgctgggactcttttctcagcactttaacctcgctaccttcaacaagctcgtcagctatagaaaagcaatgtatcacgccttggagaaggcccgtgtgcgcgctggaaaaacttttccttcatcgccaggcgacagcctcgaagaccaacttaaacccatgctggagtgggctcatggaggatttaaacccacaggaatcgaaggactgaagcccaataatactcaaccagtggttaataagagcaaagtccgacgggcaggctctagaaagcttgagtctcggaagtatgagaacaaaacccgacgccggactgctgacgactctgcgacaagcgactattgtccggcaccaaagcgattgaagactaactgctacaacaatgggaaggataggggcgacgaggaccaatcaagagagcaaatggcaagcgatgtcgcaaacaacaagtcgtcactcgaggacgggtgcctcagctgcggacgtaagaacccagttagttttcaccccctgtttgagggaggattgtgtcagacctgccgagaccgttttctagagctattctatatgtacgacgatgatggataccagagctattgtaccgtgtgctgcgaggggagggaactcctgctctgcagcaacaccagttgttgccggtgcttttgtgtggagtgcctcgaagtcttggtggggacaggcaccgctgccgaagctaaactgcaagagccctggtcctgttatatgtgtctcccacagagatgccacggagtgctccgaaggcgaaaagattggaatgtacgcctacaggccttcttcacaagtgatacaggtctggaatatgaggcccctaagctctatcctgctattccagccgcacgacgccgccccatacgggtgttgtcccttttcgatggcatcgccaccggatacttggtcctgaaagagctgggaattaaggtcggaaagtatgtcgcatcagaggtatgtgaggagtcaattgcagtgggcaccgtaaagcacgagggcaacattaagtacgtcaatgacgtaagaaacattactaagaagaatattgaggagtggggtccatttgacctggtgataggaggtagcccctgtaacgacctgtccaacgtcaaccccgcccgaaagggtctatatgagggcactgggaggctattttttgaattctatcacctacttaactactcgcgacccaaggagggggatgaccgcccctttttctggatgtttgagaatgtggtggctatgaaagttggggataagagggatatcagccggtttcttgagtgcaaccctgttatgatcgatgctatcaaggtgagcgctgcccaccgagctcggtatttctggggaaatcttcccgggatgaatcgcccagtcattgcgtctaagaatgacaagttggaactccaggactgtttagagtataatcggatagcgaagttaaagaaggtccaaacgatcaccactaaatcgaattcaatcaaacaaggtaaaaatcagctcttccctgtggttatgaacgggaaagaggacgttttgtggtgtactgaactcgagcgtatatttgggttcccagtgcactacacagacgtgtccaatatgggtcggggggcccgccaaaaactgctaggaaggtcatggtccgtgcccgtcattaggcatctttttgctccactgaaggattactttgcctgcgaatag

SEQ ID NO: 114859 - DNA, 2379 bp, Artificial Sequence
  Description of Artificial Sequence: Synthetic coding sequence
atgaagggcgataccaggcaccttaatggcgaagaagatgcaggtggccgtgaagattccatcttggtgaacggagcctgctcggatcagagtagcgacagcccaccaatccttgaggctatacggactcctgaaatacgaggtcgtaggtccagctcacgactgagtaagcgcgaggtttcgagcttgctttcttatacacaggacctgacaggcgacggagatggtgaagacggcgatgggtcagataccccagttatgcctaaactttttcgtgagacccggacacggtcagaatctccagcagtccgcacccggaacaacaactctgtaagctcacgggaacgccaccgtccatcccctaggtcaacccgcggtcggcagggcaggaaccacgtcgatgaatcccccgtcgagttccctgctacacgatctctgaggcgtcgggcaacagcctctgctggaactccatggccaagcccacccagcagctatttaaccattgacctgactgacgatacggaggacactcacggtacaccccaatcttcatccacaccctatgcccgcctggcacaagattcacagcagggcgggatggagagcccacaagtggaagcagatagcggggatggagatagcagtgagtatcaagatggaaaggagttcgggattggagacctcgtatggggcaaaatcaaaggcttttcttggtggcccgccatggtggtaagttggaaagccacatccaagcggcaggccatgtctggcatgcggtgggtgcagtggttcggggacgggaaattttcagaggtatcagccgataaactggttgcccttggcctgtttagccagcattttaatctagcaacctttaataagctggtgagctaccggaaagcgatgtaccatgctctggaaaaggccagggtgcgggctggcaaaacattcccatccagcccgggagattctctggaggatcaactaaaacccatgcttgagtgggcccatggtggttttaagcctactggcatcgaaggcctgaagcctaacaatacacaaccagagaacaaaacacgccggaggactgcagatgactcagcaactagcgattactgcccagctcccaagaggctcaaaaccaactgctacaataacgggaaggacaggggtgacgaagatcagtctagagagcagatggctagtgacgtagcaaataacaagtcttccttggaggatggttgcttgtcctgcggccgaaaaaaccccgtgtcttttcatccccttttcgaaggtgggctgtgtcagacttgtagggacagatttttggaactgttttatatgtacgacgacgatggttaccaaagctattgtaccgtgtgttgcgagggtcgcgaactgttactttgtagtaacacatcctgctgtaggtgtttttgcgtggagtgtctcgaggtcctggtggggaccggcactgctgctgaggctaaactgcaggagccatggtcttgctacatgtgtctgcctcaaagatgccacggagtcctgagacgacgaaaagactggaatgttagacttcaagctttctttacatctgatactggtctagaatatgaagcccctaagctttaccctgcaatcccagctgccaggagaagacccattagggtactgtctttattcgacggaatcgctacgggctatctggtccttaaagagttgggcattaaagtcggaaagtacgttgcatcagaagtgtgcgaggaatcgatcgccgtgggaacagtgaagcacgagggaaacattaagtacgtcaatgatgttcgcaatatcacaaagaaaaacattgaggaatggggccctttcgatctagtgataggaggatccccatgtaacgatctgagcaacgtaaatcccgcacgaaaaggactctacgagggcacggggcgcctcttcttcgagttttaccacttgctgaactatagtagaccgaaggagggcgacgacagaccatttttctggatgttcgagaacgttgtcgcgatgaaagtcggtgacaaaagggacatttctaggtttctcgagtgcaatccagtgatgatcgatgccattaaagtctctgccgcacatcgcgcccgctatttctggggaaacctaccaggaatgaacagaccggttattgcttctaagaatgataagttagagcttcaggattgtcttgagtataaccgcatcgctaaagacctttggctgtcatgtgcacttcatcggagagtgcagcacgggccctggtgtccacccgaggcggccggtaaagtcctggagagagcatgccacccgactcctttacggccttctgagggtctgttgtgtatgtag

SEQ ID NO: 114860 - DNA, 2313 bp, Artificial Sequence
  Description of Artificial Sequence: Synthetic coding sequence
atgaagggagacacccggcatctgaacggggaagaggacgctgggggtcgcgaggattcgatactggtgaacggggcgtgctcagaccagtctagtgattctcccccaattcttgaagccataaggacgcctgagatccgaggaagacgaagcagcagtcggctttctaagagggaagtgagttccctcctgagctatacacaggatctcactggagacggcgacggtgaggatggggacggttccgacacccccgtaatgccaaagctttttagggaaacccggactcgcagtgaatcccccgccgtgcgaacacgcaacaacaactcagtctcttctcgtgaaagacataggccatcacccaggtctacaaggggaagacaggggcggaatcacgtggacgaatccccagttgaattccctgctactaggtcactcaggcgcagagctacagcttccgctggtaccccatggccttctcctccatcaagctatctcacaatcgatctcacagatgacaccgaagatacacatggcacccctcaaagctcttctacaccttatgcccgccttgcacaggatagccagcaggggggcatggagtccccgcaagtcgaagccgattcaggagatggagactcatcagaatatcaggatggaaaggaatttggtattggcgaccttgtatggggtaaaatcaaagggttctcttggtggccagctatggtggtgtcatggaaagccacctccaaaaggcaggccatgtcaggaatgagatgggtccaatggtttggcgatggaaagttctccgaagtatcagccgacaagttagtggctcttggcctgttctcccagcatttcaatctcgctacattcaataagttagtatcttatcggaaggccatgtatcacgctcttgagaaagctcgcgtacgcgccggcaaaaccttcccctctagcccgggggattctttagaggatcagctgaaacctatgcttgaatgggcacatggaggttttaaacctaccggtatcgagggcctgaaacctaataatactcagcccgaaaataaaacccgaagacgaaccgctgacgatagcgcaacgtctgactactgtccagctcctaagaggctgaagaccaactgttataataatggcaaagaccgaggcgatgaggatcagtcacgtgagcagatggcatccgacgtggccaataataaatcttctctggaggatggatgtctgtcctgcggacgaaaaaatccagtgagtttccatcccctgtttgagggagggctgtgtcaaacctgccgggaccgcttcctagaattgttctatatgtacgatgatgatggctatcagtcatactgcaccgtgtgctgtgaaggtagagagttactgctttgtagcaacacttcctgctgccgctgcttttgcgtagaatgtcttgaagtgttagtcggaaccggaacagccgccgaggctaaattacaggaaccatggtcttgctatatgtgtctccctcagagatgtcacggcgtattacggagacgcaaagattggaatgtcaggctccaagctttcttcacctctgatactgggctcgaatatgaggctccaaagctctacccagctattccagcggctagacgacgcccaatcagggtgctgtccctttttgatgggattgccactggatacctcgttttgaaagagctcggtattaaggtcgggaagtatgttgcatccgaagtgtgtgaggaatcaatcgccgtgggtaccgtcaaacacgaggggaacattaaatacgtcaacgacgtacggaacatcacaaagaagaacatagaggagtgggggccctttgacctggtcatcggagggtccccctgcaacgacctgtccaacgtcaaccctgcacgcaaaggcctgtacgaaggaaccggcaggcttttctttgaattctatcatctgctgaactattccagacccaaagagggcgacgatcgcccctttttctggatgttcgaaaatgttgtggccatgaaggtgggcgacaaacgagatatctcacgttttctggaatgtaatccggtgatgatcgatgctattaaggtttctgctgcccaccgcgcccgctatttctggggcaatctgccaggaatgaacagaatcttcggctttcccgttcactataccgacgtaagcaacatggggaggggcgcgagacagaagttgctaggccgttcctggtctgtgcctgtcatcaggcacttgtttgctcccctgaaggattacttcgcatgcgagtag

SEQ ID NO: 114861 - DNA, 2502 bp, Artificial Sequence
  Description of Artificial Sequence: Synthetic coding sequence
atgaagggggatactaggcacttgaacggagaggaggacgccggaggtcgcgaggattctatactggtgaatggagcatgttccgatcagagcagcgacagtcccccaatcttggaggctataaggacccccgagatacgtggaagacgctcttcgtctcgactgtcaaagagagaggtatcgagcctgctctcatacacccaagatctgactggggacggtgacggggaggacggggacggtagtgataccccagtcatgcccaagctgtttcgagagacacgcactagaagtgaaagtccagcagtcagaactcggaacaataattccgtctcctctagagagcgacaccgtccatcaccaaggtcaacacgggggcgtcagggcaggaatcacgttgacgaaagcccagttgaatttcccgccacacggagcctgcgcaggagagcaacagcctccgcaggcaccccttggcccagtccaccctccagctacctgactatcgacctgacagacgacacagaagacacccatggcacacctcagagtagcagtactccatacgccaggctcgcacaagattctcagcagggaggaatggaatcaccgcaggtggaggcagacagtggagatggagatagttctgagtaccaggacggaaaggaatttggcataggcgatcttgtgtgggggaaaattaaggggttctcttggtggccagctatggtcgtttcctggaaagcaacctctaaacgccaagctatgagcgggatgaggtgggtgcagtggttcggagatgggaaatttagtgaggtttctgccgataagctggtggcgttgggtctgttctctcagcactttaaccttgcgaccttcaataaacttgtgtcttacagaaaggctatgtatcacgccttagagaaagctagagttagagccgggaaaaccttcccaagtagtccaggcgactctctggaggaccaactgaaacccatgctggagtgggcccacggcggcttcaaacctacgggtatcgaagggttaaagccaaacaacacccagcccgagaataaaacacgccggcgtaccgcggacgatagcgccacgtccgactactgtcctgcccccaaacgactgaagaccaattgctataacaacgggaaggatcgcggggatgaagatcagtctcgtgagcaaatggcatctgacgtcgccaacaataagagctctctggaggatggctgtctttcgtgcggacgcaagaatccagtgtctttccaccctctgtttgagggtggcttatgccagacatgtcgggatcggttcctagagcttttctatatgtatgacgatgatggataccagtcatactgtacggtgtgttgtgagggccgtgagttactactctgtagcaacacctcatgctgtagatgcttctgtgtggagtgcctggaagtgctcgtgggtactggcaccgccgcagaggcaaagctgcaggagccttggtcctgttacatgtgtcttccacagagatgccacggcgtattgcggcgacgcaaggattggaacgtgcgactgcaggcattctttacgagtgataccggccttgagtacgaggcccctaagttgtatccagcaattccggcagcccgccggagaccgattcgggtgctgtccttatttgatggtatcgctacgggctatctggtgttgaaagaattaggcatcaaggtaggaaagtacgtggcttctgaagtgtgcgaagaatctatcgcggtaggaactgttaagcacgagggcaatatcaagtacgtcaatgatgtgcgcaacatcactaagaaaaacatcgaggagtggggtcctttcgacctagtaatcggtgggagcccctgtaacgatttaagcaatgtgaacccagctcgaaaaggactctatgagggcaccggaaggctgttcttcgagttttaccaccttctgaattactcgagacccaaggaaggtgacgacaggcccttcttctggatgtttgagaacgttgtagccatgaaggtgggggacaagcgtgatattagccgctttctagagtgtaaccccgtcatgattgacgcgattaaggtgagtgccgcacacagggctaggtacttctggggtaacctgccgggcatgaaccggcccgtgatcgcctcgaaaaacgataagttggagttgcaggattgccttgagtataaccgaatagcaaagctcaagaaagtgcagacaatcaccacgaagagcaacagcatcaaacagggcaagaaccaactctttcccgtggtcatgaatggcaaagaagacgtattatggtgtaccgagctggaacgtatcttcgggtttccggttcattacacagatgtcagtaacatgggtcgcggagctcggcaaaagctcttgggccggtcttggtccgtccctgtcatccgccaccttttcgcaccactgaaggattattttgcgtgcgaatag

SEQ ID NO: 114862 - DNA, 999 bp, Artificial Sequence
  Description of Artificial Sequence: Synthetic coding sequence
atgaaaggggatacacgccacctgaacggcgaggaagatgctggtggaagggaggattcgattctggtgaacggagcttgctcagaccaatctagcgattccccgcccatcctggaggctatccgtaccccggagattcgaggacgccggagtagctctcgcctgtcaaagagggaggtgtcgtccctgctgagctatactcaggacctgactggggacggggacggtgaggacggagatggctcggatactccagttatgccgaagctattcagagagactcgcaccagatcagagtctcccgctagtctgaggagacgcgctacggcctcagcaggcaccccctggccaagcccgccttcaagttatctcaccatagacctcaccgatgataccgaggatacccacgggacgccgcagtcctcaagtactccatacgcacgattggcccaggactctcaacaaggtggtatggagtccccccaggtagaggcagactccggggacggcgacagtagcgagtaccaagacgggaaggagtttggcattggggacctagtgtggggaaagattaagggcttttcttggtggccagccatggtggtgagctggaaggcaacctctaagaggcaggcaatgtcaggcatgaggtgggtgcagtggtttggggacggtaaattcagtgaagtaagcgccgataaactggtggccttggggcttttcagtcagcattttaacctggccacattcaacaaactagtgagttaccgcaaagcaatgtaccacgccttagaacgaacgcggctggaagatgctcagctgactacacagcccccgcttaccacagcccctcacccctccgccagccggcaaatcgccataacaaccgccaagactgaaggcatgaaaattagggcagagaataagtggctccagatgctgcccacaacgagggccgcttggaaggagaagcctcgagttctgccaccctccttgtag

SEQ ID NO: 114863 - DNA, 2187 bp, Artificial Sequence
  Description of Artificial Sequence: Synthetic coding sequence
atgaaaggagataccaggcatctgaacggagaggaagacgccggcggcagagaggatagcatccttgtgaatggggcctgttctgatcagtcctccgactctccccctattctcgaggccattcggactcctgagatccgtggcaggagatcaagttctcgcttgtctaagagggaggtctcctctctactcagctacacgcaggacctcacaggagacggggatggagaagatggtgacggatcagatacccccgtgatgcccaagctttttcgcgagaccaggacccgctctgaaagccctgccagcctgcggagacgagctaccgccagcgctggtaccccatggccgagcccaccctcttcctacctcactattgacctcacagacgataccgaagacactcatggcactccgcagtcttccagcaccccatatgccagactagctcaggacagccagcaaggcgggatggaatccccacaagtggaagctgatagtggagacggagattcctcggaataccaggacggaaaggagtttggaattggcgatctggtgtgggggaaaatcaaaggcttcagttggtggcctgccatggtggtttcatggaaggccacgagcaagcggcaggcaatgtctggtatgcgctgggtgcagtggttcggtgacggaaaattcagcgaagtgagcgccgataagcttgtggcccttggcttattttctcagcacttcaatctcgcgacctttaacaaactcgtttcttataggaaggcaatgtaccacgccttggaaaaggcccgcgtcagagctgggaagacatttcctagctccccgggtgatagccttgaagaccagctgaaacccatgctagagtgggcacacgggggattcaagcctacaggtatcgaaggcctgaaacctaacaacacccaaccagagaacaaaactagaaggagaactgcagacgacagcgccacttccgattactgcccagcccctaagaggcttaagaccaattgttataacaatggcaaggataggggagacgaggatcagtcccgcgagcaaatggcaagtgacgttgccaataataagagctctcttgaggacggttgtctctcctgcggccgcaagaatcccgtgtcctttcaccccctgttcgagggagggctgtgccagacatgtagagaccgctttctggagttgttctatatgtatgacgacgacgggtatcagtcatactgtacagtttgctgtgaaggccgggagcttttactgtgctccaatactagttgttgtcggtgtttttgtgtggaatgtctggaggtattggtaggcactgggacggcagcagaagcaaaactgcaagagccatggtcctgttacatgtgccttccacagcgctgccatggagtcttgcgccgtcggaaggactggaacgtcaggctgcaggcgttctttaccagcgatacagggctggagtacgaagcgccaaaactttatcctgccatccctgctgcccgtcgccgccctatcagggtcctgtcactgtttgacgggattgctacggggtaccttgtacttaaagagctcggaatcaaggtcggcaaatatgtcgccagcgaggtgtgtgaagagagcatcgctgtggggaccgtaaaacatgaagggaatatcaagtatgttaacgacgtacgtaatatcaccaagaagaacattgaagaatggggcccatttgacttagtcatcgggggtagtccctgcaacgacttgtctaacgttaatcctgcacgtaaaggtttatacgagggcacgggacgcctattttttgagttctatcacctgttaaattattcacgccctaaagaaggggacgaccgaccatttttctggatgtttgaaaatgtggtggccatgaaagtcggcgataagagagatatcagccgtttcctggagtgcaatccagtcatgattgacgccatcaaggtttcagcggcccaccgggcacggtacttttgggggaatctgcccggaatgaacaggatatttggcttccccgtgcactataccgatgtgtcaaatatgggccgtggtgcccggcagaagctgctggggcggtcatggagcgtccctgtgattcgccacctgttcgcaccccttaaagattactttgcttgtgagtag

SEQ ID NO: 114864 - DNA, 2085 bp, Artificial Sequence
  Description of Artificial Sequence: Synthetic coding sequence
atgaagggcgataccaggcacctgaacggagaagaggatgccgggggtcgagaggactccattttggtaaacggtgcttgctccgaccagtcctctgactctccccctatactggaagccatccgaacgccagaaattcgtggccggcgctccagctctaggttgtccaaaagggaggtgtcgtcccttctctcctacactcagtctctcagaagaagagcgaccgcttccgctgggactccatggcccagcccgccatcatcttacctgacaatcgacctcacagacgatactgaggacacccacggcacaccccagtctagttctaccccctacgctaggttggctcaggactctcagcagggcggcatggaaagtccacaggtcgaggccgactccggcgacggagactcttcagagtatcaggacggaaaagaatttggaatcggggatctggtgtggggaaaaatcaaagggttttcctggtggcccgctatggtggttagttggaaggccactagcaaacgtcaagctatgagcggcatgcgctgggtccagtggtttggtgacgggaagttcagcgaggtcagcgcggacaaactcgtggccctgggcttatttagtcagcactttaaccttgctacatttaataagctggtcagttaccgcaaggctatgtaccacgccctagaaaaagcccgggttcgggcgggaaagacctttcctagctctcccggcgactctctggaggaccagctgaagcctatgctggagtgggcacacggtggtttcaagcccaccggcatagagggactcaagcctaataatacccagcctgagaataaaacccgacggaggaccgctgacgacagcgcaacaagcgattattgtcccgcgcctaagcgcctgaagaccaattgttacaataacggaaaggataggggcgacgaagatcaatccagagagcagatggcatccgatgtggccaacaacaaatcttccctcgaggacgggtgcttatcatgtggtcggaaaaacccagtgagtttccatcccctgtttgagggtggtctgtgccagacttgtcgggataggttcctagagctcttctacatgtacgacgacgacgggtaccagtcttattgcacagtgtgctgcgaggggcgggaacttttgttatgtagcaatacttcctgctgtaggtgcttctgtgtggaatgtttagaggtcctggtcggcactggcaccgcagctgaggctaagctgcaggaaccgtggtcttgttatatgtgcctgcctcagcggtgtcacggtgtacttcggaggagaaaggattggaatgtgcggttacaggcctttttcacgagtgataccggcctcgagtatgaagccccaaagttatatccagcgattccggctgccaggcgcaggcctatcagagttctgtcgctgttcgatgggattgctacggggtacctggttctcaaggaactggggatcaaagtcggaaagtacgtcgcctctgaagtgtgcgaggaaagcatagccgtgggcaccgttaaacacgagggaaatatcaaatacgtaaacgacgttagaaatattacaaagaagaatatcgaagaatggggccctttcgacctggttatcggcggctcaccttgtaacgacctgagcaacgttaaccctgcgaggaagggcctgtatgagggaactggacgtctgttctttgaattttatcacctgctgaattactcgagacctaaagagggggacgataggccatttttctggatgttcgagaatgtggtggcaatgaaagtcggcgataagagggacataagtagatttcttgaatgcaatcccgtcatgatcgacgccattaaagtcagcgccgctcacagagcccggtatttttgggggaacctgcctggcatgaaccggatttttggctttcccgttcactataccgacgtcagtaacatgggccgcggggccaggcagaagttactgggaagatcctggtctgtcccagtgatcagacaccttttcgcaccccttaaggattatttcgcctgcgaatag

SEQ ID NO: 114865 - DNA, 1701 bp, Artificial Sequence
  Description of Artificial Sequence: Synthetic coding sequence
ggtcgatcaccccgggggaggagtgaacgcccacccaccgatggcacagggtccctggcggtcggtagggctggtggcaatgccgccagaccggctgcattaggcctgtctggcccttctaaaccttcaagtgcaataggcgccggcgacagccgcgctcagcgcccggcacgcccccccgccggcttgccccccgcatcaccagatccaaggctccggcggccagcggcacctcagccggcccttcggcaagagtctatgaagggggatacacgccatttgaacggtgaagaggacgccgggggtagagaagactcaatactggtaaatggagcatgttcagaccagagctctgacagtccccccatccttgaggccattaggacacccgagattcgaggaaggcggagttcctctagattgtcaaaacgagaggtgagctccctcctttcttacactcaggacctcacgggcgacggagatggcgaggacggagacggctccgacacacctgttatgcctaagctgttcagggagactaggacacgaagtgagagcccagcagtgcgtacaagaaacaacaatagtgtatccagccgtgagagacatcgtccctcccccagatccactcgtggccggcagggacggaaccacgttgatgagtccccggtcgaattccccgcgacaagaagtctacgaagaagagccacagcctccgccggcacaccatggcccagcccccctagctcctatcttacaatcgatcttactgacgacaccgaggatacccacgggactccgcagtcctcctcaactccctatgcccggctcgcccaggacagccagcaaggcggcatggagtcccctcaagtggaggccgactccggtgatggagattcctctgagtatcaggacggaaaggaatttggcatcggagatctggtgtggggaaaaatcaaaggcttcagttggtggcccgccatggtggtatcctggaaagccactagcaagagacaagctatgtctggaatgcgctgggtgcaatggttcggcgatgggaagtttagcgaggtctcagccgacaaactggttgccctcggtctgtttagccagcattttaacctcgctacatttaacaagttggtgtcttaccgtaaagcgatgtaccacgctctggagaaggcgcgtgtgcgcgccggcaaaactttccctagcagccctggcgattccttagaggatcagctgaagcccatgctggaatgggcccatgggggatttaagccaactgggatcgaggggctcaagcccaataacacccagcctgaaaataagacgaggcgcagaacagccgatgactccgctaccagcgactactgccccgcccctaagagactcaagactaattgttataacaacggtaaggaccggggggatgaggaccaaagcagggaacagatggccagtgacgtggcgaataacaaaagtagcctggaagatggatgtttgtcttgtggccgcaagaaccctgtttcatttcacccgttgtttgaggggggactctgccaaacttgcagacatctgtgtggggactcagtgaagcccactcacccctcttgtctcgcactttgtctgtggggaagaatgggcgattcatgtcaccggggccagtggcatgccggtcactctcagcttagtttctag

SEQ ID NO: 114866 - DNA, 1164 bp, Artificial Sequence
  Description of Artificial Sequence: Synthetic coding sequence
atggccgctatcccagctcttgacccagaggctgagccatccatggacgtcatccttgtgggctctagcgagctgtcctccagcgtaagcccaggcaccgggcgcgatctcatagcctacgaggtgaaagcgaatcaacggaacattgaagatatatgtatctgttgtggaagcctccaagtacacactcagcatccactgtttgaaggcgggatatgcgcaccatgcaaggacaagtttctggacgccctgtttctgtatgatgatgacggctaccagtcctactgcagcatctgctgcagcggagagacactgctcatctgcggcaatcccgattgtactcgctgttattgcttcgagtgcgtcgattctcttgtgggacccggcacctctggcaaggtccacgctatgagtaactgggtgtgctacttatgtctcccctccagtagatccggcttattgcagcgtaggagaaagtggcgaagccagctgaaggcattttacgatcgcgagtccgagaaccccctggagatgttcgaaacggtgccagtctggcggcgtcagcccgtccgggttttgagcctctttgaggacatcaaaaaagagttgacaagcctgggctttctcgaatccggctctgatccagggcagctaaagcatgttgtggatgtcaccgatacggttcggaaagacgtcgaggaatggggaccttttgatctcgtgtatggagccactccccccttgggccatacctgtgatcgaccgccaagctggtacttgttccagtttcaccggctgctccagtatgctcgcccaaagcctgggtcccctagacccttcttctggatgttcgtagacaatctcgtgctcaacaaggaagacctggatgtcgcttccagatttttagaaatggaacccgtgaccatacccgacgtccacgggggtagcctccagaatgcagtgagagtgtggtccaatatcccggctatcagaagctccaggcactgggcactggtgtctgaggaggagctgtccctactggctcagaataagcagtcatccaagctcgccgcaaagtggcctaccaagcttgtgaagaactgctttctgcccctccgcgaatatttcaagtatttcagtacagaactcacatcttccctgtag

SEQ ID NO: 114867 - DNA, 1161 bp, Artificial Sequence
  Description of Artificial Sequence: Synthetic coding sequence
atggctgccatccccgctctggaccccgaagcagagccgtcaatggacgtcattctggtaggatcttctgagctgtcctcctccgtcagccccggcactggaagagacctgatcgcatatgaagtgaaggccaatcagagaaatatcgaggacatttgcatctgttgcggcagtcttcaagtgcacacccagcaccccctgttcgagggaggcatttgtgccccgtgcaaagataaattcttggatgctctgttcctttatgatgacgacgggtaccagtcctactgctcaatttgttgcagcggtgaaacactccttatctgtggaaaccccgactgcactcggtgctattgcttcgagtgcgtggattccctcgtggggccaggcacatccggtaaggtgcatgccatgtccaattgggtgtgttacctctgtcttccaagttcacgatcgggactactgcagcggagacggaagtggcggagccagttaaaagctttttatgaccgtgagagtgagaaccccctggagatgttcgagacagttccagtctggcggcggcaacctgtcagggtcctctcccttttcgaagacatcaaaaaagaactgacaagcctcggcttcctggaaagcggatccgaccccggccagctgaagcacgtggtggacgtaacagacactgtgcgcaaagacgtcgaagagtgggggcccttcgatttagtgtatggggccacgcccccgctcggtcatacctgcgatcgaccgccaagctggtatctctttcagtttcacaggctgctacaatacgcccgcccaaagcccgggagccccaggccattcttctggatgtttgtcgataaccttgtgctgaacaaagaagatctggacgtggcatcccggttcctggaaatggaacctgttaccattccagatgtgcatggtggttccttacaaaatgcggtgagagtgtggagtaacattcctgctatacggtcacgtcattgggcattagtatctgaagaagagctcagtctactggcacagaataagcaatcttccaagctggcagctaaatggcccacaaagctggtgaagaactgcttcctgccactgagggaatactttaaatacttttccaccgaactgacatcatctctttag

SEQ ID NO: 114868 - DNA, 3123 bp, Artificial Sequence
  Description of Artificial Sequence: Synthetic coding sequence
atgctcgaagatatctccgaagaggatatctgggagtacaagagtaaaagaaaacccaagcgagtggaccccaacaatggatcaaagaatatactcaaatcagttgaaaaagcaaccgatggcaaataccagtcaaagcggagtcgcaatcgaaaacgagcagcagaagccaaagaggtcaaggaccatgaggtgccactcggaaatgccggttgccagacttccgtggccagttcgcagaactcaagctgtggtgacggcattcagcaaacccaagataaggaaacgacgccaggaaagctctgtcgcacacagaaatctcagcatgtatcccccaagattcgacctgtttacgatgggtactgcccgaattgccaaatgccttttagctcactgattggccagacgccccggtggcacgtgtttgaatgtctggactctccaccacggtccgaaaccgagtgtccagacggtctgctctgcacctctacaattccgttccattataagcgctatacccacttcctgctggcgcagagtcgcgctggcgaccatcccttttcatccccttcccccgctagcggagggagcttcagtgagactaagagcggcgttctgtgttcattggaggaaagatggagcagctatcagaaccagactgacaactctgtgtctaatgatccactccttatgacccagtatttcaaaaagtcccccagcctgaccgaagcctccgagaaaatttctacccacattcagactagtcagcaggccctccaatttacggattttgttgagaatgacaagctggtgggcgtcgccctgcggttggcaaataatagcgagcacatcaatttgccgctacccgagaacgattttagtgattgcgagattagctatagtccccttcaatcagatgaggatacacatgatattgatgaaaagcctgacgacagtcaggagcagctgttcttcacggaatcctctaaggatgggtctctcgaggaggacgatgactcctgcggattcttcaagaagcggcacggacccctgctgaaggaccaggatgagtcctgcccaaaggtgaactcattcctgaccagggacaaatatgacgaaggtctttacagatttaatagccttaacgatttatcgcagccaatatcccagaataatgaatccaccctgccttatgacctggcctgcacaggcggggactttgtcctattcccgcccgcattagctggaaagcttgcagcttcggtgcaccaggccacaaaggctaagccagatgagcccgaatttcattccgcccagagtaataagcagaagcaggtcatcgaggaaagtagtgtgtacaaccaagtctccctcccactggttaaaagtctcatgttgaagcccttcgagagccaggtagaaggttatctttccagccaaccgacccagaataccattcgcaaacttagctccgaaaatctaaacgccaaaaacaatactaatagcgcatgtttctgcaggaaagcactcgaaggggtgcctgtcggcaaagctaccattttaaacaccgagaacttaagtagcactccagcaccaaaataccttaagattctgccttccggcctgaaatacaacgcccggcatccctcaacaaaggttatgaagcagatggacataggcgtgtacttcggactgccaccaaagcgaaaggaagagaagctgctgggggagagtgctctcgaggggatcaacttgaatcctgtgccctctcccaaccagaaacggtcaagtcagtgcaagcgcaaggcagaaaaatcattaagcgatctggagtttgacgccagcaccctgcacgaatctcagttgtctgtagaactgtcctcggagagatcccagcgccagaaaaagaggtgtaggaagagtaactccttacaagaaggagcttgtcagaagaggtctgaccatctaattaacacagagtcagaggccgtaaatttatctaaagtgaaggtgtttaccaagtccgcccatgggggtctacagcgtgggaataaaaaaatccccgaaagtagcaacgttggcggatctcggaagaaaacctgcccattctacaagaagatccccggaaccggattcactgttgatgctttccaatacggcgtggtcgagggctgtacggcatactttctgacacacttccactctgaccactacgccgggctgtccaagcactttacctttccagtgtattgcagcgagatcaccggaaacctgctcaagaacaaattgcatgttcaagagcagtatatccatcccctccccttagacaccgaatgcattgtcaacggggttaaagtagttctgctcgatgctaaccattgtcctggcgcagtcatgattctgttctacctgccaaatggcaccgttatcctgcacaccggcgacttccgtgccgaccccagcatggaaaggtcactcctggctgaccagaaagtgcatatgttatatctagatacaacatactgctcccctgaatatacttttccgagccagcaggaggttataagatttgctatcaatactgctttcgaggcagtgacactcaatccacacgctctggtggtgtgcgggacttactctattggcaaagagaaggtctttctggcgatcgcagacgtgctgggatcgaaggtgggcatgagccaagagaagtataagaccctgcagtgccttaacatacccgaaatcaactctctcatcacaacagacatgtgcagctcactggtccatctcttgcctatgatgcaaataaattttaaaggattacagtcccatctgaaaaaatgtggaggtaaatataaccagatcctggcttttaggcccaccggatggactcactctaataagttcacccgcatcgcagatgttattccacaaacaaagggaaacatttccatctatgggattccgtattctgaacactcctcctacctagagatgaaaaggtttgtgcagtggctgaaaccacagaaaattattcccaccgtgaatgtgggtacctggaaatcgaggtctaccatggaaaaatatttccgggagtggaagctggaggccgggtactag

SEQ ID NO: 114869 - DNA, 3123 bp, Artificial Sequence
  Description of Artificial Sequence: Synthetic coding sequence
atgcttgaggatatatcagaggaagacatctgggaatataaatcaaagaggaagccaaagagagtggaccccaacaacgggtccaaaaatattcttaagagcgtcgagaaagctaccgacgggaaataccagagtaagaggtcccgcaatagaaaaagggcagccgaggcaaaagaagtgaaggaccacgaggtcccgctgggaaacgcaggctgccagactagtgtggctagcagccaaaactctagttgtggagacggcatccaacaaactcaggacaaagaaacgacgccggggaagctgtgtcggactcagaaaagccagcacgtgagccctaaaatccggcccgtttacgacggctactgccccaactgccaaatgcctttcagctcgctgattggccagactccacggtggcacgtttttgagtgcttggatagtcctccccgttctgaaactgaatgcccggatggtcttctatgcactagcaccatcccctttcattacaagcggtacacccacttcctcctggcccagtctagagccggcgatcacccattcagctccccgagccctgccagtgggggatcttttagtgaaactaagagtggggtgctgtgcagcttggaagaacgctggagtagctaccagaaccagaccgataactctgttagcaacgatcccttgctcatgacccagtacttcaagaagtccccatctctgacagaagccagcgaaaaaatatctacacacattcagacctctcaacaggcactgcagttcaccgatttcgtcgagaacgataaactggttggggtggccctcaggctggctaataatagcgagcatattaatctgcctctcccagagaacgacttcagtgattgcgagatcagctactcccccctgcagtcagatgaggatacgcacgatatcgatgaaaagcctgatgactctcaggaacagttatttttcacggagagcagcaaggacggcagtctcgaagaagacgatgacagttgcggattctttaagaaaagacatggccccctgcttaaagatcaggatgaaagctgcccaaaggtgaatagtttccttaccagggacaaatatgatgagggactctatcggttcaattcattgaatgatttgagtcaacccatcagccagaataacgaatcaacactgccttacgatctggcatgcaccggaggtgattttgtgctgttcccccctgccctcgctgggaaactggctgcctcggttcatcaggcgaccaaggccaagcccgacgaacccgagtttcatagcgctcagagcaataagcagaagcaggtgattgaagaatccagcgtgtacaaccaggtgtccttgcctttggtgaagagcttgatgcttaagccctttgagtctcaggtggagggctatctgagcagccaacccacccagaacacaatccgaaaacttagttccgaaaacctcaatgcgaaaaacaataccaatagcgcctgcttttgccgcaaagcgctcgagggagtgcctgtcggaaaggctaccattctcaacactgaaaacctgtcatccacaccagccccaaagtacctgaagatactcccctcagggctcaagtataacgcccggcatccttccacaaaggtcatgaagcagatggacataggtgtatatttcgggctgccacccaagaggaaggaggaaaagctgctcggagaatctgctctcgagggcatcaatctcaaccccgtcccctctccaaaccagaagcgaagttcgcagtgtaaacgcaaggctgaaaaatcactaagcgatctagaattcgacgcgtcgaccctccatgaaagccagctatcagtggaactgagtagcgagagaagccagcggcagaaaaagcggtgccgaaagtcgaattccctgcaggagggagcctgccagaagaggagtgaccacctgatcaataccgagtcagaagcggttaatctcagcaaagtaaaggtgttcacaaagagcgcccacggcggccttcagagaggaaacaagaaaattcccgaaagcagcaatgttggaggctcacgcaagaagacgtgcccattctacaagaaaatcccaggaaccggttttaccgtggacgcttttcagtatggtgtcgtggaaggctgtacagcctattttctcacacacttccactcagatcattatgcgggcttgagcaaacattttacctttcccgtgtattgctccgaaatcaccgggaacttgctcaagaataagcttcacgtccaggaacagtacatccatccactgccgttggacacagagtgcatcgtgaatggtgtgaaagtggtactgttggacgcgaaccactgccctggagcagtcatgattctgttctatcttcctaatgggacagttattctgcacaccggcgatttccgcgccgacccctctatggagcggagcctgctggctgaccaaaaagttcatatgctgtatctggacactacttactgttcacctgaatacacctttccctcgcaacaagaggtcatccgttttgccatcaacactgccttcgaggctgtcaccctgaatccgcacgccctggtcgtgtgcggaacctatagtattgggaaggagaaagtgtttctggcgatagctgatgtgctggggagtaaggtgggtatgtctcaggagaagtataagaccctccagtgcctgaatattccagagatcaactccttaatcaccacggacatgtgcagcagtctggttcatttactgcctatgatgcagattaactttaaaggcctacagtctcacctcaagaaatgcgggggcaaatacaatcaaatcctggcttttcgacccactggatggacccattctaataagttcacccgcattgctgacgttattccccagaccaaaggaaatatcagtatctacgggatcccatacagtgagcatagtagctatctggagatgaagcggtttgtgcagtggcttaaacctcaaaaaatcatcccgacagtaaatgtgggaacctggaagagccgcagtacaatggaaaagtatttcagagagtggaaactggaggccgggtactag

SEQ ID NO: 114870 - DNA, 813 bp, Artificial Sequence
  Description of Artificial Sequence: Synthetic coding sequence
atgcttcaaaaacccaaatccgtgaagctccgggccctccgctcccccaggaagtttggagtggctggccgctcgtgccaggaggtgctaaggaagggttgcttaaggttccaactgcctgagagaggaagtagactatgcctgtacgaagacgggaccgagctcaccgaggattatttcccgtccgtgcctgataatgcagagttggtcctgctcacattgggccaggcctggcagggctatgtgtccgacatcagaaggttcttgtctgctttccacgagccccaggtcggtctgattcaggccgctcaacaactgctgtgcgacgagcaggccccccagaggcagaggctgctggcggacctgctgcacaacgtgtcccagaacatagccgcagaaacaagagccgaagacccaccctggtttgaggggctggaatctcgcttccagtctaaatcgggttatctgcggtattcctgcgaatcccgtatccgaagctaccttcgcgaggtgtcgagctaccctagcactgtcggcgccgaggctcaagaagagtttcttagggtgctcggctccatgtgccagaggctgcgctcgatgcagtataacggttcttacttcgaccgcggcgccaagggaggttccaggctgtgtactcccgagggttggtttagctgccagggcccttttgatatggacagttgcttaagcagacactccattaatccgtattccaaccgcgagtctagaatcctcttttccacctggaatctggaccacatcgacggtgttctgttatgcggccccggatag

SEQ ID NO: 114871 - DNA, 825 bp, Artificial Sequence
  Description of Artificial Sequence: Synthetic coding sequence
atgtgcctgttactggatagacacctcctcttcgtaccactggttgccgacgtgtcggatataagacgctttctttcagctttccacgaaccccaggtggggctaatccaggctgcacagcagctcttgtgcgatgaacaagcaccacagaggcagcgcctgctggcggatctgctccacaatgtttcgcagaatatcgccgctgagacgagagcagaagatccaccttggtttgagggactagagtcccggtttcaatcaaagtcgggatatctgcgatattcgtgcgagagtagaattagaagctaccttagagaagtgagttcctatccttcaaccgtcggtgcagaggcacaggaagaatttttgagggttcttggtagcatgtgtcaaagactgagaagcatgcaatacaatggaagttactttgacagaggggccaaaggaggctccaggttgtgcacgcctgaaggttggttctcatgccaagggccctttgatatggacagctgcctgagcagacattccattaatccttactccaatagagagtctaggattctgttctctacttggaatctggatcatattatagaaaaaaaaagaaccatcatccccactctggtcgaggctattaaggagcaggatggcagggaagtggactgggaatacttctacggcctactctttacatctgagaacttgaagctagttcacattgtctgccacaagaagaccacccacaagttgaactgcgacccttcacgtatatataagccgcagaccaggttaaagcggaagcaacccgtgagaaaacgtcagtag

SEQ ID NO: 114872 - DNA, 312 bp, Artificial Sequence
  Description of Artificial Sequence: Synthetic coding sequence
atgctgcagaagccgaaaagtgtcaagctgcgggccctgcgcagccctagaaaattcggggtcgccggtaggagctgccaagaggtgttacgtaagggttgcctgagattccagctgccagaacgcggcagcaggctgtgcctctacgaagacggtacagagctcaccgaagactacttccccagcgtgcccgataatgctgagttggtgttattaaccctgggtcaggcctggcaggggtggttccggcacgtgagccaggactccttaacactactaggatccagttgcccaccagcactggtttcctag

SEQ ID NO: 114873 - DNA, 825 bp, Artificial Sequence
  Description of Artificial Sequence: Synthetic coding sequence
atgtgtctgttactcgaccgtcacctgttattcgtgcccctggtggccgatgtgtccgatatccggagatttctgtccgcctttcacgaacctcaggtaggactaatccaggccgcacagcaattactctgtgacgaacaggcacctcagcgacagagactgcttgccgacttactgcacaatgtaagtcaaaacattgccgctgagacccgggcagaggaccctccatggtttgagggccttgaaagcagattccagtcaaaaagcggatacctccgttactcttgcgagtcacgcatacggagctacctgcgtgaagtgtcctcctatcccagcacagtaggtgccgaggcacaggaggaatttctgcgcgtgctgggatccatgtgtcaaagactgagaagcatgcagtataatgggagttactttgacaggggcgccaaaggcggctccagactgtgcacaccagaaggttggttcagttgtcagggaccttttgacatggactcctgcctatctagacacagtatcaacccgtattccaacagggagagcagaattcttttttctacctggaacttggaccacataatcgaaaagaaacggacgatcatccccaccctggtagaagccatcaaagagcaggatggacgcgaggtcgattgggagtacttctatggccttctttttaccagcgagaacctcaaactagttcacatcgtctgccacaaaaaaaccacccataaactgaattgcgacccgtcaagaatatacaaaccccagacccgcttgaaacggaaacagccggttcgcaagagacaatag

SEQ ID NO: 114874 - DNA, 1017 bp, Artificial Sequence
  Description of Artificial Sequence: Synthetic coding sequence
atgctccagaaacctaaatcagtcaagcttagggccctcagatctccgaggaagttcggagtggcagggcgcagctgtcaggaggtgctgcggaaggggtgccttcgtttccagctaccagagcgtggtagtcggctgtgtttgtacgaggatgggaccgagttgaccgaagattacttccctagcgtccctgataacgccgaactagtgctcctgactttaggccaggcctggcaggggtatgtgtcggacatcagacggtttttatccgcctttcacgagccacaggttgggcttatccaggccgcgcagcaactgttgtgtgatgagcaggccccccagagacaacgcctcctggccgacctcttgcataatgtgtcacagaatatcgccgctgagacacgagctgaggacccgccctggttcgaaggactagagagccgattccagagcaagagtggttacctcaggtactcctgcgagtctagaatccgctcatatctccgggaggttagtagctacccctcaaccgtcggggctgaggctcaggaagaatttctccgagtcctgggctcaatgtgtcagcgccttcgctcaatgcaatacaacggctcatatttcgatagaggggctaaggggggctctcgactctgcacccccgaaggttggttcagctgtcagggccctttcgatatggatagttgtctcagcaggcacagcattaatccttactcaaatagagagagtcggatcctattcagtacatggaatctggatcacattatagaaaagaagcgaaccatcatccctacccttgtcgaggccataaaagagcaggacggtcgggaagtagattgggagtacttttacgggttgctctttacgtccgaaaaccttaagttggttcacatcgtttgccacaaaaagacaacccacaagctgaactgtgacccgtcacgaatctataaaccgcaaacgcgtctgaaacgtaaacaacccgttcgaaagcgccagtag

SEQ ID NO: 114875 - DNA, 351 bp, Artificial Sequence
  Description of Artificial Sequence: Synthetic coding sequence
atgctccagaagccgaagagcgtgaaacttagggcactcagatcgccccgtaagtttggggtggccggccgcagttgccaagaagtcttacgcaaggggtgtctgcgattccagctgccagagagggggagtcgattatgtctctacgaagacgggaccgaattaaccgaggattactttccatccgtgcctgacaacgccgaactcgtgctgttgaccttaggacaggcctggcagggatcagtgggtgtgagggcccggacaaagacacgggacacatcttcactctctccaggcgactgccaagccctcggtaacggaggaagatgcggacagagactattcctttag

SEQ ID NO: 114876 - DNA, 261 bp, Artificial Sequence
  Description of Artificial Sequence: Synthetic coding sequence
atgctccagaaacctaagagcgtgaaactgagggccctgaggtcccctcgcaagttcggagtagccggacgctcctgccaagaggtactgaggaagggatgtttgaggtttcagctacccgagagaggatcacggctgtgtctatacgaagacggaaccgagctaactgaagactactttccgagtgtccccgataatgccgagctggtcttattaaccctgggtcaggcctggcagggatgctggtctgccgtcgcgtag

SEQ ID NO: 114877 - DNA, 249 bp, Artificial Sequence
  Description of Artificial Sequence: Synthetic coding sequence
atgctccagaaaccgaagagtgtcaagctccgagccctccgtagcccacgcaaattcggggtggcgggccgcagttgtcaagaggtcctgaggaagggttgcctaagatttcagctgcccgagcgcggaagccgcctctgcctctacgaagatgggaccgaactgactgaggactacttcccctctgtcccagataacgccgagctggtgttattgaccctgggacaggcctggcagggctgcgagtag

SEQ ID NO: 114878 - DNA, 813 bp, Artificial Sequence
  Description of Artificial Sequence: Synthetic coding sequence
atgctgcagaagcctaaatcagtgaaattgcgagctctgcgatctccaaggaaattcggcgtcgcaggcaggtcctgtcaagaggtgctgaggaaagggtgccttcggttccaactgcccgagcggggaagtcggctgtgcctttatgaggacggcactgagttgacagaagattacttccccagcgtcccagataatgctgaactcgtcctgcttaccctggggcaggcttggcaagggtatgtgtctgacattcggcggtttctttccgctttccatgaaccacaggtcggccttatacaggctgcacagcagctcctgtgcgacgaacaggcaccgcagcgacagagattgctagctgatttactgcacaatgtttcacagaacatcgccgccgaaacaagggccgaggaccctccatggtttgaggggctcgaatctcgttttcaatctaagagcggctatcttcgctacagctgcgagagcaggatacgttcctatctgagggaggtcagcagctacccttccaccgtgggcgctgaagcccaggaggagttcttgagggttttaggttcaatgtgtcagcgactgcggtccatgcagtacaatggttcatactttgaccggggggcgaaaggaggatcccggctctgtaccccagagggttggttctcgtgccagggaccctttgatatggacagctgccttagtaggcatagtatcaatccatattccaatcgagaaagccgcatcctgttctccacttggaacttagaccatatagacggagtgttgttgtgtggacccgggtag

SEQ ID NO: 114879 - DNA, 3183 bp, Artificial Sequence
  Description of Artificial Sequence: Synthetic coding sequence
atggaacagttgaacgagctcgagctgcttatggagaagtccttctgggaggaggctgaacttccagcagagctatttcaaaaaaaggtcgtggcctcttttccacgaactgtcctgtcaacaggtatggacaataggtatctcgtgttagcagtgaataccgtgcagaataaggagggaaattgtgaaaaaagactggtcattacagcttcccagagcctcgagaacaaggagctgtgcattcttaggaacgactggtgcagtgttccagtggaacctggcgacattatacatcttgagggtgattgcacatcagacacatggatcatcgataaggatttcgggtacctcattctctatccagacatgctaatatcaggcaccagtattgcctcgtcaatcaggtgcatgagacgagcagtcttaagcgagacattcaggtcgagcgaccctgcgacccggcaaatgctgatcggtaccgtcctccacgaagtctttcagaaagccataaataactccttcgcgccagagaaattgcaggagctggcatttcaaacaatacaagaaattaggcatctgaaggaaatgtatcgcctgaacctgagccaggacgagatcaaacaggaggtggaagactacctgccatctttctgtaagtgggcgggggactttatgcataagaatacttctaccgactttccacagatgcagctgagtctgccatccgacaactcaaaggacaattcgacatgtaacatcgaggtggttaaacctatggatattgaggaatctatttggtccccccgctttgggctgaaggggaagattgatgtcaccgtgggagtgaaaatccatcggggttacaagactaagtataagatcatgccccttgaattgaaaacagggaaggaaagcaacagtattgaacatcggtctcaggtggtgttgtacacactgttgtctcaagagaggagagccgatccggaggccggtcttcttctctacttgaagacaggacagatgtatcctgtgcccgccaatcacctagataaacgggaattgctaaaactaaggaatcagatggcgtttagcctttttcaccggatatctaagtccgccacacgccaaaagacccagctcgcctccttaccccagataatagaagaggagaagacctgtaaatattgttcacagatcggcaattgtgccctgtacagtagagccgtggagcaacagatggactgcagctcagtgccaattgttatgcttccgaaaatcgaggaggagactcagcatctcaaacagacccatctggagtatttctccctgtggtgcctcatgcttactctggaatcacagagcaaggataacaagaagaaccatcagaacatttggcttatgcccgcctctgagatggagaaaagtggatcctgtatcggcaatctgatcaggatggagcacgtaaagattgtttgtgatggacaatatcttcacaatttccagtgcaagcacggcgccattcccgttactaacctgatggctggcgatcgcgtcatcgtctccggcgaggaacgtagtctattcgccctctcacgcgggtacgttaaggagattaacatgacaaccgtaacttgtttgctggaccgcaacttatctgttcttcctgaatcaacccttttccgcctggaccaggaggagaaaaattgcgacattgacactccgctgggcaacctgagtaaactaatggagaacaccttcgtgagcaagaagctgagagacctcatcattgattttagagagccgcagtttatctcatacttatctagcgtactgccccatgacgcgaaagatacagtcgcttgcattctcaaagggctgaacaagccgcaaagacaggctatgaaaaaggtgctcctatctaaagattacactctaatcgtcggaatgcccggcacaggaaaaacgactactatctgcaccttggtccgcatcttgtacgcttgcggcttttcagtgctcctcactagttacacccactccgctgtggacaatatactcctcaaacttgcaaaatttaaaatcgggtttcttagattagggcagatccagaaggtccaccctgctatccagcaattcacagaacaggaaatttgtcgcagtaagtctatcaaatccttagcgctcttggaagagctgtataactcccaattaattgtggccaccacctgcatgggtatcaatcatcctatttttagtcgcaagatctttgatttctgcatcgtggatgaggcgtcccagatctcccagcctatttgcttgggaccactatttttcagtagacgctttgtgctcgtgggggatcaccagcagctgccacctttagtacttaatagggaagccagggccctcggaatgtccgaatccttattcaagaggctagagcaaaacaagtcagccgtagttcagttaacagtgcagtaccggatgaattcaaaaattatgtccttaagcaataaactcacttacgagggcaaactagagtgcggtagtgacaaggtggctaatgcagtcattaacctccgccatttcaaggacgtaaaacttgaactagaattttacgctgattacagtgacaacccttggctaatgggagtgttcgaacctaataatccagtgtgcttcctcaatacggacaaggtccctgcccctgagcaggtggagaaaggtggagtgagcaatgtgacagaggctaaactcattgtgtttctaacctccatcttcgtaaaagccgggtgctccccttcagatatcgggataattgcaccctaccggcagcaactcaaaattattaatgatctgctggccaggtccattggaatggtggaggtgaacactgtggataagtaccagggccgcgacaaatcaattgtgctggtgagctttgtgagaagtaacaaagatggtaccgtgggggagctgctgaaagattggagacgattaaacgtcgctatcactcgcgcaaaacacaaactgattctcctcggatgtgtcccatcgctcaactgctacccacccctcgagaagctgctgaaccacctgaattcagagaaactgatcatagacctcccatctcgggagcacgaatcactctgtcacatcctcggcgacttccagcgtgagtag

SEQ ID NO: 114880 - DNA, 2469 bp, Artificial Sequence
  Description of Artificial Sequence: Synthetic coding sequence
atggaacagctgaacgaactcgagctcctgatggagaagagtttctgggaggaagccgaactccccgcagagctattccagaaaaaggtggtggcctcattcccgcggaccgttctgagcactggtatggataacaggtacctcgttctggcagtcaacactgtgcagaacaaagaaggaaattgtgaaaagagactcgtcattaccgcatcacaaagtctcgagaacaaagagctttgcattctaaggaacgactggtgttcagtgccagtagagcctggagatataatccacctggaaggggattgcaccagcgatacctggatcattgataaggactttgggtacctaatcctgtaccccgacatgctcatttcggggacatcaatagccagtagcataaggtgcatgcgtcgtgctgttctgagcgagaccttccgatcatctgatccggccacaaggcagatgctgatcgggaccgtactgcacgaagtttttcagaaggcgatcaacaacagcttcgcccctgagaaactacaggagcttgcctttcagacaatccaagagattagacacctaaaggaaatgtatcgactgaacctgagtcaggacgaaattaaacaagaggtcgaggattatctccccagtttctgcaaatgggctggagattttatgcacaagaacacatctactgatttcccccagatgcagttgtctctcccttcggataattcgaaggataatagtacttgtaatatcgaagttgtcaaacccatggacattgaagagagcatttggtcgcctcgatttggccttaagggcaagatcgacgtcacagtgggagttaaaatccaccgcgggtataaaactaagtataaaattatgccactggaattaaaaaccggaaaagagtctaactcgatagagcatcgatcccaggtagtgctctacacgctgctgtcacaagagcgccgtgccgacccagaggcggggctgcttttgtacctaaagaccgggcaaatgtaccccgtccccgcaaaccatttagacaaacgggaactacttaaacttaggaaccaaatggcattcagcctgttccaccggatatctaagtcagctaccaggcaaaaaactcaactggcatccctccctcaaatcatcgaagaggaaaaaacatgtaagtattgcagtcagattggcaattgtgccctctattcacgtgcagtcgagcaacagatggactgtagctccgtcccaatagtgatgctgccaaagattgaggaggagacacagcacttaaagcagacgcacctcgagtatttcagcctgtggtgccttatgctcacactggagtctcagagcaaagacaacaaaaagaaccaccaaaacatctggttgatgccagcatccgagatggaaaagtcaggctcctgcattgggaatctgatccgtatggaacacgtgaaaatagtgtgtgatggccaatatttgcataactttcaatgcaagcacggagcgatccctgtcaccaacttgatggcaggcgatagagtgatcgtgagcggggaggagcgtagtttgttcgcactaagcaggggctacgttaaagaaattaacatgacgaccgtgacctgcctcctggaccggaatctgtccgtgcttccggagagcacactgtttagacttgaccaggaggagaagaactgcgatatcgatacacccctaggaaacctctcaaaacttatggaaaacactttcgtgtcaaaaaaacttagagacctgatcatcgatttccgcgaaccacagttcattagctacctcagctccgtgctaccccatgatgctaaagatactgtcgcctgtatcttgaaagggcttaataaaccccagcggcaggccatgaaaaaagttctgttaagtaaggactatacattaatcgttggcatgcccggaaccggaaagaccacgactatatgtacacttgtgcctgcccccgaacaggtggagaaaggaggagtaagtaatgtgactgaggccaaacttatcgttttccttacttctatcttcgtcaaggccgggtgctcgccctcagacatagggattattgcgccctacaggcagcagctaaaaatcatcaatgacttacttgcgcgcagcatcggtatggtggaggtgaacacagtcgacaaataccaggggagagataagagcatcgtgctcgtttccttcgtgcggtccaataaagacggcactgttggggagcttctaaaagactggcggagactcaatgtagctataacgagagctaagcacaaactgatccttctgggctgcgtcccatctctcaactgctatcctccattggagaaactgctgaaccatctcaactcagaaaagctgatcatcgatctgcccagtcgggaacacgagtctctctgccacatcttaggcgattttcagcgggagtag

SEQ ID NO: 114881 - DNA, 3441 bp, Artificial Sequence
  Description of Artificial Sequence: Synthetic coding sequence
atgaaaaccccctgtattccgagtccaaaacagggcagtaagggccggggacagagcccagcggctcaggtccgcggccctacgtggaacgctcccgcgcgggaggggcggccaggagcagggcacctggggcatctccgcgtgggagcttgtgcccggggggcgcaggcgcgcgctttctttccatttctttccttcctatgctatccgcgttttagatgtctcttctgtttgcagttcgcgatacctgcttcccgtatggaacagctgaacgagctagagcttctcatggagaagagcttttgggaggaggccgagctcccagccgagctctttcagaagaaagttgtggcctctttcccaaggaccgtgctgagtaccggcatggataatcgctatttggttctggctgtcaatacagtgcagaataaggaaggaaactgcgagaaaagactagtcatcaccgccagccagtccctggagaacaaggaactgtgtatacttcggaacgactggtgctccgtgcccgtcgaacctggggacataattcacttagagggcgattgcacctcggacacctggattatcgataaagattttggatacctcatcctctaccccgacatgctgataagcgggactagcatcgcgtccagtatccggtgcatgaggcgagcagtgctcagcgagaccttccgcagctcagacccagccactcgtcagatgctgattggtactgtcctccacgaggtcttccagaaggccattaacaacagtttcgccccagagaagttgcaagagctggctttccaaaccatccaggaaatccgccacttgaaggagatgtaccgcctgaatttgtcccaagacgaaattaagcaggaggtggaggattacctaccatctttttgcaagtgggctggagacttcatgcataagaatacctctactgacttcccgcagatgcaattgtctctcccttccgacaattccaaagataattccacctgtaacatcgaggtggtcaagcctatggatatcgaggagtcaatctggtctccacgatttggactcaaggggaaaattgatgtgaccgtgggggtgaagatccacaggggatacaaaactaagtataaaattatgcctctggaactgaaaacaggaaaggagagcaactctattgagcatagatctcaagtcgtcctgtacactctgctctcccaggagcgccgcgcagaccccgaagcaggcctactgctctacttgaagacaggacaaatgtaccccgtacccgctaaccaccttgacaagagggaactgctgaagcttcggaaccaaatggcattttcacttttccaccggatcagtaagtcggccactaggcagaaaacacagctggcatctctcccccaaattatagaagaagaaaagacctgtaagtactgcagtcagatcggaaactgcgccctctatagccgagccgtggagcagcagatggactgctcctccgttcccatagtgatgttgcctaagatagaggaagagacccagcatttgaaacagacccacctggagtatttctccttatggtgcttaatgttgactctcgagtcacagtcaaaggataacaaaaagaaccatcagaacatctggctgatgcctgcgagcgagatggaaaagagtggaagctgcattggaaatctgattcggatggagcacgtaaaaattgtctgcgatgggcaataccttcataattttcagtgcaaacacggggccattccagtaacaaatctgatggccggcgacagggtcatcgtgtccggcgaagaacgatctttattcgcattatcccgggggtacgtgaaagagattaatatgacaaccgttacctgtttactcgacagaaatctctccgttctgccagagtctactctgtttcgtttggaccaagaggagaagaactgtgatattgatacgcctctcggaaatctttctaagctgatggagaacacatttgtcagcaaaaagttaagggatctaatcatcgacttcagggagccgcaatttatttcttacttatcgagcgttctgcctcacgacgccaaagatacagtggcatgtattctgaaaggcctaaacaaacctcaacggcaggccatgaaaaaagtcttgctaagcaaggactataccttgattgttggcatgcccggcacagggaagactacaacaatttgtacactggtgagaattctttacgcctgcgggttctccgtgcttttaacctcatacacccacagcgcggtggacaacatcttacttaaactcgccaaatttaagatagggttcttacgccttgggcagattcaaaaggtgcatccggccatccagcagtttactgaacaggagatttgccgatccaaatctatcaaatccttggcacttcttgaggaactgtacaatagccagctcatcgtggcaacaacttgcatgggcatcaaccatcctattttctctaggaaaatttttgatttctgcatagtcgacgaggcttctcagatctcccagcccatttgtctgggacctctatttttttctcggaggtttgtactggtgggagatcaccagcagctgccgcccctggttctcaacagggaggcccgagcactaggaatgagcgaaagtctctttaagaggttggaacagaacaagagcgctgtggttcaacttacagttcagtatcggatgaattcaaaaatcatgagtctgtccaataagttgacatacgaaggtaaattggagtgcggcagcgataaggtggcaaatgcagtcatcaatctgcgccactttaaagacgtgaagctggagctcgagttctatgcagattacagtgacaatccgtggctgatgggagtgtttgaaccgaacaatccagtttgctttttaaacaccgacaaagtgcctgcccccgaacaagtggagaaaggaggcgtaagtaacgtcacagaagccaaactgatcgtgtttcttacgagcatcttcgttaaagcaggctgcagcccctccgatatcgggataattgctccctatcgacaacagttaaagattatcaacgacctgctcgcccggtcaatcggaatggtggaagtgaataccgtggataagtatcaaggcagggacaagtcaatcgtactggtgtcctttgtgcggtcgaacaaggatgggacagttggtgaactccttaaggattggaggcgacttaacgtagccattactagggctaagcacaagcttattcttctgggatgtgttcccagcttaaattgttaccctcctttggaaaagctccttaaccaccttaattctgaaaaactaattattgaccttccctcacgcgagcatgaatccctttgccatatcctaggagacttccaacgagagtag

SEQ ID NO: 114882 - DNA, 717 bp, Artificial Sequence
  Description of Artificial Sequence: Synthetic coding sequence
atgttatgtttcctgcgcggaatggccttcgtcccatttctcctggtgacgtggagctcggccgcgtttattatctcctacgttgtggcagtgctgtccggacatgtcaatccctttctgccttatatctccgatacaggcaccactccacctgagagtggaatatttggctttatgatcaatttcagtgcctttttgggggcagccaccatgtatacacgctataaaattgtgcagaaacagaaccagacttgttatttctccacacctgtgtttaaccttgtgagcctagtgctcgggctggtggggtgcttcggtatgggcattgttgcaaattttcaagaactagcagtgccagtcgtccatgatggcggagccctgctggcctttgtttgcggcgtggtgtacactctgcttcagtccattatttcgtacaagtcttgcccacagtggaattcactctcaacctgccatatcaggatggtgattagcgcggtgtcctgcgccgctgttattcccatgattgtgtgtgcatcgctcatctccatcactaagctagagtggaatccgcgtgaaaaagactatgtgtaccatgtggtgtctgcgatctgcgaatggaccgttgcttttggatttattttttacttcctcaccttcatccaagatttccagtctgtgacgctgcgtatcagcaccgagatcaacggggacatctag

SEQ ID NO: 114883 - DNA, 801 bp, Artificial Sequence
  Description of Artificial Sequence: Synthetic coding sequence
atgtggtggttccagcaaggcctgtcttttttgcccagtgcattggtgatttggacctccgccgcatttatcttcagttacattactgctgtgactctacaccatatcgatccagctctgccatacatctccgacacagggaccgtcgcccccgagaagtgcctctttggtgccatgcttaacattgccgcggtgctctgcatcgccactatttatgtccggtataaacaggtacacgcgttgtcacccgaggagaacgtgatcataaagctgaacaaggccgggcttgtgctggggatcttaagctgtctaggactcagtattgtcgcgaactttcaaaaaacgacattgttcgccgctcatgtctctggcgccgtgttgactttcggtatggggagtctgtatatgttcgtgcaaaccatcctcagctatcagatgcagcctaagatccatggtaagcaagtgttctggatacggctgttgctggttatctggtgtggcgtgtcggcccttagcatgctgacctgcagctcagtcctccacagcggcaattttgggacagatttagagcagaagctgcattggaaccctgaggataaagggtacgtgcttcatatgataactactgccgccgaatggtctatgagtttttccttctttggcttcttccttacatacattcgcgattttcaaaagatctccctgagggtcgaagctaacttgcatggcctgacactgtatgataccgcaccctgccctataaacaacgagcgaactcggctgctttctcgggacatttag

SEQ ID NO: 114884 - DNA, 801 bp, Artificial Sequence
  Description of Artificial Sequence: Synthetic coding sequence
atgtggtggttccagcagggactgtcgtttctgccttcggcccttgttatctggacgagtgctgctttcatattcagttatataaccgccgtcaccctgcatcacatcgaccctgctctgccatacatttccgatactggcaccgtagcccctgaaaaatgcttattcggagctatgctcaacatagcagcagtcctatgcattgccaccatatatgtgcgctataagcaggtgcacgctttatcccctgaggagaatgtgatcataaagcttaacaaagccggattggttcttggtatattgtcttgtctcggtctgtcgatcgtggcaaacttccaaaagaccactttatttgcagcccacgtgtcaggggctgttctcacgttcggcatgggctctctttacatgtttgtgcagacaatcctatcctatcagatgcagcctaaaatccacggaaagcaggtattctggatcaggctcctcctggtgatctggtgcggtgtgtccgctttaagtatgctgacctgttccagtgtgctccattctgggaactttggtactgatctggagcaaaagttgcattggaaccccgaggacaagggatatgtgttacacatgattaccaccgccgccgagtggtcaatgtccttcagcttctttggcttctttttaacttacattagagacttccagaaaatttccctgagagtggaagccaatctgcacggactgaccctgtatgacacagccccttgcccaattaacaacgagagaacaagattactgtcacgtgatatctag

SEQ ID NO: 114885 - DNA, 699 bp, Artificial Sequence
  Description of Artificial Sequence: Synthetic coding sequence
atgccgtctttgtgggaccgattcagcagcagctctacttcctccagcccgagctctcttcctcggacgccaacacctgacagacctccaaggtcagcatggggatctgccacaagagaggaaggtttcgataggtcgacttccctcgagagctccgactgtgagtctttggattcaagcaactcaggctttggaccagaagaagatacagcatatctcgatggggtctctctgcccgactttgagttactgagcgaccctgaagatgagcacctctgtgcaaatctgatgcagttgctgcaggagagccttgcccaggccagactgggctcaagacgccccgctcggttactcatgccatctcagctcgtgtcccaggtgggaaaagaactactgaggctggcatactccgaaccatgtggtttgcgaggtgccctgctggatgtgtgcgtcgagcaggggaagtcttgccattctgtgggtcaactcgcactcgatccctcattggtacctacctttcagctaacactggtgctccgtttggatagtaggctgtggccaaagattcaggggctgttctcttctgcgaacagcccatttctgcctggctttagtcaaagcctcaccctctctaccggcttcagggtcattaaaaagaagctgtacagctcagaacagctcctcatcgaagaatgctag

SEQ ID NO: 114886 - DNA, 582 bp, Artificial Sequence
  Description of Artificial Sequence: Synthetic coding sequence
atggtggcaaccgggagtctgagctcgaagaatccagcttccatttccgaactgcttgattgtggatatcaccctgagagcttgctgtcagattttgactattgggactacgtcgtcccagagccaaacctcaacgaagtcatcttcgaggagagcacctgtcaaaatctcgtgaaaatgctggagaactgtctgagcaaatcgaagcagaccaaactgggatgctccaaagttttagttcctgaaaaactgacacagcgcatcgcacaggatgttctacgattgagttccacagagccctgcgggctccgcggctgcgtgatgcacgtcaacttggagattgaaaacgtgtgcaaaaaactggacaggatcgtgtgtgactcttccgttgtgcccaccttcgaattgacactggtgtttaaacaggaaaattgttcatggacaagctttcgcgactttttcttcagtcgcgggcgattttcatctggttttagacgtacactgatcctgagtagcgggtttcggctggttaaaaagaagctttactcgctcatcggaactacagtcattgagggaagctag

SEQ ID NO: 114887 - DNA, 534 bp, Artificial Sequence
  Description of Artificial Sequence: Synthetic coding sequence
atggtggccactggtagcctgtctagtaagaatccggcctcgattagcgagctgctggactgcgggtatcaccccgagagtctgctcagcgacttcgattattgggactacgtggtgcccgaaccgaatctgaacgaagttatttttgaggagtccacctgccaaaatcttgtcaagatgctcgaaaattgcctgtccaaatccaagcagacaaaactgggatgtagtaaagtactggtgcccgaaaaactgacacaaagaattgcccaggatgtgctgagactgagctcgactgagccttgtggcctccggggctgtgtgatgcatgtcaacctcgaaatagagaacgtatgtaagaaattggatcgtatcgtctgtgactcttcagttgtgccaaccttcgagctgaccctggtatttaagcaagagaattgtagctggactagcttccgcgacttttttttttccagaggtaggttttcttccggttttcgacgcacactcatactcagtagcggattcaggctggtgtag

SEQ ID NO: 114888 - DNA, 387 bp, Artificial Sequence
  Description of Artificial Sequence: Synthetic coding sequence
atggtagccacaggtagcttgagctccaagaacccagcctcaatctccgagctgctggattgtgggtatcatccagagtccctcctgtccgatttcgactactgggattatgtggtccccgagcccaatctgaacgaggtgatcttcgaggagtccacatgtcagaatctcgtaaaaatgctggagaactgcctgagtaaatccaagcagaccaaactcggctgtagcaaagtgcttgtaccggagaaattgacacaaagaatcgctcaggacgttttgcgcctatctagcacggagccgtgcggcttacgtggctgcgtcatgcatgtcaatctggagattgaaaatgtgtgtaaaaagctggaccgcattgtctgcgatagctag

SEQ ID NO: 114889 - DNA, 1239 bp, Artificial Sequence
  Description of Artificial Sequence: Synthetic coding sequence
atggcaaatgtggcagacaccaagctgtacgacatcttaggagttcctcccggagcctcagagaacgagctgaaaaaagcatacaggaagttggcaaaagaatatcatcctgataagaaccctaacgcaggtgacaagttcaaggagatcagctttgcctatgaagtgctgagtaaccctgagaaacgagagctgtacgatagatatggcgagcagggcctgagagagggatccggcggtggaggtggcatggacgatattttctcgcatattttcggcggaggactcttcggttttatgggtaaccaaagcaggtcccgcaacggacgccggcggggagaggacatgatgcacccgctgaaggtttccctcgaggatctgtataatggaaaaactaccaagctgcagttgagcaagaacgtcctgtgttctgcttgtagcggtcaggggggcaagtctggtgcggtacagaagtgctcggcatgtagagggcgaggtgtacggataatgattcgccagttagccccaggcatggtgcagcagatgcaaagtgtttgcagtgattgtaacggagagggcgaagtgattaatgagaaggatagatgcaagaagtgtgagggcaagaaggttataaaggaagtgaaaattttggaggtccatgtggataaagggatgaaacacggacaaaggattactttcaccggggaagccgaccaggcccccggagtagaacccggggacatagtccttctgcttcaagaaaaggaacacgaggtctttcagagggacggaaatgaccttcatatgacttacaaaataggccttgttgaagccctgtgtggattccagttcacattcaaacatttagacggcagacagatcgtcgtgaaatacccgcccggcaaagtgatcgaaccaggttgtgtgagagtggtgagaggtgaggggatgccacagtaccgtaaccccttcgaaaagggcgacctgtatataaaattcgacgtacagtttcctgaaaataattggatcaacccagacaagctgtccgagttggaagatctactgccttcccgcccagaggtgcccaatattataggtgagaccgaagaagttgagctgcaggagttcgactctacacgggggagcggcggcggacagcggcgcgaggcttataatgactcctcagacgaggagtcaagcagccatcacggacctggggttcagtgcgctcatcagtag

SEQ ID NO: 114890 - DNA, 1443 bp, Artificial Sequence
  Description of Artificial Sequence: Synthetic coding sequence
atggctgctcgctgcagtacgaggtggctgctcgtggtagttggcacccctcgcttacctgcgatcagcggtaggggcgctcgccccccaagagaaggcgtcgtcggtgcctggctgagccgcaagctctcggtgccagcctttgcctcatcgctcactagctgcgggcctagggccctgcttacactgaggcccggcgtctccctcactggcacgaagcataatccattcatctgcacagcatcctttcacacttcagcacctttagctaaagaagattactatcaaattctgggagtaccccgcaatgcatctcagaaagaaattaagaaagcgtattatcagctggccaaaaaataccacccggacacaaacaaggatgatccaaaggcaaaggaaaagttctcccaactcgctgaggcgtatgaagtcctgtcagatgaggtcaaacggaaacaatatgatgcctacggaagcgccggctttgaccctggtgccagcggctctcagcacagttactggaagggaggcccaaccgtcgaccccgaagaactgtttaggaaaatcttcggggaattctcatcatccagttttggcgacttccagactgtgtttgaccaaccacaggagtattttatggagctgacctttaaccaagccgcaaaaggtgtgaacaaggagttcaccgtgaatataatggacacgtgcgaaagatgcaatggcaaggggaacgaacccggaaccaaggtccagcactgccattattgtggcggtagcggtatggagaccataaacaccggcccgttcgtcatgcggtccacctgtcgtagatgcggcggaagggggtcaattatcatttcgccctgcgtcgtttgcagaggcgccgggcaggcgaagcagaaaaagcgcgtgatgatcccggtccccgccggagtcgaggatggtcaaacggttagaatgcctgtgggaaagagagagattttcatcactttccgggtacaaaagagccccgtctttcgacgcgatggcgcagacatacatagcgatctttttatttccattgcgcaggccctgctgggaggcaccgccagagcccagggcctctatgaaactatcaatgtcaccattcctccaggaacgcagaccgaccagaaaattcgcatggggggaaaaggtattccaagaatcaattcttacggatacggcgatcattacattcatattaagatacgggtccctaagaggttaacgtcccggcaacagagcctgattttgagttatgcggaggatgagactgatgtcgaaggaaccgttaacggcgtcacattaacatcatccggcggatccacaatggattccagcgctggcagcaaagcccggcgggaggcaggagaggacgaagaaggatttttaagtaagcttaaaaagatgttcacaagttag

SEQ ID NO: 114891 - DNA, 1362 bp, Artificial Sequence
  Description of Artificial Sequence: Synthetic coding sequence
atggctgcccgttgcagtacaaggtggctacttgtcgtcgtgggaaccccaaggctccctgcaatcagcggtaggggggcacgcccccctcgcgagggagttgttggggcgtggctctctcgcaaactgagcgtgccagccttcgcgtccagccttacatcctgcggtccaagagctcttctgacgctgagacccggtgtatccctgacggggaccaaacataacccatttatttgcacggcgtcttttcacacatcagctcccctcgcaaaggaggactactatcaaatcctgggggtaccccgaaacgcaagccaaaaagagatcaagaaagcctactaccagctcgctaaaaagtaccatccagatacgaataaagacgaccccaaggcaaaagagaaattctcccagcttgcggaagcctacgaagttctgtcagacgaagtcaaacgcaaacagtacgatgcatacggcagtgctggattcgacccaggagccagcggatctcagcacagttactggaagggcggaccaactgttgaccctgaagagctcttcagaaaaatctttggagaattcagcagttcctcctttggggactttcagacagtgttcgatcaaccccaagagtatttcatggaactgacattcaaccaggctgctaaaggcgtgaataaagagtttacagtgaatattatggatacctgcgaacggtgtaatggaaagggcaacgaaccgggcaccaaagttcaacactgtcattactgcggtggaagcggaatggagaccatcaacacaggacctttcgtgatgcggagtacgtgccgtcgctgcggaggccgagggtcaatcattatttccccatgtgttgtgtgcagaggcgccggccaggcgaaacagaagaagagggtgatgataccagtgcccgctggtgtcgaggatggacaaacggtccggatgcccgttgggaaacgggagatctttattaccttccgagtgcaaaagagccctgtatttcggagggatggtgccgacatccactctgacctgttcatctctatcgcccaggctcttctggggggcacagcgcgcgcccaaggactctacgaaactatcaatgtcacaattccacctggaactcagactgatcagaagatcaggatgggcggaaaagggattccgaggataaattcctatggctacggggaccactacattcacatcaagatacgagtccccaaaaggctgaccagcaggcagcagtccctgattctctcatacgccgaggacgaaacggatgtggaaggcacggtgaatggagtgactctgacctcttctgggaagcgttctactgggaattag

SEQ ID NO: 114892 - DNA, 903 bp, Artificial Sequence
  Description of Artificial Sequence: Synthetic coding sequence
atggccgagccccaggcggagaggcctcggctgtgcgtttttcctgacctgctgcgccctcctagcgcagccgacatagaaacatggtgccaaccgtatcgcaagattttcggggagttttcgagtagctcgttcggtgattttcagacagtctttgatcagccacaggagtattttatggagttgacctttaatcaggctgcaaagggagttaataaggaatttaccgtgaatatcatggatacatgtgagcggtgtaacggcaaaggaaacgaacccggtacaaaagttcaacactgccactattgcggcggttcaggcatggagacaatcaacactgggccttttgtcatgcggtcaacctgccggagatgcggcgggagggggtcaatcattataagtccgtgtgtcgtgtgtcgaggcgccggccaagccaaacagaaaaaaagagtaatgattcccgtgccagctggagtagaggacggccagaccgttcgtatgccggtcggaaagcgtgaaatttttatcacgtttcgcgtccagaaaagcccagttttcagacgcgatggcgcagacatacactctgacctctttattagtatcgctcaggctcttctcggtgggaccgctcgggcacaagggttatatgaaacgattaatgtgactattccacctgggactcagacagaccagaaaattagaatgggaggcaagggaatcccccgaattaactcctatgggtatggcgatcactacatacatatcaagatccgggtccctaaacggctaacaagccgccagcaatcactgatccttagctacgccgaggatgaaactgacgttgagggaactgtaaatggagtgaccttgactagctctgggaagagaagcacaggaaactag

SEQ ID NO: 114893 - DNA, 1023 bp, Artificial Sequence
  Description of Artificial Sequence: Synthetic coding sequence
atggggaaggactactatcagaccttaggcctggctcgtggagcctcagatgaagaaatcaaaagagcttatcgacgacaagccctgcggtaccacccagacaaaaacaaggagcccggtgcagaggaaaagttcaaagagatcgcagaagcctacgatgtgctttccgaccctagaaagagggagatcttcgataggtacggagaagaaggcctcaaggggagcgggccctccggcggcagcggtggaggtgccaacggcaccagtttcagttatacatttcatggggatccacatgccatgtttgccgaattctttggcggacgaaaccctttcgacacttttttcggccagaggaatggagaggaaggtatggatatagatgacccattctccgggttccccatgggcatgggtggtttcacaaatgtgaatttcgggcggtctagatctgcccaggagccggctcggaagaagcaggacccacccgtaacacacgacctgagggtctctctggaggagatttacagcggttgtaccaaaaaaatgaagatctcccacaagcgcctgaatcctgacgggaagagcatccggaatgaggataagatcctgactatcgaggtgaaaaagggctggaaggaggggacgaagataacctttcctaaagaaggggatcagaccagtaacaacattcccgccgatattgtgttcgtacttaaggacaaaccgcacaacatttttaagcgggatgggagcgatgtcatttacccggcacgtatcagcttacgggaggctttgtgtggctgtacggtgaacgtgcctactctggacgggcggaccatcccggtggtgttcaaggatgttatacggcccggtatgcgacgtaaggtccccggggagggtctgccactgcctaaaactccagagaagcgaggcgacttgataatagagttcgaagttatttttccggaaagaattccacaaaccagtcgcacggtcttagagcaagtgcttcccatctag

SEQ ID NO: 114894 - DNA, 723 bp, Artificial Sequence
  Description of Artificial Sequence: Synthetic coding sequence
atgttcgccgagttctttggggggcgcaacccattcgacacctttttcggccaacgtaatggtgaagagggaatggatatcgacgacccgttttccggtttcccgatgggcatgggaggattcaccaatgtgaattttggtaggtccaggagcgcccaggaacccgcaaggaagaagcaggaccctcccgtcacacacgaccttagggtttctcttgaggaaatctactcaggctgcaccaaaaagatgaaaatctctcataaaagacttaatcccgatggtaaatccatcagaaatgaagataaaattcttaccatcgaagtgaagaaaggctggaaagagggcacaaagatcacgtttcccaaggagggggaccagacctccaataacattccggctgacatcgtctttgtacttaaggacaagcctcacaacatctttaagagggatggctccgatgtgatctaccctgctaggataagcctgagagaggccctgtgcggctgcacagtgaatgttcccacacttgacgggcggacgatcccggtagtctttaaggacgtgataaggcccgggatgcgtcgaaaagtaccaggagagggcctgccactgccaaaaacgccggagaagcgaggggacctgataatcgagttcgaagtgattttccccgaaaggattcctcagacctcacggaccgtcttagagcaggtgctgccgatatag

SEQ ID NO: 114895 - DNA, 1230 bp, Artificial Sequence
  Description of Artificial Sequence: Synthetic coding sequence
atgtccagtcttagggcacgtctgcccgctactcggcgtcgggtagcgcagccgttcgcacggcccgcgagcccctctctagtgccccgtagtgggtcagctatggagtcaaacaaagacgaggccgagaggtgtatttctattgccctaaaggctatacagtctaaccagccagacagagcgctgcgttttctcgaaaaagcccaacgcctgtatccaactccacgcgtgagagcgctgattgaatcattaaaccaaaaaccgcaaacagctggggaccagcctccgcccactgatactactcacgccacacatcgtaaggcgggcgggacggacgctccttctgccaatggggaggctggcggagagagcaccaagggctataccgcagagcaagtggcagcagtgaaaagagtgaaacagtgcaaggactactatgaaattctcggagtgtcaagaggggcaagtgatgaagacttgaagaaggcctacagacgcctcgcactgaaattccaccccgacaagaatcatgccccaggggcaaccgaggccttcaaggccataggtactgcatacgcagtgctaagcaaccctgagaagagaaaacagtatgatcagttcggtgacgataaatcccaggccgcccgtcatggccatggtcacggtgactttcaccgtggttttgaggccgacatttcacccgaggatctttttaacatgtttttcggaggggggtttccatcttctaacgtgcatgtgtattccaacggtaggatgcggtacacataccaacaaagacaggatcggcgagataaccagggggacgggggactaggcgtgttcgtccaactaatgcctatacttatactcattttggtctcggcattgtcccagctcatggtgtcttctccgccttattcactcagtcccaggcccagcgtgggacatattcatcggcgggtgactgaccatctcggggtcgtgtactatgtcggagatacattttccgaagagtacacaggctcctctctgaagacagtcgagcggaatgttgaggatgactatatcgccaaccttcggaataactgttggaaagagaaacaacagaaagaaggccttctgtaccgggcaagatacttcggggacacagatatgtaccaccgtgcacagaagatgggcacaccatcctgctcccggctctccgaggtgcaggctagtctacacggctag

SEQ ID NO: 114896 - DNA, 1230 bp, Artificial Sequence
  Description of Artificial Sequence: Synthetic coding sequence
atgtcctccctacgagctcggctcccagccactcgcaggagggtcgctcagccttttgcaagacccgcatctccgtcgctcgtgccaagatccggcagtgccatggagagtaacaaggatgaggccgagcgctgtatctctatcgcactgaaggccatacagagcaaccagcctgatagagctctccgtttccttgaaaaagcccaaagactatatccaacgccaagagttagggcattaatagaatctctgaatcaaaagcctcaaacagccggggaccagccccctccaaccgacaccacacatgccacccatcgaaaggccggagggaccgacgcccctagcgctaatggagaggcgggcggtgagagtacaaagggctatacagctgagcaggtggccgctgtgaagcgggtgaaacagtgcaaagattactacgagatactgggcgttagccggggcgctagtgacgaagacctgaaaaaggcgtataggcgtctggcgttaaagtttcaccctgacaagaatcatgcacccggcgctacggaggcattcaaggccataggcaccgcctatgcagtgctcagcaatccggagaaaaggaaacagtacgaccagttcggtgacgataagtctcaagcagctcgccacggtcacgggcatggagattttcatcgcgggtttgaagctgacattagccccgaagacttattcaacatgttcttcggaggcggtttcccaagcagcaatgtacacgtatactcaaatggccgaatgcggtatacatatcagcagcgccaggacagacgggacaaccagggggacggcggccttggcgtttttgtccagttgatgcccattcttatcctcattttagtgtctgcactgtctcagctaatggtctcctccccgccatattctctgtctccccgacccagtgtgggtcacatacaccgaagagtcaccgaccatttaggcgttgtgtattatgtcggtgacaccttctccgaggagtacacaggatcctctttgaagactgttgaaaggaatgtagaagacgactacatcgccaacttgaggaataattgttggaaggagaaacaacagaaagagggcctactttatagagcacgctactttggggataccgatatgtatcacagagctcagaagatgggcactccctcatgttcacggctgtcagaagtgcaggccagcctccatggttag

SEQ ID NO: 114897 - DNA, 1128 bp, Artificial Sequence
  Description of Artificial Sequence: Synthetic coding sequence
atggaaagcaataaggatgaggccgagagatgtatcagcatcgccctgaaagcaatacagtcaaatcaacctgatagagccctcaggtttctcgaaaaagctcaacgattataccctacgccccgagtccgagcccttatcgagagtctaaaccagaaaccccagacggctggcgatcagccccccccaacggatacaacacacgccacccaccgcaaggctggtgggactgacgcgccttccgccaatggcgaggccggtggagagagcacaaagggttacacggctgagcaggtggcagcggtgaaacgcgtcaaacaatgtaaggactactacgagattctcggagtttctcgtggggcgagcgacgaagacctcaagaaagcttaccggcgactggccctgaaatttcatccagataagaatcacgcacctggcgcgacggaagccttcaaagcaattggtaccgcttacgcagtcctgagtaaccctgagaagagaaaacaatacgaccagttcggcgacgacaagtcacaggctgcacgccacggtcatggacacggagactttcaccgtggtttcgaagcggatatttccccggaagacctgttcaacatgttcttcgggggcggcttccccagtagtaacgtgcatgtctattccaatggtaggatgagatacacttaccaacagagacaagaccggcgagacaaccagggcgatggtggccttggagtatttgtgcagctgatgcccatactgattctcatcctcgtgtcagctctctcccagttgatggtgagtagccccccctattctctgagcccaagaccgtccgtcgggcacatccacagacgcgtgacggatcacctgggcgtggtgtattatgtgggagatactttttctgaggagtacactggctcttctttaaaaacagtggagcgcaatgtagaggacgattacatcgctaacctgagaaacaattgctggaaggagaagcagcagaaggaaggcctcctgtatagagctcgctactttggggacacagacatgtaccaccgggctcagaagatggggaccccgtcctgttctcgactcagcgaggttcaggcctctctgcatggctag

SEQ ID NO: 114898 - DNA, 975 bp, Artificial Sequence
  Description of Artificial Sequence: Synthetic coding sequence
atggcttcttattacgaaattctggacgttcctcgctcggcttcagccgacgatatcaagaaggcatacagaaggaaagccctgcaatggcaccccgataagaatcccgataacaaagaatttgcggagaagaagttcaaagaggtggcagaggcctacgaggtactttcagacaaacacaaaagagagatttatgacagatatggccgggaggggttaacaggcaccggaacgggtccttcgcgcgccgaggcaggttcagggggtccaggctttacctttaccttccggagcccagaggaggtatttcgggaattcttcgggtctggggatcccttcgcagagctttttgatgacttgggaccattttctgagctgcagaatagggggagcaggcacagtggccccttttttaccttcagcagttccttccccggtcactctgactttagcagcagctccttctctttcagccctggagctggggcctttagaagcgtctccactagcaccactttcgtgcaagggcggaggatcactactcggaggatcatggagaacggtcaagaaagggtggaagttgaagaggacggccagttgaagtcagtaacaatcaacggcgtccccgacgacctggctctgggactggaactgtctcggcgcgaacagcagcccagtgttacctcccggtctggcggaactcaggtccagcaaacacccgcttcttgtccgctcgactccgatttatctgaggacgaggatctccagctcgcaatggcctactctctctcagagatggaagccgctggcaagaagccagcaggtggccgggaagcacagcataggaggcagggaagacccaaagcccaacaccaggatccaggcctcggcgggactcaggagggcgcccggggggaggccactaagcgatctcccagccctgaggagaaagccagcaggtgcctgatcctgtag

SEQ ID NO: 114899 - DNA, 834 bp, Artificial Sequence
  Description of Artificial Sequence: Synthetic coding sequence
atggcttcgtactacgagattctggacgtgccgcggtccgcctccgctgacgacattaaaaaggcgtacagaagaaaggcgctgcagtggcacccggataaaaaccccgacaataaggagtttgctgaaaagaagttcaaagaggtggcggaggcatatgaagtcctgagcgataagcataagcgtgaaatttatgatcgctacggccgggagggtcttaccggaaccggtacaggaccctcccgagcggaagccggctcaggcggacctggtttcaccttcactttccggtcacccgaagaagtatttcgcgagttttttggatccggcgacccttttgccgagctgtttgatgatctggggccctttagcgaattgcagaaccgcgggtctcgccacagcggtccctttttcacattttcatcatctttcccaggacacagcgatttcagtagcagcagttttagctttagtcccggggccggcgcttttcgtagcgtcagcacgtccaccacttttgtccagggaagaagaattacaactcgacgcatcatggaaaatggacaagagagagtggaggtggaagaggacggacaactgaaaagtgtcacaataaacggcgtgcctgacgacttggctctgggattggaactctcccgacgcgagcagcaaccctctgtgacctccagatccggggggacacaggttcaacaaaccccagcctcatgccctctcgatagcgacttgtctgaggacgaggacctccaactggcaatggcttatagcctgtcagagatggaggccgccgggaagaagcccgcagacgtcttctag

SEQ ID NO: 114900 - DNA, 687 bp, Artificial Sequence
  Description of Artificial Sequence: Synthetic coding sequence
atggcctcatactacgaaattctggacgttccccggagcgcttctgctgacgatattaagaaggcatataggcgcaaggcgctgcagtggcaccctgacaagaatccagacaacaaagagttcgccgagaagaaatttaaagaggtcgctgaagcatacgaggtactttccgataagcacaaaagagaaatctacgacaggtacggtcgggaaggcctcacaggtacaggcacaggacctagcagagccgaagccggctctggaggccctgggtttacgtttacattccggtcaccagaagaggtatttcgtgaatttttcggcagcggtgaccccttcgccgaattattcgacgatctgggcccctttagcgaactgcagaatcgaggctctagacatagtggcccctttttcacattctcatcttccttccccggtcacagcgatttttcaagctcaagcttttctttttcgcctggagccggagctttccgctcagtgtcaactagtactaccttcgtccaaggccggcgaataaccacacgccgaatcatggaaaatggtcaggaacgggtggaggtagaggaagatggacagctcaaatctgtgacgatcaatggtgtgccagatgatcttgcccttgggctggaactgtctcgacgcgagcagcagccaagcgtcacatag

SEQ ID NO: 114901 - DNA, 447 bp, Artificial Sequence
  Description of Artificial Sequence: Synthetic coding sequence
atggcatcttattatgagattcttgacgtccccagatccgccagcgcggacgatattaaaaaggcttaccggcgcaaggcccttcagtggcatcctgacaagaatccggacaacaaggagtttgcggagaagaaattcaaggaagtggccgaagcctacgaggttctgtccgacaaacacaaaagggagatttacgacagatacggccgggaggggctaactggcacgggcactggacctagccgcgccgaggcaggttccggtggcccggggtttacctttacattcaggagccccgaagaggtattccgtgaattctttggtagcggcgacccatttgcagagctcttcgacgatctgggtcccttctctgagttacaaaacagggggagccgacactcagggccttttttcacatttagcagttcatttccaggccatagttag

SEQ ID NO: 114902 - DNA, 369 bp, Artificial Sequence
  Description of Artificial Sequence: Synthetic coding sequence
atggcgagctattatgagatcctggatgtgcccaggtccgcatctgctgacgacataaagaaggcctacagaagaaaagcactgcagtggcatcccgacaaaaatccagacaataaggaatttgcggagaaaaagtttaaagaagtagctgaggcctatgaagtgctttctgacaaacacaaaagggaaatttacgaccggtacggtcgcgagggacttactggtacgggaaccgggcctagcagggcggaggccggctcaggcggaccaggattcacctttaccttcagatcgcccgaagaggtttttcgcgagtttttcggcagcggcgacccattcgcagaactctttgacgatctggggccatag

SEQ ID NO: 114903 - DNA, 981 bp, Artificial Sequence
  Description of Artificial Sequence: Synthetic coding sequence
atggtggattattatgaagtcctcggggtgcagaggcacgccagccctgaagatattaaaaaagcttaccggaagctagccctcaaatggcaccccgacaagaaccccgagaataaagaggaggcggagaggaagttcaagcaggtcgcagaggcctacgaggtcttaagcgacgccaagaagcgggatatttacgataagtatggcaaagaggggctaaatggagggggaggtggcggctctcactttgatagccccttcgaatttggattcaccttccggaatccagatgacgtgttcagggaatttttcgggggacgtgatcccttcagtttcgactttttcgaagatccttttgaagacttctttggaaatcggcgcggcccgagaggcagtaggtcacgcggtactggctccttcttttcagcctttagcggttttccatccttcgggtccggattctccagcttcgacaccggctttacctcctttggatctcttggacacggtgggctgacctccttctctagcacatcttttggggggtcagggatggggaatttcaagagcatctctaccagtactaaaatggtcaacggtcggaagattacaacaaaacgaatcgtggaaaatggccaagaacgcgtggaggtggaagaggacggccaactgaagtcgttaacgataaatggcgtcgctgacgatgacgctttagctgaggagcggatgcgccgaggccagaatgccctgccggctcaacccgctgggttgcgcccaccgaagccaccccgacccgcaagcctgctgaggcatgcgccgcactgtctgtctgaggaggaaggcgaacaagaccgtcccagagctcctggaccatgggatccactcgccagcgccgccggactaaaggagggcgggaaacgaaaaaaacagaagcagcgggaagaaagcaagaagaagaaatcaacaaaaggcaatcattag

SEQ ID NO: 114904 - DNA, 378 bp, Artificial Sequence
  Description of Artificial Sequence: Synthetic coding sequence
atggttgattactatgaagtgctgggtgtgcagcgacacgcctccccagaagatatcaaaaaggcgtataggaaactcgctctgaaatggcatcccgacaaaaaccctgagaacaaagaagaggctgaacgcaaattcaagcaggtggctgaggcgtatgaggtcctgagcgatgcaaagaagagggacatatacgacaaatatggtaaggaaggcttgaacgggggcgggggcggaggctcccactttgatagccccttcgaattcggattcaccttccggaatcctgatgacgtgttcagagaattcttcggcgggagggacccatttagcttcgactttttcgaagacccattcgaagatttttttgggaactag

SEQ ID NO: 114905 - DNA, 687 bp, Artificial Sequence
  Description of Artificial Sequence: Synthetic coding sequence
atggtggactactatgaggtcttgggggtgcagaggcacgctagcccagaggatatcaagaaagcctatcggaaactcgcactgaagtggcacccggataaaaaccccgaaaacaaggaggaggcagagagaaagttcaagcaggttgccgaggcatacgaggtgttgagtgacgcaaaaaaaagggatatatatgacaagtatggcaaagaggggcttaatgggggcggagggggaggaagtcactttgactctccctttgaattcggctttaccttccggaaccctgatgatgtctttcgagagttcttcgggggcagagatcccttctcttttgatttcttcgaggacccttttgaagatttttttggaaacaggagaggaccacgaggatcgagatcacggggcacagggtcattttttagtgccttcagtggctttccctcatttgggagcggcttctctagttttgataccggcttcacatccttcggttcgttaggtcacgggggcctaacgagctttagttctacaagctttggggggagtgggatggggaattttaagagcatatcaacttctaccaaaatggtgaatggacgcaaaatcaccacaaagcgcattgtggagaacggccaagagcgggtggaggtggaggaggacggccagttgaagtccttgacatag

SEQ ID NO: 114906 - DNA, 648 bp, Artificial Sequence
  Description of Artificial Sequence: Synthetic coding sequence
atggtggactactacgaagtgctgggggtgcaaagacatgcatcacccgaggatatcaaaaaggcgtacagaaagcttgctctcaaatggcacccagacaaaaatccagaaaacaaggaggaggccgagagaaaattcaagcaagtggcggaagcctacgaggtgctgtccgatgcaaaaaagcgagacatttatgacaaatatggaaaagagggcctaaatgggggcggaggaggcgggtcccacttcgacagtccgtttgagtttggatttaccttccgcaacccagacgatgtcttcagggagttttttggcgggagagatccgttcagtttcgatttctttgaagatcccttcgaagattttttcggcaatcggcgggggcctcgtgggtcacggtcacggggcactggcagctttttttccgctttcagcggctttccaagcttcgggtctgggttttctagctttgataccggattcacgagcttcgggtcacttggacatggtggcctcacgtcatttagctctacttcgtttggtggaagtgggatgggcaatttcaaatccatttctacaagcacaaaatggctcatggcggaaaagagcctccagcgggagctaagccgcaccgtgaagaaggagtag

SEQ ID NO: 114907 - DNA, 726 bp, Artificial Sequence
  Description of Artificial Sequence: Synthetic coding sequence
atggtcgactactacgaggtcctgggcgtgcagcggcatgcatctccagaggatatcaagaaggcttatagaaaactggctctgaaatggcacccggacaaaaacccagaaaacaaagaagaggctgagaggaagttcaagcaggtggccgaggcctatgaagtactttctgacgcaaaaaagcgggacatttacgataagtacggtaaagagggcctgaacgggggtggtggcggaggatcgcacttcgatagccctttcgagttcgggtttaccttccggaaccctgatgacgtgtttcgagaattctttggaggaagagaccctttttcctttgacttcttcgaggatccgttcgaagatttcttcgggaatcggcgaggaccacgtggaagtcggtcgaggggcactgggtcttttttctcagcatttagcgggttcccttcctttggctcgggcttttctagcttcgacactgggtttacttcttttgggagcttaggccatggaggattgacatccttttcttccaccagcttcggcggcagcgggatggggaactttaagagtatctcaacctcaaccaagatggtgaacggccgcaagattaccacaaagcggatagtggaaaacggtcaggagcgagtcgaagtggaggaggacgggcagctgaagagcctcacaatcaatggcaaggagcagctgctgcgcctggacaacaagtag

SEQ ID NO: 114908 - DNA, 201 bp, Artificial Sequence
  Description of Artificial Sequence: Synthetic coding sequence
atggtagactactacgaagtactgggagtccagagacatgctagtccagaagacatcaagaaggcctaccgcaagcttgctttgaagtggcatcctgataaaaatccggagaacaaagaggaggcggagcggaaattcaaacaggtggccgaggcctacgaggttctgagcgatgcgaaaaaaagagacatttacgattag

SEQ ID NO: 114909 - DNA, 138 bp, Artificial Sequence
  Description of Artificial Sequence: Synthetic coding sequence
atggtggactactacgaagtgttaggcgtacagaggcacgccagtcctgaggacattaagaaggcatatcgaaagttggccctgaaatggcatcctgacaagaaccctgagaacaaagaggaagctgagagaaagtag

SEQ ID NO: 114910 - DNA, 441 bp, Artificial Sequence
  Description of Artificial Sequence: Synthetic coding sequence
atggtggactattacgaagtgttgggtgtacagcggcacgcttctcctgaggacattaagaaggcctacagaaagctcgcactaaaatggcatccggacaagaaccctgaaaacaaggaagaagccgagcgcaagttcaaacaggtggcggaggcttatgaggtcctttcagacgctaaaaagcgtgatatctacgacaaatatggtaaagaagggctgaacggaggtggcgggggaggctctcatttcgactctcctttcgaatttggttttacttttaggaacccggatgatgtgttccgggaattcttcggaggcagggatcctttctctttcgattttttcgaggaccctttcgaagacttcttcggaaaccgacgagggccccgcggcagtaggtccagggggaccgggtctttctttagcgcgttctcaggttag

SEQ ID NO: 114911 - DNA, 636 bp, Artificial Sequence
  Description of Artificial Sequence: Synthetic coding sequence
atggttgactactatgaagtgctcggagtgcagcgccacgccagtccagaagacattaagaaggcctacagaaaactggcacttaagtggcatcctgacaagaatcccgagaacaaggaagaagccgagagaaaattcaagcaggtagccgaagcctatgaggtgctctcagacgctaaaaagagggatatttacgataaatatggtaaagaaggcctgaatggcggcggcggcggtggttctcacttcgatagcccgttcgagttcggcttcacgttcaggaacccggatgacgtgttcagggaattttttggtggaagggaccctttttcattcgacttctttggagtagcggacgacgatgctcttgcagaggagcgcatgaggcgtggccaaaatgcccttcccgcacagcctgccggactgaggccccccaagcctcctaggcctgcctcactgctgaggcacgctccacactgcttgtctgaagaggagggagaacaggacagaccccgcgctcccggcccctgggatcctctcgcatctgcggcagggctgaaagagggaggaaagagaaaaaagcagaaacagcgggaagaatctaaaaaaaagaagtccaccaaggggaatcactag

SEQ ID NO: 114912 - DNA, 834 bp, Artificial Sequence
  Description of Artificial Sequence: Synthetic coding sequence
atgccacacccccgcattctcaaacggccaaagaagagggacatctacgataagtatggcaaggagggacttaacggagggggggggggtggcagccatttcgactccccattcgaattcggatttacttttagaaatccagatgacgtgttccgagagttctttggagggcgggaccctttctcgtttgatttcttcgaggacccattcgaagatttcttcggaaaccggcgcggcccccggggatcccggtccagaggcacagggtccttcttctccgcgttttctggtttccctagttttggctccggtttctctagcttcgacactggcttcacctcatttggctccctgggccatggcggactgacctcttttagctccaccagtttcggcggaagcgggatgggtaatttcaaaagcatcagtacctctacaaagatggtcaacggaaggaaaatcaccaccaagcgcatagtagaaaacggacaggagcgggtggaggtggaggaagacggtcagctgaaaagcctcaccatcaatggagtggccgatgacgacgctctcgcggaagagcggatgcgacgcgggcagaacgccctaccagcacagccggccggattaaggccgcctaaacccccaagacccgcctctctcctccgtcacgctccacattgcttgagcgaggaagagggcgaacaggatagaccaagagcacccggaccatgggatccgctcgccagtgctgccggcctgaaagagggcggaaaaaggaagaagcagaagcagcgggaggaatcaaagaagaagaaatctaccaaaggaaaccactag

SEQ ID NO: 114913 - DNA, 297 bp, Artificial Sequence
  Description of Artificial Sequence: Synthetic coding sequence
atggtagattattacgaggtgttgggggtgcaaagacacgcatcacccgaagacatcaagaaggcataccgcaaactggctctgaagtggcaccctgataagaaccctgagaacaaggaagaagcggagcggaagtttaagcaggtcgcagaagcctacgaggtcctttccgacgcgaagaaaagggacatctatgataagtatggcaaggaaggcctgaatgggggcggaggtggaggaagtcacttcgactcccctttcgagttcggctttaccttcagaaaccccgatgattag

SEQ ID NO: 114914 - DNA, 672 bp, Artificial Sequence
  Description of Artificial Sequence: Synthetic coding sequence
atggccacaccccagtctatcttcattttcgcaatctgcatactgatgataacggaactcattctggcctccaaatcatattatgacattctgggggtacctaaaagcgcaagcgagaggcagattaaaaaggcgtttcacaaactggcgatgaagtaccaccccgataaaaacaagagtccagacgcagaggccaaattccgggaaatcgcagaagcttacgaaaccctgagcgatgcgaacagaagaaaggaatacgatactctcggccatagcgcgtttacaagcggaaaaggccagcgcgggtctggaagcagtttcgaacaatccttcaatttcaactttgacgatttgttcaaggactttggcttcttcgggcaaaatcagaatacagggagcaagaagaggtttgaaaaccacttccaaactaggcaggatgggggaagttccagacaacgccaccacttccaggaatttagttttggcggggggcttttcgatgatatgtttgaggacatggaaaagatgtttagctttagtgggttcgactccacaaatcagcacacggttcagaccgaaaataggtttcatggctccagcaagcattgtagaactgtcacacagcggcggggcaatatggtaacaacctacactgattgctccggacagtag

SEQ ID NO: 114915 - DNA, 2382 bp, Artificial Sequence
  Description of Artificial Sequence: Synthetic coding sequence
atgggagtgtggctcaacaaggacgattacattcgggatctgaagaggattatcctctgtttcctaatcgtgtacatggcaatcctggtcggaacagaccaggatttctacagtctgttgggtgtgagcaaaaccgcatcttctagggagattaggcaggcgttcaaaaaactcgccctgaagctgcaccctgacaagaaccctaataatcctaacgcccatggggattttctgaaaattaaccgtgcctacgaggtgcttaaagacgaagacttgcggaaaaaatatgataagtacggcgagaagggcctcgaagataatcaaggcggacaatatgaatcctggaactactataggtacgattttgggatctacgacgacgaccctgaaattatcactctggagcgacgtgaatttgacgcagccgtcaactctggcgaactctggtttgtgaatttctattcgcctggctgttctcactgccacgacttggctcccacctggcgcgacttcgccaaggaagttgatgggctgctgcggattggagctgtgaactgcggggacgatcgtatgctgtgccgcatgaagggtgtgaatagttatccctcgctgttcatcttccgatctgggatggcccccgtgaagtatcacggcgatcgtagtaaagagtctctggtgagtttcgctatgcagcatgtccgaagcacggttactgagctgtggaccggcaactttgtcaacagtatccaaacagcctttgctgcgggtatcggctggctcatcacattctgcagtaaaggaggggattgcttaacttcacaaacacggctcagactaagtgggatgcttgacggactggtgaacgtggggtggatggattgcgcgacacaggacaatctgtgtaaaagccttgatattacaacttccactaccgcgtatttccctcccggggccacactcaataataaggaaaaaaactccatcctgttcctgaacagcctggacgcgaaggagatctatctcgaagtgatacacaacctcccggattttgaactgctctcagccaataccctcgaggacagacttgcacaccacagatggctgctgttcttccatttcgggaaaaatgagaatagcaatgatcccgagttaaaaaaactgaagaccctcttgaagaacgatcatatccaggtgggccgtttcgattgttcatcggcccctgacatctgctcaaatctttacgtatttcagccatcactggctgttttcaaaggacagggcacaaaggagtatgagattcaccatggaaagaaaattttgtatgacatcctggccttcgccaaagaatccgttaacagtcacgtgaccacactggggccccaaaatttccctgctaacgacaaggagccttggctggtcgacttcttcgcaccttggtgtccgccatgccgcgccctgttgcccgaactgcgtagggccagcaacttactttacggtcagctgaagtttggaactctggactgcaccgtgcacgagggcctctgtaacatgtataacatccaggcctacccaacaaccgtggtctttaaccaatcgaacatccatgagtacgaaggacaccacagcgcagagcaaatcctggagttcatcgaggacctaatgaacccaagcgtcgtgagtctgactcccacaacatttaatgaactggtgactcagagaaagcacaatgaggtatggatggtcgatttttacagcccatggtgccacccttgccaagtgctaatgcctgaatggaaaagaatggccaggacgctgaccggcctgatcaacgtgggcagcatagactgccagcaatatcattcgttttgcgctcaagaaaatgttcagagataccctgagattcgattcttccctcccaaatccaacaaggcatatcactatcattcctataacggatggaatcgagatgcctattccttgcgcatttgggggttaggatttttgcctcaagtcagcacagatctcacacctcagacatttagcgagaaagtcctgcagggcaagaatcactgggtgattgacttctatgccccttggtgtgggccctgccaaaactttgcacccgagtttgagttgctggcgcggatgatcaagggtaaagtcaaagcaggaaaggttgactgtcaggcctatgctcagacatgccaaaaagccggtatcagagcttaccccaccgtcaagttctatttttacgaaagggctaagcggaattttcaggaggaacagattaatacgcgggatgcgaaggcaatcgctgccttaatctccgaaaagctggaaacactgcggaaccagggcaagcgcaataaggatgagctgtag

SEQ ID NO: 114916 - DNA, 2244 bp, Artificial Sequence
  Description of Artificial Sequence: Synthetic coding sequence
atgggggtgtggttaaacaaggatgattatatacgggacctgaagaggattattctctgttttcttatcgtttatatggcaatcctggtgggcacagatcaagatttttactctctgcttggggtcagtaaaacagccagcagtcgggagattaggcaggccttcaaaaaattagctctcaaattgcatccggacaagaatccaaataaccctaatgcccacggagactttttgaagattaacagggcatatgaggtcctcaaagatgaggatctgcgaaagaaatatgacaagtacggagagaagggcctcgaggataatcagggtggtcaatatgagagctggaactactatcgatacgacttcggaatctacgatgatgacccggagattattacccttgaaagacgggagttcgatgctgcagttaattcgggggaactatggttcgttaacttctattcaccaggatgcagccactgtcatgacctagctcccacctggagagacttcgccaaggaagttgatgggctactccgcatcggcgccgtcaactgtggggatgaccgtatgctttgccggatgaagggggtgaattcctatccctcactgttcatctttcggtctggcatggcacccgtcaagtatcatggagatagaagtaaagaaagcctggtgtctttcgccatgcaacacgtgaggtccaccgtcacagagctctggaccgggaacttcgtgaactccatccagaccgcatttgcggctggtattgggtggctcattacattttgctccaaagggggcgactgcctcaccagtcagaccagactgcggctgagcggtatgctgttcctcaacagtctcgatgctaaggagatctacctcgaagttatccataaccttccagattttgaactcctgagtgctaacactctggaggataggttggcacaccaccgctggctgctgttttttcatttcgggaagaacgagaactccaacgacccggaattaaagaaactaaaaacccttctgaaaaacgaccacattcaggtcgggcggttcgactgcagctcagctcctgatatttgctcgaacctgtatgtctttcagccctcgctggccgtgtttaagggacagggaactaaagagtatgagattcaccatggcaagaaaatactctacgacatccttgcgtttgccaaggagtcagtcaattctcatgtgacgactctcggtccgcagaacttcccagctaacgacaaagagccgtggctggtggacttcttcgctccctggtgcccgccgtgtcgggcgctcctcccagagctgcggcgagcttcaaatctgctgtatgggcagctgaaattcgggaccctggattgcacagtgcacgaagggctgtgcaatatgtataatatacaggcatatccaacaactgtcgtgttcaaccagtctaatatccacgagtatgaaggccatcatagcgcagagcaaattctcgagttcattgaggatctgatgaatcctagtgtggtgtcgctaacaccaacaaccttcaatgagcttgtgacgcaacgcaagcacaacgaggtctggatggtggatttttattccccttggtgccacccgtgtcaggtcttgatgccggagtggaaaagaatggctcggaccctcactggtttgattaacgtgggcagtatagactgtcagcagtaccatagtttctgtgctcaggagaatgtccagcggtaccctgaaataaggttttttcccccaaaatctaacaaggcataccactaccatagctacaacggctggaaccgcgacgcctattccctgagaatctggggccttggctttttgccacaagtgtctaccgatttaactcctcagactttctccgagaaagtcttgcagggaaagaatcactgggtgattgatttttatgctccctggtgtggtccgtgccagaattttgcacctgagttcgagctcctggcccggatgataaaggggaaggtcaaggcaggcaaggtcgactgtcaggcttacgcgcagacatgtcagaaagccggaattcgggcgtaccccactgtaaagttttatttctacgagcgcgcgaaacgtaacttccaggaagaacagattaacacacgtgacgccaaggccatcgcagccctgatcagcgagaaacttgaaacactccgaaatcaggggaagcggaacaaggatcatctgtag

SEQ ID NO: 114917 - DNA, 534 bp, Artificial Sequence
  Description of Artificial Sequence: Synthetic coding sequence
atgggagtctggcttaacaaggatgactatatccgagacctaaaacgcattattttatgtttccttatcgtgtatatggccattctggttggaactgaccaggacttctacagcctgctcggagtgagtaagaccgctagctcccgggagatacgccaggcctttaaaaagcttgccctgaagctgcacccagacaagaaccccaataatccaaatgcacatggcgattttctcaagatcaaccgagcttatgaagtactgaaggacgaagacctcagaaagaaatacgacaagtacggggagaaaggactcgaagacaaccaaggtggccagtatgaaagctggaattattatcgatacgactttgggatatacgacgacgaccccgaaatcattacactggagagacgtgaatttgacgccgccgtaaattctggagagctctggttcgttaacttttatagccccggctgttcgcattgtcatgacctggccccaacatggagagactttgccaaggaatcacttcggtag

SEQ ID NO: 114918 - DNA, 999 bp, Artificial Sequence
  Description of Artificial Sequence: Synthetic coding sequence
atgggtgtttggcttaacaaagatgactatataagggacttaaaacgtatcattctgtgctttttgattgtgtacatggctattctggtagggaccgatcaggacttctattcgctcttgggtgtgagcaagaccgcctcatcaagggaaatcagacaggccttcaagaaattggctctcaaactgcaccctgacaagaatcctaacaatcccaacgcccacggagacttcttgaaaatcaacagggcttatgaggtgttgaaagacgaagaccttcgaaagaaatacgacaaatacggagaaaagggcctcgaggacaaccagggtggtcagtacgagtcatggaactactaccgatacgacttcggtatctatgacgatgatcctgagattatcaccctggaacggagagaattcgatgctgcagtaaattctggcgaattgtggtttgtcaacttctactctcctggttgtagtcactgccacgacttagcccccacctggcgggacttcgccaaggaagtggacggacttcttcgcatcggtgccgtgaactgcggggatgatcggatgctctgtaggatgaagggcgtgaactcatatccttcactgtttatcttcaggtcagggatggctcctgtaaaatatcacggagacagatccaaggagagcctggtatcctttgccatgcaacatgtacgctcaacagtaactgaactgtggactggcaatttcgttaacagcatccagactgcctttgccgcgggcatagggtggctaatcacattctgttctaaagggggcgattgtctgacgtcacagactcgcctgagactctctggaatgctggatggcctggtcaatgtggggtggatggattgtgccacacaggataacctctgcaaaagtctggacatcacaaccagcaccaccgcctacttcccccccggcgcaaccctcaacaataaagagaagaactcaatcttactgttacactag

SEQ ID NO: 114919 - DNA, 6732 bp, Artificial Sequence
  Description of Artificial Sequence: Synthetic coding sequence
atgaatatcattcgggagaacaaagatcttgcctgcttctatacaaccaagcactcctggagaggcaaatacaaaagggttttctccgttggcacacacgctattaccacctacaatccaaatactcttgaagtcaccaaccagtggccctatggggatatttgttccatatcacccgtgggcaaggggcaagggactgagttcaatttgacttttagaaagggatcaggcaaaaaatctgagacattaaaattttccaccgaacaccggactgagttacttactgaagcattgcgttttcggactgacttctcggaggggaaaataacaggcagaaggtacaactgctataaacaccattggtcagacagtagaaaaccagtcattctcgaggtcacccccggaggcttcgatcagattaaccccgctacgaatagagtactgtgttcatacgactaccggaacattgaagggtttgtggatctgtctgattatcagggaggtttctgtattctatatggaggattttcccggctgcacctttttgccagcgagcagcgagaagaaattatcaagtcagcaatagaccacgctggcaattatatcggcatttctctccgtattcggaaggagccgctggagttcgagcagtatcttaatctccgcttcggaaagtacagcacggacgaaagtattactagcctggcggagtttgttgtgcaaaaaatcagccctaggcattcagaacctgtcaagcgggttctagccctaaccgaaacgtgtctggtcgaacgcgatcctgctacgtacaatattgccaccctgaagcccctcggggaggtcttcgccctggtgtgtgactccgagaacccgcagctgttcactattgaattcataaagggccaggtccggaagtattcatctaccgagcgggattcactcctcgcttctctcctcgacggagtgagagcctcagggaaccgggacgtctgtgtgaagatgacccctactcacaagggtcagagatggggacttttgagtatgcccgtggatgaagaggtcgagagccttcacctacgatttctcgccacgcccccaaacggcaatttcgctgacgccgtgttcagatttaacgccaacatatcttattctggagtgctgcacgctgtaacacaggacggcctgttctctgagaacaaggagaaattgataaataacgctataacagctctgctgtcccaagagggtgacgtagtcgcctccaatgcagaactagagagccagtttcaggctgtgaggaggctggtggcctccaaagccgggtttctggccttcactcagctcccgaagtttagggaacggctgggcgtgaaggtggtgaaggcgttaaagagatctaataatggcatcatacatgctgcggttgacatgctgtgcgccctgatgtgcccgatgcacgacgattacgacctgcggcaggagcagcttaacaaggcttcactgctgtcaagcaagaagttcctagaaaatctgcttgagaagtttaactcacatgttgatcacggtactggcgctctggtcataagcagcctgctcgattttctgaccttcgctctgtgcgctccatactctgaaaccactgagggccaacagttcgatatgttactcgaaatggtggccagcaatggccgcaccctctttaaactgtttcagcatccctccatggctattataaagggtgctggcctcgtcatgaaggctataatcgaagagggagacaaagagatagcaaccaagatgcaggaactcgcacttagcgagggagcgctaccccgccatttacacacagcaatgtttacaatttcatcagaccagcgcatgctaaccaaccggcaattgtctcgccacctggtcggactctggacagccgacaatgccactgctacaaacctgctgaagaggattcttccccctggactgcttgcgtacctcgagtcgtccgatttggtcccagagaaagatgcagatcggatgcacgtgcgtgacaacgtgaaaatcgctatggaccagtacgggaagttcaacaaggtgccagagtggcagcgactcgcaggcaaggctgccaaagaggttgaaaaattcgcaaaagaaaaggtcgatcttgtgttgatgcactggcgggacagaatgggcattgcccagaaggaaaatataaaccagaaaccagtggttttacgaaagcgaagacagaggattaagatcgaggctaattgggacctcttctactatcggttcggacaagatcatgcccgaagcaacctcatctggaatttcaaaactagggaagagctgaaggacacacttgagtctgagatgagagctttcaacattgatagggagctcgggtctgcaaatgtaatctcctggaatcaccacgagtttgaggtcaagtacgaatgcttagcagaggaaattaaaatcggtgattactatctgcgtctcttgctagaggaggacgagaatgaagagagtgggtcgattaagcgctcatacgagttcttcaatgagctgtatcacaggtttctgttgacccccaaggtgaacatgaagtgcttgtgcttacaggctcttgctatagtgtacggcagatgccatgaggagatcggcccttttactgacacgcggtatatcattggaatgctggagaggtgtaccgataaactcgaacgcgaccgcctgatcctgtttctaaacaagcttattctgaacaagaagaatgtgaaggatcttatggattcaaatggaatccgcatcctggtcgatctgctgaccctggcgcacctgcacgtaagcagggccacagtaccgctgcagtcaaatgtaattgaggctgcaccagacatgaaacgcgaatccgagaaggagtggtatttcgggaatgcagacaaagagaggtcgggtccctatggtttccacgaaatgcaagaactgtggaccaaaggaatgctcaacgccaaaaccaggtgttgggcgcagggcatggacggatggaggccattacagagcatccctcagctgaagtggtgtcttcttgcctctggacaggccgtcttgaatgaaaccgacttagctactttgatcctcaatatgcttatcacaatgtgtggttatttcccaagccgggaccaagataatgcaatcatccgccctctgcccaaggtaaaaaggctcctgagtgacagcacctgtttgcctcacattattcagctgctcctgacctttgatccgatcctggttgaaaaagtcgccatcctgctgtatcacatcatgcaggacaaccctcagctgcctcgcctgtatttaagcggcgtatttttttttataatgatgtataccggctctaatgtcctgcctgtcgcaaggtttctgaagtatactcataccaagcaggcattcaagagcgaggaaacaaaaggtcaagacatattccaacgttccatactggggcatatactgcctgaggccatggtttgttacctggagaattacgagcccgaaaaatttagtgagatctttctcggggaatttgacacaccagaagccatctggtctagtgagatgcgtcgcctcatgatcgagaagatcgctgctcatcttgccgactttaccccccggctgcagtcaaatacccgggctctgtaccagtattgcccaattcccatcatcaattatccacagttggagaatgaattattttgcaatatctattacctgaaacagctctgcgatactctaaggttccctgattggccaatcaaagaccccgtaaaactgttgaaggacaccctggacgcatggaagaaggaggtcgagaagaaaccccctatgatgtccatcgacgacgcatacgaagtgctgaatttgccacaaggacaagggcctcacgacgagtccaaaatccgaaaagcatattttcgattagctcagaagtaccatcccgataaaaacccagaagggcgtgacatgtttgaaaaggtcaacaaagcatacgagtttctgtgcacgaaaagtgcaaagatagtggatggccctgaccctgagaacatcatcctgattcttaagacacagtctattttgttcaataggcataaggaagatctgcaaccatacaaatatgctggctaccccatgctaatcagaacaatcacaatggaaacgtctgatgatcttctgttcagcaaagagtctcctttgctccccgcagcgacagagctcgcctttcacacagtcaactgtagtgctctcaatgccgaggaactccggcgtgagaacggcctggaggtgctgcaggaggctttctctcggtgcgtcgctgttctgacaagagcctccaagccttctgatatgtcagtccaagtgtgcggttacatttctaaatgctactccgtagccgcacaatttgaggagtgtcgggagaagattacagagatgccgtctatcataaaggacctgtgtcgtgttctctatttcggcaagagcatacctagggtggccgctttgggcgtcgagtgcgtatcaagcttcgccgtcgatttctggttacagactcatctcttccaagccgggatcctatggtatctgctcgggttcctgtttaactacgactacacgctcgaagaaagcggcatccagaagtctgaggagacaaatcagcaggaagtggcgaattcgctggcaaagctttctgtacacgccctatccagactcgggggatacctggcagaagagcaggccacacctgaaaacccgaccatcagaaagagtctagcggggatgctgaccccctatgttgcgcgtaagctggccgttgcatcagttaccgagattctcaaaatgctgaatagcaatactgagtccccatatcttatctggaataactccacacgtgctgagctattggaattcttggagagccaacaagagaacatgatcaagaagggcgattgtgataagacttacggatccgagtttgtttacagcgaccatgcaaaggagctcattgtcggggagatcttcgtccgcgtgtataatgaggtgcccaccttccagctcgaggtgccgaaggcatttgcggcctctctcctcgactatataggctctcaagcccagtacttacacacgttcatggcaataacgcacgccgccaaggttgagtctgagcaacacggcgacagactgccacgggtagagatggcactagaggcgttacgcaacgtgatcaaatataatcctgggagtgagtcggaatgcattggtcatttcaaactgatatttagcctcctgagagttcacggcgccggtcaggtccagcagctggccttagaagttgtcaatatagtaacctcaaaccaggactgcgttaacaacatcgcggagtccatggtgctgtcaagcctccttgccctacttcattcactgccaagtagccgccagttagtgcttgagactctctacgcactgactagcagcacaaaaattattaaggaggccatggccaaaggagctctcatctatctactcgacatgttctgtaattccactcatccccaggtccgagctcagacagccgagctgtttgcgaagatgactgccgacaagctaatcggacccaaagtgcgcattacgctcatgaaattcctcccctctgtgttcatggatgcgatgagggacaatcccgaggcagccgttcatatcttcgagggtacccatgagaacccagagctgatttggaacgacaactccagggataaagtgtctactaccgtccgagagatgatgctggaacatttcaaaaatcagcaagataatcctgaagcaaattggaaactgcccgaggactttgcggtggtttttggggaggccgaaggagagctcgcggttgggggcgtttttttacgtatattcatcgcacagcccgcttgggtcttaaggaagccacgcgaattcctgatagcactgctggagaagttgacagagttactggagaaaaacaatccacacggtgagactctcgaaacactcacaatggcaaccgtgtgcttattcagtgctcagccacaactcgctgaccaagttcctcccctgggccacctcccaaaggtaattcaagccatgaatcatcgcaacaatgcgattccaaagagtgctattagggtgattcacgcactctctgagaacgagttgtgcgtgcgagctatggcctcccttgagaccatcggcccgctcatgaacggcatgaaaaaacgagccgacacagtaggcttagcctgcgaggctattaatcggatgtttcaaaaggagcaatcagagctggttgcacaggcactcaaagcggatctagtaccatatctgttaaagctcctggagggcatcggtctggagaacctggatagccccgctgcaacaaaagcccagattgttaaggctctgaaagccatgactcggtcgctacagtacggcgaacaggtcaacgaaattctctgtaggtcctccgtgtggtctgccttcaaggaccaaaagcatgacctctttatttctgagtctcagaccgcaggctacctgaccggtcctggcgtcgcagggtatctgacggctgggacaagtacctcagtgatgtcgaacttaccaccaccagtagaccatgaggctggcgacctcggataccagacttag

SEQ ID NO: 114920 - DNA, 2673 bp, Artificial Sequence
  Description of Artificial Sequence: Synthetic coding sequence
atgtatcagatatcaaagaactccgggtgggcaaggagcagagaatataacttcaatctgaagacgcaatccatactgtttaaccgacataaggaggatctacagccttataagtatgccggatatccgatgttgatccgcaccattacaatggaaaccagcgatgaccttctattttcaaaggaatctcctttactgccagcggctacggagctggcattccatacagtgaattgttctgcattgaacgcagaggagctgcggcgtgaaaatggcctcgaggtgcttcaggaggcctttagtagatgcgtagctgtgctcacacgggcaagtaagccatcggacatgagtgtgcaagtatgcgggtatatctccaaatgctactccgtcgcagctcaattcgaagagtgccgggaaaagattactgagatgcctagcataattaaggatctgtgcagagttctctatttcggcaagtcaatcccccgcgtagcggcacttggagttgaatgcgtgtcatcctttgccgtcgatttttggctccagactcatctattccaggcgggcatcctttggtatctgctcggctttctgtttaactatgattacacccttgaagagtcaggcattcaaaagagtgaggagacaaatcagcaggaagtggccaactccctcgctaagctcagcgttcatgcccttagtagactgggcgggtatctcgctgaagagcaggcgactccagagaaccctactattaggaagagtctggccggcatgttgaccccctacgtcgccaggaagttggccgtcgcatctgtaaccgagatcctcaaaatgctcaattcaaacacagagtctccttacctcatctggaataatagcaccagagctgagctcctggaatttctggaatctcagcaagagaatatgatcaaaaagggagactgtgacaaaacatacgggagcgaatttgtatacagcgaccacgcgaaggaattgatcgtgggagagattttcgtgagagtctacaatgaagtcccaacctttcagctggaagtaccaaaagctttcgccgcctctctgcttgactacattgggagccaggcccagtatctgcacacttttatggccatcacacacgcagccaaagtggagagtgagcagcatggggatagactccctagggtggagatggctctggaagccctccggaatgtgataaagtacaaccccggctctgagtccgaatgtattggccatttcaaactaattttcagtctcctgcgggtgcatggagctggtcaggtgcaacagctggccttagaggtcgtgaatatcgtcacaagcaatcaggattgtgtcaataacattgccgaatccatggtcctgtctagtcttctcgccctgctgcactcacttccaagctctcgccaattagtgctagagacactgtatgcgctaacctcctccactaagatcattaaagaggcgatggcaaaaggggccttaatctacctcctcgatatgttttgcaacagcacccaccctcaggtacgtgcccagacggccgaactatttgccaagatgacggccgataaactgatcggccctaaggtgcgcattactcttatgaagtttctgccatccgtgttcatggatgcaatgcgggataatcccgaagcagctgtccacatttttgagggcactcatgagaatccggaactgatctggaatgataactcgagagacaaggttagcacaaccgtgcgagagatgatgctggagcatttcaagaatcaacaggacaatcccgaagccaactggaaacttcctgaagatttcgcagtcgtatttggggaggctgagggcgagctcgccgtgggcggagtcttcctgaggatcttcatcgcccaaccagcctgggtgctgcggaagccccgggagtttttaatcgccctgctggaaaagctgacagagcttctcgagaaaaataatccacatggggagactctggaaaccctcaccatggctactgtgtgcctcttctcggcccaaccacagctggctgaccaggtaccccctctgggtcacctgcctaaggtcattcaggccatgaaccacaggaataacgccatccccaaaagtgcgattagggtcatccatgcactcagtgagaatgagctatgcgtgcgcgctatggcttcccttgagacaatcggaccactgatgaatgggatgaaaaagcgagccgatactgtggggctagcctgcgaggccataaatcggatgttccagaaagagcagtctgagctcgtcgcgcaagccctcaaggccgaccttgtaccctacctgctgaagttgcttgagggcattggactcgaaaacttggattcccccgcagccacaaaagcccaaattgtgaaagctctgaaggccatgacccggagtttgcaatacggggagcaggtgaacgaaatcttgtgcagatcaagcgtgtggagtgcgtttaaggatcagaagcacgacctgttcatatctgaaagccaaacggctggctacctcacagggcccggcgtcgccggctatctcacggcgggaacttcaacctcagtaatgtctaatctgccaccacctgtggaccatgaggcgggagacctcggctaccagacatag

SEQ ID NO: 114921 - DNA, 351 bp, Artificial Sequence
  Description of Artificial Sequence: Synthetic coding sequence
atggcttctacagtggtcgcagtgggacttacaatagctgctgccggctttgccggacgttacgtgctgcaagctatgaaacacatggaaccacaagtcaagcaagtctttcagtctttaccaaagtccgcttttagcggcggctactatcggggaggtttcgaacccaaaatgaccaagcgggaggcggctctgattctgggtgtttcaccaacagccaataaagggaagatccgagacgctcacagacggattatgctcctcaaccacccagacaagggaggtagcccttatatcgcagccaaaattaatgaggcaaaagatctccttgagggacaagccaaaaaatag

SEQ ID NO: 114922 - DNA, 1707 bp, Artificial Sequence
  Description of Artificial Sequence: Synthetic coding sequence
atgttgctgttgccttcagctgcggacggtaggggcaccgcaattacccatgctcttacatccgcctctactctttgtcaggtggaaccagtcggtcgttggttcgaagcctttgtaaagcgccgcaacagaaacgccagtgcctcctttcaggaactggaggacaagaaggaactgtccgaggagagcgaagatgaagagctgcagcttgaagagttcccaatgctaaaaaccttagatccaaaagactggaaaaaccaggatcactacgctgtgttgggactaggccacgttaggtacaaagcgacccagaggcaaatcaaagccgcccacaaagcaatggtcctgaaacaccatcctgacaaaagaaaagctgccggtgaacctattaaggagggcgacaatgactatttcacctgcataactaaagcctacgagatgctgagtgaccctgtgaagcgccgggccttcaactcagtcgacccaaccttcgacaacagcgtcccatctaaaagtgaagccaaagacaatttctttgaggttttcacccccgtctttgaaagaaacagccggtggagcaataagaaaaatgttcccaagctcggtgacatgaatagtagctttgaagacgtggatattttttatagcttttggtataacttcgacagctggcgcgaattttcttacctggacgaggaggagaaagaaaaagctgagtgcagggacgaaaggcgatggattgagaagcaaaacagagccaccagagctcagagaaagaaggaggagatgaacagaatccggacattggtggacaatgcttattcttgcgatccccggatcaaaaaatttaaggaagaagagaaagccaagaaagaggcagaaaaaaaggcgaaggctgaggccaagcgcaaagaacaggaagctaaggaaaagcaacgacaagcggaactcgaagcagcacggctggccaaagagaaggaggaggaggaagttcgacaacaggccctgttagcaaagaaagaaaaggatatccagaaaaaggctatcaaaaaggagcggcaaaaactgcggaattcctgcaaaatcgaggaaataaatgaacagattagaaaagagaaggaggaggccgaggcccgcatgaggcaagccagtaaaaacacagaaaaaagcacgggtggagggggcaatggcagcaagaattggtcagaagatgatctccaactgttaatcaaagcagtgaatctgtttcctgccgggaccaactctcgttgggaagtgatagctaactatatgaacatccattccagctccggcgtgaagaggacagccaaggatgtcattggcaaggcaaagtctttgcaaaagttggacccccaccagaaggacgatatcaataaaaaggcctttgacaaattcaaaaaggaacatggagttgtcccacaggcagacaacgcgaccccatctgaacgtttcgagggtccctacacagactttacaccctggaccacagaagaacaaaagctgcttgaacaagcactgaagacctaccctgtaaacactcctgaacgctgggagaaaatcgccgaagctgttcccggacgtaccaagaaggactgcatgaaaagatataaagaactggtggagatggtcaaggctaagaaagccgcccaagagcaagtacttaacgccagtagggcgaagaagtag

SEQ ID NO: 114923 - DNA, 1866 bp, Artificial Sequence
  Description of Artificial Sequence: Synthetic coding sequence
atgttgctgttacccagtgccgctgacggacgcggcacagcgattacgcatgccctgactagcgctagtactctatgccaggtagagcccgttggccggtggtttgaagccttcgtgaaacgaagaaataggaatgcttctgctagtttccaggagctggaggacaagaaggaattgtccgaagagagcgaggatgaggagctgcagctggaagaattccctatgctgaaaaccctcgatcctaaagactggaaaaatcaggaccactatgcggttctaggcctgggtcatgttaggtataaagccactcagcgtcaaattaaggccgctcataaggccatggtcctgaagcatcatccagacaagcgcaaagccgcgggagagccaattaaggagggcgacaacgactacttcacctgcatcactaaggcgtacgagatgcttagcgaccctgtgaagcgtcgtgcctttaactctgttgatcccacattcgataattccgtcccatccaaatccgaagctaaagacaatttcttcgaagtgttcacccctgtcttcgaaagaaactcaagatggtctaacaagaagaacgtccccaaactgggagatatgaacagtagctttgaggacgtggatatcttctattcattctggtacaattttgactcatggcgggaattttcgtaccttgatgaggaggagaaagagaaggccgaatgccgcgatgagcgccgctggattgaaaagcagaatcgggctactcgtgcccagagaaaaaaagaagaaatgaatcgaattaggactctggttgataatgcttatagttgcgatccaaggattaaaaagtttaaggaggaggaaaaggccaagaaagaagccgaaaaaaaagcaaaggccgaggctaaacgcaaggagcaggaggccaaagagaaacagaggcaggccgagctcgaggcggcaagactggctaaggagaaggaagaggaggaagtgagacagcaagctctcctcgcaaagaaggagaaagacatacaaaaaaaagctatcaaaaaagagaggcagaagctaaggaactcatgtaagacctggaatcacttttccgacaacgaggctgagagagtgaagatgatggaagaggtagagaagctctgcgacaggctcgaacttgcatcgctgcagtgtctgaatgaaacgctcactagttgcaccaaagaggtgggcaaggcagccctggagaaacagatcgaggagattaatgaacaaattagaaaggaaaaagaggaggccgaagctcgaatgcggcaggcatctaaaaacaccgagaagtccactgggggaggcgggaacggctcgaagaactggtctgaagatgacctgcaacttctgatcaaggctgttaatctgttccccgccggaactaactcgcgatgggaggtgatagctaactacatgaatatccactcctccagtggtgtgaagagaaccgccaaagacgtcataggcaaggccaagtctcttcagaagctggacccccaccagaaggacgacataaataagaaagctttcgacaagttcaagaaagaacatggtgtcgtcccacaggccgacaacgccacaccatcagagcggttcgaaggcccctacacagactttaccccatggacgaccgaggaacagaagctgcttgagcaagccctcaaaacttaccccgtcaacactccagaacgctgggaaaagattgcagaagccgtccctgggcgcacgaagaaggattgcatgaagagatataaggagctggtagagatggtcaaggctaagaaagcggcccaggaacaggtgttgaacgcttcgagggccaagaagtag

SEQ ID NO: 114924 - DNA, 609 bp, Artificial Sequence
  Description of Artificial Sequence: Synthetic coding sequence
atgctactgctgccctcagcagctgatggccgggggaccgccattacacacgccttgacgtccgcaagcacgctgtgtcaagtggagccagtcggcaggtggttcgaggctttcgtgaaacgccgcaacaggaatgcctccgcttcttttcaggaactggaagataagaaggaactgagtgaagagtctgaggatgaggaactccagctggaagagttccccatgctcaaaacactcgaccctaaagattggaaaaaccaggatcactacgccgtgttaggcctgggccatgtgcggtataaggcaacccagcgtcagatcaaggccgctcataaagccatggtgcttaagcatcatccagataaaagaaaggcagccggcgagcctataaaggagggggacaacgattacttcacctgcatcactaaggcctacgaaatgttaagcgatccagtcaaaaggagagcattcaactccgtggaccctactttcgacaactccgttccctcaaaaagtgaagcaaaggacaatttcttcgaggttttcacgcccgtgtttgagaggaactcaagagtttccatcagtaaaaagaagaagaagaaaagatag

SEQ ID NO: 114925 - DNA, 822 bp, Artificial Sequence
  Description of Artificial Sequence: Synthetic coding sequence
atggaggcgaacatgcccaagcggaaggaaccgggaagaagcttgagaataaaagtcatcagcatgggcaacgctgaagtgggcaagtcttgtattataaaacgctattgcgaaaaacgatttgttagcaaatatctagcaactattggaatcgattacggcgtgactaaggtacacgtgagagacagggagattaaggtgaacatctttgacatggcaggtcatccttttttctacgaggtgcgtaacgaattctacaaagacacccagggagtcatattggtatatgatgtggggcagaaggacagtttcgacgcactcgacgcatggctcgccgagatgaaacaagaactcggcccacacgggaacatggaaaacattatttttgtagtgtgcgccaataaaattgattgtaccaagcatcggtgcgttgatgagagcgaaggaaggctgtgggctgaaagtaaggggtttctgtatttcgagacttctgcccagaccggcgagggtatcaatgaaatgttccagaccttttacataagcattgtcgacctatgcgagaacggaggcaagcgccctacaacgaacagcagtgcctcgtttacgaaagaacaggctgacgccatccgccggattaggaactccaaagatagctgggatatgttgggcgtgaaaccgggggcctcacgcgacgaggtcaacaaggcttatcggaagctggctgtgctactccatcccgataaatgtgtggctcctggatctgaggacgccttcaaggctgtcgtgaacgcccgaacagccttgctgaaaaatattaagtag

SEQ ID NO: 114926 - DNA, 609 bp, Artificial Sequence
  Description of Artificial Sequence: Synthetic coding sequence
atggccggccatccgttcttttacgaagtgagaaacgaattttataaagacactcaaggtgtgatcctcgtttatgacgtaggtcagaaggatagttttgacgccctcgacgcctggttggccgagatgaaacaggagttgggacctcacgggaacatggaaaatatcatctttgtcgtctgcgcaaacaagatagactgcactaagcacaggtgcgtggacgagagtgaagggaggctgtgggctgagtctaaagggttcttgtacttcgagacaagcgctcagaccggggagggcatcaacgagatgtttcaaactttttacatctctatcgtcgacctgtgcgaaaacggcggcaagagaccaacaacgaacagctctgcgtcttttactaaggagcaagccgacgcaataaggagaatacggaacagtaaggactcctgggacatgctcggggtgaagccgggcgcctctcgcgacgaggtaaataaggcttataggaagttggctgtgttactccaccccgacaagtgcgttgcacctggcagtgaagacgcctttaaggctgttgtgaacgcccgaactgcccttttgaagaatattaaatag

SEQ ID NO: 114927 - DNA, 1515 bp, Artificial Sequence
  Description of Artificial Sequence: Synthetic coding sequence
atggtggccccaggcagcgtcacatctcggcttgggtctgtgttccccttcctgttagtgctggtggacttacagtacgagggcgctgaatgtggcgtaaatgcagacgtcgaaaagcacctagaactggggaagaaactgcttgccgctggacagctcgccgacgcactgagtcagtttcatgccgccgtagatggcgatccagataactacatcgcttactaccgccgcgccaccgtgtttctggctatgggcaaatcaaaagccgcactgcccgaccttacaaaagtcatccagcttaaaatggactttacagccgcccgcctacagcgggggcacctgctacttaagcagggcaaactggacgaagctgaggatgattttaagaaagtactgaagtctaacccatccgaaaacgaagagaaggaggcgcagtctcagttgatcaagagtgatgagatgcaacgcttacgctcacaagccctgaacgcattcgggtccggggattacaccgcggccatcgcatttctggataagattcttgaagtttgcgtctgggacgccgagctgcgcgagttaagagccgagtgcttcatcaaggaaggagaacccaggaaagctatcagcgacctgaaggcagccagcaaattaaagaatgacaatactgaagccttttacaagatctccacactctactatcagcttggggaccacgaattgagcctctctgaggtgcgggagtgcctcaagctggaccaggatcacaagagatgctttgcacactacaaacaggtcaaaaaactgaacaaactcatcgaatcagcggaagagctgatcagagacggcagatatactgatgctacatctaagtatgaaagtgtaatgaaaacagaaccgagcatcgcagaatatacagtgcgctccaaagaaaggatttgccactgcttcagcaaggacgagaagcccgtggaggctattcgggtgtgctcagaggtgttgcaaatggagccagacaatgttaacgccctgaaagatagagccgaggcttatttaatcgaagagatgtatgacgaagcaatacaggattacgagaccgctcaagaacacaacgaaaatgatcagcaaatccgagaggggctggaaaaagcacaacggctgctgaaacagtcccagaagagggactactataaaatcttgggcgtgaagaggaacgccaaaaaacaggaaatcataaaagcatatcgcaagttagccctgcagtggcaccctgacaactttcaaaatgaggaagagaaaaagaaagcagaaaaaaaatttatcgatatcgctgccgccaaagaggtgctttccgatccagagatgcgcaaaaaattcgatgatggggaggacccgctggacgccgagagccaacagggagggggcggtaacccattccatcggtcctggaacagttggcagggattcaacccattcagttccggaggtccattcaggttcaagtttcacttcaactag

SEQ ID NO: 114928 - DNA, 597 bp, Artificial Sequence
  Description of Artificial Sequence: Synthetic coding sequence
atggctgatcagagacagagatcactgtcaacatctggcgaaagcctttaccacgtgttgggcctagataaaaacgccactagtgacgatattaagaagtcttatcgaaaactagccctgaaataccaccctgacaaaaatcctgacaacccagaggccgctgacaagtttaaggagatcaataatgcacacgctatattgaccgatgctactaagcgtaacatctacgacaagtacggcagtttgggattatacgtcgctgagcaatttggcgaggagaacgtgaacacctatttcgtgcttagttcatggtgggccaaggctttatttgtgttttgtggcctgttgacatgctgttactgctgctgctgcctctgttgctgttttaactgttgctgcggcaagtgcaagcccaaggctccagaaggagaggagactgagttttatgtgtccccggaagatttggaagctcagctgcagagtgatgaacgagaggcaaccgacacaccgattgtaatccaacccgcgagcgctaccgaaactacacagttgactgcagactcccatccatcctatcacacagacgggttcaactag

SEQ ID NO: 114929 - DNA, 504 bp, Artificial Sequence
  Description of Artificial Sequence: Synthetic coding sequence
atggctgaccagcgccaacggtcactgagcacctccggggaaagcctatatcacgttcttgggttagacaagaatgccacttctgacgatatcaagaaatcttaccgcaagttagcactgaaatatcatcctgataaaaatccggacaaccccgaggctgctgataaattcaaggaaattaacaacgctcatgctattctgacagacgcaacaaagcggaacatatatgataagtatgggtcacttggactatacgtggctgagcagtttggggaggagaatgtcaatacttattttgtcttgtcttcctggtgggcgaaagctctgttcgtgttctgcggactgttgacttgttgctattgttgttgttgcctgtgttgctgtttcaattgttgctgcgggaaatgcaagccaaaagccccagagggggaagagaccgagttttatgtctcacccgaagatttggaggctcagcttcagtcagacgaaaggggcggacactag

SEQ ID NO: 114930 - DNA, 600 bp, Artificial Sequence
  Description of Artificial Sequence: Synthetic coding sequence
atggcgtgcaacatccctaaccaacggcagaggactctgtctactaccggcgaagccctgtacgagattctgggccttcacaaaggtgctagcaacgaggaaatcaagaagacctatcgcaagctggccttaaagcaccatccagacaaaaaccccgacgatcctgcagctactgagaagtttaaggagatcaacaatgctcatgcgatcctgacagacatttccaaaagatcaatctacgataagtatggctctttaggactgtacgtcgctgaacaatttggcgatgagaatgtaaacacgtacttcatgctgagctcctggtgggccaaggcgctgttcgttatcgtcggtctgctaactggatgttatttttgttgttgtctgtgctgctgctgcaactgctgctgtggccactgccgacccgagtcctccgttcctgaggaagacttctatgtgtcacccgaggacttggaagaacagatcaagtccgatatggagaaggatgtcgactttcctgtctttttgcagccaactaatgcaaatgagaagacgcagttgatcaaagaaggaagccgatcgtattgcactgatagctag

SEQ ID NO: 114931 - DNA, 570 bp, Artificial Sequence
  Description of Artificial Sequence: Synthetic coding sequence
atgtcaaccgttaaagaggccgcccaccgcctctcaaaatcagaaatgtctttgtatgctgtgcttgatttaaagaaaggagccagtcctgaggattttaaaaaatcatattcccatagcgctcttttacctcatcccccgttcgagtaccaccttggacgcaaactggcactcagataccatcccgacaagaacccaggaaacgctcaagctgccgaaatcttcaaagagataaacgccgcgcacgcgatattgtccgatagcaagaagcgtaaaatctatgatcagcatggctctttaggcatctatttatatgatcattttggcgaagaaggcgtgcgctattactttatcctgaatagctgttggtttaaaactctcgtaattctctgtacattacttacttgctgttgcttctgttgttgttgttgcttttgctgtggagccctcaaaccccccccggaacaggattctgggcggaagtatcaacaaaacgtacagtctcaacccccccggtctggagccaagtgcgattttcgctccgaggaaaattcggaggacgatttctag

SEQ ID NO: 114932 - DNA, 570 bp, Artificial Sequence
  Description of Artificial Sequence: Synthetic coding sequence
atgagtacagtgaaggaagccgcccacaggttatctaaatctgagatgtccctttacgctgtcctggacctgaagaaaggcgcctcaccagaggattttaagaaatcatattcccactccgccctgctgccccacccgcccttcgagtatcacctgggtagaaagcttgccctgcggtaccaccccgacaaaaacccgggaaatgcccaggccgccgaaatttttaaagaaatcaacgctgcacacgcaatcctaagtgattcgaagaagcgcaagatctatgaccagcacgggtcgctggggatttacctgtacgatcacttcggcgaggaaggcgtgaggtactatttcattctgaattcttgctggttcaaaacactggtcattctgtgcacgttgctcacatgttgttgcttctgctgctgctgctgcttttgctgcggagcgcttaagccgccgcccgagcaggactccggacgcaagtatcagcaaaatgtgcagagtcagcccccacggtccggcgccaaatgcgattttcgatcagaagagaacagcgaagacgacttctag

SEQ ID NO: 114933 - DNA, 2703 bp, Artificial Sequence
  Description of Artificial Sequence: Synthetic coding sequence
atggagccctcctatgggggaggtttgttcgacatggttaagggcggggccgggagattgttttctaatcttaaggataatctgaaggacaccctaaaggacacatcttcccgggtaattcaatctgtcacgtcatatacaaaaggagacctcgacttcacttatgttacttctaggataatagtgatgtcattccccctcgacaatgttgatattggtttccggaaccaagtggatgatatacgtagtttcttagactcgcggcacctcgaccattacactgtttataacttaagccccaaatcatacaggactgcaaaattccactcaagagtttcagaatgcagctggcccattaggcaagcgcctagccttcataatttgtttgccgtctgccgaaatatgtacaactggctcctgcagaaccctaagaatgtctgtgtggtgcactgtctcgacggcagggctgcaagctcaatccttgttggggccatgttcattttttgcaatctctactccacaccaggccctgccatcagactgctgtatgctaagaggccaggcattgggctctctccctcacaccgacggtatctcggctatatgtgtgacctcctagcagacaagccctacaggcctcacttcaagcccctgactatcaagtccataaccgttagtccaatcccttttttcaataaacaacgaaatggttgccgtccttattgtgacgtgctcattggcgaaactaagatctacagtacgtgtaccgatttcgagcgcatgaaggagtatagagtacaggacggtaagatctttatcccattaaacatcactgtgcagggtgacgtcgtcgtcagcatgtaccacctgcgctcaaccatcgggtcacggctgcaagccaaagttacaaatacccagattttccagctgcagtttcacactggcttcattccactcgacaccaccgtcctcaagttcactaaaccagagctcgacgcttgcgacgtgcccgagaagtatccacagctatttcaggtgaccctcgatgtggagctgcagccccatgacaaggtgatagatctgacccctccttgggaacactattgtaccaaagatgtgaatccatctattctcttttcgagtcaccaggagcatcaggatactcttgctctggggggacaagcaccaatcgatattccccctgacaaccccagacactatggccagagtggatttttcgccagtctgtgctggcaggatcagaaatctgagaagtcgttttgcgaagaagaccatgcggcacttgttaaccaagagtcagaacaatcagacgacgaactccttactttatctagcccccatggaaatgctaatggcgacaaaccccacggggtcaagaagccatcaaaaaaacaacaagagccggcggcaccccccccgcccgaggatgtcgacctgcttggattggaggggagcgcaatgtcaaattcattctctccccccgccgctcctcctaccaattccgagctacttagcgacctctttggcgggggtggagccgcgggtcctacacaggcaggccagtccggagtcgaggacgtgttccacccatcaggtcctgcttctacccagagcactccacgcaggagcgcaactagcacttcggcctccccgaccttgcgggtgggcgagggggccaccttcgatcccttcggcgcaccctccaaaccctccggacaggatctgctgggcagcttcctcaacacctccagtgcaagctcagatcctttcctgcagcctaccagatcccccagtcccacagttcacgcaagcagtacccccgccgtgaacatccagcccgatgtgtctggaggatgggattggcacgccaagccgggtggctttggcatggggtctaagtcagccgcaacaagccccacaggcagcagtcacgggacccccacacaccagtccaagccacaaactttggacccatttgcggatctgggtactctgggatccagctccttcgcctcaaagccgacgacgcccactgggctcggggggggctttccaccgctctcttctccacagaaggcaagtccccagccaatgggaggaggatggcagcagggaggagcctacaattggcaacagccccaacctaagccccagcctagtatgccccattctagtccacaaaaccggccaaactacaacgtgtccttctcagctatgccaggtggtcagaacgagaggggcaaaggttcttcaaacctggagggcaagcagaaagccgccgattttgaggatttgctgagcggtcagggttttaacgcccataaggacaagaaaggaccccgcaccatcgctgagatgaggaaggaggagatggccaaggaaatggaccctgagaaactgaaaatcctcgagtggatcgagggaaaggagagaaatattagggctttgctgtccactatgcacactgtgctctgggcaggagagactaaatggaagccagttgggatggctgacctcgtcaccccagagcaggtgaaaaaagtgtatagaaaagcggtcctcgtagtccatcctgataaggctaccggccaaccttatgagcagtacgctaagatgatcttcatggaactcaacgacgcttggtccgaatttgagaatcaggggcagaagcccctgtattag

SEQ ID NO: 114934 - DNA, 2913 bp, Artificial Sequence
  Description of Artificial Sequence: Synthetic coding sequence
atgagtcttttgggctcttataggaagaaaactagcaatgacggctacgagagcctccagttggtcgatagcaatggagatctctctgcgggaagtggtggagtgggcgggaaacagcgcgttaacgccggggcggcggctcgtagcccggctaggcaaccgccggatcgcgcatccacaatggacagctccggcgcctccagtcctgatatggaaccctcctacggcggcggactgtttgatatggtgaaaggaggggccggtagattgttctccaatctgaaggataatttgaaagacaccttgaaggatacatcgtctagggtgatccaatccgtcacgagttacactaaaggtgaccttgactttacctatgtgacctcccgtatcatagttatgagctttccgttagataacgtcgatatcggcttcagaaatcaggttgatgacataaggtcatttttggacagcaggcacttggaccactatacagtctacaatttaagcccaaagtcatatcgcaccgccaaatttcactctcgggtttctgagtgttcctggccgattcgccaggccccctcattgcacaatctgttcgccgtatgccgaaacatgtataattggctattacagaatccgaagaacgtgtgtgtggttcattgcttagacgggcgggccgcttctagcattctggtaggtgcaatgttcatcttttgcaatctgtacagtactcctgggccagccatacgcctgctgtacgctaagagacccggcatagggctaagtccgagtcatcggcgctacctgggctacatgtgtgatttactggctgataagccgtaccggccccacttcaaacccctaaccattaaatctatcacagtgagccctattccatttttcaataagcagcggaacggctgtcgaccctactgtgacgtactcatcggagagactaagatctattcaacatgtacagatttcgagcgcatgaaggagtatcgcgtgcaagatggcaaaattttcatacccctcaatattacagtgcagggcgacgtcgtcgtgtcaatgtatcacctaagatccacaatcggtagccgcctgcaggccaaagtgacaaatacgcagatttttcaactacagttccacacagggttcatcccccttgacacgaccgtgcttaagttcaccaaaccagagctggatgcatgtgatgtgccagagaagtaccctcagctgtttcaagtgacgctggacgtggagttacagcctcacgacaaggtgatagatctgactccaccatgggaacactactgtaccaaagacgtgaacccctccatactattttcatcccatcaggagcaccaggatacactggctctgggcggccaggcccctatcgacattcctccagataatcctcggcactacggtcaaagcggctttttcgcctcgctgtgttggcaggatcaaaagagtgagaagtctttctgtgaagaagaccatgccgctctcgtgaatcaggagtcagagcaaagcgacgatgaacttctcaccttgtcaagtccacacggcaacgctaatggggacaaaccgcatggggtgaagaaaccatccaaaaaacaacaggagccagctgcaccaccacctcctgaggacgttgatttgttagggctcgaaggctccgccatgtctaactcctttagcccccctgcagcacctccaacaaacagcgaacttctctcagatctgttcggtggtggcggggcagccgggccgacacaggccggtcagagcggggtggaagatgtttttcacccctcggggcctgcatccactcagtcaacaccccggcggtccgcgacctctaccagcgcttctccaactcttcgcgtgggagaaggagccacctttgacccctttggggctccttccaaaccatcaggtcaggacctcctcggctcattcctgaacacgtcctctgcctctagcgatcccttcttacagccaacccggtccccatcacccactgtccacgcaagctcaacaccagccgttaatattcagcccgatgtctcaggcgggtgggactggcacgctaagcccggtggatttggcatgggtagcaaatctgctgcgacctcacctaccggatcatcccatggaacgcccacgcatcagtctaagcctcagactcttgatccttttgccgatctggggaccctgggcagtagtagctttgcttctaagcccaccaccccgactggactgggcggaggtttccctccactgtcttccccacagaaggcttcccctcagccaatgggcggtggctggcaacagggcggcgcgtacaattggcagcagccccagccaaagccgcagccatctatgccgcattcatccccccagaaccgtcctaactataacgtgagtttttctgctatgcctggtggtcagaatgaacgtgggaaaggaagctccaatctggaaggtaaacagaaggcggcagatttcgaagatttattaagcggacaaggattcaacgcccataaggataaaaagggcccccgcaccattgccgagatgcgtaaggaggagatggctaaagaaatggatccagagaaactgaaaattcttgagtggatcgaaggcaaagaacgcaacataagggcactgctctccactatgcatacagttctttgggccggagaaaccaagtggaagcctgtcggcatggctgacttagtgacccctgagcaggtgaagaaggtgtaccgcaaggccgttctggtcgtccatccagataaagctaccggtcaaccgtacgagcagtatgccaagatgattttcatggagctgaatgacgcttggagcgaatttgaaaaccagggacaaaagccgctatactag

SEQ ID NO: 114935 - DNA, 2742 bp, Artificial Sequence
  Description of Artificial Sequence: Synthetic coding sequence
atgaaggattccgagaataagggcgcgagcagtccagatatggaaccatcctatggaggtggcctgttcgacatggtgaaagggggggctgggcgcttgttcagcaacctcaaggacaaccttaaagacacgctgaaggacacctctagccgggtcatccagtctgtcacaagctacacgaaaggggatttggattttacctatgtgacgagtcggattatagtaatgtcattccccttggacaacgtagacatcgggtttagaaatcaggtggacgacatacggagtttcctcgacagccggcacctagatcactacactgtctacaacctgtctcctaaatcgtaccgcacagcaaagttccattctcgcgtctccgaatgctcctggccaatcaggcaggccccgtcactgcataacctgtttgccgtgtgtcggaatatgtacaactggttacttcagaaccctaaaaacgtttgtgtggtgcactgtctggatgggcgcgcagcaagctccatcctcgtaggggctatgtttattttttgtaacttgtactctacccccgggccggcgatacgtctgctgtacgcgaaacggcctggcattgggttgtctccttcgcacaggcgctatcttggttatatgtgcgacttgttagctgataagccgtatagaccccacttcaaacccctgaccatcaagagcatcactgtttcccccatcccttttttcaacaagcagagaaacggctgcaggccttactgcgatgtactcatcggggagacaaaaatatactcaacttgcaccgacttcgaacggatgaaagaatacagagtgcaggacggcaagattttcattccattgaacattactgttcagggagatgtggtagtgagcatgtaccacctgcgctcaaccatcggatcacgcctccaagctaaggttaccaacactcagattttccagctccaattccacacaggctttatccccctcgacaccaccgttctcaagttcaccaagccagagctggacgcctgcgatgttccagagaagtatccgcagcttttccaggtcaccctggatgtggagttacagccacacgacaaggtcattgacctcacccctccttgggagcactactgcactaaggacgtcaatccatccattttattttcctcccatcaggagcatcaggataccctggctctaggcggacaggcacccattgacattccccctgacaatcccaggcactacggacagagtggcttcttcgcatctctgtgttggcaggatcagaagtcggagaaaagtttctgcgaggaggaccacgccgctctcgtaaaccaagagagcgagcagtcagatgatgagctcctaacattgtcctccccacatggcaatgcaaacggagataagccccatggagtcaagaagccgtcaaagaagcaacaggaacctgcagcccctccaccacccgaagatgttgatttgctgggcctcgaaggttccgcaatgagcaacagtttctccccccctgctgcaccaccaacaaacagtgaactgctctctgacctcttcggtggaggaggggcagctggtccaacacaggcaggacagagcggagtggaagacgttttccatccaagcgggccagcgagcacccagagcaccccccgccggagcgcaacaagtacatctgccagtcccacactccgagtcggggagggcgcaaccttcgacccgtttggggcaccaagcaaacccagtggccaggacttactcggatcattcctgaatacctcttccgcttcctccgacccttttttgcaacctaccagatcaccatcaccgacagtgcacgcgtcctctacccctgcggtaaatatacagcctgatgtttccggggggtgggactggcatgccaaaccaggcggttttggaatgggctctaagtccgcagccactagccctactgggagctcccacggtacaccgacgcatcagagcaagcctcagaccctggacccattcgcagatcttggcaccctgggcagttcgtcttttgcttctaagccaacaacacccacagggttgggaggtggcttccctccactgtctagccctcagaaagcctcaccacagccaatgggcggcggttggcagcagggcggagcctataactggcaacaaccacagcccaagccacaaccgtccatgcctcattcctccccacaaaatcggcccaattataacgtatcgttttcggctatgcccggtggtcagaacgaaagggggaaaggatctagcaaccttgaaggcaagcaaaaggcagctgatttcgaagacctcctaagcggccagggcttcaatgcgcataaagataagaagggacccaggacaatagccgaaatgcgcaaggaagaaatggcaaaggagatggacccagaaaagctgaaaatcttggaatggatcgagggaaaggagcggaatatcagagcactgcttagcacgatgcacaccgtcctgtgggcgggtgaaactaaatggaagcctgttggaatggccgatctggtgacaccggagcaggtgaagaaagtgtacagaaaggcggtgctggtcgttcatcccgataaagcaacaggccagccatatgaacagtacgctaagatgatattcatggaactcaacgatgcctggagtgaattcgagaatcagggccagaagcctctgtactag

SEQ ID NO: 114936 - DNA, 783 bp, Artificial Sequence
  Description of Artificial Sequence: Synthetic coding sequence
atgggactgctggacctctgtgaggaggtgttcggaactgcagatctctatcgtgtgcttggggttcgccgcgaggcctccgatggggaagtcaggcgcggctaccataaagtgtccctccaagtgcacccagacagggtgggcgaaggggataaggaagacgccacaagaagattccaaatcctgggcaaggtgtactcagtgctgtccgatagggagcaaagagccgtgtatgacgaacaggggactgtcgacgaagactcgccggtcctcacgcaggatcgcgattgggaggcatattggcgcttgctgttcaagaagatctcactggaggatatacaggccttcgagaagacctataaaggctctgaagaggagctggccgatataaagcaagcatacctggactttaagggcgatatggaccagatcatggagtccgtgctgtgcgtgcagtacacagaagagcccagaattcgcaacattatacaacaagcgatcgatgccggagaagtgcccagctacaacgctttcgtcaaggaaagtaagcaaaaaatgaatgctcgaaagagaagagctcaggaagaggcaaaagaggccgagatgtccagaaaagaattaggcctggatgagggggtggatagcctaaaggctgccattcagagcaggcagaaggaccggcagaaagaaatggataatttccttgctcagatggaagcgaaatactgtaaatcaagcaaaggcggtggaaagaaatctgcgcttaaaaaagaaaaaaagtag

SEQ ID NO: 114937 - DNA, 1029 bp, Artificial Sequence
  Description of Artificial Sequence: Synthetic coding sequence
atgctggaaaattcgctttactcgccgacttgggaggggagtcagttttgggttaccgtccagagaaccgaagcagctgagaggtgcggactgcacggcagttacgttctcagggtcgaggctgaaagactaaccctactgaccgtgggtgcacagagccagatactcgagcccctcctcagttggccctacactctcctgaggcgctacggcagggacaaggttatgttttccttcgaggcgggtaggagatgcccaagcggcccgggaacattcacctttcaaaccgcccagggaaatgacatctttcaagcagtcgaaactgccatccatagacagaaagcccaaggcaaagccggccaaggccatgacgtactgagagcggattcccacgagggtgaggtcgctgaaggaaaactgcccagcccccctggtccacaggagctgctggacagcccccccgccctgtacgccgagcccctggatagccttcgcattgccccttgccctagccaggacagcctctattctgaccctctggattctacctccgctcaggccggcgagggggtgcagagaaaaaagccattgtattgggatttatacgagcatgcccagcagcagttgctgaaggccaagcttactgaccctaaagaggatcccatatatgacgagccagaaggtcttgccccggtccctccgcaaggactgtacgatctgcccagggagccaaaggatgcgtggtggtgccaggcacgcgttaaggaggaaggatatgaactgccatataatcccgctactgacgattacgccgtgccgcccccccgcagtaccaagcctctactagccccaaagccccaggggccggcatttcccgagcctggaactgcaactgggagtgggatcaagagccataactccgccctgtattcccaggttcaaaaatccggcgcatcagggtcatgggattgcggactctcccgggtgggcacagataagactggggtcaagagtgagggatcaacttag

SEQ ID NO: 114938 - DNA, 855 bp, Artificial Sequence
  Description of Artificial Sequence: Synthetic coding sequence
atggagcctggtatgctggggccacacaatttgccccatcatgagcccatctcttttgggatcgatcagattctctccgggcccgagaccccgggagggggcctgggactcgggagagggggtcagggccatggtgaaaacggagcctttagtggcgggtaccatggcgcaagcggttacggacctgcaggctctttggccccgttacccggaagttctggggttggtccggggggagtcatccgcgtcccggcccacagacccctacccgtgcccccgcctgccggcggtgcacccgccgtgcccgggcctagtggcctggggggagccggtggtctggccggtcttaccttcccctggatggactccgggaggagattcgcgaaagaccggctgacagccgctctgtctcccttctcagggactaggcggatcggccacccataccagaatcgtacaccacccaagagaaagaaaccacgcacatcattctctaggtcacaagtcttggagctcgagagaagattcctgcgccaaaagtatctggcgtctgccgagcgcgccgctctggcaaaggctctcaggatgactgacgcccaagtgaagacctggttccagaataggcgcacaaagtggaggaggcagacagcagaggaacgcgaagccgagcggcacagggctggcaggttattgctgcacctgcagcaggacgccctgcctagacccttgcgaccaccactaccaccagatccgctgtgccttcacaatagctccctctttgccttacagaatttacagccatgggcggaggataacaaggttgcctctgtttctgggctcgcatctgtggtctag

SEQ ID NO: 114939 - DNA, 1239 bp, Artificial Sequence
  Description of Artificial Sequence: Synthetic coding sequence
atgggagatggagctgtgaagcaggggtttctatacctgcagcagcagcagacgttcggtaagaagtggcgccggtttggagcttcactgtacggcggcagtgactgtgccctggctagactagaactccaagaaggcccggagaaacctcgccggtgcgaggccgcacggaaggtcatcagattatccgattgtcttcgcgtagccgaggccgggggcgaagcgtcaagtcctagagatactagcgctttcttcctagagaccaaagaaaggttatatctcctggccgctccagctgcggagcggggtgattgggtacaagccatctgtctgctggcctttcccggccagcgtaaagagctttcaggcccggaggggaagcaatcacgtccatgcatggaggaaaatgaactgtatagttctgctgtcacagtcggccctcataaagagttcgcagtgaccatgcgccctactgaagcttccgagcgatgtcacttaagaggctcttatactctgcgcgcgggtgaatctgccctcgaactctggggcggcccagaaccaggaactcagctgtacgactggccttatcgtttcctccgacggttcggtagagacaaagtgactttcagctttgaagctggacggagatgtgtgtcgggcgagggcaattttgagtttgaaacccggcagggcaatgagatcttcctcgcccttgaagaagctatttccgctcagaaaaatgccgccccagcgaccccccagcctcaacccgcaacaatccccgccagcttgccccgcccagacagcccttacagccgacctcacgactccctgcctcccccgtccccaacaacccctgtgcccgcccctaggccccgaggtcaagagggcgagtacgctgtaccatttgacgcggtggcaagatcactggggaaaaactttcgcggcatcttggccgtcccaccgcagctcctggccgatccactctatgatagtatcgaagagacacttcccccacgacctgatcacatttatgatgaacccgagggggttgcggctctttctttgtacgattcaccccaagagcctcggggggaggcttggcggcggcaggccaccgcagaccgggaccccgccggccttcagcacgtacagcctgccggacaagacttttccgcgtccggctggcaacctggcacagagtacgacaacgtcgtcctgaaaaagggcccaaagtag

SEQ ID NO: 114940 - DNA, 777 bp, Artificial Sequence
  Description of Artificial Sequence: Synthetic coding sequence
atgaggcccacggaagcgtccgaaagatgtcatctccgggggagctacactctcagagccggcgagagcgccctggagttgtgggggggccctgaacccgggactcaattatatgactggccatatcgcttcctgaggcggttcggccgagacaaggtcaccttttcattcgaggccgggcgtaggtgcgtgtccggcgagggcaacttcgagttcgagacacgacagggtaatgaaattttcttagccctggaggaggcgatctcggcccagaagaatgccgcacctgccactccccagcctcaaccggcgactattccagctagcctgcctagacccgatagcccttattctaggccacatgactcgcttcctcctccgagccctacaactcccgttcccgcccctagacccaggggtcaagagggtgagtacgccgtgccttttgacgcagtggctcgctcgctaggtaagaacttcagagggatattggcagtccctcctcaattactcgccgatcctctctatgacagcatcgaggagacgctcccaccaaggccagaccatatttatgatgaacccgagggcgtcgctgctctgtcactgtatgacagtccccaggagccaaggggggaagcatggagaaggcaagcaacagcagacagggatcccgcaggccttcaacacgttcaacctgcaggacaggacttttcggcctcgggatggcagccgggcacggaatatgacaacgtagtactgaagaaaggtcccaagtag

SEQ ID NO: 114941 - DNA, 993 bp, Artificial Sequence
  Description of Artificial Sequence: Synthetic coding sequence
atggatccattagaaacccctattaaagacggcatcctttatcagcaacacgttaaattcggcaagaaatgctggagaaaggtgtgggccttgctctacgcaggggggccttccggggttgcaaggttagaaagctgggaggtgagggatgggggtttgggggccgctggagatcgctcagctggacccggaagacgaggagagcggcgcgtcatacgactggcagactgtgtctctgtgctgccagctgacggggagagctgccctagagatactggggcattcctccttactacgacagaacgatcccacctccttgccgcccagcacaggcaggcctggatgggccccatttgccagctggcctttccaggcacaggagaggcttccagtgggtccacagatgcccagagcccaaagagaggacttgtacctatggaagagaactctatctattcttcctggcaggaggtgggagaattccctgttgtcgtgcagagaactgaggctgccacaagatgtcagctcaaaggacctgccctcctggtgctgggccctgatgcaattcagctccgtgaggcaaaggggactcaggctctctacagctggccgtaccatttcctgcgtaaatttgggtctgataagatcttgctcggtaccccaggtgtaagcttacttatttgtaaaggagagcgtaccgatgacgtgtcaggcataatcctcgacgaatcgctgctacgagcgtactccgtgccaggggccggcggacattccagggtgcaagattcattaggcccagtgctccgggaacctacattccagggtgagaggtcctttctgaagactagcatgctgcgatccctactctgttcttgttcatggcgccaccctcgatcccaaccaagaacacaagcgtcctgcctgcaagggtccgactgtccagcacctcatagaaattctacatctgcagcccacaccctgggaacctcttag

SEQ ID NO: 114942 - DNA, 1491 bp, Artificial Sequence
  Description of Artificial Sequence: Synthetic coding sequence
atgaccaggggcgctagactgaggagtgacgcccgagcccagctaaaccagctctcactggatggtgggacgggaagcggtcagaagggtaagtgtgaagaattcccttctagtctcagtagcgtcagccccggactcgaagccgccgccctactgctcgcggtgactatggacccgttggagacgccaatcaaagatggaattttgtaccaacagcatgtcaagtttggtaagaagtgctggcgcaaggtatgggcactgttgtatgccgggggcccatcaggtgtcgctcgtctggaatcatgggaagtgagggacggcggcctgggcgccgcaggggatcgatcagccgggcctggtcggaggggcgagcggcgcgtgatccgcctcgccgactgcgtgagtgtgctgcccgccgacggcgaatcttgtccacgggataccggagcgttccttttaaccacgacagaacgcagtcatctccttgccgcccagcaccgacaggcctggatgggtcccatatgccagttagcatttcccgggacaggcgaggctagctcaggctctactgatgcccagtcccccaaaagaggcctcgtccctatggaggaaaactccatatatagctcttggcaagaagtgggcgaattccctgtcgtggtccaaagaactgaagccgccactcgttgtcagctgaaaggccccgcgctcctggtacttggacctgacgcaattcagctcagggaggcaaaaggcactcaggcactctactcctggccctaccattttttacgcaagttcggctccgacaaaggtgtgttcagtttcgaggcggggaggcgatgccactccggtgaggggctcttcgctttttcaacgccttgcgcacctgatttatgccgggccgttgccggcgcaattgccaggcagagagagaggctgcccgagctgacaaggccccagccctgtccactgcccagagctacaagtttaccttcgttggacacccccggagaattacgcgaaatgcctcccggccctgaaccacccacatcacgaaaaatgcacctggcagaacctggaccccagtccctgcccctgctgctgggaccggagccgaatgacctagcctctggcctgtatgcgagcgtatgcaaaagagccagcggtccgcctggaaacgagcacctctacgaaaatctgtgtgttctggaggccagtcccaccttgcacggcggggagcctgaaccccatgagggaccaggatcgcggtcccccacaactagtcccatctaccacaacggccaggatctttcttggccgggacctgccaacgactctaccctggaagctcagtatcgccgtcttctggagcttgaccaagtggagggcactggcagaccggaccctcaagctggatttaaagcgaaactggtgaccctgctgagtcgagaacggaggaagggacccgcaccttgcgacagaccgtag

SEQ ID NO: 114943 - DNA, 687 bp, Artificial Sequence
  Description of Artificial Sequence: Synthetic coding sequence
atggaccctctcgagacccccataaaggacggcattctgtaccagcagcacgttaagttcggaaagggcaccggggaggccagctcgggctccaccgacgctcagtccccaaaacgcggtcttgttccgatggaggagaacagtatctacagcagctggcaggaagtcggtgagtttcctgtggtggtgcagaggactgaagctgccacaaggtgccagctgaaggggcctgcactgctggtcctggggccagatgccatacagctgagagaagccaagggaacacaagccttatactcctggccttaccacttcctgaggaagtttggatctgacaagatattgcttggcacaccgggagtatcattgttaatttgcaaaggggaacggactgacgatgtttccgggattattctggatgaaagtcttctgcgcgcctactcagtgcccggtgcgggcggccatagccgcgtgcaggactccttgggccccgtgctgcgggaacctacttttcaaggtgaacgatcatttctgaagacaagcatgcttcggtcattattgtgctcgtgttcctggcgtcaccctcggagccagccacggactcaggcctcatgcctccagggttcagattgtccagccccgcatcggaacagcacgtccgccgcccacaccctcggcacctcatag

SEQ ID NO: 114944 - DNA, 435 bp, Artificial Sequence
  Description of Artificial Sequence: Synthetic coding sequence
atggatcccctggaaacacctatcaaagatggcatcctttaccagcaacacgtcaagtttgggaagaaatgctggcgtaaggtgtgggctctgctgtatgcaggggggccaagtggggtcgcgcggctggaaagctgggaggtacgggatggggggcttggtgctgccggagaccgcagcgctgggcccggaaggaggggtgaacggcgggttatcaggttggcagattgtgtgtccgtcctgcctgctgatggggagtcttgtccacgtgatactggtgcattcctcctaacaacaactgaaaggtcgcacctcctcgcagcccagcaccgccaggcctggatgggtccaatctgccagcttgcctttcccgggaccggagaggcatcaagtggttccaccgacgcgcagagcccaaagcgagggctggtctag

SEQ ID NO: 114945 - DNA, 471 bp, Artificial Sequence
  Description of Artificial Sequence: Synthetic coding sequence
atggaccctctcgaaacgccgattaaggacggcatcttgtatcaacagcatgttaaatttggcaaaaagtgttggcgcaaggtctgggctctgttgtacgcgggggggccgagcggagttgctcgccttgagtcctgggaagtgcgagacggcgggcttggtgccgccggcgatcgcagcgccggtcccggcagaagaggtgaacggcgagtcatacgccttgcagattgcgtctccgtgctccccgcagacggggaatcttgtcctcgtgataccggtgcattcctgctgaccacaaccgaacggtcgcacttgctggcggcacagcataggcaggcctggatggggcctatctgtcagctcgcgtttccaggtacaggtgaggcctctagtggatccaccgacgcccagtcccccaaacgcggcctcgtcccaatggaggagaatagtatttactcatcctggcagtag

SEQ ID NO: 114946 - DNA, 132 bp, Artificial Sequence
  Description of Artificial Sequence: Synthetic coding sequence
atggatccactagaaacccctatcaaggatggcatcctttatcagcagcacgtgaagtttggcaaaaagtgctggcgaaaagtgtgggcgttgctgtacgcaggaggcccctccggagtggcacggttgtag

SEQ ID NO: 114947 - DNA, 642 bp, Artificial Sequence
  Description of Artificial Sequence: Synthetic coding sequence
atggaccctctggagacccccattaaagatggaatcctttaccagcaacacgttaagttcgggaagaaatgttggagaaaagtgtgggccttactgtacgcgggtggccctagcggcgtcgcccgcctggaatcctgggaggtgcgggatggtggcctgggcgccgccggagatcggagcgcagggcccgggaggcgaggcgagaggcgcgtgattaggctcgcagattgtgtttcagtgctgccggcagatggggagtcatgccctagggatacaggagcctttctccttacaactacagagagatctcatttactggccgcccagcaccggcaggcttggatggggccgatctgccagctcgcattcccaggaaccggcgaggcttcgtccgggtccacagacgcccagtctcccaaaagaggcttagtgcccatggaagaaaattccatatacagctcctggcaagaagtgggtgaatttcctgttgtggtgcagcgaactgaggctgcaaccaggtgccagcttaaaggccctgcccttctcgtcctgggtccagacgctattcagttgcgagaggccaagggtacccaggccctgtattcatggccataccatttcctcagaaaattcgggtcgtag

SEQ ID NO: 114948 - DNA, 42 bp, Artificial Sequence
  Description of Artificial Sequence: Synthetic coding sequence
atggatcctctcgagactccaatcaaggatggaatattgtag

SEQ ID NO: 114949 - DNA, 258 bp, Artificial Sequence
  Description of Artificial Sequence: Synthetic coding sequence
atggacccgcttgaaacacctattaaagatgggattttgtatcagcagcatgtcaagttcggcaagaagtgctggagaaaggtctgggctctattgtatgccggtggtccctcaggagtcgcccggctagagtcctgggaggttcgcgatggcggcttaggggccgcgggcgatcggagcgcaggcccaggccgccggggcgagagacgagtgatacgcctggctgattgtgtgagcgttctgcccgccgacggctag

SEQ ID NO: 114950 - DNA, 981 bp, Artificial Sequence
  Description of Artificial Sequence: Synthetic coding sequence
atggccactaatttcagcgacattgtgaaacagggctacgttaaaatgaaatctaggaagttagggatctaccgtagatgttggttggtgttccggaagtcctcatcaaaaggcccccagagactcgagaagtaccctgatgagaagagtgtgtgtttgcggggatgtcccaaggtgactgaaatttcgaacgtgaaatgcgtgacacgcttgccaaaagagacaaaacggcaggctgtggcgattatttttaccgatgatagcgctcgtactttcacctgtgattcagaattagaagcagaggaatggtataaaacgctttcagtggagtgcctgggcagtcgcctcaatgacatatctctgggagagcctgacttattggcgcccggagtgcagtgcgaacagaccgacagatttaacgtttttctgctgccttgtccaaatctggatgtatatggagagtgcaagctccagattacgcacgagaatatctacctgtgggacatacataacccccgggttaaattggtgtcttggcctctttgttcgctgcgacggtacggccgggacgccacgcggttcactttcgaggcagggcggatgtgcgacgcaggagaggggctctacacgttccagacccaagagggagaacaaatctatcagcgagttcacagcgcaactctagcaattgccgagcagcacaaacgggtcctattagaaatggaaaagaatgttcggctattgaacaagggtacggaacactactcctacccctgtactcccaccacaatgctgcctcgatccgcctactggcaccatattaccggctctcagaacattgcagaagcgtcgtcctacgcaggggagggatatggagcggcccaggccagctcagaaaccgatctgctgaatcgcttcattttgctgaagccaaaaccgagccaaggcgactcctcagaagccaaaacgccctcccagtag

SEQ ID NO: 114951 - DNA, 921 bp, Artificial Sequence
  Description of Artificial Sequence: Synthetic coding sequence
atggcctcaaattttaatgatatagtgaaacaggggtatgtcaggatccgtagccgcagattaggaatctaccagaggtgctggctggtgttcaaaaaagctagttccaagggcccaaaaaggctggaaaaattcagtgatgagcgcgccgcgtactttagatgttaccacaaggtgacggagctcaacaacgttaagaatgtagcaaggctgcctaaaagcaccaaaaagcacgccatcgggatctattttaacgatgacacaagcaaaaccttcgcctgcgaatccgacctggaagctgacgagtggtgtaaggtgcttcaaatggagtgcgtgggcacaaggattaacgatatatccctgggggaacccgaccttctggctactggagtggagcgtgaacagagtgagcgattcaatgtctatctgatgccctctccgaacctggacgtccatggagagtgcgctctgcagatcacctacgaatacatctgcctgtgggatgtacaaaatcctagggtaaaacttatctcctggccactctccgctctgaggcgttatggaagggatactacgtggtttacgttcgaggccgggaggatgtgtgagaccggtgaggggctattcatcttccaaacacgcgatggagaagccatttatcaaaaggtgcactcagcagctcttgccatcgcagagcaacatgagaggctgttgcagtccgtgaaaaactccatgcttcagatgaaaatgagcgaacgggccgcttctctctctaccatggtcccactgccacggtctgcctattggcagcacatcaccaggcagcatagcaccggccagctctaccgcctgcaagatgtgtccagcccattgaaattgcacaggacggagacgttccccgcctaccggtccgagcattag

SEQ ID NO: 114952 - DNA, 1515 bp, Artificial Sequence
  Description of Artificial Sequence: Synthetic coding sequence
atgaccgaagctgcactggtggagggacaggtaaagttgcgggatggaaagaagtggaaatctcggtggctggtgctaaggaagccctcccccgttgccgattgcctcctgatgctggtgtataaagataagtccgagagaattaaaggactgcgcgaacgctcgagcctgaccctggaggatatatgtggccttgaaccaggactcccctacgagggcctagtgcacaccctggctatcgtgtgcctttcacaggccatcatgctgggttttgacagtcacgaagccatgtgcgcttgggatgcacgaatacggtacgcactgggcgaagtgcatagatttcacgtgaccgtggcaccggggaccaagctcgaatctggtcccgcaaccctgcatctctgtaacgacgtattggtgctcgccagggacatccccccagctgtgaccggtcaatggaagttatcagatctgaggcggtacggggcggtgcccagcggcttcatcttcgagggcggtacacgctgcggctattgggcgggagtcttttttctttcgagcgcggagggggaacaaattagtttcttatttgactgtatagtcagggggatttcgccaacaaagggtcctttcggcctgaggccagtgctacctgatccttctcctccaggaccatcgaccgtcgaagagagagtagctcaggaggccttagagaccctccagctggagaagcgcctgtctcttctgagtcacgccggcaggcccggaagtggtggggatgaccgatccctgagctcaagttcttccgaggcatcccatctcgatgtgtctgcaagttcacgcctgacagcctggcctgaacagagttcgagtagcgcatccactagccaagagggaccccgccctgctgctgctcaggccgccggtgaggcaatggtgggtgccagcagaccaccacctaaaccactgcgccccagacagctgcaggaagttgggcggcagagttcttctgattccggaatcgcaacagggagccactcaagctactcatcatccttgtcaagctacgcgggcagctcactggacgtatggcgcgcaaccgatgagctcggctccttgttgagtctgccagcagctggagctccagagccgagcctgtgtacatgcttacctggaactgtggagtatcaagtccctacttccctgcgggcccactacgacactcctcgatccctgtgcctcgcaccaagagatcattccccaccttctcaggggagccccggcaactctgctgccagggactcgggcggccaaacttcagccggctgcccttctgggtggctgggtaccagacggcggggtctggttatggaggcccctcaaggctctgaagccactctgcctggacccgcgcccggcgagccctgggaagctgggggacctcatgcagggccacctcctgcctttttttcagcttgcccagtctgcgggggactcaaggtcaatccccccccctag

SEQ ID NO: 114953 - DNA, 1827 bp, Artificial Sequence
  Description of Artificial Sequence: Synthetic coding sequence
atgacagaggcggccctcgtggaaggacaggtcaagctaagggacggcaaaaagtggaagagccggtggctggttctccgcaagccctctccagtggcggattgcttacttatgctggtctataaagataaatccgagcgcattaagggtttgcgtgagcgcagttctctcacgcttgaggacatttgtgggcttgagccagggctgccatacgagggtttagtccacactctcgcaatcgtctgcctgagccaggccataatgctgggctttgactcccatgaggcgatgtgtgcttgggatgccaggattcgatacgccttgggagaagtgcacagattccacgtcaccgtggctcccggaaccaaactggagtccggcccagcaactctccacttgtgcaacgatgtattggtgctcgcaagagatatcccacccgctgtgacgggccaatggaaactgtcagacctgcggagatatggggccgtcccttcaggattcatcttcgagggaggcacacggtgcggctactgggccggggtctttttcctaagtagtgcagaaggagagcagatctcatttcttttcgattgcattgttaggggcatttctcccaccaagggaccattcggtcttcggcccgttctgcctgaccccagcccccccgggccatccacagttgaggaaagagtagcgcaggaagctctggagacacttcagctggagaagaggctgtcccttctatctcacgccggccggcccgggagtggtggagatgacaggagccttagctcatcatcatcagaggccagccacctagatgtatctgcatcctcccgtctcactgcctggccagagcagtcatcctcctccgcatccaccagccaagaaggccccaggcctgccgctgctcaagctgcgggcgaggccatggttggtgcctctaggcccccacctaagccgcttagaccccgtcaactccaagaagtaggtagacagagtagcagcgatagtggcattgcgacagggtcccattcatcatacagctcttcactgtcctcatacgccgggtcctcgctcgacgtgtggcgagctactgacgaactcggctctctgctatctctcccagccgctggagcacctgaaccatctctgtgcacgtgtctgccaggaaccgtagaataccaggtgcccacttctctgagggctcactacgatactccaaggagtttgtgtctcgcaccccgggaccactctcccccaagccaaggatcacctggaaacagtgccgccagagacagcggtgggcagacgtcagccggatgtccaagtggctggttagggaccaggaggaggggcctggtaatggaagccccccagggatccgaggccaccttaccagggccagcccccggggaaccctgggaggcaggcgggccccacgctggcccgccaccagctttcttcagcgcctgccccgtctgtggcggtctgaaaggcgcagccgcaagcgcccctggacccgccactgcacatagcggctctcctgggcccgttgccgtggacagccctggccccgagaggccccgcggcgagagtcccacatatgtcaacatacccgttagtccctcttctaggaaacagcttcactatatggggctcgagctgcaggaggcgtcagagggcgtgcgaggtgcaggcgctagtctatatgcccagatcgatattatggcaactgaaacggcccatcgggtaggtgtccggcacgctagggccagggaagaacagctgagcgagcttgagcagagaaaagctgccccacagtag

SEQ ID NO: 114954 - DNA, 768 bp, Artificial Sequence
  Description of Artificial Sequence: Synthetic coding sequence
atgacggaagcagccctggttgagggacaggtgaaacttagagacggaaagaagtggaagagtaggtggcttgtcctccgcaaaccatcacccgtggctgactgtctcttaatgctggtctataaggacaaatccgaacggattaaaggactgagggagaggagctcactcaccctggaagacatttgcggactggagccaggcctgccttatgagggtttagtgcacacccttgctatcgtgtgcctcagtcaagccattatgctggggttcgacagtcacgaggcgatgtgcgcctgggacgcacgaattaggtacgccctgggggaagtgcataggttccatgtcacagtggcacccggcaccaaacttgaaagtggaccggccacgcttcatctgtgtaatgacgtacttgtcctggcgcgggacatccctcccgcggtcacaggccagtggaaactgagcgaccttagacggtatggggccgtgccctcaggcttcatcttcgaaggcggtaccaggggctggcggcttctgcctgtgctgggaaggggcggggcggatcagctgccagttagactgcataggcctaggcatttgccacaccagggtcccctgtgggcggccgcaggctctacgcggcctaagtctcccggaacactcgactgtggtggtgcctgtggcccgggaagtcccggaaatcccactgccggagaggccgctgaaccccctctaacctgcggacaagctgggcagtggaggggctag

SEQ ID NO: 114955 - DNA, 1371 bp, Artificial Sequence
  Description of Artificial Sequence: Synthetic coding sequence
atgggctatttccgttgcgcccgagctggcagcttcggacgccggaggaagatggagccctccaccgccgcccgcgcttgggcgctcttttggctgctcctgcccctgcttggggcggtgtgcgcgagcggacctaggacgctggtgctgttagacaatctaaatgtcagggagacccactcattattctttcgaagcctaaaagataggggtttcgagctgacattcaaaaccgctgatgatccttcgttgtcactcatcaagtacggcgaattcctgtacgacaacttaatcattttcagtccttccgtcgaggactttggtggaaacattaacgtagaaactattagtgcctttatcgatgggggcggttcggtcctcgtcgccgccagcagtgacattggagatccccttagagaactaggttcagagtgtggtattgagtttgacgaggagaagacagccgtgatcgaccaccataactacgatatcagtgacctgggacagcatactctcattgtcgcggacaccgagaatctgttgaaggcccccacaattgttggaaaatcatcacttaatcctattttattccggggtgtgggaatggtggcggaccctgacaatcctttggtactcgatattctcactggtagctcaacttcctattctttcttccccgacaaacctatcacacaatacccacacgccgtgggcaaaaacacccttctcattgccggcctccaggcccgcaacaacgctcgcgttatctttagcgggtcgctcgatttcttttctgatagtttttttaactctgctgtacagaaggcagcgcccggatcacagcggtactctcaaacaggaaattatgagctggcagtggccctgtcacgctgggtgttcaaggaggaaggggtgctccgggttgggcccgtttctcaccacagggtgggtgagaccgcgccccctaacgcatacactgtcaccgacctggtcgagtattccattgtcatccagcagctttctaatggaaagtgggtgcccttcgatggtgacgatatacagttagaatttgttagaatcgaccccttcgttcgcactttccttaaaaagaagggcggtaaatactccgttcagttcaagctgcccgacgtgtacggcgtattccagtttaaagtggactataatagactggggtatacccacctctatagcagcacgcaagtgtccgtcagacctctacaacacacccaatatgagagattcatccctagtgcgtacccttattacgcatcagcctttagtatgatgctgggcttattcatcttcagtatcgtttttctgcacatgaaggagaaagagaagagtgactag

SEQ ID NO: 114956 - DNA, 1260 bp, Artificial Sequence
  Description of Artificial Sequence: Synthetic coding sequence
atgggttacttcaggtgcgcaagggccgggtcgtttggacgccggcggaagatggagccaagcaccgcagcccgagcctgggcactgttttggctccttcttccgctgctgggagctgtttgcgccagtggaccccggactttggtgctcctggataacctcaacgtgagagagacacacagcctgtttttcaggtcactgaaagattttgggggaaacatcaatgtagagacaatttcagcgtttattgatggtggcgggagcgttctggtcgctgcttcgagcgacattggcgatccactcagggagctaggaagtgaatgcggtatagagttcgatgaggaaaaaactgctgttatcgaccaccacaattacgacatttccgatttaggtcagcatacgctcattgtggcagatacagagaatctcctgaaagcacctacaatcgttggaaaaagcagcctgaaccctatactgtttcgtggcgtcgggatggtggcggaccccgataatccgctcgtcctggatatattgaccggcagctcaacctcttacagcttcttccccgataagccaattactcaatacccccacgcggtagggaaaaatactctgttaatagccgggctgcaggccagaaacaatgcacgcgttatattcagtggttctctggatttcttctccgactcttttttcaatagtgccgttcaaaaggccgcgcccggatcccagcggtatagccagaccggcaattacgagctcgctgtcgcactgagtagatgggtgtttaaagaagagggggtgttgagagtggggccggtgtcacaccacagagtcggggaaacagccccacccaatgcatataccgtaacggacctcgttgaatactccatcgtgattcagcagttatcaaatgggaaatgggtgccgttcgatggggacgatattcagctggagttcgtccggatcgatcctttcgtgcgtacttttttaaagaaaaagggcggcaaatactccgttcagtttaagctgccggatgtctatggggtatttcaatttaaggttgattacaaccgactcgggtacacacacttgtattcctcaacacaagtttcggtcagacccctgcaacacactcaatatgagaggttcatcccatccgcctacccttattatgcctcggccttctcaatgatgctgggcctttttatctttagtatcgtcttcctgcacatgaaggaaaaggagaaaagcgactag

SEQ ID NO: 114957 - DNA, 279 bp, Artificial Sequence
  Description of Artificial Sequence: Synthetic coding sequence
atgacgaagctggcccaatggttatgggggctggccatactgggatcaacttgggtagccctcacaacaggtgcattagggctcgagctacctctttcatgccaggaggttctgtggcctctccccgcttacttgctggtgtccgccggctgctatgcgcttggcaccgtggggtaccgggtcgctacatttcacgattgcgaggacgccgcccgcgaactgcagagtcaaattcaagaggcaagagcagatctggcccgccgaggcctcaggttttag

SEQ ID NO: 114958 - DNA, 369 bp, Artificial Sequence
  Description of Artificial Sequence: Synthetic coding sequence
atgcttagtgtgggcggattacgactaagccttgtccggttctcgtttctcctgcttagaggcgctttattaccctctttagccgtcacaatgactaaattggcccagtggctttggggcctggctattctgggctctacgtgggtggccctgaccacaggcgctctcggattagagttgccactgagttgtcaagaggtgttatggccactgcctgcctatctgctggtatccgctggctgttatgcactgggcaccgtagggtatagggttgcgacttttcatgactgtgaggatgctgcgcgcgaattgcagagtcagatacaagaagctcgcgcggacctcgccagaaggggactgagattctag

SEQ ID NO: 114959 - DNA, 279 bp, Artificial Sequence
  Description of Artificial Sequence: Synthetic coding sequence
atgactaagttagcccagtggctctggggcttagcgattctcggtagcacatgggtcgcactgaccaccggagccttgggattagagcttcccttatcgtgtcaggaggtcctgtggcctctgccggcttaccttctcgtttccgctggctgttacgcactcggtaccgtaggttacagagttgctaccttccacgattgtgaagatgccgctcgggaactccagtcgcagatacaggaagctagagcagatctggcacgaaggggtctgcgcttttag

SEQ ID NO: 114960 - DNA, 1191 bp, Artificial Sequence
  Description of Artificial Sequence: Synthetic coding sequence
atggaccccagggggacgaaacgcggtgccgaaaagactgaggtcgcggagccacggaacaaactgcctcggcctgccccgagtctgccgactgaccctgcactgtatagcgggccctttcctttctaccgacggccttcggagttgggctgcttcagcttggatgcacagcggcagtatcacggcgacgctcgcgctcttcgctattatagccccccccccacaaacggtccaggcccaaatttcgacttgcgagacgggtaccctgacagatatcaaccccgcgatgaggaagttcaggagcggctggaccacttactgtgttggctgctggaacacagagggcggctggaggggggacctggctggttggctgaggctatcgtcacttggaggggtcacctaactaaactcctaaccaccccatacgagagacaggaggggtggcaactagccgcatccagatttcaggggactctctacctgagcgaggtggaaaccccgaatgcacgggctcagagactggcccggccacctctgctgcgtgaattgatgtatatgggctacaaattcgagcagtatatgtgcgccgacaagccaggaagtagcccggatccatctggggaggtcaatactaatgtggccttctgctctgtgctgaggtcaaggctggggtcacacccgctgctgtttagtggagaggtggactgtacagatccacaagccccaagcacacagccgccgacatgttatgttgagctaaagacatcaaaggagatgcactcccctgggcaatggaggagcttttacagacacaagttgctgaaatggtgggcccagagttttttgcctggggttccaaacgtcgtcgctggcttccgtaacccagatggttttgtgagttccctgaagacttttccgacaatgaagatgttcgagtatgtccgcaatgatagggacgggtggaatccaagtgtctgcatgaacttctgtgccgcttttcttagcttcgcacagtcgacagtcgtccaggatgatccgcgacttgttcaccttttcagttgggaaccaggtggacctgtgacagtgagtgtacaccaggacgccccttatgctttcctgccgatctggtatgtcgaggccatgacccaggatctgccctcccctcccaaaaccccatccccaaagtag

SEQ ID NO: 114961 - DNA, 1191 bp, Artificial Sequence
  Description of Artificial Sequence: Synthetic coding sequence
atggatccgaggggaacaaagagaggtgccgagaaaacagaggtcgcagagcctagaaacaaactgcctcggccggccccatctcttcctacagaccctgccttgtactctgggccattccctttctatcgacggccgtcagagctcggctgtttttctttggatgcgcagcgacagtaccatggagacgcccgggcccttaggtactactcgccaccacccacgaatggcccgggaccgaactttgatcttcgagacggctaccccgaccgttaccagccccgtgacgaagaagtacaagaaagactggaccacctgctgtgctggttactcgagcaccggggcaggttggaggggggccctggctggctagctgaggcaatagttacctggagaggccacttgactaaactgttgaccacaccctacgagaggcaggagggttggcagcttgccgcctcccggttccaaggaactctgtacctgtccgaggtggagacgccaaacgccagggctcagagactcgcacgtcccccattgctcagggagctcatgtatatgggttacaagtttgaacagtacatgtgcgccgataagcctggcagcagtcccgatccatctggggaggtgaataccaacgtggctttttgttccgtactgagaagcagattagggtctcatccactccttttcagcggtgaggtcgattgcacagatcctcaggcccctagtacacaacctccaacgtgctacgtggagttgaaaacctctaaagaaatgcatagccccggccagtggcggagtttttatagacacaaactccttaaatggtgggcccagtccttcctgcccggagtgcccaacgtcgtggcaggatttcgcaaccctgacggatttgtgagcagcctcaaaactttcccaaccatgaaaatgttcgaatacgtccgtaacgaccgggacggctggaatccttcagtgtgcatgaacttttgtgctgccttcctaagttttgcccaatctactgttgtgcaagatgacccccgtctggtgcatctgttttcctgggagcccggtggaccagttactgtgagtgtgcaccaggacgccccatacgcttttctgccgatttggtatgtggaggccatgacacaggaccttccctcgccccctaagactccatccccgaagtag

SEQ ID NO: 114962 - DNA, 1191 bp, Artificial Sequence
  Description of Artificial Sequence: Synthetic coding sequence
atggaccccaggggaactaaacgaggagcagagaagacagaggtcgctgagcctagaaacaagctcccacgtccagccccaagcttacctacagaccctgccctgtattccggcccatttccattttaccgcagaccctcagaacttggatgtttcagcctggacgcccagcggcagtatcacggcgatgctcgcgctctgcggtattactcaccacctccaacaaatgggccaggccccaacttcgacctgagagatggataccccgatcggtaccaaccccgtgacgaggaagttcaggaacgccttgatcatctcttatgttggttgctcgaacacagggggcgcctggaaggaggccccgggtggctggccgaggccatcgtgacttggagaggacatcttactaaattgttgacaaccccctacgagagacaggagggctggcaactggcagcatccagatttcagggcaccctgtatctgtccgaagtcgaaacacccaatgccagggcgcagcgcctggcccggccaccgttgctccgcgagttgatgtatatggggtataaattcgaacagtatatgtgcgccgataaaccaggatcaagccctgacccgagtggcgaagtgaacacgaacgtggcattttgctccgttctccggtccaggctcgggtcccatcctctgctgtttagcggtgaggtcgattgtaccgatcctcaggcgcccagcacccagcctccaacatgttacgtcgaacttaaaaccagtaaggagatgcactcacccgggcaatggcgtagtttttatcgacataagttgttgaagtggtgggctcaaagctttctgcctggagtccccaacgtggtggctggcttcaggaatcccgacggttttgtgtcctcgttgaaaacgtttcctacaatgaaaatgttcgagtacgtccggaatgaccgggacggatggaacccttcggtgtgcatgaacttctgcgccgcattcctcagttttgcacagtccaccgtggttcaggacgatccacggttggtgcatttgtttagctgggaacccggcggtcccgttaccgtgtcggttcaccaggacgccccttacgctttcttgcccatctggtatgtcgaggccatgacacaggacctcccgtccccaccaaagactccatctcctaagtag

SEQ ID NO: 114963 - DNA, 1191 bp, Artificial Sequence
  Description of Artificial Sequence: Synthetic coding sequence
atggacccgcggggtactaagcgtggcgccgagaagaccgaggtcgcggaaccgcgaaacaaactcccgagaccagctccaagcctgccaactgatcctgcgctctacagcgggccctttccattctacaggcgcccctccgagctaggatgtttcagtctcgatgcgcaaaggcaataccacggggacgctcgggcgttaagatattattcccccccacctaccaacggcccgggtcccaattttgacctccgagatgggtacccagaccggtatcaacctagagacgaggaagtacaagagcgactggaccaccttctgtgctggctcttggaacatcgtggtagactggagggcgggcccggctggctggcagaggccatcgtgacctggcgggggcatctcacaaaactgttaaccacgccatacgagagacaggaaggatggcagttggcagccagcaggtttcagggtaccctttatcttagcgaggttgaaacgcctaatgctcgggcgcagcggctcgctaggccacctctcctgcgggagttgatgtacatgggatataagtttgagcagtacatgtgtgctgacaagccgggttctagtcctgacccttcaggagaagtgaataccaacgtcgcgttctgctccgtgctgaggtccaggcttggctcgcatccactgctgtttagcggtgaagtagactgtacagatccccaggctccctccacccagccaccaacctgctacgtcgagctgaaaaccagtaaggaaatgcattcccctggacaatggcggtcgttctatcgacataaactgctcaaatggtgggcacagtcattcctgcccggtgtcccaaatgtggtggccggcttccgtaatcccgacgggtttgtgtctagtcttaagactttcccaaccatgaaaatgttcgagtatgtgcggaatgaccgcgacgggtggaatccttcagtctgtatgaatttctgtgccgctttcttaagttttgctcagagcaccgtggtgcaggatgacccccggttagtacatcttttcagttgggaacctggtggcccagtgaccgtgtcagttcatcaggacgccccctatgccttcctgccaatatggtacgtggaggctatgacacaggatctgccctccccacccaagaccccgagccctaagtag

SEQ ID NO: 114964 - DNA, 1191 bp, Artificial Sequence
  Description of Artificial Sequence: Synthetic coding sequence
atggatcctagagggactaaaaggggcgccgagaagaccgaggtggccgaaccaagaaataagttacccaggccagccccaagtctcccaactgaccctgctttgtactcagggcctttccctttttatagacggccatccgagctgggctgcttctcactggacgcccagaggcagtaccacggggatgctcgagcactgcggtattattctcccccaccaaccaacgggccgggccccaacttcgatttgagagacgggtatcccgatcggtatcagccccgggatgaggaagtccaagagcgtctggatcacttgctgtgttggctgctggagcatcgtgggaggttggaagggggtccaggatggctggccgaggctatagtgacctggcggggtcacctgacaaagctcctgacaacgccgtacgagaggcaggagggttggcagttagcagcctccagatttcagggtactctgtatctgtcggaagttgaaacacccaatgcccgtgcccaaaggctcgctcggcctcccctgctgcgtgagctgatgtacatgggatacaagttcgagcaatacatgtgcgcagacaagcctgggagctcccccgatccctccggagaggtgaataccaatgttgctttctgttcggtactgcgcagtagattgggatcacatcctcttcttttctcaggggaagtggattgtacagacccgcaagctccgagcacccagcctcctacgtgttacgtcgaactcaagacttctaaggaaatgcattcaccaggacagtggcgctctttttacagacacaagctactcaaatggtgggcccaaagcttccttcccggcgttcctaacgttgttgccggttttcggaatccagacgggttcgtttcatctctcaaaaccttccccactatgaagatgtttgagtatgttcggaatgatcgagacggatggaaccccagtgtctgcatgaacttttgtgccgcttttctgagttttgcccagtcaactgtggttcaggacgatcctcggctggtccaccttttcagctgggagcccggaggccctgtgaccgtctccgtccaccaggatgcaccctatgcctttctgccgatttggtacgtagaggcgatgacccaggacctgccttctccccctaaaacacctagcccaaaatag

SEQ ID NO: 114965 - DNA, 1191 bp, Artificial Sequence
  Description of Artificial Sequence: Synthetic coding sequence
atggatccacggggaactaaacgcggggccgagaagactgaagtcgcagagccaagaaataagttgcctcgccccgccccgtccttgcccaccgatccagctctgtacagcggcccattccccttttatcggcgaccttccgaattggggtgtttctctctggatgcccaacgacagtaccatggggacgcccgtgctctccgatattactcacccccacctacgaatgggcccggccccaattttgatctgcgtgacggttacccagacaggtaccagccgagggatgaagaagtgcaagagcggctcgatcatctgctgtgctggctgctggaacaccggggccggctcgagggcggacccggttggcttgctgaggccatcgtaacctggcggggccatctgaccaagctactcactacaccttacgaaagacaggagggctggcagctagcggcatccaggttccagggaaccctctacctctccgaggtggagacaccaaacgcccgagcccaacgtctcgcccggcctccgcttttgcgggaactgatgtatatgggctacaagttcgagcagtacatgtgcgccgacaagccagggagcagcccagatccatcaggagaggtcaatactaatgtcgcattttgttctgtcctgcggagccgtctgggaagccacccactcctattcagcggagaggttgattgtacagaccctcaggcaccttccactcagccgccaacctgttacgttgagcttaaaacctccaaggagatgcatagtccgggacagtggcggtctttctatcgtcacaagctccttaaatggtgggcccagagttttctgcccggcgtgccgaacgtggttgctgggttcaggaaccccgatggcttcgtgtcctcactcaaaacctttcccaccatgaaaatgtttgagtacgttcgaaatgacagagacggctggaacccatccgtctgtatgaacttttgcgctgcctttctgtcattcgctcagtctacagtggtgcaagacgatccccggctagttcacctgttttcttgggagcccgggggacccgtaacagtcagcgttcatcaggacgccccctatgcctttttacccatttggtacgtggaagcaatgacacaagacctgccatctcctccaaagactccgtctcctaaatag

SEQ ID NO: 114966 - DNA, 1191 bp, Artificial Sequence
  Description of Artificial Sequence: Synthetic coding sequence
atggatccgcgtgggacaaagcggggcgcagagaaaactgaggtggctgagccacgcaataagttgccacggcctgcaccatctctgccaacggacccagctctttacagtgggccattcccgttttaccgccgcccatctgagcttgggtgtttttcattggacgcccagcgccagtatcacggggatgcccgggctctccgctactattccccaccccccactaacggccctggcccgaacttcgatctgagagacggctacccagacagataccagccaagggacgaggaggtccaggagagactggaccatctattgtgttggttgctggagcatcggggtcgactggaaggggggccaggctggctcgctgaggcgattgtaacctggcggggacacctgactaagcttctcactacaccctacgaaaggcaagagggatggcagttagcagctagccgatttcagggcaccctgtacctgtcagaggttgaaacgcccaatgcacgtgcacagaggcttgcgcggcccccacttttgagggagctcatgtatatgggctataagtttgagcagtacatgtgcgctgataaaccgggatcctcacccgatccctccggcgaagtcaacacgaacgttgccttttgtagcgtgctcagatctcggttgggctctcatccactgttgttttccggtgaagtggactgcactgaccctcaggcacccagcacccagcctcctacatgctacgtggaactgaagacgagcaaggaaatgcagagcccgggccagtggcggtccttctaccgacacaaattgttgaaatggtgggcccagtcctttctgcctggagtccctaacgttgttgctgggttccgaaacccagacggatttgtgagcagtctcaaaaccttccctactatgaaaatgttcgaatacgtgaggaatgaccgcgatggctggaacccttctgtgtgcatgaacttctgtgctgcattcttatccttcgcacaatctactgtcgtccaggacgatccgcgattggttcacctcttttcctgggaaccgggggggcctgtcaccgtgagtgtgcatcaggacgccccctacgccttcctgccaatatggtacgtcgaggccatgacacaagacttacctagtcccccgaagaccccatcccccaaatag

SEQ ID NO: 114967 - DNA, 1191 bp, Artificial Sequence
  Description of Artificial Sequence: Synthetic coding sequence
atggatccacgaggaaccaagagaggcgcagaaaaaaccgaagtggccgaaccgcggaataagttaccaagaccagctccctctctgcccacagaccccgcgctgtatagtggcccatttcctttctaccgtcgaccgtcagagctaggctgcttttccctcgacgcacagagacagtaccatggagacgccagggccttaaggtactatagcccaccgccgacaaatggcccagggcctaattttgatttgagggatggatacccggaccgttaccaaccccgcgatgaagaggttcaagaaagactcgaccatctgctttgctggctcctggagcataggggcaggttggagggcggccccgggtggttggcagaggcaatcgtgacatggaggggtcacctgactaagctgctcactactccttacgagcgccaagagggttggcagctcgccgcaagtaggtttcaagggaccctatacctctctgaggtggaaacccccaacgcccgcgcgcagaggctggcgagacctcccctcctgcgggagctgatgtacatgggctacaagttcgaacagtatatgtgcgcggacaagcccggatcttcacccgatccttctggcgaggtgaacacaaacgtagccttctgctctgtactgcgatccaggttgggatcccaccctctgctgttcagtggggaggtcgattgcacagatccgcaggcaccatccacacagccccccacttgctatgttgaattgaagaccagcaaggaaatgcacagtcctggccaatggcgcagcttctaccgccataagcttcttaagtggtgggcccagtccttccttcccggcgtacctaacgtggttgccggattccggaaccctgacggcttcgtgtctagcctgaagaccttcccaaccatgaaaatgtttgagtacgttcgcaatgatagagacgggtggaacccatctgtctgcatgaacttctgcgctgcattcctcagtttcgcacagtcgaccgtggtgcaggacgacccaaggctggttcaccttttttcgtgggaaccaggcggcccagtgaccgtgtccgtgcatcaagatgcgccttacgcttttctgccgatctggtatgtcgaggccatgactcaggacctgccttcccctccaaaaactccgagtccaaaatag

SEQ ID NO: 114968 - DNA, 1191 bp, Artificial Sequence
  Description of Artificial Sequence: Synthetic coding sequence
atggatccgaggggtactaagcgcggggcagagaaaacagaggtggctgagcctcgtaataagctaccacggcctgccccgtccctcccaaccgatcccgccttatatagcgggccgtttcccttctatcgaaggccatccgaattgggctgcttctctctggatgcgcaaaggcagtaccatggggacgcccgagctctgcggtattattctcctccaccaacgaatgggcctggccccaattttgacttgcgcgacgggtaccctgacagataccagcctagagacgaagaggtccaggagcgactggaccatcttctctgttggctgctggagcatcggggcagactggaggggggcccggggtggcttgccgaggccattgttacttggcggggccaccttacaaagctgctcaccacaccttacgagaggcaggaaggatggcagttggccgccagccgcttccaggggacactttatttgtccgaggtggagacacctaatgccagagctcagcggctcgcgagacccccgctcttgcgtgagctcatgtatatgggctacaaatttgaacagtacatgtgtgcagacaagccaggatctagtcccgacccttctggggaagtgaacacgaatgtcgccttttgcagcgtattgagatctcgcctgggctcacacccgcttctctttagcggtgaggtagactgtactgaccctcaggctccgtccacacagccacctacttgctacgtcgaactgaaaacttctaaggaaatgcactcgcccggtcaatggcgtagtttctatagacacaaactcctgaagtggtgggcccaaagtttcctgcctggggtacccaatgtggtggctggattcagaaatcctgacggctttgtgagctccctgaaaaccttccccacgatgaagatgttcgagtatgtcagaaacgatagagacggatggaacccatcagtctgtatgaacttttgtgccgctttcctttcatttgcgcagtcgactgttgtgcaggacgaccctcgcttagtgcatttgttctcttgggagcccggggggcccgtgaccgtttcagtgcaccaggatgcaccatacgcctttctccccatttggtatgtcgaggctatgacgcaggatctgccaagcccccccaaaactccatcacccaagtag

SEQ ID NO: 114969 - DNA, 1191 bp, Artificial Sequence
  Description of Artificial Sequence: Synthetic coding sequence
atggaccctcgagggacaaagcgcggtgccgagaagacagaggtggccgagcccaggaataagcttccaagacccgccccaagccttcccaccgatcctgcactgtacagcggccctttcccgttttacaggaggcccagtgagctgggctgtttcagcctggatgctcagagacagtaccacggggacgcccgggctctacgctactactctcctccgccaacgaacggacctggtccgaatttcgatctgcgggatggctatccagacagataccagccgagggatgaggaagtgcaggagagactggatcacctcctgtgttggctgctggagcatcggggccgattggaaggaggaccaggatggctcgccgaggctatcgtcacatggcgggggcatttgaccaagcttctgacaactccgtatgagcggcaggaggggtggcagttggctgcctcgagattccaaggaaccctctacctgtcagaggtcgaaactcccaatgcacgggctcagcgactggcgagaccacctctgcttcgcgagttaatgtacatgggctacaaattcgagcagtatatgtgcgccgataaacccggatcatctcctgatccgtctggcgaggtgaatacaaacgtagccttctgctctgtgctgcgttctcggctgggctcacaccccctgctgttctcaggcgaagttgactgcactgacccccaagcgccaagcacccagcctccgacctgctacgtggagctcaaaacatcaaaagagatgcactctcccggacagtggaggagtttctataggcacaagttacttaagtggtgggcccaatcgtttctccccggcgtgcctaatgtagtcgcaggcttcaggaaccctgatggatttgtgtcatctctgaagactttccccacaatgaagatgttcgagtatgtgcgtaatgatagagacggttggaatccaagtgtgtgtatgaatttttgtgcggcttttctttcttttgctcagagtacagtggtgcaggacgatccgagactggtacacttgttttcgtgggaacctggcggccctgtcactgtctccgtccaccaagatgccccctatgcgttcctcccaatttggtatgtggaagctatgacccaggacttaccttccccgccaaagactccctctccgaagtag

SEQ ID NO: 114970 - DNA, 1191 bp, Artificial Sequence
  Description of Artificial Sequence: Synthetic coding sequence
atggacccccgaggtacaaagaggggggccgagaaaacagaggtggcagaaccaagaaataaactgccaagaccagccccaagcctccctaccgatcccgcgctttactctggccctttccccttctacagaagaccatcggagctaggctgcttctccctagacgctcaacggcagtatcacggggacgctcgcgctctcagatattatagtcccccccccaccaatgggccagggccgaacttcgatttacgtgatggctatccggatcgctaccaacctagagacgaagaggttcaagaaaggctggatcatttgctgtgctggctcctggagcaccgcggccgactggagggcggacctggctggcttgctgaggctattgtgacatggcggggtcatttaactaagttgctcacaaccccatacgagaggcaggaagggtggcagttggctgcgagccgattccagggcaccctatacctgtccgaagttgagacccccaacgcccgggcccagcggctggcaaggccacccctcctgcgcgaacttatgtacatgggctataagtttgaacagtacatgtgtgctgataagcccgggtcctcgcctgatcctagcggagaggtcaacactaatgtggctttctgttcggtgctgcgatcacgactaggctcccacccactgttgttttctggagaagtagactgcacagacccacaggccccttctactcagccccctacatgttatgtcgaactgaagactagcaaggaaatgcattcccctggccagtggcgttcattttaccgacataagctgctgaaatggtgggctcagtctttcctgcctggcgttccaaacgtggtggctggctttagaaatccggacgggttcgtcagttcattgaagacatttcctactatgaaaatgttcgagtacgtccgcaacgacagagatggctggaacccaagtgtctgcatgaacttctgtgctgcttttcttagtttcgcacagtctacagttgtgcaggacgacccgcgcctggtgcacctatttagctgggagcctggagggccagtcacagtatccgtgcaccaagatgccccttatgccttcctacctatctggtatgtggaggcaatgacccaagatctgccgtcaccacctaagacaccctctccaaagtag

SEQ ID NO: 114971 - DNA, 1191 bp, Artificial Sequence
  Description of Artificial Sequence: Synthetic coding sequence
atggacccgcggggcacaaagcgcggagcagaaaagaccgaggtggcagaacctcgcaataaactgcctaggccggctccttctctgcctactgatcccgctctctacagcgggcccttcccattttaccgcagacctagcgaactcggctgtttttcactcgatgcgcaaaggcagtaccatggagatgccagggcactgcgctactacagccctcccccgaccaatgggcccggccccaactttgatctgcgggatggataccccgaccgctaccagcctcgagacgaagaggttcaagagcggctggaccacctcttgtgctggctccttgaacaccgggggcgcttggaggggggacccggctggctggcagaagccatcgtcacatggagaggacaccttaccaagctactgacaacaccatatgagcggcaagagggctggcaactcgccgcctccaggttccagggaaccctttacctgtcagaagtagagacccctaatgccagggcccagcgcctggcccgcccaccacttctgcgagaactgatgtacatgggatataaattcgagcaatatatgtgcgcggacaagcctggcagcagccctgacccatctggagaggtgaatacgaacgtcgcattttgttcagtactgcggagcagattggggtcacaccccctgctgtttagtggcgaggttgactgtaccgacccccaggctcctagtactcagccccccacttgctacgtggaactgaaaacttccaaagagatgcaaagccccggacagtggcgcagtttctaccgccacaaattgctgaagtggtgggctcagtccttccttccgggtgttcccaacgtcgtggccgggttccgcaacccagacggtttcgtgagcagtctaaagaccttcccgaccatgaagatgtttgaatacgtgcgcaacgatagggatgggtggaacccatctgtgtgcatgaatttctgtgccgcttttctgtcctttgctcagagcaccgttgtacaggacgacccaaggcttgtccacctgttctcctgggagccgggtgggccagtgaccgtgagtgtccatcaggatgctccttatgcgttcttgcccatttggtacgtggaagccatgactcaagacctgccatcccctccaaaaactccaagtcccaagtag

SEQ ID NO: 114972 - DNA, 1191 bp, Artificial Sequence
  Description of Artificial Sequence: Synthetic coding sequence
atggatccgcggggcactaaacggggcgcagagaagacagaggtggccgagccacggaataaactccctcgtcctgccccatctctgccaacggacccagccttatatagtggcccctttcccttttacagacggcctagtgaattgggatgtttttcactggacgctcagcgtcaataccacggcgacgcaagggcactaagatactacagccctccccccaccaatggacccggccccaactttgacctcagagacgggtatccggatcgttaccaaccgagagatgaggaggtgcaagaaaggctggatcacctgttgtgctggctcctagagcataggggccggctggagggggggccaggttggcttgcagaagccatcgttacctggaggggacatctgacgaaactgctaacaactccatacgagcgccaggaagggtggcagcttgcagccagtcgctttcagggaacattgtatctcagcgaagtcgagactcctaacgccagggcccagcgactggcccggcccccattgctccgagagcttatgtacatggggtacaaattcgagcaatacatgtgcgccgacaaacctggatcctcccctgatccttccggggaggtgaataccaatgtggcattttgcagcgtgttgcgctcgagactcggcagccatcctttgctattcagcggtgaggtggattgtacagatccacaggctcctagtacccagccgcccacatgctacgtggagctgaagactagtaaggagatgcacagccccggccaatggagatctttctaccggcacaaactgctcaagtggtgggcccaaagtttcctgcccggcgtgccaaacgtcgtcgctggatttaggaatcctgatggctttgtgtcaagcctcaaaacattccccacaatgaaaatgtttgaatacgtccgcaacgatagagacgggtggaatccgtcagtgtgcatgaacttttgtgcagcctttctttcgttcgctcagagcaccgtggtccaggacgacccccgcctcgtgcatctgtttagttgggagcccggtggccccgtcacagtctcggtgcaccaggacgcaccctacgcctttcttcccatttggtacgtggaggccatgacccaggaccttcctagcccaccaaagactccaagcccaaaatag

SEQ ID NO: 114973 - DNA, 1191 bp, Artificial Sequence
  Description of Artificial Sequence: Synthetic coding sequence
atggacccgagggggaccaagcgaggagcagagaaaactgaagtcgccgagcctcgtaacaagctgccgcggcccgcaccaagcctccctacggaccccgctctatacagtggccccttcccattctaccgtagaccgagtgaacttgggtgctttagtctcgacgcgcagaggcagtatcatggcgacgccagagccctgagatattatagtccacctccaaccaatggccccgggcctaactttgacttgagggatggatacccagataggtatcaaccacgggatgaggaagtgcaagagcggctggatcacctcctttgctggttgctggagcataggggccgactggaaggggggcctggttggctggcagaagccattgtgacttggagagggcacttgacgaaactgctgactacgccatacgaacgtcaagaaggttggcagctggccgccagccggtttcaggggactctgtacctttcagaggttgagacaccaaacgccagggcccaaaggctggcgcggccacccctgcttagagaactgatgtatatggggtataagttcgagcagtatatgtgcgccgacaagccaggttcttccccggacccatccggcgaggtaaacactaacgtagctttctgttcggtcctccgatccagacttggctcacatccacttctctttagcggtgaagtggattgcactgatcctcaggccccgagtacgcagccgccgacctgttacgttgaattgaagacatccaaagagatgcactcccctggccaatggaggtcattctacagacacaagctgctgaagtggtgggcgcaaagctttctgccgggagtgcctaacgtcgtcgcggggtttcggaatccagatgggttcgttagcagcttgaaaacattccctacaatgaaaatgtttgaatacgtgagaaatgatagggatggttggaaccccagcgtgtgtatgaacttctgtgcggcgttcctgagctttgcccaatcaactgtggtccaggatgaccctaggttagtgcacctgttcagctgggaaccaggcggacctgtgactgtatcagtgcatcaagacgccccctatgcattcctcccaatttggtatgtcgaggccatgacgcaggatctgccctcccctccaaaaacgccgtcccccaaatag

SEQ ID NO: 114974 - DNA, 1191 bp, Artificial Sequence
  Description of Artificial Sequence: Synthetic coding sequence
atggatcccaggggcacaaagcgcggcgcggagaagacagaagtggcagaacccagaaataaactaccacgccccgcacccagcctccccacagatcctgccttgtatagtggtccgttccctttctatcgacgccccagcgaactcgggtgtttctcactggacgctcagcgtcagtatcatggggacgcccgggctctgagatactacagccctccaccaacaaacggcccagggcccaatttcgacctccgcgacggttacccagatcggtaccagccaagggatgaggaagtgcaggagcgccttgatcatctcctctgctggctcctcgagcataggggacgcttggagggaggtccaggatggctcgccgaggccattgtaacttggaggggccaccttaccaagttgttgaccacgccctacgagcgacaggaaggatggcagcttgctgccagtcggttccaaggcacgctttatcttagcgaagtggaaacgccgaatgcccgggcacagcgactcgcaagaccaccactgctgagggaacttatgtacatgggttataagtttgagcagtacatgtgtgcagataaacccggtagcagtccggatcctagcggagaagttaacacaaatgtggctttctgcagcgtcttacgctccagattaggctcacatcccctgctgttttctggggaggtggactgcaccgacccacaggcccccagcactcagccaccgacctgctatgttgagctgaagacctcaaaagagatgcactcaccaggacagtggcgtagtttctacaggcacaagctgctgaagtggtgggcccagtcgtttctgccaggagtccctaacgtggtcgccgggtttaggaatcctgacggttttgtgtccagccttaaaacttttcctaccatgaaaatgtttgagtacgtgagaaacgacagggacggatggaacccctctgtctgcatgaacttttgcgccgccttcctgagctttgcccaatctacagttgtgcaggacgaccccaggctcgtgcatttgttctcctgggaacccggcgggcctgtcaccgtgtccgtacaccaggatgctccctatgctttcttgccaatttggtacgttgaagctatgactcaggatcttccatcacccccaaagaccccgtctcccaagtag

SEQ ID NO: 114975 - DNA, 1191 bp, Artificial Sequence
  Description of Artificial Sequence: Synthetic coding sequence
atggaccctcggggcacgaaacggggtgccgaaaaaactgaagtggcagagcctagaaacaagttaccgcgacccgctccgagcttgcccacggatcccgccctgtacagcggacctttcccattttataggagaccctcagaattgggatgttttagcctcgatgcacaaaggcagtatcatggggatgcccgtgccctcaggtattatagccctccacctactaatggcccgggacctaatttcgacctgcgggacggataccccgaccgctaccagcctcgtgacgaggaggtccaagaacggctggaccacctgctttgttggctgctggagcatcggggccgactggagggaggaccgggatggttggctgaggctattgtcacctggcggggccatcttactaagttgctgactactccatacgaaaggcaggaggggtggcagcttgccgcgtctcggtttcagggcaccctgtacctgtctgaggtggagacccccaatgccagggcgcagaggcttgccaggcccccgcttctccgcgagcttatgtatatggggtacaagtttgagcagtacatgtgtgccgacaagccggggagcagcccagatccatctggggaagtgaacactaatgtggccttctgcagcgtgttgagatctagattaggctcacaccccctgctgttttccggcgaggtggactgtactgacccccaggcccctagcacccagcccccaacctgctacgtggagctgaagactagcaaagagatgcacagcccgggccagtggagatctttctatagacacaagctcctgaagtggtgggcccagtcttttctgccaggcgtccccaatgttgtcgccgggttccggaatcctgacgggttcgtcagcagtttgaaaaccttccctacaatgaaaatgtttgagtacgtccggaatgaccgggacggatggaatcccagcgtgtgtatgaatttctgtgctgctttcttgtccttcgcacagtcaacagtggtccaggatgacccgcggctggtgcaccttttttcctgggagccaggaggccctgttaccgtctctgtccatcaggacgctccctacgccttcttaccgatctggtacgtcgaggcgatgacccaggatcttccaagcccacccaagactccaagcccaaagtag

SEQ ID NO: 114976 - DNA, 1191 bp, Artificial Sequence
  Description of Artificial Sequence: Synthetic coding sequence
atggacccccgcgggaccaagcgtggcgccgagaaaaccgaggtggcagagcctcggaacaagctccccaggccagcaccgtccctgccaaccgatccggccctctactccggacccttccctttctaccggaggcccagtgagcttgggtgttttagcctggatgcccagcgacagtaccacggtgacgctagggccctgagatactacagtcccccacccactaatgggcccggccccaattttgacttacgagacggatatccagaccgttatcagcctagagatgaagaggtgcaggaaagattggaccacctcctctgctggctcctggagcaccgaggccgtctggagggaggccccggatggctggccgaggccatcgttacctggcgtgggcacttgaccaaactcctcactactccttacgagcgccaagagggctggcagctggccgcttctcgatttcagggtactctgtatctgtccgaggttgagacccctaatgccagggctcaacggttggctcgacccccacttctgagagagctcatgtatatgggatataagttcgaacagtatatgtgcgctgataagcctggatcttcacctgatcccagtggggaagtgaacactaacgtggccttttgcagcgtgttaaggtccaggctcggtagccatccattattgtttagcggagaggtcgattgcaccgacccacaagcccccagtacccagcctcccacgtgctatgtggagctcaagacatcaaaggagatgcactccccaggccagtggcggagcttctatagacacaagctgctgaagtggtgggcccagagtttcctgcctggagtgcctaacgttgtggccggcttccggaaccccgacggctttgtcagttctctgaagaccttccctacaatgaagatgtttgaatacgtgaggaacgatcgcgatggttggaatcccagcgtctgcatgaacttttgcgccgcctttctgagcttcgcccagagtaccgtcgtgcaggacgaccctcgattagtgcacctgttctcctgggaacccggggggcccgttactgtttctgtgcatcaggacgcaccatacgcctttctgcctatctggtatgtagaggccatgacacaggaccttccttctccccctaaaaccccttctcctaaatag

SEQ ID NO: 114977 - DNA, 1191 bp, Artificial Sequence
  Description of Artificial Sequence: Synthetic coding sequence
atggacccgcggggaacaaaacgcggtgcagagaagactgaggttgctgaaccccgaaataagctacctaggcccgctccctcactcccaacagaccccgccctatactctggcccattccccttctatcgcaggccctctgaacttggttgcttctcactagacgcccagagacagtaccacggcgatgcgcgggctctgcgctattattctcctccacctacgaacgggccgggcccaaattttgatctgagagatggataccccgatcggtaccaacctcgggatgaggaggtgcaggagagactcgatcacctgttgtgttggctgctcgaacataggggacggcttgaggggggcccaggttggctcgccgaggcaatcgtgacctggcgcggtcatctgacaaagcttttgacaaccccatacgagagacaagaaggatggcagcttgccgcctccaggttccagggaacgttatacctgtctgaggtcgagacacctaacgcacgtgcccaaaggctggcacgccccccgctcctgcgagaactgatgtacatgggatacaagttcgagcagtatatgtgtgccgacaagccgggctcgtccccagacccttctggagaagttaatacaaatgtggctttttgtagtgtgctgcgctctaggcttggctcccatccgctgcttttctccggcgaggtggactgcactgacccccaggccccaagcactcagcccccaacctgttacgtggagcttaagaccagcaaggagatgcagtccccgggccagtggagaagtttctatcgccataaactgctgaaatggtgggcacagagctttctgcctggagtccccaatgtggtggctggctttaggaaccccgatgggttcgtgagctccctgaaaacctttcccaccatgaagatgtttgaatatgtcagaaacgaccgggatggatggaacccatccgtgtgtatgaatttctgcgccgcctttctgtcttttgcccagtcgacagtcgtacaggatgacccccgcctggtccaccttttcagctgggagcctgggggacccgtcaccgtgagcgtacaccaagacgcgccatatgcgttcctaccaatctggtacgtggaagcaatgactcaggatttgccctcaccacccaaaaccccttcacccaaatag

SEQ ID NO: 114978 - DNA, 1443 bp, Artificial Sequence
  Description of Artificial Sequence: Synthetic coding sequence
atgaacgcctccgaattccgacggagaggtaaagagatggtggactacatggccaattatatggaagggatcgaagggcgccaggtgtatcccgatgtggagcctggctatctgaggcccttaataccggcagcagcaccccaggaacctgacacctttgaggacatcatcaacgacgtggaaaagatcatcatgcctggggtgacccactggcatagcccatacttctttgcttactttccgactgccagttcgtatcccgcgatgctggctgacatgctgtgtggggcaatcgggtgtatcggctttagctgggcggccagtcccgcgtgcacagaactggaaacagttatgatggattggttggggaaaatgttagagctgcctaaggccttcctcaacgagaaggcaggggaaggaggcggtgtgatacagggctccgctagcgaggccacgctcgtagccttgctcgcagctagaacgaaagttattcatcgcctgcaagcagcctcccctgagctaacccaggccgccatcatggaaaagctagttgcatattctagtgatcaggctcactcttcggtcgaacgggccggactcataggcggtgtgaagcttaaggcgataccatcggacggaaactttgccatgagggcaagcgcattgcaagaggccttggagcgggacaaagccgcgggcctgattccattttttatggtcgccaccctgggtactaccacttgttgctctttcgacaatcttcttgaagtggggccaatttgcaataaggaagacatctggctgcatgtggacgccgcctatgccggtagcgctttcatatgccctgagtttcgtcaccttctgaacggagtcgaatttgctgacagttttaatttcaacccacacaagtggctgttagtgaatttcgattgctccgctatgtgggtgaaaaagagaaccgatctaactggagccttccggctggatcctacctacctcaaacactctcaccaggatagtggactgatcaccgactatcggcactggcaaatcccccttgggcggcggtttcggagcctaaagatgtggttcgttttccgcatgtatggtgttaaggggctgcaggcatatattagaaaacatgtccagctgtctcacgaatttgagtccttagtcaggcaggaccccaggttcgagatctgtgtagaagtgatccttggccttgtctgttttcggctgaagggatctaacaaagtaaacgaagctctattgcagcggattaactctgccaaaaagattcatctcgtgccctgccacctgcgcgataagttcgtgttacggttcgccatctgctcccgtactgttgagtctgcgcatgtccagagagcttgggagcacataaaagaacttgcagctgatgtcttgagagctgagcgagagtag

SEQ ID NO: 114979 - DNA, 96 bp, Artificial Sequence
  Description of Artificial Sequence: Synthetic coding sequence
atgaacgctagtgagtttcggaggaggggcaaggagatggtggactatatggctaactacatggagggcatagaggggcggcaggtctatccgtag

SEQ ID NO: 114980 - DNA, 51 bp, Artificial Sequence
  Description of Artificial Sequence: Synthetic coding sequence
atgaacgcgagcgagtttaggagacgaggtaaggaaatggtggattactag

SEQ ID NO: 114981 - DNA, 1443 bp, Artificial Sequence
  Description of Artificial Sequence: Synthetic coding sequence
atgaatgcttctgaattccggaggagaggcaaggagatggttgactatatggccaactatatggagggtattgagggccggcaggtctaccctgacgtggagccaggctatctccgtcctctaattccagctgccgccccccaggaaccagacacattcgaggacatcattaacgatgtggagaagatcattatgccaggagtcacccactggcatagtccatactttttcgcttacttccccacagcctcatcttaccctgcaatgctagccgatatgctttgtggagccattggatgcatcgggtttagctgggctgcctctccagcgtgtaccgaattggagactgtgatgatggactggctgggaaagatgttagagcttccaaaagctttcctgaacgaaaaggcgggggaaggcgggggagttatccagggtagtgcatccgaggctactctggttgccctcttagctgcacgtactaaagtcatacatcggctgcaggcagcgtcacccgaattaacgcaggccgcaatcatggagaagttggttgcgtatagttccgatcaagcgcattcatccgtggagagagctgggctcatcggtggcgtcaaactgaaagcgatacctagcgatgggaatttcgctatgcgtgcatctgcactgcaagaggcactggaacgggacaaagctgctggcttgataccttttttcatggtggccacattgggaacaaccacgtgttgctccttcgataacctgctggaggtaggacctatatgtaacaaagaggatatctggctgcacgtggatgctgcctacgccgggtccgcatttatttgtccagagttccggcatctcctcaatggcgtggagttcgcagattccttcaactttaatccacataagtggttgttggtgaattttgattgcagcgcaatgtgggtcaagaagcgcactgacctgacaggagcatttagactggatcctacttatctaaagcactcccatcaggattctggactcataactgattaccggcactggcagatccctcttggacgtcggttccgatccttaaagatgtggtttgttttccgcatgtatggcgtcaaagggcttcaggcttatattaggaagcacgtgcagctctctcacgagttcgagagccttgtgaggcaggatccccggttcgaaatatgtgtggaggtgatactgggattagtgtgctttaggctcaagggttcaaataaagtcaacgaggctctgcttcagcgtattaacagcgcaaaaaaaatccacctcgttccatgccacctgcgcgacaagtttgtgctgcgttttgccatttgtagccggactgtcgagtctgcacatgtacagcgggcgtgggagcatatcaaagaacttgctgctgacgttctgcgggctgaacgcgaatag

SEQ ID NO: 114982 - DNA, 1017 bp, Artificial Sequence
  Description of Artificial Sequence: Synthetic coding sequence
atgaatgcttccgaattccgccgaagaggaaaagaaatggtcgactacatggccaactacatggaagggatagaggggcggcaagtgtaccctgatgttgagccaggataccttcgcccgctgatcccagccgcagccccacaggagccagacactttcgaagacatcatcaatgatgtcgaaaaaatcatcatgcccggcgtaacacattggcattctccctacttcttcgcctactttcctactgcatccagctaccctgccatgttagccgacatgctttgcggagctattggttgcatcggcttttcgtgggcagctagtcctgcctgcactgagttagaaaccgtcatgatggactggctgggcaagatgttggagctacctaaagcttttctgaatgagaaggctggagaaggcgggggcgtgatacagggctccgcctcagaagctaccctggtggccctgttggccgcacgaaccaaggtcattcatcgcctacaggccgccagtcctgaattaacccaggccgcaatcatggagaagctcgttgcttattcatctgatcaggctcacagctccgtcgaacgggctgggcttattggcggcgtcaagctgaaagcgatcccctctgatggcaatttcgctatgagggcctctgccctgcaggaggcactcgaaagagataaggctgccgggctcataccctttttcatggttgccacattaggcacaactacttgctgctcctttgataatttgttagaggtcggacccatttgtaataaagaggatatttggttacacgtggatgctgcatacgccggatctgcctttatttgtccagaatttcgtcatctgttgaacggtgtggagtttgcggactctttcaatttcaatccccataagtggctcctagtgaacttcgattgtagtgcaatgtggtcccggcagccagtgagaatgctgcgtctaaagaagacctgcctggtgagtgcagtcgtccgccggtcctag

SEQ ID NO: 114983 - DNA, 1209 bp, Artificial Sequence
  Description of Artificial Sequence: Synthetic coding sequence
atgaacgcaagcgagtttaggagaaggggtaaagagatggttgattacatggccaattatatggaaggaattgaggggagacaagtataccctgatgtggaaccgggctacctgcgtccgctcatcccggcagccgcccctcaggagcccgatactttcgaggacattatcaatgatgtggagaagatcattatgcctgggggatctgcctcggaagccacccttgtggcactcttagcggccaggaccaaggtgatacacagacttcaggcagcttcccccgagttgacacaggccgctataatggagaaacttgttgcttactcctccgatcaggcccacagtagcgtcgaacgggcaggcctcataggaggtgttaaactgaaggctattccctctgacggcaactttgccatgcgcgctagcgctctgcaggaggctcttgaaagggacaaggcggccgggttgattcccttcttcatggtcgctaccctggggacaaccacttgttgttccttcgataatctattagaggtaggcccgatatgtaataaagaagatatctggctccacgtggacgccgcgtatgcgggctctgccttcatctgcccagagttcaggcacctgctgaacggagtggagtttgcggattctttcaatttcaaccctcataaatggcttctagtgaacttcgattgctccgcgatgtgggtgaaaaaaaggacagacttgaccggcgcctttcgactggacccaacatatctgaagcattcccaccaagatagcggcctgatcacagattacaggcactggcagatccccctggggcgccgatttagaagcttgaaaatgtggtttgtgttcaggatgtatggagtgaaaggactgcaggcctatattaggaagcatgtccaactgtcccacgagtttgagtctctggtgagacaagatccacgatttgagatctgtgtggaagtgatcctggggttagtgtgttttcgacttaaagggtccaataaagttaacgaagcactcctccagaggatcaatagcgccaaaaagatccatttagttccctgtcatttgagggacaaattcgtcctacgctttgcaatctgcagtagaacagtggagtcagcgcacgtgcagcgggcctgggaacacataaaagagctggcggcagacgttctgagagcagagcgggaatag

SEQ ID NO: 114984 - DNA, 1164 bp, Artificial Sequence
  Description of Artificial Sequence: Synthetic coding sequence
atgaatgcgagcgaattccgccgcaggggcaaggagatggtggactacatggctaactacatggagggcatcgagggccgtcaagtttacccagatgtggaaccaggttacctaaggcctttaattccggcagccgcaccccaggaacccgacaccttcgaggacattatcaatgacgttgagaaaatcattatgcccggagtaacacactggcactcaccttacttttttgcctacttccctaccgcctcctcctaccccgccatgttagctgacatgctgtgtggcgccatcggctgcattggattttcttgggcagcctccccagcatgcacagagctagagaccgtaatgatggattggctggggaaaatgttggaacttcctaaggcctttctcaacgagaaggccggtgaggggggcggtgttatccagatggttgccaccctggggactacaacatgctgcagctttgacaatctgctcgaggtgggccccatctgtaataaggaagatatttggctgcatgtggacgccgcctacgctggaagtgccttcatatgccccgagttccgtcacctgctgaatggagtagagttcgcagactcatttaattttaatccacataagtggctgttggtcaactttgactgctccgccatgtgggtgaagaagcgcacagacctcaccggagcctttagactagacccaacatatctcaaacacagccatcaagactctggcctgatcactgattataggcactggcagatccccctcggacggaggttcagatcactaaagatgtggtttgtgtttcgcatgtatggcgttaagggtttgcaggcctacatcagaaagcatgtgcagctgtcccatgagtttgagtctctggttcggcaggaccccagattcgagatttgtgtcgaggtcatcctggggctagtgtgcttcagattgaagggtagcaacaaagtgaacgaggctctcctgcaaagaataaactcagctaaaaaaattcatttagtcccttgtcatttaagggacaaattcgtgctgcggtttgctatctgttcgcgcaccgtggaatccgcacacgtgcagagggcatgggagcatatcaaagagctggctgccgacgtactgcgcgccgagagagagtag

SEQ ID NO: 114985 - DNA, 735 bp, Artificial Sequence
  Description of Artificial Sequence: Synthetic coding sequence
atgcgggaggccgccttcatgtattccactgctgttgctatcttcttagtcatcctggttgcggcactacagggatccgccccaagggaatctcctttgccttaccatattccgctagaccctgagggtagtctggaattgtcatggaacgtgagttacactcaggaggctatccatttccaactacttgtgaggcgacttaaggctggtgtgctgttcggtatgtctgacaggggcgagctagaaaacgccgacctggtagtgctgtggaccgatggcgacactgcctacttcgctgacggcacagttcatctggtgtacggcatcctcgaagagcctttcagatcacttgaggctattaacgggtccggcctccagatgggactgcagagggttcagctgctgaaacccaacattccggagccagaactgcccagcgatgcctgtacaatggaagtgcaggcacctaatatccagattccctcccaggaaaccacatactggtgttatatcaaggagctccccaaaggcttctcacgccaccacatcatcaaatatgaacctattgtcaccaaggggaacgaggccctcgtccaccatatggaggtgtttcagtgtgcacccgagatggattctgtgcctcattttagtggtccgtgcgactctaaaatgaaacctgacaggcttaattactgtagacatgtgctggctgcctgggccctgggggccaagtag

SEQ ID NO: 114986 - DNA, 1854 bp, Artificial Sequence
  Description of Artificial Sequence: Synthetic coding sequence
atgcccgctctgtctcggtgggcttcacttccggggccatcaatgcgcgaggctgcatttatgtattccacagcagtcgctatattcctggttatcctcgtggcagctctccaaggtagcgcaccccgcgaaagccccctcccttatcatatcccactggaccccgagggttccctagagctgagctggaatgtctcctacacacaggaagcaatccactttcagctacttgttcggcggcttaaggccggggtgctgttcggcatgtccgataggggggagctggagaatgctgacctggtagtgctctggacagatggagatactgcttactttgcagacgcctggagcgatcagaagggtcaaatccacctggatccccagcaggattaccagctgctccaagtgcagagaactcccgagggactgactttgctgttcaaaagaccatttggtacttgcgaccctaaggactacctgatagaagatggcactgttcacctggtgtatggtatcctcgaggaacctttcagatcgcttgaagctatcaatggctctggcctgcagatgggtcttcagcgagtgcaattgctgaagccgaatatacccgagcctgagcttccaagtgatgcatgtaccatggaggtccaagcgcccaacatccagataccatcccaggaaaccacttactggtgctacattaaggagctcccaaaagggttctctcggcatcatattattaaatatgaacccatagtgactaaaggcaacgaagccctggtacaccatatggaggtgtttcaatgtgcacccgaaatggattcagtcccccattttagtggaccatgcgatagcaaaatgaagcctgacaggctcaactactgtaggcatgtcctggccgcatgggcgctaggagcaaaggctttttactacccagaggaagcggggctggcattcggaggtccgggctcttctcgttacttgcgattggaggtgcattaccacaatccactggtcattgaaggaagaaacgactcctctggtataaggctctattatacggctaaactcagaagattcaacgcaggaattatggagctggggctagtttacactccagtcatggcaatccctccacgagaaactgcttttatccttactggttattgcaccgataaatgcacacaattggccttacccccctctggaattcatatctttgcatcccagttacacactcatctgacaggcagaaaggtggtgacggtgctcgtcagagatggcagagagtgggagattgttaatcaggataaccattatagtccgcattttcaggaaataaggatgttgaagaaggtggtgagtgtacacccaggagacgttctgatcacctcatgtacctataacacagaggatcgagagcttgctaccgtcggggggttcggaatcctggaggagatgtgcgtgaactatgtgcattactacccacagactcagctcgagctctgcaaatctgctgtcgacgccggatttctccagaaatactttcacctgataaatagatttaataacgaagacgtctgtacttgcccccaggcatctgtgagccagcagtttacttctgttccttggaattccttcaatcgcgacgttcttaaagcgctgtactcattcgcaccaattagcatgcactgtaataagagttccgcagttcgcttccagggggaatggaatttgcaacctctgcctaaggtgatatcaaccctggaagaacccactccccaatgtcccacttcgcaggggaggtctcctgctggacccacggttgtgagtatcggcgggggaaaaggctag

SEQ ID NO: 114987 - DNA, 1341 bp, Artificial Sequence
  Description of Artificial Sequence: Synthetic coding sequence
atgaggaccttaaacacgagcgccatggatggaacagggctggtggtggaacgtgacttttctgttcgaatattgactgcctgtttcttgtccctgcttatactgagtacgttgctgggcaatacactggtttgcgctgccgtcattagattccgacaccttaggagcaaggtgaccaacttttttgtcataagcctggcggtctccgacctgttagtcgctgtgcttgttatgccatggaaagctgtagcagagatagctggcttttggcccttcggaagcttttgcaatatatgggtggcattcgatatcatgtgctccactgcttcgatcctcaatttgtgtgttatttctgtggaccgctactgggctatttcctctccttttcgctatgaacgaaagatgactcctaaggccgcattcatactaatctccgtggcctggaccttgtccgtccttatcagtttcattcctgtgcaactttcctggcacaaagcgaagcccacatctccctccgacgggaacgccaccagcctggccgagacaatcgacaactgtgacagcagcctgagtcggacctacgccatctctagtagcgtgatttcattttatatccctgtcgcaatcatgatagttacgtacaccaggatctaccgaatcgcccagaagcagataagacggatcgctgcattggagcgcgccgctgtgcatgcaaagaactgccagacgacaactggcaacggaaaaccagtggaatgtagtcagcctgagtcatccttcaagatgtccttcaagcgtgagaccaaggtgctcaaaacactcagcgtgatcatgggagtgtttgtttgctgctggttgccgttctttatccttaattgtatcctgccattctgcgggtcaggcgagacccagccattttgcatcgactcaaatacattcgatgtgttcgtctggttcggatgggcaaactcgtccctaaacccgatcatttacgctttcaatgccgattttagaaaagcctttagcactctcctgggatgctaccggctctgtcctgctaccaataacgccattgagacagtttccattaacaataatggcgccgcaatgttctcctctcatcatgagccgagaggctccatctcaaaagagtgtaatctggtctacctgatccctcacgctgttggttcgtctgaggaccttaaaaaagaagaagccgccgggatcgctcgacccctggagaaactctctcccgcactgtctgtgattttggactacgacacagatgtctccctcgagaagattcaaccaattacccaaaacggccagcaccccacgtag

SEQ ID NO: 114988 - DNA, 1341 bp, Artificial Sequence
  Description of Artificial Sequence: Synthetic coding sequence
atgagaaccctaaatacaagtgccatggacggcacagggcttgttgtggaacgggatttttcagtgagaatcctcacagcttgttttctgagtctgcttatcctatccactctcctgggaaacactctggtttgcgccgccgtgataaggttcaggcacctgaggtctaaagtgacaaactttttcgtgatttcccttgctgtgagcgatttgctggtggccgtgctcgtaatgccctggaaagcagtggccgaaatcgctggcttttggccatttggcagtttttgcaatatttgggttgcattcgacataatgtgttctacagcctccatattgaatctgtgtgtgatcagtgttgacagatattgggctatctcgtcaccttttaggtacgaacgcaagatgacacccaaggcagcttttatccttatatctgtggcttggacactatcagtgttgatctcttttattccagtccagctgtcgtggcataaggcaaagccaacgtcgccaagtgacggcaatgccacttcacttgccgagacgatcgataattgtgacagttcgctatccaggacctacgcgatctcaagctcagttatctccttttacatacctgtagcaatcatgatcgtcacctacactaggatctatcggatagcccagaagcaaattcgccggatcgctgccctggagcgcgcagcggtgcatgcgaagaactgccaaactacaactggcaacggcaagcccgtggagtgcagccagcctgagtcatccttcaagatgtccttcaagagggagacgaaggttctgaagacactcagcgtgatcatgggtgtattcgtgtgctgctggctgccattcttcattctcaattgcattctgcctttttgcggaagtggcgagactcagcctttttgcatagattccaacactttcgatgtgtttgtgtggttcggctgggcaaactcctctctcaatccaatcatatatgcttttaacgctgactttcgtaaagctttttcgactctcctaggctgctatcggctttgccccgcaacaaataacgccattgagacggtttccatcaataataacggcgcggcaatgttcagttctcaccatgagccgaggggttcaatatcaaaggagtgtaacctcgtttatttgattcctcacgccgtgggctcttcagaagaccttaagaaagaggaagcggcgggaatcgcccggcccttggaaaaactgtccccggcactatccgtgattttggattatgatacagatgtgagtctcgagaaaatccagcccataactcagaacggccaacacccaacgtag

SEQ ID NO: 114989 - DNA, 1245 bp, Artificial Sequence
  Description of Artificial Sequence: Synthetic coding sequence
atggatcctctgaatcttagctggtacgatgatgatctggagcgacagaattggagccgcccattcaatgggtccgacggaaaagctgaccgaccacattataactactacgcaaccctcctgacactactgattgccgtgattgtctttggaaatgtcctcgtgtgtatggccgtgagcagggagaaggcgctccagacaaccacgaactatctgattgtatctctggccgtagctgatttacttgtggccactctggtcatgccttgggtagtgtatttggaggtcgttggggagtggaaattcagccgaatccactgcgatatctttgtgactcttgatgtgatgatgtgcactgccagtatcctgaatctgtgcgctatcagcattgaccgctatacagctgttgccatgccgatgctctataacacaaggtactcctccaagcggagggttaccgtgatgatttcgatcgtctgggtactgtcatttacaatctcatgtcccctgctgttcgggctgaataacgcagatcagaatgaatgcattatcgctaatccagcgttcgtcgtctacagtagtatcgtcagtttttacgtgccattcattgtgacacttctcgtgtacatcaaaatttacatcgtgttgagacggagacgcaaacgggtcaacacaaagagaagttcaagggccttcagagcacacttaagagctccccttaaagaagcagcccggcgtgctcaagagctggagatggaaatgctgagttccacatcaccaccagaaagaactcgctactctccaatccccccttcccaccaccagttaacactgcctgacccatctcaccacggattacattctactcctgactcccccgctaagcctgagaaaaacgggcatgccaaggatcatcctaaaattgccaagattttcgagatccagacaatgcccaacggcaaaacaagaacatctctgaagaccatgagccggcgtaagttgtcacaacagaaggaaaagaaagcaactcagatgctggccatagtactgggcgtgtttataatatgttggctgcccttcttcattacccacattctcaacatccactgcgactgtaacatccctccggttctgtattcagcctttacctggctcgggtatgtgaattcagccgtgaacccgattatatacaccacatttaatatcgaatttaggaaggcattcctgaaaatcttgcattgctag

SEQ ID NO: 114990 - DNA, 1338 bp, Artificial Sequence
  Description of Artificial Sequence: Synthetic coding sequence
atggacccattaaacctaagctggtatgatgacgatcttgagaggcagaattggtccagaccctttaacgggagtgacggaaaggcagaccgccctcactacaactattacgccacactgctgacgctgctgatcgcggtgatcgtcttcgggaatgtgctggtgtgtatggcagtgtctagggaaaaagccttgcagacaaccacaaactacctgatcgtctcattagccgtggcagacctgctggtggctacattagtgatgccctgggtcgtttatctggaggtggttggggaatggaaattctccaggattcactgtgacatttttgttacacttgacgtaatgatgtgcacagcgagcatcttgaatctatgtgcgatatcaatcgatcgctacacagcagttgcaatgcccatgttatataacacacgatattctagcaaaagacgtgtcactgtgatgatttcaattgtgtgggttctcagcttcacgatcagctgtccactgctgttcggcctgaacaatgccgatcaaaatgagtgcatcatcgcaaatccagcctttgtggtctactcctcaatcgtgtcattttacgtccccttcatcgtcacgttgctggtttacatcaagatttatatcgtccttcggaggagacggaaacgcgtgaataccaaacggagcagccgagcatttcgcgcccacctgcgcgctcctcttaaaggcaactgtactcaccccgaagatatgaaactttgcactgtaattatgaagtcaaacggaagcttcccggttaatcgcagaagggttgtgcaagaggccgccagaagagcacaggagctagagatggagatgcttagttcaacttcgccacccgagagaacacggtattcaccgatccccccatcacatcaccagctgacactgccagacccatcccaccacggtttgcactcaaccccagacagccccgccaagccagaaaaaaatggacatgccaaagatcacccgaaaattgcaaagatctttgagatacagactatgcccaacggaaagacacgaacgagcctgaaaactatgtccagacggaaactgtcacagcagaaggaaaagaaagcaacccagatgctggccattgttctgggagtgtttatcatctgctggttgccattcttcatcacgcatattctcaacatccactgtgactgtaatattccaccagtcctttacagcgcatttacttggcttggctatgtgaattccgcggtcaaccccatcatctacactaccttcaacattgagttccgcaaagcctttctgaaaatcctgcattgttag

SEQ ID NO: 114991 - DNA, 1332 bp, Artificial Sequence
  Description of Artificial Sequence: Synthetic coding sequence
atggatcctctgaacctgagctggtacgatgatgatctagagaggcagaactggtcacggccctttaacggctctgatggcaaggcggaccgaccgcactacaattattacgccaccctgctcaccttactcatcgctgttatcgtcttcggcaacgtcctggtgtgtatggccgtaagtcgtgaaaaggctctgcagaccaccactaattacctgatcgtaagccttgcagttgccgatttgctcgtggctacgcttgtgatgccctgggtggtgtatctcgaagtagtcggggagtggaagttctccagaattcactgcgacatttttgtgactctcgacgtcatgatgtgtacagcgtccattctgaatctgtgtgccatcagtattgacagatacaccgctgtcgccatgccaatgctgtataatacgaggtactcttcaaagagaagagtcacagtgatgatctctatcgtgtgggtcctttcattcacaatttcttgccccctgctgttcgggttgaataatgccgaccagaacgagtgcatcatagccaaccctgccttcgtggtgtactcttccatcgttagcttttatgtcccgttcatcgtaacattattggtctacatcaaaatttatatcgtgctacggcggaggagaaagagggtcaacacaaagaggagtagtagagcctttagggcccatttaagggctcctttaaagggcaattgtacccaccccgaggatatgaagctctgtacggtaataatgaaaagcaatggttccttcccagtgaacaggcgacgcgtcgaggctgcaagaagagctcaggaactggagatggaaatgctgagctctacgtcaccccctgaaaggacgagatacagccccattcccccatctcaccaccagttgactctccccgaccccagtcatcatggccttcatagcactcccgacagcccggcaaaacctgaaaagaatggacacgccaaggaccatcccaaaatagccaaaattttcgaaattcaaacaatgcccaatggaaaaactcggacaagtctgaagaccatgagtcgcagaaaactgtctcagcaaaaagaaaagaaggctacacagatgctagcgatcgttctgggggtgttcattatctgttggcttccattcttcattacccatatcctgaacattcactgcgactgtaacataccacccgtgttgtatagcgccttcacctggctcggatacgtaaattctgccgtgaaccccatcatttacaccacatttaatattgagtttcgtaaggctttcctgaaaattctgcactgttag

SEQ ID NO: 114992 - DNA, 1338 bp, Artificial Sequence
  Description of Artificial Sequence: Synthetic coding sequence
atggaccccttgaatttatcgtggtacgatgacgacttagagcggcagaattggtctcgcccatttaatggatccgacggcaaggccgataggccacattacaattactatgctactttgttgaccctgctgatcgccgtgattgtctttgggaatgttctggtctgtatggcagtcagtagggagaaggcgctccagacaacaaccaattaccttatcgtgagtctcgcagtcgccgacttgctcgtcgccacgcttgttatgccatgggtcgtttatctcgaagtggtcggagaatggaaattctcacgcattcattgtgacatattcgtcactcttgatgttatgatgtgcactgcttctatcttaaacctttgcgcgattagcatcgataggtataccgccgtagctatgccaatgctgtacaacacccgatatagctctaaacgacgcgttacggttatgattagcatcgtctgggtgctgtcgtttacgatttcttgtcccctgctgttcggactgaataacgcggaccagaatgagtgcattattgctaatcctgcgtttgtagtatattcgagcattgtgtctttctatgtccccttcatcgtgacactgttagtgtacatcaagatatatatcgtgttgagacgccgccgtaagcgggtgaataccaaacggagcagccgggccttccgagcgcaccttagagccccgcttaagggcaactgtacgcatcctgaggatatgaaactatgcacagtgatcatgaagagcaatggcagctttcccgtaaaccgtaggagagtagtgcaagaagccgctcgcagggcccaggaattggagatggagatgctgagcagcacctctccacccgaaagaacccgatactcccctattccgcctagtcatcaccagctcaccttgccagacccttctcaccacggactgcacagcaccccggactcacccgcgaaacctgaaaaaaacggtcacgccaaagaccacccaaaaatcgcgaagatctttgagatccaaactatgccgaatggcaagacacgaaccagcctgaagacaatgagcaggcgcaagctaagccagcagaaggagaaaaaggctacgcaaatgctggctatcgtgctcggcgtatttattatctgttggctgccctttttcataactcacattctgaacatccactgcgactgcaacattcccccagtcctctattctgcattcacgtggctgggttacgttaactcagccgtgaaccccatcatctacactacattcaacatcgagtttcgaaaggcttttctgaagattcttcactgctag

SEQ ID NO: 114993 - DNA, 24 bp, Artificial Sequence
  Description of Artificial Sequence: Synthetic coding sequence
atggatcccctgaaccttagctag

SEQ ID NO: 114994 - DNA, 1332 bp, Artificial Sequence
  Description of Artificial Sequence: Synthetic coding sequence
atggaccccctgaacctgtcctggtatgacgacgacctggagaggcagaattggtccaggccctttaatggatcggatggcaaagccgatcgcccccattataattactatgccactctgctgaccctcctgattgccgtgatcgttttcggtaacgtgctcgtgtgtatggcagtttcacgtgagaaggcactccagacgacaacaaattacttaattgtgtccctcgctgtggccgatttactcgtcgcgacactggtcatgccgtgggtcgtgtacctggaagtggtcggcgaatggaaatttagccgcattcactgcgacatatttgtgacgctggacgtcatgatgtgcaccgcaagcatcttgaacctgtgcgccatctcaatagatcgctacacggcagtggccatgccgatgctgtacaatacccggtattcttcaaaaaggagagtgacagtgatgatctccattgtttgggtcttatccttcactattagctgtcctctgctgtttggtctgaacaacgctgaccagaatgaatgtatcatcgcaaaccccgcgtttgttgtatattccagtatcgtgtcgttctacgtgccctttattgtgaccttattagtgtatattaagatttacatcgttctgcgcagaaggcgcaagagggtgaacactaaaaggtccagccgggcctttcgcgcccatttgagagcacctctgaagggaaattgcacccaccccgaggatatgaaactctgcaccgtcatcatgaagagcaatggaagctttcccgtcaatcgacgaagagttgaggccgcacggagagctcaggagttggagatggaaatgctttcttcaacttcccctcctgaaagaactcgctatagcccaatccctccaagccaccatcagttgactctacctgatccatcccaccatggcttacatagtacacccgattcaccggcgaagccagagaagaacggccacgcaaaagaccatccaaagatcgcaaagatctttgagatccagactatgcccaacggcaaaactagaacatctctgaagacaatgagcagacggaagctcagccaacagaaagaaaagaaagccacccagatgctggccatcgttcttggagtgtttattatctgctggttacccttcttcattacccacattcttaatattcactgcgattgcaacattccccccgtgctctactccgcattcacctggctgggctacgtgaactccgccgtgaatccaatcatttacacaaccttcaatatcgaattccgcaaagcctttctgaagattctgcactgttag

SEQ ID NO: 114995 - DNA, 534 bp, Artificial Sequence
  Description of Artificial Sequence: Synthetic coding sequence
atggatcctctcaatttgtcttggtatgatgacgacctagagaggcagaattggtccagaccgtttaatgggagcgacgggaaggctgacagaccacactataactactacgccaccttgctcacgctgctcattgcagttattgtgtttgggaatgtcctggtatgcatggctgttagtcgtgagaaggccctccagacgacaacgaattacctgatcgtaagtttggcagtggctgatctgcttgttgctacactggtgatgccctgggtagtgtacctcgaagtcgttggagagtggaagttctccaggatacactgcgacatctttgtgacattggacgtgatgatgtgcacagcctcaatcctgaatctgtgtgcgatcagcatcgaccgatacactgccgttgctatgccaatgctctataatacccgctatagctctaaacgacgtgtcacagtcatgatctctattgtctgggtcctgtcttttacaatcagctgcccactgctgtttggcctgaacaatgcatag

SEQ ID NO: 114996 - DNA, 1329 bp, Artificial Sequence
  Description of Artificial Sequence: Synthetic coding sequence
atggaccctttaaatctgagctggtatgatgacgatctggagcggcagaactggagccgtccatttaacggcagcgacggaaaagcggataggcctcattacaactactatgctaccttattgacactcctgatagccgtaattgtttttggtaatgtgcttgtgtgtatggcagtctcccgggaaaaagcactacagacaaccaccaattacctgattgtctcactggctgttgcagatctgctagtggctacgctcgtgatgccgtgggtggtgtacttggaagtaggcgagtggaagttcagccggatccattgcgacatcttcgttaccctagacgtgatgatgtgtactgcgtcaattctcaacctctgcgcaatttctatcgaccggtacacggcggtagcaatgcccatgctgtacaacacacgctactctagtaagcgcagagtgaccgtgatgatctctatcgtgtgggtcctcagttttactatcagttgccctctcttatttggactaaataacgctgaccagaatgaatgtatcatagccaacccagctttcgtggtttactcttctatcgtaagtttctatgttccattcatcgtaaccctcctcgtgtatatcaaaatttatatcgttttgagacgaaggcgcaagcgtgtcaatactaaaagaagttcacgcgcattccgagctcacttgagagccccgcttaagggtaactgcacacatccagaggatatgaaactctgcacagtgataatgaagagcaatggttcttttcccgtgaatcgaagaagagtggaagctgcccgacgcgcccaggagctggagatggagatgctcagttcgacctctcctcctgagcggacccggtatagtcccattcctccgagccaccaccagctcaccctgcctgacccttctcatcacggactacattccaccccagattctccagccaagcctgaaaaaaatggacacgccaaagatcacccaaaaatagccaagatcttcgagatccagacaatgcctaacggaaaaacacggaccagcctaaaaaccatgtcaaggaggaaactctcacagcaaaaggagaagaaagccactcagatgctcgcgatcgtactaggcgttttcatcatttgctggctaccatttttcataacacacatcctgaacattcattgcgactgtaacatcccccccgtactgtactccgccttcacttggctgggttatgtgaacagcgctgtcaaccctattatatataccacttttaacatcgagttcagaaaagcttttctgaagattctgcactgctag

SEQ ID NO: 114997 - DNA, 1029 bp, Artificial Sequence
  Description of Artificial Sequence: Synthetic coding sequence
atggcatccctgagccagcttagtggccatctcaactatacctgcggtgccgagaactctaccggggcgagccaagcccggcctcacgcatattacgcactgtcttattgcgccctaatcctggccatcgtgtttggaaacggactcgtctgcatggccgtcttgaaagagagagccctacagactaccactaactacctcgtagtgtcccttgcggtggctgatcttctagtcgctaccctcgtaatgccatgggttgtgtatctcgaggtaacaggtggtgtgtggaacttttcaagaatctgctgtgatgtgttcgtgacgctcgacgttatgatgtgtactgcctctatccttaacctctgcgctattagcatcgaccggtacactgcagttgtcatgcctgttcactatcagcacgggaccggacagtcttcttgtcgccgggtagctctgatgattacagccgtttgggtactggccttcgcagtgagctgcccactactcttcgggttcaacacaacaggagaccctactgtctgcagcatctcgaatcctgattttgtgatctattcctcagtggtgtctttctatctgccatttggagtcacggtgcttgtctacgcaagaatttacgttgtcttaaaacaacgccgtcgcaagcggatcttgaccaggcagaactctcagtgtaatagcgtgcgccccggatttcctcagcagaccctgtccccagatcccgcacacctcgagctgaaacgttattactccatctgccaagataccgccctcggcggacccggatttcaggaacgcggcggcgagttaaagcgggaggagaagacgcggaactcgctcagtgctacatcaggggaggagggtaaccccaatgggggacattgcgcttggggcttgcattgcctccttgctgccctcctccttgatccttgcagccagtacccactgcctgacatgcccagagtaccgagggcactgcagtgccacgatatggctggactaagggagtag

SEQ ID NO: 114998 - DNA, 1104 bp, Artificial Sequence
  Description of Artificial Sequence: Synthetic coding sequence
atggcaagcttatctcaactgagcgggcacctgaattatacctgcggcgccgagaacagtaccggggctagccaggcccgtcctcatgcttattacgccttaagttattgcgcccttatactcgctattgtctttgggaacggtctggtctgtatggctgtattgaaggaacgcgccctgcagacaaccaccaattatctggttgtatccctagcagttgctgatctgctggtcgcaactttagtgatgccctgggtggtctatttggaggttacaggtggcgtctggaacttcagccgaatctgttgcgatgtattcgtgacactcgatgtgatgatgtgcactgcctccatcctgaatctgtgtgccatctccatcgacaggtatactgctgtggtcatgcctgtgcattaccagcatggaactggccagtcctcatgtcgtagggtggctctgatgatcacagccgtttgggttctggcttttgccgttagctgtccactgctgtttgggttcaacactacgggtgaccctacagtttgttctatctctaacccggatttcgtgatatatagttccgttgtctctttttacctgccatttggcgtaaccgtgttggtgtacgctcgtatctacgtggtcctgaagcagcgccgccggaaacggatccttacaagacagaacagccaatgtaactcagtcaggccagggttcccccaacagaccctgtccccagatcctgctcaccttgagcttaagagatactattcaatttgtcaggacacggccctcggcggccctgggtttcaggagaggggaggagagctgaagagagaagagaagactcggaatagcttgatgcctctgagagagaagaaggcgacacagatggttgccatagtcctcggagcgttcattgtatgttggctcccattcttccttactcacgtactcaatacacattgccagacatgtcatgtgtcccccgagttatattctgctactacttggctgggttacgtcaattctgccctgaatcctgtgatttacaccacttttaatatcgagtttcgcaaagcctttctcaagatcctatcctgctag

SEQ ID NO: 114999 - DNA, 1203 bp, Artificial Sequence
  Description of Artificial Sequence: Synthetic coding sequence
atggcttccctcagccagttgagcgggcatctgaactacacgtgtggtgccgagaacagcactggcgcttctcaggccaggccacacgcctactatgctttgtcgtactgtgccttaattctcgcaatcgtcttcgggaacgggcttgtttgcatggctgtcctgaaggaacgcgccctgcaaacaactactaattacctagtggtatctctggccgtggccgatcttcttgtggccaccctggttatgccatgggtggtctatctggaagtgactgggggcgtttggaattttagtcgaatctgctgcgacgttttcgtcaccctggacgttatgatgtgcacagctagcattctcaatctgtgtgcgatcagcatcgaccgctatacggccgttgtgatgcctgtgcactaccagcatggtaccgggcagagcagctgtaggcgcgtggctttgatgatcacagccgtctgggtgctcgccttcgccgtgagctgtcctctgctgtttggctttaacacaactggagaccccactgtgtgttctatttctaaccctgactttgtgatttactcaagtgtcgtgagtttctaccttccttttggcgtgactgtgctggtctatgcgaggatctatgtcgtgctgaaacaaaggcggcggaaacgcattctcacacgccaaaatagtcaatgcaacagtgttcgtcctggcttcccccagcaaacccttagtccagaccccgcccatctggagctgaaacgatactattctatctgccaggatacagcccttggcggccccgggttccaagagaggggtggggaactgaagagagaagagaagactagaaactctctgtccccaaccatcgcaccaaagctcagcctcgaggtacgaaaactcagcaatggtcggctttctacttcactgaagcttggaccgctccagccaaggggcgtgccattgcgggagaagaaggctacccagatggtggccattgtgctgggcgcctttattgtttgttggctaccttttttcctgacgcacgttttgaatacccactgccaaacgtgtcacgtgtctcctgagctctactcagcaacgacttggctcggatatgtgaacagcgccttaaatcccgtgatctatacgacattcaacatcgaatttcgcaaagccttcctcaagatcctgagttgctag

SEQ ID NO: 115000 - DNA, 1203 bp, Artificial Sequence
  Description of Artificial Sequence: Synthetic coding sequence
atggctagcctgtcacagttgagcggacaccttaactatacctgcggcgccgaaaatagcactggcgcttcgcaggccagaccgcatgcctactacgcactttcctattgcgcccttattttagccatcgtgtttgggaacggcctggtttgcatggctgttctgaaagaaagggcacttcagactactacaaactacttggtggtaagcctcgcagtagctgacttgctggttgcgactctggtgatgccgtgggtggtgtatttggaggttacaggcggcgtctggaacttctcccgcatctgttgtgatgtgtttgtgaccctagatgttatgatgtgcactgcgtccatcctaaacctctgtgcaatcagcatagaccgatacacggcggtcgtgatgcctgtgcattaccagcacggcacaggtcagagctcgtgtcgtcgagttgcccttatgattaccgccgtctgggttttggctttcgcggtaagttgtccgcttctgtttgggttcaacaccactggagacccaaccgtctgcagtattagcaacccagacttcgtcatctacagttcagtggtgtcattctacttacccttcggcgtcacagtgcttgtctacgcacgcatttatgtggtcctgaagcagaggaggagaaagaggatacttacccgccagaactcccagtgcaacagcgtaaggccagggttcccacagcaaactctaagccctgatcccgcccatttggagcttaagcgttactacagtatatgtcaagatacagctttgggtggaccgggattccaggagaggggaggggaactcaaaagagaggagaagactcgcaactccctgtctcctaccatagcgccaaagctatctctggaggtccggaaactgtctaacggaaggctctctacatcactgaaactggggccactccagcccagaggagtgccactgagggagaagaaagcgacacaaatggtggcgatcgtgctgggggcattcatagtgtgttggctgccttttttcctaacgcatgttctcaatacccattgtcagacctgccatgtatcccctgaattatattccgcaactacctggctcggttatgtcaacagcgcacttaacccagtgatttacactacattcaacattgagttccggaaggcttttctaaaaattctgtcttgttag

SEQ ID NO: 115001 - DNA, 1203 bp, Artificial Sequence
  Description of Artificial Sequence: Synthetic coding sequence
atggcctctctgagccagctttcaggtcacctcaattacacatgtggcgcagagaactctaccggcgcctcgcaggctcggccccacgcatactacgccctctcctattgcgcgttgattctggccatcgtgtttgggaacggactcgtctgtatggctgtgttgaaagaacgcgctcttcagaccacaacaaattatttggtggtatctctcgccgtggccgatctgttagtggcaacactcgtcatgccttgggtggtgtatctcgaggtgaccggcggtgtgtggaacttcagtcgcatctgttgtgatgtcttcgtcacactggacgtgatgatgtgtactgcgagcatcctgaacctttgtgcaatatctatcgaccgttacaccgcggttgtgatgcccgtgcactaccagcacgggacagggcaaagtagttgtaggagagtcgcccttatgatcacagccgtgtgggtgctggcttttgctgtttcttgccctctgctgtttggttttaatacaactggcgatccaactgtgtgtagtataagcaaccccgattttgttatttactcttcagtggtgtccttttatctgccttttggagtgacggtgctagtttatgctcgcatatacgtcgtgctcaaacagcgcaggcgaaagagaatcttaaccagacaaaattctcagtgcaatagcgtgaggccaggcttcccgcaacaaacactttccccagatcctgcacatctggagctaaaaagatattattctatatgccaggataccgcattgggggggcccggcttccaggagcggggaggggaattaaagcgcgaggaaaagactcgcaattctctaagtcctacaatcgcccctaaattatctctagaagtcaggaaactctctaacggcaggctctctactagcctgaaactcggacccttacagcctagaggggtgcccttaagagagaagaaagccacacagatggtagctattgtgctgggcgcgtttatagtgtgctggctccctttctttttgacacacgtgttgaacacacattgccagacttgtcacgtgtcacctgagctctattccgccaccacttggctaggctacgtcaattctgcactcaatcctgtaatctacaccacatttaatattgagttccggaaagccttcctgaagatacttagctgctag

SEQ ID NO: 115002 - DNA, 1260 bp, Artificial Sequence
  Description of Artificial Sequence: Synthetic coding sequence
atgggtaatcggagtaccgcagatgcagacggcctcctcgcaggccggggccctgctgctggcgcctctgctggtgctagcgctggactcgccgggcagggggcagcggctctggtcgggggtgtcttgctaattggggccgttttggctggcaacagtttagtgtgcgtcagcgtggccaccgaacgcgctctgcaaacccccacaaactctttcatcgtgtcactggcagcagccgatctcctactcgccctgctcgtacttccactctttgtctatagcgaagtgcagggcggcgcgtggttgttgagtccacggctgtgcgatgcgcttatggcaatggatgtgatgttgtgcacagccagcatattcaatttgtgcgctatctccgtagaccgcttcgttgctgtcgcagtgccattaagatataaccggcaggggggctccaggaggcagttgctcctaattggcgccacctggttgctgtccgcggctgttgccgcccccgtactttgtggactcaacgatgtgagagggagggatcctgcggtatgccgtctggaggacagggattacgtagtttactcaagcgtgtgcagttttttcttgccttgtcccctaatgctattgttgtactgggctacatttcgtgggctacagagatgggaagtggctcgaagagctaagctgcacggaagggcccctcggcgaccaagcggacctgggccaccatctcccacaccaccagctcctcggctgccacaagacccttgtgggcccgactgtgcaccacccgcccccggattgcccagagggccctgcggaccagattgtgcccccgcagcaccttcactgcctcaggacccctgtggccctgattgcgccccacctgctccggggctgccccccgatccgtgcgggagcaattgcgccccccccgacgccgtgcgggccgctgctctgccgcctcaaacacctccccagacacgccgtcgacgcagagccaaaatcaccggccgcgagcggaaagccatgcgggtgttaccagtggtcgttggtgcatttcttctttgttggaccccatttttcgttgtgcacatcacccaagccctctgcccagcctgctccgtaccgcctcggttggtgtccgccgtaacatggctgggttacgtgaactcagccttgaacccagtgatctatacggtgtttaacgctgagtttcgcaacgtgtttagaaaagcactgagagcgtgttgttag

SEQ ID NO: 115003 - DNA, 1434 bp, Artificial Sequence
  Description of Artificial Sequence: Synthetic coding sequence
atgctgcccccaggctctaacggcacggcatacccaggccaattcgctctgtatcagcagctggcccaggggaatgcagtcggtggtagcgccggggcgcctcctctcggacctagtcaggtcgtgaccgcttgtctgttaacactgttgataatatggaccctgctgggcaatgttctcgtgtgtgccgccatcgtcaggtcaagacacctgagggctaatatgaccaacgtgttcatagttagcctggccgtaagcgatctgtttgtggcactgcttgtcatgccctggaaggccgtggccgaggtggccggctactggccattcggcgcattttgcgatgtgtgggttgcgttcgatatcatgtgcagcaccgcgagtattctgaacctctgtgtcatctcagtcgaccgttactgggcgatctccaggcccttcagatacaagcgaaaaatgactcagcgtatggcactcgtgatggtcgggctagcctggaccttgtcgattctgatttctttcattcccgtgcagctgaattggcacagggatcaggctgctagctggggaggccttgaccttccgaataatttagcgaattggacaccctgggaggaggacttctgggagccggatgtgaatgcagaaaactgcgatagctccttaaaccgtacatacgcgatttccagctctctaataagcttctatatccccgtggccatcatgatcgtcacttacacccggatttatcgtatcgctcaggttcaaatccggcgaatcagttccctcgagagggccgcagagcacgcacaatcctgcaggtcatcggcagcttgtgccccagacaccagcctccgagcgtcaattaagaaggagaccaaggtcctgaagacactctccgtgattatgggagtttttgtgtgctgttggcttcctttctttatcctgaactgtatggttccattctgctccggccaccccgagggcccaccggccggatttccctgcgtgtccgaaaccactttcgacgtgttcgtgtggttcggttgggccaactcttctttgaatccagtaatatacgccttcaatgcagacttccagaaggtatttgcgcagctcctcggttgctcgcacttctgctctcgaactcctgtggagactgttaatattagcaacgaactgatctcatacaaccaagatatcgtattccataaggagattgctgccgcgtacatacatatgatgcctaatgcagtgacacccggtaaccgggaggtcgataatgatgaggaagaaggaccgttcgaccgcatgtttcagatctatcagacatctccggacggcgacccggtggcagagagtgtatgggaactggactgtgagggagagatcagcctggacaaaatcactccatttacgcctaacgggttccactag

SEQ ID NO: 115004 - DNA, 438 bp, Artificial Sequence
  Description of Artificial Sequence: Synthetic coding sequence
atggatccggaggagcaggaactgctcaatgattaccggtatcggtcttacagctcagtgattgagaaggcactgagaaatttcgaatcatccagcgaatgggccgacctgatctccagcctgggcaaacttaacaaagcgctacaaagcaatttaagatacagcctgttgccgcggcggttgctcatctctaagcgcttggcacagtgcctgcaccccgctctgccctccggagtccatttgaaagctcttgagacctatgagattatcttcaagatcgttgggacaaaatggctcgccaaggacctgttcctttactcttgcggactgtttcctctgctggcccatgctgctgtctccgtaagacctgtcttactcactctctacgagaaatacttcctgccgctgcagaaactgctgctgccctcgttgcagtag

SEQ ID NO: 115005 - DNA, 6897 bp, Artificial Sequence
  Description of Artificial Sequence: Synthetic coding sequence
atggaccctgaagaacaggagctgttgaatgactatcgttaccgaagctacagcagcgtaatcgaaaaagcactgcgcaatttcgaatccagtagtgagtgggctgatctcatctcatctcttggaaaattgaataaagctcttcagtcaaacctgagatactcactccttcctaggcgcctgctgatttcgaagagattggcacagtgcctgcacccggccttaccatccggggttcatctgaaggccttggagacttatgagatcatcttcaaaatcgtgggaaccaaatggctggccaaggatctatttttgtactcgtgcggcctgttccccttactggcacatgcggctgtgtccgttaggcctgtgctgttaacattatacgaaaaatactttttaccactccagaagttgctcctgccgtctctccaggccttcatcgttgggctgctccccggcctcgaagaaggcagcgaaataagcgataggaccgacgctctacttttgagactctccctggtggtgggaaaagaagtcttttataccgccctctggggcagcgtgctggcctctccttctatccggcttccggccagcgtctttgtcgttggacacattaaccgcgacgccccaggtcgcgagcagaagtatatgctggggaccaatcatcagctgacagttaagtcactgagagcgtccctccttgactctaatgtccttgttcagcggaacaacctagaaattgtactgtttttttttccattctatacctgtctcgattccaacgagagagcaattccattgctgcgaagtgacattgtgaggattctgtcagccgcaactcagactctgctgcgacgcgatatgagcttgaaccgcaggctttatgcgtggttactgggctccgatatcaaaggcaatacagtggtgcctgaatccgaaataagcaactcttatgaagatcagtcctcctactttttcgagaaatacagcaaagatttattagttgaaggccttgccgagattctacatcagaaatttattgatgcggatgttgaggaacgccatcatgcgtatctgaagccatttagagtccttatttcccttctggataagcccgagattggaccacaagtggttggaaacctgtttctggaggtgatccgggctttttattcttactgcagagacgccttagggtctgatttgaagcttagctacactcaaagcggaaattcactgattagcgctattaaggagaataggaacgcttccgagatcgtaaagacagttaatttactgatcacatccctgagcacagacttcctgtgggactacatgactcggtgtttcgaggaatgctttcggcctgtgaaacagcgttattcggtgcggaattctgtgtcaccaccacctaccgtgtccgagctgtgcgcgctgttagtttttctcctggatgtgatacctctggagctctactcagaggtccaaacacagtacttaccacaggtcttgggatgtttggtgcagcctctggccgaggacatggaggctctgagcctcccagaactgacccacgcccttaagacttgctttaaggtcctcagtaaggtgcagatgcctccctcttaccttgacactgagtctaccagcgggactagctctcccgtgaagggtgagaacggcaagataatccttgaaaccaaggcagtgatcccaggggacgaagatgccagtttcccgcccctgaagtccgaggatagtggaattggcctgagcgcttcttccccagagttaagcgaacacctgcgtgtcccccgggtttcactggaacgcgacgatgtctggaaaaaaggcggttctatgcagcggacctttctatgcatccaggagttaattgccaacttcgcctccaaaaatattttcggcgtgcagctgactgcctctggtgaagaatcaaaatccgaggaacctgccggaaaacgagatcgcgatggaacccagtcactggctgctaatgactcatccaggaaaaacagctgggaaccaaagcctataaccgtaccacagtttaaacagatgctctcagacctgttcacggcccgaggatcacctttcaagaccaagtcaagcgaatccccaagctcaagtccctcttccccagcccggaagaacggcggcgagtgggatgtagagaaggtggtgatcgacctaggtggctctagggaggagaggcgagaggccttcgcagctgcatgtcacttgctgcttgattgtgcaactttccctgtttacctttcagaagaggagaccgagcagctttgtgcgaccttgttccaactaccaggcgcgggggactccagcttcccttcgtggcttaaatccctcatgaccatttgctgctgcgtaactgactgctatctgcagaacgtagctatctctaccttactcgaagtcatcaatcactcgcagtcactcgctctcgtgatcgaagataaaatgaaaaggtacaagtctagcggccacaatcccttcttcgggaaactccagatggtgacagtgccaccaattgcacctggcatattaaaagtgatcgctgaaaaaaccgatttttaccagagggtggcccgcgttctgtggaatcaactcaataaggagacgcgtgaacaccacgtcacctgtgtggagctgttttacaggctgcattgcctggccccgactgcaaacatctgcgaagacatcatctgccatgccctgctcgaccccgacaaaggcaccagacttgaagcgctattccgctttagtgttatatggcatctgaccagagagatacagggctcacgcgtgaccagccacaatcggtcattcgacaggtcactgttcgtggtgcttgactccttggcttgcaccgacggggctattggggctgccgcgcagggatggttagttagggccctgagcctcggggatgtggcccggattctggagcctgtccttttactgctgctgcagcccaagacccagcgtacaagcattcactgtctgaagcaggagaactctgcggatgatcttcataggtggttcaacaggaagaaaacatcattccgggaagcgtgcgcagtcccagaaccccaggaatcaggaagtgaggaacatctgcctctctcacagtttaccaccgttgacagggaagcaatttgggcagaagtcgagaaggagccagagaagtatcctctgcggggcgaattgtcagaggaggagctgccctattacgtagagctgcccgaccgcacggcccacggagcccccgactcttctgaacacactgagtcagccgatacaagcagctgccacactgactccgaaaacacctcatctttttcctccccgagccacgatttacaggaactcagcaatgaggaaaattgttgcgcacctattcctatgggcgggcgcgcttatccaaaacgatccgccttacttgccgcctttcagtcagagagctttaaggccggggccaagctctcactcgtcagggtcgactctgataagacacaggccagcgagtctttttctagtgacgaggaagccgatctggaactgcaggctctcacaacaagtagactgttaaagcaacagagggagcggcaggaggcggttgaggcactattcaagcatattctcctgtacctccaaccatacgattccaggcgcgtactatatgcctttagcgtactcgaagcggtgttaaaaaccaatcccaaggaattcatagaagccgtgagcaggaccagcatggacaccagcagtacagctcacctgaacttaattagcaacctccttgccagacatcaagaggctttaataggacagtctttttacggaaagctgcaaacacaagtgcctaacgtttgcccccactcactattactggaattgcttacgtatttgtgcttaagttttctgagaagttactacccctgttatctcaaggtaagccacagagatattctcgggaaccgcgatgttcaggtcaaatcagtcgaggttctgatcaggattatgatgcagctggtttctgtcgccaagagctcggagggcaaaaacgtggaatttattcactcgcttcttcagcgctgcaaagttcaggagtttgtcctgttgtcactgagcgcaagcatgtacacttcacaaaagcgctacggcctggcaacagcccatcatgggcgcgcccttccagaggatagcttgtttgaggagagcctgattaatttggggcaggaccaaatatggtctgaacatcccctccagattgaacttttaaagctcctgcaagtcctgatcgtcctcgagcatcatcttggccgggcacacgaggaggccgagaaccagccagacctcagtagggagtggcagagagctctcaacttccaacaggccatcagcgccctgcagtatgtgcaacctcacccactcacctcccagggcctgcttgtgagtgcagtcgttcggggtctgcagcccgcatacggttatggcatgcatccagcgtgggtatcactggttacacattctctgccctattttgggaaaagtctgggatggaccgtaactccttttgtggtgcaaatctgtaagaacctcgacgacttagttaaacagtacgaaagcgaaagcgtgaaactgagtgtttccaccacgagtaagcgggaaaacattagcccagattacccactgactctgctcgaagggcttactaccatcagtcatttctgcctcctggaacaggcaaaccagaacaagaagacaatggccgcaggcgatcctgccaacctgcgaaacgcacgcaatgccatacttgaagagcttccacgcacagtgaatacaatggcactcctatggaatgtgttgcggaaggaagagacccagaagaggccagtggacctgttgggtgcaacaaagggatccagcagcgtgtattttaaaaccactaaaacaatacgacaaaagatcctcgacttcttgaacccactgaccgcccatctgggcgtccaactcactgccgccgtggccgcagtgtggtctcgtaagaaagcccagcgacactccaagatgaaaatcatccccacggcaagtgccagccagctgacgctggtcgatctggtttgtgctctgtccactctccaaacggacactctcttgcatcttgttaaagaggtcgtcaaaaggccacctcaggtcaaggggggggatgaaaaatccccattagtcgacatcccagtgctgcaattctgctatgcctttcttcagcgactgccagtcccagcgctgcaggaaaactttagttcacttctgggtgtgttaaaggagagtgtgcagctcaacctggcccctccgggttactttctgctcctctcaatgttaaatgatttcgtaacccgcactccaaatctggaaaacaaaaaagaccagaaagatctccaggagattacccaaaaaatactggaggccgtgggaaatatcgccggatcatcactagaacagacaagctggcttagtcgtaacctcgaagtgaaggcccagccgcaggcaagtctcgaagaaagcgacgccgaggaggatctttatgatgcagcagccgcgtccgctatggttagttctagtgctccttccgtgtatagtgttcaagctctgtccctgctggcggaggtcctcgcctcacttcttgatatggtatatcgaagtgacgaaaaagaaaaagccgttcctctgatcagcaggctgctgtattacgttttcccgtacctgcgcaatcattccgcctataatgccccaagtttccgcgcaggggcacagctgcttagctcactgtccggctacgcctataccaagcgggcctggaggaaggaggtcttggagttgtttcttgatcccgctttctttcagatggatacatcctgcgtgcattggaaatctattatagaccacctgctcacgcacgaaaagaccatgttcaaggacctgatgaacatgcagagctcgtccctgaaattgtttagtagcttcgagcaaaaagcaatgctgcttaaacggcaagcctttgcagtcttttcaggggaactcgaccagtatcatctgtatctcccccttatacaggagcgtctgacggataatctgcgcgtgggccagaccagtatcgtggctgctcaaatgttcctattttttcgagtcctcctgcttagaatctccccccagcatcttacaagtctgtggcctatcatggtttcagagctaatccagacatttacccagttggaagaggatctgaaggacgaagatgagagtttgagatctaccaataaagtcaaccgaacaaaagtatctgtgcctgacgctaatgggccttcagtaggcgagattccccagagcgagctaattctgtacttaagcgcttgcaagttcctggatacagctctgagcttccctcctgacaagatgccacttttccagatttaccgatgggctttcatcccggaggtagatacggagggtccggcatttctctctgatgtagaggagaaccaccaggaatgtaaacctcacactgttaggatcctggaacttctaaagctgaaattcggtgagatcagcagtagtgacgaaatcacgatgaagtccgaattcccccttttacggcagcacagtgtgtcttctatccgccagctgatgcctttctttatgactcttaatggagcttttaaaactcagcgccaattgccggctgactccccgggcaccccatttctggacttccctgtcactgactcccccagaatcctcaagcaactggaagagtgcatcgagtacgactttttagagcaccctgagtgttag

SEQ ID NO: 115006 - DNA, 792 bp, Artificial Sequence
  Description of Artificial Sequence: Synthetic coding sequence
atgttctattttcattgtcctccccaactggaaggaaccgccacatttggtaatcactcttccggggactttgacgatggcttcctgcgcagaaagcagcgccggaaccggacgactttcactctccaacaactggaggcattggaggccgtgtttgcacaaacccactaccccgatgtttttacacgggaagaactggccatgaaaatcaatctgacagaggcgagagtccaggtatggtttcagaaccgtagggcaaagtggagaaagactgagagaggagcttcagaccaggagcctggcgcaaaagagcccatggctgaagttacaccaccccctgtgaggaatatcaattctcccccaccaggagaccaagccagatcaaagaaggaggccctggaggctcagcagagtctgggaaggacagtcgggccagccgggcccttttttccttcatgtctacccggaacactactgaatactgcaacttacgctcaggctttaagccatgttgcatctcttaagggcggcccattgtgtagctgctgtgtgccggaccctatggggctgtcattcctgcctacctacggctgccagtcgaatagaacggcttcagttgccacgctccgcatgaaggcacgagagcactctgaggcagtgctgcagagcgcaaacctgctcccttccacatcctcaagccctggcccagtggccaagcccgccccaccagacggatcacaggaaaagaccagcccaaccaaagagcagtccgaagcagagaaaagtgtgtag

SEQ ID NO: 115007 - DNA, 807 bp, Artificial Sequence
  Description of Artificial Sequence: Synthetic coding sequence
atggttttgatgtcctgcgaccaaaggctgatcagccttttactagtgggtactgcaacgtttggtaatcactccagtggagactttgatgacggctttttgcggcggaaacaacgaagaaataggacaacatttaccctgcagcaactggaggctctggaggcagtcttcgctcagacacattaccctgacgttttcactagggaagagcttgccatgaaaatcaatttaaccgaggctcgggtccaggtgtggttccagaaccgccgggccaagtggagaaaaaccgagcggggagcttcagaccaggagcccggggccaaagagcctatggctgaggttacccccccaccagtcaggaatatcaattcgcctccgcccggcgatcaagctcggagtaagaaggaagccctggaggcacagcagagcctcgggcgtaccgttgggcctgcgggccctttctttccttcatgtctgcctggtacacttctgaacacagccacttatgctcaggccctaagccacgtggcctctctgaaggggggtccactgtgcagttgttgcgtgccagaccccatgggactcagcttcttacctacgtacggttgccaatcgaaccgaaccgcatccgtagctacactgcggatgaaagcgcgtgagcactccgaagccgtcttacagtctgccaatctgctgccatccacatcaagtagcccaggcccagttgccaaacctgctccacctgacggcagccaggaaaaaacatccccgaccaaggaacaatccgaggctgagaagtccgtgtag

SEQ ID NO: 115008 - DNA, 384 bp, Artificial Sequence
  Description of Artificial Sequence: Synthetic coding sequence
atgaagctgaacgtggatggcctgttggtctacttcccatacgactatatttatccggagcagttcagctacatgagagaactgaaaaggacactcgatgcaaaagggcatggcgtgctggaaatgccctctggcaccggcaaaactgtctctcttctggccctcattatggcgtatcagagggcctaccccctggaggtaacaaagctgatatactgctcaagaaccgtgccagagatcgaaaaggtcatcgaagaacttagaaagctgctgaatttttatgagaaacaggagggagaaaagctgccatttctagggctcgctctctcttcaagaaaaaatctgtgtattcaccccgaaactacctctgcctctacaccgtag

SEQ ID NO: 115009 - DNA, 4614 bp, Artificial Sequence
  Description of Artificial Sequence: Synthetic coding sequence
atgggcgagaagctggagctcaggctgaaatccccagttggggcagagcctgcggtgtacccttggccattgccagtctatgataagcaccacgatgccgcccatgagatcattgagactatccggtgggtctgcgaggagattcccgacctgaagctggcaatggaaaactacgttttgatagattacgacacaaaaagtttcgaatctatgcagcggctctgcgataagtataatcgggccatcgattctatccaccagctctggaaaggcaccacccagcccatgaagctgaacactcgccccagcacaggcctgcttcgccatatcctccagcaggtgtacaatcactccgtgactgatcctgagaaactcaacaactatgagcccttctcacctgaagtgtacggggagacatctttcgacctggtggcgcagatgatagatgaaatcaagatgaccgatgacgatctgttcgtagacctcgggtctggagtgggccaggtggtgctacaagttgcagcagctaccaactgtaaacaccactatggggtggaaaaagccgatattcctgctaaatacgctgagacaatggatagagaatttagaaaatggatgaaatggtacggcaaaaagcatgccgaatacactcttgagcgtggggactttctgagcgaggagtggagggagaggatagcaaacacaagcgttatcttcgtaaacaacttcgctttcggaccggaagtggatcatcagctcaaggaaagattcgccaacatgaaggagggcgggagaatcgtatcctcaaagcccttcgcccctctcaacttcaggatcaactcgcgcaatctgtcagatattggcacaattatgcgcgtggtcgaattaagccctctgaaagggagcgtctcttggaccggtaaacctgtaagctactacttacatactatcgacagaaccatcctggaaaactacttttcctcattgaagaacccgaagctacgggaggaacaggaagccgccaggagaagacagcagcgagagtctaaatcaaatgctgccactcccactaaaggccccgagggcaaggtcgctggacctgctgatgctcctatggactctggcgctgaggaggaaaaagcgggggctgcgactgtcaagaaaccctctcccagcaaagctagaaaaaaaaagcttaataaaaaggggcgcaagatggccggccgcaaacgagggcggcccaagaaaatgaacactgcgaaccccgagaggaaacctaaaaaaaatcagacagccttggacgcactgcacgcccagaccgtctcccagaccgcagcatcttccccgcaggacgcctatcgaagtccccattcccctttctaccagctgccaccgagtgtccaacgccatagtcctaatccacttctggtcgcccctacgcctccagcactgcaaaaactacttgagagcttcaaaattcaatacctacagtttctggcatacacgaagaccccacagtataaagcaagcctgcaggaactattgggtcaggaaaaagagaagaacgcccagctgcttggggcggctcagcagcttctgagccactgtcaggcccaaaaggaggaaattaggcggctgtttcagcagaagctggatgaacttggagttaaggctctgacttacaatgacctgattcaggcgcaaaaagagataagtgcccacaatcagcagctccgcgaacaaagtgaacaactcgagcaggacaatcgtgcactacgagggcagtctctccagctgttgaaagcccgctgcgaggaactgcagctggactgggccaccctgtctctggagaaactgctgaaggagaagcaggctctgaaatctcagatttctgaaaaacagcgacactgcctggagctgcagattagcatagtggagctggagaaatcccagcggcagcaggagcttctgcagttgaagagctgtgtgccaccagatgatgctttaagcttacatcttcggggcaagggcgcacttgggagagagctggagcccgacgcttctcgtttacacctggaactggactgtaccaagttctccctcccgcatctgtcgtctatgagccccgaactgtccatgaacggtcaagccgccggatacgagctctgtggagtgctcagcagaccttcctccaagcagaacacccctcagtaccttgcctccccactcgatcaggaggtggtgccatgcaccccgagccacgtggggcgtccacgcctggagaagctttccggcctggccgcacccgattacactcgactctcacccgcgaagattgtgctgcggcggcatctgagccaggaccatacagtacctgggcgtccagccgcctcagagttacactcccgggccgagcatacaaaggaaaacggactgccctatcagtctccatctgtacctgggagcatgaagttatctcctcaggatccaaggcctctctcccccggcgccctccagttggccggcgagaagtcatcggagaaaggcctgagggagagagcctatggtagcagcggtgagctgattacctcattaccgataagtattcctctgagtacagtgcaacccaataaactgccggtgtccatcccactcgcatccgtggttttgccaagccgggcagaacgggctcgctccactcccagccctgtcctgcaaccacgggacccgagctcaaccttggaaaagcaaatcggcgcgaatgcccatggtgccggatcccgatcgctggctcttgcccctgccggcttcagctatgccggttccgtggccatctctggagcgctggcaggaagtccagcgagtttgaccccaggtgctgagcctgctacattggatgagtctagctcttcaggatctctgtttgccacagtggggagtagatcttcaacgcctcagcaccccctgttgttagcccagcctcgcaattcactgccggccagcccagcacatcagttgagtagttcccctagattaggaggcgccgcccagggtcccctgcccgaggcgagtaagggggatctcccttccgatagcggtttttctgatcccgagtctgaggccaagcgaaggattgtattcacaattactaccggcgcggggagcgccaagcagagtccttcaagcaagcattcccccctcactgcaagtgctcgcggcgactgcgtgccctcacacggtcaagattctcggcgtaggggaagacgtaaaagagcctctgcaggtaccccttcactgtcagcaggagtgtcacctaagcgcagagccctcccaagcgtcgccggtctgtttacgcagccatcgggctctccactgaacctgaactcaatggtgtcgaacataaatcagccactggagatcacggcaatttcctctcccgaaaccagcctgaagagcagtcctgttccttatcaagatcacgaccagcctcccgttttgaaaaaagagcgccccctgtcacagaccaatggtgcgcactacagccctcttaccagtgacgaagaaccaggatctgaggatgaacccagctcagccaggatcgaacgcaaaattgcgactatctccttagagagtaaatcacctcctaaaactctggagaatggaggtgggctagctggcaggaaaccggcacccgcaggggagcctgttaatagctcgaaatggaaaagcaccttctcacccatcagtgacattggacttgccaagtctgccgactcccctctgcaggcctcttccgccctgtctcagaacagccttttcacctttcggccagcattggaggagcctagcgcagatgccaagctcgcagcccacccccgaaaaggtttcccaggaagcctgtctggagccgacggcttatcaccaggcaccaatccggccaacggttgcacttttggagggggccttgccgcggacctgtccctgcactctttctcagacggcgcctctctgccccacaagggcccagaggctgcggggctctcatctccccttagcttcccttcacaacgcggaaaggaggggtccgacgccaacccatttttgtctaagcggcagctagacggcctcgccgggttaaagggcgaagggagccgcggaaaggaagccggcgagggggggctgcctctttgcggccccacagacaaaactcctctcctgtcaggaaaggccgctaaggcaagggacagagaggttgacctgaaaaatggccacaacttatttatttctgcggccgctgtgccccccggatccttgcttagcggtccaggcctcgcgcctgcagccagtagtgccggtggagctgcctccagcgcgcagacccaccggtcctttctggggcctttccctcccggcccccagttcgccttaggccccatgtctctgcaagctaatttgggaagcgtcgcgggatctagtgtactccagtcgctattcagttcagttccagcggctgccgggctggtgcacgtgagtagtgccgcgaccaggctgaccaatagtcacgccatgggatcgttcagcggcgttgccggaggcacagtgggagggaactag

SEQ ID NO: 115010 - DNA, 1203 bp, Artificial Sequence
  Description of Artificial Sequence: Synthetic coding sequence
atgaggggccgacggggggaccgaatgacaataaatattcaggagcatatggcaatcaatgtttgtcccggtccaatccggcctattcgtcagatctctgattacttcccccgagggccgggccccgagggggggggaggagggggcggagaagccccagcccatctggtgccgctggccttggccccgccagcagccttgctcggcgctaccacaccagaggatggcgccgaggttgatagttacgatagcgacgatgcaacagctctcggtaccctggagtttgatttgttatatgatcgcgcttcttgcacgctgcattgcagtattctgagggctaaaggtctcaaacctatggattttaatggtcttgccgacccatatgtaaagcttcacctcttgcctggcgcttgcaaggccaacaaactgaagacgaagacacagaggaatactctcaaccctgtgtggaatgaagatttaacatattctggtattacagatgacgatatcacacacaaagtgctgcggattgcagtgtgtgacgaggacaagctctctcataacgagttcatcggcgaaatccgtgtccctctgcggagacttaagccttcccagaagaaacacttcaacatttgcctggagcgccaggtgcctctcgccagtccttccagcatgtccgctgcgctaagagggatttcttgttatctcaaagaactggaacaggcggaacaggggcaaggactgctcgaggagcggggaaggatcttgctctccctcagttatagcagccgcagacgcggtcttcttgtgggcatactgcgatgcgcccatttagcggcaatggacgtgaatggctactctgacccatatgtcaagacatacctgcggccagacgttgacaagaaatctaaacacaagacctgtgtcaagaagaagaccctgaatcctgaatttaacgaggaattcttttatgagatcgagctctctacgctggccactaagacgcttgaggtaaccgtgtgggactacgacattggaaagtccaatgattttattggcggagttagtctggggccaggagcccggggcgaggcgcgtaaacattggagcgattgtctccaacagcctgacgctgcgctagagcgatggcacactctgacctctgaattgcccccagccgcaggagccttgtcttccgcctag

SEQ ID NO: 115011 - DNA, 927 bp, Artificial Sequence
  Description of Artificial Sequence: Synthetic coding sequence
atgaccttacgaaggcgcggagaaaaagctaccatcagcatccaggagcatatggctatcgatgtgtgtccgggacctatccgccccataaaacagatttccgactacttccctagattcccccgaggactgccccctgacgcaggcccacgggccgcggccccgccagatgcaccggctcgtcccgcggtggccggggcaggacgaaggtctcctagcgacggcgcacgggaagatgacgaagacgtggaccagttattcggagcatatggatcctcccccggacccagccctggcccatctcccgcacggcccccagctaaaccacctgaagacgagcctgacgccgatggctacgagagcgatgactgtactgccctaggaacgctggattttagtctcttatacgaccaagagaataacgctcttcattgcaccattacgaaagctaaagggctgaagccaatggatcataatggtctggccgacccttacgtgaagctacacttgttgcctggcgcttctaaggccaataagctacgcacaaagaccctgaggaatactctgaaccctacctggaatgagaccctgacatattatggtatcacggatgaagatatgatccgaaagaccttgaggatcagcgtttgtgacgaagacaagtttcggcacaacgaattcataggggaaactcgggtacctctgaaaaaacttaagcccaatcataccaagaccttttctatctgccttgagaagcagctgcccgttgacaagactgaagacaaaagcctggaagaaaggggacgtatattaattagccttaagtatagcagccagaagcagggccttttagttggcatcgttcggtgtgctcatctcgccgcaatggacgccaatggatattccgatccctatgtaaaaacgtag

SEQ ID NO: 115012 - DNA, 927 bp, Artificial Sequence
  Description of Artificial Sequence: Synthetic coding sequence
atgaccctccgccggcgcggcgaaaaagcgactatttcgattcaagaacatatggccatcgatgtttgcccgggacctatccggccaataaagcagataagcgactacttcccacggttcccaagaggattaccaccagacgccggcccaagggccgcggcacccccagacgcacctgcccgtcctgccgtagctggtgcaggccgccgttccccatccgacggcgcccgcgaggatgacgaggatgtggatcaactgttcggcgcatacggatcatcaccaggacctagccctgggccatcaccagctcgccctcctgcgaaaccacctgaagacgagccagacgcagatggttacgaaagtgatgactgcactgctctgggaaccttagatttcagcttgttgtatgatcaagagaataacgcgctgcactgtaccataactaaagccaagggattgaagcccatggaccataatggattagctgacccctatgtgaagctgcacttgctgccgggtgcctctaaagcaaacaaactcaggacaaaaaccctgagaaatacgctgaatccgacctggaacgagacattgacgtactacgggattaccgacgaggacatgatcaggaagaccttgcgaatctctgtttgcgacgaagataaattcaggcacaatgagtttatcggtgagacacgcgttccccttaaaaagctcaagccaaaccatacgaaaaccttctctatttgtctagagaaacagctgcccgtggataaaacagaggacaaatctctcgaggagcgaggaaggattcttatcagccttaagtactccagtcagaagcagggcctgttggtgggaattgtgcggtgcgcgcacttggccgccatggacgcaaacggatactcggatccttacgtgaaaacgtag

SEQ ID NO: 115013 - DNA, 1275 bp, Artificial Sequence
  Description of Artificial Sequence: Synthetic coding sequence
atggctctacccacaccctctgattccactttgcctgctgaggctagaggcagaggacgccgcaggcgtctggtgtggactccttcccaatctgaggctctccgcgcatgtttcgaacgcaacccttatcctgggattgctacaagagaaagattggcccaggcaatcggcatccctgagcctcgagtccagatctggttccaaaacgagaggagtaggcagctcaggcaacatagacgagaatcaagaccttggcctggcagacgtggcccccccgagggcagacgtaaacgcaccgctgttactggatcccagactgccctcttgcttcgtgccttcgagaaggatagatttccaggaatagcggcccgcgaggagctggcccgagaaacggggctgcctgagtcacggatccagatttggttccaaaataggcgcgcccgccatccagggcagggcgggagagctccagctcaggcaggcggcttgtgctcagcagcacctggcggcggtcaccctgctcctagctgggtggcgtttgcccatactggcgcctggggaaccggcctgcctgcgccccatgtaccatgcgcgcctggcgcccttccgcagggcgcctttgtgagccaggctgcacgcgccgccccagctctccaaccttcgcaagcagctcccgccgagggtgtgtcacagcctgcgccagcccgcggcgacttcgcttatgcagcccctgctcctcctgatggggcactcagccacccccaggcacctaggtggcccccacaccctgggaaatctcgggaggaccgtgacccacaaagggatggtctaccggggccctgtgctgtggcccagcccggtcccgcacaagcaggcccccagggacagggggtactggccccaccaactagccagggcagcccttggtgggggtggggccgcggtccccaggttgccggagcagcgtgggaaccacaggccggggctgcaccaccccctcaacccgctcccccagatgcctccgcttccgctagacagggacagatgcagggcattcccgcgccaagccaggcacttcaggaaccagctccttggagcgcgttgccatgtgggttgttgctggatgagctgctggcctctccagagtttttgcagcaagcccagcctctgctggagactgaggcgcctggagagctagaagcctccgaagaggctgcaagcctagaagctccactgtctgaggaggagtatcgagcccttttggaggaattgtag

SEQ ID NO: 115014 - DNA, 1458 bp, Artificial Sequence
  Description of Artificial Sequence: Synthetic coding sequence
atgaaggggtggagtctgcctgcatgtggtccccttcagggtcgcctggcagggtggcttgctgtgcgcgctggcttgctggccgccccagcagccgtgcacagccccgccgaggtccatgggagcccacccgccagtctgtgtcccaggccttccgttaaattcagacctggactgaccgctatggcactccccactccatcagattcaaccctgccagctgaggcccgcggacggggccgcaggcggagacttgtctggaccccctctcagtcagaagctctgcgagcatgcttcgagagaaacccttatcctggcatcgcaacaagggaaagattagctcaagcaattggcatacccgagccccgcgttcagatctggtttcagaatgagcgatcccgtcagcttcgtcagcatcggcgcgaaagccgaccctggcccggcagacgcggcccccccgaggggcggcgcaaacgcaccgcggtgactggcagccagaccgctttgctcctgagggctttcgagaaggacaggtttccagggattgccgcaagggaggagttggctagggagacaggtctgcctgagtcacgcatccagatctggttccagaaccgccgagccaggcatcctggacagggaggacgtgctccagctcaggccggcggtctctgttcagctgcgccaggaggaggccaccctgctccatcttgggtggccttcgctcataccggtgcatgggggacaggactgcccgctcctcatgtaccctgcgctccaggggcgctacctcagggagcctttgtgagccaggctgcccgcgctgcccccgctctacaaccaagccaggcagcaccagctgagggggtgtctcagcccgcaccagcacgcggagacttcgcttacgctgctcctgcaccccctgacggggccctgagtcacccacaagccccacgatggccaccgcaccccggaaagagccgcgaggatcgagatccacagagggatggtctgcctggaccttgcgccgttgcccagcccgggccagcacaggccggtccacagggtcagggggttctggcccctccaacatctcaaggtagcccctggtggggctggggtagggggcctcaagtggcaggggccgcctgggagccccaagcgggagccgcccctcctcctcagccggctcctcctgatgcctctgcctcggctcgacagggccagatgcaaggtattcccgctccctctcaggccctgcaggagccggcgccctggagtgccctgccatgtgggctcctgctggacgaactgctagcttcccccgagttcctacagcaggcacaacccctcctggagaccgaggcccccggtgagctcgaggcttccgaagaagctgcctctctggaagcacctctgtccgaggaggaataccgggctttgctggaggagttatag

SEQ ID NO: 115015 - DNA, 1326 bp, Artificial Sequence
  Description of Artificial Sequence: Synthetic coding sequence
atgaagaccctaccattgcattcacactgcacagagatgcaaaggctgctccccaagctggagatgcttaccctgggttctagcttttgtagtctccaaggcgagttctgtcaagctatggactcgtttacaaccgtctcacatgtggggatgtgtgaagaaacggacgcatcatttaacgtgttcagccctaagtttcaatttgacaggagccattgccagtccctgagatttcaccagaacatggagctggattttggtcattttgacgaaagggataagacttcgagaaatatgcggggatctagaatgaacggtcttccatctcctacacacagtgcacactgcagcttctatcgtacacggactttgcaagccctcagcaatgaaaaaaaggccaagaaggtgcgattctaccgaaacggagatcggtatttcaagggcatagtctacgcggtgtcatcagatcgctttcgtagtttcgacgcactgctcgctgacctgacccgatctctaagcgataacataaacctaccccagggcgtgcgctacatttacacgatcgatggttctcgcaaaattggttcaatggacgagctggaggagggcgagagttatgtgtgctcaagtgataattttttcaaaaaagtggaatacaccaaaaacgtgaaccctaactggtctgtgaacgtgaagacttctgccaatatgaaggccccacagagcttggcaagctccaacagtgcccaagcgcgagagaataaggattttgtccgaccgaaactagtcaccattatccgctcaggggtgaagcctaggaaggcggttcgggtgttactgaataaaaagacagcccactcctttgaacaggtgctgactgatatcactgaggccataaaacttgaaaccggggtggtcaagaagctttataccctggatggaaaacaggtcacatgtctgcacgatttcttcggcgatgatgatgtctttattgcatgtggtccagaaaagttcaggtacgcgcaagacgacttttctctggatgagaacgagtgtcgcgttatgaagggaaaccctagcgccaccgccgggcctaaggcctcaccaaccccccaaaagacctctgcgaaaagccctggccctatgcgccgatccaagtcccctgcagactctgcaaacggtacatcctctagccagcttagcacgcctaaatcgaaacagtccccaatttctacccccacctcccccgggtccctcaggaaacacaaggatttgtacctgcccctatcccttgatgattcagacagtctgggagatagcatgtag

SEQ ID NO: 115016 - DNA, 1098 bp, Artificial Sequence
  Description of Artificial Sequence: Synthetic coding sequence
atggaattagactttggacactttgacgagcgcgataagactagcaggaatatgcgggggtccaggatgaatggcctgccaagtcctacccactcagcccactgttccttctatagaaccaggacccttcaggctctgtcaaacgagaaaaaggccaaaaaggtgagattttatagaaacggcgatcgctatttcaaggggatcgtctacgcggtaagttccgataggttccggagctttgatgcactgctcgctgacctcacgcggtctctgtcagataatattaatttgccccagggagtgagatatatctacacaattgatggaagccgtaaaattggtagcatggatgagctggaagagggcgagagctacgtgtgttcttcggataacttcttcaagaaagtggaatacaccaaaaacgtgaaccccaactggtctgtcaacgtgaaaacttccgccaacatgaaagccccacagtctcttgcatctagtaacagcgcccaggccagagagaacaaagattttgtgcggcccaaactcgtgaccataatcagaagcggagttaagccaaggaaggccgtccgcgtattgctgaacaagaagactgcacattcgtttgaacaggtgctcacggatattaccgaagctattaagctcgagaccggcgtggtgaaaaagctctatactctcgatggcaagcaggtcacatgtctgcatgacttttttggcgacgatgatgtattcatagcttgcggaccggagaagtttcgctacgcacaggacgatttttctctggacgaaaacgagtgtagagtaatgaaaggcaatccgagcgccactgcgggacccaaagcctcaccaactccccagaaaacgagtgctaaatcgcccggcccgatgcgccggtccaagtccccggcagatagcggtaatgaccaggacgcaaacggaaccagctcctcacagctgtctaccccgaaatctaagcagagcccaatcagcacccctacctcaccaggcagccttcgcaagcataaagatctctacctcccgctgtcccttgacgatagcgacagcctcggggattctatgtag

SEQ ID NO: 115017 - DNA, 1098 bp, Artificial Sequence
  Description of Artificial Sequence: Synthetic coding sequence
atggaattggatttcggccacttcgatgagagagataagactagtaggaatatgcgtggatctaggatgaatggtctcccctcccccacgcactccgcacactgttccttctacagaacgcgcacgttacaggccctgtcgaatgaaaagaaagctaagaaagtgcgattctataggaatggcgatagatattttaagggcatcgtgtatgctgtctcgagtgatcgatttcgctccttcgatgcgttactggccgatctaacacggtctttaagtgacaatatcaacctgcctcagggcgtccgatacatctacacaattgatggtagtcgaaaaatagggtcaatggacgagcttgaagaaggcgaatcctatgtgtgctctagcgacaattttttcaaaaaggtcgaatatacaaaaaatgtcaaccccaattggtctgtgaacgtgaagacgtcggctaatatgaaggccccgcagtctctggccagcagcaactctgctcaagcaagggaaaataaagacttcgtacgaccaaagcttgtgacgattattagaagcggcgtgaagccgagaaaagctgtgagagtgctcctgaataagaagacagcacactccttcgaacaagtcttaaccgacatcacggaagctattaaactggagaccggtgtggtgaagaaactgtatactctggacggcaaacaggtgacttgtttgcatgacttttttggagacgatgacgtgtttatcgcctgcgggccagagaagtttcgctacgcacaggatgatttttcactggacgaaaacgagtgtcgagttatgaaagggaatccatctgctacagcgggcccaaaagcatccccaaccccacagaaaactagcgccaagtcgcctggcccgatgcgcagatctaaaagccccgccgactctgggaatgaccaggacgccaatggcaccagcagttcccagctatctaccccaaagtcaaaacagtcccccatcagcacccccactagcccaggttccctgcgcaagcacaaagacctttatttaccactgagcctcgatgatagcgactcgttaggggacagcatgtag

SEQ ID NO: 115018 - DNA, 1317 bp, Artificial Sequence
  Description of Artificial Sequence: Synthetic coding sequence
tgatgcaccgagatgcagagacttctgccaaaactggaaatgctgacactcggcagctctttctgctccctgcagggagaattctgccaggcaatggacagtttcaccaccgtgtctcacgtaggaatgtgcgaagaaacggatgcgagtttcaacgtgtttagtccaaagttccaattcgatcggtcccactgtcagtccctgcgatttcatcagaatatggagttggattttggtcacttcgacgagagagataaaacttccaggaacatgaggggcagccgtatgaacgggcttcccagcccaacccattctgctcattgttccttttatcgcacacgcaccctgcaggccctgtcaaacgaaaaaaaggcaaagaaagtccggttctatcggaacggggatagatacttcaaggggattgtgtacgccgtatcctcggaccgttttcgtagttttgacgccctgctggctgatctaacccgaagcctttctgacaacattaacctgccccagggcgtgcgctacatctatacaatcgatggcagcaggaaaatcggtagtatggacgaattggaggagggcgaatcttacgtgtgcagtagtgataactttttcaagaaggtcgaatacaccaagaatgtgaaccccaattggtccgtaaacgtaaagacttccgctaatatgaaggccccccaatctctggcctcttcaaacagcgcccaggccagagagaacaaagattttgtcagacccaagctggttaccatcattagaagcggagtgaagccaagaaaggcagtgcgcgtacttctcaataagaagacagctcacagcttcgagcaggtactgacagacattacagaggctataaagctggagaccggggtcgttaaaaagctttataccctggacggaaaacaggtcacctgtctccacgatttctttggcgacgatgatgtgttcatagcttgcggtcccgaaaaattccgttatgcgcaggacgacttctcattggatgagaatgaatgtcgggtgatgaaggggaatccgtccgctacagccggacccaaagccagccctacccctcaaaaaacctcggcgaagtctccaggccctatgcgccgctccaagagcccagccgacagcggaaacgaccaagacgccaacgggacctctagcagccagctgagtacaccaaagtcgaaacaatccccaatctcgaccccaacttccccgggcagtctgcgcaagcataaggacctgtacctgcccctgtccctggacgattctgattccctcggagacagtatgtag

SEQ ID NO: 115019 - DNA, 1083 bp, Artificial Sequence
  Description of Artificial Sequence: Synthetic coding sequence
atggagctcgatttcgggcatttcgatgagcgcgataaaactagcagaaacatgcgggggagccgcatgaatggattaccttcacccacccacagcgctcactgttcgttctatcggacacgcaccctgcaggcccttagtaatgagaagaaggcgaagaaagttaggttttatcgcaatggtgatcggtatttcaagggcatcgtgtacgctgtcagcagtgatagattcagatctttcgacgcattgttagctgacttaacccgctcactatcggacaatattaatctgcctcagggggtaaggtatatttacacgatagatggatcccgcaaaattggaagcatggatgagctggaagagggcgagagttacgtctgttcctcagacaacttttttaaaaaggtcgagtacactaagaacgtaaatccgaactggtctgttaatgtaaagacgtcagctaacatgaaagcccctcagagcctggccagttctaactctgcccaggcccgcgagaataaagatttcgtgagacctaaactagttacgatcatccgctctggtgtcaaaccaagaaaggcagtgagggtactcctgaacaaaaagacagcacactctttcgagcaggtgctaacggacattactgaagccatcaaattggaaaccggggtagtgaaaaagctctataccctggacgggaagcaagtcacttgtctgcatgatttttttggggacgatgacgtctttattgcttgtggtcctgagaagttcaggtacgctcaggacgacttttctctggatgaaaatgagtgcagggtcatgaagggcaatccatctgctacagcaggccccaaggcttctccaaccccgcagaagacctctgccaagagccctggtccaatgagacgctcaaagagccctgccgactcagccaatggcaccagctcctctcagttgtctacacccaagtctaagcaatcccccatatccaccccaacatcgcccgggtcactcagaaaacataaggacctgtatctccccttgtcgctggatgatagtgatagcttgggcgattctatgtag

SEQ ID NO: 115020 - DNA, 342 bp, Artificial Sequence
  Description of Artificial Sequence: Synthetic coding sequence
atggagctcgactttggtcattttgacgaacgggacaagacctctcgtaacatgcggggctcccgcatgaacggattgcccagccccactcactccgctcattgctccttctaccgcaccagaacgttacaagcactgagtaatgaaaaaaaggccaaaaaagtgagattttacagaaacggcgacaggtactttaagggaattgtgtatgcggtatcctctgacagattcaggtccttcgacgcactcctggctgacttgacacgcagcttatccgataacatcaacctaccgcagggcgtccgatacatctatacaatagatggctctaggaaaatatag

SEQ ID NO: 115021 - DNA, 1083 bp, Artificial Sequence
  Description of Artificial Sequence: Synthetic coding sequence
atggaactcgatttcggccacttcgacgaaagggacaagacctccagaaatatgagaggaagtaggatgaatggactcccatcccccacgcactcagcccactgtagtttctaccggactcgcaccctgcaagctctgtctaacgaaaaaaaggctaagaaggtccggttttaccgcaacggggatcgctattttaagggaatcgtctatgccgtgtcgagcgaccgctttcgcagctttgacgctcttttggcggatttgacacgatcactctctgataatattaatctgccacagggcgtccgttacatatacaccattgatggctctcgtaagatcggatctatggatgaactggaggagggtgagtcgtacgtgtgctctagcgataactttttcaagaaagttgagtacaccaaaaatgtcaaccccaattggtccgttaacgtcaaaacctcggccaacatgaaggcgcctcagagcctggcttccagtaacagtgcccaggcaagagagaacaaagacttcgtgagaccaaagttggtaactatcatacggtcaggcgtaaagcctaggaaagcggtgagagtcctgctcaacaaaaagactgcacatagctttgagcaggtgttaactgatattaccgaggcaatcaagttggaaacgggcgtggtgaagaaactttatacactggatggcaagcaggtgacatgcctacacgacttcttcggcgatgacgatgtctttatcgcttgtggtccagagaagtttaggtatgcacaggatgattttagcctggatgagaatgagtgtagagtgatgaaggggaatccatctgcaactgcaggtccaaaagcatcccctacgccccaaaaaactagtgccaaatctcccggacccatgcgcaggtccaagagccctgcagacagcgcgaatggtacttcctccagtcagctgtcaacccctaaatccaagcagtctcctatttccaccccaaccagcccaggttctctgcgcaagcacaaagacttatacctgcctctgagcctggatgattccgactcactgggtgattccatgtag

SEQ ID NO: 115022 - DNA, 1065 bp, Artificial Sequence
  Description of Artificial Sequence: Synthetic coding sequence
atggctaagacgggggccgaagaccatcgggaggccctgtcccagagttccctcagcctcctcacagaagccatggaggtgttgcagcagtcgtccccggagggaacacttgacggcaataccgtgaacccaatatataagtatattctcaatgacctgccccgggagtttatgagttcacaggcaaaggccgtaataaagactacagacgactatctacagagtcaatttggcccaaataggctggtccatagcgcagctgttagcgaggggagcggcctgcaggactgttccacccaccagactgcctcggaccactcacacgacgagataagcgacctggattcttataagtccaatagcaaaaataattcttgctccatatctgcttcaaagaggaacaggcctgtgagcgctccagtgggccaactgagagtcgccgagttctcctcactgaaattccaatctgcccgaaactggcagaaattgtcccagcgccacaaattgcagccccgggtgattaaagttaccgcttataaaaatggttcaaggaccgtctttgctagggtgaccgtacctaccattactctgttactcgaggagtgtacagagaaactgaacctgaatatggctgcacggagggtatttctggccgacggcaaagaggctctcgagcctgaggacattcctcacgaggctgacgtgtatgtgagtaccggcgagcctttcttgaacccctttaagaagattaaggaccacctgctgctaatcaagaaagtgacatggacgatgaacggacttatgctgcctacagacataaaacgtcgcaagactaagccagtactgtctataagaatgaaaaaattaaccgaaaggacaagcgtgcggatactttttttcaaaaatggcatgggccaggacggtcacgagattacggtaggcaaagagaccatgaaaaaagtacttgacacgtgcaccattcggatgaacctgaacctgccagccaggtacttctacgacctgtatggcaggaaaatcgaagatattagtaaagggaagcactag

SEQ ID NO: 115023 - DNA, 690 bp, Artificial Sequence
  Description of Artificial Sequence: Synthetic coding sequence
atgaaaatgtggaataactggggctggtgcgggggccggcgccgaggatgcaccaagattctgtctactaagaagggaattcagatgagtatcaagaacaaacatctcatcgtgatcccagctttttcccacacgatgagtcagctcgacttcgatttccactgcgtatttgtgtctattgatgaagggatcttcaaagccggcgccgaacgaagtgagactcgaggagcagctgaagtccaggaagatgaggatacgcaggttgaggtcccggttgaccagcggccggccgaaatagttgatgaggaggaggatggcgaaaaggccaacaaggacgccgagcagaaggaggatttttccggaatgaatggagacttggaggaagaagggggccgtgaagcaactgacgctcctgagcaggttgaagagatcttggatcactcagaacagcaggcgagacccgcccgggttaacggcggaactgacgaggagaacggcgaagagctgcagcaggtgaataacgagctgcagttagtgctggacaaggagcggaagagccagggcgccgggtccggccaggacgaggctgatgtcgatcctcaacgacctcctcggccggaggtgaagatcacctctccagaagagaatgaaaacaatcagcaaaacaaagactacgccgctgtggcctag

SEQ ID NO: 115024 - DNA, 1431 bp, Artificial Sequence
  Description of Artificial Sequence: Synthetic coding sequence
atgagcggcagctccgcccgatcaagtcatctgtctcagccggttgttaagtccgtgttagtgtatagaaatggcgatcctttttacgcagggagaagggtggtgattcacgagaaaaaggtgtccagtttcgaggtgttcctcaaggaagtgactggcggagtgcaggctccattcggcgcagtccgcaacatctacacacctcgtacaggccaccggatacgaaagctggatcaaattcagtcaggtgggaactatgttgcgggaggccaagaggctttcaaaaagctaaactacttggacataggtgagatcaagaagaggcctatggaagttgtgaacacagaagtgaagcccgtgattcatagcagaatcaacgtatcagccaggtttcggaaacccctgcaggagccctgtaccatcttcctcatagcaaacggggatctaattaaccccgccagtcggctcttgattcccaggaaaaccctcaaccagtgggatcatgttttacagatggtgaccgaaaagataacgctccggtcaggggcggtgcacagattatacacactggaagggaaactggttgagtcaggggcagaactcgagaacggccaattctatgtagcagtgggtcgcgacaagttcaaaaagctgccatatagtgaactgttatttgataagtcgactatgaggcggccttttggccagaaagcatcctcactgcccccaattgtgggctccaggaagtcgaagggcagcggaaacgataggcattcaaagtcaactgtcggaagcagtgacaactcctcacctcagccactgaaacggaagggcaaaaaagaggacgtcaacagcgagaaacttactaaactgaagcagaacgtgaagctgaagaatagccaagaaacaattccaaactccgatgaaggaatcttcaaagccggcgccgagagatccgaaacccgtggcgccgcagaagtgcaggaggatgaggacacgcaggtggaagtgcctgtcgaccagcggccagcggaaatagtggacgaagaagaagatggcgagaaagctaacaaagatgccgaacagaaggaagatttctccgggatgaacggcgatctggaggaggaagggggacgcgaagctacagacgctccagagcaggtagaagaaattttagatcattccgagcagcaggccaggccggcacgggtcaacggtggtaccgacgaggaaaatggggaggagctgcagcaggttaataacgaacttcagctggtgcttgataaagagcgcaaatctcagggcgccgggtcagggcaggatgaagccgatgtggatccacaacgccccccccgcccagaggtgaagatcacgtctccagaagaaaatgaaaacaaccagcaaaataaagattacgcagccgtagcttag

SEQ ID NO: 115025 - DNA, 267 bp, Artificial Sequence
  Description of Artificial Sequence: Synthetic coding sequence
taggtggtgatccatgaaaaaaaggtttcgtccttcgaggtcttccttaaagaagtcacagggggcgtgcaggccccatttggggccgtccgcaatatttacactccaagaaccgggcatcgaattcgcaagctcgatcagattcagtcaggcgggaactatgtggctggaggccaggaggcattcaaaaagttaaattatctggatatcggcgaaataaaaaaaaggccgatggaggttgtgaacaccgagcttcatgtgctgtag

SEQ ID NO: 115026 - DNA, 363 bp, Artificial Sequence
  Description of Artificial Sequence: Synthetic coding sequence
atgagcgggtcctccgcacgaagcagccacttgagtcagccagtggttaagtccgtcctcgtctaccgcaacggagatcctttctatgcagggcggagagtcgtcatacacgagaagaaggtgtctagctttgaggtgtttctgaaagaagtcaccgggggagtgcaggccccttttggcgccgtccggaacatctacacacctcgcacagggcacaggattcggaagctggatcagatccagtcaggcggcaactatgttgcaggaggccaggaggcctttaagaagctcaattacctcgacatcggcgagatcaagaaacggccaatggaggtggtgaatacagagcttcacgtgctgtag

SEQ ID NO: 115027 - DNA, 1947 bp, Artificial Sequence
  Description of Artificial Sequence: Synthetic coding sequence
atgaaaaaaccaatttgcaagacgaccgagccgtacgcaccagtgagattaagggtcctgcaaaacggtgagaagaataagaataggtccgttacaatactgggaccggacatcagtcccggtcgaaaaacacagtgtaccgagattctgaacctgcctagtgctgctcgccgtctgtacaacgagaaaggcaaagagatcttcgcactgaaggacctgcagagagatgaattagtgtatgtgtcctgtggcgaactgtggattaaccctgaccttagtatcgcccaacagaagaaacagatctttttaaggaacctcgagagcgatatcgcgaagattcagatattttgttctacacataagatcgaggcgttagtactcgaggtccagtcagacatagtcagtggcagcaagctggcggtgcacaagcccgtagctatattcggcgaggagaaacaggtgaccgagcccgaggagaagcagatgcaggaagatccactgactaccgagaatgcttcttcggagatattagattcccacgtcagagcacacctgaggatgaaagcatgtcacactttaccaagatacgcgtggcaagaaacatctcacgactttgatgaagatgactctcttcctaaaaaaactgaaaaaggcctttttgagaatgtggagccacagaaaaagcactcttgctcccctaagcacagtaaactccataagcactgccatcagcagttcgaatatagggacggccaaatcataagccacgcggctcctcagctagtgctaggggttcagggcccaaatctgagaagtggcatggaagtagtccttgtcgagaagaaatcagatggttctcaccaaaggtggattcatcaggaagattctcgaaccttccatctggtttccaacccagatcttgtcctggctgtaagcatgacaaaaacacgtaatgaggtgtgtgggtatccagttatcgttcagaagtacaaaccttacaacaatggcgccgcgaatcagaagtggcactatatgaaaaatattaaggccctagttgcttttcattctacagccctggacaaggaaatcacgagcgctaactatgccggggtgtgcacatcatcagtcattaaggaagagaacatcgaccagcctggatactgctacctaagccctgatggcaaacgcaaaactatgctgtgtctggcctgcggtcagtctatgaggaccgaaaagggattgaagcagttgctgcctggagtgcctttcctatgtataagtggaaccaaaacccaaaaaccatttctgcaggggccgttcaaagtcatctcagtcgcggaagtggatttatcatgtgataaggctgaaaagacactgagctattatcaggctagactgctgtccctgcgcatgaagacttgtacccaggcagcctcgcattctggtatggcagctacccatcagaaagccgtgaaaatcatcgcctataagaatggcgacggttatagaaatgggaagttgatcgtggcaggaacgttccccatgctgctcaccgagtgtactgagcaactgggcctggccagggccgcttctaaagtctatactaaggatggaacgcccatattcactctccgggacttggttctatgggctctggacgagagcttcctccagagggacagcgagaaacaaaagcaggacgccgctccggtagggaaggaacagatcattgtcgaaaaaaatcctaggatgaaggttaagaaccgactcttcgctaaatctgtaacgagcgactccctcgatggcattgataagtcgctcctgaccctgattctccgcaatccaatcgccatttgggttagctgcggggaaccctttctgccccctaacgagagcaggaaaatacgggaaaccgagcttgcaaagaagggccagaacttcggctag

SEQ ID NO: 115028 - DNA, 1365 bp, Artificial Sequence
  Description of Artificial Sequence: Synthetic coding sequence
atgaagaatatcaaagccttagtggcattccattcaacagctctggacaaggagattacctctgccaactatgccggcgtctgcacctcttcagtgataaaagaagagaacatcgatcagccaggctattgttacctgtcccctgacgggaagcgcaagacaatgctctgccttgcctgtggccagtcaatgcgcaccgagaaaggcctgaagcagctactgcctggagtgccttttctatgtattagtggtactaagacacagaagccatttctgcaaggcccatttaaagttatttctgtcgcagaggtcgatctttcctgcgacaaggcggaaaagactcttagctattaccaagctagactactgagcttgcgaatgaagacctgtacacaggcagcctcccattctggaatggccgccacacaccagaaggccgtgaagataatcgcctataagaacggcgacggctaccggaatggaaaactgatagtggccggaacctttcccatgctcctgacagagtgtacggagcagctgggtctggctcgggcagcaagcaaagtgtataccaaagatggtacacctatctttactctgcgtgacctggtgctatgggcactggacgaatcttttttacagagagactctgagaaacagaagcaggatgccgcaccggtgggcaaggagcagattatcgttgagtcaatggaggagaatccccggatgaaagtgaagaaccgattgtttgcaaagtccgtgacctccgactctctcgacggaatagataaatcactgctgactttgatccttcggaaccctattgccatctgggtcagctgtggggagcctttcttaccgcccaacgcgctgcagaaagccgagaaactagaaaaacagaactggctgaagaaagatcgcatactcgccgacctggatactatgaggcataagatgaggcagctcaaaggtcggcgagtggccgcttgccagcccgctaccatggtgcccactaagtctcctgtgcaacccgtcgtggtagagggcggctggacggaacagactcaacaggagattaagctgatggaattgataagacataccgaggcacacctatcagaaatccaggaaatggagtcaaaaattaacttccctatcgccaccaaacggatagccgtaaagccatctaacctctacaagcagccaaacacaaaacgggtgtggatctatctgaacggcggacgaccggaagacgggacttacgcatggggaaaaacgatctctgaggtatccctcctatatctgaaaacatggattttcatttggagcagaaaggtctttttttatttccttatcaccgcttag

SEQ ID NO: 115029 - DNA, 2190 bp, Artificial Sequence
  Description of Artificial Sequence: Synthetic coding sequence
atgtccttcggcagagatatggagcttgagcacttcgatgaacgtgacaaggctcagcggtattcacggggaagtagggtaaacggtttaccatccccaacccacagtgcgcattgctcattctacagaactcgcactctacagaccctttcttccgagaagaaggccaaaaaagtgaggttctatcggaacggcgacagatatttcaagggaattgtgtatgcaatatccccagaccggtttagatcttttgaagccctcttagctgatctgacacgcactctgtccgataacgtgaacctgcctcaaggtgtacggacgatctacactatcgatggcctcaaaaagatttcttcactagatcaactggtggagggagagtcgtatgtttgcggaagcatcgagccattcaagaagttggagtataccaaaaatgtcaatcccaactggtctgtaaatgtgaagactacatcagccagtagagcggtttctagcctagccactgcaaagggaagtccttctgaagtgcgcgagaacaaggactttatccgccctaaactcgttaccataatccgttcaggcgtgaagccaagaaaggcagtccgaatattgctgaacaaaaaaaccgcccacagtttcgaacaagtcctcacagacatcactgatgccatcaagctcgactcaggagtggtgaagcgcctctataccctggacgggaaacaagtaatgtgtttacaggacttttttggtgacgacgatatctttatcgcctgcggccccgagaaattcaggtatcaggatgattttttactggacgagagcgagtgtcgggtggtgaaatcaacttcatacacaaaaatagccagtagctcccgccggagtacaacgaagtcaccagggccttcccggagatctaagtcccctgccagcacctcatcagtcaacggcacgcccggatctcagctgagcacacctagaagtggaaagagcccgagcccatcaccgacatcgcctgggtcattaagaaaacagcggtcatctcagcatggtggctctagcacttctctggcatcaaccaaagtctgctcatcaatggacgaaaacgatgggccaggagaagaagtgagtgaggagggcttccagatccccgccaccatcaccgaaagatataaagttggcaggacaatcggggacggcaacttcgcggtagtcaaggagtgcgtggaacgcagcaccgcccgagaatacgcattgaaaattattaagaagtcaaagtgccgcggcaaagagcacatgatacagaacgaggtctcgatacttaggcgggtgaagcacccaaatattgtcttactgatcgaagaaatggacgtgcccaccgaactgtatctagtcatggagctggtgaaaggaggggatctgttcgatgcaataacatccaccaataaatataccgaacgagatgctagcggtatgctgtataacttggcctcggcaatcaagtatttacactcgctaaacattgtgcatcgcgacattaagcccgagaacttgctggtgtatgagcatcaagatggatcaaaaagcctgaagttaggggactttggacttgcaacaatcgttgacgggcctttatatacagtgtgtggcactcccacttacgtggcaccggagattatcgcagagacagggtatgggctaaaagttgacatctgggctgccggcgttatcacttacatcctgctgtgcggattccctcccttccggggttctggagatgatcaagaagtcttattcgaccagatactaatggggcaggtggattttccctcaccatattgggacaatgtgtccgattccgccaaggagcttatcactatgatgcttctggtggacgtggaccagaggttcagcgctgtccaggtcctagagcatccttgggtgaacgatgacgggctgccggaaaacgaacaccaactgagtgtggccggaaaaataaaaaagcactttaatacgggaccgaaacccaactccacggccgcaggtgtgagtgtcattgccctcgatcatggattcaccattaagcgctctggcagcttggactactaccagcagccgggcatgtactggatcaggccccccctgctgatccgacgaggacgtttctccgatgaggacgcaactcgcatgtag

SEQ ID NO: 115030 - DNA, 2223 bp, Artificial Sequence
  Description of Artificial Sequence: Synthetic coding sequence
atgtcctttggtagagacatggagctcgaacatttcgatgaacgggataaggcccagagatacagccgggggagccgagtgaatggtctcccctctcctacccactcagctcactgttccttctaccgcaccaggactcttcagaccctgagcagcgaaaagaaggcgaaaaaagtgaggttctataggaatggagatcgctatttcaaagggatagtatacgccataagtcctgacaggttccgctccttcgaggcattgctggccgacttgaccagaactctgtctgacaatgtaaatttgccgcagggtgtacgcaccatctacaccatcgatggcttgaagaaaatctctagtcttgatcaactggttgagggcgagtcctatgtgtgtggctcaatcgagccatttaagaaattggagtacacgaaaaacgtgaaccccaattggtccgttaatgtcaagacaacctcagcgagcagggccgttagctccctagccacagccaaaggaagccccagtgaggtgcgcgagaataaggactttatcaggcctaaattggtgactatcatcaggagcggcgtgaaacctcgcaaggccgttagaattctcctgaacaaaaaaactgcacattcctttgaacaagttctgaccgatatcacggacgcaataaaactggactccggagtcgtgaaacgactgtatacactagacggcaagcaggtgatgtgcctgcaggatttcttcggggatgatgatattttcatcgcatgcggccccgaaaaattccggtaccaagatgattttctactggacgagagcgagtgcagggttgttaagtcaaccagctatacaaaaatcgccagctcctctagacgatcaaccactaaatcccctggccctagccggcgctccaagtcaccggccagtacatcaagtgtgaacggcactcccggatcccagctttcaacaccacgttctgggaagtctccctccccaagcccaacaagtccggggtccctgcgcaagcagcgttcttctcagcacgggggctcctctaccagcctggcaagcaccaaggtctgctcctcaatggatgaaaacgatggcccgggggaggaggtaagcgaggagggctttcagattccagctacaattacagaaaggtacaaagtcggacggacaatcggagatgggaattttgcagtggtgaaagagtgtgtcgaacgcagtacagctagggaatacgcactgaagattattaagaagtctaaatgccgaggcaaagagcatatgatccagaacgaggtcagcatcctgagacgggttaagcatcccaatattgttttgctgattgaggaaatggatgtgcctaccgagttatatcttgttatggagcttgtgaaaggcggggacctattcgatgcaatcaccagcaccaataaatacaccgaacgagacgcctccggaatgctgtacaacctagcgtccgcaataaaatacctccacagcttgaatattgtgcatcgcgatataaagccggaaaatctgctggtttatgagcaccaggacgggtcgaaatcactgaagcttggagacttcggcctggctacgattgtggatgggcctctgtacaccgtgtgcggcaccccaacatacgtggcccctgaaatcatcgccgagacaggctacggcctgaaggtggacatatgggctgccggcgtgatcacctacattctattatgcggatttccgccctttaggggcagcggcgatgaccaggaagtgttatttgaccagatactaatggggcaggtagattttccctcaccatattgggataacgtctcggactcagctaaggagcttataaccatgatgctcctggtggacgttgaccagcggttctccgccgtccaggtccttgaacatccttgggtcaatgatgatggcctgcccgaaaacgaacaccaattgtccgtggctggtaaaatcaaaaaacactttaacacaggccctaagcccaactctaccgcagcgggggtttccgtcatcgctacgacagccctggacaaagagagacaggtgtttcgcagacggagaaatcaggacgtgcggagtagatataaagcacaaccagcccccccagagctgaacagtgagtcagaggactactccccttcttccagcgaaaccgtccgaagccctaactcccccttttag

SEQ ID NO: 115031 - DNA, 1092 bp, Artificial Sequence
  Description of Artificial Sequence: Synthetic coding sequence
atgagtttcggcagagatatggagcttgagcatttcgacgagcgggataaagcccagcgatactctcgaggcagtagagtgaacggactccctagccccacccatagtgctcactgcagcttctataggacacgcacactccaaactctcagctctgagaagaaggccaaaaaagtacgcttctaccggaatggggacagatacttcaagggaatcgtctatgccatttccccagataggtttagaagctttgaagctttgttagccgatttgacgagaaccctgagtgataacgtgaatctgccccagggcgtgcgtaccatttatactatcgacggcctgaagaagatctctagcttggatcagctggtggagggagagtcctacgtgtgtggatctatcgaacctttcaaaaagttggagtacactaaaaatgtgaatcctaattggagtgtaaacgtgaaaactacgtctgcctctagagccgtaagttcactggccacagcaaaggggtccccctctgaagttcgggagaataaggattttatccgccctaaattagtgaccatcatcaggagtggagtcaaaccgagaaaagctgtacgtatcctgttaaacaaaaagacagcccattcattcgaacaggtgctcaccgacataactgatgctattaagctggacagcggcgtggtaaaaagactatacactctggatggtaagcaagtgatgtgcctgcaggacttttttggtgacgacgatatctttatagcgtgtggacctgaaaagtttcggtaccaggatgactttctccttgatgagtcagagtgtagggtcgtgaagagtacttcatacaccaagatcgcctcaagtagtcggagatctactactaagtcccctggaccaagcaggcggtctaagtctccagcatcgacctcaagcgtcaatggcaccccggggtcacagctatctactcctagatccggtaagagccctagtccaagccccacgtcacccggcagcttacggaaacagagagatctataccgcccgctatccagtgacgacttagacagcgtcggcgatagcgtgtag

SEQ ID NO: 115032 - DNA, 1302 bp, Artificial Sequence
  Description of Artificial Sequence: Synthetic coding sequence
atgctcgaactcatcgaagttaatggcacaccagggtcccagcttagtacacctcgctcggggaaatccccttcaccctcaccaacaagccctggcagccttcggaagcagcgctcctcacagcatggcggctcaagcacatccctggcttcgacaaaggtctgctcttccatggatgagaatgacggtccgggcgaagaggttagtgaggaaggtttccagatccccgcaacaattacagagcgctacaaagtagggaggactattggcgatggcaattttgctgtggtcaaagaatgcgtggaaaggagcacagctcgggaatacgcattgaaaataataaagaagtcgaagtgtcgtggaaaagagcacatgattcaaaatgaggtgagcattctgaggcgtgtaaagcatccaaatatcgtactgctcatagaggaaatggatgtgcccacggagctgtacctggtcatggagctagttaagggaggtgatttgtttgacgccatcacttctacaaacaaatataccgagcgcgacgccagcggcatgctgtataacctggcaagcgccattaaatatctacacagcttgaacatcgttcatagggacatcaagccagagaaccttcttgtgtatgagcaccaagatgggtccaagtctttgaagttgggtgattttggcttagctacaatcgttgatgggcccctgtataccgtatgcggcacccccacatatgtggcaccagagattatcgccgagaccggatacggattgaaggtggacatttgggccgccggagttatcacgtatatcctgctttgcggattcccaccatttagaggatccggagatgatcaagaagtgctcttcgaccagatcttgatggggcaagtggactttccttcaccttactgggacaatgtctcggactctgcaaaggagctgattaccatgatgctgctggtggacgtggatcagaggttcagtgcggtgcaggtcttggagcacccttgggtcaatgatgacggtttgcctgaaaacgaacaccagctgtcggtagccggcaaaatcaagaaacattttaacactggacctaaacctaatagcactgctgcaggggtgtccgtgattgccactaccgccctggacaaggagcgccaagtattccgaaggcgacggaaccaggacgtgagatctaggtacaaagcacagcccgcccccccagagctgaacagtgagtcagaggattattccccctcgtcctcagagaccgtccggagtcctaactcaccattctag

SEQ ID NO: 115033 - DNA, 1266 bp, Artificial Sequence
  Description of Artificial Sequence: Synthetic coding sequence
ttatcattaatcaagttcaacggaacccccggcagccagttatcgactcctcgtagtggcaagagtcccagcccctctcctacatctccgggttccctgaggaaacagcggagtagccaacatggaggcagcagcactagcttagcgagtacaaaggtgtgttcaagtatggatgaaaacgacggccctggggaagaggtatctgaggaaggcttccaaatccctgcaactatcacggagcgctacaaagtgggacgtactattggtgatggtaacttcgccgtggtgaaggagtgcgtggagcgctccaccgccagggagtacgccctcaaaatcatcaagaagtctaagtgtagaggcaaagaacacatgatccagaatgaagtctctattctgagaagggtgaagcaccccaacatcgtcctgctaatcgaagagatggacgtcccaaccgaactatacttggtgatggagctcgtcaaggggggtgatctgtttgacgctattacctccaccaacaaatacacagagagagacgcctcaggaatgctgtataacctagcctccgccatcaaatatctgcatagcttaaacattgttcaccgggacataaagccagagaatcttctggtgtacgagcaccaggacggatccaagtccctcaagttaggagactttggacttgcaacaatcgtggacgggccactgtacacagtctgcgggacaccaacctacgtcgcccctgaaatcattgctgaaactggctatggcttgaaagtggacatctgggccgctggcgtcatcacatacatcctgctatgtggattcccaccttttcgaggctccggggacgatcaagaggtgctgttcgaccagattttgatgggccaggtggactttccctcaccctattgggataatgtctcagattctgccaaggagcttattactatgatgctgctggttgatgtagatcagcgctttagcgccgtacaggtgcttgagcacccatgggttaatgacgacggccttccggagaatgaacaccagctttcagtggctggaaaaatcaagaaacactttaatactgggcccaaaccgaattcaactgcagcgggggtgtcggtcatcgctctggatcacggatttactatcaagcgtagcggatccctggactactatcagcagcctggtatgtactggattcggcccccgctgttaatacgtcgaggtcgcttttcggacgaggatgcaaccagaatgtag

SEQ ID NO: 115034 - DNA, 1860 bp, Artificial Sequence
  Description of Artificial Sequence: Synthetic coding sequence
atgtcattcggacgcgatatggaactggaacattttgacgaaagggacaaggcccagcggtatagccgtggttcccgggtgaacggtttgccttcacccacccactctgcacattgttcattctatcggacaaggaccctgcagacactcagtagcgagaaaaaagcaaaaaaagtgcggttttatcgtaatggagaccggtattttaagggtattgtgtatgctataagccccgaccgcttcagatcctttgaggcattgctcgcagatctgaccaggaccctgtcagacaatgtgaatctgccccagggtgtgaggactatttataccattgacggtctgaagaagattagctctctggaccaacttgtcgagggcgaatcatacgtgtgtggctcaatcgaacccttcaagaaacttgagtatacaaagaatgtgaaccctaactggagcgttaatgtgaagacaacgagtgcaagccgcgccgtctccagcttagcaaccgctaagggatccccctccgaggtcagggagaataaggattttatcagacccaagctcgtcaccataataaggtccggagttaagccccgcaaggcagtccgaattctgctgaataagaagacagcgcacagttttgaacaggtccttaccgacataactgacgccattaagctcgactccggtgtcgtcaaacggctgtacactttagatggcaagcaagtcatgtgccttcaggactttttcggagacgacgacattttcatcgcatgcggtcccgaaaaattccgttaccaggatgatttccttcttgacgaaagcgagtgtagggtcgtgaagagtacgagttataccaagatcgcctcatcctccagaaggtcaactaccaagtcccctgggcccagcagacgatctaaaagccctgccagtaccagctccgtgaatggcaccccagggagccaactgagcacgcccagaagtggtaagtccccctcaccttcccctactagtcctggctccctaagaaaacagcgatccagccagcatgggggcagcagcacatccttggccagtactaaagtgtgtagctcaatggatgagaacgacggtcctggcgaggaggtatcagaggagggctttcagattcccgcgacaatcacagaaagatacaaggtgggtcgaaccatcggagatgggaatttcgctgtggtgaaggagtgtgtcgagcgctcaacagcgcgcgagtacgccctaaagattatcaaaaagtcaaagtgcagggggaaagagcatatgatccagaacgaggtctccattctgcggcgagtcaaacatcccaacatagtgctgcttatagaagagatggacgtgcccactgaattgtacctggtaatggagctggtcaagggcggcgacctgtttgatgccataaccagcacaaacaagtaccttcactccttaaacatcgttcatagggatatcaagcctgaaaatctgcttgtttacgaacatcaggatggcagcaagagcttgaagttgggcgactttggcctggcaacaatcgtggacggaccactgtacaccgtgtgtgggacaccaacttatgtggcccctgagattatcgccgagacaggctacggtctgaaagtggatatctgggctgcaggagtcataacatacattcttttgtgcgggtttccaccgtttagaggcagcggagacgatcaggaagtgctcttcgaccagatcctgatggggcaggtggattttccttccccatactgggataacgtctctgatagcgcgaaagagctgatcacaatgatggcttctcagaagatgaacatttcctgccaatag

SEQ ID NO: 115035 - DNA, 2301 bp, Artificial Sequence
  Description of Artificial Sequence: Synthetic coding sequence
atggcaagcacaaggtctatcgaactggaacatttcgaagagcgggataagcgtcctagaccgggcagcagacggggagcccccagttctagtggcggaagttcctccagcgggcctaaaggcaatggccttatacctagtccagcccactccgcccattgctctttctatagaactaggacacttcaggctttgtcttctgaaaagaaggcgaaaaaagctcggttctatcgcaatggggaccggtactttaagggattggtattcgccatctctagcgaccgctttagaagcttcgatgctcttctcattgagctgactcgcagcctgagtgataatgtcaatctgcctcaaggtgtaagaacaatttacacaatcgacggtagccgcaaagttacaagccttgacgagctattggagggtgaatcatacgtctgtgcgagcaatgaaccattccgtaaggttgattacacgaagaacattaaccccaattggagtgtgaacataaaaggcggcacctcgcgggccctagcggcagcctcttctgtcaagtcagaggttaaggaatccaaagattttattaagccaaagcttgtgacagtgatcaggtcgggtgtgaaacctaggaaagccgtccggatccttctcaacaagaaaaccgcacactccttcgagcaggttttgaccgacatcactgaggccatcaagctggactctggtgtggtgaagcgcctttgcactctcgacggcaaacaggtgacttgcctccaggacttctttggggacgacgacgtgtttattgcctgcggacctgaaaagtttcgttacgcccaggacgacttcgtgttggatcactccgagtgtcgggtgcttaagtccagttattcacgcagcagcgctgtaaagtacagcggcagtaaatcccctggtccttcgaggagatctaaaagtcccgcctctgttaatggaacaccaagcagccagctcagtactcctaaatccactaagagttcatcctcttctcccacgagccctggctcctttcgcgggcttaaacagatctcagcccatggtcggtcctccagcaacgttaacgggggccccgaattggatcgttgtatcagtcctgagggggtaaatgggaatagatgctccgaaagctcaactttacttgagaagtacaagatcggcaaggtgataggtgacggcaactttgccgtcgtgaaggagtgcatcgaccggtcgacgggcaaggaattcgccctgaagattattgataaggccaaatgctgcgggaaggagcacctgatagaaaacgaggtctccatcttacggcgtgtgaagcatccaaatattattatgctcgtcgaggagatggaaacggcaacagaactctttctggtaatggaactggtaaaggggggtgacctgttcgacgcgattacaagctcaacaaagtacaccgagagagacgggagcgccatggtctacaacttagctaacgctctgagatatcttcacggcctgagcatcgtccatcgggacatcaaacctgagaacctgctggtctgcgagtatcctgacggaaccaagagcctgaaattgggcgacttcggtcttgcgacagtcgtcgagggcccactgtatacagtttgtggcacaccaacatatgtggctccagaaatcattgccgaaactggttacggattgaaggttgacatttgggcggctggagtgataacctacattttgctgtgcggctttccgccgtttaggtcggagaataacctgcaagaggacctattcgatcagatactggccggcaaactggagtttcccgccccttactgggataacatcacagacagtgccaaggagttgatttctcaaatgttgcaggtgaacgtggaggcacgctgcacggcaggacaaatcctttcacatccctgggtgagcgatgatgcttcacaggagaacaatatgcaggctgaggtcactggtaaactgaaacagcacttcaataacgcactgcccaagcaaaattcgaccactaccggggtatccgtaattatgaatactgctttggataaagaaggtcagattttttgttctaaacattgtcaagattctggcaggccaggcatggagcctatttcaccagttcccccgtctgtggaagaaattcccgtccccggcgaagccgtgcctgcccctaccccccctgaatcccccaccccccatcctccgccagccgcacccggcggtgagcgcgctggcacttggcggagacatcgggactag

SEQ ID NO: 115036 - DNA, 2352 bp, Artificial Sequence
  Description of Artificial Sequence: Synthetic coding sequence
atggcgagtactcgctccattgagttagagcacttcgaagaacgcgacaaaaggccacgccctggatcacggcgtggggcgccatcttcctcaggtggcagtagcagctccggcccgaagggaaatggtctaatcccttcaccggcgcactctgcacattgttccttctaccgcactcgtacactccaggccttaagcagcgagaaaaaagccaaaaaagcaagattttacagaaatggggacaggtactttaaggggttagtctttgctatctccagtgacaggtttaggtcctttgacgccttactcattgagttgacccggtccctaagtgataatgtaaatctgccccagggcgtccgaaccatatacaccattgatggcagcaggaaagtgacctctctagatgagttgttggaaggcgagagttacgtttgtgctagtaatgagccttttcgcaaagtggactatacaaaaaatatcaatcccaattggagcgtcaacatcaagggtgggacctctcgtgcactggcggctgcctcgtccgtgaagtccgaggttaaggagtccaaggactttattaaacctaaactggtcaccgttatccgctccggtgtgaagccaaggaaggccgttcggatactgctgaataagaagactgctcatagcttcgagcaggtgctgactgatataaccgaggctattaagcttgattcgggtgtggtgaaacgcctgtgcaccctcgacgggaagcaggttacgtgtctgcaggatttctttggcgacgacgacgtcttcatcgcctgtggtcccgagaaatttcggtatgcccaagatgacttcgtgcttgaccacagcgagtgtagagttttaaaaagcagctatagccggtcaagcgccgtgaaatattccgggtccaaatcccctggcccttctcgcaggtccaagagccctgctagtgtgaaacgcggaggtcattactcttctgcatactcaactgctaagtcccctgtcaatggcaccccatcatctcagctttctactcccaagagcactaagtcttcctccagttctccaaccagccctggctcctttagagggcttaagcagatctccgcccacgggcggtcttcctctaatgtgaacggcggtcccgagctggatcgatgtatttcccccgaaggtgtgaatgggaatagatgtagcgaatctagtaccctgctcgaaaaatataagatagggaaagttataggcgatgggaacttcgcagttgtcaaagaatgtatcgacaggtccaccggtaaagaatttgccctgaaaatcattgacaaggcaaagtgctgtggcaaggagcatctcatcgagaatgaagtgtccatcttgcgccgggtaaagcaccccaatatcatcatgctagtggaagagatggagactgctacggaattattccttgttatggagctggtgaaaggcggtgatctctttgatgccattacttctagcactaagtacacagagcgggatgggagcgccatggtctacaaccttgcaaacgcattgcggtacctccacggcctgtccatcgtccacagggacataaaacctgagaacttgctcgtttgcgaatatcctgacggtactaaaagtttgaaactgggcgacttcggacttgcaacggttgtggaaggacccctgtacacggtttgcggtactcctacgtacgtcgccccagaaattatcgccgagacaggctatggcctgaaggtggatatttgggccgcaggtgtgatcacctatatcctcttatgcggctttccgccatttcggagcgaaaacaatttgcaggaagatctcttcgaccagatcctggccggaaaactcgagttccccgcaccttactgggacaatataactgatagtgctaaagagctaatctcacagatgttgcaagtgaacgtcgaagcaagatgcaccgcaggtcagattttgagccatccttgggtaagtgacgacgcatcacaagaaaacaatatgcaggctgaagtcaccggcaaactgaagcaacacttcaataacgccctgcccaaacaaaattctactacaacgggcgtctctgtgattatgaacaccgccctggataaggaaggccagatcttctgctcgaagcactgccaagactccggaagacccggtatggaacccatcagccccgtacccccatcagttgaagagattcctgtacccggcgaggctgtgcccgctccgactcctcctgaatcccctaccccacacccaccacctgctgcccccggtggagaacgcgccggcacctggcgcagacatcgcgactag

SEQ ID NO: 115037 - DNA, 2298 bp, Artificial Sequence
  Description of Artificial Sequence: Synthetic coding sequence
atggccagtacaagatccatcgaactggaacattttgaggagagagacaaacgaccccggcccggttcccgacgcggcgccccctcttccagcggaggcagttcctcaagtggtccaaaggggaatggactcataccctctcccgctcattccgcgcactgcagcttttaccgaacacggactcttcaagccctaagcagtgaaaagaaagccaagaaagcccgcttttaccgcaatggtgaccggtattttaaaggccttgtgttcgccatctccagtgatcggttcagaagctttgacgcactcctgatcgaattgacgcggtcgctcagcgataacgttaatttaccccagggcgttcgaactatctacactatagacggatcccgcaaggttacttcactagacgaactgctcgaaggggagtcctatgtctgcgcaagcaacgaaccttttcgcaaagtggactacactaaaaacattaatccaaattggagtgtaaacatcaaggggggaacatctcgtgcgttggccgctgcttcctcagtgaagagcgaggtgaaagaatcaaaggatttcataaaacccaaacttgtaactgtgatccgttccggggtgaagccaaggaaggcggtgcgtatcttactgaacaaaaagactgcccacagttttgagcaggtattaactgacatcacagaagcgatcaaattggactcgggtgtggtgaagcgcctgtgcactctagacggtaaacaggtgacctgtctgcaggacttttttggagatgatgatgtgttcattgcatgtggccctgagaagttcaggtatgcccaggacgacttcgtgcttgaccatagcgaatgcagggttctgaagagctcatactctcggagcagcgctgtaaaatactctggcagcaagagccccggcccctctagacggtctaaatcgcctgccagtgtgaatggtacaccatcatctcagttaagcacacccaaatcaaccaagagttcgtcctcatcccccacaagtccaggttcatttaggggtctgaaaatatccgcccatgggagaagctcatcaaacgtgaatggaggacctgaattagatagatgcatttctcctgaaggggtgaatggaaatagatgtagcgagtccagcaccctgcttgaaaaatacaagataggtaaggttattggagatggcaacttcgctgtcgtaaaggaatgtattgacagatccactggtaaagagttcgctctcaagattatcgacaaggcgaaatgctgtgggaaggaacatctcatcgaaaatgaagtctccattctccgccgagttaaacatcccaatataataatgctcgtcgaagaaatggagaccgccacggaactgtttctcgtaatggagctcgtgaaaggtggggacttattcgacgctattacgtccagcacaaagtacacagagcgggatggctcagcaatggtgtacaatctggctaacgcgttaagatacctgcacgggctgtcaattgtgcatcgggatattaagccagaaaacctcttggtctgtgaataccctgacggaacgaaaagcttgaaattgggagatttcggactggcaactgtcgtggaaggccctctctataccgtgtgcggcacccccacgtacgttgctcccgagatcatcgccgaaactggatatgggctgaaggtcgacatttgggcggccggcgttattacatacatactgttatgtgggttcccaccttttcggagcgagaataacctccaggaagatctgttcgaccagatcttagctggaaaattggagtttcccgctccctactgggataatattacggattctgccaaggagctgatttctcagatgctgcaggtcaacgtagaagctcggtgtacagcgggccagatcctgtcgcacccgtgggtgagcgacgacgcctctcaggaaaacaatatgcaggcagaggtgaccggcaaactgaaacagcactttaataacgcccttcctaagcagaattcaaccacgaccggtgtgagcgtgatcatgaatacggccctggataaggaaggccaaatcttctgcagcaagcactgtcaagattctgggcgacctggtatggaaccaataagtcccgtgccacccagcgtggaggagattcctgtaccgggcgaggcagtccccgctccaacacctccagaatctcccacacctcatcctcccccagcagctccgggtggggaaagagcaggaacatggcggaggcaccgagactag

SEQ ID NO: 115038 - DNA, 1947 bp, Artificial Sequence
  Description of Artificial Sequence: Synthetic coding sequence
atgggaaaggaacccctgacactgaagtccattcaggttgcagtcgaagaactgtaccctaacaaggcgcgggcattaacgcttgcccagcactcaagagctccatctccaagactccgtagccggctctttagtaaagccctcaaaggcgaccatcgttgtggtgagaccgagacacctaaaagctgctcagaagtcgctgggtgcaaagctgctatgcggcaccagggtaaaattccggaggagctgagcctcgacgatcgcgcacgcacccagaaaaaatggggacgaggtaagtgggagccagagccatcatccaaacctccaagagaggccaccctcgaggaaaggcacgctaggggcgaaaaacatttaggagtcgagatcgagaagacgagtggcgagatcatcagatgcgagaagtgtaaacgagagagggagcttcagcagagcttagaaagagaaagactgtcattgggcacatccgaactggatatggggaaagggccaatgtatgatgtagaaaaactggtcagaacaagaagttgcagacgcagccctgaagcgaaccctgcctccggagaggagggttggaagggtgactcacatcgatcttccccccgcaatccaactcaggagttacggagaccctcgaagtcaatggacaaaaaagaggaccgggggcccgaagatcaagagtcccacgcacagggcgctgcgaaggctaaaaaggacctggtcgaggttctccccgtgacagaggagggactgcgtgaggtgaagaaggatacacgcccaatgagcagaagcaaacatgggggctggttgctacgggagcaccaggcggggtttgaaaagttgaggcgcacgagaggggaagagaaggaggcagaaaaggagaaaaagccttgcatgtctggtggtcgccgtatgacattgcgagatgaccagcccgctaaactggaaaaagaaccaaagacccgtccagaagaaaataagccagaacgccctagcggccggaagccacggcccatgggaatcatcgcagcaaacgtggagaagcactacgaaacagggagggtgatcggcgacggaaactttgccgttgttaaagagtgcagacatagggaaactagacaagcctatgcgatgaaaataattgataaatcacgcttaaaaggcaaggaagacatggttgactcagagatcctgatcatccaaagtctctctcacccgaacattgtgaagctgcacgaggtatacgaaacggacatggaaatttacctgatcctggaatatgtacagggcggagacctcttcgacgccatcatagagagcgttaagttccctgaaccagacgcggctctaatgatcatggacttgtgcaaggcattggttcacatgcacgataagtctattgtccatcgagacctcaagcctgaaaatctcttggtgcagagaaacgaagataagtcgacaacactcaagcttgccgatttcggattagcaaagcatgtggtgagaccaatcttcactgtgtgtggcacacctacctatgtagcaccggaaatcctgagcgaaaagggatatggtctggaggtggatatgtgggcggcaggcgtgatcttgtacatcttgctgtgcggctttcccccattccgtagtcccgagcgggaccaagacgaacttttcaatatcatccaactggggcatttcgagttcctgcctccgtattgggataacatctctgacgctgccaaagatctggtctctaggctgctggtcgtagaccctaaaaagcggtataccgcacaccaggtcttacagcacccatggattgaaaccgcaggcaagacaaatacagtcaagcggcagaaacaagtgtccccaagcagcgagggtcactttagatcccaacacaagcgggtggtggagcaagtatcctag

SEQ ID NO: 115039 - DNA, 1122 bp, Artificial Sequence
  Description of Artificial Sequence: Synthetic coding sequence
atgcctaatgacgaggctttcagtaagccttccacaccaagcgaggcaccgcatgctcccggagtgccgccccaagggcgagcagggggatttgggaaagccagcggggccctagtgggcgcggcctcgggtagttctgccggaggatcttccagagggggaggttccggttcaggagcctccgatttaggggccggatctaaaaagtcacctagactgcctaaatgcgctaggtgccggaatcacggctacgcttcccccctgaagggacacaagcgtttttgtatgtggcgcgactgtcagtgcaagaagtgtaacctcattgcggagcggcagcgcgtgatggccgcacaggtcgcactcagaaggcagcaggcgcaagaagaggaactgggcatttcccacccaattcctttaccctcagccgccgaactgctcgttaaaagagagaacaacggcagcaatccttgtctcatgacggaatgctcaggtacgagtcaaccacctcccgcatcagtgcccacaacagcagcctccgagggaagaatggtcatacaagatatccccgctgtgacttcgagaggacacgtggagaatacgccggatttagtgagtgactccacatattactccagtttctatcagcccagtttattcccgtattacaataacctgtacaactgtccccaatactccatggctctggctgccgattccgcctctggggaagtgggcaacccactaggcggaagccctgtcaagaattccctgagaggcttgcccggaccctatgtgcctggtcaaactggtaaccagtggcagatgaagaatatggaaaatagacatgcgatgagtagccaataccggatgcatagctattaccctcctccaagttacctaggacaatccgttccacagttttttacctttgaagatgcaccatcttaccctgaggcacgcgccagcgtcttctcgcccccgtctagtcaagacagcgggctggtgtctcttagtagtagcagcccgataagtaataaatcaacaaaagccgtgctcgagtgtgaacctgcgtctgagccttcctcctttacagtcacccctgtcattgaggaggatgagtag

SEQ ID NO: 115040 - DNA, 525 bp, Artificial Sequence
  Description of Artificial Sequence: Synthetic coding sequence
atgcccaacgatgaggctttctctaaaccttctaccccatcagaggcaccccacgctccaggggtgccaccccagggccgcgccggggggtttggaaaggcgagcggtgcgctggtcggagcagccagtggcagcagcgctgggggtagtagtagaggaggggggtccggctctggggcctccgacctgggagccggatccaaaaagagtccccggctccctaaatgtgctaggtgcaggaaccacggatacgccagcccattgaagggacataaacggttttgcatgtggcgagattgtcagtgcaagaagtgcaatttaatagcggagaggcaaagggtcatggctgcgcaggtcggcgccggggtgagggagccaggcttttcactgagtttctttttcttctttttctttcgatggagcttagcacgcctcccaagactgcagtgctcaggcgccatcctggcacactgtaactcagcctctagggtgcaggctattctgctgccccaacctcctaaatag

SEQ ID NO: 115041 - DNA, 681 bp, Artificial Sequence
  Description of Artificial Sequence: Synthetic coding sequence
atggcagacccacaagccgggagcgctgccggagattgggagattgatgtggaatcacttgagctcgaggaggatgtgtgcggtgctcctcggtccacccccccaggaccctccccacctccagccgatggcgactgcgaagatgacgaagacgatgacggggtggacgaagacgctgaagaggaaggcgacggtgaagaggcgggggcttctcctggaatgcctggccagcctgaacagaggggaggacctcagcctagacctcctcttgccccccaagcatcacccgcaggtacgggtccaagagaacgatgcacccctgcaggcgggggagctgagccacgcaagctctctagaactccgaagtgcgctcggtgtcgcaaccacggtgtcgtgagctgtctcaaagggcacaaacgcttctgcagatggagggattgccagtgtgctaattgtttactagtggtggagcggcaacgcgtaatggccgctcaagttgctcttagacgccaacaagccacagaggataaaaagggcctttcaggtaaacagaataacttcgaacgcaaagcagtttaccagagacaggtccgcgcgccttctcttctggccaagtccattcttgaggttctgcttgggctcttttacagctactacgtctacatcatgaaccatctctag

SEQ ID NO: 115042 - DNA, 1686 bp, Artificial Sequence
  Description of Artificial Sequence: Synthetic coding sequence
atggccgacccgcaggcaggtagtgctgcgggggattgggaaatcgacgtcgagagcctggagctggaggaagatgtgtgtggagccccacgtagcacaccaccggggcctagtccccccccggcagatggtgattgcgaggatgacgaagacgacgatggagtggatgaggacgccgaggaggaaggcgatggagaggaggccggggcttcaccgggcatgcccgggcaaccggaacagcgcgggggccctcagccgcggcctccccttgccccgcaggctagcccagctgggaccggcccccgggagcgttgtactccagctggtggaggagctgaaccacggaaactgagtcgtacacccaagtgcgctagatgcagaaatcacggggttgtgtcctgcctgaagggccacaaaaggttctgcagatggcgggattgccagtgcgctaattgtctgctcgttgtcgagcgccagagagtgatggctgctcaggtcgccctcagaaggcagcaggcaactgaggacaagaaagggttgtcgggtaagcagaacaatttcgagagaaaagccgtctatcaaaggcaggtgagggcgccatccctgctcgccaagagtatcctggagggttatagacccatccccgccgaaacatatgtgggcggaacatttccactgcccccccccgtttcagaccggatgagaaaaagacgcgcattcgctgataaggagctggagaacatcatgttggagcgggagtacaaagaaagagaaatgctggagacgtcgcaagccgctgcgctcttcctacccaatcggatggttccgggaccagattacaactcgtacaaatctgcttacagcccaagcccagtcgaacccccttctaaggacttctgcaacttcctccctacatgcttggacctcaccatgcagtattcaggatcaggcaacatggagctaatctcatcaaatgtaagtgtggccactacctatcgacagtaccctcttagctctcgctttctcgtttggccaaagtgtggaccaatcagtgacactctgttatatcagcagtgtttgttgaacgctacaacatccgttcaggcgctgaagccaggtgcaagctgggacctcaagggagcgagggtgcaggatggactcagcgcagaacaggacatgatgcctagcaagctggaaggctctctggtgctaccccacacccccgagattcagaccacacgcagcgacctccaggggcatcaagctgtgccagaacgctcagccttctctccacctcggagaaacttctcccccatagtcgacacagacagcctggcggcgcagggccatgtgctgaccaagatctcgaaggagaacactcggcaccccctacccctgcggcacaaccccttccattctctgtttcagcaaactctgacggataaatctgggccagagctgaaaaccccatttgtaaaagaggcttttgaggagacgcctaagaagcaccgggaatgtctcgtgaaggataatcagaaatacaccttcaccattgatcggtgcgcaaaggacctgttcgtggctaagcaggtgggtaccaaactgtcggtgaatgagccattatcattctccgtagagagtatcctgaagcggcccagctctgccattacacgcgtaagtcaatag

SEQ ID NO: 115043 - DNA, 1686 bp, Artificial Sequence
  Description of Artificial Sequence: Synthetic coding sequence
atggcagatccccaagcgggttcagccgccggagattgggagatcgacgttgagtcactcgagcttgaagaagacgtttgcggagcccccaggagtacacccccaggccccagcccgcctccagcggacggcgactgtgaggacgatgaagatgatgatggcgtggatgaagacgccgaagaggaaggcgacggggaggaggccggcgcctctccgggaatgccgggtcagcctgaacagaggggcggaccccagccacgcccccctttggcaccccaagcctcacccgctggcactggtccgcgggagcgatgcactccagctggaggtggcgcagagccgcgcaaactgtcacggacccccaaatgtgcccgatgtagaaatcatggcgtagtatcctgcctgaaaggacacaaacgcttctgtcggtggagggactgtcagtgcgccaattgcctcctggtggtcgaaaggcagagggtcatggcggctcaggtggcactgcggagacagcaggctactgaggataagaaaggcttgtccggtaagcagaacaacttcgaacggaaggcagtatatcagcgccaggtgagggccccatctctacttgccaaaagcattctcgagggctatagacccatcccagccgaaacctatgtcggagggaccttcccactacccccacctgtgtctgaccgtatgaggaagaggcgggccttcgcagataaagaattggagaacatcatgctcgagcgagaatacaaagagagagaaatgctggagacttcacaggctgccgcattgttcctgcccaaccgcatggtgccaggtccagactataactcctacaagtcggcttactcaccttcaccggtggagcccccttcaaaggacttctgcaacttcttacccacatgtctggacttgacaatgcaatatagtggttcagggaatatggagctcatctctagtaatgtttcggttgccactacatacagacaatacccactcagctctcggtttctagtctggccaaaatgcgggcctatcagcgatactctgctctaccagcagtgtttgctgaacgcgacaacttccgtgcaggcgctgaaacctggagcctcatgggacctgaaaggggcccgagtccaggacgggctttccgcagagcaggatatgatgcccagcaagctcgaggggtccctggttcttccccacactccagaaattcagaccactcgctctgacctacaaggacaccaggccgtcccagaaaggagtgcctttagcccacctaggcggaatttttcaccaatagttgataccgattctctggccgctcagggacatgtactgacaaaaatttcaaaggagaatacaagacaccccctgcccctaagacataatcccttccattctttgtttcaacagactcttactgataagtcaggccctgagctgaaaactccattcgtaaaagaagcctttgaggagacccctaagaaacaccgggagtgtttggtgaaggataatcaaaaatatacctttaccatcgaccggtgtgcgaaggatcttttcgtggccaaacaggtaggtaccaaattgtcagttaacgaaccactatccttctcagtcgagagcattctgaagagaccttcgtctgccatcacccgtgtgagccagtag

SEQ ID NO: 115044 - DNA, 1686 bp, Artificial Sequence
  Description of Artificial Sequence: Synthetic coding sequence
atggcggacccacaggccggaagcgctgcgggcgactgggagatcgatgtggagtccttagagctggaagaagatgtctgcggcgcaccaagatcaacccctcccggtcctagcccacctcctgccgatggcgattgtgaggacgatgaggatgatgatggcgtagatgaggacgccgaggaagagggcgatggagaggaggcgggcgcttcccccggaatgcccggacaacccgaacagagagggggtcctcagcccagacctccgctcgccccgcaggcttcccccgcaggcactgggcctcgcgaacggtgcactcctgccgggggcggtgcagaaccgaggaaattgtcacgcaccccaaagtgcgccagatgcagaaaccacggcgtggtgtcctgtcttaagggtcataagagattctgtcggtggagggattgtcaatgcgccaactgcttgctcgtcgtcgagagacagagggtaatggcagctcaggtagccctgcgccgccagcaagctaccgaggataagaaggggttgtccggaaagcagaacaattttgagaggaaggccgtataccaaagacaggtgagggcaccatccctacttgccaagtccatcctcgaaggatacaggccaatcccagcagagacttatgtgggcggcacctttccccttccaccgccagtgtccgatcgcatgcgtaagcggcgcgcctttgccgacaaagaactcgagaatatcatgctggaacgcgagtataaggagcgggaaatgctcgaaaccagccaggcagccgcactcttcttgcctaaccgaatggtgcccggaccagactataactcatacaagtcggcgtacagcccctcacctgttgaaccaccttccaaggacttttgcaatttcctgccaacgtgtttggacttgacaatgcagtactccggttcaggaaacatggaactgatctcatcaaacgtgtccgtagccaccacctatcggcagtatcccctcagctctaggtttctcgtttggccaaagtgtgggcccatctccgataccttactgtatcagcagtgtctgttaaacgctactactagcgtgcaggccctcaagcccggggcgtcttgggatcttaagggcgcacgagtgcaggacggcctgagtgctgagcaggacatgatgccaagtaagctggaggggagcctggtgctcccccacacacctgagattcagacaactcgcagcgacctacaggggcaccaggctgtgccagaacgatccgcattcagcccgcctcggagaaacttctctccaatcgtggacaccgatagcttggcagcgcaggggcatgtgctcaccaaaatcagcaaggagaacacacgccatccactccccctgcgccacaaccctttccattcactgtttcaacaaaccttgaccgataaatccgggcccgagttaaagaccccctttgtgaaggaagcattcgaggagactccaaaaaaacaccgggagtgcttggtgaaagacaaccagaaatacacattcacaatagatagatgtgctaaagacctttttgtcgctaagcaggttggcacgaagctttcagtcaatgagcccttatccttctccgtcgaatccattctcaaacgcccttcctccgccataacccgggtgtctcaatag

SEQ ID NO: 115045 - DNA, 681 bp, Artificial Sequence
  Description of Artificial Sequence: Synthetic coding sequence
atggccgatccacaggctggctcagcagctggagactgggaaatagatgtggaatctctcgagctggaagaagacgtgtgtggcgccccccgttccactccacctggcccctctcccccacccgcagatggggattgcgaagacgacgaggatgacgatggagtggatgaggacgccgaggaggagggcgatggcgaggaggctggggcctcccctggcatgccgggccagccagagcaaaggggtggaccccagccgcgaccaccactcgcacctcaggcttcccccgctggtactggccctcgtgaaagatgcactccggctggtggtggagccgaaccccgcaaattatccagaaccccaaagtgtgcgagatgtagaaatcatggagttgtgagttgccttaagggccacaagcggttctgtcgctggagagactgccagtgcgccaactgtctgctcgttgtcgagagacagcgcgtaatggccgcgcaagtggccctgagaagacagcaggctaccgaggacaagaaagggctgagtgggaagcagaataactttgaacgcaaggctgtctaccaacgacaggtgcgggctccctctctattggcaaaatccatactggaggtgctgctgggtcttttttattcttactacgtatatatcatgaatcacttatag

SEQ ID NO: 115046 - DNA, 681 bp, Artificial Sequence
  Description of Artificial Sequence: Synthetic coding sequence
atggctgacccgcaggcaggaagcgcagctggggattgggagatagatgtcgagtcacttgaactcgaggaggacgtgtgtggagcccctcgctccacaccccccgggccctccccccctccagcggatggggactgtgaggatgacgaagacgacgacggggtggacgaggacgccgaagaagagggcgatggtgaggaagccggtgcttctcctgggatgccaggccagcctgaacagcgtggtggccctcaacctcggcccccacttgccccccaggccagccccgctggcaccggacctagggagcgatgcacccccgccggcgggggcgctgaaccccggaaactctcccgcacacctaagtgtgctcggtgtcgaaaccatggtgtcgtttcatgcctaaaaggacataagcgcttctgtaggtggcgtgattgccaatgcgcaaactgtttactcgtagtcgagcgccagagagttatggccgcccaggttgcactccgccggcagcaggccacagaggacaagaaaggactgtcggggaaacaaaataacttcgaaagaaaggctgtgtatcagcggcaagttcgggctccgagcttattggcaaaatccatactggaggtgctcttgggccttttttattcatactatgtctacataatgaatcacctttag

SEQ ID NO: 115047 - DNA, 6039 bp, Artificial Sequence
  Description of Artificial Sequence: Synthetic coding sequence
atgtggattctggcattgagcctgttccagtccttcgccaacgtattcagcgaagatctgcactccagcctgtactttgtgaacgcatccctgcaggaagtggttttcgcttcaactactggtaccctcgtcccctgccctgccgccgggatcccccccgttacactccggtggtacctcgcaaccggcgaagaaatctacgatgtaccaggcatccgccatgtgcacccaaacggcaccctgcagatttttcctttcccacccagcagcttttcaacgctcattcacgacaacacttactactgcacagccgagaatccttcaggcaagatacggagccaagatgtccacattaaggctgtactgcgggagccgtatacggtgcgggtggaggaccaaaaaaccatgcgaggaaacgtcgccgtattcaaatgcataataccttcgtcagttgaggcatatatcactgtagtgtcttgggaaaaggataccgtttctcttgtttctggttcaaggttcctcatcacatcgacaggagctctgtatatcaaggatgtgcaaaatgaagacgggctttacaactacaggtgtattacgcgacatcgctataccggcgagacccgacagagcaacagtgctcgtctctttgtttcggaccctgccaacagtgcaccatccattctggacggattcgaccaccgaaaggcaatggcgggacaacgggtggaactgccctgcaaggccctcggtcaccccgaacctgactatcgatggttgaaagacaacatgcccctggagctttcaggacgttttcaaaagaccgtgacgggcttgctaatcgagaatattcgaccatcagactctggtagctacgtgtgcgaggtgagcaacagatatggaaccgccaaggtcattgggcgactttatgtcaaacagcctcttaaagcgaccatatcacctcggaaggtaaagagctctgttggatctcaggtttcccttagctgcagcgtcactggaactgaagatcaggagctgagttggtaccgaaacggcgaaatcctgaatcccgggaaaaacgtccggatcaccgggatcaaccacgagaacctgataatggatcacatggtcaagtcagacggtggggcttaccagtgctttgtgcggaaggataaacttagtgctcaggactacgtgcaggttgtgctcgaggatgggactccaaaaattatctcagccttctctgaaaaagtagtatctccagctgaacccgtctcccttatgtgcaacgtcaaaggcacacctttacccacgataacctggacactagatgatgatccaattctgaagggcggttctcaccgcatctctcagatgattacatcagagggcaacgtagtctcctacctgaacatcagcagctctcaagttcgcgacggtggggtttacagatgcaccgccaacaattctgctggggtggtgttgtatcaggcccgtataaatgttcgtgggccagctagcatcagacctatgaagaatataaccgcgattgccggtagagatacatacattcattgccgggtgattggctatccatactattcaatcaagtggtataagaatagcaaccttcttccatttaatcatcgccaggttgcattcgagaacaatggtaccttaaagctgagtgacgtgcagaaggaggtcgatgaaggcgagtatacatgtaacgtgcttgttcagcctcaactttcaacctcccagagcgtccacgtgactgtgaaggtccctcctttcattcagccatttgaatttcccaggttctctatcgggcagagggtgtttatcccttgcgtagtcgtgtccggtgatttaccaattaccatcacatggcaaaaggatggtcgcccgattccagggtctttgggggtgaccattgataacatcgacttcacctcatcattacgtattagtaacctctcattaatgcacaatggaaattatacgtgcattgctagaaatgaggcagccgcggtggagcaccagtcccaacttattgtgcgcgttccgcccaagttcgtggtccagccacgcgatcaggacgggatatatggtaaggcagtcattctaaactgctccgctgaggggtaccctgtgcctactattgtctggaaattcagtaagggagctggtgtgcctcagtttcagccaatcgctctgaatggccgtatacaagtactctctaacgggtctctattaatcaaacacgtcgtagaggaggactctggctactacctgtgtaaggtctcaaacgacgttggtgccgacgtgtccaaatctatgtacctgaccgtaaaaatccccgctatgatcaccagttacccaaacacaacactcgcgactcaaggccagaagaaagagatgtcttgtacagctcatggagagaagccaatcatcgtacgttgggaaaaggaagaccggatcattaaccccgaaatggccagatacctcgtctcaaccaaagaggttggcgaagaggttatctcaacgttacaaatcctgcccaccgtccgtgaggattcaggcttctttagttgtcacgctattaactcatacggagaggataggggcatcatccagcttactgtgcaggaaccccctgaccctccggagattgagatcaaagatgtgaaggctaggaccataacccttcgatggacaatggggtttgatggaaacagccctatcactggctatgatatcgagtgcaagaataagagcgactcctgggatagtgcccagcgcaccaaggatgtgagtccccagctgaacagcgcaacgatcatcgacatccacccttcgtcaacttacagcatcagaatgtatgctaaaaacaggattggcaaatctgagcctagcaacgagctgaccatcacggctgatgaggcagcacccgatgggccccctcaggaggttcatctggaacctataagctcccaatccattagggtgacatggaaggcccctaaaaagcacctgcaaaatggcattatcagggggtatcaaatcggctatcgcgagtattctactggaggcaattttcagtttaatatcatttcagttgacactagtggcgattccgaggtgtataccctggacaatcttaataaattcactcagtatgggctggtggtccaggcttgcaaccgcgccggcacaggcccatcctcccaggaaatcatcactacgacactcgaggacgtgccaagctaccctcccgaaaacgtgcaagccatagctacctctccagagagcatttccatctcatggtccacactctctaaggaggccctgaacggtattctccagggtttcagggtaatatattgggcaaacctgatggatggcgaacttggagaaattaagaatatcactactacccagcctagtttagagctcgacggcctggagaagtatacgaattactcgattcaggtattggctttcactcgcgccggcgatggagtgcgaagtgagcagatattcacgaggaccaaagaagatgtgcctggacctcccgcaggagtcaaagctgccgcagcatcagcatctatggtcttcgtctcctggttaccacctctgaagttgaatggaattatacgaaaatacacagtcttctgtagccatccctaccccactgttatatccgaattcgaggctagtccagatagctttagctatcgcatccccaatctaagtcgtaaccgacagtactcagtgtgggtggtggctgtgactagtgctggacgaggtaattcctctgagattataactgtggaaccactcgccaaagcaccggctaggattctcacatttagtgggaccgtcaccactccatggatgaaagacatcgtgctgccctgcaaagcggtaggagatccttcaccagcggttaaatggatgaaggactccaatggcactccctctttggtgactatcgatgggcgacgctccatcttcagcaacggatccttcatcatcaggacagtgaaggcggaagacagcggctactacagttgtatcgccaacaacaactggggatctgatgagatcattctcaacttgcaggtccaggtccctccagatcaaccacgactcaccgttagcaaaacaaccagctccagcataaccttatcttggctgccgggggacaacggggggtcatcaatacgtgggtatatcttacaatattctgaagataattccgagcaatggggaagctttccgatctcaccgtcagagcgaagttatcggttggaaaacctgaagtgcggaacttggtataaatttactttgaccgctcagaacggcgtcggacctgggcggatcagtgaaattattgaagcaaaaaccctgggcaaagagccgcaatttagtaaagagcaggagttatttgcgtccattaataccacgcgggtccgtttgaacttaattggttggaacgacggaggttgtcccataaccagcttcacccttgaataccgccctttcgggactaccgtgtggactaccgcacaacgcacctcattaagtaaatcctatatactgtacgaccttcaagaggctacttggtatgagcttcagatgcgggtgtgtaatagcgctgggtgcgccgagaaacaggccaattttgctacactcaactacgatggttctaccatccccccgctgattaagagcgttgtccagaacgaagagggcttgactaccaatgaaggcttgaaaatgctcgtcacaatctcttgcattttggtcggcgtactgttactgttcgtcctattactcgtggtacgtcgtcggaggagagaacaaagacttaagaggctgcgtgatgccaaatctctggccgagatgttaatgagtaaaaatacacgcacttctgacaccctgtctaagcagcaacagacccttaggatgcacattgacattccacgggcccaattgctcatcgaggagagagacactatggaaacgatagacgacaggagcactgttctgcttactgacgctgattttggagaagccgctaagcaaaagtctctgacggtaacccatacagtccactaccaatcagtgagccaggcaaccggacctctggtagacgtgagtgatgcccgcccaggaacaaaccctaccacccggagaaatgccaaggccggtcctactgcccggaaccgctatgcttcccagtggaccctcaatcggccccaccctacgatctctgcacacacactaacaactgattggcgccttcctacccctagagcagcggggtcagtcgataaagagtccgattcatattcagtctcacccagccaagatacagatcgagctcgatcaagcatggtctcaacggagtcggcatcgtcgacttacgaagagctggctcgggcctatgaacacgctaagatggaggaacaactaaggcatgccaaattcacaatcaccgagtgtttcatctcagatactagtagcgagcaactcactgctggcacgaatgaatacacagattcactcaccagcagtactccctctgaaagcggaatatgtcgcttcactgcatcaccacccaagcctcaggatgggggccgcgtcatgaatatggcagtgccgaaggcccatcggcccggcgatctgatccacttgcccccttatctgcgcatggatttcctcctgaaccgcggcggcccaggaacttctagagacctctcattgggccaggcctgtctcgagccacaaaaatctcgtactctcaagcgccctaccgtgttggagcctatcccgatggaagctgcatctagcgcctcttctactcgcgaggggcaatcttggcaaccaggcgccgtggcgaccctcccccagagggaaggtgctgagctggggcaagcagcgaagatgagtagttcccaggagagtttgctggattcaagaggccatttgaaggggaacaatccctacgccaagagctataccctcgtctag

SEQ ID NO: 115048 - DNA, 6342 bp, Artificial Sequence
  Description of Artificial Sequence: Synthetic coding sequence
atgacgggagccggagagcccagaagagaagaacctccaccccagccaagcgctggtctgagatctagagagtctggtgcgccttctgccggcgggtgggagagagccgagcgaggccggggagccgccgccagacccgcgaccggccctccaccgaggcgcattgggcccctttacggcatgtggctcgtgacattcctcctgctgctggactcccttcacaaagctagacctgaggacgtcggtacgtccttgtattttgtcaatgactctctacagcaggtgacatttagtagctcggttggcgtcgtggtgccgtgcccagctgcaggttcaccctccgccgccttgagatggtacctggcaacaggggatgacatatacgacgttcctcatatcagacacgtgcacgctaatggaactcttcaactctatccattcagcccctcagcattcaattcattcatccacgataacgattacttctgcactgccgaaaatgccgcaggaaagatccgctcacccaatattcgggtaaaagctgtctttagggaaccctacactgtcagagtggaggatcaacggtctatgcggggcaatgtggctgtgtttaagtgccttattccatcatcagttcaggaatacgtgagtgtggttagctgggagaaagataccgtgtccattatccccgagcatcgtttttttataacctaccatggtggactttatattagcgacgtgcagaaagaggatgcactgtcaacttacaggtgcatcactaagcataagtactcaggtgaaaccaggcaatctaatggcgcgcgcctcagtgttactgatccagctgagtctatccctacaatcctggatgggttccacagccaagaagtgtgggcaggccatacagtggagctgccctgcacagccagtggctaccctattcccgcgatacggtggttaaaggatgggcggccactgccggcggatagccgttggaccaaaagaataaccgggctcacaatctccgacctgaggacggaagacagtggcacatacatttgtgaggtaacaaacacattcggtagcgcagaggcaacaggtatccttatggttattgaccctctccatgttacactgaccccaaaaaaattaaagaccggtatcggcagtaccgtgatcttgagctgcgccctgacagggagccctgagttcacaatcagatggtacaggaacaccgaactcgtgctgcccgatgaagctattagtatccgaggtctgtctaacgagaccttgttgataacttcagcccagaagagtcacagcggagcctatcaatgctttgccacgcgcaaagcacagactgctcaagactttgctatcatcgcgctggaggatggcacaccgcgcatcgtgtctagcttttctgagaaagtagtgaaccccggtgagcagttcagcctcatgtgcgccgccaaaggagcccccccacctaccgtcacctgggccctggatgacgagccaattgttcgcgacggcagccaccgcactaatcaatatacaatgagcgatggcaccacaatcagccacatgaatgttactggcccacagattcgggatggtggagtctatcgatgtaccgcaagaaacctggtgggatcggccgagtaccaggcacggattaacgtgcgcgggccaccaagcattcgggctatgcgaaacattaccgctgtggcaggtcgggatacactgattaactgccgcgtgatcgggtacccgtactacagcatcaagtggtacaaggatgcactgttgctcccagacaaccatcgccaagtcgtcttcgagaacgggacgcttaagctgaccgacgtccaaaaaggtatggacgagggtgaatacttgtgtagtgtgctgattcagcctcagctgtccatctctcagtctgtccatgtggccgttaaggtccccccgttgatccaaccttttgagtttccccccgcatccatcggccagctgctctacattccttgtgtcgtttccagcggcgacatgccaatcaggataacttggcggaaagacggccaggtgatcattagcgggtccggagtgactatagaatccaaggaatttatgagttccctccaaatcagctcggtttcgctcaagcacaacgggaattacacgtgtatcgcttctaacgctgctgctacggtctctagagagagacagctcatagtacgtgtgcctccccgtttcgtggtacaacccaataaccaagacggcatctacgggaaagccggcgtgctgaactgctccgttgacggataccctcccccaaaggtgatgtggaagcacgccaaggggagcggtaatccccaacagtaccatcccgtcccacttaccggccgaatccagattctgccgaatagctctctgcttatccgccatgtcctggaggaggacattggttattacctgtgccaggcgtccaatggtgtgggtacggacatttccaagtccatgtttctcacagtcaagatcccggccatgataacctcccacccaaataccacaatcgctattaaagggcatgcaaaggagctcaactgtacagcgaggggcgaacgcccaattattataagatgggagaaaggcgatactgtcatcgacccggaccgtgtgatgagatatgccattgccactaaggacaacggggacgaggtggtgtccacactgaaactgaagccggctgaccgaggcgactccgttttcttttcctgccatgctatcaattcctatggggaagacagaggcctgatccagcttaccgtacaagaacctccagatccccccgagctggaaatcagggaagtgaaagcccggagtatgaatcttcggtggactcaacggtttgacggcaattcaatcataacgggctttgatatcgagtataagaataaatccgattcctgggacttcaaacaatctactagaaatatctctcctaccatcaatcaggccaacatcgtggacctccaccctgccagtgtctattcaattcggatgtattccttcaataagataggtagatccgagccttctaaagagcttactatttctacagaggaagcagcgccggacggtccccctatggacgtgaccctccagccggtgacttcccagagtatccaggttacctggaaggccccaaaaaaggaattacaaaacggcgttattagaggttatcaaatagggtaccgagagaactccccaggcagcaacgggcagtattcaatcgttgaaatgaaggccacaggcgactctgaggtgtacactctggataatctgaagaagttcgcgcagtatggggtggtcgtccaagcctttaacagggcgggtaccggaccatcttcctccgaaatcaacgcgactaccctggaggacgtcccctctcaaccgcccgaaaacgtgcgcgcactgagcatcacatcagacgtggctgtcattagctggtccgaaccacctcgttccaccctgaacggggttctgaaaggctacagagtgattttttggtccctgtatgttgatggcgagtggggcgaaatgcagaatattaccacaacacgcgaacgggtcgaactgcggggaatggagaagtttacaaattatagtgtccaggtcctggcctacactcaggctggagatggcgtccgcagttccgtactctatatccaaacaaaagaggacgtccctggtccccccgccgggattaaggctgttccttcctctgctagctctgtggttgtatcttggctcccccctacaaaacccaacggggtcattcgcaaatacacaattttctgctccagccctggctcgggccagcccgccccatccgaatatgaaacgtcgcccgaacagctgttttaccggattgcacatcttaatcgcggacaacagtatctcctttgggttgctgccgtgaccagcgctgggagaggaaatagctctgaaaaagttaccatcgagccagccggtaaggctcctgccaaaattatcagcttcggcggcaccgtcactacaccttggatgaaagacgtgcgactcccttgcaatagcgtcggagatccagcgcccgctgttaagtggaccaaggattccgaggacagcgcaatccccgttagcatggacggccatcggctgatccacacgaatggcaccctgctcctacgggccgttaaagctgaggatagcgggtattacacatgcacagccaccaacaccggtggttttgatactatcatcgtcaacctgctggtgcaggttccacctgatcagcctaggctgacagtgtccaaaacctcagcttccagtattacgttgacttggattcccggcgacaatgggggcagctcaatacgcggctttgtcctccagtacagtgtggacaacagtgaggagtggaaggatgtattcatctctagttctgaacggtcgttcaagttggacagcctgaagtgcggcacctggtataaagtgaaactcgcggccaaaaactccgtcggctcgggcagaatttcagaaatcattgaggccaaaacgcatgggagggaaccttccttcagtaaagatcagcatttattcacccatatcaactccacccatgcgcgcctcaatctccagggttggaataatggcggttgtcccattaccgcaattgtgctggagtacagaccaaaaggcacatgggcgtggcaagggttacgggcaaactccagtggggaagtgtttctaactgagctcagagaggccacttggtacgagctgcgcatgcgggcttgcaatagtgcaggttgcggcaatgaaacagctcagttcgccaccctcgactatgacggcagcactatccctcccatcaagagtgcccaaggtgagggtgatgacgttaaaaagctgtttacaattggttgcccagtcatccttgccactctgggcgtggctctgctgttcatcgtgcgtaaaaaaagaaaggagaaacgcctgaagcggcttagggacgccaagtctctggccgaaatgcttatttcaaagaataaccgctccttcgacacaccagtgaagggcccccctcaaggacctcgtctgcacattgacataccccgggtccaactgctgatagaggataaggagggaatcaagcagttgggagacgataaagctacgatacccgtgaccgacgcggagttctctcaggccgtgaacccacagtcgttttgtaccggagtgtcgctgcaccaccctacgctgatccagagcactgggcctctgatcgacatgtcggatattagacccggcacaaatccggtttcccgtaaaaacgtgaaatccgcacacagcactcggaaccgttacagtagtcagtggactctcaccaagtgtcaggcatccactcctgccaggaccctcacctccgattggcgcacagtggggtcccagcatggcgtgacagtgacagagtccgacagctacagtgcttcactttcccaggataccgacaagggtagaaattcaatggtttctacagaaagcgcgtcttccacttacgaggagctggcaagggcctatgaacacgcaaagctggaggaacagttacagcacgctaagttcgaaatcactgagtgcttcattagtgatagctcttctgaccagatgactacaggcacaaatgagaacgcagatagcatgacaagtatgtcaaccccttctgagcccggtatctgtagatttacagccagcccaccaaagccccaggatgcagatcggggcaagaacgtggcagttcccatcccacacagggccaacaagtcggattactgcaatcttcctttgtacgctaagtccgaagccttctttagaaaggccgatggtcgggagccctgtccagtcgtgcctccaagggaggcttccatccgtaacctggctagaacatatcatactcaagcccggcacttgacactcgatccggcaagtaaaagcctggggctgccccaccctggggccccggctgcagcctcgaccgctacactaccacaacgcactcttgccatgcccgctccacccgctgggaccgcccccccggctcccgggcccacccccgcggagcctcctactgccccctcagctgccccccccgcccccagcaccgagcctcctagagccggtggaccccacacgaagatgggaggaagtagagattctctcctggaaatgtcgacgtccggcgtgggaagaagtcagaagcagggagctggggcgtattcaaaatcttatacactcgtgtag

SEQ ID NO: 115049 - DNA, 5463 bp, Artificial Sequence
  Description of Artificial Sequence: Synthetic coding sequence
atgcttccttactgggccggccatacggtggaactgccatgtactgccagtggctacccgattccagccataagatggttgaaggacgggagacctcttccggcggacagcagatggaccaagcggatcactgggctgacaattagcgatctcagaactgaggactcaggaacctatatttgtgaagtcacgaatacttttggaagtgcagaggccacagggatactgatggtcatcgatccactgcacgttaccctgacgccaaagaagctcaagacagggattggctcaaccgtcatacttagttgtgccttgacgggctcccccgagttcaccatcaggtggtatcggaataccgagttggtgctccctgatgaggcaatatcaatcagggggctgagtaatgagacattgctgattaccagcgctcagaagtcgcattctggagcctatcagtgtttcgccacccggaaggctcaaaccgcgcaggattttgccattatcgcactggaggatgggactcctagaattgtctccagtttcagtgagaaggtcgttaatcctggtgagcagttttcactgatgtgtgcagccaaaggagcaccaccaccaaccgtgacatgggcccttgacgacgaacctatcgtcagggacggctctcatagaacgaaccagtatacgatgagcgatggcactacaatctcccatatgaatgtaaccggcccgcagatccgagacggcggggtctacaggtgtacggcccggaatctagtggggtctgcagaatatcaggccagaataaacgtcaggggaccaccgagcatccgggccatgcgcaacattactgccgtagcgggcagggacacgctcattaattgtcgggtcatagggtacccctactactcaattaagtggtataaagatgcgctgctgctgccggataaccatcgacaggttgtgtttgaaaatggaactctgaagctgaccgatgtgcagaaggggatggatgagggggagtacctgtgttcggttctgatccagccccagctctccattagccagagcgtacacgtggcagtgaaagtccctccactcattcagccctttgaatttcctcctgcatccataggacagctcctctatatcccatgcgtcgtaagcagcggagatatgcctatcagaattacctggagaaaggatgggcaagtcatcatttcagggtctggcgttacaattgagagtaaggaattcatgtcaagtctgcagatcagcagcgtttctctaaagcacaacggcaattatacttgcatcgccagcaatgccgcagccacagtctcaagagagcgccagctgattgtcagggttccacctcggtttgtagtgcagccaaacaaccaggacggcatctatggcaaagcgggcgtgctcaattgcagtgtggacggataccccccacctaaggttatgtggaaacacgccaagggcagcggcaacccccaacagtaccacccggttccactgacgggccggatacagattttgcccaattccagtcttttgattagacacgtactggaggaagacatcggctattacctctgccaggcttccaacggagtaggtactgacatcagtaaaagcatgttcctaactgtgaagatcccagccatgatcacaagtcaccccaacacaaccattgcgattaaggggcacgcgaaagaactcaattgcaccgccagaggtgaaaggccaattatcatccggtgggaaaagggagataccgttatcgaccctgatcgcgtgatgagatacgccattgcaactaaggacaatggggatgaagtggtgtccacgctcaagcttaagcccgccgacagaggggacagtgtgttctttagctgtcacgcgattaatagttatggcgaagataggggtctgattcaactcaccgtacaggagccccccgacccgcccgagcttgagattcgcgaggtaaaagcgcggagcatgaatttgcggtggacccagagatttgacggcaacagtattatcaccggttttgacatcgaatacaaaaataagtctgacagttgggacttcaaacagtccaccagaaacatcagcccaaccatcaaccaagctaacattgtagatttacatcctgcaagcgtgtactctataagaatgtactcattcaacaagattggccggtccgaaccttccaaagagctgaccatctctaccgaagaagcagcccctgatggtccaccgatggatgttaccctgcaaccagttaccagtcagtctattcaggtaacctggaaggccccaaagaaggagctgcagaacggcgtgattagagggtaccaaattggttaccgcgaaaacagccctggcagcaacgggcagtactccatagtcgagatgaaagccacaggagattctgaagtatataccctagataatcttaaaaagtttgctcaatacggcgtcgtggtgcaggccttcaaccgggctggaacaggaccttccagctctgagatcaacgccacaaccctcgaggatgtgccctcccagcccccagaaaacgttcgagctcttagcatcacttcggatgtagcagtcatatcctggtctgagccaccaaggagcaccctgaatggggttttaaaagggtatcgggtgatattctggtctctgtacgtggacggcgaatggggggagatgcagaacattactaccactcgagaacgtgtcgagctaagaggaatggagaagttcacgaattacagcgtgcaggtcctggcctatacgcaagccggagatggcgtaagatcatcagtcttgtatatccaaacaaaagaggatgtgcccggacctcccgccgggatcaaagcagtaccctctagcgcaagcagcgtcgttgtgtcatggttgcctcccacaaagcctaatggggttatccggaaatatactattttttgttcctccccgggatccggacagccggctccctcagaatacgaaactagcccggagcagctattttaccgcatcgctcacctaaacagaggccagcagtacctgctgtgggtggccgccgtcacctccgctggaagaggtaactcctcagaaaaagtaaccattgagcccgccggcaaggcccctgccaagatcatttcgttcggaggaacagtaacaaccccgtggatgaaagacgtccggctgccttgcaacagcgttggcgaccctgctcccgcggtgaagtggacgaaggattccgaggattcagcgataccagtgtcaatggacggtcaccggctgattcataccaatgggacgctcctcctgcgggctgtgaaagctgaggacagtgggtactacacatgtacggcaaccaacaccggcggcttcgacaccataattgtcaacctgctggtacaggtcccacctgaccagcctcgactgacggtttccaagactagtgcgtctagcatcacgctgacctggatccccggcgataatggggggtcttccattagggggttcgtgctccagtatagcgtggacaatagcgaagaatggaaggacgtcttcatatcatcatctgaaaggagctttaagctggactctctgaagtgtggcacctggtacaaagttaaattagctgcgaaaaattctgtcgggtcagggagaatcagtgaaattattgaagcaaagacccacggcagagagccttcattctcgaaagatcaacacttattcacgcacataaatagtacgcacgcccggctgaacctccaaggttggaacaatggggggtgccctatcaccgcgatcgtcctggaataccgccctaagggcacttgggcatggcaaggcttgcgcgctaatagcagtggggaagtgtttctgactgagctcagagaggctacatggtacgagctgagaatgagggcctgtaactcggccggttgtggtaacgaaacggcacagttcgcaaccctggattacgacggaagcaccatccccccaatcaaatcagcacagggagagggtgatgacgttaaaaagctttttacaatcgggtgtccggttattctggctacgcttggggtggccctgctatttatcgtcagaaagaagagaaaggaaaaaaggctgaagagactgcgtgacgcaaagtccttggcagagatgctcatctccaaaaacaacagatctttcgacactccggtgaagggacccccgcagggaccccgcttacatatagacataccacgcgtgcagctcctgattgaggataaagaggggatcaaacagctgggcgacgataaggctactatccctgttacagacgcagagttttcccaggctgtaaatccccagtcattctgtaccggagtgtcactgcaccacccgactttgatccagtccactgggcccctgatcgacatgtcagatattcgacctggtaccaatcctgtcagtagaaaaaatgttaaatccgctcacagcacaaggaaccgctatagttcccagtggaccctaaccaagtgccaggcatccacacctgcgaggacattaaccagcgattggcggaccgtcgggtcccagcacggcgttacggtgacagagagtgactcgtatagcgcaagcctgtcccaagacacggacaaggggaggaattctatggtcagcacagaaagcgcatcatccacttacgaagaattagctcgtgcctatgaacacgcgaaattggaagagcagcttcagcacgccaaattcgagattacagaatgcttcatttctgattcctcctcggatcagatgacaactggcactaatgagaatgctgactccatgacatccatgtccactccatctgagcccggaatctgccggtttactgcatctccccctaaaccccaggacgccgatcgaggtaaaaacgttgctgttccaatccctcacagggctaacaagtcggactactgcaatctcccattatacgcaaaatcagaggccttttttaggaaagctgacggacgggagccctgtcccgtagtgccccctagagaggcatctatcaggaatttggctcgcacctaccatactcaggctcgacacctcactctagatcccgcatccaaaagcctgggactcccccaccctggcgcaccagcagccgcaagcaccgcgaccttgccacagagaaccttggcgatgcccgctccccctgccggaacagccccccctgcccctggcccaacaccagcagaaccccccacggcccccagcgcagctccccccgcacctagcaccgagccacctcgggccggaggccctcacactaagatgggcggctccagagactccttattggaaatgagcacctcaggagtgggacggtcacagaaacagggcgctggagcctactccaagagttacacactagtatag

SEQ ID NO: 115050 - DNA, 762 bp, Artificial Sequence
  Description of Artificial Sequence: Synthetic coding sequence
atggagggaacagtaaatttgcaactttccgcgaagtctgtgggtgtcttcgaggcattctacaattccgttaaacctatccagattattaatagtacaatagaaatggtcaagccaggaaagtttccaagcggtaaaaccgagattccattcgagttccccctgcacctcaagggtaataaagtcctgtacgaaacctaccatggggttttcgtgaacattcagtatacattacgatgtgatatgaaaaggtccctcctcgcaaaagatctgacaaagacatgtgagttcattgtgcatagtgccccacagaagggaaagtttactcccagtccagtcgacttcaccatcacccccgagacgctccagaacgtcaaggagagggccctgctgcccaaatttctgttgcgtactagtcagctgaacaaactttgccatcacgccgcgactaatggtcgcgcaggcggcggcgagcttgggagccgtcaccagaagcgcggcgccgccgccggggctcggggggatgtgagggtctgcaggtacgcccgcgatgccacagagattcagaacattcagatcgctgacggtgacgtatgtcgtggtctgtccgtcccaatatacatggtgtttccacggctcttcacatgtccgaccttggaaaccacaaacttcaaggtggagtttgaagtgaacatcgtagttctgctgcaccccgatcacctgatcaccgaaaacttcccattaaaactgtgcagaatctag

SEQ ID NO: 115051 - DNA, 894 bp, Artificial Sequence
  Description of Artificial Sequence: Synthetic coding sequence
atgggcacggctctggatatcaagataaagagggcaaataaagtctatcatgccggtgaagtactttccggcgtggtggttatttcttccaaggacagtgtacagcatcagggtgtgtcccttacaatggagggaacagtgaacctacagctcagcgccaaaagcgtgggggtgtttgaggccttctacaactcagtgaagcccattcaaatcattaacagtacgattgagatggtcaagcccgggaagtttccatctggcaaaaccgagattcccttcgaattcccgctgcatctgaagggaaacaaagtgctgtacgaaacttatcacggagtatttgtaaatattcagtacaccctgcgttgcgatatgaagcgatctttgttggctaaggatctcactaaaacgtgtgagttcatcgtgcatagcgcgccgcagaaaggcaaattcacaccaagcccggtggattttaccataaccccagagaccctccaaaatgtgaaggaaagagcgcttctacctaaatttctgctcagaggacatctcaacagcacgaactgcgttataacccagcccctcaccggggaactcgttgttgaatcctccgaggcagctattcgaagcgtagagttacagctcgtgagggtggagacatgcggttgcgccgaggggtacgccagggatgcaactgagattcaaaacatccagatagctgacggcgacgtttgtcgagggttgtcagtgcccatttatatggtgtttcccagacttttcacctgtccaactctggaaaccacaaacttcaaagtcgaattcgaagttaacatcgttgttctgctgcaccccgaccaccttatcacagaaaacttccccttgaaactgtgtaggatctag

SEQ ID NO: 115052 - DNA, 519 bp, Artificial Sequence
  Description of Artificial Sequence: Synthetic coding sequence
atgggaactgcactggacattaagataaaaagagctaacaaagtgtaccacgctggaccccaaaagggcaaattcacaccctctcctgtagatttcacgattactcctgagacactgcagaatgttaaagagagggcgctactgcccaagtttcttctgcgggggcacctgaacagtactaattgtgtcatcacccagccacttaccggtgaactggtagtggaatcctccgaggctgccattaggagtgtcgaattacagttggtgcgggttgagacctgcggatgcgcggaaggatacgcacgcgacgccaccgagatccaaaatatacagatcgctgacggtgatgtatgtagaggcctctctgtccccatctatatggtcttcccgagactatttacttgtccgactctggagaccactaattttaaggtggagtttgaagttaatatcgtggtgctcctgcaccctgatcacctcattacagagaatttcccattgaagctgtgccgcatttag

SEQ ID NO: 115053 - DNA, 813 bp, Artificial Sequence
  Description of Artificial Sequence: Synthetic coding sequence
atgggcactgccttggacatcaaaatcaagagagctaacaaggtgtaccacgcgggcgaggtgctgagtggagtggttgtgatatcatctaaggacagcgttcaacaccagggtgtatctttgactatggagggcacagttaacctgcaactgtccgcgaagagcgtcggagtgttcgaggcgttttataattcagtcaaacctatccagatcattaactcaacgatcgaaatggttaagccggggaaatttccatccggtaagacggagatcccgttcgagttcccacttcacctgaaaggcaacaaggttctgtatgaaacctatcacggagtctttgttaacatccagcctcagaagggcaaattcacacctagccctgttgacttcacaattacccctgagaccctgcagaatgtgaaggagcgcgcccttcttcccaaatttctgctgcggggccacttaaattccactaactgcgtgatcacacagccattaactggagaactggtggtggaaagctcagaggccgccatcagatctgtggagttacagctggtgagggtggaaacttgtggatgcgctgaagggtatgcaagggatgctacggagatacagaatatccagattgcagatggggacgtatgtcgaggcctatccgtgcctatctacatggtatttccgcggctcttcacttgccccactttagagacgaccaactttaaggtagaattcgaggttaacatagtcgtgctgctacacccagatcatcttattaccgagaatttcccactgaaactctgcaggatctag

SEQ ID NO: 115054 - DNA, 663 bp, Artificial Sequence
  Description of Artificial Sequence: Synthetic coding sequence
atgggcacagccctcgacatcaaaatcaaaagagccaacaaggtgtaccacgcgggcgaggtgctctctggcgtggtggtgatctcgagcaaagattctgtgcagcaccagggcgtcagcctgacaatggagggaaccgtgaacctccagttatcagcgaaatctgtcggcgtgtttgaagccttctataattccgtgaagccacagaaagggaaattcactcctagcccagtcgactttactatcacaccagagacattgcagaatgtcaaggaacgggccttattaccaaagttcttgctgcgtggacacttgaacagcaccaactgtgtcattactcagcccctgaccggtgaacttgtggtggaaagttcagaggcagccattagaagcgtagagcttcaactggtgagagttgagacctgcggctgtgcagaggggtatgcccgcgacgccacagaaatacaaaacatccagatcgctgacggagatgtgtgccgtggcttgagtgtccccatttacatggtattccccagactctttacatgtcctacgctggagaccaccaatttcaaagtggaatttgaagtgaatatcgtcgtgttacttcacccagatcacttaattaccgagaacttcccactgaagctctgcagaatttag

SEQ ID NO: 115055 - DNA, 357 bp, Artificial Sequence
  Description of Artificial Sequence: Synthetic coding sequence
atgtccctgatcattctcacacgggatgatgaacctagaatcttcactccagatagcgacgccgcttcacctgcgctgcattctactagcccattgcccgacccggcatccgcaagcccactgcacagggaagagaaaattttgcccaaggtgtgtaacattgtcagctgcctctccttcagcctgcctgcttctccaacagatagcggcttagcttccccaaccattatcacccgcgaaggacagcagttttgggcaaaatgtttgatttggaagtatcagctctatctgcacggtctgcataaaaagtccgacggacgccgagacaaacagatctcagcaagtccaagcacatag

SEQ ID NO: 115056 - DNA, 573 bp, Artificial Sequence
  Description of Artificial Sequence: Synthetic coding sequence
atggagccagaggccgctgctggcgcccgtaaagctcgaggtaggggctgccactgccccggggacgcaccgtggagacccccacccccccgggggcctgagagtcccgctccctggagaccttggattcagacacctggagacgcagagctgactcggactggacgaccgctcgaaccccgcgcagaccagcatacttttggctctaaaggagccttcggatttcagcatcccgtccgggtctatctgcctatgtccaagcgccaggagtatctgcgtagcagcggcgagcaagtgctggcgagttttccggtgcaggctactattgacttttatgatgacgaatcgactgaatctgcctccgaggccgaagagccggaggagggacccccccctctccaccttttgccccaggaagtgggcggccgccaggagaatggccccggaggcaagggccgcgatcaaggtattaaccagggacagcggtcttcaggcggcggagaccactggggagaaggccctttgccgcaaggggtttcatctcgtggcggtaaatgttccagttccaagtag

SEQ ID NO: 115057 - DNA, 294 bp, Artificial Sequence
  Description of Artificial Sequence: Synthetic coding sequence
atgaaggaacccggtccgaatttcgtgaccgttcgcaaaggattgcacagtttcaaaatggcattcgtcaagcatctacttttattcttgtccccacgactggagtgctccggtagcatcacagaccattgctctttgcacctgcctgtgcaggaaatcctcatgtctcaacctcccgaacagctcgggctgcaaaccaacctgggaaaccaggagagctccgggatgatgaagttgtttatgccacggcctaaggtacttgctcagtatgagagcattcaatttatgccttag

SEQ ID NO: 115058 - DNA, 276 bp, Artificial Sequence
  Description of Artificial Sequence: Synthetic coding sequence
atgaaggagcctggacctaatttcgtgaccgtcaggaaaggcttacatagtttcaagatggcctttgtcaaacacctccttctggaatgtagtggaagcatcacggatcactgtagcctgcacttgcccgtgcaggagatcttgatgtctcagcctccagaacagctaggcctgcagaccaacctgggaaatcaggagtcgtccggcatgatgaaactgtttatgcccaggccgaaagtcctggcacaatacgagtctatacagttcatgccctag

SEQ ID NO: 115059 - DNA, 531 bp, Artificial Sequence
  Description of Artificial Sequence: Synthetic coding sequence
atggcaagcagcagtggaaatgacgacgatctcacaatcccacgagccgccattaacaagatgataaaggagacactgcctaacgtacgcgttgccaacgatgcccgcgagctggtggttaactgttgtaccgagttcattcacctgatcagctccgaagcaaatgagatctgcaacaagtctgagaaaaagacaatttccccagaacacgtgattcaggccctggagtcacttggctttggctcatacatctctgaggtgaaggaggtgttacaggaatgcaagacggttgcccttaaaagaaggaaggcgtcgtcccgcttggagaatttaggtatcccggaagaagaactgctgcgccagcaacaggaactatttgcaaaagccaggcagcagcaggccgaactagcccagcaggagtggttgcagatgcagcaagccgcacaacaggctcagctggcagccgcatccgcaagcgcttccaaccaggcaggaagttctcaagacgaggaagacgacgacgatatctag

SEQ ID NO: 115060 - DNA, 531 bp, Artificial Sequence
  Description of Artificial Sequence: Synthetic coding sequence
atggcatcctcctcagggaacgatgacgacctgactataccacgggccgccatcaacaaaatgatcaaagagacccttccaaatgtcagggtggcaaatgacgcacgggaactggtagtgaactgttgcaccgagtttatccacctcatttcaagcgaggcgaacgaaatttgcaataagtctgaaaaaaagacaataagccctgagcatgtcattcaggcccttgagtctctgggatttggaagctatatttctgaggtcaaggaggtcctgcaggaatgcaaaaccgtggcactaaaacgccgcaaagccagttctaggctagaaaacctcgggatccccgaggaggagctgctccgccagcagcaggaactctttgcaaaggcccgacagcagcaagcagagctagcgcagcaggagtggttacagatgcaacaagctgcacaacaggcccaattggctgcagccagcgcttctgcttccaatcaggcggggagtagccaagatgaggaggatgacgatgacatttag

SEQ ID NO: 115061 - DNA, 1470 bp, Artificial Sequence
  Description of Artificial Sequence: Synthetic coding sequence
atggaatccatgttttcttcccctgccgaggcggctctgcagagagaaactggggtccccggcttactgactcctctccctgacctggatggggtttacgagctggaaagagtggctggtttcgtgagggacctcggatgtgaaagagttgccttgcagttccctgatcagttgttgggtgacgcagtggcagtggccgcaaggctggaagagacaaccgggagcaaaatgttcatccttggtgacaccgcctatggctcgtgctgtgtcgacgtgctgggggccgagcaagcaggcgcccaggctctgattcacttcggaccagcctgcctgagcccccccgcgcgacccctaccagttgctttcgttcttcgacagcggagtgttgccctagaactgtgcgttaaggcatttgaggcccagaatcctgatccgaaggctcctgtggtgctgctgtcagaacccgcttgcgcccatgctctggaggcgttggcaacactgctgcggccaaggtacctcgacctcctggttagctctccggctttcccccaaccggtcggatcactcagtcccgaaccaatgccactggaacgctttgggcgaaggttcccactcgccccaggcaggagactagaagaatatggcgctttttacgtaggtggatccaaggctagtccagatccagatctagacccagatctttccaggctgttgttaggttgggctcccggacagcctttctccagttgctgccccgataccgggaaaacacaggacgaaggcgcgagggccggccggttaagggcacgaagacggtatctggtggaaagggccagagatgctcgcgtcgtgggcctgttggctggcactctcggtgttgcacaacatcgagaggcactcgctcaccttcgcaatctcacacaggcggccggcaaaaggtcatatgtattagccctgggacgccccacacccgcaaaattagccaactttccagaggttgacgtgttcgttctgctcgcttgcccattgggtgcccttgcccctcagctgagcgggtcctttttccagcccatactggcaccatgtgaactggaggctgcctgtaacccagcgtggccgcccccgggcctggctccccacctgacccactacgctgatttactcccagggtcaccatttcatgtcgcactcccaccacccgagtccgagctgtgggagacgcctgacgtctccttaataaccggggatctccggccaccacccgcctggaaatcttctaacgatcatgggagcctcgctctgactccacggccacagttggaactggccgagtcctcacccgccgcctcgtttctgtctagtagatcttggcaggggctggagccccggctgggacaaacgccagtaacagaggccgtgagtgggaggcgtggaatcgctatcgcatacgaggacgaggggtccgggtag

SEQ ID NO: 115062 - DNA, 786 bp, Artificial Sequence
  Description of Artificial Sequence: Synthetic coding sequence
atggagagcatgttttctagccccgcagaggccgctttgcaacgggaaacaggggtacccgggctgttaacgccgctccctgatctcgacggcgtgtacgagctggagcgagttgctggtttcgttcgtgatttgggatgtgagcgggtcgctttacagttcccggatcagctgctaggagatgcagtggcagtggctgcacgcctggaagagaccacaggaagcaaaatgtttatcttgggcgataccgcatacgggagctgttgcgtggacgtcttgggagccgaacaagcaggggcacaggcccttattcactttggtcctgcctgcctgtccccccccgccagaccgctccctgttgccttcgtgttgagacagcgatccgtggcactcgaactgtgcgtgaaagctttcgaggcccagaaccccgacccaaaagcacctgtagtgcttctgtcagagcccgcctgcgctcatgccttaggatccccttttcacgtggcgctacctccaccagagtccgagttatgggagacacctgacgtgagcctgatcacaggcgacttacggcccccccccgcatggaagtccagcaacgatcacgggtctctagcccttacccctcgccctcagctggagttagctgaatcgtctcctgctgcctcatttctcagttctcgttcatggcaaggtttggaaccccgacttggtcaaacgcctgtcactgaagcagttagcggtagaaggggcattgcaattgcatacgaagatgaaggcagcggatag

SEQ ID NO: 115063 - DNA, 1065 bp, Artificial Sequence
  Description of Artificial Sequence: Synthetic coding sequence
atgttgtggctgtggcttcatgactggcggcggcgtcagggacagagatgcagtttctgggtgactcagcccaccgccgaggctctagccaccctgttgcgccctcgctacctggatctcctggtgagctcccctgcatttccccaaccggtgggatcactgtctcccgaacccatgccccttgagcgctttggtcgtcggttccccctcgctccgggtcgcaggctggaagaatatggcgcattttacgtcgggggcagcaaagccagccctgatcctgacttggaccccgacctgagtagactgctactcgggtgggctccaggccagccattctccagttgctgtcctgatacaggaaagacgcaggatgaaggagcgcgggccggccgcctccgagcacgacgcaggtatctcgtggaaagagccagagacgccagagtggttggacttttggccggaacactgggggtggcccagcatcgcgaggccttggcgcatctgcgcaacctgactcaggcagctggcaagcggtcctatgtgctcgcgttagggagacccacaccggccaaactggctaactttcccgaggtcgacgttttcgtgttgttggcttgtcccctcggagccctagcccctcagttgtccggctctttcttccaaccaatcctggcaccttgtgagttagaggctgcctgtaaccctgcctggccaccaccaggtctggctccacatctgacacactacgctgatctactgccaggttccccttttcacgtggccctgccaccaccagagagtgaactttgggagactccagacgtgtctctgattacaggggacttaagaccaccacccgcctggaagtcttctaacgatcatggatctctagccctgacaccacgcccacagctcgaactcgccgaatcttccccggcagctagctttctcagcagccgctcttggcaagggctcgaacccagattgggccagacccctgtgaccgaggccgtgtccggtagaaggggcatcgccatcgcatacgaggatgaagggagcggatag

SEQ ID NO: 115064 - DNA, 174 bp, Artificial Sequence
  Description of Artificial Sequence: Synthetic coding sequence
atggcagtattccatgatgaggtggagattgaggatttccagtatgacgaggattctgaaacctacttttacccctgtccatgtggcgacaatttttctattacaaaggatcagtttgtgtgcggagagactgtgccagctcccagtgccaataaggagttggtcaagtgctag

SEQ ID NO: 115065 - DNA, 249 bp, Artificial Sequence
  Description of Artificial Sequence: Synthetic coding sequence
atggccgtgttccacgacgaggtcgaaatcgaagatttccaatatgacgaggactctgagacatacttttacccttgtccttgtggtgacaactttagcattaccaaggaggacttggagaacggcgaggatgtggctacctgcccctcttgctcccttataatcaaagtaatttatgataaagaccagtttgtatgcggcgagacagttcccgcaccaagcgccaacaaggaattggtgaagtgctag

SEQ ID NO: 115066 - DNA, 855 bp, Artificial Sequence
  Description of Artificial Sequence: Synthetic coding sequence
atgctgtatcttataggccttggtctcggggacgcaaaagacataactgtaaaaggactcgaggtggtccggcgctgttccagggtgtatttggaggcctatacaagcgtgctgaccgtgggcaaggaggctcttgaagagttttatggacgaaagttggttgtcgccgatcgagaggaggtggaacaggaggcagacaacatactgaaggacgctgacatcagcgacgtcgcattcttggtcgtaggagatccattcggcgctaccacgcacagcgacctggtcctacgggccactaaactgggtattccctaccgcgtaattcacaacgccagcattatgaatgcagtaggctgctgcgggctccagctgtacaaattcggggagacagtgagcatcgttttctggacagacacgtggaggcctgagagtttttttgataaagtcaagaaaaatcgtcagaacggcatgcatacactgtgcctactcgatataaaagtcaaagagcaaagcttggaaaatctgattaagggtcgcaaaatatacgagccccctaggtacatgtcagtgaatcaagccgctcaacagcttttggaaatcgtgcaaaaccagcgtattagaggagaggaacccgttaccgaggaaaccctatgcgtaggcctcgccagagtgggggccgatgaccagaagattgccgccgggactttgcggcagatgtgtaccgtggacctgggcgagcccttgcattcgctgattatcactggaggctcaatccaccccatggagatggagatgctgagtctcttctcaatccccgagaactcttccgaaagtcagtcaattaacgggctgtag

SEQ ID NO: 115067 - DNA, 858 bp, Artificial Sequence
  Description of Artificial Sequence: Synthetic coding sequence
atgctgtacctgattgggcttggtcttggggatgccaaggacataaccgtgaaaggcttggaggtggtccggcgctgcagcagggtgtacctcgaagcttacacctcggtcctgacagttggaaaggaagccctcgaggaattctacggacgcaagctggtcgttgccgatcgcgaggaggtggagcaagaggccgataacatactgaaagatgcagatattagcgatgttgcctttcttgtcgtcggtgacccttttggcgctactactcattcagatctggtgttgcgagccaccaaattgggaattccatatcgcgtgatccacaacgcaagcattatgaacgcagtcggctgctgtggtttacaactatacaaatttggtgaaaccgtgagcatagtcttctggactgacacctggcggccagaaagcttcttcgataaggtgaaaaagaaccgtcagaacggcatgcataccttatgtctgctggacataaaagtgaaagagcagagcctcgagaatcttatcaagggccggaagatatatgagccccctcgttatatgtcagtgaaccaagctgcccagcaactgcttgaaatagtgcagaatcagagaataagaggggaggagcccgcagtaacagaagaaactctgtgtgtcgggctcgccagagtgggggcagatgaccagaagatcgcagctgggaccctgcgacagatgtgtacggttgatctgggagaaccactccattccctgatcataaccggtgggtctatccatcctatggaaatggagatgctgagccttttctccatacccgagaattccagtgagtctcagagtatcaacggcctgtag

SEQ ID NO: 115068 - DNA, 705 bp, Artificial Sequence
  Description of Artificial Sequence: Synthetic coding sequence
atgctctacctgatcggtctgggactcggggatgctaaagacatcactgtaaaaggactggaggttgtccggcggtgctcccgggtgtacttggaggcatatacttcagtcctcactgttgggaaggaagctttagaagaattctacggacgaaaattggtggtcgctgaccgcgaggaggtggagcaggaggcagataatatactgaaggatgcagacatctcagacgtagcatttctggtggtcggggaccccacggacacttggcgtcccgaaagcttttttgacaaagttaagaagaaccggcaaaatgggatgcatacactgtgcctcctggatatcaaagttaaggaacagagccttgaaaatctcatcaaaggcagaaagatatacgaacctccccgctatatgagcgtgaatcaggctgcgcagcaattgctcgagattgtgcagaatcagcgcatccgcggagaggagccagctgtgaccgaggaaaccttgtgtgttggcctggcacgagtgggcgccgacgatcagaagatcgccgcaggcacattgcggcagatgtgcactgtggatttgggagaacctctgcactcactgatcattaccggaggcagtatccacccaatggagatggaaatgctgagcctgttctcgatccctgagaattcctccgaatcccaatccatcaatgggctgtag

SEQ ID NO: 115069 - DNA, 141 bp, Artificial Sequence
  Description of Artificial Sequence: Synthetic coding sequence
atgtgcactgtcgatctgggcgagccactccacagtctgattattacaggagggtccatccatcccatggagatggagatgctttcccttttttccatcccagagaatagctctgaatcgcagtctatcaatgggctgtag

SEQ ID NO: 115070 - DNA, 855 bp, Artificial Sequence
  Description of Artificial Sequence: Synthetic coding sequence
atgctgtacttaatcggcctgggcctcggcgatgccaaggacatcactgtaaagggactggaagtggtcaggcggtgcagccgagtttacctggaagcctatactagcgtcctgacagtgggcaaagaggctttggaagaattctatggcaggaagctggtcgtggccgacagagaagaggtcgagcaggaagccgacaacatcctaaaggatgccgatatcagtgacgtcgccttcctggtcgtgggtgacccttttggtgcgaccacacactccgacctcgtcctgcgggctactaagctgggtattccttatcgcgtcattcacaacgcttcaatcatgaacgccgtgggatgttgcgggctccaatatatatcactggaacggcagttcctgctgttctttggacagacactgggccccgaaagctttttcgataaggttaaaaagaacaggcagaatggaatgcacactctatgtctccttgacatcaaagtgaaggagcagagtttggagaacctcataaaaggcaggaagatttatgaacccccacggtacatgtcagtaaaccaggccgcacagcaattactcgagatcgttcagaatcagcggattaggggcgaagagccggctgtgacagaggagactttgtgtgtgggactggctcgcgtcggggcagatgatcagaaaatcgccgctggcaccctgaggcagatgtgtaccgtcgacctcggtgaacctctccactctctaatcataactgggggttctattcaccctatggaaatggagatgctgagcttgtttagcattccagagaattccagtgagagccaatccatcaacggtctgtag

SEQ ID NO: 115071 - DNA, 858 bp, Artificial Sequence
  Description of Artificial Sequence: Synthetic coding sequence
atgctctacctgatcgggctgggcctcggtgatgctaaagacattacagttaaagggctggaggtggtcagacgctgctcacgtgtttaccttgaggcctatacatccgtgctgactgtcggcaaggaggccctcgaggagttctatggccgcaaactggtggttgcggatagagaagaggttgagcaggaagctgacaatattctcaaggacgcagacatttcagatgttgcgttcctggtggtaggagatcccttcggcgctactacccactcagatctggtcctcagggctactaaactggggattccataccgcgttatccataacgcgtccattatgaatgccgtggggtgttgtggcctgcagttgtataaatttggcgaaacggtctcaatcgtcttttggacagatacatggagaccggagagtttctttgacaaagtgaaaaagaataggcagaacggtatgcacactctgtgtcttctcgacatcaaggtgaaggaacaatcattagagaatctcataaaagggcggaaaatctatgagcccccacggtacatgtctgtgaaccaggccgcgcagcagttgctggagatcgttcagaaccagcgaatccggggcgaggaaccggccgtgacagaggagacactctgtgtcggcctcgcccgggtcggagctgatgaccagaagattgctgcgggcaccttgcgacagatgtgcactgtggacttgggagagcctctgcatagcctgataatcacgggcggatctatccatcccatggagatggagatgcttagtcttttctccatccccgagaattcatccgagtcccagagtatcaatggcctgtag

SEQ ID NO: 115072 - DNA, 2028 bp, Artificial Sequence
  Description of Artificial Sequence: Synthetic coding sequence
atggaggggcgtccaccaccagaaggaaggccccctccccggcctcgaaccggtcgcgcgcctcggggacgcagaagggcagtttttgcagccgtattgcactggtcacacatcacacatttgttcgaaaatgatcgccactttagccacctgtccacgcttgaacgagagatggcatttcggactgaaatgggcttgtactacagctactttaagactattgtggaggccccgtcttttctgaatggcgtgtggatgatcatgaacgacaaattaaccgagtatccacttgtaatcaacactctgaagagatttaacctttaccccgaggtgattctcgctagctggtacaggatttataccaagattatggacctgattggaattcaaacaaaaatctgttggacagtcactagaggcgagggactgtcaccaattgagagttgcgaggggctgggtgaccccgcgtgcttctatgttgcagtgatttttattctcaatggtttaatgatggctctgttctttatctacggaacatacctgagcggctcccggctcggggggcttgttacagtgctctgtttcttctttaaccacggcgaatgtactcgcgtcatgtggacaccgcccctgcgcgagtctttctcatatcccttccttgtgctgcaaatgcttctggtgacccacatcctaagagccactaagctgtaccgtggcagcctcatcgccctgtgcatatccaacgtttttttcatgctgccgtggcagtttgcccaattcgtgctcctcacgcagatagcctccttgtttgctgtatacgtcgtggggtacatcgatatctgcaaacttcgaaagatcatatatattcacatgattagcctcgccctctgtttcgtgctgatgtttgggaacagcatgctgctgactagttactacgccagctctctcgttattatttggggcatcctcgctatgaagcctcacttccttaagatcaatgtatctgaattgtctttatgggtaattcagggttgtttctggctttttggcacagtcatcctgaagtatcttacctcaaagatcttcgggattgccgatgacgctcacatcggaaacctcctgacaagtaagtttttcagttataaagacttcgatacattactctatacatgtgctgctgagtttgactttatggagaaggaaactccgctacgctacacgaagacactccttctgcctgtcgtgcttgtggtgttcgtcgcaattgtgaggaaaatcatttctgacatgtggggggttttagcaaagcagcaaacacatgtgaggaagcatcagttcgaccacggagagctggtatatcacgctctacaattgctcgcgtataccgcgctgggcatactcattatgaggctcaaattatttctgacccctcacatgtgtgttatggcctccctgatctgctctcgacagctcttcggctggctgttttgtaaggttcatccgggcgccattgtctttgccattttggccgccatgtcaatacaaggttcagccaatctgcagacccagtggaatattgtgggtgagttcagcaatttgccccaggaggaactcatcgagtggattaaatactcaactaagccggacgcagtttttgcgggcgccatgcccacaatggcgagtgttaagttatcagcactgcgcccgatagtgaatcacccacactatgaagacgcgggcttgcgtgctcggactaagattgtgtatagcatgtattctcgaaaagccgccgaggaggtgaaacgagagttgatcaagttgaaggtcaactactatatactagaggaaagctggtgtgttcggagatccaagcctggctgctcgatgcccgaaatttgggatgtggaggatcctgccaatgccggtaagactccgctttgcaatctattggtgaaggactccaaaccacacttcacaaccgtattccagaactcggtgtacaaggtcttggaggtagtcaaggaatag

SEQ ID NO: 115073 - DNA, 258 bp, Artificial Sequence
  Description of Artificial Sequence: Synthetic coding sequence
atgtattctaggaaggctgccgaggaggttaagagggaactgataaagctgaaagtaaactattacattctggaggaaagttggtgtgtccgcagaagtaagccaggatgttcgatgccagagatctgggatgtcgaggaccccgccaacgccggcaaaactcccctttgtaacctgctagttaaagattcaaagccgcactttacaactgtctttcaaaatagcgtgtacaaagtcctggaagtggtaaaagagtag

SEQ ID NO: 115074 - DNA, 2277 bp, Artificial Sequence
  Description of Artificial Sequence: Synthetic coding sequence
atgcggaagcaaggggtttccagcaagagactccagtcttccggccgatcacagtctaagggtcggcgtggagccagcctggctagggaacccgaggttgaggaagagatggagaagtcagctttaggcggcggcaagctcccccgaggaagttggaggtcttctcccggcaggatccagtctttaaaggaacgcaagggcctggaattggaagtggtggcaaagacattcctgttaggccccttccagttcgtgcggaacagcttggcgcaattgcgcgaaaaagtgcaggagttgcaagcccggcgtttcagcagtaggacaactctcggcatcgccgtgttcgtggctatcttgcattggttacatctggtgaccctcttcgagaacgatagacacttttcccacctgagctccctggagagggagatgacatttcgaacagagatgggtctgtattactcctacttcaaaaccatcatcgaagccccatcctttctggagggtttgtggatgatcatgaatgatcgcctgactgaatatccactgataatcaatgctatcaaacgattccatctctaccccgaagtcattattgccagttggtactgcacgttcatgggcattatgaatctgttcggcctagagactaagacctgttggaacgtcacacggatcgaaccactgaacgaggttcagtcttgcgaaggcctgggggatccagcttgtttttatgtaggtgtcatctttatcctcaacggtctcatgatggggctgtttttcatgtacggtgcttacctgagtggaactcagctgggcggcctaattacggtgttatgtttttttttcaatcacggggaggccacgcgggttatgtggactcctccactacgtgagtcattcagctacccattccttgttttacagatgtgcatactgaccctaattctccggacctcttccaacgaccgccgacctttcatcgcattgtgtctgagcaatgttgcgttcatgcttccctggcagtttgcccagtttatattgtttacccagattgccagcctatttccaatgtatgtggtggggtacatcgagccctctaagtttcagaagataatctacatgaatatgatcagcgtcactttgtccttcatccttatgttcggaaacagtatgtacctgtcaagctactacagctcctctttgcttatgacttgggcaattatcttgaaacgcaatgaaattcagaaactaggcgtgtctaagcttaacttttggttaatacagggatccgcatggtggtgtggtacaattattcttaaatttcttacttccaagattctgggagtgtcagaccatatccggctgtcagatctcatcgccgccagaattctcagatacacagattttgacactctgatatacacttgcgccccagaatttgatttcatggaaaaggcaactcctctgcgttacaccaagactctattgcttccagtggtgatggtaatcacctgtttcatatttaagaagaccgtacgggacatatcctacgttctggccacaaacatctacctgcgcaagcaactgcttgaacattccgaactcgcctttcacaccctgcaacttctggtgtttacagcgctggctatcctgattatgcgcctgaagatgttcctgactccacatatgtgtgtcatggcaagccttatctgttcccgacagctgttcggctggctgtttcgccgggtgcgcttcgagaaggtgatatttggtatcctgactgtgatgtctattcagggctatgctaacctgaggaaccagtggtcaatcatcggcgaatttaataacctcccgcaagaggagttgcttcagtggattaaatattctaccacttcagacgctgtgtttgctggcgcaatgccaacaatggcaagcattaagttgagcaccctccacccaattgtgaaccacccccattacgaagacgctgatctcagggctaggacaaaaatagtctacagcacctactcccgtaaatctgctaaggaggttcgcgacaaactgctggagttgcacgtcaattactacgtgttagaggaggcctggtgcgttgtgcgaaccaagcccggctgtagcatgctggaaatctgggatgttgaggaccccagcaatgctgcaaaccccccactgtgtagcgttcttctggaagacgcgaggccctactttaccacagtgttccagaacagcgtatatagagtacttaaagttaactag

SEQ ID NO: 115075 - DNA, 618 bp, Artificial Sequence
  Description of Artificial Sequence: Synthetic coding sequence
atgaggctaaagatgttcttaaccccccacatgtgtgtgatggcttccctgatctgttcccgccagttatttggctggctctttcggagggtgcgctttgaaaaggttatcttcggtatcctgaccgtcatgtcgatacaggggtacgctaacttgaggaaccagtggtccataatcggggagttcaataacctcccacaagaggaactcctgcagtggataaaatactcgacgacatcagacgcagtcttcgcaggggccatgcctacaatggcttccatcaagctgtccaccttgcatcccatcgtgaatcacccacattacgaagatgctgaccttagagcaaggactaaaattgtctattcgacctactccaggaaatccgccaaagaggttagagacaagctgctagagcttcacgtgaactattacgtgctggaagaggcatggtgtgtggtacggactaaaccaggatgttccatgttggaaatctgggatgtcgaggatccaagcaacgccgccaacccgcccctctgctctgtgttactcgaggatgctcgaccgtactttacgaccgtctttcagaacagcgtctatagagtgttgaaggtgaactag

SEQ ID NO: 115076 - DNA, 273 bp, Artificial Sequence
  Description of Artificial Sequence: Synthetic coding sequence
atgagaaaacaaggggtctcttctaagaggcttcagagctcgggacgcagccagtctaagggacggaggggtgcatcgctcgcccgcgagcccgaggttgaggaggagatggagaaaagcgccttgggtgggggaaaattgcctagggggtcttggagatcctcccctggaagaatccagtccctcaaagagcgcaaaggtctcgagctggaggtagtcgccaagactttcctgcttggcccatttcagttcgtgcggaattcactagcatag

SEQ ID NO: 115077 - DNA, 1629 bp, Artificial Sequence
  Description of Artificial Sequence: Synthetic coding sequence
atgatgtctatcagacagagacgagagataagagctacagaggtatccgaggatttccccgcccaggaagaaaacgtcaaacttgaaaacaagttgccctcgggctgcacttcccgcagactatggaaaatcctgtcccttacaattggcggcactatcgcgctctgtatcgggcttctaactagcgtctatctcgctaccctgcacgaaaatgacctgtggttttcgaacatcaaagaagtggaaagggagatctcattcaggactgagtgcgggctgtattatagctactataagcaaatgctgcaggctccaaccctagtacagggctttcacggactgatatacgacaataagacagagtctatgaagactataaacctcctacagagaatgaacatttatcaggaggtctttctgagtatcttataccgggttctccccatccagaaatatctggagcctgtctacttctacatctacacactatttggactacaagctatctatgtgactgccctgtacattacatcctggcttctgagtgggacatggctgtccgggctgttagctgccttctggtacgtgactaacaggatcgatacaacgcgagttgagtttaccatccccctgcgagaaaattgggctcttcctttttttgccattcagatcgctgccattacctatttcttgcggcccaatctacaaccgctgagcgaacggttaactttgctggccattttcatatcaacgtttctgttcagtctgacctggcagttcaaccagttcatgatgctcatgcaggctctggtgctcttcacgttagactcgcttgatatgctgcctgcagtaaaagctacctggctctacggaatacagataacatcacttctgctcgtctgtatcctgcagttttttaatagcatgatattaggaagcttgctgatctcctttaacctatccgtgttcattgcccggaaacttcagaagaacctgaaaaccggctcctttctgaaccggctggggaaactgttgctgcatctctttatggtgctgtgccttactctgttcctaaacaacatcatcaaaaagatactgaacctgaagtcggatgagcatatcttcaagtttttaaaggcaaaattcgggttaggggccactagggacttcgacgctaatctttacttatgtgaggaagccttcggattattgccatttaatacctttggccggctttccgataccctactgttttatgcttacatctttgttctatccatcaccgtgattgtagccttcgtcgtggcttttcacaacctttcagatagcacaaaccagcaaagcgtgggcaaaatggagaagggaactgtcgacctcaagcctgagactgcatataacctcatccacactattctgtttggcttcttggcactgtctacaatgcggatgaagtacctctggacaagtcacatgtgtgtgtttgcctcatttggattgtgttccccagagatatgggaactactccttaagtctgtacacttatacaaccctaagaggatttgtattatgagatactctgtacccatactaatccttctgtatctgtgctacaaaaaccagaagtcctag

SEQ ID NO: 115078 - DNA, 2151 bp, Artificial Sequence
  Description of Artificial Sequence: Synthetic coding sequence
atgatgtctatacgccagagacgtgagatacgcgccacggaggtatccgaggactttccagctcaggaggagaacgttaagctcgagaataagttacctagcggatgcacatcccgccggttatggaaaattctctctctcacgattggcggcacaatcgccctgtgcatcggcttgctaacttccgtgtatcttgctacactacatgagaatgacctgtggttttccaatatcaaggaagtggagcgggagatttccttcagaacagaatgcggcctttattattcctactataagcagatgctccaggctcccaccctggtccagggattccacggactgatttacgataataaaacagagtccatgaaaactatcaacctgctgcagagaatgaacatctaccaggaggtgttcctgtccatcctctaccgcgtcctgcccatccagaagtacctcgaacccgtgtatttttacatttacaccctcttcggtttgcaagccatctatgttacagctctgtacatcacttcttggttgctgagtggaacatggctgtctggcctcttagctgcgttctggtatgtgacaaatagaatagacactactcgcgtggagttcaccatccctctgagagaaaattgggccctccccttcttcgccattcagattgcagcaataacttatttcctgcgtcccaatctacagcctctatccgagagactgacgctcctggccatcttcatatctacatttttattctctctcacctggcagttcaatcagttcatgatgctgatgcaggccttagttttgtttactctagatagtctagatatgctcccggcagtgaaagcgacctggctttacggcatccagattacctccctcttgctggtttgcattctgcagttctttaattctatgattttgggttcgctcctgataagtttcaacctttcagtgttcatcgcgcgaaagctccaaaagaacctgaagaccggatcttttctgaataggcttggcaagttgctgctccacttgttcatggttctttgccttactttgttcttgaataatataataaagaagatcttgaacttaaaatccgacgaacacatctttaaatttctcaaagcaaagttcggcttgggggctactcgggacttcgacgccaacctgtacctgtgcgaggaggcattcggcctgctgccattcaacacattcggaagactctctgacacactgttgttctatgcttatatattcgtcctaagcattactgttatcgtggcctttgtcgttgcatttcacaacttatccgacagtactaaccagcaatctgtcggcaagatggagaaggggactgtcgatcttaaaccagaaacagcttacaatctgatacatactattctgtttggattccttgcattgagcactatgaggatgaagtacttatggaccagccacatgtgcgtattcgcaagcttcgggctttgcagccccgagatttgggagttacttctgaaatcagttcacctgtataatcccaagcggatttgtattatgcgttacagcgtgcccatcctgatactcctctacctctgttataaattttggccagggatgatggatgagctgtctgagctgagagaattttatgacccagataccgtagagcttatgaactggatcaactcaaatactccaaggaaggctgtcttcgctgggtctatgcaattgctggccggagtgaaactctgcactgggcggaccctgacaaatcaccctcactatgaggactcctctctcagggaacggactcgggctgtctaccagatttatgctaagagagcaccagaggaggtgcacgcattgctaagatctttcggcacagattacgtgattctcgaggactctatttgctacgaacggcggcatcgccgagggtgcaggcttagagatttgctcgatattgccaatggtcacatgatggacgggcctggagaaaatgaccccgatctgaagcccgctgaccacccccggttctgcgaggagattaagaggaatctgccgccctatgtggcttactttactagagtgttccagaataagactttccatgtgtataagctgtcccggaataaatag

SEQ ID NO: 115079 - DNA, 342 bp, Artificial Sequence
  Description of Artificial Sequence: Synthetic coding sequence
atgatgagcattagacaaaggagagaaattcgggctacggaggtgagcgaagatttccctgcccaggaagaaaatgttaagctcgaaaacaagctgccctccgggtgcaccagcagacggctctggaaaatccttagtctcaccattggtgggaccctccccttcgcgctcgactttctgcacctttccactctgcctcgctatatgaagatgatatacggattccttatactacggaaatggtctgaaaagagccattctgagcaatcggtcgcctgtataacacccacaacctcaagatgctgtaggctgcagcctagttgcaaggtgttcatggcatag

SEQ ID NO: 115080 - DNA, 2151 bp, Artificial Sequence
  Description of Artificial Sequence: Synthetic coding sequence
atgatgagcattcggcaacggcgcgagatacgcgcgacagaggtgtctgaggactttcccgcccaggaagaaaacgttaaattggaaaacaagttgccttctggctgtacctcccggagactgtggaagattcttagcctgactattggtggcacaattgcgctctgcatcggactgctgacaagtgtctatcttgctacactccatgaaaatgacctttggtttagcaatatcaaggaggttgagagggaaatttcttttaggacagagtgtggcctttattactcttattataaacagatgctgcaagcccccacactggtgcagggcttccacggacttatttacgataacaagaccgagagcatgaagacgatcaatctccttcagcgcatgaacatttatcaagaggtctttctctctatcctctacagggtgctgcccatccagaagtacctggaacccgtctacttttatatttatacactcttcggacttcaggctatctatgtcaccgccctgtacattacaagttggttgctctctggcacctggctgagcggcctgctggcagcattctggtacgtaaccaacagaatcgacactacaagagtggaatttaccattccgcttcgagaaaattgggccttgccattttttgccattcagattgcagcaatcacctattttctgaggcctaatttacagccactctctgagcggcttaccttgctggcaatctttatatccacattcctgttctcactgacatggcaatttaaccaattcatgatgctcatgcaagcattggtgctgtttacccttgattctctggacatgctgccagccgttaaggccacctggctctacggcatccagatcacgtctcttctgctggtgtgcatcctgcagttttttaattcaatgatcctgggatcacttttgatatcctttaacctgtcagttttcattgcacgaaaactgcagaagaacctgaaaactggttcttttcttaatcgactggggaaattgctcttgcacctgttcatggtgctatgtctcactctgtttctaaataatatcatcaaaaagattctgaatctaaagtccgacgaacatattttcaagttccttaaggcaaagttcgggctgggggctacccgcgacttcgatgccaatttgtatctgtgcgaggaagcttttggcctgctcccgtttaacaccttcggtcggttgagcgataccctcctcttctatgcctacattttcgtgctgtcaattaccgtaatagttgcatttgttgtcgcctttcacaacctctctgattctacaaatcagcaaagtgtcggcaagatggagaagggcactgtggatctgaagcctgagacagcctataacctgattcacaccatactctttggcttcctggcactgtccactatgcggatgaaatatctttggacaagtcacatgtgcgtctttgcctccttcgggttgtgtagtccagaaatctgggagctgctcctgaagtccgtgcatctttataaccccaagagaatctgcatcatgagatattccgtgcccatccttattctgctatatttatgctacaaattttggccaggcatgatggacgagttgtctgagcttagagagttctacgatcctgataccgtggagttgatgaactggatcaactcaaatacccccaggaaggctgtgttcgctggaagcatgcagctcttggctggcgtgaagctttgtacggggcggacccttacgaaccatcctcattatgaggattcatcactgcgggaacgcaccagggcggtctaccagatctatgctaaacgcgcccccgaggaggttcatgcccttctgcggtctttcgggacggactatgttatccttgaggacagcatctgctatgagaggagacaccgaaggggctgccgactgcgcgacctccttgatattgccaatggccatatgatggacggccccggggagaacgatcccgacctgaaaccagcggaccatccaagattctgcgaagagataaagagaaacctgccaccctacgtggcctactttacccgcgtgttccagaataagaccttccatgtgtataaattaagtaggaataagtag

SEQ ID NO: 115081 - DNA, 2172 bp, Artificial Sequence
  Description of Artificial Sequence: Synthetic coding sequence
atggcggaggaagagggaccaccagtagaactccgccagaggaaaaaacccaagtccagcgagaataaggaaagcgccaaggaggagaagatcagcgacatccctatccctgagcgagcccccaagcatgtgctctttcaaagattcgccaaaatcttcattggttgtctggctgcagttacctccggcatgatgtatgcactgtatctatcggcttatcatgagcggaaattctggttctctaaccgccaggagttggagcgggaaattaccttccagggggatagtgccatttattactcttactacaaggatatgctaaaagccccctcttttgagaggggtgtctacgagcttactcacaacaataaaaccgtcagcctgaagaccatcaatgccgtccagcagatgagcttgtatcccgagctgatcgccagcattctgtatcaagccactggatctaacgagataatcgaacccgtgtatttttacatcgggatcgtgttcgggctccaagggatctacgtgaccgccctcttcgtaactagttggctgatgtcagggacatggcttgccgggatgttgacagttgcctggtttgtcatcaacagggtggatacgacaaggatcgagtactccatcccattgagagagaattgggccctgccctactttgcctgccagatcgcagcactgactggctatctaaagtctaacctgaatacatacggcgaaaggttctgttacctgttgatgtcagcctcaacatatacattcatgatgatgtgggagtactcacactacctcctgtttctgcaggctatctcactgtttctgctggataccttcagtgtggagcagtctgataaagtgtatgaggtatacaaaatatacattttctcactctttctgggctatttgctccagttcgaaaatcctgccctattggtttccccactcctgtctctagtcgccgccctgatgctggcgaagtgcctgcagctgaacgttaagaaggggtccttcgtcgcgaagatcattaaggtcataaatttctatctcgtgtgcaccttgacaattacattgaatattatcatgaagatgtttgtgccgcataaagagaacggccacatgcttaagttcctggaagtcaagttcggccttaatatgaccaaaaattttacaatgaactggctcttatgccaggagtccctgcaggctccgtcacaagactttttcctgaggttaacgcagtcaagtctgctccctttctacattttggtgctgattatctgtttcctctcaatgctccaggtcattttccgaaggatcaatggtaagtcactgaaggaaaccgtaaccctggaagacgggagaatcggcgaacggcctgagattatctatcatgtgatacataccatcttactgggtagtctcgccatggtcatcgagggcttgaagtatatttggatcccctacgtatgcatgctcgccgcgtttggagtgtgtagtcctgaactgtggatgaccctgtttaagtggctgagattgaggaccgtccaccccatactacttgccctgatcctgtcaatggcggtcccgacaatcatcggcctgtcgttatggaaggaattcttcccccgcctgatgacagaactgatggagcttcaagagttctatgatcctgatacagtggaactcatgacctggatcaagcgacaagcccccgtagccgccgtcttcgccggctctccccaactgatgggcgccatcaaactctgcaccggatggatggtcacatctctcccactctataacgatgacgatcttctaaagagaaatgagaatatttatcaaatttatagtaagagatccgcagaggacatctataagatattgacctcttacaaagcaaactacttaatagtagaagacgcgatctgtaatgaggtcgggcccatgcggggctgtcgtgtcaaggaccttttagatatcgcgaatggccatatggtatgtgaggaaggagacaaattaacatatagtaaatatgggcgcttctgtcatgaagttaaaatcaattactcaccctacgtaaattattttaccagagtgtactggaatcgcagttatttcgtgtacaaaatcaacactgttatctccttccagtcctag

SEQ ID NO: 115082 - DNA, 300 bp, Artificial Sequence
  Description of Artificial Sequence: Synthetic coding sequence
atggaacctgagcaaatgttggagggccaaacccaagtcgctgagaaccctcatagtgaatacggacttactgataatgttgaacgcattgtcgaaaacgagaaaataaacgccgagaagagctcgaaacaaaaagtggatctgcagagcctgcccacacgggcctaccttgatcagactgtagtgcctattctcctccaggggctcgccgtcctcgccaaggaaagacccccgaacccaatcgagttcttggccagctacctcctgaagaataaagcccagtttgaagaccgcaattag

SEQ ID NO: 115083 - DNA, 300 bp, Artificial Sequence
  Description of Artificial Sequence: Synthetic coding sequence
atggaacccgagcagatgttggagggccagacgcaggtggctgaaaatccacactccgaatatggactgacggataacgtggaacggatagtggaaaatgaaaaaataaacgctgagaaatcaagtaagcagaaggtggatctgcagtccttgcctacccgggcttatctcgatcagacagtcgttcctattttgttgcagggcctcgctgtgctggctaaggagcggccaccaaacccaatcgagtttctggcctcctacctgctcaagaataaggcccagttcgaggataggaattag

SEQ ID NO: 115084 - DNA, 1956 bp, Artificial Sequence
  Description of Artificial Sequence: Synthetic coding sequence
atggctggtcacccctggcatgggaccgcggcactggcctctagtcaagcgtggagagacggccgtgagaggcaggcactggtctcctgccgggccctgtatacatatgaagacggatcggacgacctgaaactcgccgctagcggcgaggggggcctacaagaattgagtggccattttgaaaatcagaaagtgatgtacggcttctgctccgttaaggacagtcaggccgccttacctaagtacgtgctcataaactgggtcggagaagacgtaccagacgctagaaaatgcgcttgtgcgtctcatgttgccaaggtagccgagtttttccaaggagtggatgtgattgttaatgccagttctgtggaagatattgatgccggtgccattggtcaacgtttgtcaaatgggctagcccggctttcttcaccagtactgcaccgtctgagattgcgggaagatgagaacgcagagcccgttggaaccacctaccagaaaaccgatgcagccgtcgagatgaagcgcataaacagggagcagttctgggagcaggccaagaaagaggaagagctacgtaaggaagaggaaaggaagaaggcccttgatgagcgcctaagatttgagcaggagagaatggagcaggaacggcaagagcaggaggaacgtgagcggcggtatcgggaacgagagcagcagattgaagaacatcgtaggaagcagcagacacttgaagccgaagaggccaaacggagactgaaagaacagagcatcttcggagaccatcgtgatgaggaggaggaaacccatatgaaaaaatctgagtccgaggttgaagaggcagcagctatcattgcccagcgccctgacaaccccagagagtttttcaagcagcaggagcgagtggccagcgccagcgctggctcttgcgacgttcccagtccctttaatcatagaccaggctcccacctcgactcccatcgtcgcatggctcctaccccgattcctacgaggagcccttccgactcatctaccgcttcgaccccagtagctgagcagatcgaaagagccctggacgaagtgacgtcatcgcaaccacctccccttccacccccaccacccccggcgcaagagacacaggaaccgtccccgatcctggacagcgaagaaacccgggcggcggctccccaggcatgggccggaccaatggaagaaccaccacaggcgcaggccccaccacgggggcctggatcacccgctgaggacctgatgtttatggaatctgccgagcaggccgtgctggcagctccagtcgagccagccacagcagacgccactgaaatccacgacgctgcggataccatcgaaacagacactgctactgcagacactacagtggctaataacgtgccgcccgctgctacctcgttgattgacctgtggcccggcaatggtgagggcgcctctactctccagggcgaaccacgtgcccccacgcctcctagtggtaccgaggtcacattggctgaggtgcccctgctagacgaggtggcccctgagccactcttgcctgccggcgaaggatgcgccacgctgctgaactttgatgaactcccggaacctcctgctactttctgtgatcctgaggaagttgagggggagagcttggcagctccacagacacccacccttccctctgctctggaagagctggaacaggagcaagagccggaacctcaccttctgacaaatggcgaaacaacacagaaggagggaactcaggcctccgagggttatttttcacagagtcaggaggaggaattcgcacagtctgaggagctgtgcgccaaggcccctccaccggtgttttacaacaaaccccctgagatagatatcacgtgttgggacgccgatcccgtacctgaggaggaggaaggctttgaaggaggcgactag

SEQ ID NO: 115085 - DNA, 1950 bp, Artificial Sequence
  Description of Artificial Sequence: Synthetic coding sequence
atggccggagtgtcattttccggtcacagactcgagctgctggccgcttacgaggaggtgatcagagaagagagcgccgctgattgggctctgtacacttacgaagatggctcagacgatctgaagctggccgcctcaggggaaggggggttacaggagctgagcggccactttgagaatcagaaagtgatgtacggtttctgctcagtgaaggactcccaggcagccctgcctaagtacgtactgattaactgggtgggcgaagacgtgcctgacgctcgtaaatgtgcatgcgcctcccacgtggcaaaagtggcagagttctttcagggcgtcgacgtgatagtgaatgcttcatccgtcgaggatattgacgccggcgccattgggcagaggctttctaatggattagcaaggctgtcctcgccagtgctccatcgattgcgactgagggaagatgagaatgcggaaccggtcggcacgacataccaaaaaactgatgcagcagtagagatgaaacgaattaacagggaacaattttgggaacaagccaagaaagaggaagagttgaggaaggaggaggagcggaagaaagcactggatgaaaggctgcggtttgagcaagaacggatggagcaagagagacaggagcaggaggagcgggagaggaggtatagggaacgggaacaacagatcgaggagcatcgtaggaagcagcaaactctggaggccgaggaagccaagcggagactgaaggagcaaagcatcttcggagaccaccgcgacgaagaagaagaaactcacatgaaaaaatccgaaagtgaggtggaagaggcggccgccatcatagcgcagagacccgacaaccctagggagtttttcaagcagcaggagcgggtagcaagtgcttctgccggatcctgcgacgttccaagtccatttaatcatagacccgggagtcacctggattcacatagaaggatggctcctacccctatccccactaggagtcctagcgattcatcaaccgcctctacaccagtggccgagcagatcgagcgggctttggatgaggtcacctcgtctcagcccccccccctgcctcccccccctcctccggctcaggaaacacaagaaccctccccaatcctggacagcgaggaaaccagggccgccgccccacaggcctgggctggcccaatggaagagccaccccaagcccaggcaccaccacgcggccctggatcacctgccgaggatctgatgttcatggaatctgccgaacaagccgtgctggctgctcctgtcgaacccgctacagccgacgctacagaaattcatgacgcggcagatacaatagaaaccgacacagccaccgccgacaccactgtggctaataatgtaccacctgccgctacctccttgattgatctgtggcctgggaatggagagggtgcttctaccctgcagggcgaaccccgcgccccgacaccccccagtggcacagaggtcactttagccgaggtgcccctactggacgaagtcgcccccgagcccttactgccggccggagaaggatgtgccaccctgctcaattttgatgaacttccagagccccctgctacattctgtgatcctgaggaggtggagggcgagtctcttgccgcgcctcaaacaccaactctgccaagcgcccttgaagagctagaacaggagcaggagccagagccccatctcctcaccaacggagagactactcaaaaggaaggcacccaggcctcagagggctacttttcacagtcccaagaagaagagtttgcccagtccgaagaactgtgtgccaaggctcccccacccgtgttttataacaaacctcctgagattgacattacatgctgggatgctgacccggttcccgaagaggaggaaggattcgagggtggggattag

SEQ ID NO: 115086 - DNA, 1146 bp, Artificial Sequence
  Description of Artificial Sequence: Synthetic coding sequence
atgaagaaaagtgaatccgaggtcgaggaagctgccgccatcatcgcccagaggccagataatccaagggagttctttaagcagcaggaacgggtcgcatctgccagtgccggcagctgcgacgtgccgtcaccttttaatcaccggcctggcagccatctggacagccaccgccggatggcacctactcctatcccgacgcgcagcccgtcggatagtagcaccgctagcaccccagtagccgaacagattgagcgtgcccttgatgaggtgacatcatcccagcctccccccctgccacccccacccccacctgcacaagaaacacaggagccatcccctatactggatagcgaggagactcgggcagctgcaccgcaggcgtgggcaggcccgatggaagaacctccccaagcccaggccccacccagggggcctggaagcccagccgaggacctgatgtttatggaatcagctgagcaggccgtactcgcggctcctgtcgagccggcgacagcagacgccaccgagatccacgacgcggctgatactattgagacagacaccgccaccgctgataccactgtggcgaacaacgtgcctccggccgctacgagcctgatcgatctgtggcccgggaacggcgaaggcgcttcgaccctgcagggagaaccgagagcccccactcctccgtccggaacggaggtgacccttgctgaggtgcccctactggatgaggtcgcacctgaaccccttttacccgccggcgagggatgcgctactctgctgaactttgatgagcttcctgaacctcctgccactttttgtgatccggaagaggtcgagggtgagagtttggcagccccgcagactccgacgcttccctctgctctggaggaactggaacaggaacaggagcctgagccacacctactgacgaacggggaaacaactcaaaaagagggaactcaggctagcgaaggatacttcagccagagccaggaggaggagtttgcacagtccgaagagctttgtgctaaagccccgcctccggttttctataacaaacctcccgaaatcgacataacctgttgggacgccgaccctgtgcccgaagaggaagagggctttgaaggtggagattag

SEQ ID NO: 115087 - DNA, 954 bp, Artificial Sequence
  Description of Artificial Sequence: Synthetic coding sequence
atggcaggcgtaagttttagcggtcaccgcttggagttgctggccgcatacgaggaagtcatcagggaggagtctgcagccgattgggcactctatacttatgaagatggctcagacgaccttaaattggctgcctctggaggaggtttgcaagagctcagtggacattttgagaatcagaaagtgatgtatggcttttgttccgtcaaggacagtcaagccgccttaccaaagtatgtcctgatcaattgggtgggagaggacgtgcccgacgcaagaaaatgcgcctgtgctagccacgtggccaaggtagcggaatttttccagggggtggacgtgatcgttaatgctagttcggtggaagacattgacgccggagcaataggacagcgcctcagtaacggcctggctcgtctcagttcaccggtgctgcatcggctaaggctgagagaagatgagaacgccgagcccgtgggcactacgtaccagaagaccgacgccgcagtggagatgaagaggatcaatagggaacaattttgggaacaggctaagaaggaagaagaattgagaaaggaggaagaacgcaaaaaagctctggacgaacgcctgaggtttgaacaagagcgcatggagcaggagagacaagagcaggaggaaagagaacgccgttaccgcgagagagagcagcaaatagaggagcaccgtagaaaacagcagactttggaagccgaggaggctaagcggagactcaaggaacagagtatctttggcgatcaccgggacgaggaggaggagacccacatgaagaagtcggaatcagaggtggaagaggccgcagcgatcattgcacagcggccggataatcctagagaattcttcaaacagcaggagagagtcgctagcgcaagtgctggatcgtgtgatgtgccctcacccttcaaccaccggccgtag

SEQ ID NO: 115088 - DNA, 375 bp, Artificial Sequence
  Description of Artificial Sequence: Synthetic coding sequence
atggcaggcgtcagcttctcgggacatcggctggaactgctcgctgcttacgaagaagtcatcagggaggagtcagccgctgattgggcattgtatacctatgaggacgggtctgatgatctaaagctggccgcctccggtgagggaggtctacaggagctgtctggccattttgagaaccaaaaagtgatgtacggcttctgttccgtgaaggactcccaggcagcactcccaaagtacgtgctcattaactgggttggcgaggacgtaccagatgccaggaaatgcgcctgcgcttcacatgtggccaaagtggccgagttctttcagggagtggacgtaatagtgaacgcttcatcagttgaagatatctag

SEQ ID NO: 115089 - DNA, 3900 bp, Artificial Sequence
  Description of Artificial Sequence: Synthetic coding sequence
caccgtatgagcttccaccctggcagagggtgtccccggggcaggggaggtcacggtgccaggccttccgccccatctttccgcccgcagaacttgaggttgttacacccacaacagccgcccgtacagtaccagtacgaacccccatcagctccgagtaccactttctcaaattccccggcacccaattttctccccccgcggccagacttcgtaccttttcccccaccgatgccaccgagcgcccaggggcccctaccaccctgtcccatccgaccccctttccccaaccatcaaatgcgacatcccttccccgtccccccctgctttccaccaatgcctccaccgatgccctgccccaacaatccacctgtccccggagctcccccgggtcaaggaactttcccctttatgatgccgcctccctctatgcctcatcccccaccaccacctgtcatgccacagcaggtgaattaccagtatccacctggctactcccatcataacttccctcctcctagttttaattctttccagaacaaccccagctcctttttaccatccgcaaacaactctagtagtccccactttagacacctgccaccgtatcctttaccaaaggctccctctgaacgccgatcacccgagcgactcaagcactacgatgatcacagacatagagaccattctcatgggaggggagaacggcataggagcctcgaccgaagggagcgagggaggtcgcctgacagaagaaggcaggatagtcgctaccgtagcgactacgaccgaggtagaactccctcacgccatagatcttacgagcgatcatcgcgctcgcccagtcgtgaaaaaaagcgcgcgagatgggaggaagagaaagaccgatggtctgataatcagtcctctggtaaagataagaactacacaagcattaaagagaaggaaccagaggagactatgccagataagaatgaggaagaggaagaagaactactcaagccagtgtggatccggtgtacccatagtgagaactactatagcagcgatccaatggatcaggtgggcgacagtaccgtggtggggacatcgcgtctgcgagatctctacgacaaatttgaggaagagctcgggagtcgtcaggaaaaggccaaagctgcccgcccgccctgggagccaccaaaaaccaagctggacgaggacctggagtcaagttcggaatctgagtgcgagagcgatgaggattcgacctgctcatccagctctgacagcgaggtctttgacgtgatcgcagaaattaaaagaaagaaggcccatcctgacaggcttcatgacgagctgtggtataatgaccccggtcagatgaacgacggacccctgtgcaagtgctccgcgaaggcaaggcggactggtatacgacactctatataccctggagaagaagctattaagccatgcaggcccatgaccaataacgctggccggctgtttcattaccggattacagtctcacccccaaccaatttccttaccgaccgccccaccgtcatcgagtacgacgaccacgaatacatctttgagggattctctatgtttgctcacgcacctctgaccaacattcccctttgtaaagttatccggttcaatattgattacacgatccactttatcgaggagatgatgccagaaaatttttgcgtgaaaggcttagaactattcagtctgttcctgttcagggacatcctggagttatatgactggaatctgaaaggaccactttttgaagacagccccccctgctgccctcggttccatttcatgccccgattcgtaaggttcttaccagacggcgggaaggaagtcttatcaatgcatcaaattctgctgtatctgttaaggtgctccaaagccctggtgccagaagaggaaattgccaatatgctccagtgggaagagttggagtggcagaaatatgctgaagagtgcaagggcatgatcgttaccaatcctgggacgaagccatcctccgttcggatcgatcaacttgatcgggagcagttcaaccctgatgttatcacatttccgatcatcgtgcactttggcattcgcccagcccagctgagctatgccggagacccccagtaccagaaactatggaaaagctatgtgaaattgaggcaccttctggccaactcgcctaaagtgaagcagacggacaagcagaaattagcccaacgcgaggaggcgctccagaagatacggcagaaaaacaccatgcgcagggaagtgaccgtggagttgtcctctcaggggttttggaaaacaggaatccgcagcgatgtgtgccagcatgccatgatgctgccagtactgacccaccacataagataccaccagtgtctgatgcatctggataagctgatcggttacacctttcaggataggtgtttgttacaactggccatgactcacccgagtcatcacctgaatttcggaatgaatccagaccacgcgaggaactccctgagcaactgtggcataaggcagccaaaatatggggatcgaaaagtccaccacatgcacatgcgaaagaagggtatcaacaccctgatcaacatcatgagccggctggggcaggatgacccaaccccgtcacggattaatcacaatgaacgcttagagtttttgggggacgccgtcgtggagttcctgacatctgtacatctctactatctgttcccctctctggaagagggcggactcgcaacttatcgcacagctatcgtgcagaatcagcatctggcaatgttggcaaagaaattggaactggatagatttatgttatacgctcacggaccagacttgtgtcgcgaatcagacctgagacatgccatggctaattgcttcgaagcccttataggagctgtgtatctcgaggggtctctcgaagaagcaaagcagttattcggaagactgctgtttaacgaccctgacttgagggaggtatggctgaactaccctttacaccccttgcagttacaggagccgaatacggatcgccagctaatcgaaacttctccggtgctgcagaaacttaccgaatttgaagaagctataggtgtcatctttacccatgtccggctgctggcccgggccttcacgctgcgcactgtggggttcaatcacctgaccctcgggcataaccagaggatggaatttttaggcgactctattatgcagctggtggcgacggagtatctctttattcactttcccgatcaccacgaagggcaccttactctgctgcgttcatctctagtaaacaaccgtactcaagccaaagtggccgaggagctcggcatgcaggaatacgccattactaacgataaaactaagaggcctgtggccttgcgcactaagactctagccgatcttctggagagtttcatagctgctctttacatcgacaaagacctcgaatacgtccacactttcatgaacgtatgtttttttccaaggcttaaagagttcatactcaaccaagattggaatgaccctaaatcacagctccagcagtgctgtctcacacttagaactgagggcaaagagcccgatataccactctacaagacactgcaaaccgtgggaccatcccatgctcggacgtataccgtggcggtgtactttaagggagaacgcattgggtgcgggaagggcccctccattcaacaggctgagatgggagctgccatggacgcattggagaaatataacttccctcagatggcgcatcaaaagaggtttattgaacgcaagtacagacaggagctgaaggagatgcggtgggagagagagcaccaagagagagaaccagacgaaacagaagatataaaaaaatag

SEQ ID NO: 115090 - DNA, 4125 bp, Artificial Sequence
  Description of Artificial Sequence: Synthetic coding sequence
atgatgcagggcaacacctgtcacagaatgtcatttcatcccggaaggggatgtccccggggccggggagggcatggcgccagaccaagtgctccgagctttagacctcagaatctcagactgcttcatcctcagcaaccccccgtccaataccagtatgagcctccatccgccccaagcaccacgttctccaattccccagcacccaattttttgccacctcgcccagattttgtgccattccctccgcccatgcccccctccgctcagggacctctgcccccgtgcccgattcgccctcccttcccaaatcaccagatgcgtcacccattccccgttcctccatgttttccaccaatgcccccacccatgccatgccccaacaaccctccagtacctggagcacctcccgggcagggaacttttccttttatgatgcctcctccatcaatgccccatcctcccccccctcccgttatgcctcagcaagtgaactatcagtaccccccaggatattcacaccacaactttccgccgccttcatttaacagttttcagaataatccctcctcatttctgccctctgctaacaacagttcgtctcctcactttaggcacctgcccccgtatcccctgcccaaggcgccatccgaacggcgatccccagagcgcctgaagcactacgatgaccaccgacatagggatcattctcatggtcgcggtgaacgccaccgcagtctcgaccgacgagagagagggcgctcacctgacagaagacgccaggacagtcgatatagaagtgactacgatcgcggccgaactccgtcacggcaccggtcatacgagaggtcacgcgaaagggaacgggaacgccacagacatcgggataacagacgcagcccttcgctggaacggtcctataaaaaggaatacaagagaagcgggcgaagctatggcctttcagtcgtgcccgagccagccgggtgcacccccgaactgcctggcgagattattaaaaacactgactcctgggccccccccctagagatagtgaatcacagatccccctcacgggagaagaagagggcacgctgggaggaagaaaaggatcggtggtcagataatcagtcgtcggggaaagacaagaattacaccagcataaaagagaaggagcctgaagaaactatgcccgataagaatgaagaggaggaagaagagttattaaaaccagtgtggatacggtgcacgcatagtgagaactattatagcagcgatcctatggatcaggtcggggattccacggtcgtcggaacatctaggctcagggacttgtatgacaaattcgaggaggaactcggttcaagacaagagaaagctaaggctgccaggcctccctgggaacccccaaaaaccaagctagatgaagatctggaatcgtcgtcggagtccgagtgtgaaagcgatgaagattccacttgctcttcctcaagcgattcggaggtgttcgatgtgatcgccgaaattaaaagaaaaaaggcccatcccgatcggctgcacgacgaactgtggtataatgaccctggtcagatgaacgacggccctctgtgcaaatgcagcgccaaggctcgacgcactggcattcgacattcgatctatcccggcgaggaggccatcaagccttgtcggcctatgaccaacaatgccgggaggctattccattatcggatcacggtatcgccacccacaaattttctgaccgatcgtccgacagtgattgagtatgatgaccatgaatatatattcgaagggttttccatgtttgcacatgcccctctgacaaatatccccctgtgtaaagtaatacgatttaacattgactataccatccatttcattgaagaaatgatgccggagaatttctgcgttaagggactcgagctatttagtcttttcctgtttagagacattctggaattgtacgattggaacctcaaagggcctttgttcgaagacagccccccctgttgccctaggtttcactttatgcctagatttgtccggttcctccctgacggcgggaaggaggttctgtctatgcaccaaatcctcctttatcttttgaggtgctcgaaggcactggtgcccgaggaggagattgccaatatgcttcagtgggaggagttggagtggcagaaatatgcggaggagtgtaaaggcatgatagttacaaatccagggacaaaaccttcctccgtacgcatcgaccagctggaccgggagcagttcaatcccgacgtgattacctttcccattattgtgcacttcggcattcgtcctgcacagctgtcatatgccggtgacccgcagtaccaaaaactctggaagtcctatgtgaaactgcggcacctgctcgcgaattctcccaaggtaaaacaaaccgataaacaaaaactggcacagcgtgaagaggcattgcagaagataaggcagaagaatacgatgagacgagaggtcacggtggaattgtcaagccagggattctggaagacaggaatccgcagcgatgtctgccagcatgcaatgatgctccctgtgctcacccaccacatcaggtatcaccagtgtctaatgcacctggataagctgattggatacactttccaggatagatgtctcctccagcttgccatgacacatccctctcaccaccttaatttcggtatgaatcctgatcatgcgcgaaactccctcagtaactgtgggatccgccagcctaagtacggtgataggaaagtgcatcacatgcatatgaggaagaaaggaattaacacactcattaacattatgagccgcttaggacaggatgatccgactccctcccgtatcaatcataacgagcggttggaatttctgggggatgctgtcgttgagtttctaacgtctgttcacttgtattacctgttcccctcattggaggagggtggtctggcgacttatcggactgctatcgtccagaatcaacacttggccatgcttgccaagaaattggagctggacagattcatgctgtatgcccatggccccgacttatgccgggaatccgatcttcgacacgccatggcaaattgcttcgaggcccttatcggtgctgtgtacctggaggggtccctggaggaggccaaacagctttttggcagactgctctttaacgatcccgacttgcgagaggtgtggttgaattaccctctgcacccattgcagcttcaagagccgaacacagacaggcagctcatagagacaagccccgtactccaaaaactcacggagttcgaggaggcaatcggtgtgatcttcacgcatgttcgcttactcgcgcgggcattcacactgcgtacagtcggtttcaatcatctcacgcttgggcataatcagagaatggagtttttaggagacagcatcatgcaactggtggctactgagtatctgttcatacacttccctgaccatcatgaagggcacctaactctgttaaggtcatccctggtgaacaacaggactcaggccaaagtagcagaagagctgggaatgcaggaatacgctattaccaacgacaaaacgaaaaggcctgtggcccttagaacaaaaactctcgcggatctgttggaaagctttatcgctgctctgtacatcgataaggacctggaatacgtgcacacatttatgaacgtatgcttcttccctcgcttaaaagaatttattctcaaccaggattggaacgaccccaaaagccaactgcagcagtgctgtctcacgttgcggacggaaggcaaagaaccggatatccccctgtacaaaaccttacagaccgtggggcctagccacgcaaggacctacacggtggccgtgtactttaaaggggagcggatcggctgtggtaaaggaccctccattcaacaggctgagatgggagccgctatggacgcactagaaaagtacaattttccacagatggcacaccagaaacgcttcatcgagaggaaatatagacaggaattgaaagagatgcgatgggaacgcgagcatcaagagcgggaacccgacgagaccgaagacatcaagaaatag

SEQ ID NO: 115091 - DNA, 3558 bp, Artificial Sequence
  Description of Artificial Sequence: Synthetic coding sequence
cataggatgagctttcaccccggtcggggatgtcctaggggaagaggagggcacggagccaggcccagcgcaccgagcttccgacctcaaaatctccgcctgctgcacccccagcaacctcccgtgcagtatcagtatgaaccgccatctgccccaagtacaacttttagcaacagcccagcacctaatttcctcccaccgcggcccgatttcgttccttttccccctcccatgcccccttcggcccaggggcccctgcccccatgtcctatccgcccccccttccccaaccaccagatgaggcatccatttcccgtccccccgtgcttcccgcctatgcccccccctatgccttgtccgaataaccctcctgtgccgggtgcgcccccaggacagggcacctttccctttatgatgccacctcctagtatgccccaccctccgcctccccccgttatgccacagcaggtcaattatcaatacccacctggctattcccatcacaacttcccccccccctcatttaactcctttcagaataacccttcctctttcttaccaagcgccaacaattctagcagtcctcatttcagacacctgcccccatacccactgccaaaggccccatcagaacgacgcagccctgagaggcttaagcattacgatgaccataggcacagggatcatagccacggacgtggtgaacggcatagaagcttggaccgcagagagcggggccgttccccagaccggagacggcaggattcccgatatcgtagcgattacgaccggggcaggacccctagtcggcaccggagttacgagaggagccgcgaacgggaaagggaacgtcatagacaccgtgataatagaagaagtccatccctggagaggagctacaaaaaggagtacaagcgaagtgggagccgctcgccatccagggaaaagaaacgtgctcgctgggaagaagaaaaagacaggtggagcgacaaccagtcctcaggcaaggataagaattataccagtattaaggaaaaggagcccgaagaaactatgccagataaaaacgaagaggaggaagaggagctcttaaagccggtatggattagatgtacacactccgaaaattattacagttcggacccaatggaccaggtaggggactcaactgtggtgggaacctcgagactcagggatctatacgataaatttgaggaagagcttggcagccgccaggagaaagccaaggccgctcggccgccctgggaaccgcccaagactaaattagatgaagatctcgaatcttcgagtgagtcagagtgcgaaagtgacgaggattccacatgcagtagtagctcagactccgaagtctttgacgtgattgccgaaatcaagcgtaaaaaagcccacccagaccggctacacgatgagctgtggtataatgatccgggccagatgaatgacggcccgctctgtaagtgttccgccaaagcacgccggaccggtattcgtcactcgatatacccaggggaagaggccatcaaaccttgccggccaatgaccaacaacgctgggcgccttttccactacaggattacagtgtctcccccgacaaattttctgacagaccgcccaaccgtgatagagtatgatgatcacgagtatatttttgagggtttttccatgttcgctcacgccccacttacaaacatccccctctgcaaggtgatacgtttcaatatcgattatactatacattttatcgaagagatgatgccagagaacttctgtgtgaagggcctcgaactgttctcgctgtttctgtttcgagatatcctggagttgtacgattggaacttgaaaggccccctgtttgaagatagtcctccatgctgcccccggttccacttcatgccacggttcgtaagatttctgcctgatggcggaaaggaggtcttaagcatgcaccagatcttgctctacctcttgcggtgctccaaggccctggtgcccgaagaggaaatcgcaaacatgctccagtgggaggagctggagtggcagaagtacgcggaagagtgtaaagggatgatcgtcaccaatccaggcacaaagcctagttctgtccgaatcgatcagctcgaccgggaacagttcaacccagacgtaatcactttcccgataatagttcactttggcatccggccagctcagctgtcttatgctggggacccacagtaccagaagctgtggaaatcgtacgtgaaactccggcacttgttagcaaactcccctaaggttaagcagacagataagcagaaactcgctcaaagggaggaggcattgcagaaaattcgccagaagaacaccatgagacgagaggtaacagtggagctgagctcccagggattttggaaaacaggcatccgttccgacgtctgccagcacgctatgatgctgcccgtattaacacatcatatcagataccatcagtgtctgatgcatctcgacaaattgataggctacacattccaggataggtgccttttacagctggcgatgacacatcccagtcatcatctgaactttggcatgaacccagatcatgcgaggaatagcctcagcaactgtggaatacgccagcctaaatatggagatcggaaagtgcatcacatgcacatgagaaagaagggcatcaacactctgataaatattatgagccgtctgggtcaggatgacccaacccccagtcgtattaaccataacgaaaggctggaattcctgggggatgctgtagtggaattcctgacatctgtgcatctgtactatctatttccatcccttgaggagggaggtctagcaacttacagaaccgccatcgtccagaaccaacatttagcaatgctcgcgaagaaactagagctcgaccgcttcatgctctatgcgcatggtcccgatttatgccgagaaagtgacctgagacatgccatggccaattgctttgaggctctgattggtgcggtgtatcttgaaggatcgctggaggaagctaagcagctcttcggaaggctgttattcaacgatcccgacctgagagaggtctggctcaattacccgctgcacccactgcagctccaggagcctaacaccgacagacagttaatcgaaacaagtccggttcttcagaaacttaccgagttcgaggaggctatcggcgtaatcttcactcacgtccggctcctggcccgcgctttcactttacgtacagtaggctttaatcacttgactctgggtcataatcaacggatggagttcctaggagactcgataatgcaactggtggctacggagtacctgttcattcattttcccgaccaccatgagggtcacctgactcttctgagaagttctttggtgaataacagaacccaagctaaggtagctgaggaacttggtatgcaggagtggagtatctacctgctaagtaactgtgactgctgcctgctgcgaccctctttggtttttctacagacaatgaacgaagtctgtagtctaaaatag

SEQ ID NO: 115092 - DNA, 4014 bp, Artificial Sequence
  Description of Artificial Sequence: Synthetic coding sequence
atgatgcagggcaatacctgtcacagaatgagttttcaccccggccgcgggtgcccgagaggacggggcggccatggggcccggccaagtgccccatcatttcggccacagaacctgcgcctgctccaccctcagcagccgcccgtgcagtatcaatatgagcctccatctgcgccttcaacgacattctcaaattctcctgccccgaactttctgcctccccggccggattttgtgcccttccccccccctatgccgccatctgcacagggccccctgcccccctgtcctatccgaccaccattccccaatcatcagatgaggcacccttttcctgtgcctccctgctttcccccgatgccaccccccatgccctgccccaacaatcctcccgtccctggcgccccccctggacagggtaccttccctttcatgatgccacctccatcgatgccccacccccctcctccgccagtcatgccacagcaggtgaactaccagtacccccctggatattcacaccacaacttcccaccaccttccttcaactcatttcagaacaatccatccagcttcttaccatccgcaaacaactcctcttcgcctcacttccgacacctcccaccttaccccttacccaaagcaccttcagaaaggcgaagccccgagcgcctgaaacactatgacgatcaccgccaccgggatcactctcacggccgcggggagcggcaccgcagtttggatcgccgtgagcgtgggaggagtcccgatcgacgcaggcaggacagtaggtacaggtctgattacgaccgcgggagaactccgtcgaggcatagatcctacgaacgcagtcgcgagagagaacgggaacgccatagacacagagataataggcgcagcccctcccttgaaagatcttataagaaagagtataagcgctctggtagccggtccccctcccgtgagaaaaaaagggcccgctgggaagaagaaaaagacaggtggtctgataatcaaagctcgggtaaagataagaattatactagtatcaaagagaaggaacccgaggaaacaatgcccgacaaaaacgaggaagaggaggaggaactactcaagcccgtatggattagatgtactcattccgagaactactacagcagtgatcccatggaccaggttggagattcgaccgttgttggcaccagtaggcttagggatttatacgacaaattcgaagaagagctgggctctcggcaggagaaggccaaggcggcgcgacccccttgggagcctcctaagaccaagctcgatgaagatctggagtcctctagcgaatctgaatgtgagagcgatgaagactccacatgcagcagctcctccgactccgaagttttcgacgttattgcagagatcaagcggaagaaagcgcatccggaccgtctgcacgacgagctttggtataatgaccccggccaaatgaacgatggcccactgtgtaaatgtagcgcgaaggcaaggcggactggcatccgacattctatttaccctggagaggaggccatcaagccctgcaggcctatgacaaataatgctgggcgcctattccactataggatcactgtctcccctccgacgaacttcctgacagaccgtcccactgtcatcgagtacgacgaccacgagtatatctttgaaggattctctatgtttgcgcatgctccactgactaatatccctctttgtaaggtgataagatttaatatagactacacaatccacttcatagaagagatgatgcccgagaacttctgtgtcaaagggctggagctgttttctcttttcttgttccgcgacattctcgagctttatgactggaacttgaagggccccttgtttgaagattcccccccttgttgtccccggttccactttatgccaagatttgtgcgctttctgcctgacggaggaaaagaggtgcttagtatgcaccagatcctgctctacctgctgcgatgcagcaaggcattggtcccagaggaggagatcgccaacatgttgcaatgggaggaactggagtggcaaaaatacgcagaagagtgtaagggcatgatcgtgaccaacccaggaactaagcccagtagtgtgcgaattgaccagctggacagagagcagtttaatcctgatgtgataacatttcctatcatcgttcactttggaatccgtccggcccagctctcttacgctggagatccccagtatcagaagctgtggaaaagctacgtgaaactccgtcacctgttagcaaacagcccaaaggtgaaacagactgacaaacagaaactagcccaaagagaagaagcactccagaagatccgtcagaaaaatacaatgagacgtgaggtgacagtggaactgtcaagtcagggcttttggaagaccgggatcaggagcgatgtgtgtcagcacgctatgatgctgcctgtgctcacacaccacatacgttaccatcagtgcctgatgcatctggacaagctcatcggatacacgtttcaggaccggtgcctgcttcagctggccatgacccatccaagtcatcatctgaattttgggatgaaccccgatcacgccagaaattctcttagcaactgcgggattcgacaacctaaatatggagaccggaaagtgcaccacatgcatatgaggaaaaaaggcattaataccctgatcaacattatgtcccgcctgggccaggatgacccgactccttctagaataaatcacaatgagaggttggagtttctgggtgatgccgtagtcgaatttcttacctccgtccatctgtattatctttttccatcactcgaagagggaggcctggccacatatcgaaccgcgattgtgcaaaaccagcatctggccatgctcgcaaaaaagctggagctcgaccgctttatgttgtacgcacacggaccggacttgtgtcgggaaagcgacttacgccacgcaatggccaattgctttgaagctcttataggggcagtttatctggaaggttccctcgaggaagccaagcagctgttcggtaggttgctatttaatgacccagacctccgggaagtgtggctgaattacccattgcaccctctccagctccaagaacccaataccgatcggcagcttattgaaacgtcccctgtcctgcagaagctgaccgagtttgaagaagcaatcggtgtgatctttacacacgttagattgcttgcacgagctttcaccctgcggaccgtgggcttcaaccacctgactctgggccacaaccaacggatggagttcctcggcgactctatcatgcagctagtagctacagaatacctgtttattcacttccccgatcatcacgagggccatcttacactactacgtagctcactggtaaacaaccgcacccaagcgaaagtggcagaggagcttggaatgcaggaatatgcgattacaaatgataagacgaagcgacctgtcgcgctgagaaccaagaccctcgctgacctgctggagtcttttattgccgcgctctacattgacaaggacctggagtatgtgcataccttcatgaacgtttgctttttcccacgtttaaaggagtttattctgaaccaagattggaacgatccaaagagtcagctccaacagtgttgcttaacattgcgcacagaggggaaggaaccggatatacctctgtacaagaccctgcagactgtaggtccctcacacgcaaggacctatacagttgcagtatattttaaaggcgagcgcatagggtgtggaaaaggacctagcattcagcaggccgagatgggcgctgccatggacgctctcgagaagtacaattttccccagatggctcaccagaaacggttcatcgaacgaaagtatcgccaggagttgaaagaaatgcggtgggaacgggaacaccaggagcgggaacccgacgagaccgaagacataaagaaatag

SEQ ID NO: 115093 - DNA, 606 bp, Artificial Sequence
  Description of Artificial Sequence: Synthetic coding sequence
atgatgcaggggaacacctgtcatcggatgagttttcatcctgggcgtgggtgccctcggggtcggggagggcatggggctagaccctccgccccaagtttcagaccccagaacttacgcttgctgcatccccagcaacccccagtgcaataccagtacgagcccccctctgccccctccacaaccttctctaactccccggctcccaatttcttgccccctaggcctgatttcgtgcccttccctcctccaatgccacctagcgcacaagggcccttaccaccatgtcccattcggcctccttttccgaatcatcagatgagacatccattccctgtccctccatgttttccaccaatgccaccacctatgccgtgccctaataatcccccagtaccgggcgcgccccctggccaaggaacgtttcccttcatgatgcctcccccaagcatgcctcatcccccacctcccccagtaatgccccaacaggtaaactaccaatacccgcccggttattcccaccacaacttcccaccaccgagcttcaactctttccagaacaacccaagcagctttttgcccagcgctaacaacagttccagctag

SEQ ID NO: 115094 - DNA, 4125 bp, Artificial Sequence
  Description of Artificial Sequence: Synthetic coding sequence
atgatgcagggcaacacctgccaccgcatgtccttccatcccgggcgggggtgcccacgggggcgcggtggacacggagcacgtccctcagctccaagcttccgccctcagaacctgaggctactgcatccccaacagccaccagtccagtatcaatatgagccaccctctgctccatccactaccttttccaatagtcctgctccaaactttcttccccccagaccggattttgttcccttcccgccgcctatgcccccgtctgcccagggtcccctccctccttgtcccatccggcctccttttcccaaccaccagatgaggcatccctttccagtgcctccctgctttccgcctatgccgccaccgatgccttgtccaaataatccccctgttcccggggctccacctggccaggggacctttccctttatgatgcctcctcccagtatgcctcatcccccacctccccctgtgatgccgcagcaggtaaattatcagtatcctccaggatattcacaccataatttcccaccgccctcatttaactcctttcagaacaacccctcatcttttctaccatcagcaaacaacagtagtagtccccatttccgccatctccccccgtatccactgcccaaagcccctagtgagaggagaagcccagaacgtctgaaacattatgatgatcaccggcaccgtgatcatagtcacggacgaggggaacgtcaccggagtctggacaggcgggagcgtggtcgctctcccgaccggcgccggcaggatagccggtaccggtccgactatgaccgagggcggacaccgtccaggcatagaagttatgaaagatctagggaacgggagcgagagcggcatcgccatagagacaatagacggagtccatcactggaaagatcatacaaaaaggagtataaaagatcaggacgctcctacggactgagcgtagtgccggagcccgctgggtgtacacctgaactccctggagaaatcataaaaaacaccgactcctgggcccccccactcgagatcgtcaatcatagatcacccagccgcgagaagaagcgagctcgctgggaagaagaaaaagacagatggtctgacaaccagtcatccgggaaggacaagaactacacgtccataaaggagaaggagcctgaggagactatgcctgacaaaaacgaagaggaggaggaggagctccttaaacccgtgtggatccgttgtactcatagtgagaattactatagcagcgacccgatggaccaggtgggtgatagcaccgtggtcgggacctcccgcctaagggacctctacgataaattcgaggaggaactgggctccagacaggagaaggccaaagcggcgcgccccccctgggaacctcctaagactaaactggacgaagatttggagagctcatccgaatcagagtgcgagagcgatgaggacagcacctgcagcagtagttccgactctgaggtattcgatgtcatcgccgaaataaagcgcaaaaaggctcaccctgataggttgcatgatgagctctggtacaacgaccccggccagatgaacgatggcccactctgcaaatgttccgctaaggcccgccgcaccggaattcggcacagtatctacccaggtgaagaagccattaagccatgccggccaatgacgaacaatgctgggcggttattccattataggatcacagtgtcccctcccacaaactttcttaccgataggccaacagtgattgagtacgacgatcatgagtatatcttcgagggtttctctatgtttgcccatgctcctctgactaacattccactttgtaaagtcattaggttcaatatcgactacacaatccattttatcgaggagatgatgccggagaatttctgtgtaaagggattggagttgttcagtttattcttgtttcgtgatattctagagctgtacgattggaatttgaaaggacccctctttgaagacagcccgccatgttgcccacgattccattttatgccgcgcttcgtcaggttcctgcccgatggaggaaaagaagttctttctatgcaccaaattctgctctaccttctgagatgtagcaaagcacttgtacctgaggaagaaattgccaacatgctacagtgggaggagctggagtggcaaaagtacgcagaggaatgtaagggcatgatagtgactaatccgggcacaaagccgagctctgtgcgtatcgatcaactggatagagagcagttcaacccagacgttattacattcccgatcattgttcactttggcatacgcccagcgcagctgagttatgccggtgatccacaataccagaaactctggaagtcctatgttaagcttcgacacctgctggctaacagccccaaagtgaaacaaacagacaaacagaagctggcccagcgggaagaggcactccagaagatccgccagaagaacactatgaggcgtgaggttaccgttgagcttagctcgcaggggttctggaagaccggcatcagatccgatgtgtgccaacacgcaatgatgctgcctgtgctcacacaccacattaggtatcaccagtgtcttatgcacctggataagttaatcgggtacacctttcaggacaggtgcttactccagctggcgatgactcacccatctcatcatctgaattttggcatgaatcccgaccatgcgagaaattcattatccaactgcggaattcgacagccgaaatacggggaccggaaggtgcaccacatgcatatgcggaagaagggcatcaacaccctgattaatattatgtccaggctaggtcaggacgaccccacccctagtagaataaatcacaacgaacgactggagttccttggagacgctgtggtcgaattcctgacgtccgttcatctctattatttgtttcctagcctggaagaaggaggtctggccacctataggacagcaattgtgcaaaaccagcacctagccatgcttgccaaaaaactggagctggatcggttcatgctctacgcccacgggcctgacctttgtcgggagagcgacctccgacatgcaatggccaactgtttcgaggcgctgattggcgccgtttacctggaaggtagtctggaggaggccaagcagctgtttggacggttgctgttcaatgatccggatctccgagaggtgtggctgaattaccctcttcacccgctgcagcttcaggagccaaatacagaccgacagctgattgagacttcaccagtgctccagaaactgacggagttcgaggaagcgatcggggtgattttcacgcacgttaggctgctcgctcgagcctttaccttgaggaccgtcggattcaatcatctaactcttggccacaaccagagaatggagtttcttggcgactccataatgcagctggtagccacagagtacctgtttatacactttccagatcatcacgagggccatctaacattactgaggagcagtctggtcaacaataggacccaggctaaagtggctgaagagctgggcatgcaggaatacgccataacaaacgataagactaagcggccagtcgcactgagaacgaagacactggccgaccttttggagagctttatagcggcgctgtatattgacaaagatttagagtacgttcatactttcatgaatgtctgctttttccccagactcaaagagttcattctcaaccaagattggaacgaccccaaatcccagctgcagcagtgttgtttaacactgcgcactgaaggaaaggagcccgatattccattgtataaaaccttgcagaccgtgggaccctcccacgccaggacatacaccgttgccgtgtattttaagggcgagaggatagggtgcggcaagggacccagcatccagcaggccgagatgggggccgcaatggacgcactggaaaaatacaacttcccccaaatggcccaccagaagagattcattgaaagaaaatatcgccaagaactgaaggaaatgcggtgggagagagaacaccaggaacgcgaacctgatgagactgaagacattaaaaaatag

SEQ ID NO: 115095 - DNA, 630 bp, Artificial Sequence
  Description of Artificial Sequence: Synthetic coding sequence
atgaaagccgtcgtgcagcgggttacacgcgcatccgtgaccgtgggaggcgagcagatctctgcaattggccgggggatctgcgtgcttttggggattagccttgaggatacccagaaggaactggaacacatggtgcgcaagattctcaatttacgagttttcgaagatgagtcaggaaagcattggagtaaatctgtcatggataaacaatacgagattctctgtgtgtctcaatttactttacagtgcgtgctgaaggggaacaagccagacttccatctggctatgcctactgagcaagcggagggcttctataatagcttcctggagcaattaaggaagacgtatcgaccagagctgataaaggatggcaagttcggagcgtacatgcaggttcatatacagaatgacggtcccgtgacgatagaattagaaagcccagctccagggacagcgacatcggatccaaaacagcttagtaaactggaaaagcaacaacagcgcaaagagaagacacgagccaagggtccgtccgaaagttctaaggagcggaatactcctagaaaggaggataggtcagcttcctctggggcagaaggagacgtgtccagcgaaagagaaccttag

SEQ ID NO: 115096 - DNA, 843 bp, Artificial Sequence
  Description of Artificial Sequence: Synthetic coding sequence
atgggtcgtgctgagctacttgaaggaaaaatgagcacacaggatccaagcgatctgtggtctagatccgatggcgaagcagagttgttacaggacttgggatggtaccatgggaatcttacccgacatgccgcagaagccctgctgctgtcaaacggctgtgacggttcatacctattgagagactccaacgagactaccggtctgtactccctgagcgtcagagcaaaggattccgtgaaacatttccatgtggaatatacgggctacagtttcaagttcgggtttaatgaattcagttcactcaaagattttgtaaaacactttgccaaccagccccttattggtagtgagaccggcaccctgatggtgttaaagcatccctatccaagaaaagttgaagagccaagtatctacgagtccgtcagagtccataccgcaatgcagaccggccgtaccgaggatgacttagtgcccacggccccgtccctgggcactaaagaagggtacttaacaaagcagggtggcctggttaaaacatggaagactcgatggttcaccctacaccgtaatgaactgaagtatttcaaagatcagatgagcccagaacctatcaggattctggacctcacggagtgtagcgcagtccagttcgattattcccaggagagagtcaattgtttttgtttggttttccccttcagaaccttctacctctgtgcaaagaccggggtggaagcagacgagtggatcaagattctgcgatggaaattgtcgcagatccgcaaacaattgaaccagggcgaagggactatacgcagcagaagtttcatttttaaatag

SEQ ID NO: 115097 - DNA, 4656 bp, Artificial Sequence
  Description of Artificial Sequence: Synthetic coding sequence
atgggcttctgcctcgcactcgcgtggacactactggtgggggcttggacacctctgggggcccagaacccaatttcatgggaggtccagaggtttgacgggtggtataacaatttgatggagcacagatgggggtcaaaaggctcaagactgcaaagactcgtccccgcctcatacgcagacggcgtgtaccagcctcttggcgaaccacatctgcccaatcctagggatctctccaacacaatttcccgtggccccgctggcttggctagcctacgcaatcgcactgtcctgggtgttttcttcgggtaccacgtcctgtctgatctggtgtcggtggaaacaccgggctgccccgcggagtttcttaatatcagaattccccctggcgatccaatgtttgatccagaccagcgcggtgacgtggtgttgcccttccagagatccaggtgggatcctgaaaccgggagaagcccgtccaaccctcgggaccccgccaatcaagttaccggctggttagacggaagcgctatttacggcagttctcactcttggagtgacgctctgagatccttttctcggggtcagctggcatccggcccagacccagctttcccgagagattcccaaaaccccctcttaatgtgggccgctccagatcccgcaactggccagaacggtccaagagggctctacgcgttcggcgcagaacggggtaacagagagcctttcctgcaggcactgggattactctggttccgctaccacaatttgtgggctcagagactggcaagacagcacccagattgggaggacgaggaactgtttcagcatgcgcgcaagcgggtcattgccacataccagaatatcgccgtttatgaatggctgccttcctttcttcagaaaaccctgccagagtacaccggctaccgtccttttcttgatccttcaattagtagtgaatttgtcgccgcatcggagcagttcctaagcactatggtcccgccaggcgtatacatgcggaacgctagctgccacttccaaggcgtgattaatcgtaacagtagtgtgagtagagccttgcgcgtctgtaacagttactggtctagagaacatccctccctacaaagtgccgaggacgtggatgcccttcttctgggtatggccagccagattgcagagagggaggatcacgttctggtcgaggatgttcgggacttctggcccggaccgcttaaatttagcagaacagaccacctggcctcttgtcttcagagaggccgtgacctaggtctgccgtcttataccaaggcacgcgccgccctgggcttgagtcccatcacccgctggcaggacattaaccctgctctgagccggagcaacgacaccgtgttggaggcaacagccgctctttacaatcaagatctctcatggcttgagctcctgccgggcggactgttggaaagtcacagagacccagggcccctcttcagcacaatcgtgctggagcagttcgtgagattacgagacggagacaggtactggttcgaaaatactagaaacggcttattctctaaaaaagaaatcgaagagatccgaaacaccacattgcaagatgtgctggtggccgtcatcaacatcgacccatcagctcttcaacctaacgtgttcgtgtggcataaaggcgacccctgcccccagccaagacagctgagcacagagggattacccgcgtgcgctccatcggtggtgagggactacttcgaaggctcagggtttggctttggtgtgacaattggtacactctgctgctttcctttggtgagcctgctgtcagcatggatagtggcccggcttagaatgagaaacttcaagcggctccagggccaggatcggcaatcaattgtctctgagaagttagtaggtgggatggaggcactcgagtggcaggggcacaaagaaccatgtaggcccgtactggtctacctccagcctgggcagattcgcgtagttgacggaaggttgactgtcttacggactatccagctgcagcccccccagaaagttaatttcgtgctctcaagtaatcgcggcaggagaactttactgctgaagatcccaaaagaatatgatcttgtgctgctgttcaaccttgaggaggagcggcaggctctggtggagaaccttcgaggagcactgaaagagagtggactgtcaatacaggaatgggaactgcgggagcaggaattgatgcgtgcagccgtcacacgcgaacagcgaaggcacctgcttgaaaccttttttcgacatcttttttctcaagttctcgacattaatcaggctgatgctggaacacttcctctagattcatctcagaaggtgagggaggcgctgacttgcgagctgagccgagccgaatttgcagagtccctgggactgaaaccacaggatatgttcgtggagtctatgttcagccttgccgacaaggatggtaatgggtacctgagcttccgtgagtttctggatatacttgtggtgtttatgaaagggagcccagaagaaaagagtagactgatgttccggatgtacgactttgacggcaatggtctcataagtaaagatgagttcatccggatgctgcgctcattcatcgagatcagcaataattgtctgagtaaggcccagctggccgaagtcgtcgagtccatgttcagggagtcaggatttcaggacaaagaagaactgacttgggaggacttccacttcatgcttagggaccataatagcgaactcagattcacccagctttgcgtgaagggcgtagaggtgcctgaagtaatcaaggacctgtgtaggcgtgcatcttatatctcccaggatatgatttgcccgtctccccgtgtgagcgcaaggtgtagccggtccgacatcgaaaccgaactcacgccccagagactccagtgccccatggatacagacccacctcaggaaatccgtagaagatttggaaagaaggttaccagcttccagcccctgctttttacagaggctcatcgtgagaaattccagaggagttgtttacaccagactgtccagcagtttaagaggttcattgagaactataggcggcacattggctgcgtcgccgtcttctatgctattgctggtggtcttttcttggagcgcgcatattattacgccttcgccgcacatcataccggcatcaccgacacaaccagagtgggaatcatactctccagaggcactgctgcttcaattagctttatgttctcgtacatcctcttgactatgtgtagaaacctcattaccttcctaagagaaaccttcctgaacaggtatgtcccctttgatgccgccgtggacttccatcgcctcattgcgagcacagctatcgtactcactgtcctgcatagtgtgggccatgttgtcaacgtatatctttttagcattagcccgttgagcgtcctgtcatgcctattccccggtctcttccatgatgatgggagcgaacttccgcagaaatactactggtggttctttcagactgtcccagggttgacaggtgttgtgctcctacttatcctggcgataatgtacgtctttgcctcccaccatttccgcagacgctcatttcgcggattttggctcacccaccacctatacattcttttgtatgtgctgctgatcatacacggtagcttcgctttgatccaactgccacggtttcatattttttttctcgtgcccgccataatatacggcggggataagctcgtgtcattatcccgcaagaaggtcgagatcagtgttgtcaaagctgagctactccccagcggagtgacacatctaaggttccagaggccccagggtttcgagtacaagtccggccaatgggtgcgtatcgcatgcctggcgctcggcacgaccgagtaccacccgttcacgttgacttctgcccctcatgaggacaccctttcactccacatcagagcagcaggcccgtggaccacccggcttagagagatctactctgccccaactggggatagatgcgcccgataccccaaactgtacctcgacggaccttttggtgagggtcaccaggagtggcacaagtttgaagtgtctgtgctcgtgggaggtggcatcggcgttacaccatttgcctccatcttgaaggatctggttttcaagtctagcgtgtcctgccaagtgttttgcaaaaagatctattttatttgggtgacaagaacccagcggcagttcgagtggctggccgacattatccgcgaggtggaggaaaacgatcatcaagatttggtatcagttcacatctatattactcagctcgccgaaaaatttgatttaaggactaccatgctctatatctgtgaaaggcacttccagaaggtgctcaaccgttcactgtttaccggacttcgttcaattacccacttcggccgacccccatttgagccattcttcaatagcctgcaggaggtccacccacaagtcaggaagatcggggtgttcagttgtgggcctccaggcatgacaaagaatgtggagaaagcttgccagctaattaaccgtcaggatcgcacccattttagtcaccactatgaaaacttttag

SEQ ID NO: 115098 - DNA, 4656 bp, Artificial Sequence
  Description of Artificial Sequence: Synthetic coding sequence
atggggttctgcctagctctcgcctggactcttctcgtcggagcatggacacctctgggggcccaaaacccaatctcatgggaagttcagagatttgatggttggtacaataatctgatggaacaccggtgggggagtaaaggatcccgcttgcagcgtttggtgccagcttcctacgcagatggtgtgtatcagcctctgggagagccacacctgcccaatccccgcgacttgtccaacacaatctctcggggtcccgctggcctggcttctctccgcaacagaaccgtattgggggtgttctttgggtaccatgtgctgtctgatctggtttctgtggaaacacccgggtgtcccgccgagtttctgaatattcgcataccccccggcgatccgatgtttgaccccgatcagagaggcgacgtagtcctcccgttccaaaggagccgctgggatccggaaacaggaaggagccctagcaaccctcgtgaccccgctaatcaagtgactggatggctggatgggtcagctatctatggttcctcccactcctggtcagacgcgctccggtccttctcgaggggacagcttgcctcagggcctgacccagcattcccccgggactcccagaaccctcttttgatgtgggcagcccccgacccagcaaccggccagaacggcccacgcggactgtatgcattcggggcagagagagggaaccgtgagcctttcttgcaggctctcggactgctgtggtttcgctaccacaatctctgggctcagcggctggccagacagcatcccgactgggaggatgaagagctctttcagcatgcacgcaaacgggtcatcgccacttatcaaaacatcgcagtatacgaatggctgcccagtttcctgcagaaaactctgcctgaatacactggctatcggccatttttagatccaagcatatcctccgaattcgtggccgcatctgagcagttcctgagtactatggtccctcccggtgtgtacatgcgtaacgccagctgccattttcaaggggtaatcaataggaattcgagcgtctcaagggctctcagagtgtgtaattcttactggagcagagagcatccaagtctgcagagcgctgaggacgtggatgccctgctgctcgggatggctagccagatcgcagaacgtgaagaccacgtgcttgtggaggatgtgagggacttctggcccggacctctaaagttctcacgcacagaccatttggcttcttgcctccagcggggccgcgatctcggtctgccctcttacacgaaagcccgcgcagcattaggactgagtccaattaccagatggcaggatatcaatcctgcgttgagtcgcagtaacgataccgtgcttgaagcaaccgcggccctttacaaccaagatctgtcctggctggagctgttgcctggcggactcctggagtcgcatagagaccctggacctctttttagcaccattgttctcgagcagttcgttagactgcgggatggagatcggtattggttcgaaaacacacgcaatggactgttctctaagaaggagatcgaagaaatcagaaataccaccctacaggacgttctggtagccgttattaatattgatccctctgctctacagcctaatgtttttgtgtggcataagggagatccatgcccccagccacgacagttatccaccgaaggactgcccgcctgcgctcctagcgttgtacgggattattttgaaggttccgggtttggattcggggtcactatcggtacactctgttgcttccctcttgtgagtctgctttctgcttggatagtggcccgcctcagaatgcgcaatttcaaacgactccagggccaggatcgccagagcattgtgagcgaaaaactggtgggcgggatggaggcactggagtggcagggccacaaggagccatgtagaccggttctagtctacctgcagcccggtcagattcgggttgttgacggacgcctgaccgtcctgaggactattcagctccaaccaccacagaaagtgaattttgtgctgtctagtaaccggggacgacgtaccctgttactgaaaatcccaaaagagtacgacctcgtactgctgttcaatctggaggaggagagacaggccctggtggagaaccttagaggcgccctgaaagagagcggcctctctattcaggaatgggagctaagggaacaagaactcatgcgagctgccgtgacacgagagcagaggcgccacttactggaaacttttttccgccacctcttttcccaggttctcgacataaaccaggccgacgccggaactctccctttagactcttctcagaaggtcagagaagcactgacatgtgagctctctagggctgaatttgccgagtccttgggactaaagccacaagacatgttcgtcgaatcaatgttttctttagcagacaaagacggcaatggttacctttcttttcgggagttcctggacatcctggttgtattcatgaaggggtccccagaggagaagtcacgactgatgtttagaatgtatgattttgatggaaatgggttgatttccaaagacgaatttattagaatgctacgctctttcatcgaaatttcgaataattgcctgtccaaagcccagctagccgaagttgtggaatctatgttccgtgaaagcggctttcaagacaaggaggaacttacgtgggaagactttcattttatgctgcgtgatcacaatagcgaactgaggtttacacagctgtgcgttaagggggtcgaggttccagaagtcatcaaagatctgtgtagacgggcgtcttatatcagccaggacatgatttgtccaagtcctcgcgtcagcgcacgctgttccaggagcgacattgaaaccgaactcacacctcaaagactgcagtgtcctatggataccgatcctccccaggagatccggcgccggttcggaaagaaagtgacctccttccagcctctgctcttcaccgaggcccatcgagaaaaatttcagagatcttgtttgcatcagaccgtccagcagtttaagagattcatcgagaattatcgccggcacattggctgcgtggcagtcttctacgcgattgctggggggctctttctggagagggcctattattacgcctttgccgcacaccacacaggaattaccgataccactagggtaggcattatactgtcccggggaaccgctgcgagcatttctttcatgtttagttacatcctcctgacaatgtgtcgcaacctcatcactttcctgagggagaccttcctgaacagatacgtgccatttgatgccgcggtcgactttcatcgactgatcgcgtctactgcgatcgttcttaccgtgctccatagcgtggggcatgtcgtgaatgtctacttattctccatcagccccttatcagtcctctcttgtctgttccccggccttttccacgacgatggcagcgagctgccacaaaagtactactggtggttcttccaaacagtccctgggctgaccggggttgttctgttgttgattttggccattatgtacgtgttcgcttctcaccactttcgcagacgaagctttcgtggtttttggctgacacatcatctgtacattctgttgtatgtgcttctaattatccatggatcatttgccctcatccaactgcccaggttccacatattctttctggttcccgccattatttacggaggcgacaagctagttagtctgagccgcaagaaggtggagatcagcgtggtgaaggctgaactcctgccatcaggggtcacacatctgagattccaaagaccacagggctttgaatacaagtccggtcagtgggtgagaatcgcttgcctggcgcttggcaccaccgagtatcatccatttaccctgacatctgcaccccacgaagacaccctgagcttgcacattcgcgccgccgggccctggacaactcggctccgggagatctattccgctccaacgggcgacagatgtgcacgttatccaaagctgtacctggatggtcctttcggagagggacatcaggagtggcacaaattcgaagttagtgtgcttgtaggcggtggaataggagtgacgcctttcgcgtctatcctaaaagatctggttttcaagagctccgttagctgtcaggtcttctgtaaaaagatctatttcatctgggtcaccaggacccagaggcaattcgagtggctggcagatatcatacgcgaagttgaggaaaatgatcaccaggacctggttagcgtgcatatttatataactcagctggccgagaagtttgatctaaggacgacaatgctatacatatgtgagcgtcattttcagaaggtccttaacaggagtctctttactggtctcaggtccatcacgcatttcggacgtcctccttttgaacctttctttaacagcttacaggaggtacacccacaagtccggaagatcggggtgttttcttgtgggccacccggcatgaccaaaaatgtggagaaagcctgtcagctgattaaccgccaagatcgcactcatttctcccatcactacgagaacttctag

SEQ ID NO: 115099 - DNA, 4656 bp, Artificial Sequence
  Description of Artificial Sequence: Synthetic coding sequence
atgggattctgtctggctctggcttggacgttactcgtgggggcatggacacccttaggagcccagaatccaataagctgggaggttcagaggttcgacggctggtataataacctgatggagcaccggtgggggtctaagggcagccggcttcaacgtttggtccctgcctcttatgcagatggcgtgtaccagccgctgggggagccccatctgccaaatcctcgggacctgagcaacacaatcagtagggggcccgccggattagcatccttgaggaacaggacagtgttgggtgtgtttttcggataccatgtactcagcgatctcgtatccgttgagacaccaggctgccccgcagagtttctgaatatcaggattccccctggagatcccatgtttgacccggatcagcgtggggacgtggttctgccatttcagcgatccaggtgggaccccgaaaccggacgcagtccaagcaatccgagggacccggccaatcaggttacaggatggttggacgggtcagccatctacgggtcctcccactcctggtcggacgccctgagaagctttagtcgaggacagttggcttcgggcccagatcccgctttccccagggattcacagaacccgctgctcatgtgggctgcgcctgacccagccaccggtcaaaacggccctcgcggactctacgccttcggggcagaacgaggtaacagagaaccttttctgcaggcgctcggactgctgtggtttcgctatcacaatctctgggctcagcgactagcccgccaacacccggactgggaggatgaggaactattccagcatgcccggaagagggtgattgcaacttatcagaatatcgctgtatatgagtggttgccctcttttctgcagaagactctcccagagtacactggctatcggcctttcctggatccctcaattagctccgagttcgtcgctgctagcgaacaattcctgtcaaccatggtgccccccggggtctatatgaggaacgcatcatgccactttcaaggagttataaataggaactcgagtgtgagtcgtgcactgcgggtgtgtaattcctactggagtcgcgagcacccgtccctgcagtctgctgaagacgttgatgctctcctgcttggaatggccagccagatcgcggagcgcgaagatcacgtgttagtggaagacgtaagagatttctggccaggaccgctcaagttctcaagaactgaccatcttgcaagctgcctgcagcggggtcgggatctgggcctgccctcctataccaaggctcgggcagctctcgggctgagtccgatcacaagatggcaggacatcaatcctgcactatcgcgttcaaacgataccgttttggaagcaactgctgcgctgtataaccaggatctttcttggctggaattgctgcccggcggcctcttggagtcccatcgcgatcccggacctctgttctccacaatcgtgcttgaacagttcgtgcgactgagagacggcgataggtactggtttgaaaacaccagaaatggtttattctctaagaaagagatagaggaaatcaggaacacaacattgcaggatgtgttggtagcagtgatcaacatagaccctagtgctctgcagcccaatgtattcgtctggcataagggagacccctgtcctcagccacggcagctctccaccgagggactgcctgcttgtgccccatcggttgtgcgggattacttcgaggggagtggattcggatttggagtcactataggcaccctctgctgctttccacttgtgtccttgctctccgcatggatagtagcccgcttacgcatgagaaacttcaagcggctgcaaggacaagatcgacaaagcatagtgtctgaaaaactggtcgggggaatggaggcgctggagtggcaggggcacaaggagccatgcaggcctgttctggtctatctccaaccaggacagattcgtgtggtcgacggtagacttaccgtgctgcggactattcagcttcagccacctcagaaagtcaacttcgtgctgagtagcaataggggtagacgcacactcctcctcaagattcccaaggagtacgatctggtgctcctgttcaacctggaagaggaacgccaagcgctagtggagaacctgcggggtgctttgaaggagtcaggcttatctatccaggaatgggagctacgggagcaagaattaatgcgggccgccgtgacacgggaacagcgccggcacttgctggaaaccttcttccggcaccttttcagccaggtactggatataaaccaagccgatgccggaactttgcccctagattccagtcaaaaagttagggaggccttaacatgtgagctctcacgggcagaatttgcggaatccttgggcctgaagccacaagacatgttcgtggagtccatgttttctttggccgacaaggacggtaacggctatctttctttccgagagtttttggacatactggtcgtgtttatgaagggctcacccgaagaaaaatcccggctgatgtttcgaatgtacgactttgatgggaatggtcttatttctaaagacgaattcatcagaatgctaaggtcatttattgagatctccaataattgcctgagcaaggcacagctggcagaagttgtcgaatctatgttcagagagagtggatttcaggacaaggaagaactgacgtgggaagactttcactttatgcttcgggaccacaattccgagctgcgtttcactcaactgtgcgtgaaaggtgtcgaggtcccagaggtaattaaggacctctgccgccgggcttcttatatttctcaggatatgatttgtccctctcctagagtgtccgcgagatgtagccggtcagatattgagacagaacttaccccccagaggttgcagtgcccaatggacactgacccaccccaggaaatcagaagacgtttcggcaagaaagtgacctcctttcagcccctcttattcacagaggcacatcgggagaaattccagcggtcttgtctgcaccagaccgtgcaacaattcaaacgtttcattgagaactacaggcgccacattggatgtgtggctgtcttttacgcaatcgccggtgggctgttcctcgagcgtgcctactattacgcgtttgccgctcaccacaccggcattaccgataccacacgcgtgggcatcatactttctcgaggcactgccgcctccattagtttcatgttctcgtacattcttctaacaatgtgtaggaatcttatcacattcctgcgggagacattccttaataggtacgtaccattcgacgccgctgtcgacttccatagattgattgcttccacagccatcgtgcttacagtcctccattccgtaggtcacgtggtcaacgtatacctgttcagcattagtcctctgtctgtgctcagctgcctttttcctgggctgtttcatgatgacgggagcgagctgcctcagaagtactactggtggttctttcagacagtgcccgggctgacaggtgtcgtgctcttgctgatattggccattatgtacgttttcgcgagccaccatttcaggcgcagatcttttagagggttctggctgactcatcatttatacattctgttgtatgtcctgctcatcatccatgggtccttcgcactgatacagctaccacgatttcatatcttttttttagtccctgcaattatctatggaggggacaaattagtcagtctgtcccgaaaaaaagtcgaaatctcggtggtgaaggctgagttgctgccatctggcgtgacccatttgagattccagcgtccccagggatttgaatataaatcaggccaatgggtgaggatcgcttgtctcgccctggggaccactgagtaccatccttttacactgacctccgcaccccacgaagataccctgagcctgcacattagagcagctggcccatggaccaccagactgagagaaatttatagtgcccctacaggcgatcgttgtgctaggtaccccaagctgtatctggatgggccatttggggaaggccaccaggaatggcacaagtttgaggtgtcggtcctagtgggaggtggtattggggttaccccttttgcaagcatcctgaaagacctcgtgttcaagtcctccgttagttgtcaggtgttttgtaagaaaatttactttatctgggttactagaacacaacgacaattcgaatggctcgccgacattattagagaagttgaagaaaacgatcaccaggatctggtttcagttcacatctatattacacagttagcagagaagtttgatctgcggaccactatgctgtacatctgtgagaggcacttccagaaggttctgaatcgctcgctcttcaccggactgaggtccatcacccatttcggacggccccccttcgagccatttttcaactcgctccaggaggtgcatcctcaggtcaggaagatcggggtgtttagctgcgggcccccagggatgacgaagaacgttgaaaaggcttgccagttgataaatcgacaggatcgcacacacttttcacatcattatgaaaatttttag

SEQ ID NO: 115100 - DNA, 132 bp, Artificial Sequence
  Description of Artificial Sequence: Synthetic coding sequence
atgggattctgcctcgcactggcatggacgctcctggttggagcctggacgccattgggcgcacagaacccaatctcgtgggaggttcagcgctttgatggctggtacaataacctcatggaacacaggtag
